United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 6

SEQ ID NO: 223654 - DNA, 17 bp, P. troglodytes
caggctcaggtgatcct

SEQ ID NO: 223655 - DNA, 16 bp, P. troglodytes
caggctcataggcaga

SEQ ID NO: 223656 - DNA, 16 bp, P. troglodytes
caggctccagaagcag

SEQ ID NO: 223657 - DNA, 16 bp, P. troglodytes
caggctccatgagcag

SEQ ID NO: 223658 - DNA, 16 bp, P. troglodytes
caggctcctcctccaa

SEQ ID NO: 223659 - DNA, 16 bp, P. troglodytes
caggctcctgagcagc

SEQ ID NO: 223660 - DNA, 16 bp, P. troglodytes
caggctctgaaactga

SEQ ID NO: 223661 - DNA, 16 bp, P. troglodytes
caggctctgcttccag

SEQ ID NO: 223662 - DNA, 16 bp, P. troglodytes
caggctctggctctgt

SEQ ID NO: 223663 - DNA, 16 bp, P. troglodytes
caggctgaaggagcag

SEQ ID NO: 223664 - DNA, 16 bp, P. troglodytes
caggctgaatttggcc

SEQ ID NO: 223665 - DNA, 16 bp, P. troglodytes
caggctgagcacagtg

SEQ ID NO: 223666 - DNA, 19 bp, P. troglodytes
caggctgaggcaggagaat

SEQ ID NO: 223667 - DNA, 16 bp, P. troglodytes
caggctgaggccagag

SEQ ID NO: 223668 - DNA, 16 bp, P. troglodytes
caggctgagggctcag

SEQ ID NO: 223669 - DNA, 16 bp, P. troglodytes
caggctgatctcgagc

SEQ ID NO: 223670 - DNA, 16 bp, P. troglodytes
caggctgatcttgaat

SEQ ID NO: 223671 - DNA, 16 bp, P. troglodytes
caggctgatgctggct

SEQ ID NO: 223672 - DNA, 16 bp, P. troglodytes
caggctgcaaattttc

SEQ ID NO: 223673 - DNA, 16 bp, P. troglodytes
caggctgcacagctca

SEQ ID NO: 223674 - DNA, 16 bp, P. troglodytes
caggctgctacaacaa

SEQ ID NO: 223675 - DNA, 16 bp, P. troglodytes
caggctgctggagcca

SEQ ID NO: 223676 - DNA, 16 bp, P. troglodytes
caggctggaatgtaat

SEQ ID NO: 223677 - DNA, 16 bp, P. troglodytes
caggctggaatgtagt

SEQ ID NO: 223678 - DNA, 16 bp, P. troglodytes
caggctggagccacca

SEQ ID NO: 223679 - DNA, 16 bp, P. troglodytes
caggctggagctgcag

SEQ ID NO: 223680 - DNA, 16 bp, P. troglodytes
caggctggaggagtgc

SEQ ID NO: 223681 - DNA, 16 bp, P. troglodytes
caggctggaggccagt

SEQ ID NO: 223682 - DNA, 16 bp, P. troglodytes
caggctggagggcatt

SEQ ID NO: 223683 - DNA, 20 bp, P. troglodytes
caggctggagtgcggtggcg

SEQ ID NO: 223684 - DNA, 16 bp, P. troglodytes
caggctggagtggcag

SEQ ID NO: 223685 - DNA, 16 bp, P. troglodytes
caggctggagttgcaa

SEQ ID NO: 223686 - DNA, 16 bp, P. troglodytes
caggctggatttcagt

SEQ ID NO: 223687 - DNA, 16 bp, P. troglodytes
caggctggcctcaagc

SEQ ID NO: 223688 - DNA, 16 bp, P. troglodytes
caggctggcctcagac

SEQ ID NO: 223689 - DNA, 19 bp, P. troglodytes
caggctgggcacggtggct

SEQ ID NO: 223690 - DNA, 16 bp, P. troglodytes
caggctgggcccagtg

SEQ ID NO: 223691 - DNA, 16 bp, P. troglodytes
caggctgggctcaaac

SEQ ID NO: 223692 - DNA, 16 bp, P. troglodytes
caggctgggctgggca

SEQ ID NO: 223693 - DNA, 16 bp, P. troglodytes
caggctgggcttggtg

SEQ ID NO: 223694 - DNA, 16 bp, P. troglodytes
caggctggggccccag

SEQ ID NO: 223695 - DNA, 16 bp, P. troglodytes
caggctgggggcagtg

SEQ ID NO: 223696 - DNA, 16 bp, P. troglodytes
caggctgggtgacaga

SEQ ID NO: 223697 - DNA, 16 bp, P. troglodytes
caggctgggtgcagtg

SEQ ID NO: 223698 - DNA, 16 bp, P. troglodytes
caggctgggtgccatg

SEQ ID NO: 223699 - DNA, 16 bp, P. troglodytes
caggctggtcaccaac

SEQ ID NO: 223700 - DNA, 16 bp, P. troglodytes
caggctggtcctaaac

SEQ ID NO: 223701 - DNA, 16 bp, P. troglodytes
caggctggtcctgaac

SEQ ID NO: 223702 - DNA, 16 bp, P. troglodytes
caggctggtctcgcac

SEQ ID NO: 223703 - DNA, 16 bp, P. troglodytes
caggctggtgacagag

SEQ ID NO: 223704 - DNA, 16 bp, P. troglodytes
caggctggtgggcagt

SEQ ID NO: 223705 - DNA, 16 bp, P. troglodytes
caggctggtggtgaac

SEQ ID NO: 223706 - DNA, 16 bp, P. troglodytes
caggctgtagaggaag

SEQ ID NO: 223707 - DNA, 16 bp, P. troglodytes
caggctgtcataacaa

SEQ ID NO: 223708 - DNA, 16 bp, P. troglodytes
caggctgtccttgaac

SEQ ID NO: 223709 - DNA, 16 bp, P. troglodytes
caggctgtgcactgca

SEQ ID NO: 223710 - DNA, 16 bp, P. troglodytes
caggctgtgcaggaag

SEQ ID NO: 223711 - DNA, 16 bp, P. troglodytes
caggctgtttgtgcca

SEQ ID NO: 223712 - DNA, 16 bp, P. troglodytes
caggcttcagtttcct

SEQ ID NO: 223713 - DNA, 16 bp, P. troglodytes
caggcttgagccacca

SEQ ID NO: 223714 - DNA, 16 bp, P. troglodytes
caggcttgagccacta

SEQ ID NO: 223715 - DNA, 16 bp, P. troglodytes
caggcttgagccactg

SEQ ID NO: 223716 - DNA, 16 bp, P. troglodytes
caggctttccttgttt

SEQ ID NO: 223717 - DNA, 16 bp, P. troglodytes
cagggaaactgaggcc

SEQ ID NO: 223718 - DNA, 16 bp, P. troglodytes
cagggaaagggtggga

SEQ ID NO: 223719 - DNA, 16 bp, P. troglodytes
cagggaaatgaaaact

SEQ ID NO: 223720 - DNA, 16 bp, P. troglodytes
cagggaaccaagtggt

SEQ ID NO: 223721 - DNA, 16 bp, P. troglodytes
cagggaactttttttt

SEQ ID NO: 223722 - DNA, 16 bp, P. troglodytes
cagggaagccattcct

SEQ ID NO: 223723 - DNA, 16 bp, P. troglodytes
cagggaagccatttct

SEQ ID NO: 223724 - DNA, 16 bp, P. troglodytes
cagggaagcccaggag

SEQ ID NO: 223725 - DNA, 16 bp, P. troglodytes
cagggaagccccaccc

SEQ ID NO: 223726 - DNA, 16 bp, P. troglodytes
cagggaagtcaaatct

SEQ ID NO: 223727 - DNA, 16 bp, P. troglodytes
cagggaagtggaggtt

SEQ ID NO: 223728 - DNA, 16 bp, P. troglodytes
cagggacaaggatgaa

SEQ ID NO: 223729 - DNA, 16 bp, P. troglodytes
cagggacagaaagaca

SEQ ID NO: 223730 - DNA, 16 bp, P. troglodytes
cagggaccacactttg

SEQ ID NO: 223731 - DNA, 16 bp, P. troglodytes
cagggacccaggctcc

SEQ ID NO: 223732 - DNA, 16 bp, P. troglodytes
cagggacccaggctga

SEQ ID NO: 223733 - DNA, 16 bp, P. troglodytes
cagggacctggtggga

SEQ ID NO: 223734 - DNA, 16 bp, P. troglodytes
cagggactttgttttg

SEQ ID NO: 223735 - DNA, 16 bp, P. troglodytes
cagggagaagatggca

SEQ ID NO: 223736 - DNA, 16 bp, P. troglodytes
cagggagaaggaaacc

SEQ ID NO: 223737 - DNA, 16 bp, P. troglodytes
cagggagaaggcagcc

SEQ ID NO: 223738 - DNA, 16 bp, P. troglodytes
cagggagacagagtga

SEQ ID NO: 223739 - DNA, 16 bp, P. troglodytes
cagggagacctcatct

SEQ ID NO: 223740 - DNA, 16 bp, P. troglodytes
cagggagagactccat

SEQ ID NO: 223741 - DNA, 16 bp, P. troglodytes
cagggagatgaagaag

SEQ ID NO: 223742 - DNA, 16 bp, P. troglodytes
cagggagatggatttg

SEQ ID NO: 223743 - DNA, 16 bp, P. troglodytes
cagggagcagggctgg

SEQ ID NO: 223744 - DNA, 16 bp, P. troglodytes
cagggagccagtgtgg

SEQ ID NO: 223745 - DNA, 16 bp, P. troglodytes
cagggagcctgggctg

SEQ ID NO: 223746 - DNA, 16 bp, P. troglodytes
cagggagctctggagc

SEQ ID NO: 223747 - DNA, 16 bp, P. troglodytes
cagggagctgagatca

SEQ ID NO: 223748 - DNA, 16 bp, P. troglodytes
cagggagctgagatcg

SEQ ID NO: 223749 - DNA, 16 bp, P. troglodytes
cagggaggacttcctg

SEQ ID NO: 223750 - DNA, 16 bp, P. troglodytes
cagggaggcagcagag

SEQ ID NO: 223751 - DNA, 16 bp, P. troglodytes
cagggaggccagggag

SEQ ID NO: 223752 - DNA, 16 bp, P. troglodytes
cagggaggctgaagtg

SEQ ID NO: 223753 - DNA, 16 bp, P. troglodytes
cagggaggctgggagg

SEQ ID NO: 223754 - DNA, 16 bp, P. troglodytes
cagggagggagcttcc

SEQ ID NO: 223755 - DNA, 16 bp, P. troglodytes
cagggagggaggcagc

SEQ ID NO: 223756 - DNA, 16 bp, P. troglodytes
cagggagggcatggaa

SEQ ID NO: 223757 - DNA, 16 bp, P. troglodytes
cagggaggggaacatt

SEQ ID NO: 223758 - DNA, 16 bp, P. troglodytes
cagggaggggagcatc

SEQ ID NO: 223759 - DNA, 16 bp, P. troglodytes
cagggaggtgggagga

SEQ ID NO: 223760 - DNA, 16 bp, P. troglodytes
cagggatatttgtctg

SEQ ID NO: 223761 - DNA, 16 bp, P. troglodytes
cagggatcagcaaact

SEQ ID NO: 223762 - DNA, 16 bp, P. troglodytes
cagggatgcaaagatg

SEQ ID NO: 223763 - DNA, 16 bp, P. troglodytes
cagggatgcctgggtc

SEQ ID NO: 223764 - DNA, 16 bp, P. troglodytes
cagggatggagccctc

SEQ ID NO: 223765 - DNA, 16 bp, P. troglodytes
cagggatggtgctaaa

SEQ ID NO: 223766 - DNA, 16 bp, P. troglodytes
cagggatgtgccacca

SEQ ID NO: 223767 - DNA, 16 bp, P. troglodytes
cagggattcaaaccca

SEQ ID NO: 223768 - DNA, 16 bp, P. troglodytes
cagggattctctggag

SEQ ID NO: 223769 - DNA, 17 bp, P. troglodytes
cagggattgttcaggcc

SEQ ID NO: 223770 - DNA, 16 bp, P. troglodytes
cagggatttttctttt

SEQ ID NO: 223771 - DNA, 16 bp, P. troglodytes
cagggcaaggcagggc

SEQ ID NO: 223772 - DNA, 16 bp, P. troglodytes
cagggcactgaagaag

SEQ ID NO: 223773 - DNA, 16 bp, P. troglodytes
cagggcactgcctagt

SEQ ID NO: 223774 - DNA, 16 bp, P. troglodytes
cagggcagagctgccc

SEQ ID NO: 223775 - DNA, 16 bp, P. troglodytes
cagggcagagggcagg

SEQ ID NO: 223776 - DNA, 16 bp, P. troglodytes
cagggcagccagagag

SEQ ID NO: 223777 - DNA, 16 bp, P. troglodytes
cagggcaggcagctcc

SEQ ID NO: 223778 - DNA, 16 bp, P. troglodytes
cagggcaggcctggtg

SEQ ID NO: 223779 - DNA, 16 bp, P. troglodytes
cagggcaggcttcctg

SEQ ID NO: 223780 - DNA, 16 bp, P. troglodytes
cagggcagggacaggg

SEQ ID NO: 223781 - DNA, 16 bp, P. troglodytes
cagggcagggcaaggc

SEQ ID NO: 223782 - DNA, 16 bp, P. troglodytes
cagggcagggcagagg

SEQ ID NO: 223783 - DNA, 16 bp, P. troglodytes
cagggcagggccaggg

SEQ ID NO: 223784 - DNA, 16 bp, P. troglodytes
cagggcagggcctggg

SEQ ID NO: 223785 - DNA, 16 bp, P. troglodytes
cagggcagggctgggg

SEQ ID NO: 223786 - DNA, 16 bp, P. troglodytes
cagggcagggcttggg

SEQ ID NO: 223787 - DNA, 16 bp, P. troglodytes
cagggcaggtgagccc

SEQ ID NO: 223788 - DNA, 16 bp, P. troglodytes
cagggcatggtggtgc

SEQ ID NO: 223789 - DNA, 16 bp, P. troglodytes
cagggccaaggccagg

SEQ ID NO: 223790 - DNA, 16 bp, P. troglodytes
cagggccaggcctggg

SEQ ID NO: 223791 - DNA, 16 bp, P. troglodytes
cagggccagggccagg

SEQ ID NO: 223792 - DNA, 16 bp, P. troglodytes
cagggccagggctggg

SEQ ID NO: 223793 - DNA, 16 bp, P. troglodytes
cagggccaggtggtgg

SEQ ID NO: 223794 - DNA, 16 bp, P. troglodytes
cagggcccaggcagag

SEQ ID NO: 223795 - DNA, 16 bp, P. troglodytes
cagggcccagggctgg

SEQ ID NO: 223796 - DNA, 16 bp, P. troglodytes
cagggcccagtgtgtg

SEQ ID NO: 223797 - DNA, 16 bp, P. troglodytes
cagggccccactgccc

SEQ ID NO: 223798 - DNA, 16 bp, P. troglodytes
cagggcccctctgctg

SEQ ID NO: 223799 - DNA, 16 bp, P. troglodytes
cagggccctggtgggg

SEQ ID NO: 223800 - DNA, 16 bp, P. troglodytes
cagggcctagaacagt

SEQ ID NO: 223801 - DNA, 16 bp, P. troglodytes
cagggcctggagtgga

SEQ ID NO: 223802 - DNA, 16 bp, P. troglodytes
cagggcctggcacaga

SEQ ID NO: 223803 - DNA, 16 bp, P. troglodytes
cagggcctggcaccca

SEQ ID NO: 223804 - DNA, 16 bp, P. troglodytes
cagggcctggggctgg

SEQ ID NO: 223805 - DNA, 16 bp, P. troglodytes
cagggcctggtgtgtg

SEQ ID NO: 223806 - DNA, 16 bp, P. troglodytes
cagggcctgtaatccc

SEQ ID NO: 223807 - DNA, 17 bp, P. troglodytes
cagggcctgttttgggg

SEQ ID NO: 223808 - DNA, 16 bp, P. troglodytes
cagggcgtggtggtgc

SEQ ID NO: 223809 - DNA, 16 bp, P. troglodytes
cagggctggccagggc

SEQ ID NO: 223810 - DNA, 16 bp, P. troglodytes
cagggctgggactggg

SEQ ID NO: 223811 - DNA, 16 bp, P. troglodytes
cagggctgggctgggc

SEQ ID NO: 223812 - DNA, 16 bp, P. troglodytes
cagggctggggaggag

SEQ ID NO: 223813 - DNA, 16 bp, P. troglodytes
cagggctggggcaagg

SEQ ID NO: 223814 - DNA, 16 bp, P. troglodytes
cagggctggggcaggg

SEQ ID NO: 223815 - DNA, 16 bp, P. troglodytes
cagggctggggctgcc

SEQ ID NO: 223816 - DNA, 16 bp, P. troglodytes
cagggctggggctggg

SEQ ID NO: 223817 - DNA, 16 bp, P. troglodytes
cagggctgtgactccc

SEQ ID NO: 223818 - DNA, 16 bp, P. troglodytes
cagggctgtgcttcct

SEQ ID NO: 223819 - DNA, 16 bp, P. troglodytes
cagggctgtggtctca

SEQ ID NO: 223820 - DNA, 16 bp, P. troglodytes
cagggcttcaccatat

SEQ ID NO: 223821 - DNA, 16 bp, P. troglodytes
caggggaacaaaggaa

SEQ ID NO: 223822 - DNA, 16 bp, P. troglodytes
caggggaagaccacct

SEQ ID NO: 223823 - DNA, 16 bp, P. troglodytes
caggggaaggaaataa

SEQ ID NO: 223824 - DNA, 16 bp, P. troglodytes
caggggaccagggcag

SEQ ID NO: 223825 - DNA, 16 bp, P. troglodytes
caggggagatggggag

SEQ ID NO: 223826 - DNA, 16 bp, P. troglodytes
caggggagcccccacc

SEQ ID NO: 223827 - DNA, 16 bp, P. troglodytes
caggggaggcctcagg

SEQ ID NO: 223828 - DNA, 16 bp, P. troglodytes
caggggaggctgaggc

SEQ ID NO: 223829 - DNA, 16 bp, P. troglodytes
caggggcagagctggg

SEQ ID NO: 223830 - DNA, 16 bp, P. troglodytes
caggggcaggagctgg

SEQ ID NO: 223831 - DNA, 16 bp, P. troglodytes
caggggcaggaggcag

SEQ ID NO: 223832 - DNA, 16 bp, P. troglodytes
caggggcagggccctc

SEQ ID NO: 223833 - DNA, 16 bp, P. troglodytes
caggggccaggccagg

SEQ ID NO: 223834 - DNA, 16 bp, P. troglodytes
caggggccaggcccag

SEQ ID NO: 223835 - DNA, 16 bp, P. troglodytes
caggggccaggctggg

SEQ ID NO: 223836 - DNA, 16 bp, P. troglodytes
caggggccagggctgg

SEQ ID NO: 223837 - DNA, 16 bp, P. troglodytes
caggggccaggggcca

SEQ ID NO: 223838 - DNA, 16 bp, P. troglodytes
caggggctgaggagag

SEQ ID NO: 223839 - DNA, 16 bp, P. troglodytes
caggggctgaggcagg

SEQ ID NO: 223840 - DNA, 16 bp, P. troglodytes
caggggctgcaggtgg

SEQ ID NO: 223841 - DNA, 16 bp, P. troglodytes
caggggctggagagga

SEQ ID NO: 223842 - DNA, 16 bp, P. troglodytes
caggggctggaggaag

SEQ ID NO: 223843 - DNA, 16 bp, P. troglodytes
caggggctggaggagg

SEQ ID NO: 223844 - DNA, 16 bp, P. troglodytes
caggggctggagggag

SEQ ID NO: 223845 - DNA, 16 bp, P. troglodytes
caggggctggaggtgg

SEQ ID NO: 223846 - DNA, 16 bp, P. troglodytes
caggggctggcaggag

SEQ ID NO: 223847 - DNA, 16 bp, P. troglodytes
caggggctgggaagag

SEQ ID NO: 223848 - DNA, 16 bp, P. troglodytes
caggggctgggaggag

SEQ ID NO: 223849 - DNA, 16 bp, P. troglodytes
caggggctgggagtgg

SEQ ID NO: 223850 - DNA, 16 bp, P. troglodytes
caggggctgggccagg

SEQ ID NO: 223851 - DNA, 16 bp, P. troglodytes
caggggctgggcctgg

SEQ ID NO: 223852 - DNA, 16 bp, P. troglodytes
caggggctgggctggg

SEQ ID NO: 223853 - DNA, 16 bp, P. troglodytes
caggggctggggagtg

SEQ ID NO: 223854 - DNA, 16 bp, P. troglodytes
caggggctggggatgg

SEQ ID NO: 223855 - DNA, 16 bp, P. troglodytes
caggggctgggggaga

SEQ ID NO: 223856 - DNA, 16 bp, P. troglodytes
caggggctggtggagg

SEQ ID NO: 223857 - DNA, 16 bp, P. troglodytes
cagggggtacatgtgc

SEQ ID NO: 223858 - DNA, 16 bp, P. troglodytes
cagggggtggaggttg

SEQ ID NO: 223859 - DNA, 16 bp, P. troglodytes
cagggggtggggagct

SEQ ID NO: 223860 - DNA, 16 bp, P. troglodytes
caggggtatatcaact

SEQ ID NO: 223861 - DNA, 16 bp, P. troglodytes
caggggtcagcaaact

SEQ ID NO: 223862 - DNA, 16 bp, P. troglodytes
caggggtcagcaaatt

SEQ ID NO: 223863 - DNA, 16 bp, P. troglodytes
caggggtgagccacca

SEQ ID NO: 223864 - DNA, 16 bp, P. troglodytes
caggggtgagccaccg

SEQ ID NO: 223865 - DNA, 16 bp, P. troglodytes
caggggtggcagaggc

SEQ ID NO: 223866 - DNA, 16 bp, P. troglodytes
caggggttagcaaact

SEQ ID NO: 223867 - DNA, 16 bp, P. troglodytes
caggggttggcaaact

SEQ ID NO: 223868 - DNA, 16 bp, P. troglodytes
cagggtaatttatgaa

SEQ ID NO: 223869 - DNA, 16 bp, P. troglodytes
cagggtattgctctgt

SEQ ID NO: 223870 - DNA, 16 bp, P. troglodytes
cagggtcaggagtttg

SEQ ID NO: 223871 - DNA, 16 bp, P. troglodytes
cagggtcaggcaaaaa

SEQ ID NO: 223872 - DNA, 16 bp, P. troglodytes
cagggtcagggtcagg

SEQ ID NO: 223873 - DNA, 16 bp, P. troglodytes
cagggtctcattttgt

SEQ ID NO: 223874 - DNA, 16 bp, P. troglodytes
cagggtctctgttgcc

SEQ ID NO: 223875 - DNA, 16 bp, P. troglodytes
cagggtctggagagga

SEQ ID NO: 223876 - DNA, 16 bp, P. troglodytes
cagggtcttgctctat

SEQ ID NO: 223877 - DNA, 16 bp, P. troglodytes
cagggtcttgctctgc

SEQ ID NO: 223878 - DNA, 16 bp, P. troglodytes
cagggtcttgctgtgt

SEQ ID NO: 223879 - DNA, 16 bp, P. troglodytes
cagggtcttgtgctgt

SEQ ID NO: 223880 - DNA, 16 bp, P. troglodytes
cagggtgacaaagtga

SEQ ID NO: 223881 - DNA, 16 bp, P. troglodytes
cagggtgacagagaga

SEQ ID NO: 223882 - DNA, 16 bp, P. troglodytes
cagggtgactatagtt

SEQ ID NO: 223883 - DNA, 16 bp, P. troglodytes
cagggtgagaccctgc

SEQ ID NO: 223884 - DNA, 16 bp, P. troglodytes
cagggtgatcagacat

SEQ ID NO: 223885 - DNA, 16 bp, P. troglodytes
cagggtgccagcctgg

SEQ ID NO: 223886 - DNA, 16 bp, P. troglodytes
cagggtggagcccacc

SEQ ID NO: 223887 - DNA, 16 bp, P. troglodytes
cagggtggcaggagag

SEQ ID NO: 223888 - DNA, 16 bp, P. troglodytes
cagggtgggcagaggg

SEQ ID NO: 223889 - DNA, 16 bp, P. troglodytes
cagggtggggaacatc

SEQ ID NO: 223890 - DNA, 16 bp, P. troglodytes
cagggtggggcccagg

SEQ ID NO: 223891 - DNA, 16 bp, P. troglodytes
cagggtggtgacttca

SEQ ID NO: 223892 - DNA, 16 bp, P. troglodytes
cagggtgtgcaggttt

SEQ ID NO: 223893 - DNA, 16 bp, P. troglodytes
cagggtgtggtggtac

SEQ ID NO: 223894 - DNA, 16 bp, P. troglodytes
cagggtgtggtggtgg

SEQ ID NO: 223895 - DNA, 16 bp, P. troglodytes
cagggttcaagcaatt

SEQ ID NO: 223896 - DNA, 18 bp, P. troglodytes
cagggttcaagcgattct

SEQ ID NO: 223897 - DNA, 16 bp, P. troglodytes
cagggttccccagaga

SEQ ID NO: 223898 - DNA, 16 bp, P. troglodytes
cagggttggttcctcc

SEQ ID NO: 223899 - DNA, 20 bp, P. troglodytes
cagggtttcaccgtgttggc

SEQ ID NO: 223900 - DNA, 16 bp, P. troglodytes
cagggtttcactctgt

SEQ ID NO: 223901 - DNA, 16 bp, P. troglodytes
cagggtttcgccacgt

SEQ ID NO: 223902 - DNA, 16 bp, P. troglodytes
cagggtttctcaacct

SEQ ID NO: 223903 - DNA, 16 bp, P. troglodytes
cagggtttctcaatct

SEQ ID NO: 223904 - DNA, 16 bp, P. troglodytes
cagggtttctcagcct

SEQ ID NO: 223905 - DNA, 16 bp, P. troglodytes
cagggtttgaacccag

SEQ ID NO: 223906 - DNA, 16 bp, P. troglodytes
cagggtttggagtgga

SEQ ID NO: 223907 - DNA, 16 bp, P. troglodytes
cagggtttgtgaatac

SEQ ID NO: 223908 - DNA, 16 bp, P. troglodytes
cagggttttcaccatg

SEQ ID NO: 223909 - DNA, 16 bp, P. troglodytes
cagggttttgctttgt

SEQ ID NO: 223910 - DNA, 16 bp, P. troglodytes
cagggtttttctctgt

SEQ ID NO: 223911 - DNA, 16 bp, P. troglodytes
caggtacggtggctca

SEQ ID NO: 223912 - DNA, 16 bp, P. troglodytes
caggtactggggaggc

SEQ ID NO: 223913 - DNA, 16 bp, P. troglodytes
caggtagatcacttga

SEQ ID NO: 223914 - DNA, 16 bp, P. troglodytes
caggtatgagccaccg

SEQ ID NO: 223915 - DNA, 16 bp, P. troglodytes
caggtattaagcccag

SEQ ID NO: 223916 - DNA, 16 bp, P. troglodytes
caggtattctgttgta

SEQ ID NO: 223917 - DNA, 16 bp, P. troglodytes
caggtatttctttctt

SEQ ID NO: 223918 - DNA, 16 bp, P. troglodytes
caggtattttattctc

SEQ ID NO: 223919 - DNA, 16 bp, P. troglodytes
caggtcactgtaaaat

SEQ ID NO: 223920 - DNA, 16 bp, P. troglodytes
caggtcacttaaggtc

SEQ ID NO: 223921 - DNA, 17 bp, P. troglodytes
caggtcaggagatcaag

SEQ ID NO: 223922 - DNA, 16 bp, P. troglodytes
caggtcatctgcccgc

SEQ ID NO: 223923 - DNA, 16 bp, P. troglodytes
caggtccaggagcccc

SEQ ID NO: 223924 - DNA, 16 bp, P. troglodytes
caggtcccaccccaga

SEQ ID NO: 223925 - DNA, 16 bp, P. troglodytes
caggtcccacgcccac

SEQ ID NO: 223926 - DNA, 16 bp, P. troglodytes
caggtccctctcacaa

SEQ ID NO: 223927 - DNA, 16 bp, P. troglodytes
caggtccctggtgcca

SEQ ID NO: 223928 - DNA, 16 bp, P. troglodytes
caggtcctcagaccca

SEQ ID NO: 223929 - DNA, 16 bp, P. troglodytes
caggtcctccaggcct

SEQ ID NO: 223930 - DNA, 16 bp, P. troglodytes
caggtcctggcatctt

SEQ ID NO: 223931 - DNA, 16 bp, P. troglodytes
caggtctgagccacca

SEQ ID NO: 223932 - DNA, 16 bp, P. troglodytes
caggtctgtctgcctc

SEQ ID NO: 223933 - DNA, 16 bp, P. troglodytes
caggtcttctgactcc

SEQ ID NO: 223934 - DNA, 16 bp, P. troglodytes
caggtcttgctctgtt

SEQ ID NO: 223935 - DNA, 16 bp, P. troglodytes
caggtcttgctgtggc

SEQ ID NO: 223936 - DNA, 16 bp, P. troglodytes
caggtcttttgaaata

SEQ ID NO: 223937 - DNA, 16 bp, P. troglodytes
caggtgaagacaccac

SEQ ID NO: 223938 - DNA, 16 bp, P. troglodytes
caggtgaagtggctca

SEQ ID NO: 223939 - DNA, 16 bp, P. troglodytes
caggtgactctgatgc

SEQ ID NO: 223940 - DNA, 16 bp, P. troglodytes
caggtgagagccactg

SEQ ID NO: 223941 - DNA, 16 bp, P. troglodytes
caggtgaggaaacaga

SEQ ID NO: 223942 - DNA, 16 bp, P. troglodytes
caggtgaggaaaccga

SEQ ID NO: 223943 - DNA, 16 bp, P. troglodytes
caggtgaggtggctca

SEQ ID NO: 223944 - DNA, 19 bp, P. troglodytes
caggtgatccacctacctt

SEQ ID NO: 223945 - DNA, 16 bp, P. troglodytes
caggtgatccacctga

SEQ ID NO: 223946 - DNA, 16 bp, P. troglodytes
caggtgatcctcctgc

SEQ ID NO: 223947 - DNA, 16 bp, P. troglodytes
caggtgatggacattt

SEQ ID NO: 223948 - DNA, 16 bp, P. troglodytes
caggtgattctaatat

SEQ ID NO: 223949 - DNA, 16 bp, P. troglodytes
caggtgattggcccac

SEQ ID NO: 223950 - DNA, 16 bp, P. troglodytes
caggtgatttgtatgc

SEQ ID NO: 223951 - DNA, 16 bp, P. troglodytes
caggtgatttttaaaa

SEQ ID NO: 223952 - DNA, 16 bp, P. troglodytes
caggtgcacactacca

SEQ ID NO: 223953 - DNA, 16 bp, P. troglodytes
caggtgcagcagctca

SEQ ID NO: 223954 - DNA, 16 bp, P. troglodytes
caggtgcagctgcagc

SEQ ID NO: 223955 - DNA, 16 bp, P. troglodytes
caggtgcaggccacca

SEQ ID NO: 223956 - DNA, 16 bp, P. troglodytes
caggtgcaggtgcagg

SEQ ID NO: 223957 - DNA, 16 bp, P. troglodytes
caggtgcagtgattca

SEQ ID NO: 223958 - DNA, 16 bp, P. troglodytes
caggtgccactggggt

SEQ ID NO: 223959 - DNA, 16 bp, P. troglodytes
caggtgcccacaacca

SEQ ID NO: 223960 - DNA, 16 bp, P. troglodytes
caggtgcccaccaccg

SEQ ID NO: 223961 - DNA, 16 bp, P. troglodytes
caggtgcccagcacca

SEQ ID NO: 223962 - DNA, 16 bp, P. troglodytes
caggtgcccatcaaca

SEQ ID NO: 223963 - DNA, 16 bp, P. troglodytes
caggtgcccctccccc

SEQ ID NO: 223964 - DNA, 16 bp, P. troglodytes
caggtgccccttggca

SEQ ID NO: 223965 - DNA, 16 bp, P. troglodytes
caggtgccgccaccac

SEQ ID NO: 223966 - DNA, 16 bp, P. troglodytes
caggtgcctgccaccc

SEQ ID NO: 223967 - DNA, 16 bp, P. troglodytes
caggtgcgagccaccg

SEQ ID NO: 223968 - DNA, 16 bp, P. troglodytes
caggtgcgagccactg

SEQ ID NO: 223969 - DNA, 16 bp, P. troglodytes
caggtgcgcgccacca

SEQ ID NO: 223970 - DNA, 16 bp, P. troglodytes
caggtgcggcggctca

SEQ ID NO: 223971 - DNA, 16 bp, P. troglodytes
caggtgcggtggttca

SEQ ID NO: 223972 - DNA, 16 bp, P. troglodytes
caggtgctatggctca

SEQ ID NO: 223973 - DNA, 16 bp, P. troglodytes
caggtgctcaataaat

SEQ ID NO: 223974 - DNA, 16 bp, P. troglodytes
caggtgctggacagga

SEQ ID NO: 223975 - DNA, 16 bp, P. troglodytes
caggtgctggtatcca

SEQ ID NO: 223976 - DNA, 16 bp, P. troglodytes
caggtgctggtgagga

SEQ ID NO: 223977 - DNA, 16 bp, P. troglodytes
caggtgctgtgtccca

SEQ ID NO: 223978 - DNA, 16 bp, P. troglodytes
caggtggaaatgcaga

SEQ ID NO: 223979 - DNA, 18 bp, P. troglodytes
caggtggagctgcctgcc

SEQ ID NO: 223980 - DNA, 23 bp, P. troglodytes
caggtggagctgcctgccagtcc

SEQ ID NO: 223981 - DNA, 16 bp, P. troglodytes
caggtggaggtaattg

SEQ ID NO: 223982 - DNA, 16 bp, P. troglodytes
caggtggaggtgactg

SEQ ID NO: 223983 - DNA, 16 bp, P. troglodytes
caggtggatcacttga

SEQ ID NO: 223984 - DNA, 16 bp, P. troglodytes
caggtggatcatctga

SEQ ID NO: 223985 - DNA, 16 bp, P. troglodytes
caggtggatgacttga

SEQ ID NO: 223986 - DNA, 16 bp, P. troglodytes
caggtggattgcttga

SEQ ID NO: 223987 - DNA, 16 bp, P. troglodytes
caggtggccaagagca

SEQ ID NO: 223988 - DNA, 16 bp, P. troglodytes
caggtggctcacctga

SEQ ID NO: 223989 - DNA, 16 bp, P. troglodytes
caggtggctggggagg

SEQ ID NO: 223990 - DNA, 16 bp, P. troglodytes
caggtgggcatggtgg

SEQ ID NO: 223991 - DNA, 16 bp, P. troglodytes
caggtggggtggctca

SEQ ID NO: 223992 - DNA, 16 bp, P. troglodytes
caggtggtgggcaggg

SEQ ID NO: 223993 - DNA, 16 bp, P. troglodytes
caggtgtaagccactg

SEQ ID NO: 223994 - DNA, 16 bp, P. troglodytes
caggtgtcagccacca

SEQ ID NO: 223995 - DNA, 16 bp, P. troglodytes
caggtgtcatgggagg

SEQ ID NO: 223996 - DNA, 16 bp, P. troglodytes
caggtgtgaaccaccg

SEQ ID NO: 223997 - DNA, 16 bp, P. troglodytes
caggtgtgaaccactg

SEQ ID NO: 223998 - DNA, 16 bp, P. troglodytes
caggtgtgagccacag

SEQ ID NO: 223999 - DNA, 16 bp, P. troglodytes
caggtgtgagccacat

SEQ ID NO: 224000 - DNA, 16 bp, P. troglodytes
caggtgtgagccacca

SEQ ID NO: 224001 - DNA, 16 bp, P. troglodytes
caggtgtgagccaccg

SEQ ID NO: 224002 - DNA, 16 bp, P. troglodytes
caggtgtgagccacct

SEQ ID NO: 224003 - DNA, 16 bp, P. troglodytes
caggtgtgagccacta

SEQ ID NO: 224004 - DNA, 16 bp, P. troglodytes
caggtgtgagccactg

SEQ ID NO: 224005 - DNA, 16 bp, P. troglodytes
caggtgtgagccactt

SEQ ID NO: 224006 - DNA, 16 bp, P. troglodytes
caggtgtgagccatcg

SEQ ID NO: 224007 - DNA, 16 bp, P. troglodytes
caggtgtgagccatct

SEQ ID NO: 224008 - DNA, 16 bp, P. troglodytes
caggtgtgagcccccg

SEQ ID NO: 224009 - DNA, 16 bp, P. troglodytes
caggtgtgagccgcca

SEQ ID NO: 224010 - DNA, 16 bp, P. troglodytes
caggtgtgagccgccg

SEQ ID NO: 224011 - DNA, 16 bp, P. troglodytes
caggtgtgagccgctg

SEQ ID NO: 224012 - DNA, 16 bp, P. troglodytes
caggtgtgagctaccg

SEQ ID NO: 224013 - DNA, 16 bp, P. troglodytes
caggtgtgagctatca

SEQ ID NO: 224014 - DNA, 16 bp, P. troglodytes
caggtgtgagctgcca

SEQ ID NO: 224015 - DNA, 16 bp, P. troglodytes
caggtgtgagctgctg

SEQ ID NO: 224016 - DNA, 16 bp, P. troglodytes
caggtgtgaggaagaa

SEQ ID NO: 224017 - DNA, 16 bp, P. troglodytes
caggtgtgaggcaccg

SEQ ID NO: 224018 - DNA, 16 bp, P. troglodytes
caggtgtgagtcacca

SEQ ID NO: 224019 - DNA, 16 bp, P. troglodytes
caggtgtgagtcaccc

SEQ ID NO: 224020 - DNA, 16 bp, P. troglodytes
caggtgtgagtcaccg

SEQ ID NO: 224021 - DNA, 16 bp, P. troglodytes
caggtgtgagtcacct

SEQ ID NO: 224022 - DNA, 16 bp, P. troglodytes
caggtgtgagtcactg

SEQ ID NO: 224023 - DNA, 16 bp, P. troglodytes
caggtgtgcaccaaca

SEQ ID NO: 224024 - DNA, 16 bp, P. troglodytes
caggtgtgcaccatgc

SEQ ID NO: 224025 - DNA, 16 bp, P. troglodytes
caggtgtgggagggac

SEQ ID NO: 224026 - DNA, 16 bp, P. troglodytes
caggtgtggtagcaca

SEQ ID NO: 224027 - DNA, 16 bp, P. troglodytes
caggtgtggtagtggg

SEQ ID NO: 224028 - DNA, 16 bp, P. troglodytes
caggtgtggtgacgca

SEQ ID NO: 224029 - DNA, 16 bp, P. troglodytes
caggtgtggtggctgt

SEQ ID NO: 224030 - DNA, 16 bp, P. troglodytes
caggtgtggtggtgct

SEQ ID NO: 224031 - DNA, 16 bp, P. troglodytes
caggtgtgtgccacac

SEQ ID NO: 224032 - DNA, 16 bp, P. troglodytes
caggtgtgtgccatca

SEQ ID NO: 224033 - DNA, 16 bp, P. troglodytes
caggtgtgtgtcactg

SEQ ID NO: 224034 - DNA, 16 bp, P. troglodytes
caggtgttcaaggcca

SEQ ID NO: 224035 - DNA, 16 bp, P. troglodytes
caggtgttccacctgc

SEQ ID NO: 224036 - DNA, 16 bp, P. troglodytes
caggtgtttctatcta

SEQ ID NO: 224037 - DNA, 16 bp, P. troglodytes
caggtgtttgaggcca

SEQ ID NO: 224038 - DNA, 16 bp, P. troglodytes
caggttaattttttgt

SEQ ID NO: 224039 - DNA, 16 bp, P. troglodytes
caggttatctttatag

SEQ ID NO: 224040 - DNA, 16 bp, P. troglodytes
caggttcaagcgatct

SEQ ID NO: 224041 - DNA, 16 bp, P. troglodytes
caggttctcactcata

SEQ ID NO: 224042 - DNA, 16 bp, P. troglodytes
caggttctcactctgt

SEQ ID NO: 224043 - DNA, 16 bp, P. troglodytes
caggttgagaaccact

SEQ ID NO: 224044 - DNA, 16 bp, P. troglodytes
caggttgcagtgagcc

SEQ ID NO: 224045 - DNA, 16 bp, P. troglodytes
caggttggggaagttc

SEQ ID NO: 224046 - DNA, 16 bp, P. troglodytes
caggttgggtgacaga

SEQ ID NO: 224047 - DNA, 16 bp, P. troglodytes
caggttggtctcgaac

SEQ ID NO: 224048 - DNA, 16 bp, P. troglodytes
caggttggtcttgaac

SEQ ID NO: 224049 - DNA, 16 bp, P. troglodytes
caggttggtcttggac

SEQ ID NO: 224050 - DNA, 16 bp, P. troglodytes
caggtttcttcactgt

SEQ ID NO: 224051 - DNA, 16 bp, P. troglodytes
caggtttctttttctt

SEQ ID NO: 224052 - DNA, 16 bp, P. troglodytes
caggtttgttgaaaat

SEQ ID NO: 224053 - DNA, 16 bp, P. troglodytes
caggttttctgctctg

SEQ ID NO: 224054 - DNA, 16 bp, P. troglodytes
caggtttttgtttcat

SEQ ID NO: 224055 - DNA, 16 bp, P. troglodytes
caggttttttgcatgt

SEQ ID NO: 224056 - DNA, 16 bp, P. troglodytes
caggttttttgttgtt

SEQ ID NO: 224057 - DNA, 16 bp, P. troglodytes
cagtaaaaagatcagc

SEQ ID NO: 224058 - DNA, 16 bp, P. troglodytes
cagtaaaataaagcac

SEQ ID NO: 224059 - DNA, 16 bp, P. troglodytes
cagtaaaattcaacat

SEQ ID NO: 224060 - DNA, 16 bp, P. troglodytes
cagtaaactcattttt

SEQ ID NO: 224061 - DNA, 16 bp, P. troglodytes
cagtaaagctggaaaa

SEQ ID NO: 224062 - DNA, 16 bp, P. troglodytes
cagtaaatatatatat

SEQ ID NO: 224063 - DNA, 16 bp, P. troglodytes
cagtaaatattagtta

SEQ ID NO: 224064 - DNA, 16 bp, P. troglodytes
cagtaaatattttagg

SEQ ID NO: 224065 - DNA, 16 bp, P. troglodytes
cagtaaatgtaaaaga

SEQ ID NO: 224066 - DNA, 16 bp, P. troglodytes
cagtaaatgtgattca

SEQ ID NO: 224067 - DNA, 16 bp, P. troglodytes
cagtaaatgtttattg

SEQ ID NO: 224068 - DNA, 16 bp, P. troglodytes
cagtaacagaagaaaa

SEQ ID NO: 224069 - DNA, 16 bp, P. troglodytes
cagtaagatataaata

SEQ ID NO: 224070 - DNA, 16 bp, P. troglodytes
cagtaagccatgatca

SEQ ID NO: 224071 - DNA, 16 bp, P. troglodytes
cagtaagtgctcaata

SEQ ID NO: 224072 - DNA, 16 bp, P. troglodytes
cagtaagttttgaaat

SEQ ID NO: 224073 - DNA, 16 bp, P. troglodytes
cagtaataaaaaacct

SEQ ID NO: 224074 - DNA, 16 bp, P. troglodytes
cagtaataacattgaa

SEQ ID NO: 224075 - DNA, 16 bp, P. troglodytes
cagtaatattttgaaa

SEQ ID NO: 224076 - DNA, 16 bp, P. troglodytes
cagtaatgaaaagaaa

SEQ ID NO: 224077 - DNA, 16 bp, P. troglodytes
cagtaatgggatgact

SEQ ID NO: 224078 - DNA, 16 bp, P. troglodytes
cagtaattttattaga

SEQ ID NO: 224079 - DNA, 16 bp, P. troglodytes
cagtacaaagagagga

SEQ ID NO: 224080 - DNA, 16 bp, P. troglodytes
cagtacaataaaatat

SEQ ID NO: 224081 - DNA, 18 bp, P. troglodytes
cagtacaccctccgcagc

SEQ ID NO: 224082 - DNA, 16 bp, P. troglodytes
cagtacattgaagaga

SEQ ID NO: 224083 - DNA, 16 bp, P. troglodytes
cagtacattgggaggc

SEQ ID NO: 224084 - DNA, 16 bp, P. troglodytes
cagtaccagcccagag

SEQ ID NO: 224085 - DNA, 16 bp, P. troglodytes
cagtaccagcctggag

SEQ ID NO: 224086 - DNA, 16 bp, P. troglodytes
cagtaccccactctac

SEQ ID NO: 224087 - DNA, 16 bp, P. troglodytes
cagtacctcagaatat

SEQ ID NO: 224088 - DNA, 16 bp, P. troglodytes
cagtactttgggagac

SEQ ID NO: 224089 - DNA, 16 bp, P. troglodytes
cagtactttgggaggt

SEQ ID NO: 224090 - DNA, 16 bp, P. troglodytes
cagtagaaaaaaatat

SEQ ID NO: 224091 - DNA, 16 bp, P. troglodytes
cagtagagatgaggtt

SEQ ID NO: 224092 - DNA, 16 bp, P. troglodytes
cagtagagatggggct

SEQ ID NO: 224093 - DNA, 16 bp, P. troglodytes
cagtagcagcagtagc

SEQ ID NO: 224094 - DNA, 16 bp, P. troglodytes
cagtagcctcctaact

SEQ ID NO: 224095 - DNA, 16 bp, P. troglodytes
cagtagctaggactac

SEQ ID NO: 224096 - DNA, 16 bp, P. troglodytes
cagtagctcacacctg

SEQ ID NO: 224097 - DNA, 16 bp, P. troglodytes
cagtagctcacgcctg

SEQ ID NO: 224098 - DNA, 16 bp, P. troglodytes
cagtagctcatgcctg

SEQ ID NO: 224099 - DNA, 16 bp, P. troglodytes
cagtagctgggattat

SEQ ID NO: 224100 - DNA, 16 bp, P. troglodytes
cagtaggtgcttaata

SEQ ID NO: 224101 - DNA, 16 bp, P. troglodytes
cagtagtgggattgct

SEQ ID NO: 224102 - DNA, 16 bp, P. troglodytes
cagtataacctcatct

SEQ ID NO: 224103 - DNA, 16 bp, P. troglodytes
cagtataataaagata

SEQ ID NO: 224104 - DNA, 16 bp, P. troglodytes
cagtatagcaactatt

SEQ ID NO: 224105 - DNA, 16 bp, P. troglodytes
cagtatagtttgaagt

SEQ ID NO: 224106 - DNA, 16 bp, P. troglodytes
cagtatcactctaata

SEQ ID NO: 224107 - DNA, 16 bp, P. troglodytes
cagtatcatgagaaca

SEQ ID NO: 224108 - DNA, 16 bp, P. troglodytes
cagtatgaattatctt

SEQ ID NO: 224109 - DNA, 16 bp, P. troglodytes
cagtatgtggcctttt

SEQ ID NO: 224110 - DNA, 16 bp, P. troglodytes
cagtattgttaaaatg

SEQ ID NO: 224111 - DNA, 16 bp, P. troglodytes
cagtatttctcaaaat

SEQ ID NO: 224112 - DNA, 16 bp, P. troglodytes
cagtatttctcaaact

SEQ ID NO: 224113 - DNA, 16 bp, P. troglodytes
cagtatttgtctttct

SEQ ID NO: 224114 - DNA, 16 bp, P. troglodytes
cagtatttgtgtgtgt

SEQ ID NO: 224115 - DNA, 16 bp, P. troglodytes
cagtattttatagttt

SEQ ID NO: 224116 - DNA, 16 bp, P. troglodytes
cagtattttattcagg

SEQ ID NO: 224117 - DNA, 16 bp, P. troglodytes
cagtattttattcttt

SEQ ID NO: 224118 - DNA, 16 bp, P. troglodytes
cagtatttttatttct

SEQ ID NO: 224119 - DNA, 16 bp, P. troglodytes
cagtcaagcccaaatt

SEQ ID NO: 224120 - DNA, 16 bp, P. troglodytes
cagtcaagtcttcaga

SEQ ID NO: 224121 - DNA, 16 bp, P. troglodytes
cagtcaatgatggact

SEQ ID NO: 224122 - DNA, 16 bp, P. troglodytes
cagtcacaggcctcac

SEQ ID NO: 224123 - DNA, 16 bp, P. troglodytes
cagtcaccccagccaa

SEQ ID NO: 224124 - DNA, 16 bp, P. troglodytes
cagtcactatcatgag

SEQ ID NO: 224125 - DNA, 16 bp, P. troglodytes
cagtcactcacacctg

SEQ ID NO: 224126 - DNA, 16 bp, P. troglodytes
cagtcactttggaaaa

SEQ ID NO: 224127 - DNA, 16 bp, P. troglodytes
cagtcagagagaaagg

SEQ ID NO: 224128 - DNA, 16 bp, P. troglodytes
cagtcagcagccatcc

SEQ ID NO: 224129 - DNA, 16 bp, P. troglodytes
cagtcaggctggtggg

SEQ ID NO: 224130 - DNA, 16 bp, P. troglodytes
cagtcagggaaccaag

SEQ ID NO: 224131 - DNA, 16 bp, P. troglodytes
cagtcagggagccaat

SEQ ID NO: 224132 - DNA, 16 bp, P. troglodytes
cagtcagtatgatatt

SEQ ID NO: 224133 - DNA, 16 bp, P. troglodytes
cagtcagtgctgaaac

SEQ ID NO: 224134 - DNA, 16 bp, P. troglodytes
cagtcatagcagaagg

SEQ ID NO: 224135 - DNA, 16 bp, P. troglodytes
cagtcatgcatcactt

SEQ ID NO: 224136 - DNA, 16 bp, P. troglodytes
cagtcatggctcactg

SEQ ID NO: 224137 - DNA, 16 bp, P. troglodytes
cagtcatggctcattg

SEQ ID NO: 224138 - DNA, 16 bp, P. troglodytes
cagtcatgtgctacat

SEQ ID NO: 224139 - DNA, 16 bp, P. troglodytes
cagtcattaaaaatga

SEQ ID NO: 224140 - DNA, 16 bp, P. troglodytes
cagtcatttcttccct

SEQ ID NO: 224141 - DNA, 16 bp, P. troglodytes
cagtccaagtccccaa

SEQ ID NO: 224142 - DNA, 16 bp, P. troglodytes
cagtccaatgtcctgg

SEQ ID NO: 224143 - DNA, 16 bp, P. troglodytes
cagtccagcctggcca

SEQ ID NO: 224144 - DNA, 16 bp, P. troglodytes
cagtcccacaagactg

SEQ ID NO: 224145 - DNA, 16 bp, P. troglodytes
cagtcccagctgagcc

SEQ ID NO: 224146 - DNA, 16 bp, P. troglodytes
cagtccccagaatgtg

SEQ ID NO: 224147 - DNA, 16 bp, P. troglodytes
cagtcccccagagtct

SEQ ID NO: 224148 - DNA, 16 bp, P. troglodytes
cagtccctcccatcac

SEQ ID NO: 224149 - DNA, 16 bp, P. troglodytes
cagtccctggaccctg

SEQ ID NO: 224150 - DNA, 16 bp, P. troglodytes
cagtcctcccatctca

SEQ ID NO: 224151 - DNA, 16 bp, P. troglodytes
cagtcctcccgcctcg

SEQ ID NO: 224152 - DNA, 16 bp, P. troglodytes
cagtcctcctgcctgg

SEQ ID NO: 224153 - DNA, 16 bp, P. troglodytes
cagtcctcctgcttca

SEQ ID NO: 224154 - DNA, 16 bp, P. troglodytes
cagtcctgggtggggc

SEQ ID NO: 224155 - DNA, 16 bp, P. troglodytes
cagtccttccaccttg

SEQ ID NO: 224156 - DNA, 16 bp, P. troglodytes
cagtccttttgggttt

SEQ ID NO: 224157 - DNA, 16 bp, P. troglodytes
cagtctacccctactg

SEQ ID NO: 224158 - DNA, 16 bp, P. troglodytes
cagtctagtgagggag

SEQ ID NO: 224159 - DNA, 16 bp, P. troglodytes
cagtctatcattgata

SEQ ID NO: 224160 - DNA, 16 bp, P. troglodytes
cagtctcaagaaaaaa

SEQ ID NO: 224161 - DNA, 16 bp, P. troglodytes
cagtctcaagcagttc

SEQ ID NO: 224162 - DNA, 16 bp, P. troglodytes
cagtctcaagtagttc

SEQ ID NO: 224163 - DNA, 16 bp, P. troglodytes
cagtctcactgtgtca

SEQ ID NO: 224164 - DNA, 16 bp, P. troglodytes
cagtctcaggcctgct

SEQ ID NO: 224165 - DNA, 16 bp, P. troglodytes
cagtctcagtggctca

SEQ ID NO: 224166 - DNA, 16 bp, P. troglodytes
cagtctccatctccca

SEQ ID NO: 224167 - DNA, 16 bp, P. troglodytes
cagtctcccaagcagc

SEQ ID NO: 224168 - DNA, 16 bp, P. troglodytes
cagtctcccaggctgg

SEQ ID NO: 224169 - DNA, 16 bp, P. troglodytes
cagtctccctctccct

SEQ ID NO: 224170 - DNA, 16 bp, P. troglodytes
cagtctcgctctgttg

SEQ ID NO: 224171 - DNA, 16 bp, P. troglodytes
cagtctcgggtatttc

SEQ ID NO: 224172 - DNA, 16 bp, P. troglodytes
cagtctctacaaaaaa

SEQ ID NO: 224173 - DNA, 16 bp, P. troglodytes
cagtctctctctgtca

SEQ ID NO: 224174 - DNA, 16 bp, P. troglodytes
cagtctctgcctccca

SEQ ID NO: 224175 - DNA, 16 bp, P. troglodytes
cagtctctgccttcat

SEQ ID NO: 224176 - DNA, 16 bp, P. troglodytes
cagtctctttgctaaa

SEQ ID NO: 224177 - DNA, 16 bp, P. troglodytes
cagtctgactctggca

SEQ ID NO: 224178 - DNA, 16 bp, P. troglodytes
cagtctgatttttttt

SEQ ID NO: 224179 - DNA, 16 bp, P. troglodytes
cagtctgcttccttca

SEQ ID NO: 224180 - DNA, 16 bp, P. troglodytes
cagtctggctccagag

SEQ ID NO: 224181 - DNA, 16 bp, P. troglodytes
cagtctggctccaggg

SEQ ID NO: 224182 - DNA, 16 bp, P. troglodytes
cagtctgggaaacaga

SEQ ID NO: 224183 - DNA, 16 bp, P. troglodytes
cagtctgggcaacagt

SEQ ID NO: 224184 - DNA, 16 bp, P. troglodytes
cagtcttattggatta

SEQ ID NO: 224185 - DNA, 16 bp, P. troglodytes
cagtcttcccacttca

SEQ ID NO: 224186 - DNA, 17 bp, P. troglodytes
cagtcttgctctgtcac

SEQ ID NO: 224187 - DNA, 16 bp, P. troglodytes
cagtgaaaaaataatg

SEQ ID NO: 224188 - DNA, 16 bp, P. troglodytes
cagtgaaaaaggaaat

SEQ ID NO: 224189 - DNA, 16 bp, P. troglodytes
cagtgaaaacattttt

SEQ ID NO: 224190 - DNA, 16 bp, P. troglodytes
cagtgaaaagggaaca

SEQ ID NO: 224191 - DNA, 16 bp, P. troglodytes
cagtgaaaccatcagg

SEQ ID NO: 224192 - DNA, 16 bp, P. troglodytes
cagtgaaaccccattt

SEQ ID NO: 224193 - DNA, 16 bp, P. troglodytes
cagtgaacagagatca

SEQ ID NO: 224194 - DNA, 16 bp, P. troglodytes
cagtgaactgtgttca

SEQ ID NO: 224195 - DNA, 16 bp, P. troglodytes
cagtgaacttaaagat

SEQ ID NO: 224196 - DNA, 16 bp, P. troglodytes
cagtgaaggccaggct

SEQ ID NO: 224197 - DNA, 16 bp, P. troglodytes
cagtgaaggctgagaa

SEQ ID NO: 224198 - DNA, 16 bp, P. troglodytes
cagtgacaccatcatg

SEQ ID NO: 224199 - DNA, 16 bp, P. troglodytes
cagtgaccaaagactt

SEQ ID NO: 224200 - DNA, 16 bp, P. troglodytes
cagtgactcacacctg

SEQ ID NO: 224201 - DNA, 16 bp, P. troglodytes
cagtgactcacgcctg

SEQ ID NO: 224202 - DNA, 16 bp, P. troglodytes
cagtgagaccctttct

SEQ ID NO: 224203 - DNA, 16 bp, P. troglodytes
cagtgagactccacct

SEQ ID NO: 224204 - DNA, 16 bp, P. troglodytes
cagtgagagagagaga

SEQ ID NO: 224205 - DNA, 16 bp, P. troglodytes
cagtgagagccctgag

SEQ ID NO: 224206 - DNA, 16 bp, P. troglodytes
cagtgagattgcacca

SEQ ID NO: 224207 - DNA, 16 bp, P. troglodytes
cagtgagcaaagatca

SEQ ID NO: 224208 - DNA, 16 bp, P. troglodytes
cagtgagcagaggagt

SEQ ID NO: 224209 - DNA, 16 bp, P. troglodytes
cagtgagcagcaggac

SEQ ID NO: 224210 - DNA, 16 bp, P. troglodytes
cagtgagcagtgagca

SEQ ID NO: 224211 - DNA, 16 bp, P. troglodytes
cagtgagccagcctgg

SEQ ID NO: 224212 - DNA, 16 bp, P. troglodytes
cagtgagccatgatca

SEQ ID NO: 224213 - DNA, 19 bp, P. troglodytes
cagtgagctatgatcatgt

SEQ ID NO: 224214 - DNA, 16 bp, P. troglodytes
cagtgagctatgatgg

SEQ ID NO: 224215 - DNA, 16 bp, P. troglodytes
cagtgagctatgattg

SEQ ID NO: 224216 - DNA, 16 bp, P. troglodytes
cagtgagctcagatca

SEQ ID NO: 224217 - DNA, 16 bp, P. troglodytes
cagtgagctgaggtct

SEQ ID NO: 224218 - DNA, 16 bp, P. troglodytes
cagtgagctgagttcg

SEQ ID NO: 224219 - DNA, 16 bp, P. troglodytes
cagtgagctgggatgg

SEQ ID NO: 224220 - DNA, 16 bp, P. troglodytes
cagtgagctgtgacca

SEQ ID NO: 224221 - DNA, 16 bp, P. troglodytes
cagtgaggaaactgag

SEQ ID NO: 224222 - DNA, 16 bp, P. troglodytes
cagtgaggcaggagaa

SEQ ID NO: 224223 - DNA, 16 bp, P. troglodytes
cagtgaggccccatct

SEQ ID NO: 224224 - DNA, 16 bp, P. troglodytes
cagtgaggccctgtct

SEQ ID NO: 224225 - DNA, 16 bp, P. troglodytes
cagtgaggggtgtgtg

SEQ ID NO: 224226 - DNA, 22 bp, P. troglodytes
cagtgagtcgagatcgcgccac

SEQ ID NO: 224227 - DNA, 16 bp, P. troglodytes
cagtgatactgatttt

SEQ ID NO: 224228 - DNA, 16 bp, P. troglodytes
cagtgatgaaagtggg

SEQ ID NO: 224229 - DNA, 16 bp, P. troglodytes
cagtgatgatgacctt

SEQ ID NO: 224230 - DNA, 17 bp, P. troglodytes
cagtgatgcaatctcag

SEQ ID NO: 224231 - DNA, 16 bp, P. troglodytes
cagtgatgccactgag

SEQ ID NO: 224232 - DNA, 16 bp, P. troglodytes
cagtgatggactggat

SEQ ID NO: 224233 - DNA, 16 bp, P. troglodytes
cagtgattatgagctt

SEQ ID NO: 224234 - DNA, 16 bp, P. troglodytes
cagtgattcacacctg

SEQ ID NO: 224235 - DNA, 16 bp, P. troglodytes
cagtgattctcaaagt

SEQ ID NO: 224236 - DNA, 16 bp, P. troglodytes
cagtgattctcaaatt

SEQ ID NO: 224237 - DNA, 16 bp, P. troglodytes
cagtgatttttatttt

SEQ ID NO: 224238 - DNA, 16 bp, P. troglodytes
cagtgcaaaatggaaa

SEQ ID NO: 224239 - DNA, 16 bp, P. troglodytes
cagtgcaaagtgaaaa

SEQ ID NO: 224240 - DNA, 16 bp, P. troglodytes
cagtgcaacctccact

SEQ ID NO: 224241 - DNA, 16 bp, P. troglodytes
cagtgcaagaatggcc

SEQ ID NO: 224242 - DNA, 16 bp, P. troglodytes
cagtgcaagatgtgct

SEQ ID NO: 224243 - DNA, 16 bp, P. troglodytes
cagtgcaagctctgcc

SEQ ID NO: 224244 - DNA, 16 bp, P. troglodytes
cagtgcaatctctgcc

SEQ ID NO: 224245 - DNA, 16 bp, P. troglodytes
cagtgcacagaagtca

SEQ ID NO: 224246 - DNA, 16 bp, P. troglodytes
cagtgcagtggtgaga

SEQ ID NO: 224247 - DNA, 16 bp, P. troglodytes
cagtgcagtggtgcaa

SEQ ID NO: 224248 - DNA, 16 bp, P. troglodytes
cagtgcattccagcct

SEQ ID NO: 224249 - DNA, 16 bp, P. troglodytes
cagtgccacaataaac

SEQ ID NO: 224250 - DNA, 16 bp, P. troglodytes
cagtgccacgatctca

SEQ ID NO: 224251 - DNA, 16 bp, P. troglodytes
cagtgccagcccactg

SEQ ID NO: 224252 - DNA, 16 bp, P. troglodytes
cagtgccatgctcttg

SEQ ID NO: 224253 - DNA, 16 bp, P. troglodytes
cagtgccatgcttcct

SEQ ID NO: 224254 - DNA, 16 bp, P. troglodytes
cagtgcccaaagtctg

SEQ ID NO: 224255 - DNA, 16 bp, P. troglodytes
cagtgcccagcacata

SEQ ID NO: 224256 - DNA, 16 bp, P. troglodytes
cagtgccctgcacaca

SEQ ID NO: 224257 - DNA, 16 bp, P. troglodytes
cagtgcctcacgcctg

SEQ ID NO: 224258 - DNA, 16 bp, P. troglodytes
cagtgcctggcaccag

SEQ ID NO: 224259 - DNA, 16 bp, P. troglodytes
cagtgcctggcagaga

SEQ ID NO: 224260 - DNA, 16 bp, P. troglodytes
cagtgcctggcagagt

SEQ ID NO: 224261 - DNA, 16 bp, P. troglodytes
cagtgcctggcccaca

SEQ ID NO: 224262 - DNA, 16 bp, P. troglodytes
cagtgcctggctcata

SEQ ID NO: 224263 - DNA, 16 bp, P. troglodytes
cagtgcctgggaaggc

SEQ ID NO: 224264 - DNA, 16 bp, P. troglodytes
cagtgcctgggaatgt

SEQ ID NO: 224265 - DNA, 16 bp, P. troglodytes
cagtgcctggtacatg

SEQ ID NO: 224266 - DNA, 16 bp, P. troglodytes
cagtgccttgcacaca

SEQ ID NO: 224267 - DNA, 16 bp, P. troglodytes
cagtgctcaataaatg

SEQ ID NO: 224268 - DNA, 16 bp, P. troglodytes
cagtgctcacgcctgt

SEQ ID NO: 224269 - DNA, 16 bp, P. troglodytes
cagtgctgagaggaaa

SEQ ID NO: 224270 - DNA, 18 bp, P. troglodytes
cagtgctgagattacagg

SEQ ID NO: 224271 - DNA, 16 bp, P. troglodytes
cagtgctgaggttgag

SEQ ID NO: 224272 - DNA, 16 bp, P. troglodytes
cagtgctgcaatcaca

SEQ ID NO: 224273 - DNA, 16 bp, P. troglodytes
cagtgctgctgtgaac

SEQ ID NO: 224274 - DNA, 16 bp, P. troglodytes
cagtgctggaggctgg

SEQ ID NO: 224275 - DNA, 16 bp, P. troglodytes
cagtgctgggattaca

SEQ ID NO: 224276 - DNA, 16 bp, P. troglodytes
cagtgctggggaggcc

SEQ ID NO: 224277 - DNA, 16 bp, P. troglodytes
cagtgctgtgttgaat

SEQ ID NO: 224278 - DNA, 16 bp, P. troglodytes
cagtgcttcccaaact

SEQ ID NO: 224279 - DNA, 16 bp, P. troglodytes
cagtgcttcgggaggc

SEQ ID NO: 224280 - DNA, 16 bp, P. troglodytes
cagtgcttctcaagct

SEQ ID NO: 224281 - DNA, 16 bp, P. troglodytes
cagtgcttgtgttcaa

SEQ ID NO: 224282 - DNA, 16 bp, P. troglodytes
cagtggaaaaatctgg

SEQ ID NO: 224283 - DNA, 16 bp, P. troglodytes
cagtggaaagttttaa

SEQ ID NO: 224284 - DNA, 16 bp, P. troglodytes
cagtggaagtggctct

SEQ ID NO: 224285 - DNA, 16 bp, P. troglodytes
cagtggaatattattt

SEQ ID NO: 224286 - DNA, 16 bp, P. troglodytes
cagtggagaggggagc

SEQ ID NO: 224287 - DNA, 16 bp, P. troglodytes
cagtggagaggggatg

SEQ ID NO: 224288 - DNA, 16 bp, P. troglodytes
cagtggaggaagtaat

SEQ ID NO: 224289 - DNA, 16 bp, P. troglodytes
cagtggaggctacaga

SEQ ID NO: 224290 - DNA, 16 bp, P. troglodytes
cagtggaggtggcaga

SEQ ID NO: 224291 - DNA, 16 bp, P. troglodytes
cagtggagtgatcaca

SEQ ID NO: 224292 - DNA, 16 bp, P. troglodytes
cagtggatgaatggat

SEQ ID NO: 224293 - DNA, 16 bp, P. troglodytes
cagtggcaatctcagc

SEQ ID NO: 224294 - DNA, 16 bp, P. troglodytes
cagtggcacaatcaca

SEQ ID NO: 224295 - DNA, 16 bp, P. troglodytes
cagtggcacaatgtcg

SEQ ID NO: 224296 - DNA, 16 bp, P. troglodytes
cagtggcaccatgtcg

SEQ ID NO: 224297 - DNA, 16 bp, P. troglodytes
cagtggcagcagcagc

SEQ ID NO: 224298 - DNA, 16 bp, P. troglodytes
cagtggcagtggtggg

SEQ ID NO: 224299 - DNA, 16 bp, P. troglodytes
cagtggcatgatctcc

SEQ ID NO: 224300 - DNA, 16 bp, P. troglodytes
cagtggcattcagtac

SEQ ID NO: 224301 - DNA, 16 bp, P. troglodytes
cagtggccaggtgcag

SEQ ID NO: 224302 - DNA, 16 bp, P. troglodytes
cagtggcccaggcctg

SEQ ID NO: 224303 - DNA, 16 bp, P. troglodytes
cagtggccccatctca

SEQ ID NO: 224304 - DNA, 16 bp, P. troglodytes
cagtggcctgtgcctg

SEQ ID NO: 224305 - DNA, 16 bp, P. troglodytes
cagtggcgagatcttg

SEQ ID NO: 224306 - DNA, 16 bp, P. troglodytes
cagtggctattcacag

SEQ ID NO: 224307 - DNA, 16 bp, P. troglodytes
cagtggctcaagcctg

SEQ ID NO: 224308 - DNA, 16 bp, P. troglodytes
cagtggctcacacctg

SEQ ID NO: 224309 - DNA, 16 bp, P. troglodytes
cagtggctcacatctg

SEQ ID NO: 224310 - DNA, 16 bp, P. troglodytes
cagtggctcacccctg

SEQ ID NO: 224311 - DNA, 16 bp, P. troglodytes
cagtggctcacctctg

SEQ ID NO: 224312 - DNA, 16 bp, P. troglodytes
cagtggctcacgccta

SEQ ID NO: 224313 - DNA, 16 bp, P. troglodytes
cagtggctcacgcctg

SEQ ID NO: 224314 - DNA, 16 bp, P. troglodytes
cagtggctcacgtctg

SEQ ID NO: 224315 - DNA, 16 bp, P. troglodytes
cagtggctcactcctg

SEQ ID NO: 224316 - DNA, 16 bp, P. troglodytes
cagtggctcactcttg

SEQ ID NO: 224317 - DNA, 16 bp, P. troglodytes
cagtggctcatacctg

SEQ ID NO: 224318 - DNA, 16 bp, P. troglodytes
cagtggctcatgccta

SEQ ID NO: 224319 - DNA, 16 bp, P. troglodytes
cagtggctcatgcctg

SEQ ID NO: 224320 - DNA, 16 bp, P. troglodytes
cagtggctcatgtctg

SEQ ID NO: 224321 - DNA, 17 bp, P. troglodytes
cagtggctccatcacag

SEQ ID NO: 224322 - DNA, 16 bp, P. troglodytes
cagtggctcccagcac

SEQ ID NO: 224323 - DNA, 16 bp, P. troglodytes
cagtggctcgcacctg

SEQ ID NO: 224324 - DNA, 16 bp, P. troglodytes
cagtggctgaacaccg

SEQ ID NO: 224325 - DNA, 16 bp, P. troglodytes
cagtggctgatacctg

SEQ ID NO: 224326 - DNA, 16 bp, P. troglodytes
cagtggctgatgcctg

SEQ ID NO: 224327 - DNA, 16 bp, P. troglodytes
cagtggctgcagaata

SEQ ID NO: 224328 - DNA, 16 bp, P. troglodytes
cagtggctgcagaggg

SEQ ID NO: 224329 - DNA, 16 bp, P. troglodytes
cagtggctgcagcaag

SEQ ID NO: 224330 - DNA, 16 bp, P. troglodytes
cagtggcttaacacaa

SEQ ID NO: 224331 - DNA, 16 bp, P. troglodytes
cagtggcttacacctg

SEQ ID NO: 224332 - DNA, 16 bp, P. troglodytes
cagtggcttacgcctg

SEQ ID NO: 224333 - DNA, 16 bp, P. troglodytes
cagtggcttaggcctg

SEQ ID NO: 224334 - DNA, 16 bp, P. troglodytes
cagtggcttatacctg

SEQ ID NO: 224335 - DNA, 16 bp, P. troglodytes
cagtggcttatgcctg

SEQ ID NO: 224336 - DNA, 16 bp, P. troglodytes
cagtggcttgcacctg

SEQ ID NO: 224337 - DNA, 16 bp, P. troglodytes
cagtggctttgccaag

SEQ ID NO: 224338 - DNA, 16 bp, P. troglodytes
cagtgggaagccactg

SEQ ID NO: 224339 - DNA, 16 bp, P. troglodytes
cagtgggcagaacttc

SEQ ID NO: 224340 - DNA, 16 bp, P. troglodytes
cagtgggcagaacttt

SEQ ID NO: 224341 - DNA, 16 bp, P. troglodytes
cagtgggcaggaagaa

SEQ ID NO: 224342 - DNA, 16 bp, P. troglodytes
cagtgggcatccttgt

SEQ ID NO: 224343 - DNA, 17 bp, P. troglodytes
cagtgggcccatgaaca

SEQ ID NO: 224344 - DNA, 16 bp, P. troglodytes
cagtgggctctgccca

SEQ ID NO: 224345 - DNA, 16 bp, P. troglodytes
cagtgggctggagaag

SEQ ID NO: 224346 - DNA, 16 bp, P. troglodytes
cagtggggaagggaaa

SEQ ID NO: 224347 - DNA, 16 bp, P. troglodytes
cagtggggaccctgtg

SEQ ID NO: 224348 - DNA, 16 bp, P. troglodytes
cagtggggctgccaca

SEQ ID NO: 224349 - DNA, 16 bp, P. troglodytes
cagtgggtcacacctg

SEQ ID NO: 224350 - DNA, 16 bp, P. troglodytes
cagtgggtgcagctca

SEQ ID NO: 224351 - DNA, 16 bp, P. troglodytes
cagtgggtgcagtgca

SEQ ID NO: 224352 - DNA, 16 bp, P. troglodytes
cagtgggtgcctgtaa

SEQ ID NO: 224353 - DNA, 16 bp, P. troglodytes
cagtgggtgctcagta

SEQ ID NO: 224354 - DNA, 16 bp, P. troglodytes
cagtggtaacatcttg

SEQ ID NO: 224355 - DNA, 16 bp, P. troglodytes
cagtggtatgattttg

SEQ ID NO: 224356 - DNA, 16 bp, P. troglodytes
cagtggtcccataaga

SEQ ID NO: 224357 - DNA, 16 bp, P. troglodytes
cagtggtccccagcct

SEQ ID NO: 224358 - DNA, 16 bp, P. troglodytes
cagtggtgaaagactg

SEQ ID NO: 224359 - DNA, 16 bp, P. troglodytes
cagtggtgacagtggg

SEQ ID NO: 224360 - DNA, 16 bp, P. troglodytes
cagtggtgacatcccc

SEQ ID NO: 224361 - DNA, 16 bp, P. troglodytes
cagtggtgcaaactca

SEQ ID NO: 224362 - DNA, 16 bp, P. troglodytes
cagtggtgcaatcatg

SEQ ID NO: 224363 - DNA, 16 bp, P. troglodytes
cagtggtgcagtcata

SEQ ID NO: 224364 - DNA, 16 bp, P. troglodytes
cagtggtgccatctct

SEQ ID NO: 224365 - DNA, 16 bp, P. troglodytes
cagtggtggaggtggg

SEQ ID NO: 224366 - DNA, 16 bp, P. troglodytes
cagtggtggtggtggg

SEQ ID NO: 224367 - DNA, 16 bp, P. troglodytes
cagtggttcacacctg

SEQ ID NO: 224368 - DNA, 16 bp, P. troglodytes
cagtggttcacgcctg

SEQ ID NO: 224369 - DNA, 16 bp, P. troglodytes
cagtggttcatgcctg

SEQ ID NO: 224370 - DNA, 16 bp, P. troglodytes
cagtggttctcaaaat

SEQ ID NO: 224371 - DNA, 16 bp, P. troglodytes
cagtggttctcaaact

SEQ ID NO: 224372 - DNA, 16 bp, P. troglodytes
cagtggttctcaacca

SEQ ID NO: 224373 - DNA, 16 bp, P. troglodytes
cagtggttctcagagt

SEQ ID NO: 224374 - DNA, 16 bp, P. troglodytes
cagtggttggaacttg

SEQ ID NO: 224375 - DNA, 16 bp, P. troglodytes
cagtggtttaaaacaa

SEQ ID NO: 224376 - DNA, 17 bp, P. troglodytes
cagtggtttctagttct

SEQ ID NO: 224377 - DNA, 16 bp, P. troglodytes
cagtggttttcaaact

SEQ ID NO: 224378 - DNA, 16 bp, P. troglodytes
cagtgtaaaagtgctc

SEQ ID NO: 224379 - DNA, 16 bp, P. troglodytes
cagtgtaaaatgttcc

SEQ ID NO: 224380 - DNA, 16 bp, P. troglodytes
cagtgtacagcagcag

SEQ ID NO: 224381 - DNA, 16 bp, P. troglodytes
cagtgtatactgctca

SEQ ID NO: 224382 - DNA, 16 bp, P. troglodytes
cagtgtatccatgctg

SEQ ID NO: 224383 - DNA, 16 bp, P. troglodytes
cagtgtccaggagaca

SEQ ID NO: 224384 - DNA, 16 bp, P. troglodytes
cagtgtcctctggaaa

SEQ ID NO: 224385 - DNA, 16 bp, P. troglodytes
cagtgtctcacacctg

SEQ ID NO: 224386 - DNA, 16 bp, P. troglodytes
cagtgtctcacgcctg

SEQ ID NO: 224387 - DNA, 16 bp, P. troglodytes
cagtgtctcactctgt

SEQ ID NO: 224388 - DNA, 16 bp, P. troglodytes
cagtgtctcatgcctg

SEQ ID NO: 224389 - DNA, 16 bp, P. troglodytes
cagtgtctcttgttcc

SEQ ID NO: 224390 - DNA, 16 bp, P. troglodytes
cagtgtgaaaaaggac

SEQ ID NO: 224391 - DNA, 16 bp, P. troglodytes
cagtgtgaatatactt

SEQ ID NO: 224392 - DNA, 16 bp, P. troglodytes
cagtgtgacaactgcc

SEQ ID NO: 224393 - DNA, 16 bp, P. troglodytes
cagtgtgacctgaatg

SEQ ID NO: 224394 - DNA, 16 bp, P. troglodytes
cagtgtgaccttgagc

SEQ ID NO: 224395 - DNA, 16 bp, P. troglodytes
cagtgtgatctcagct

SEQ ID NO: 224396 - DNA, 16 bp, P. troglodytes
cagtgtggaagaggac

SEQ ID NO: 224397 - DNA, 16 bp, P. troglodytes
cagtgtggaaggggac

SEQ ID NO: 224398 - DNA, 16 bp, P. troglodytes
cagtgtggagattcct

SEQ ID NO: 224399 - DNA, 18 bp, P. troglodytes
cagtgtggcgattcctca

SEQ ID NO: 224400 - DNA, 16 bp, P. troglodytes
cagtgtggctggagca

SEQ ID NO: 224401 - DNA, 16 bp, P. troglodytes
cagtgtggctggaggg

SEQ ID NO: 224402 - DNA, 16 bp, P. troglodytes
cagtgtgggtgggcat

SEQ ID NO: 224403 - DNA, 16 bp, P. troglodytes
cagtgtggtggcacat

SEQ ID NO: 224404 - DNA, 16 bp, P. troglodytes
cagtgtgtagtctttt

SEQ ID NO: 224405 - DNA, 16 bp, P. troglodytes
cagtgtgtgtatgtgt

SEQ ID NO: 224406 - DNA, 16 bp, P. troglodytes
cagtgtgtgtgtgcgt

SEQ ID NO: 224407 - DNA, 16 bp, P. troglodytes
cagtgttagaggtggg

SEQ ID NO: 224408 - DNA, 16 bp, P. troglodytes
cagtgttctttccact

SEQ ID NO: 224409 - DNA, 16 bp, P. troglodytes
cagtgttggaggaagg

SEQ ID NO: 224410 - DNA, 16 bp, P. troglodytes
cagtgttggaggagga

SEQ ID NO: 224411 - DNA, 17 bp, P. troglodytes
cagtgttgggattacag

SEQ ID NO: 224412 - DNA, 16 bp, P. troglodytes
cagtgttgggattata

SEQ ID NO: 224413 - DNA, 16 bp, P. troglodytes
cagtgtttcactgtgt

SEQ ID NO: 224414 - DNA, 16 bp, P. troglodytes
cagtgtttccaaactg

SEQ ID NO: 224415 - DNA, 16 bp, P. troglodytes
cagtgtttctcaaaat

SEQ ID NO: 224416 - DNA, 16 bp, P. troglodytes
cagtgtttgttgaatg

SEQ ID NO: 224417 - DNA, 16 bp, P. troglodytes
cagtgttttatacttt

SEQ ID NO: 224418 - DNA, 16 bp, P. troglodytes
cagtgttttgtagctc

SEQ ID NO: 224419 - DNA, 16 bp, P. troglodytes
cagtgtttttgttttg

SEQ ID NO: 224420 - DNA, 16 bp, P. troglodytes
cagttaaaatggttta

SEQ ID NO: 224421 - DNA, 16 bp, P. troglodytes
cagttaaatttttttt

SEQ ID NO: 224422 - DNA, 16 bp, P. troglodytes
cagttaacacaatcat

SEQ ID NO: 224423 - DNA, 16 bp, P. troglodytes
cagttaagaaccactg

SEQ ID NO: 224424 - DNA, 16 bp, P. troglodytes
cagttacctgtggtca

SEQ ID NO: 224425 - DNA, 16 bp, P. troglodytes
cagttactttttaaaa

SEQ ID NO: 224426 - DNA, 16 bp, P. troglodytes
cagttagacaggatga

SEQ ID NO: 224427 - DNA, 16 bp, P. troglodytes
cagttagccaagttgt

SEQ ID NO: 224428 - DNA, 17 bp, P. troglodytes
cagttatccggaggcct

SEQ ID NO: 224429 - DNA, 16 bp, P. troglodytes
cagttatttatttatt

SEQ ID NO: 224430 - DNA, 16 bp, P. troglodytes
cagttcaaacccgtgt

SEQ ID NO: 224431 - DNA, 16 bp, P. troglodytes
cagttcaacatggctg

SEQ ID NO: 224432 - DNA, 16 bp, P. troglodytes
cagttcaagtccaaag

SEQ ID NO: 224433 - DNA, 16 bp, P. troglodytes
cagttcagaaaaaaaa

SEQ ID NO: 224434 - DNA, 16 bp, P. troglodytes
cagttcaggctgctgt

SEQ ID NO: 224435 - DNA, 16 bp, P. troglodytes
cagttcatctcactgg

SEQ ID NO: 224436 - DNA, 16 bp, P. troglodytes
cagttccagaatttct

SEQ ID NO: 224437 - DNA, 16 bp, P. troglodytes
cagttccaggagcttt

SEQ ID NO: 224438 - DNA, 16 bp, P. troglodytes
cagttccatccatgtt

SEQ ID NO: 224439 - DNA, 16 bp, P. troglodytes
cagttcccaacaagtt

SEQ ID NO: 224440 - DNA, 16 bp, P. troglodytes
cagttcccagacgggg

SEQ ID NO: 224441 - DNA, 16 bp, P. troglodytes
cagttccccagcaaag

SEQ ID NO: 224442 - DNA, 17 bp, P. troglodytes
cagttcctcaccagcaa

SEQ ID NO: 224443 - DNA, 16 bp, P. troglodytes
cagttcctcagtcaca

SEQ ID NO: 224444 - DNA, 16 bp, P. troglodytes
cagttcctgggccaaa

SEQ ID NO: 224445 - DNA, 16 bp, P. troglodytes
cagttccttaaaataa

SEQ ID NO: 224446 - DNA, 16 bp, P. troglodytes
cagttctacgtggctg

SEQ ID NO: 224447 - DNA, 16 bp, P. troglodytes
cagttctcagatctcc

SEQ ID NO: 224448 - DNA, 16 bp, P. troglodytes
cagttctccaaagaag

SEQ ID NO: 224449 - DNA, 16 bp, P. troglodytes
cagttctgcaagctcc

SEQ ID NO: 224450 - DNA, 16 bp, P. troglodytes
cagttctgcagggtgt

SEQ ID NO: 224451 - DNA, 16 bp, P. troglodytes
cagttctgcttttagc

SEQ ID NO: 224452 - DNA, 16 bp, P. troglodytes
cagttctggagcctgg

SEQ ID NO: 224453 - DNA, 16 bp, P. troglodytes
cagttctggagttcag

SEQ ID NO: 224454 - DNA, 16 bp, P. troglodytes
cagttctgtgaatttt

SEQ ID NO: 224455 - DNA, 16 bp, P. troglodytes
cagttctgttttaagt

SEQ ID NO: 224456 - DNA, 16 bp, P. troglodytes
cagttcttccagcacc

SEQ ID NO: 224457 - DNA, 16 bp, P. troglodytes
cagttcttgaggctgg

SEQ ID NO: 224458 - DNA, 16 bp, P. troglodytes
cagttctttgggaggc

SEQ ID NO: 224459 - DNA, 16 bp, P. troglodytes
cagttgaaaatctgtg

SEQ ID NO: 224460 - DNA, 16 bp, P. troglodytes
cagttgacccttgagc

SEQ ID NO: 224461 - DNA, 16 bp, P. troglodytes
cagttgactcttcctt

SEQ ID NO: 224462 - DNA, 16 bp, P. troglodytes
cagttgatccacctgc

SEQ ID NO: 224463 - DNA, 16 bp, P. troglodytes
cagttgatgctgaaaa

SEQ ID NO: 224464 - DNA, 16 bp, P. troglodytes
cagttgctcacacctg

SEQ ID NO: 224465 - DNA, 16 bp, P. troglodytes
cagttggagcttccca

SEQ ID NO: 224466 - DNA, 16 bp, P. troglodytes
cagttggctgttaagt

SEQ ID NO: 224467 - DNA, 16 bp, P. troglodytes
cagttgtcctccaaaa

SEQ ID NO: 224468 - DNA, 16 bp, P. troglodytes
cagttgttaaacattt

SEQ ID NO: 224469 - DNA, 16 bp, P. troglodytes
cagtttaaaacttatg

SEQ ID NO: 224470 - DNA, 16 bp, P. troglodytes
cagtttaaagaagaac

SEQ ID NO: 224471 - DNA, 16 bp, P. troglodytes
cagtttaaatgataat

SEQ ID NO: 224472 - DNA, 16 bp, P. troglodytes
cagtttaagaaaaaaa

SEQ ID NO: 224473 - DNA, 16 bp, P. troglodytes
cagtttaagttttctg

SEQ ID NO: 224474 - DNA, 16 bp, P. troglodytes
cagtttatagatgagg

SEQ ID NO: 224475 - DNA, 16 bp, P. troglodytes
cagtttatgcagaaat

SEQ ID NO: 224476 - DNA, 17 bp, P. troglodytes
cagtttattgagagttt

SEQ ID NO: 224477 - DNA, 16 bp, P. troglodytes
cagtttcaaaaaaaaa

SEQ ID NO: 224478 - DNA, 16 bp, P. troglodytes
cagtttcacttttgtt

SEQ ID NO: 224479 - DNA, 16 bp, P. troglodytes
cagtttcagaatttct

SEQ ID NO: 224480 - DNA, 16 bp, P. troglodytes
cagtttcaggtagtat

SEQ ID NO: 224481 - DNA, 16 bp, P. troglodytes
cagtttcattattcta

SEQ ID NO: 224482 - DNA, 16 bp, P. troglodytes
cagtttccccacctgt

SEQ ID NO: 224483 - DNA, 16 bp, P. troglodytes
cagtttcccctatgct

SEQ ID NO: 224484 - DNA, 16 bp, P. troglodytes
cagtttcctcctcagt

SEQ ID NO: 224485 - DNA, 16 bp, P. troglodytes
cagtttctcacctgta

SEQ ID NO: 224486 - DNA, 16 bp, P. troglodytes
cagtttctcagaaaga

SEQ ID NO: 224487 - DNA, 16 bp, P. troglodytes
cagtttctccatctgt

SEQ ID NO: 224488 - DNA, 16 bp, P. troglodytes
cagtttctggtatttt

SEQ ID NO: 224489 - DNA, 16 bp, P. troglodytes
cagtttcttaaaatgt

SEQ ID NO: 224490 - DNA, 16 bp, P. troglodytes
cagtttcttcattaga

SEQ ID NO: 224491 - DNA, 16 bp, P. troglodytes
cagtttcttcatttgt

SEQ ID NO: 224492 - DNA, 16 bp, P. troglodytes
cagtttctttatctgc

SEQ ID NO: 224493 - DNA, 16 bp, P. troglodytes
cagtttgaaaaatatt

SEQ ID NO: 224494 - DNA, 16 bp, P. troglodytes
cagtttgacttcctct

SEQ ID NO: 224495 - DNA, 17 bp, P. troglodytes
cagtttgagactagcct

SEQ ID NO: 224496 - DNA, 16 bp, P. troglodytes
cagtttgcctgggact

SEQ ID NO: 224497 - DNA, 16 bp, P. troglodytes
cagtttgctcagaatg

SEQ ID NO: 224498 - DNA, 16 bp, P. troglodytes
cagtttggaaggctca

SEQ ID NO: 224499 - DNA, 16 bp, P. troglodytes
cagtttggatatttct

SEQ ID NO: 224500 - DNA, 16 bp, P. troglodytes
cagtttggcgatttct

SEQ ID NO: 224501 - DNA, 16 bp, P. troglodytes
cagtttgggaagatgg

SEQ ID NO: 224502 - DNA, 16 bp, P. troglodytes
cagtttgggtgacaga

SEQ ID NO: 224503 - DNA, 16 bp, P. troglodytes
cagtttgtgataattt

SEQ ID NO: 224504 - DNA, 16 bp, P. troglodytes
cagtttgtttctttct

SEQ ID NO: 224505 - DNA, 16 bp, P. troglodytes
cagttttaaaaatatt

SEQ ID NO: 224506 - DNA, 16 bp, P. troglodytes
cagttttaaattttat

SEQ ID NO: 224507 - DNA, 16 bp, P. troglodytes
cagttttagttttctg

SEQ ID NO: 224508 - DNA, 16 bp, P. troglodytes
cagttttataaatatt

SEQ ID NO: 224509 - DNA, 16 bp, P. troglodytes
cagttttatacatttt

SEQ ID NO: 224510 - DNA, 16 bp, P. troglodytes
cagttttatatttata

SEQ ID NO: 224511 - DNA, 16 bp, P. troglodytes
cagttttcaaaaagaa

SEQ ID NO: 224512 - DNA, 16 bp, P. troglodytes
cagttttcacatctgt

SEQ ID NO: 224513 - DNA, 16 bp, P. troglodytes
cagttttcataagtaa

SEQ ID NO: 224514 - DNA, 16 bp, P. troglodytes
cagttttccttctgtt

SEQ ID NO: 224515 - DNA, 16 bp, P. troglodytes
cagttttctcatttat

SEQ ID NO: 224516 - DNA, 16 bp, P. troglodytes
cagttttctcatttgt

SEQ ID NO: 224517 - DNA, 16 bp, P. troglodytes
cagttttcttttgatt

SEQ ID NO: 224518 - DNA, 16 bp, P. troglodytes
cagttttgaaaaagaa

SEQ ID NO: 224519 - DNA, 16 bp, P. troglodytes
cagttttgagtgaatt

SEQ ID NO: 224520 - DNA, 16 bp, P. troglodytes
cagttttgcctttttc

SEQ ID NO: 224521 - DNA, 16 bp, P. troglodytes
cagttttggaggctga

SEQ ID NO: 224522 - DNA, 16 bp, P. troglodytes
cagttttggaggctgg

SEQ ID NO: 224523 - DNA, 16 bp, P. troglodytes
cagttttggaggttgg

SEQ ID NO: 224524 - DNA, 16 bp, P. troglodytes
cagttttgttttaaaa

SEQ ID NO: 224525 - DNA, 16 bp, P. troglodytes
cagtttttaaaaaaaa

SEQ ID NO: 224526 - DNA, 16 bp, P. troglodytes
cagtttttaaaataat

SEQ ID NO: 224527 - DNA, 16 bp, P. troglodytes
cagtttttatagtttt

SEQ ID NO: 224528 - DNA, 16 bp, P. troglodytes
cagtttttccaggtgc

SEQ ID NO: 224529 - DNA, 16 bp, P. troglodytes
cagtttttcctcattt

SEQ ID NO: 224530 - DNA, 16 bp, P. troglodytes
cagtttttcttttgct

SEQ ID NO: 224531 - DNA, 16 bp, P. troglodytes
cagtttttgcttttct

SEQ ID NO: 224532 - DNA, 16 bp, P. troglodytes
cagttttttaaaaaat

SEQ ID NO: 224533 - DNA, 16 bp, P. troglodytes
cagttttttgcccatt

SEQ ID NO: 224534 - DNA, 16 bp, P. troglodytes
cagttttttttaaaaa

SEQ ID NO: 224535 - DNA, 16 bp, P. troglodytes
cataaaaaatggaaag

SEQ ID NO: 224536 - DNA, 16 bp, P. troglodytes
cataaaaaggaatgca

SEQ ID NO: 224537 - DNA, 16 bp, P. troglodytes
cataaaaatacacagg

SEQ ID NO: 224538 - DNA, 16 bp, P. troglodytes
cataaaaatgaatgag

SEQ ID NO: 224539 - DNA, 16 bp, P. troglodytes
cataaaaatgttcata

SEQ ID NO: 224540 - DNA, 16 bp, P. troglodytes
cataaaaatttgaaaa

SEQ ID NO: 224541 - DNA, 16 bp, P. troglodytes
cataaaacaaccagaa

SEQ ID NO: 224542 - DNA, 16 bp, P. troglodytes
cataaaacatgttttt

SEQ ID NO: 224543 - DNA, 16 bp, P. troglodytes
cataaaagaagacata

SEQ ID NO: 224544 - DNA, 16 bp, P. troglodytes
cataaaagcaatgaaa

SEQ ID NO: 224545 - DNA, 16 bp, P. troglodytes
cataaaagttcagaaa

SEQ ID NO: 224546 - DNA, 16 bp, P. troglodytes
cataaaagtttggaaa

SEQ ID NO: 224547 - DNA, 16 bp, P. troglodytes
cataaaatagaatgaa

SEQ ID NO: 224548 - DNA, 16 bp, P. troglodytes
cataaaatgtatttct

SEQ ID NO: 224549 - DNA, 16 bp, P. troglodytes
cataaaatgttttctt

SEQ ID NO: 224550 - DNA, 16 bp, P. troglodytes
cataaacagaaccagt

SEQ ID NO: 224551 - DNA, 16 bp, P. troglodytes
cataaacatacgtgtg

SEQ ID NO: 224552 - DNA, 16 bp, P. troglodytes
cataaactaggtattg

SEQ ID NO: 224553 - DNA, 16 bp, P. troglodytes
cataaactttcctctt

SEQ ID NO: 224554 - DNA, 16 bp, P. troglodytes
cataaagaaagttctt

SEQ ID NO: 224555 - DNA, 16 bp, P. troglodytes
cataaagacaaacata

SEQ ID NO: 224556 - DNA, 16 bp, P. troglodytes
cataaagcaggcagaa

SEQ ID NO: 224557 - DNA, 16 bp, P. troglodytes
cataaataacctgatg

SEQ ID NO: 224558 - DNA, 16 bp, P. troglodytes
cataaatagacatttt

SEQ ID NO: 224559 - DNA, 16 bp, P. troglodytes
cataaatagctgttat

SEQ ID NO: 224560 - DNA, 16 bp, P. troglodytes
cataaatgaattttat

SEQ ID NO: 224561 - DNA, 16 bp, P. troglodytes
cataaatgtgttcttt

SEQ ID NO: 224562 - DNA, 16 bp, P. troglodytes
cataaattatttgaaa

SEQ ID NO: 224563 - DNA, 16 bp, P. troglodytes
cataaattatttggaa

SEQ ID NO: 224564 - DNA, 16 bp, P. troglodytes
cataaatttgatattt

SEQ ID NO: 224565 - DNA, 16 bp, P. troglodytes
cataacaaagaagttt

SEQ ID NO: 224566 - DNA, 18 bp, P. troglodytes
cataacaatattaacttt

SEQ ID NO: 224567 - DNA, 16 bp, P. troglodytes
cataacataaaagtgc

SEQ ID NO: 224568 - DNA, 16 bp, P. troglodytes
cataaccatttttccc

SEQ ID NO: 224569 - DNA, 16 bp, P. troglodytes
cataacctatgaatga

SEQ ID NO: 224570 - DNA, 16 bp, P. troglodytes
cataagacaagaaata

SEQ ID NO: 224571 - DNA, 16 bp, P. troglodytes
cataagaccctcattt

SEQ ID NO: 224572 - DNA, 16 bp, P. troglodytes
cataagagaattcata

SEQ ID NO: 224573 - DNA, 16 bp, P. troglodytes
cataagattataatac

SEQ ID NO: 224574 - DNA, 16 bp, P. troglodytes
cataagcaggagttga

SEQ ID NO: 224575 - DNA, 16 bp, P. troglodytes
cataaggagcgtgcaa

SEQ ID NO: 224576 - DNA, 16 bp, P. troglodytes
cataagtgaaatcata

SEQ ID NO: 224577 - DNA, 16 bp, P. troglodytes
cataataaaagattaa

SEQ ID NO: 224578 - DNA, 16 bp, P. troglodytes
cataatagccaaaaac

SEQ ID NO: 224579 - DNA, 16 bp, P. troglodytes
cataatatcctccagg

SEQ ID NO: 224580 - DNA, 16 bp, P. troglodytes
cataatattctcttat

SEQ ID NO: 224581 - DNA, 16 bp, P. troglodytes
cataatattgagcaaa

SEQ ID NO: 224582 - DNA, 16 bp, P. troglodytes
cataatcccagctact

SEQ ID NO: 224583 - DNA, 16 bp, P. troglodytes
cataatcctcctggga

SEQ ID NO: 224584 - DNA, 17 bp, P. troglodytes
cataatgacaggaccaa

SEQ ID NO: 224585 - DNA, 16 bp, P. troglodytes
cataatgacttctttt

SEQ ID NO: 224586 - DNA, 16 bp, P. troglodytes
cataatgagacaccat

SEQ ID NO: 224587 - DNA, 16 bp, P. troglodytes
cataattagaagtaaa

SEQ ID NO: 224588 - DNA, 16 bp, P. troglodytes
cataattatttcaaat

SEQ ID NO: 224589 - DNA, 16 bp, P. troglodytes
cataattggaagtaaa

SEQ ID NO: 224590 - DNA, 16 bp, P. troglodytes
cataatttatttaact

SEQ ID NO: 224591 - DNA, 16 bp, P. troglodytes
cataattttttaaatg

SEQ ID NO: 224592 - DNA, 16 bp, P. troglodytes
catacaaaaatcaatc

SEQ ID NO: 224593 - DNA, 16 bp, P. troglodytes
catacaaattttaaga

SEQ ID NO: 224594 - DNA, 16 bp, P. troglodytes
catacaactcctaaaa

SEQ ID NO: 224595 - DNA, 16 bp, P. troglodytes
catacacacacacact

SEQ ID NO: 224596 - DNA, 16 bp, P. troglodytes
catacacacacactca

SEQ ID NO: 224597 - DNA, 16 bp, P. troglodytes
catacacacacactcc

SEQ ID NO: 224598 - DNA, 16 bp, P. troglodytes
catacacacacatcct

SEQ ID NO: 224599 - DNA, 16 bp, P. troglodytes
catacacacacatgca

SEQ ID NO: 224600 - DNA, 16 bp, P. troglodytes
catacacacacgcaca

SEQ ID NO: 224601 - DNA, 16 bp, P. troglodytes
catacacacataaata

SEQ ID NO: 224602 - DNA, 16 bp, P. troglodytes
catacacacatacaca

SEQ ID NO: 224603 - DNA, 16 bp, P. troglodytes
catacacacatgcaca

SEQ ID NO: 224604 - DNA, 16 bp, P. troglodytes
catacacagaagaatg

SEQ ID NO: 224605 - DNA, 16 bp, P. troglodytes
catacacagaggaaag

SEQ ID NO: 224606 - DNA, 16 bp, P. troglodytes
catacaccaataacag

SEQ ID NO: 224607 - DNA, 16 bp, P. troglodytes
catacacctgtaatcc

SEQ ID NO: 224608 - DNA, 16 bp, P. troglodytes
catacagaaatattta

SEQ ID NO: 224609 - DNA, 16 bp, P. troglodytes
catacaggagagaaac

SEQ ID NO: 224610 - DNA, 16 bp, P. troglodytes
catacaggtgtttata

SEQ ID NO: 224611 - DNA, 16 bp, P. troglodytes
catacatacatagaca

SEQ ID NO: 224612 - DNA, 16 bp, P. troglodytes
catacatatatgtgtg

SEQ ID NO: 224613 - DNA, 16 bp, P. troglodytes
catacatatgcacaca

SEQ ID NO: 224614 - DNA, 16 bp, P. troglodytes
catacatatgtacata

SEQ ID NO: 224615 - DNA, 16 bp, P. troglodytes
catacatatttttaaa

SEQ ID NO: 224616 - DNA, 16 bp, P. troglodytes
catacatgtacacaca

SEQ ID NO: 224617 - DNA, 16 bp, P. troglodytes
catacatgtgtgtata

SEQ ID NO: 224618 - DNA, 16 bp, P. troglodytes
catacattttactttt

SEQ ID NO: 224619 - DNA, 16 bp, P. troglodytes
catacatttttacatt

SEQ ID NO: 224620 - DNA, 16 bp, P. troglodytes
cataccactgctctcc

SEQ ID NO: 224621 - DNA, 16 bp, P. troglodytes
catacccagctaattt

SEQ ID NO: 224622 - DNA, 16 bp, P. troglodytes
catacccattagcagt

SEQ ID NO: 224623 - DNA, 16 bp, P. troglodytes
cataccccaaactggg

SEQ ID NO: 224624 - DNA, 16 bp, P. troglodytes
catacccgaaactggg

SEQ ID NO: 224625 - DNA, 16 bp, P. troglodytes
catacccggctaattt

SEQ ID NO: 224626 - DNA, 16 bp, P. troglodytes
catacctcaaacctca

SEQ ID NO: 224627 - DNA, 16 bp, P. troglodytes
catacctcattcttcc

SEQ ID NO: 224628 - DNA, 16 bp, P. troglodytes
catacctggctaattt

SEQ ID NO: 224629 - DNA, 16 bp, P. troglodytes
catactccaaactctt

SEQ ID NO: 224630 - DNA, 16 bp, P. troglodytes
catactgaagagaaac

SEQ ID NO: 224631 - DNA, 16 bp, P. troglodytes
catactgatttccttt

SEQ ID NO: 224632 - DNA, 16 bp, P. troglodytes
catactgctaataaag

SEQ ID NO: 224633 - DNA, 16 bp, P. troglodytes
catactggtgagaaac

SEQ ID NO: 224634 - DNA, 16 bp, P. troglodytes
catactgttttccatg

SEQ ID NO: 224635 - DNA, 16 bp, P. troglodytes
catactgtttttcata

SEQ ID NO: 224636 - DNA, 16 bp, P. troglodytes
catacttataatccca

SEQ ID NO: 224637 - DNA, 16 bp, P. troglodytes
catagaaaaagtacag

SEQ ID NO: 224638 - DNA, 16 bp, P. troglodytes
catagaaattggcaaa

SEQ ID NO: 224639 - DNA, 16 bp, P. troglodytes
catagaactgaagaga

SEQ ID NO: 224640 - DNA, 16 bp, P. troglodytes
catagaatatcttttt

SEQ ID NO: 224641 - DNA, 16 bp, P. troglodytes
catagaattggaaaaa

SEQ ID NO: 224642 - DNA, 16 bp, P. troglodytes
catagcaagatctcat

SEQ ID NO: 224643 - DNA, 16 bp, P. troglodytes
catagcagctttattt

SEQ ID NO: 224644 - DNA, 16 bp, P. troglodytes
catagccaaagcaaaa

SEQ ID NO: 224645 - DNA, 16 bp, P. troglodytes
catagcctaggtgtgt

SEQ ID NO: 224646 - DNA, 16 bp, P. troglodytes
catagcctcaaactcc

SEQ ID NO: 224647 - DNA, 16 bp, P. troglodytes
cataggaagaccccca

SEQ ID NO: 224648 - DNA, 18 bp, P. troglodytes
cataggcataggcaagga

SEQ ID NO: 224649 - DNA, 16 bp, P. troglodytes
cataggggaaaaaaaa

SEQ ID NO: 224650 - DNA, 16 bp, P. troglodytes
catagggtgtaaccaa

SEQ ID NO: 224651 - DNA, 16 bp, P. troglodytes
catagggttggaagtt

SEQ ID NO: 224652 - DNA, 16 bp, P. troglodytes
catagtaggccctcag

SEQ ID NO: 224653 - DNA, 16 bp, P. troglodytes
catagtatttcatagt

SEQ ID NO: 224654 - DNA, 16 bp, P. troglodytes
catagtcccagctact

SEQ ID NO: 224655 - DNA, 16 bp, P. troglodytes
catagtcccatatttt

SEQ ID NO: 224656 - DNA, 16 bp, P. troglodytes
catagtgaaacccctt

SEQ ID NO: 224657 - DNA, 16 bp, P. troglodytes
catagtgaaatggtta

SEQ ID NO: 224658 - DNA, 16 bp, P. troglodytes
catagtgagaacccat

SEQ ID NO: 224659 - DNA, 16 bp, P. troglodytes
catagtgagaccccgt

SEQ ID NO: 224660 - DNA, 16 bp, P. troglodytes
catagtgagaccctgg

SEQ ID NO: 224661 - DNA, 16 bp, P. troglodytes
catagtgagacctcaa

SEQ ID NO: 224662 - DNA, 16 bp, P. troglodytes
catagtgcccaaagca

SEQ ID NO: 224663 - DNA, 16 bp, P. troglodytes
catagtggtgtgcgcc

SEQ ID NO: 224664 - DNA, 16 bp, P. troglodytes
catagtggttgtacta

SEQ ID NO: 224665 - DNA, 16 bp, P. troglodytes
catagttaccattttt

SEQ ID NO: 224666 - DNA, 16 bp, P. troglodytes
catagttttaggtttt

SEQ ID NO: 224667 - DNA, 16 bp, P. troglodytes
catataaagaattctt

SEQ ID NO: 224668 - DNA, 16 bp, P. troglodytes
catataaatacataca

SEQ ID NO: 224669 - DNA, 16 bp, P. troglodytes
catataaatatgttat

SEQ ID NO: 224670 - DNA, 16 bp, P. troglodytes
catataaatggactca

SEQ ID NO: 224671 - DNA, 16 bp, P. troglodytes
catataaatgtaataa

SEQ ID NO: 224672 - DNA, 16 bp, P. troglodytes
catataagaaaactga

SEQ ID NO: 224673 - DNA, 16 bp, P. troglodytes
catataatacatattt

SEQ ID NO: 224674 - DNA, 16 bp, P. troglodytes
catataatccagcaat

SEQ ID NO: 224675 - DNA, 16 bp, P. troglodytes
catataattttcatgt

SEQ ID NO: 224676 - DNA, 16 bp, P. troglodytes
catatacacacaaaat

SEQ ID NO: 224677 - DNA, 16 bp, P. troglodytes
catatacacatacaca

SEQ ID NO: 224678 - DNA, 16 bp, P. troglodytes
catatacaccagggaa

SEQ ID NO: 224679 - DNA, 16 bp, P. troglodytes
catatacacgtgtgtg

SEQ ID NO: 224680 - DNA, 16 bp, P. troglodytes
catatacatatatatg

SEQ ID NO: 224681 - DNA, 16 bp, P. troglodytes
catatacatgtgtata

SEQ ID NO: 224682 - DNA, 16 bp, P. troglodytes
catataccaaaatcca

SEQ ID NO: 224683 - DNA, 16 bp, P. troglodytes
catataccatacaatt

SEQ ID NO: 224684 - DNA, 16 bp, P. troglodytes
catatagtgaaaccct

SEQ ID NO: 224685 - DNA, 17 bp, P. troglodytes
catatatacacatatac

SEQ ID NO: 224686 - DNA, 16 bp, P. troglodytes
catatatacagatata

SEQ ID NO: 224687 - DNA, 16 bp, P. troglodytes
catatataccatagaa

SEQ ID NO: 224688 - DNA, 16 bp, P. troglodytes
catatatactatatac

SEQ ID NO: 224689 - DNA, 16 bp, P. troglodytes
catatatagcatatat

SEQ ID NO: 224690 - DNA, 17 bp, P. troglodytes
catatatatacacatat

SEQ ID NO: 224691 - DNA, 16 bp, P. troglodytes
catatatatatatatc

SEQ ID NO: 224692 - DNA, 16 bp, P. troglodytes
catatatatatttgtg

SEQ ID NO: 224693 - DNA, 16 bp, P. troglodytes
catatatatcatatat

SEQ ID NO: 224694 - DNA, 16 bp, P. troglodytes
catatatatgataaag

SEQ ID NO: 224695 - DNA, 16 bp, P. troglodytes
catatatatgataagg

SEQ ID NO: 224696 - DNA, 16 bp, P. troglodytes
catatatatgctatat

SEQ ID NO: 224697 - DNA, 16 bp, P. troglodytes
catatatatgtctttt

SEQ ID NO: 224698 - DNA, 16 bp, P. troglodytes
catatatatgttattt

SEQ ID NO: 224699 - DNA, 16 bp, P. troglodytes
catatatatttagcat

SEQ ID NO: 224700 - DNA, 16 bp, P. troglodytes
catatatatttgtata

SEQ ID NO: 224701 - DNA, 16 bp, P. troglodytes
catatatcaaatcatc

SEQ ID NO: 224702 - DNA, 16 bp, P. troglodytes
catatatgcatacatt

SEQ ID NO: 224703 - DNA, 16 bp, P. troglodytes
catatatgtaatttaa

SEQ ID NO: 224704 - DNA, 16 bp, P. troglodytes
catatatgtatataca

SEQ ID NO: 224705 - DNA, 16 bp, P. troglodytes
catatatgtgtgcata

SEQ ID NO: 224706 - DNA, 16 bp, P. troglodytes
catatattaacatata

SEQ ID NO: 224707 - DNA, 16 bp, P. troglodytes
catatattgaagtcct

SEQ ID NO: 224708 - DNA, 16 bp, P. troglodytes
catatatttaaaatac

SEQ ID NO: 224709 - DNA, 16 bp, P. troglodytes
catatatttcatttct

SEQ ID NO: 224710 - DNA, 16 bp, P. troglodytes
catatattttatgaat

SEQ ID NO: 224711 - DNA, 16 bp, P. troglodytes
catatccaaaccatag

SEQ ID NO: 224712 - DNA, 16 bp, P. troglodytes
catatcctcattcttc

SEQ ID NO: 224713 - DNA, 16 bp, P. troglodytes
catatctgcagttact

SEQ ID NO: 224714 - DNA, 16 bp, P. troglodytes
catatctgtcacctca

SEQ ID NO: 224715 - DNA, 16 bp, P. troglodytes
catatcttcctgtctt

SEQ ID NO: 224716 - DNA, 16 bp, P. troglodytes
catatctttgtttctc

SEQ ID NO: 224717 - DNA, 16 bp, P. troglodytes
catatgaaaaaaacct

SEQ ID NO: 224718 - DNA, 16 bp, P. troglodytes
catatgaaaaaaatgc

SEQ ID NO: 224719 - DNA, 16 bp, P. troglodytes
catatgaaaaaatact

SEQ ID NO: 224720 - DNA, 16 bp, P. troglodytes
catatgaaaaaatcct

SEQ ID NO: 224721 - DNA, 16 bp, P. troglodytes
catatgaaaaaatggt

SEQ ID NO: 224722 - DNA, 16 bp, P. troglodytes
catatgaacttcaaag

SEQ ID NO: 224723 - DNA, 16 bp, P. troglodytes
catatgacccaggaat

SEQ ID NO: 224724 - DNA, 16 bp, P. troglodytes
catatgagaaaactga

SEQ ID NO: 224725 - DNA, 16 bp, P. troglodytes
catatgagaagatgct

SEQ ID NO: 224726 - DNA, 16 bp, P. troglodytes
catatgatccagaaat

SEQ ID NO: 224727 - DNA, 16 bp, P. troglodytes
catatgattttttttc

SEQ ID NO: 224728 - DNA, 16 bp, P. troglodytes
catatgcaaataaata

SEQ ID NO: 224729 - DNA, 16 bp, P. troglodytes
catatgcagaagaaaa

SEQ ID NO: 224730 - DNA, 16 bp, P. troglodytes
catatgcgcacacaca

SEQ ID NO: 224731 - DNA, 16 bp, P. troglodytes
catatgctgaggagaa

SEQ ID NO: 224732 - DNA, 16 bp, P. troglodytes
catatgcttattagcc

SEQ ID NO: 224733 - DNA, 16 bp, P. troglodytes
catatggtttttggtt

SEQ ID NO: 224734 - DNA, 16 bp, P. troglodytes
catatgtaaatatgta

SEQ ID NO: 224735 - DNA, 16 bp, P. troglodytes
catatgtataaatata

SEQ ID NO: 224736 - DNA, 16 bp, P. troglodytes
catatgtatatatatt

SEQ ID NO: 224737 - DNA, 16 bp, P. troglodytes
catatgtatatttata

SEQ ID NO: 224738 - DNA, 16 bp, P. troglodytes
catatgtattagtctg

SEQ ID NO: 224739 - DNA, 16 bp, P. troglodytes
catatgtatttatatg

SEQ ID NO: 224740 - DNA, 16 bp, P. troglodytes
catatgtccacaaaaa

SEQ ID NO: 224741 - DNA, 16 bp, P. troglodytes
catatgtggaagccct

SEQ ID NO: 224742 - DNA, 16 bp, P. troglodytes
catatgtgtatatata

SEQ ID NO: 224743 - DNA, 16 bp, P. troglodytes
catatgtgtatgtatg

SEQ ID NO: 224744 - DNA, 16 bp, P. troglodytes
catatgtgtatgtgtg

SEQ ID NO: 224745 - DNA, 16 bp, P. troglodytes
catatgtgtgcgtgtg

SEQ ID NO: 224746 - DNA, 16 bp, P. troglodytes
catatgtgtgtgtctg

SEQ ID NO: 224747 - DNA, 16 bp, P. troglodytes
catatgttattttttg

SEQ ID NO: 224748 - DNA, 16 bp, P. troglodytes
catatgttgaaatcct

SEQ ID NO: 224749 - DNA, 16 bp, P. troglodytes
catatgtttatatatt

SEQ ID NO: 224750 - DNA, 16 bp, P. troglodytes
catatgtttctcattc

SEQ ID NO: 224751 - DNA, 16 bp, P. troglodytes
catattactgtactga

SEQ ID NO: 224752 - DNA, 16 bp, P. troglodytes
catattatataatatg

SEQ ID NO: 224753 - DNA, 16 bp, P. troglodytes
catattcaagaaatca

SEQ ID NO: 224754 - DNA, 16 bp, P. troglodytes
catattcctcatttgg

SEQ ID NO: 224755 - DNA, 16 bp, P. troglodytes
catattctcaccagca

SEQ ID NO: 224756 - DNA, 31 bp, P. troglodytes
catattctcactcataggtgggaattgaaca

SEQ ID NO: 224757 - DNA, 16 bp, P. troglodytes
catattctcacttgta

SEQ ID NO: 224758 - DNA, 16 bp, P. troglodytes
catattctgaatttta

SEQ ID NO: 224759 - DNA, 16 bp, P. troglodytes
catattctttgcagca

SEQ ID NO: 224760 - DNA, 16 bp, P. troglodytes
catattgactaaattc

SEQ ID NO: 224761 - DNA, 16 bp, P. troglodytes
catattgctttatttt

SEQ ID NO: 224762 - DNA, 16 bp, P. troglodytes
catattggaatcacct

SEQ ID NO: 224763 - DNA, 16 bp, P. troglodytes
catattggcaaggctg

SEQ ID NO: 224764 - DNA, 16 bp, P. troglodytes
catattgttttccaca

SEQ ID NO: 224765 - DNA, 16 bp, P. troglodytes
catatttacacacaca

SEQ ID NO: 224766 - DNA, 16 bp, P. troglodytes
catatttagtattttt

SEQ ID NO: 224767 - DNA, 16 bp, P. troglodytes
catatttatatatgta

SEQ ID NO: 224768 - DNA, 16 bp, P. troglodytes
catatttatgtatatt

SEQ ID NO: 224769 - DNA, 16 bp, P. troglodytes
catatttatgtgtgtg

SEQ ID NO: 224770 - DNA, 16 bp, P. troglodytes
catatttctactaaca

SEQ ID NO: 224771 - DNA, 16 bp, P. troglodytes
catatttcttggagtc

SEQ ID NO: 224772 - DNA, 16 bp, P. troglodytes
catatttgcattttta

SEQ ID NO: 224773 - DNA, 16 bp, P. troglodytes
catatttgtaaaatga

SEQ ID NO: 224774 - DNA, 16 bp, P. troglodytes
catatttgtgtatgtg

SEQ ID NO: 224775 - DNA, 16 bp, P. troglodytes
catattttgaaaatat

SEQ ID NO: 224776 - DNA, 16 bp, P. troglodytes
catattttgaaccatc

SEQ ID NO: 224777 - DNA, 16 bp, P. troglodytes
catattttgtttattc

SEQ ID NO: 224778 - DNA, 16 bp, P. troglodytes
catatttttaacaaaa

SEQ ID NO: 224779 - DNA, 16 bp, P. troglodytes
catatttttaatgaaa

SEQ ID NO: 224780 - DNA, 16 bp, P. troglodytes
catatttttatatgaa

SEQ ID NO: 224781 - DNA, 16 bp, P. troglodytes
catatttttgttgttg

SEQ ID NO: 224782 - DNA, 16 bp, P. troglodytes
catcaaaaagaagttt

SEQ ID NO: 224783 - DNA, 16 bp, P. troglodytes
catcaaaaagaggaaa

SEQ ID NO: 224784 - DNA, 16 bp, P. troglodytes
catcaaaaagatgaaa

SEQ ID NO: 224785 - DNA, 16 bp, P. troglodytes
catcaaaattattttt

SEQ ID NO: 224786 - DNA, 16 bp, P. troglodytes
catcaacaaaaaagac

SEQ ID NO: 224787 - DNA, 16 bp, P. troglodytes
catcaacagataaata

SEQ ID NO: 224788 - DNA, 16 bp, P. troglodytes
catcaacatttttaaa

SEQ ID NO: 224789 - DNA, 16 bp, P. troglodytes
catcaagaagaataaa

SEQ ID NO: 224790 - DNA, 16 bp, P. troglodytes
catcaagaagcttatc

SEQ ID NO: 224791 - DNA, 16 bp, P. troglodytes
catcaagacaatggga

SEQ ID NO: 224792 - DNA, 16 bp, P. troglodytes
catcaagaccatccag

SEQ ID NO: 224793 - DNA, 16 bp, P. troglodytes
catcaagccactgcac

SEQ ID NO: 224794 - DNA, 40 bp, P. troglodytes
catcaagctaccaatgactttcttcacagaattggaaaaa

SEQ ID NO: 224795 - DNA, 16 bp, P. troglodytes
catcaagtacattcac

SEQ ID NO: 224796 - DNA, 16 bp, P. troglodytes
catcaagtgatctgcc

SEQ ID NO: 224797 - DNA, 16 bp, P. troglodytes
catcaatatttatcag

SEQ ID NO: 224798 - DNA, 16 bp, P. troglodytes
catcaatgataaactg

SEQ ID NO: 224799 - DNA, 18 bp, P. troglodytes
catcaatgatagactgga

SEQ ID NO: 224800 - DNA, 16 bp, P. troglodytes
catcaatgtaaaaatc

SEQ ID NO: 224801 - DNA, 16 bp, P. troglodytes
catcaatgtcttcttt

SEQ ID NO: 224802 - DNA, 16 bp, P. troglodytes
catcaatttttttaaa

SEQ ID NO: 224803 - DNA, 16 bp, P. troglodytes
catcacaaaggagttt

SEQ ID NO: 224804 - DNA, 16 bp, P. troglodytes
catcacaccacctgac

SEQ ID NO: 224805 - DNA, 16 bp, P. troglodytes
catcacacctggataa

SEQ ID NO: 224806 - DNA, 16 bp, P. troglodytes
catcacactccagcct

SEQ ID NO: 224807 - DNA, 16 bp, P. troglodytes
catcacactgtacccc

SEQ ID NO: 224808 - DNA, 16 bp, P. troglodytes
catcacagccttcttg

SEQ ID NO: 224809 - DNA, 16 bp, P. troglodytes
catcacagctcactgc

SEQ ID NO: 224810 - DNA, 16 bp, P. troglodytes
catcacagggagacag

SEQ ID NO: 224811 - DNA, 16 bp, P. troglodytes
catcacagggatgaag

SEQ ID NO: 224812 - DNA, 16 bp, P. troglodytes
catcacataaacagaa

SEQ ID NO: 224813 - DNA, 16 bp, P. troglodytes
catcacatcaacagaa

SEQ ID NO: 224814 - DNA, 16 bp, P. troglodytes
catcacatgaggtcag

SEQ ID NO: 224815 - DNA, 16 bp, P. troglodytes
catcaccaccattatc

SEQ ID NO: 224816 - DNA, 16 bp, P. troglodytes
catcaccactccctaa

SEQ ID NO: 224817 - DNA, 16 bp, P. troglodytes
catcaccactgccacc

SEQ ID NO: 224818 - DNA, 16 bp, P. troglodytes
catcaccagcatctgt

SEQ ID NO: 224819 - DNA, 16 bp, P. troglodytes
catcaccaggctggag

SEQ ID NO: 224820 - DNA, 16 bp, P. troglodytes
catcaccatcatcttc

SEQ ID NO: 224821 - DNA, 16 bp, P. troglodytes
catcaccgtcatcatc

SEQ ID NO: 224822 - DNA, 16 bp, P. troglodytes
catcacctcacccggg

SEQ ID NO: 224823 - DNA, 16 bp, P. troglodytes
catcacctgacattcc

SEQ ID NO: 224824 - DNA, 16 bp, P. troglodytes
catcacctgggaactt

SEQ ID NO: 224825 - DNA, 16 bp, P. troglodytes
catcacgccactgcac

SEQ ID NO: 224826 - DNA, 20 bp, P. troglodytes
catcacgcccagctaatttt

SEQ ID NO: 224827 - DNA, 16 bp, P. troglodytes
catcactgcagaaagt

SEQ ID NO: 224828 - DNA, 18 bp, P. troglodytes
catcactggccatcagag

SEQ ID NO: 224829 - DNA, 17 bp, P. troglodytes
catcactggctatcaga

SEQ ID NO: 224830 - DNA, 16 bp, P. troglodytes
catcactgtactccag

SEQ ID NO: 224831 - DNA, 16 bp, P. troglodytes
catcacttgggaactt

SEQ ID NO: 224832 - DNA, 16 bp, P. troglodytes
catcagaaggaagaaa

SEQ ID NO: 224833 - DNA, 16 bp, P. troglodytes
catcagaagggacaga

SEQ ID NO: 224834 - DNA, 16 bp, P. troglodytes
catcagaatcacatgg

SEQ ID NO: 224835 - DNA, 16 bp, P. troglodytes
catcagaatcactggg

SEQ ID NO: 224836 - DNA, 16 bp, P. troglodytes
catcagaatcacttgg

SEQ ID NO: 224837 - DNA, 22 bp, P. troglodytes
catcagaatgaacaggcaacct

SEQ ID NO: 224838 - DNA, 16 bp, P. troglodytes
catcagaatttccttc

SEQ ID NO: 224839 - DNA, 16 bp, P. troglodytes
catcagagaaatgaaa

SEQ ID NO: 224840 - DNA, 16 bp, P. troglodytes
catcagagaatccata

SEQ ID NO: 224841 - DNA, 16 bp, P. troglodytes
catcagagaattcaca

SEQ ID NO: 224842 - DNA, 16 bp, P. troglodytes
catcagagaattcata

SEQ ID NO: 224843 - DNA, 16 bp, P. troglodytes
catcagagtgaacagg

SEQ ID NO: 224844 - DNA, 22 bp, P. troglodytes
catcagagtgaacaggcaaccc

SEQ ID NO: 224845 - DNA, 22 bp, P. troglodytes
catcagagtgaacaggcaacct

SEQ ID NO: 224846 - DNA, 16 bp, P. troglodytes
catcagagttcttggg

SEQ ID NO: 224847 - DNA, 16 bp, P. troglodytes
catcagcaccatccat

SEQ ID NO: 224848 - DNA, 16 bp, P. troglodytes
catcagcacttgctgc

SEQ ID NO: 224849 - DNA, 16 bp, P. troglodytes
catcagcagatgaatg

SEQ ID NO: 224850 - DNA, 16 bp, P. troglodytes
catcagcagcagcagc

SEQ ID NO: 224851 - DNA, 16 bp, P. troglodytes
catcagcatcacctag

SEQ ID NO: 224852 - DNA, 16 bp, P. troglodytes
catcagcatcacctgg

SEQ ID NO: 224853 - DNA, 16 bp, P. troglodytes
catcagcatcagcatc

SEQ ID NO: 224854 - DNA, 16 bp, P. troglodytes
catcagcattccttcc

SEQ ID NO: 224855 - DNA, 16 bp, P. troglodytes
catcagcctaatggct

SEQ ID NO: 224856 - DNA, 16 bp, P. troglodytes
catcagctctcctggg

SEQ ID NO: 224857 - DNA, 16 bp, P. troglodytes
catcagggaaatggaa

SEQ ID NO: 224858 - DNA, 16 bp, P. troglodytes
catcagggatgttggc

SEQ ID NO: 224859 - DNA, 16 bp, P. troglodytes
catcagtaaaataaaa

SEQ ID NO: 224860 - DNA, 16 bp, P. troglodytes
catcataaagaagttt

SEQ ID NO: 224861 - DNA, 16 bp, P. troglodytes
catcatataaacagaa

SEQ ID NO: 224862 - DNA, 16 bp, P. troglodytes
catcatcaccggccat

SEQ ID NO: 224863 - DNA, 16 bp, P. troglodytes
catcatcactggttat

SEQ ID NO: 224864 - DNA, 16 bp, P. troglodytes
catcatcaggctgcaa

SEQ ID NO: 224865 - DNA, 16 bp, P. troglodytes
catcatcatcaccatc

SEQ ID NO: 224866 - DNA, 16 bp, P. troglodytes
catcatcatcatcatt

SEQ ID NO: 224867 - DNA, 16 bp, P. troglodytes
catcatcatcatctca

SEQ ID NO: 224868 - DNA, 16 bp, P. troglodytes
catcatcatcatctct

SEQ ID NO: 224869 - DNA, 16 bp, P. troglodytes
catcatcatcattctt

SEQ ID NO: 224870 - DNA, 16 bp, P. troglodytes
catcatcatcattgtt

SEQ ID NO: 224871 - DNA, 16 bp, P. troglodytes
catcatcatctctcac

SEQ ID NO: 224872 - DNA, 16 bp, P. troglodytes
catcatcctcatcatc

SEQ ID NO: 224873 - DNA, 16 bp, P. troglodytes
catcatctcatttgat

SEQ ID NO: 224874 - DNA, 16 bp, P. troglodytes
catcatctccagcatc

SEQ ID NO: 224875 - DNA, 16 bp, P. troglodytes
catcatctctctctct

SEQ ID NO: 224876 - DNA, 16 bp, P. troglodytes
catcatcttcagcaaa

SEQ ID NO: 224877 - DNA, 16 bp, P. troglodytes
catcatcttcatcatc

SEQ ID NO: 224878 - DNA, 16 bp, P. troglodytes
catcatctttaagaac

SEQ ID NO: 224879 - DNA, 16 bp, P. troglodytes
catcatctttgtaagc

SEQ ID NO: 224880 - DNA, 16 bp, P. troglodytes
catcatgagaaaaaaa

SEQ ID NO: 224881 - DNA, 16 bp, P. troglodytes
catcatgatgctagct

SEQ ID NO: 224882 - DNA, 16 bp, P. troglodytes
catcatgccctgctaa

SEQ ID NO: 224883 - DNA, 16 bp, P. troglodytes
catcatgcctggccat

SEQ ID NO: 224884 - DNA, 16 bp, P. troglodytes
catcatggaaaatggg

SEQ ID NO: 224885 - DNA, 16 bp, P. troglodytes
catcatggaacctgcc

SEQ ID NO: 224886 - DNA, 16 bp, P. troglodytes
catcatggagaatgga

SEQ ID NO: 224887 - DNA, 16 bp, P. troglodytes
catcatggtgaaaccc

SEQ ID NO: 224888 - DNA, 16 bp, P. troglodytes
catcatggtgaaatcc

SEQ ID NO: 224889 - DNA, 16 bp, P. troglodytes
catcatgtcctccagg

SEQ ID NO: 224890 - DNA, 16 bp, P. troglodytes
catcattaatgcctct

SEQ ID NO: 224891 - DNA, 16 bp, P. troglodytes
catcattattttatgt

SEQ ID NO: 224892 - DNA, 16 bp, P. troglodytes
catcattccaaaaaga

SEQ ID NO: 224893 - DNA, 16 bp, P. troglodytes
catcattctactctct

SEQ ID NO: 224894 - DNA, 20 bp, P. troglodytes
catcattctcagtaaactat

SEQ ID NO: 224895 - DNA, 16 bp, P. troglodytes
catcattgtcatcatc

SEQ ID NO: 224896 - DNA, 16 bp, P. troglodytes
catcattttgggaggc

SEQ ID NO: 224897 - DNA, 16 bp, P. troglodytes
catcatttttaaaaat

SEQ ID NO: 224898 - DNA, 16 bp, P. troglodytes
catccaaaagaataaa

SEQ ID NO: 224899 - DNA, 16 bp, P. troglodytes
catccaaataggaaaa

SEQ ID NO: 224900 - DNA, 16 bp, P. troglodytes
catccaaattagaaaa

SEQ ID NO: 224901 - DNA, 16 bp, P. troglodytes
catccaaatttgaaag

SEQ ID NO: 224902 - DNA, 16 bp, P. troglodytes
catccaagttgttgca

SEQ ID NO: 224903 - DNA, 16 bp, P. troglodytes
catccacaccaaaatc

SEQ ID NO: 224904 - DNA, 16 bp, P. troglodytes
catccacatcctgctg

SEQ ID NO: 224905 - DNA, 16 bp, P. troglodytes
catccacattgttgca

SEQ ID NO: 224906 - DNA, 16 bp, P. troglodytes
catccacctatccacc

SEQ ID NO: 224907 - DNA, 16 bp, P. troglodytes
catccacctcccaggt

SEQ ID NO: 224908 - DNA, 16 bp, P. troglodytes
catccacctctgcctc

SEQ ID NO: 224909 - DNA, 16 bp, P. troglodytes
catccactgatgaaca

SEQ ID NO: 224910 - DNA, 16 bp, P. troglodytes
catccagaaaagaagt

SEQ ID NO: 224911 - DNA, 16 bp, P. troglodytes
catccagaaacaaagc

SEQ ID NO: 224912 - DNA, 16 bp, P. troglodytes
catccagaccccagaa

SEQ ID NO: 224913 - DNA, 16 bp, P. troglodytes
catccagactggagtg

SEQ ID NO: 224914 - DNA, 19 bp, P. troglodytes
catccagcctgggcaacag

SEQ ID NO: 224915 - DNA, 16 bp, P. troglodytes
catccaggagccaagg

SEQ ID NO: 224916 - DNA, 16 bp, P. troglodytes
catccaggagtttcca

SEQ ID NO: 224917 - DNA, 16 bp, P. troglodytes
catccaggctggggtg

SEQ ID NO: 224918 - DNA, 16 bp, P. troglodytes
catccaggctggtctc

SEQ ID NO: 224919 - DNA, 16 bp, P. troglodytes
catccagggcatgctg

SEQ ID NO: 224920 - DNA, 16 bp, P. troglodytes
catccagtcctgggct

SEQ ID NO: 224921 - DNA, 16 bp, P. troglodytes
catccagttaaatttg

SEQ ID NO: 224922 - DNA, 16 bp, P. troglodytes
catccatccatctgtc

SEQ ID NO: 224923 - DNA, 16 bp, P. troglodytes
catccatccctccatt

SEQ ID NO: 224924 - DNA, 16 bp, P. troglodytes
catccatctgtccgtc

SEQ ID NO: 224925 - DNA, 16 bp, P. troglodytes
catccatgtccctcca

SEQ ID NO: 224926 - DNA, 16 bp, P. troglodytes
catccattcttccatc

SEQ ID NO: 224927 - DNA, 16 bp, P. troglodytes
catccatttatccatt

SEQ ID NO: 224928 - DNA, 16 bp, P. troglodytes
catcccagagaggcac

SEQ ID NO: 224929 - DNA, 16 bp, P. troglodytes
catcccagattcaagc

SEQ ID NO: 224930 - DNA, 16 bp, P. troglodytes
catcccagcactttga

SEQ ID NO: 224931 - DNA, 18 bp, P. troglodytes
catcccagcactttggga

SEQ ID NO: 224932 - DNA, 16 bp, P. troglodytes
catcccagccactcta

SEQ ID NO: 224933 - DNA, 16 bp, P. troglodytes
catcccagggccaggt

SEQ ID NO: 224934 - DNA, 16 bp, P. troglodytes
catcccagggtctcca

SEQ ID NO: 224935 - DNA, 16 bp, P. troglodytes
catccccaaaacacat

SEQ ID NO: 224936 - DNA, 16 bp, P. troglodytes
catcccccaccagagt

SEQ ID NO: 224937 - DNA, 16 bp, P. troglodytes
catcccccttctggct

SEQ ID NO: 224938 - DNA, 16 bp, P. troglodytes
catcccctttccagct

SEQ ID NO: 224939 - DNA, 16 bp, P. troglodytes
catccctacaaaaaat

SEQ ID NO: 224940 - DNA, 16 bp, P. troglodytes
catccctgaaggacag

SEQ ID NO: 224941 - DNA, 16 bp, P. troglodytes
catccctgggatacaa

SEQ ID NO: 224942 - DNA, 16 bp, P. troglodytes
catccctgtcctgtgc

SEQ ID NO: 224943 - DNA, 16 bp, P. troglodytes
catccctgtcttctgc

SEQ ID NO: 224944 - DNA, 16 bp, P. troglodytes
catccctgtggctttg

SEQ ID NO: 224945 - DNA, 16 bp, P. troglodytes
catcccttgtaaggtg

SEQ ID NO: 224946 - DNA, 16 bp, P. troglodytes
catcccttgtaagttg

SEQ ID NO: 224947 - DNA, 16 bp, P. troglodytes
catccgcctgccttgg

SEQ ID NO: 224948 - DNA, 17 bp, P. troglodytes
catccggaggcctaaac

SEQ ID NO: 224949 - DNA, 16 bp, P. troglodytes
catccgggctggagtg

SEQ ID NO: 224950 - DNA, 16 bp, P. troglodytes
catccgtccgtccatc

SEQ ID NO: 224951 - DNA, 16 bp, P. troglodytes
catcctaggaataaag

SEQ ID NO: 224952 - DNA, 16 bp, P. troglodytes
catcctcaccagcact

SEQ ID NO: 224953 - DNA, 16 bp, P. troglodytes
catcctcagcaaactg

SEQ ID NO: 224954 - DNA, 16 bp, P. troglodytes
catcctcatcaacatt

SEQ ID NO: 224955 - DNA, 16 bp, P. troglodytes
catcctcatcaccatc

SEQ ID NO: 224956 - DNA, 16 bp, P. troglodytes
catcctccaggcccca

SEQ ID NO: 224957 - DNA, 16 bp, P. troglodytes
catcctcccaaagtgt

SEQ ID NO: 224958 - DNA, 16 bp, P. troglodytes
catcctcccaagcagc

SEQ ID NO: 224959 - DNA, 16 bp, P. troglodytes
catcctccccagcatc

SEQ ID NO: 224960 - DNA, 16 bp, P. troglodytes
catcctcccgccttgg

SEQ ID NO: 224961 - DNA, 16 bp, P. troglodytes
catcctcctcctcctg

SEQ ID NO: 224962 - DNA, 16 bp, P. troglodytes
catcctcctgcttcag

SEQ ID NO: 224963 - DNA, 16 bp, P. troglodytes
catcctcctgggctca

SEQ ID NO: 224964 - DNA, 16 bp, P. troglodytes
catcctctacagcatc

SEQ ID NO: 224965 - DNA, 16 bp, P. troglodytes
catcctctccaacacc

SEQ ID NO: 224966 - DNA, 16 bp, P. troglodytes
catcctgaagcagctg

SEQ ID NO: 224967 - DNA, 16 bp, P. troglodytes
catcctgatttcagag

SEQ ID NO: 224968 - DNA, 16 bp, P. troglodytes
catcctgcagtgcaca

SEQ ID NO: 224969 - DNA, 16 bp, P. troglodytes
catcctggaaaaggca

SEQ ID NO: 224970 - DNA, 16 bp, P. troglodytes
catcctggccagcatg

SEQ ID NO: 224971 - DNA, 22 bp, P. troglodytes
catcctggctaacaaggtgaaa

SEQ ID NO: 224972 - DNA, 16 bp, P. troglodytes
catcctgggttcaagc

SEQ ID NO: 224973 - DNA, 16 bp, P. troglodytes
catcctgtatttttat

SEQ ID NO: 224974 - DNA, 16 bp, P. troglodytes
catccttaccagcatt

SEQ ID NO: 224975 - DNA, 16 bp, P. troglodytes
catccttcaaaaccca

SEQ ID NO: 224976 - DNA, 16 bp, P. troglodytes
catccttcaagtctgt

SEQ ID NO: 224977 - DNA, 16 bp, P. troglodytes
catccttccatccatc

SEQ ID NO: 224978 - DNA, 16 bp, P. troglodytes
catccttctcttcctg

SEQ ID NO: 224979 - DNA, 16 bp, P. troglodytes
catccttgccttcttc

SEQ ID NO: 224980 - DNA, 16 bp, P. troglodytes
catccttgtcttattc

SEQ ID NO: 224981 - DNA, 16 bp, P. troglodytes
catcctttcattttca

SEQ ID NO: 224982 - DNA, 16 bp, P. troglodytes
catccttttactttga

SEQ ID NO: 224983 - DNA, 16 bp, P. troglodytes
catccttttcaataaa

SEQ ID NO: 224984 - DNA, 16 bp, P. troglodytes
catcgtcatcatcatt

SEQ ID NO: 224985 - DNA, 18 bp, P. troglodytes
catcgtctcagccccaaa

SEQ ID NO: 224986 - DNA, 16 bp, P. troglodytes
catcgtgcccagcccc

SEQ ID NO: 224987 - DNA, 16 bp, P. troglodytes
catcgtggccaacatg

SEQ ID NO: 224988 - DNA, 16 bp, P. troglodytes
catctacaaagaccct

SEQ ID NO: 224989 - DNA, 16 bp, P. troglodytes
catctacctcagcctc

SEQ ID NO: 224990 - DNA, 16 bp, P. troglodytes
catctataaaatggga

SEQ ID NO: 224991 - DNA, 16 bp, P. troglodytes
catctatattcatgag

SEQ ID NO: 224992 - DNA, 16 bp, P. troglodytes
catctattatgtatca

SEQ ID NO: 224993 - DNA, 16 bp, P. troglodytes
catctattgtttcctg

SEQ ID NO: 224994 - DNA, 16 bp, P. troglodytes
catctcaaaaagaaaa

SEQ ID NO: 224995 - DNA, 16 bp, P. troglodytes
catctcaaaacaaaat

SEQ ID NO: 224996 - DNA, 16 bp, P. troglodytes
catctcaaaagaaaat

SEQ ID NO: 224997 - DNA, 16 bp, P. troglodytes
catctcaaaataaaac

SEQ ID NO: 224998 - DNA, 16 bp, P. troglodytes
catctcaaagaaaaat

SEQ ID NO: 224999 - DNA, 16 bp, P. troglodytes
catctcaaagaaataa

SEQ ID NO: 225000 - DNA, 16 bp, P. troglodytes
catctcaaattatttt

SEQ ID NO: 225001 - DNA, 16 bp, P. troglodytes
catctcaacactttgg

SEQ ID NO: 225002 - DNA, 16 bp, P. troglodytes
catctcaataaacaca

SEQ ID NO: 225003 - DNA, 16 bp, P. troglodytes
catctcaatttttaaa

SEQ ID NO: 225004 - DNA, 22 bp, P. troglodytes
catctcacaccagttagaatgg

SEQ ID NO: 225005 - DNA, 16 bp, P. troglodytes
catctcacatgcaaaa

SEQ ID NO: 225006 - DNA, 16 bp, P. troglodytes
catctcaccccagtta

SEQ ID NO: 225007 - DNA, 16 bp, P. troglodytes
catctcagaagaaaaa

SEQ ID NO: 225008 - DNA, 16 bp, P. troglodytes
catctcagacaatggg

SEQ ID NO: 225009 - DNA, 16 bp, P. troglodytes
catctcagagaaaaaa

SEQ ID NO: 225010 - DNA, 16 bp, P. troglodytes
catctcagatgatggg

SEQ ID NO: 225011 - DNA, 16 bp, P. troglodytes
catctcagcatcctga

SEQ ID NO: 225012 - DNA, 16 bp, P. troglodytes
catctcagctactcag

SEQ ID NO: 225013 - DNA, 16 bp, P. troglodytes
catctcaggctctgct

SEQ ID NO: 225014 - DNA, 16 bp, P. troglodytes
catctcagggcaaagc

SEQ ID NO: 225015 - DNA, 16 bp, P. troglodytes
catctcaggggaaaaa

SEQ ID NO: 225016 - DNA, 16 bp, P. troglodytes
catctcattttacaga

SEQ ID NO: 225017 - DNA, 16 bp, P. troglodytes
catctccaaacaaaca

SEQ ID NO: 225018 - DNA, 16 bp, P. troglodytes
catctccaaatatcat

SEQ ID NO: 225019 - DNA, 16 bp, P. troglodytes
catctccagaactttt

SEQ ID NO: 225020 - DNA, 16 bp, P. troglodytes
catctccagacattgc

SEQ ID NO: 225021 - DNA, 16 bp, P. troglodytes
catctccagcatctgt

SEQ ID NO: 225022 - DNA, 16 bp, P. troglodytes
catctccagcctgggc

SEQ ID NO: 225023 - DNA, 16 bp, P. troglodytes
catctccatcagagct

SEQ ID NO: 225024 - DNA, 16 bp, P. troglodytes
catctcccagtttcaa

SEQ ID NO: 225025 - DNA, 16 bp, P. troglodytes
catctcctgggagctt

SEQ ID NO: 225026 - DNA, 16 bp, P. troglodytes
catctccttggtgatg

SEQ ID NO: 225027 - DNA, 16 bp, P. troglodytes
catctcgaaaacaaaa

SEQ ID NO: 225028 - DNA, 16 bp, P. troglodytes
catctcggatcactgc

SEQ ID NO: 225029 - DNA, 16 bp, P. troglodytes
catctctaaaaagaaa

SEQ ID NO: 225030 - DNA, 16 bp, P. troglodytes
catctctaaataaaat

SEQ ID NO: 225031 - DNA, 16 bp, P. troglodytes
catctctacaaaaata

SEQ ID NO: 225032 - DNA, 16 bp, P. troglodytes
catctctacaaaacac

SEQ ID NO: 225033 - DNA, 16 bp, P. troglodytes
catctctacaacaaat

SEQ ID NO: 225034 - DNA, 16 bp, P. troglodytes
catctctaccagaaaa

SEQ ID NO: 225035 - DNA, 16 bp, P. troglodytes
catctctactgaaaaa

SEQ ID NO: 225036 - DNA, 16 bp, P. troglodytes
catctctacttaaaat

SEQ ID NO: 225037 - DNA, 16 bp, P. troglodytes
catctctatttttaaa

SEQ ID NO: 225038 - DNA, 16 bp, P. troglodytes
catctctctcttgctc

SEQ ID NO: 225039 - DNA, 16 bp, P. troglodytes
catctctgacttcttt

SEQ ID NO: 225040 - DNA, 16 bp, P. troglodytes
catctctgcctctgtc

SEQ ID NO: 225041 - DNA, 16 bp, P. troglodytes
catctctgctgaaaat

SEQ ID NO: 225042 - DNA, 16 bp, P. troglodytes
catctctggacctgcc

SEQ ID NO: 225043 - DNA, 16 bp, P. troglodytes
catctctggcctctac

SEQ ID NO: 225044 - DNA, 16 bp, P. troglodytes
catctctgggcttcag

SEQ ID NO: 225045 - DNA, 16 bp, P. troglodytes
catctctggtatgaaa

SEQ ID NO: 225046 - DNA, 16 bp, P. troglodytes
catctctgtggctttg

SEQ ID NO: 225047 - DNA, 16 bp, P. troglodytes
catctcttcccagctc

SEQ ID NO: 225048 - DNA, 16 bp, P. troglodytes
catctctttactttta

SEQ ID NO: 225049 - DNA, 16 bp, P. troglodytes
catctctttattttga

SEQ ID NO: 225050 - DNA, 16 bp, P. troglodytes
catctgaaagaaagaa

SEQ ID NO: 225051 - DNA, 16 bp, P. troglodytes
catctgagacctcatc

SEQ ID NO: 225052 - DNA, 16 bp, P. troglodytes
catctgatgtttgaca

SEQ ID NO: 225053 - DNA, 16 bp, P. troglodytes
catctgcaaacaagga

SEQ ID NO: 225054 - DNA, 16 bp, P. troglodytes
catctgcaaacaggca

SEQ ID NO: 225055 - DNA, 16 bp, P. troglodytes
catctgcaaaccagga

SEQ ID NO: 225056 - DNA, 16 bp, P. troglodytes
catctgcaaataaaga

SEQ ID NO: 225057 - DNA, 16 bp, P. troglodytes
catctgcaagcagaga

SEQ ID NO: 225058 - DNA, 16 bp, P. troglodytes
catctgcagcaacatg

SEQ ID NO: 225059 - DNA, 16 bp, P. troglodytes
catctgcctcagcctc

SEQ ID NO: 225060 - DNA, 16 bp, P. troglodytes
catctgcctcagcttc

SEQ ID NO: 225061 - DNA, 16 bp, P. troglodytes
catctgcctcccaggc

SEQ ID NO: 225062 - DNA, 16 bp, P. troglodytes
catctgcctcctgggc

SEQ ID NO: 225063 - DNA, 16 bp, P. troglodytes
catctgctcagcttcc

SEQ ID NO: 225064 - DNA, 16 bp, P. troglodytes
catctgctgatggaca

SEQ ID NO: 225065 - DNA, 16 bp, P. troglodytes
catctgcttctgggga

SEQ ID NO: 225066 - DNA, 16 bp, P. troglodytes
catctggaaaataaaa

SEQ ID NO: 225067 - DNA, 16 bp, P. troglodytes
catctggaaaatggaa

SEQ ID NO: 225068 - DNA, 16 bp, P. troglodytes
catctggaaaatgggg

SEQ ID NO: 225069 - DNA, 16 bp, P. troglodytes
catctggaatttattt

SEQ ID NO: 225070 - DNA, 16 bp, P. troglodytes
catctggcaggtgccc

SEQ ID NO: 225071 - DNA, 16 bp, P. troglodytes
catctggctacttttt

SEQ ID NO: 225072 - DNA, 16 bp, P. troglodytes
catctggtcctgggct

SEQ ID NO: 225073 - DNA, 16 bp, P. troglodytes
catctggtgagggcct

SEQ ID NO: 225074 - DNA, 16 bp, P. troglodytes
catctggttttggtat

SEQ ID NO: 225075 - DNA, 16 bp, P. troglodytes
catctgtaaaacaggg

SEQ ID NO: 225076 - DNA, 16 bp, P. troglodytes
catctgtaaaacgggg

SEQ ID NO: 225077 - DNA, 16 bp, P. troglodytes
catctgtaaaaggaag

SEQ ID NO: 225078 - DNA, 16 bp, P. troglodytes
catctgtaaaataaat

SEQ ID NO: 225079 - DNA, 16 bp, P. troglodytes
catctgtaaaataaga

SEQ ID NO: 225080 - DNA, 16 bp, P. troglodytes
catctgtaaaatggaa

SEQ ID NO: 225081 - DNA, 16 bp, P. troglodytes
catctgtaaaatggga

SEQ ID NO: 225082 - DNA, 16 bp, P. troglodytes
catctgtaaaatgggt

SEQ ID NO: 225083 - DNA, 16 bp, P. troglodytes
catctgtaacatggga

SEQ ID NO: 225084 - DNA, 16 bp, P. troglodytes
catctgtagaatgggg

SEQ ID NO: 225085 - DNA, 16 bp, P. troglodytes
catctgtagccccagc

SEQ ID NO: 225086 - DNA, 16 bp, P. troglodytes
catctgtataaaaata

SEQ ID NO: 225087 - DNA, 16 bp, P. troglodytes
catctgtatacatgtg

SEQ ID NO: 225088 - DNA, 16 bp, P. troglodytes
catctgtccatccatc

SEQ ID NO: 225089 - DNA, 16 bp, P. troglodytes
catctgtgaaacaggg

SEQ ID NO: 225090 - DNA, 16 bp, P. troglodytes
catctgtgaaatgaaa

SEQ ID NO: 225091 - DNA, 16 bp, P. troglodytes
catctgtgaagtggga

SEQ ID NO: 225092 - DNA, 16 bp, P. troglodytes
catctgtgaagtgggg

SEQ ID NO: 225093 - DNA, 16 bp, P. troglodytes
catctgtgagtgagaa

SEQ ID NO: 225094 - DNA, 16 bp, P. troglodytes
catctgtggaatgggg

SEQ ID NO: 225095 - DNA, 16 bp, P. troglodytes
catctgtggtttcctg

SEQ ID NO: 225096 - DNA, 16 bp, P. troglodytes
catctgtgtatgtgtg

SEQ ID NO: 225097 - DNA, 16 bp, P. troglodytes
catctgtgtgctgtat

SEQ ID NO: 225098 - DNA, 16 bp, P. troglodytes
catctgttaaaaaaaa

SEQ ID NO: 225099 - DNA, 16 bp, P. troglodytes
catctgttaaatgaga

SEQ ID NO: 225100 - DNA, 16 bp, P. troglodytes
catctgttattatttt

SEQ ID NO: 225101 - DNA, 16 bp, P. troglodytes
catctgttgaatgaat

SEQ ID NO: 225102 - DNA, 16 bp, P. troglodytes
catctgttgtttcctc

SEQ ID NO: 225103 - DNA, 16 bp, P. troglodytes
catctgtttatggaca

SEQ ID NO: 225104 - DNA, 16 bp, P. troglodytes
catctgtttcttttta

SEQ ID NO: 225105 - DNA, 16 bp, P. troglodytes
catcttaaaaaaaaga

SEQ ID NO: 225106 - DNA, 16 bp, P. troglodytes
catcttaaaaaagaaa

SEQ ID NO: 225107 - DNA, 16 bp, P. troglodytes
catcttaaaaagaaaa

SEQ ID NO: 225108 - DNA, 16 bp, P. troglodytes
catcttaaaattcata

SEQ ID NO: 225109 - DNA, 16 bp, P. troglodytes
catcttactaaaaata

SEQ ID NO: 225110 - DNA, 16 bp, P. troglodytes
catcttagtgggtgtg

SEQ ID NO: 225111 - DNA, 16 bp, P. troglodytes
catcttcaaggagaac

SEQ ID NO: 225112 - DNA, 16 bp, P. troglodytes
catcttcaccagcatc

SEQ ID NO: 225113 - DNA, 16 bp, P. troglodytes
catcttcaccagcatt

SEQ ID NO: 225114 - DNA, 16 bp, P. troglodytes
catcttcaggctccat

SEQ ID NO: 225115 - DNA, 16 bp, P. troglodytes
catcttcatcatcatc

SEQ ID NO: 225116 - DNA, 16 bp, P. troglodytes
catcttcatttctgcc

SEQ ID NO: 225117 - DNA, 16 bp, P. troglodytes
catcttccagacccca

SEQ ID NO: 225118 - DNA, 16 bp, P. troglodytes
catcttcctgtatact

SEQ ID NO: 225119 - DNA, 16 bp, P. troglodytes
catcttctccagcacc

SEQ ID NO: 225120 - DNA, 16 bp, P. troglodytes
catcttcttccaatat

SEQ ID NO: 225121 - DNA, 16 bp, P. troglodytes
catcttcttttttaaa

SEQ ID NO: 225122 - DNA, 16 bp, P. troglodytes
catcttgaaaaataaa

SEQ ID NO: 225123 - DNA, 16 bp, P. troglodytes
catcttgaataaattt

SEQ ID NO: 225124 - DNA, 16 bp, P. troglodytes
catcttgatcttggat

SEQ ID NO: 225125 - DNA, 16 bp, P. troglodytes
catcttgcaaaactgt

SEQ ID NO: 225126 - DNA, 16 bp, P. troglodytes
catcttgcaaccatga

SEQ ID NO: 225127 - DNA, 16 bp, P. troglodytes
catcttgctcaggctg

SEQ ID NO: 225128 - DNA, 16 bp, P. troglodytes
catcttggaacctccc

SEQ ID NO: 225129 - DNA, 16 bp, P. troglodytes
catcttggaggcagag

SEQ ID NO: 225130 - DNA, 16 bp, P. troglodytes
catcttggatgctaat

SEQ ID NO: 225131 - DNA, 18 bp, P. troglodytes
catcttggctcactgcag

SEQ ID NO: 225132 - DNA, 17 bp, P. troglodytes
catcttggctcattgca

SEQ ID NO: 225133 - DNA, 16 bp, P. troglodytes
catcttggttattgtg

SEQ ID NO: 225134 - DNA, 16 bp, P. troglodytes
catcttgtcccactga

SEQ ID NO: 225135 - DNA, 16 bp, P. troglodytes
catctttaaaaaagaa

SEQ ID NO: 225136 - DNA, 16 bp, P. troglodytes
catctttaaaatattg

SEQ ID NO: 225137 - DNA, 16 bp, P. troglodytes
catctttacttaaaaa

SEQ ID NO: 225138 - DNA, 16 bp, P. troglodytes
catctttataaaaaat

SEQ ID NO: 225139 - DNA, 16 bp, P. troglodytes
catctttatcaaaaat

SEQ ID NO: 225140 - DNA, 16 bp, P. troglodytes
catctttatcagcagc

SEQ ID NO: 225141 - DNA, 16 bp, P. troglodytes
catctttattaaaaat

SEQ ID NO: 225142 - DNA, 16 bp, P. troglodytes
catctttatttgtaat

SEQ ID NO: 225143 - DNA, 16 bp, P. troglodytes
catctttctcccatac

SEQ ID NO: 225144 - DNA, 16 bp, P. troglodytes
catctttgaagcagag

SEQ ID NO: 225145 - DNA, 16 bp, P. troglodytes
catctttgccaacact

SEQ ID NO: 225146 - DNA, 16 bp, P. troglodytes
catctttggaaaatac

SEQ ID NO: 225147 - DNA, 16 bp, P. troglodytes
catcttttagtctttt

SEQ ID NO: 225148 - DNA, 16 bp, P. troglodytes
catcttttattccata

SEQ ID NO: 225149 - DNA, 16 bp, P. troglodytes
catcttttcatttgtt

SEQ ID NO: 225150 - DNA, 16 bp, P. troglodytes
catcttttgtttcctg

SEQ ID NO: 225151 - DNA, 16 bp, P. troglodytes
catgaaaaaaatgttt

SEQ ID NO: 225152 - DNA, 16 bp, P. troglodytes
catgaaaaagaaggaa

SEQ ID NO: 225153 - DNA, 16 bp, P. troglodytes
catgaaaaattaaaat

SEQ ID NO: 225154 - DNA, 16 bp, P. troglodytes
catgaaaacaacattt

SEQ ID NO: 225155 - DNA, 16 bp, P. troglodytes
catgaaaacacacaca

SEQ ID NO: 225156 - DNA, 16 bp, P. troglodytes
catgaaaatgaaagaa

SEQ ID NO: 225157 - DNA, 16 bp, P. troglodytes
catgaaaatggctata

SEQ ID NO: 225158 - DNA, 16 bp, P. troglodytes
catgaaaatgtggaag

SEQ ID NO: 225159 - DNA, 16 bp, P. troglodytes
catgaaaggactcaca

SEQ ID NO: 225160 - DNA, 16 bp, P. troglodytes
catgaaagtggacaag

SEQ ID NO: 225161 - DNA, 16 bp, P. troglodytes
catgaaatactacaca

SEQ ID NO: 225162 - DNA, 16 bp, P. troglodytes
catgaaatatattttt

SEQ ID NO: 225163 - DNA, 16 bp, P. troglodytes
catgaaatatccagaa

SEQ ID NO: 225164 - DNA, 16 bp, P. troglodytes
catgaaatattctcca

SEQ ID NO: 225165 - DNA, 16 bp, P. troglodytes
catgaaatatttaaag

SEQ ID NO: 225166 - DNA, 16 bp, P. troglodytes
catgaaatggacaaat

SEQ ID NO: 225167 - DNA, 16 bp, P. troglodytes
catgaaattaattttt

SEQ ID NO: 225168 - DNA, 16 bp, P. troglodytes
catgaaatttgggcag

SEQ ID NO: 225169 - DNA, 16 bp, P. troglodytes
catgaaatttggtgcc

SEQ ID NO: 225170 - DNA, 16 bp, P. troglodytes
catgaacagacatttt

SEQ ID NO: 225171 - DNA, 16 bp, P. troglodytes
catgaacatgaacatg

SEQ ID NO: 225172 - DNA, 16 bp, P. troglodytes
catgaacatggaatgt

SEQ ID NO: 225173 - DNA, 16 bp, P. troglodytes
catgaacatggtatgt

SEQ ID NO: 225174 - DNA, 16 bp, P. troglodytes
catgaacctggggggc

SEQ ID NO: 225175 - DNA, 16 bp, P. troglodytes
catgaactagaaaatc

SEQ ID NO: 225176 - DNA, 16 bp, P. troglodytes
catgaactcctgggct

SEQ ID NO: 225177 - DNA, 16 bp, P. troglodytes
catgaactgggctggg

SEQ ID NO: 225178 - DNA, 16 bp, P. troglodytes
catgaagaaaccccat

SEQ ID NO: 225179 - DNA, 16 bp, P. troglodytes
catgaagaaattcaaa

SEQ ID NO: 225180 - DNA, 16 bp, P. troglodytes
catgaagaaattgaaa

SEQ ID NO: 225181 - DNA, 16 bp, P. troglodytes
catgaagaagaaataa

SEQ ID NO: 225182 - DNA, 19 bp, P. troglodytes
catgaagcgatgttgaatt

SEQ ID NO: 225183 - DNA, 16 bp, P. troglodytes
catgaaggcaataagg

SEQ ID NO: 225184 - DNA, 16 bp, P. troglodytes
catgaagtccttgcct

SEQ ID NO: 225185 - DNA, 16 bp, P. troglodytes
catgaataagttcaag

SEQ ID NO: 225186 - DNA, 16 bp, P. troglodytes
catgaataagtttttt

SEQ ID NO: 225187 - DNA, 16 bp, P. troglodytes
catgaataatccaccc

SEQ ID NO: 225188 - DNA, 16 bp, P. troglodytes
catgaataattttttt

SEQ ID NO: 225189 - DNA, 20 bp, P. troglodytes
catgaatccgggaggtggag

SEQ ID NO: 225190 - DNA, 16 bp, P. troglodytes
catgaatctactttct

SEQ ID NO: 225191 - DNA, 16 bp, P. troglodytes
catgaatgaacctgga

SEQ ID NO: 225192 - DNA, 16 bp, P. troglodytes
catgaatgatttagca

SEQ ID NO: 225193 - DNA, 16 bp, P. troglodytes
catgaatggattcatg

SEQ ID NO: 225194 - DNA, 16 bp, P. troglodytes
catgaatgtttttaat

SEQ ID NO: 225195 - DNA, 16 bp, P. troglodytes
catgaattaactcatt

SEQ ID NO: 225196 - DNA, 16 bp, P. troglodytes
catgaattatttagaa

SEQ ID NO: 225197 - DNA, 16 bp, P. troglodytes
catgaattcaagacca

SEQ ID NO: 225198 - DNA, 16 bp, P. troglodytes
catgacacccagctaa

SEQ ID NO: 225199 - DNA, 16 bp, P. troglodytes
catgaccaagaagaat

SEQ ID NO: 225200 - DNA, 16 bp, P. troglodytes
catgaccaggaaagat

SEQ ID NO: 225201 - DNA, 17 bp, P. troglodytes
catgaccggctaatttt

SEQ ID NO: 225202 - DNA, 16 bp, P. troglodytes
catgaccttgacagtt

SEQ ID NO: 225203 - DNA, 17 bp, P. troglodytes
catgacgcccagctaat

SEQ ID NO: 225204 - DNA, 16 bp, P. troglodytes
catgactggtgtcctt

SEQ ID NO: 225205 - DNA, 16 bp, P. troglodytes
catgactttgctcctc

SEQ ID NO: 225206 - DNA, 16 bp, P. troglodytes
catgagaacaacacag

SEQ ID NO: 225207 - DNA, 16 bp, P. troglodytes
catgagaacagaccaa

SEQ ID NO: 225208 - DNA, 16 bp, P. troglodytes
catgagaacagcaggg

SEQ ID NO: 225209 - DNA, 16 bp, P. troglodytes
catgagaacttcctca

SEQ ID NO: 225210 - DNA, 16 bp, P. troglodytes
catgagaagaatgtat

SEQ ID NO: 225211 - DNA, 16 bp, P. troglodytes
catgagatcaggagtt

SEQ ID NO: 225212 - DNA, 16 bp, P. troglodytes
catgagatgtttggtt

SEQ ID NO: 225213 - DNA, 16 bp, P. troglodytes
catgagatttcatcac

SEQ ID NO: 225214 - DNA, 16 bp, P. troglodytes
catgagattttggtgg

SEQ ID NO: 225215 - DNA, 16 bp, P. troglodytes
catgagcacacacaca

SEQ ID NO: 225216 - DNA, 16 bp, P. troglodytes
catgagcatggaatga

SEQ ID NO: 225217 - DNA, 16 bp, P. troglodytes
catgagccaaggaatg

SEQ ID NO: 225218 - DNA, 16 bp, P. troglodytes
catgagccaccacatg

SEQ ID NO: 225219 - DNA, 16 bp, P. troglodytes
catgagccaccaccac

SEQ ID NO: 225220 - DNA, 16 bp, P. troglodytes
catgagccaccaccgc

SEQ ID NO: 225221 - DNA, 16 bp, P. troglodytes
catgagccaccactct

SEQ ID NO: 225222 - DNA, 17 bp, P. troglodytes
catgagccaccatgcca

SEQ ID NO: 225223 - DNA, 17 bp, P. troglodytes
catgagccaccgcaccc

SEQ ID NO: 225224 - DNA, 16 bp, P. troglodytes
catgagccactgtgcc

SEQ ID NO: 225225 - DNA, 16 bp, P. troglodytes
catgagcccctgcgcc

SEQ ID NO: 225226 - DNA, 16 bp, P. troglodytes
catgagctcaggagtt

SEQ ID NO: 225227 - DNA, 16 bp, P. troglodytes
catgagctgctgtgcc

SEQ ID NO: 225228 - DNA, 16 bp, P. troglodytes
catgaggaagctgagg

SEQ ID NO: 225229 - DNA, 16 bp, P. troglodytes
catgaggattggaatc

SEQ ID NO: 225230 - DNA, 16 bp, P. troglodytes
catgaggcactgtgcc

SEQ ID NO: 225231 - DNA, 16 bp, P. troglodytes
catgaggcctgtagcc

SEQ ID NO: 225232 - DNA, 16 bp, P. troglodytes
catgagggcagggccc

SEQ ID NO: 225233 - DNA, 16 bp, P. troglodytes
catgaggtatttctcc

SEQ ID NO: 225234 - DNA, 16 bp, P. troglodytes
catgaggttgggagtt

SEQ ID NO: 225235 - DNA, 16 bp, P. troglodytes
catgagtgagccacca

SEQ ID NO: 225236 - DNA, 16 bp, P. troglodytes
catgagtgtgtgtgtg

SEQ ID NO: 225237 - DNA, 16 bp, P. troglodytes
catgagtttatttctg

SEQ ID NO: 225238 - DNA, 16 bp, P. troglodytes
catgagttttggaggg

SEQ ID NO: 225239 - DNA, 16 bp, P. troglodytes
catgatattaaaaaaa

SEQ ID NO: 225240 - DNA, 16 bp, P. troglodytes
catgatcaaattcaca

SEQ ID NO: 225241 - DNA, 22 bp, P. troglodytes
catgatcacaccactgcattcc

SEQ ID NO: 225242 - DNA, 16 bp, P. troglodytes
catgatccaatcacct

SEQ ID NO: 225243 - DNA, 16 bp, P. troglodytes
catgatctcggctcaa

SEQ ID NO: 225244 - DNA, 16 bp, P. troglodytes
catgatctggcctctg

SEQ ID NO: 225245 - DNA, 16 bp, P. troglodytes
catgatctgtccacct

SEQ ID NO: 225246 - DNA, 16 bp, P. troglodytes
catgatcttgcctcac

SEQ ID NO: 225247 - DNA, 16 bp, P. troglodytes
catgatgaacaaaata

SEQ ID NO: 225248 - DNA, 16 bp, P. troglodytes
catgatgaatggaata

SEQ ID NO: 225249 - DNA, 16 bp, P. troglodytes
catgatggtgccattg

SEQ ID NO: 225250 - DNA, 16 bp, P. troglodytes
catgatggtgtgtgcc

SEQ ID NO: 225251 - DNA, 16 bp, P. troglodytes
catgattattattatt

SEQ ID NO: 225252 - DNA, 16 bp, P. troglodytes
catgattctgaggcct

SEQ ID NO: 225253 - DNA, 16 bp, P. troglodytes
catgattggaagcttt

SEQ ID NO: 225254 - DNA, 16 bp, P. troglodytes
catgatttaattcttt

SEQ ID NO: 225255 - DNA, 16 bp, P. troglodytes
catgatttactttctt

SEQ ID NO: 225256 - DNA, 16 bp, P. troglodytes
catgatttcagctcac

SEQ ID NO: 225257 - DNA, 16 bp, P. troglodytes
catgatttcttttctt

SEQ ID NO: 225258 - DNA, 16 bp, P. troglodytes
catgattttaagtttc

SEQ ID NO: 225259 - DNA, 16 bp, P. troglodytes
catgattttatattta

SEQ ID NO: 225260 - DNA, 16 bp, P. troglodytes
catgatttttaaataa

SEQ ID NO: 225261 - DNA, 16 bp, P. troglodytes
catgatttttaaattt

SEQ ID NO: 225262 - DNA, 16 bp, P. troglodytes
catgatttttatttta

SEQ ID NO: 225263 - DNA, 16 bp, P. troglodytes
catgcaaacacacaca

SEQ ID NO: 225264 - DNA, 16 bp, P. troglodytes
catgcaaatacacaca

SEQ ID NO: 225265 - DNA, 16 bp, P. troglodytes
catgcaagaacagatg

SEQ ID NO: 225266 - DNA, 16 bp, P. troglodytes
catgcaagcaagaaga

SEQ ID NO: 225267 - DNA, 16 bp, P. troglodytes
catgcaataaatattt

SEQ ID NO: 225268 - DNA, 16 bp, P. troglodytes
catgcacacacacaga

SEQ ID NO: 225269 - DNA, 16 bp, P. troglodytes
catgcacacacaccac

SEQ ID NO: 225270 - DNA, 16 bp, P. troglodytes
catgcacacacataca

SEQ ID NO: 225271 - DNA, 16 bp, P. troglodytes
catgcacacacatacc

SEQ ID NO: 225272 - DNA, 16 bp, P. troglodytes
catgcacacactcaca

SEQ ID NO: 225273 - DNA, 16 bp, P. troglodytes
catgcacacgtgcaca

SEQ ID NO: 225274 - DNA, 16 bp, P. troglodytes
catgcacagagggaag

SEQ ID NO: 225275 - DNA, 16 bp, P. troglodytes
catgcacatcctcctg

SEQ ID NO: 225276 - DNA, 16 bp, P. troglodytes
catgcacatgtacaca

SEQ ID NO: 225277 - DNA, 16 bp, P. troglodytes
catgcacattttaaaa

SEQ ID NO: 225278 - DNA, 16 bp, P. troglodytes
catgcaccaccatgct

SEQ ID NO: 225279 - DNA, 16 bp, P. troglodytes
catgcacctgtagtct

SEQ ID NO: 225280 - DNA, 16 bp, P. troglodytes
catgcagaaaaataaa

SEQ ID NO: 225281 - DNA, 16 bp, P. troglodytes
catgcagacaggcagg

SEQ ID NO: 225282 - DNA, 16 bp, P. troglodytes
catgcagcccaggatg

SEQ ID NO: 225283 - DNA, 16 bp, P. troglodytes
catgcagtagaaaaga

SEQ ID NO: 225284 - DNA, 16 bp, P. troglodytes
catgcagtcagggagg

SEQ ID NO: 225285 - DNA, 16 bp, P. troglodytes
catgcagttctcctgc

SEQ ID NO: 225286 - DNA, 16 bp, P. troglodytes
catgcatatatataaa

SEQ ID NO: 225287 - DNA, 16 bp, P. troglodytes
catgcatatatatata

SEQ ID NO: 225288 - DNA, 16 bp, P. troglodytes
catgcatgcacatgtg

SEQ ID NO: 225289 - DNA, 16 bp, P. troglodytes
catgcatgcatacaca

SEQ ID NO: 225290 - DNA, 16 bp, P. troglodytes
catgcatgcatgtgtg

SEQ ID NO: 225291 - DNA, 16 bp, P. troglodytes
catgcatgtgcaaata

SEQ ID NO: 225292 - DNA, 17 bp, P. troglodytes
catgcatgtgtgtgcac

SEQ ID NO: 225293 - DNA, 16 bp, P. troglodytes
catgcatgtttatagc

SEQ ID NO: 225294 - DNA, 16 bp, P. troglodytes
catgcattagatattt

SEQ ID NO: 225295 - DNA, 16 bp, P. troglodytes
catgcattagctattt

SEQ ID NO: 225296 - DNA, 16 bp, P. troglodytes
catgcattagctgttt

SEQ ID NO: 225297 - DNA, 16 bp, P. troglodytes
catgcattcattcatt

SEQ ID NO: 225298 - DNA, 16 bp, P. troglodytes
catgcatttatcattt

SEQ ID NO: 225299 - DNA, 16 bp, P. troglodytes
catgcatttgttcatt

SEQ ID NO: 225300 - DNA, 16 bp, P. troglodytes
catgcatttttaaaaa

SEQ ID NO: 225301 - DNA, 16 bp, P. troglodytes
catgccaccacatttg

SEQ ID NO: 225302 - DNA, 16 bp, P. troglodytes
catgccactgctctgc

SEQ ID NO: 225303 - DNA, 16 bp, P. troglodytes
catgccactgtactac

SEQ ID NO: 225304 - DNA, 16 bp, P. troglodytes
catgccaggcatggtg

SEQ ID NO: 225305 - DNA, 16 bp, P. troglodytes
catgcccaactaattt

SEQ ID NO: 225306 - DNA, 16 bp, P. troglodytes
catgcccagccaaaac

SEQ ID NO: 225307 - DNA, 16 bp, P. troglodytes
catgcccagccctatt

SEQ ID NO: 225308 - DNA, 16 bp, P. troglodytes
catgcccagcctatta

SEQ ID NO: 225309 - DNA, 16 bp, P. troglodytes
catgcccagcctcagc

SEQ ID NO: 225310 - DNA, 16 bp, P. troglodytes
catgcccagcctcatg

SEQ ID NO: 225311 - DNA, 16 bp, P. troglodytes
catgcccagcctccag

SEQ ID NO: 225312 - DNA, 16 bp, P. troglodytes
catgcccagcctgaag

SEQ ID NO: 225313 - DNA, 16 bp, P. troglodytes
catgccccagcctcct

SEQ ID NO: 225314 - DNA, 16 bp, P. troglodytes
catgcctaaccctgcc

SEQ ID NO: 225315 - DNA, 16 bp, P. troglodytes
catgcctagctggatt

SEQ ID NO: 225316 - DNA, 16 bp, P. troglodytes
catgcctcaactttct

SEQ ID NO: 225317 - DNA, 16 bp, P. troglodytes
catgcctcattttatt

SEQ ID NO: 225318 - DNA, 16 bp, P. troglodytes
catgcctctgtgcctt

SEQ ID NO: 225319 - DNA, 16 bp, P. troglodytes
catgcctcttcccctt

SEQ ID NO: 225320 - DNA, 16 bp, P. troglodytes
catgcctgagcctcct

SEQ ID NO: 225321 - DNA, 16 bp, P. troglodytes
catgcctgctccctct

SEQ ID NO: 225322 - DNA, 16 bp, P. troglodytes
catgcctggccaagag

SEQ ID NO: 225323 - DNA, 16 bp, P. troglodytes
catgcctggcccattt

SEQ ID NO: 225324 - DNA, 16 bp, P. troglodytes
catgcctggcccctcc

SEQ ID NO: 225325 - DNA, 16 bp, P. troglodytes
catgcctggcctaaaa

SEQ ID NO: 225326 - DNA, 16 bp, P. troglodytes
catgcctggcctaaag

SEQ ID NO: 225327 - DNA, 16 bp, P. troglodytes
catgcctggcctctac

SEQ ID NO: 225328 - DNA, 16 bp, P. troglodytes
catgcctggcttgttt

SEQ ID NO: 225329 - DNA, 16 bp, P. troglodytes
catgcctgggcctccc

SEQ ID NO: 225330 - DNA, 16 bp, P. troglodytes
catgcctggttaattt

SEQ ID NO: 225331 - DNA, 16 bp, P. troglodytes
catgcctgtatcaaaa

SEQ ID NO: 225332 - DNA, 16 bp, P. troglodytes
catgcctgtatcagaa

SEQ ID NO: 225333 - DNA, 16 bp, P. troglodytes
catgcctgtcttccca

SEQ ID NO: 225334 - DNA, 16 bp, P. troglodytes
catgcgccaccatccc

SEQ ID NO: 225335 - DNA, 16 bp, P. troglodytes
catgcgcctgtaatct

SEQ ID NO: 225336 - DNA, 16 bp, P. troglodytes
catgcgtgtgccacca

SEQ ID NO: 225337 - DNA, 16 bp, P. troglodytes
catgctacctgacttg

SEQ ID NO: 225338 - DNA, 16 bp, P. troglodytes
catgctattccctctg

SEQ ID NO: 225339 - DNA, 16 bp, P. troglodytes
catgctatttcctctg

SEQ ID NO: 225340 - DNA, 16 bp, P. troglodytes
catgctcagctaattt

SEQ ID NO: 225341 - DNA, 16 bp, P. troglodytes
catgctcatcatcact

SEQ ID NO: 225342 - DNA, 16 bp, P. troglodytes
catgctcattcattta

SEQ ID NO: 225343 - DNA, 16 bp, P. troglodytes
catgctccttatgaga

SEQ ID NO: 225344 - DNA, 16 bp, P. troglodytes
catgctcggctaattt

SEQ ID NO: 225345 - DNA, 16 bp, P. troglodytes
catgctctacaaacaa

SEQ ID NO: 225346 - DNA, 16 bp, P. troglodytes
catgctcttttgatta

SEQ ID NO: 225347 - DNA, 16 bp, P. troglodytes
catgctgacaccttga

SEQ ID NO: 225348 - DNA, 16 bp, P. troglodytes
catgctgcccaggctg

SEQ ID NO: 225349 - DNA, 16 bp, P. troglodytes
catgctgctagtaaag

SEQ ID NO: 225350 - DNA, 16 bp, P. troglodytes
catgctgctgatgaag

SEQ ID NO: 225351 - DNA, 16 bp, P. troglodytes
catgctgctgctctgc

SEQ ID NO: 225352 - DNA, 16 bp, P. troglodytes
catgctggccaagctg

SEQ ID NO: 225353 - DNA, 16 bp, P. troglodytes
catgctggctgcagca

SEQ ID NO: 225354 - DNA, 16 bp, P. troglodytes
catgctgttctcatca

SEQ ID NO: 225355 - DNA, 16 bp, P. troglodytes
catgctgttcttgtga

SEQ ID NO: 225356 - DNA, 16 bp, P. troglodytes
catgcttcctatacag

SEQ ID NO: 225357 - DNA, 16 bp, P. troglodytes
catgcttctctgatcc

SEQ ID NO: 225358 - DNA, 16 bp, P. troglodytes
catgcttggctaattt

SEQ ID NO: 225359 - DNA, 16 bp, P. troglodytes
catgcttggttaattt

SEQ ID NO: 225360 - DNA, 16 bp, P. troglodytes
catggaaaaatgctca

SEQ ID NO: 225361 - DNA, 16 bp, P. troglodytes
catggaaaaattgtct

SEQ ID NO: 225362 - DNA, 16 bp, P. troglodytes
catggaaaacaatttt

SEQ ID NO: 225363 - DNA, 16 bp, P. troglodytes
catggaaaagttcttt

SEQ ID NO: 225364 - DNA, 16 bp, P. troglodytes
catggaaaatgaacaa

SEQ ID NO: 225365 - DNA, 16 bp, P. troglodytes
catggaaaatgtgtat

SEQ ID NO: 225366 - DNA, 16 bp, P. troglodytes
catggaaacagagagt

SEQ ID NO: 225367 - DNA, 16 bp, P. troglodytes
catggaaagatgctca

SEQ ID NO: 225368 - DNA, 16 bp, P. troglodytes
catggaaaggggcagt

SEQ ID NO: 225369 - DNA, 16 bp, P. troglodytes
catggaaataaagaaa

SEQ ID NO: 225370 - DNA, 16 bp, P. troglodytes
catggaacactctcca

SEQ ID NO: 225371 - DNA, 16 bp, P. troglodytes
catggaactgtgcaac

SEQ ID NO: 225372 - DNA, 16 bp, P. troglodytes
catggaagcttccaag

SEQ ID NO: 225373 - DNA, 16 bp, P. troglodytes
catggaataacttttt

SEQ ID NO: 225374 - DNA, 16 bp, P. troglodytes
catggacaaagacttc

SEQ ID NO: 225375 - DNA, 16 bp, P. troglodytes
catggacacaggaagg

SEQ ID NO: 225376 - DNA, 16 bp, P. troglodytes
catggacatagagtgt

SEQ ID NO: 225377 - DNA, 16 bp, P. troglodytes
catggagaaaccccca

SEQ ID NO: 225378 - DNA, 16 bp, P. troglodytes
catggagaaagcccgt

SEQ ID NO: 225379 - DNA, 16 bp, P. troglodytes
catggagaaatctcat

SEQ ID NO: 225380 - DNA, 16 bp, P. troglodytes
catggagaaattggaa

SEQ ID NO: 225381 - DNA, 16 bp, P. troglodytes
catggagacagaaaat

SEQ ID NO: 225382 - DNA, 16 bp, P. troglodytes
catggaggaaggcaag

SEQ ID NO: 225383 - DNA, 16 bp, P. troglodytes
catggaggcagatccc

SEQ ID NO: 225384 - DNA, 16 bp, P. troglodytes
catggaggcagtttcc

SEQ ID NO: 225385 - DNA, 16 bp, P. troglodytes
catggagggcaagctg

SEQ ID NO: 225386 - DNA, 16 bp, P. troglodytes
catggataaagaaaat

SEQ ID NO: 225387 - DNA, 16 bp, P. troglodytes
catggatagaattgga

SEQ ID NO: 225388 - DNA, 16 bp, P. troglodytes
catggatgaaccttga

SEQ ID NO: 225389 - DNA, 16 bp, P. troglodytes
catggatgagttcttt

SEQ ID NO: 225390 - DNA, 16 bp, P. troglodytes
catggatggaaatgga

SEQ ID NO: 225391 - DNA, 16 bp, P. troglodytes
catggatggaactaga

SEQ ID NO: 225392 - DNA, 16 bp, P. troglodytes
catggatggagatgga

SEQ ID NO: 225393 - DNA, 16 bp, P. troglodytes
catggatggcggcagg

SEQ ID NO: 225394 - DNA, 16 bp, P. troglodytes
catggatggctcttat

SEQ ID NO: 225395 - DNA, 16 bp, P. troglodytes
catggattgaaaaaat

SEQ ID NO: 225396 - DNA, 16 bp, P. troglodytes
catggattgaaagaat

SEQ ID NO: 225397 - DNA, 16 bp, P. troglodytes
catggatttttaaaaa

SEQ ID NO: 225398 - DNA, 16 bp, P. troglodytes
catggcaaaaactcat

SEQ ID NO: 225399 - DNA, 16 bp, P. troglodytes
catggcaaaaccccaa

SEQ ID NO: 225400 - DNA, 16 bp, P. troglodytes
catggcaaaaccctgc

SEQ ID NO: 225401 - DNA, 16 bp, P. troglodytes
catggcacatagtagg

SEQ ID NO: 225402 - DNA, 16 bp, P. troglodytes
catggcacatgtatac

SEQ ID NO: 225403 - DNA, 16 bp, P. troglodytes
catggcagaaggagga

SEQ ID NO: 225404 - DNA, 16 bp, P. troglodytes
catggcaggaggcaaa

SEQ ID NO: 225405 - DNA, 16 bp, P. troglodytes
catggcaggccagggt

SEQ ID NO: 225406 - DNA, 16 bp, P. troglodytes
catggccaacatggag

SEQ ID NO: 225407 - DNA, 16 bp, P. troglodytes
catggccaacatggtg

SEQ ID NO: 225408 - DNA, 16 bp, P. troglodytes
catggcccagccaagt

SEQ ID NO: 225409 - DNA, 16 bp, P. troglodytes
catggccctgctgaca

SEQ ID NO: 225410 - DNA, 16 bp, P. troglodytes
catggcctaatcacct

SEQ ID NO: 225411 - DNA, 16 bp, P. troglodytes
catggcctgttaggaa

SEQ ID NO: 225412 - DNA, 16 bp, P. troglodytes
catggcctgttaggag

SEQ ID NO: 225413 - DNA, 16 bp, P. troglodytes
catggccttcttccct

SEQ ID NO: 225414 - DNA, 16 bp, P. troglodytes
catggctccccagtgc

SEQ ID NO: 225415 - DNA, 16 bp, P. troglodytes
catggctgaggaggcc

SEQ ID NO: 225416 - DNA, 16 bp, P. troglodytes
catggctgaggaggtc

SEQ ID NO: 225417 - DNA, 17 bp, P. troglodytes
catggctgcatagtatt

SEQ ID NO: 225418 - DNA, 16 bp, P. troglodytes
catggctggagcagaa

SEQ ID NO: 225419 - DNA, 16 bp, P. troglodytes
catggctggctgattt

SEQ ID NO: 225420 - DNA, 16 bp, P. troglodytes
catggctggggagacc

SEQ ID NO: 225421 - DNA, 16 bp, P. troglodytes
catggctgtgttccag

SEQ ID NO: 225422 - DNA, 16 bp, P. troglodytes
catgggaaagaccagc

SEQ ID NO: 225423 - DNA, 16 bp, P. troglodytes
catgggagaaagatga

SEQ ID NO: 225424 - DNA, 16 bp, P. troglodytes
catgggaggcggaggt

SEQ ID NO: 225425 - DNA, 16 bp, P. troglodytes
catgggagggacctgg

SEQ ID NO: 225426 - DNA, 16 bp, P. troglodytes
catgggagggaggctg

SEQ ID NO: 225427 - DNA, 16 bp, P. troglodytes
catgggaggtgattag

SEQ ID NO: 225428 - DNA, 16 bp, P. troglodytes
catgggcaaaggacat

SEQ ID NO: 225429 - DNA, 16 bp, P. troglodytes
catgggcatggaggac

SEQ ID NO: 225430 - DNA, 16 bp, P. troglodytes
catgggccaccaagcc

SEQ ID NO: 225431 - DNA, 16 bp, P. troglodytes
catgggctcaagcgat

SEQ ID NO: 225432 - DNA, 16 bp, P. troglodytes
catgggctcccagagc

SEQ ID NO: 225433 - DNA, 16 bp, P. troglodytes
catgggctcctgtgcc

SEQ ID NO: 225434 - DNA, 16 bp, P. troglodytes
catgggctttggagtc

SEQ ID NO: 225435 - DNA, 16 bp, P. troglodytes
catggggaaaatgtct

SEQ ID NO: 225436 - DNA, 16 bp, P. troglodytes
catgggggcaggcacc

SEQ ID NO: 225437 - DNA, 16 bp, P. troglodytes
catgggtaactgaaac

SEQ ID NO: 225438 - DNA, 16 bp, P. troglodytes
catgggtgtgtgtgtg

SEQ ID NO: 225439 - DNA, 16 bp, P. troglodytes
catggtaaaaccccat

SEQ ID NO: 225440 - DNA, 16 bp, P. troglodytes
catggtagtgtgcacc

SEQ ID NO: 225441 - DNA, 16 bp, P. troglodytes
catggtatatcttttt

SEQ ID NO: 225442 - DNA, 16 bp, P. troglodytes
catggtcagattctgg

SEQ ID NO: 225443 - DNA, 16 bp, P. troglodytes
catggtcatgccactg

SEQ ID NO: 225444 - DNA, 16 bp, P. troglodytes
catggtctcgaactcc

SEQ ID NO: 225445 - DNA, 16 bp, P. troglodytes
catggtcttgctatgt

SEQ ID NO: 225446 - DNA, 16 bp, P. troglodytes
catggtcttgctttgt

SEQ ID NO: 225447 - DNA, 16 bp, P. troglodytes
catggtgaaaacccca

SEQ ID NO: 225448 - DNA, 18 bp, P. troglodytes
catggtgaaaccccatct

SEQ ID NO: 225449 - DNA, 21 bp, P. troglodytes
catggtgaaaccccatctctg

SEQ ID NO: 225450 - DNA, 16 bp, P. troglodytes
catggtgaaacccccc

SEQ ID NO: 225451 - DNA, 16 bp, P. troglodytes
catggtgaaacccgtc

SEQ ID NO: 225452 - DNA, 21 bp, P. troglodytes
catggtgaaaccctatctcta

SEQ ID NO: 225453 - DNA, 16 bp, P. troglodytes
catggtgaaacgctgt

SEQ ID NO: 225454 - DNA, 16 bp, P. troglodytes
catggtgaggccccat

SEQ ID NO: 225455 - DNA, 16 bp, P. troglodytes
catggtgatgcgcacc

SEQ ID NO: 225456 - DNA, 16 bp, P. troglodytes
catggtgcctggcaca

SEQ ID NO: 225457 - DNA, 16 bp, P. troglodytes
catggtgctgacatct

SEQ ID NO: 225458 - DNA, 16 bp, P. troglodytes
catggtgctgggcacc

SEQ ID NO: 225459 - DNA, 16 bp, P. troglodytes
catggtggaaagagaa

SEQ ID NO: 225460 - DNA, 16 bp, P. troglodytes
catggtggaagaagat

SEQ ID NO: 225461 - DNA, 16 bp, P. troglodytes
catggtggaaggagag

SEQ ID NO: 225462 - DNA, 16 bp, P. troglodytes
catggtggaaggcatc

SEQ ID NO: 225463 - DNA, 16 bp, P. troglodytes
catggtggcaggcgcc

SEQ ID NO: 225464 - DNA, 16 bp, P. troglodytes
catggtggcatctgct

SEQ ID NO: 225465 - DNA, 16 bp, P. troglodytes
catggtggcatggacc

SEQ ID NO: 225466 - DNA, 16 bp, P. troglodytes
catggtggccagtgcc

SEQ ID NO: 225467 - DNA, 16 bp, P. troglodytes
catggtggcgcttgcc

SEQ ID NO: 225468 - DNA, 16 bp, P. troglodytes
catggtggcggacacc

SEQ ID NO: 225469 - DNA, 16 bp, P. troglodytes
catggtggcgggcatc

SEQ ID NO: 225470 - DNA, 16 bp, P. troglodytes
catggtggcgtgcatc

SEQ ID NO: 225471 - DNA, 16 bp, P. troglodytes
catggtggctcaggcc

SEQ ID NO: 225472 - DNA, 16 bp, P. troglodytes
catggtggctctcacc

SEQ ID NO: 225473 - DNA, 16 bp, P. troglodytes
catggtggctgggttc

SEQ ID NO: 225474 - DNA, 16 bp, P. troglodytes
catggtggcttaggcc

SEQ ID NO: 225475 - DNA, 16 bp, P. troglodytes
catggtgggaggcacc

SEQ ID NO: 225476 - DNA, 16 bp, P. troglodytes
catggtggtgcacact

SEQ ID NO: 225477 - DNA, 16 bp, P. troglodytes
catggtggtgcctgcc

SEQ ID NO: 225478 - DNA, 16 bp, P. troglodytes
catggtggtgctcacc

SEQ ID NO: 225479 - DNA, 16 bp, P. troglodytes
catggtggtgggcgcc

SEQ ID NO: 225480 - DNA, 16 bp, P. troglodytes
catggtggtgtgtgcc

SEQ ID NO: 225481 - DNA, 18 bp, P. troglodytes
catggtggtttgctgcat

SEQ ID NO: 225482 - DNA, 16 bp, P. troglodytes
catggtgtaaccccat

SEQ ID NO: 225483 - DNA, 16 bp, P. troglodytes
catggtgtacatgtac

SEQ ID NO: 225484 - DNA, 16 bp, P. troglodytes
catggtgtataagctt

SEQ ID NO: 225485 - DNA, 16 bp, P. troglodytes
catggtgtcaggtgcc

SEQ ID NO: 225486 - DNA, 16 bp, P. troglodytes
catggttctgcagtct

SEQ ID NO: 225487 - DNA, 16 bp, P. troglodytes
catggttctggtacca

SEQ ID NO: 225488 - DNA, 16 bp, P. troglodytes
catggttggaactgga

SEQ ID NO: 225489 - DNA, 16 bp, P. troglodytes
catggttggagctgga

SEQ ID NO: 225490 - DNA, 16 bp, P. troglodytes
catggtttctgaagag

SEQ ID NO: 225491 - DNA, 16 bp, P. troglodytes
catggtttttaaaatt

SEQ ID NO: 225492 - DNA, 16 bp, P. troglodytes
catgtaaaaaatattt

SEQ ID NO: 225493 - DNA, 16 bp, P. troglodytes
catgtaaagcacttag

SEQ ID NO: 225494 - DNA, 16 bp, P. troglodytes
catgtaaagtgctcag

SEQ ID NO: 225495 - DNA, 16 bp, P. troglodytes
catgtaacaaaatatt

SEQ ID NO: 225496 - DNA, 16 bp, P. troglodytes
catgtaaccaccaccc

SEQ ID NO: 225497 - DNA, 16 bp, P. troglodytes
catgtaaccctgaact

SEQ ID NO: 225498 - DNA, 18 bp, P. troglodytes
catgtaagaagtgccttt

SEQ ID NO: 225499 - DNA, 16 bp, P. troglodytes
catgtaagatgtggct

SEQ ID NO: 225500 - DNA, 16 bp, P. troglodytes
catgtaataaatattt

SEQ ID NO: 225501 - DNA, 16 bp, P. troglodytes
catgtacacacacaca

SEQ ID NO: 225502 - DNA, 16 bp, P. troglodytes
catgtacacatacaca

SEQ ID NO: 225503 - DNA, 16 bp, P. troglodytes
catgtaccaccaagcc

SEQ ID NO: 225504 - DNA, 16 bp, P. troglodytes
catgtaccactacgcc

SEQ ID NO: 225505 - DNA, 16 bp, P. troglodytes
catgtagtaggtgctt

SEQ ID NO: 225506 - DNA, 16 bp, P. troglodytes
catgtatatatacaca

SEQ ID NO: 225507 - DNA, 16 bp, P. troglodytes
catgtatatatatgta

SEQ ID NO: 225508 - DNA, 16 bp, P. troglodytes
catgtatatatgtata

SEQ ID NO: 225509 - DNA, 16 bp, P. troglodytes
catgtatatatttatg

SEQ ID NO: 225510 - DNA, 16 bp, P. troglodytes
catgtatatgtgtata

SEQ ID NO: 225511 - DNA, 16 bp, P. troglodytes
catgtatattttacca

SEQ ID NO: 225512 - DNA, 16 bp, P. troglodytes
catgtatattttatat

SEQ ID NO: 225513 - DNA, 16 bp, P. troglodytes
catgtatgcatatgtg

SEQ ID NO: 225514 - DNA, 16 bp, P. troglodytes
catgtatgtgtgtgtg

SEQ ID NO: 225515 - DNA, 16 bp, P. troglodytes
catgtatttaaaaaaa

SEQ ID NO: 225516 - DNA, 16 bp, P. troglodytes
catgtatttatttgtt

SEQ ID NO: 225517 - DNA, 16 bp, P. troglodytes
catgtatttcttcttt

SEQ ID NO: 225518 - DNA, 16 bp, P. troglodytes
catgtatttctttctt

SEQ ID NO: 225519 - DNA, 16 bp, P. troglodytes
catgtattttttcctt

SEQ ID NO: 225520 - DNA, 16 bp, P. troglodytes
catgtcacatggcaag

SEQ ID NO: 225521 - DNA, 16 bp, P. troglodytes
catgtcagagactttt

SEQ ID NO: 225522 - DNA, 16 bp, P. troglodytes
catgtcagagatcttc

SEQ ID NO: 225523 - DNA, 16 bp, P. troglodytes
catgtcatcaccctca

SEQ ID NO: 225524 - DNA, 16 bp, P. troglodytes
catgtcatctgcaaca

SEQ ID NO: 225525 - DNA, 16 bp, P. troglodytes
catgtccttcacagca

SEQ ID NO: 225526 - DNA, 16 bp, P. troglodytes
catgtccttcttacat

SEQ ID NO: 225527 - DNA, 16 bp, P. troglodytes
catgtctcgcctccca

SEQ ID NO: 225528 - DNA, 16 bp, P. troglodytes
catgtctgtgtccaaa

SEQ ID NO: 225529 - DNA, 16 bp, P. troglodytes
catgtctttgcaattg

SEQ ID NO: 225530 - DNA, 16 bp, P. troglodytes
catgtctttgcaggga

SEQ ID NO: 225531 - DNA, 16 bp, P. troglodytes
catgtctttttaaaaa

SEQ ID NO: 225532 - DNA, 16 bp, P. troglodytes
catgtgaaactgtgag

SEQ ID NO: 225533 - DNA, 16 bp, P. troglodytes
catgtgaaatatattt

SEQ ID NO: 225534 - DNA, 16 bp, P. troglodytes
catgtgaagatgaagg

SEQ ID NO: 225535 - DNA, 16 bp, P. troglodytes
catgtgaccttggaca

SEQ ID NO: 225536 - DNA, 16 bp, P. troglodytes
catgtgactgtagtcc

SEQ ID NO: 225537 - DNA, 16 bp, P. troglodytes
catgtgagaaaactga

SEQ ID NO: 225538 - DNA, 16 bp, P. troglodytes
catgtgagatgtgtct

SEQ ID NO: 225539 - DNA, 16 bp, P. troglodytes
catgtgagggatctgg

SEQ ID NO: 225540 - DNA, 16 bp, P. troglodytes
catgtgatagaaaaga

SEQ ID NO: 225541 - DNA, 16 bp, P. troglodytes
catgtgatccaacaat

SEQ ID NO: 225542 - DNA, 16 bp, P. troglodytes
catgtgatgcacctgc

SEQ ID NO: 225543 - DNA, 16 bp, P. troglodytes
catgtgatttgcaaat

SEQ ID NO: 225544 - DNA, 16 bp, P. troglodytes
catgtgattttctttt

SEQ ID NO: 225545 - DNA, 16 bp, P. troglodytes
catgtgcacaacctgc

SEQ ID NO: 225546 - DNA, 16 bp, P. troglodytes
catgtgcacaatgtgt

SEQ ID NO: 225547 - DNA, 16 bp, P. troglodytes
catgtgcaggatgtgc

SEQ ID NO: 225548 - DNA, 16 bp, P. troglodytes
catgtgcaggtttgtt

SEQ ID NO: 225549 - DNA, 16 bp, P. troglodytes
catgtgcatatatatg

SEQ ID NO: 225550 - DNA, 16 bp, P. troglodytes
catgtgccaccccacc

SEQ ID NO: 225551 - DNA, 16 bp, P. troglodytes
catgtgccagcatgcc

SEQ ID NO: 225552 - DNA, 16 bp, P. troglodytes
catgtgcctagaaaag

SEQ ID NO: 225553 - DNA, 16 bp, P. troglodytes
catgtgcctttataat

SEQ ID NO: 225554 - DNA, 16 bp, P. troglodytes
catgtgctaaggaaaa

SEQ ID NO: 225555 - DNA, 16 bp, P. troglodytes
catgtggaactatgag

SEQ ID NO: 225556 - DNA, 16 bp, P. troglodytes
catgtggatttccagt

SEQ ID NO: 225557 - DNA, 16 bp, P. troglodytes
catgtggccaaaaagc

SEQ ID NO: 225558 - DNA, 16 bp, P. troglodytes
catgtggctagtgact

SEQ ID NO: 225559 - DNA, 16 bp, P. troglodytes
catgtgggcctctcca

SEQ ID NO: 225560 - DNA, 16 bp, P. troglodytes
catgtggtggaagggg

SEQ ID NO: 225561 - DNA, 16 bp, P. troglodytes
catgtgtacacacaca

SEQ ID NO: 225562 - DNA, 16 bp, P. troglodytes
catgtgtacatatgta

SEQ ID NO: 225563 - DNA, 16 bp, P. troglodytes
catgtgtatgtgtgta

SEQ ID NO: 225564 - DNA, 16 bp, P. troglodytes
catgtgtcaccatgtc

SEQ ID NO: 225565 - DNA, 16 bp, P. troglodytes
catgtgtcttcatagc

SEQ ID NO: 225566 - DNA, 16 bp, P. troglodytes
catgtgtgagagagag

SEQ ID NO: 225567 - DNA, 16 bp, P. troglodytes
catgtgtgcatatata

SEQ ID NO: 225568 - DNA, 17 bp, P. troglodytes
catgtgtgcgtgtgtgt

SEQ ID NO: 225569 - DNA, 16 bp, P. troglodytes
catgtgtgtccatgtg

SEQ ID NO: 225570 - DNA, 16 bp, P. troglodytes
catgtgtgtctgtgtc

SEQ ID NO: 225571 - DNA, 16 bp, P. troglodytes
catgtgtgtgccacca

SEQ ID NO: 225572 - DNA, 16 bp, P. troglodytes
catgtgtgtgctgtgt

SEQ ID NO: 225573 - DNA, 16 bp, P. troglodytes
catgtgtttattcatt

SEQ ID NO: 225574 - DNA, 16 bp, P. troglodytes
catgtgtttatttttg

SEQ ID NO: 225575 - DNA, 16 bp, P. troglodytes
catgtgttttgttttg

SEQ ID NO: 225576 - DNA, 16 bp, P. troglodytes
catgttacaacatgaa

SEQ ID NO: 225577 - DNA, 16 bp, P. troglodytes
catgttagcctggatg

SEQ ID NO: 225578 - DNA, 16 bp, P. troglodytes
catgttattaaaaaaa

SEQ ID NO: 225579 - DNA, 16 bp, P. troglodytes
catgttatttaaaaaa

SEQ ID NO: 225580 - DNA, 16 bp, P. troglodytes
catgttcaaaatggca

SEQ ID NO: 225581 - DNA, 16 bp, P. troglodytes
catgttcaagcaattc

SEQ ID NO: 225582 - DNA, 16 bp, P. troglodytes
catgttcacaccactg

SEQ ID NO: 225583 - DNA, 16 bp, P. troglodytes
catgttcagctaattt

SEQ ID NO: 225584 - DNA, 16 bp, P. troglodytes
catgttcatagattgg

SEQ ID NO: 225585 - DNA, 16 bp, P. troglodytes
catgttcatagctcac

SEQ ID NO: 225586 - DNA, 16 bp, P. troglodytes
catgttcccagctgag

SEQ ID NO: 225587 - DNA, 16 bp, P. troglodytes
catgttcctgtaatcc

SEQ ID NO: 225588 - DNA, 16 bp, P. troglodytes
catgttcgccaggatg

SEQ ID NO: 225589 - DNA, 16 bp, P. troglodytes
catgttctccatcatc

SEQ ID NO: 225590 - DNA, 16 bp, P. troglodytes
catgttctttgcccac

SEQ ID NO: 225591 - DNA, 16 bp, P. troglodytes
catgttgaccttggag

SEQ ID NO: 225592 - DNA, 16 bp, P. troglodytes
catgttgatgcaaatg

SEQ ID NO: 225593 - DNA, 18 bp, P. troglodytes
catgttgcccaggctgga

SEQ ID NO: 225594 - DNA, 16 bp, P. troglodytes
catgttgcctaggctg

SEQ ID NO: 225595 - DNA, 16 bp, P. troglodytes
catgttgctgcaaatg

SEQ ID NO: 225596 - DNA, 16 bp, P. troglodytes
catgttgctgcagaag

SEQ ID NO: 225597 - DNA, 16 bp, P. troglodytes
catgttggacaagctg

SEQ ID NO: 225598 - DNA, 16 bp, P. troglodytes
catgttggccaggcca

SEQ ID NO: 225599 - DNA, 16 bp, P. troglodytes
catgttggccaggctc

SEQ ID NO: 225600 - DNA, 16 bp, P. troglodytes
catgttggccatggct

SEQ ID NO: 225601 - DNA, 16 bp, P. troglodytes
catgttggccatggtg

SEQ ID NO: 225602 - DNA, 16 bp, P. troglodytes
catgttggctgagctg

SEQ ID NO: 225603 - DNA, 16 bp, P. troglodytes
catgttggtcaggctc

SEQ ID NO: 225604 - DNA, 17 bp, P. troglodytes
catgttggtcaggctgt

SEQ ID NO: 225605 - DNA, 16 bp, P. troglodytes
catgttggtttgctgc

SEQ ID NO: 225606 - DNA, 16 bp, P. troglodytes
catgttgtacatctta

SEQ ID NO: 225607 - DNA, 16 bp, P. troglodytes
catgttgtccaggctg

SEQ ID NO: 225608 - DNA, 16 bp, P. troglodytes
catgttgtttcaaatg

SEQ ID NO: 225609 - DNA, 16 bp, P. troglodytes
catgtttaacttttta

SEQ ID NO: 225610 - DNA, 16 bp, P. troglodytes
catgtttatttattta

SEQ ID NO: 225611 - DNA, 16 bp, P. troglodytes
catgtttcccagactg

SEQ ID NO: 225612 - DNA, 16 bp, P. troglodytes
catgtttcccaggctg

SEQ ID NO: 225613 - DNA, 16 bp, P. troglodytes
catgtttctgtgtcac

SEQ ID NO: 225614 - DNA, 16 bp, P. troglodytes
catgtttcttgtacag

SEQ ID NO: 225615 - DNA, 16 bp, P. troglodytes
catgtttgagatgatg

SEQ ID NO: 225616 - DNA, 16 bp, P. troglodytes
catgtttggaaaatgg

SEQ ID NO: 225617 - DNA, 16 bp, P. troglodytes
catgtttgtcttcttt

SEQ ID NO: 225618 - DNA, 16 bp, P. troglodytes
catgtttgtgtatgtg

SEQ ID NO: 225619 - DNA, 16 bp, P. troglodytes
catgtttgttggccat

SEQ ID NO: 225620 - DNA, 16 bp, P. troglodytes
catgttttaaaaccac

SEQ ID NO: 225621 - DNA, 16 bp, P. troglodytes
catgttttacttttat

SEQ ID NO: 225622 - DNA, 16 bp, P. troglodytes
catgttttctggttgt

SEQ ID NO: 225623 - DNA, 16 bp, P. troglodytes
catgtttttataaata

SEQ ID NO: 225624 - DNA, 16 bp, P. troglodytes
cattaaaaaaatgaga

SEQ ID NO: 225625 - DNA, 16 bp, P. troglodytes
cattaaaaaatgcaaa

SEQ ID NO: 225626 - DNA, 16 bp, P. troglodytes
cattaaaaaattagct

SEQ ID NO: 225627 - DNA, 16 bp, P. troglodytes
cattaaaaagaatgag

SEQ ID NO: 225628 - DNA, 16 bp, P. troglodytes
cattaaaaagattatt

SEQ ID NO: 225629 - DNA, 16 bp, P. troglodytes
cattaaaaagtctgaa

SEQ ID NO: 225630 - DNA, 16 bp, P. troglodytes
cattaaaaagtttatt

SEQ ID NO: 225631 - DNA, 16 bp, P. troglodytes
cattaaaaataaaagc

SEQ ID NO: 225632 - DNA, 16 bp, P. troglodytes
cattaaaaattaagaa

SEQ ID NO: 225633 - DNA, 16 bp, P. troglodytes
cattaaaaattgtaaa

SEQ ID NO: 225634 - DNA, 16 bp, P. troglodytes
cattaaaacattttaa

SEQ ID NO: 225635 - DNA, 16 bp, P. troglodytes
cattaaaaggtcagga

SEQ ID NO: 225636 - DNA, 19 bp, P. troglodytes
cattaaacctctttttctt

SEQ ID NO: 225637 - DNA, 16 bp, P. troglodytes
cattaaagaccaaagg

SEQ ID NO: 225638 - DNA, 16 bp, P. troglodytes
cattaaatcctcacaa

SEQ ID NO: 225639 - DNA, 16 bp, P. troglodytes
cattaaatctgtaaat

SEQ ID NO: 225640 - DNA, 16 bp, P. troglodytes
cattaaatgtaaataa

SEQ ID NO: 225641 - DNA, 16 bp, P. troglodytes
cattaaatgtaaatat

SEQ ID NO: 225642 - DNA, 16 bp, P. troglodytes
cattaaattgtacatt

SEQ ID NO: 225643 - DNA, 16 bp, P. troglodytes
cattaacagaaagaaa

SEQ ID NO: 225644 - DNA, 16 bp, P. troglodytes
cattaacagacacttc

SEQ ID NO: 225645 - DNA, 16 bp, P. troglodytes
cattaaccagcctctc

SEQ ID NO: 225646 - DNA, 16 bp, P. troglodytes
cattaacctttgtttt

SEQ ID NO: 225647 - DNA, 16 bp, P. troglodytes
cattaactaaaaagtc

SEQ ID NO: 225648 - DNA, 16 bp, P. troglodytes
cattaagaaaatgaaa

SEQ ID NO: 225649 - DNA, 16 bp, P. troglodytes
cattaagtacattcac

SEQ ID NO: 225650 - DNA, 16 bp, P. troglodytes
cattaagtataatatt

SEQ ID NO: 225651 - DNA, 16 bp, P. troglodytes
cattaagtgcattcac

SEQ ID NO: 225652 - DNA, 16 bp, P. troglodytes
cattaattcatttgtt

SEQ ID NO: 225653 - DNA, 16 bp, P. troglodytes
cattacataaacagaa

SEQ ID NO: 225654 - DNA, 26 bp, P. troglodytes
cattacataatggtaaagggatcaat

SEQ ID NO: 225655 - DNA, 16 bp, P. troglodytes
cattacatttattgtg

SEQ ID NO: 225656 - DNA, 16 bp, P. troglodytes
cattactctgaagtcc

SEQ ID NO: 225657 - DNA, 16 bp, P. troglodytes
cattactgtacactgc

SEQ ID NO: 225658 - DNA, 16 bp, P. troglodytes
cattacttttaattgc

SEQ ID NO: 225659 - DNA, 16 bp, P. troglodytes
cattagaatcacctgg

SEQ ID NO: 225660 - DNA, 16 bp, P. troglodytes
cattagaattttgata

SEQ ID NO: 225661 - DNA, 16 bp, P. troglodytes
cattagccaggcttgg

SEQ ID NO: 225662 - DNA, 16 bp, P. troglodytes
cattagcctacagttg

SEQ ID NO: 225663 - DNA, 16 bp, P. troglodytes
cattagctgatgcagt

SEQ ID NO: 225664 - DNA, 17 bp, P. troglodytes
cattaggagaaatacct

SEQ ID NO: 225665 - DNA, 16 bp, P. troglodytes
cattagggaaaagcaa

SEQ ID NO: 225666 - DNA, 16 bp, P. troglodytes
cattagggaaatgcaa

SEQ ID NO: 225667 - DNA, 16 bp, P. troglodytes
cattaggtatatctcc

SEQ ID NO: 225668 - DNA, 16 bp, P. troglodytes
cattaggttatttgaa

SEQ ID NO: 225669 - DNA, 16 bp, P. troglodytes
cattatataatgtata

SEQ ID NO: 225670 - DNA, 16 bp, P. troglodytes
cattatatttctattg

SEQ ID NO: 225671 - DNA, 16 bp, P. troglodytes
cattatctcacttaat

SEQ ID NO: 225672 - DNA, 16 bp, P. troglodytes
cattatctcatttaat

SEQ ID NO: 225673 - DNA, 16 bp, P. troglodytes
cattatctcatttgat

SEQ ID NO: 225674 - DNA, 16 bp, P. troglodytes
cattatctgtaaaatg

SEQ ID NO: 225675 - DNA, 16 bp, P. troglodytes
cattatctttaaaaaa

SEQ ID NO: 225676 - DNA, 16 bp, P. troglodytes
cattatgctgattgga

SEQ ID NO: 225677 - DNA, 16 bp, P. troglodytes
cattatgtctaaaaat

SEQ ID NO: 225678 - DNA, 16 bp, P. troglodytes
cattattaagtaaaat

SEQ ID NO: 225679 - DNA, 16 bp, P. troglodytes
cattattatcacccaa

SEQ ID NO: 225680 - DNA, 16 bp, P. troglodytes
cattattattgttgtt

SEQ ID NO: 225681 - DNA, 16 bp, P. troglodytes
cattattcacatttta

SEQ ID NO: 225682 - DNA, 16 bp, P. troglodytes
cattattctaagtgaa

SEQ ID NO: 225683 - DNA, 16 bp, P. troglodytes
cattattgacattttg

SEQ ID NO: 225684 - DNA, 16 bp, P. troglodytes
cattatttatccagga

SEQ ID NO: 225685 - DNA, 16 bp, P. troglodytes
cattatttcagcaaaa

SEQ ID NO: 225686 - DNA, 16 bp, P. troglodytes
cattatttccttaaat

SEQ ID NO: 225687 - DNA, 16 bp, P. troglodytes
cattatttctgaggcc

SEQ ID NO: 225688 - DNA, 16 bp, P. troglodytes
cattattttaaaagta

SEQ ID NO: 225689 - DNA, 16 bp, P. troglodytes
cattattttaagccac

SEQ ID NO: 225690 - DNA, 16 bp, P. troglodytes
cattattttacatgtg

SEQ ID NO: 225691 - DNA, 16 bp, P. troglodytes
cattattttgaagact

SEQ ID NO: 225692 - DNA, 16 bp, P. troglodytes
cattattttttcctaa

SEQ ID NO: 225693 - DNA, 16 bp, P. troglodytes
cattcaaaccacagca

SEQ ID NO: 225694 - DNA, 16 bp, P. troglodytes
cattcaaaccatagca

SEQ ID NO: 225695 - DNA, 16 bp, P. troglodytes
cattcaaagcagtatg

SEQ ID NO: 225696 - DNA, 16 bp, P. troglodytes
cattcaaagcagtgtg

SEQ ID NO: 225697 - DNA, 16 bp, P. troglodytes
cattcaaaggaaaaaa

SEQ ID NO: 225698 - DNA, 16 bp, P. troglodytes
cattcaacaaacattt

SEQ ID NO: 225699 - DNA, 16 bp, P. troglodytes
cattcaacaaatactt

SEQ ID NO: 225700 - DNA, 16 bp, P. troglodytes
cattcaacagctgcag

SEQ ID NO: 225701 - DNA, 16 bp, P. troglodytes
cattcaacccagcaat

SEQ ID NO: 225702 - DNA, 16 bp, P. troglodytes
cattcaactcacagat

SEQ ID NO: 225703 - DNA, 17 bp, P. troglodytes
cattcaagacataggca

SEQ ID NO: 225704 - DNA, 16 bp, P. troglodytes
cattcaagaccagcct

SEQ ID NO: 225705 - DNA, 16 bp, P. troglodytes
cattcaagagatgact

SEQ ID NO: 225706 - DNA, 16 bp, P. troglodytes
cattcacaacttggct

SEQ ID NO: 225707 - DNA, 16 bp, P. troglodytes
cattcacaatccctta

SEQ ID NO: 225708 - DNA, 16 bp, P. troglodytes
cattcacacaatggaa

SEQ ID NO: 225709 - DNA, 16 bp, P. troglodytes
cattcacacattcatt

SEQ ID NO: 225710 - DNA, 16 bp, P. troglodytes
cattcacaccatagca

SEQ ID NO: 225711 - DNA, 16 bp, P. troglodytes
cattcacagattccag

SEQ ID NO: 225712 - DNA, 16 bp, P. troglodytes
cattcacagcaacctg

SEQ ID NO: 225713 - DNA, 16 bp, P. troglodytes
cattcactgagcacct

SEQ ID NO: 225714 - DNA, 16 bp, P. troglodytes
cattcagaaatatttt

SEQ ID NO: 225715 - DNA, 16 bp, P. troglodytes
cattcagactatagca

SEQ ID NO: 225716 - DNA, 16 bp, P. troglodytes
cattcagaggctggag

SEQ ID NO: 225717 - DNA, 16 bp, P. troglodytes
cattcagcaaacattt

SEQ ID NO: 225718 - DNA, 16 bp, P. troglodytes
cattcagcaagtattt

SEQ ID NO: 225719 - DNA, 16 bp, P. troglodytes
cattcagcacaggaga

SEQ ID NO: 225720 - DNA, 16 bp, P. troglodytes
cattcaggaaaacaaa

SEQ ID NO: 225721 - DNA, 24 bp, P. troglodytes
cattcaggacataggcatggacaa

SEQ ID NO: 225722 - DNA, 16 bp, P. troglodytes
cattcaggagcatgtt

SEQ ID NO: 225723 - DNA, 16 bp, P. troglodytes
cattcagtattatgtt

SEQ ID NO: 225724 - DNA, 16 bp, P. troglodytes
cattcagtttgaagaa

SEQ ID NO: 225725 - DNA, 16 bp, P. troglodytes
cattcagttttatttt

SEQ ID NO: 225726 - DNA, 16 bp, P. troglodytes
cattcatcacatagtt

SEQ ID NO: 225727 - DNA, 16 bp, P. troglodytes
cattcatcatgctctt

SEQ ID NO: 225728 - DNA, 16 bp, P. troglodytes
cattcatccttcaagt

SEQ ID NO: 225729 - DNA, 16 bp, P. troglodytes
cattcatgagaactcc

SEQ ID NO: 225730 - DNA, 16 bp, P. troglodytes
cattcatggattcaac

SEQ ID NO: 225731 - DNA, 16 bp, P. troglodytes
cattcatgtgcatgtg

SEQ ID NO: 225732 - DNA, 16 bp, P. troglodytes
cattcatgttgcagca

SEQ ID NO: 225733 - DNA, 16 bp, P. troglodytes
cattcattcaacaact

SEQ ID NO: 225734 - DNA, 16 bp, P. troglodytes
cattcattcaacaatt

SEQ ID NO: 225735 - DNA, 16 bp, P. troglodytes
cattcattcaacatat

SEQ ID NO: 225736 - DNA, 16 bp, P. troglodytes
cattcattcacaaata

SEQ ID NO: 225737 - DNA, 16 bp, P. troglodytes
cattcattcactcact

SEQ ID NO: 225738 - DNA, 16 bp, P. troglodytes
cattcattcaggaaat

SEQ ID NO: 225739 - DNA, 16 bp, P. troglodytes
cattcattcatccatt

SEQ ID NO: 225740 - DNA, 16 bp, P. troglodytes
cattcattcatgtatt

SEQ ID NO: 225741 - DNA, 16 bp, P. troglodytes
cattcattcattcaac

SEQ ID NO: 225742 - DNA, 16 bp, P. troglodytes
cattcattcattcagt

SEQ ID NO: 225743 - DNA, 16 bp, P. troglodytes
cattcattcattccat

SEQ ID NO: 225744 - DNA, 16 bp, P. troglodytes
cattcattcattccct

SEQ ID NO: 225745 - DNA, 16 bp, P. troglodytes
cattcattcatttgag

SEQ ID NO: 225746 - DNA, 16 bp, P. troglodytes
cattcattccttcatt

SEQ ID NO: 225747 - DNA, 16 bp, P. troglodytes
cattcattctctctcc

SEQ ID NO: 225748 - DNA, 16 bp, P. troglodytes
cattcattgagcacct

SEQ ID NO: 225749 - DNA, 16 bp, P. troglodytes
cattcatttacacatt

SEQ ID NO: 225750 - DNA, 16 bp, P. troglodytes
cattcatttacatgtt

SEQ ID NO: 225751 - DNA, 16 bp, P. troglodytes
cattcatttacttact

SEQ ID NO: 225752 - DNA, 16 bp, P. troglodytes
cattcatttatccatt

SEQ ID NO: 225753 - DNA, 16 bp, P. troglodytes
cattcatttatgtatt

SEQ ID NO: 225754 - DNA, 16 bp, P. troglodytes
cattcatttcaaaatt

SEQ ID NO: 225755 - DNA, 16 bp, P. troglodytes
cattcatttttatagc

SEQ ID NO: 225756 - DNA, 16 bp, P. troglodytes
cattcatttttatgac

SEQ ID NO: 225757 - DNA, 17 bp, P. troglodytes
cattccaatcacctgct

SEQ ID NO: 225758 - DNA, 16 bp, P. troglodytes
cattccacaagtattt

SEQ ID NO: 225759 - DNA, 16 bp, P. troglodytes
cattccacagtgtata

SEQ ID NO: 225760 - DNA, 16 bp, P. troglodytes
cattccacccaacaac

SEQ ID NO: 225761 - DNA, 16 bp, P. troglodytes
cattccactccagcct

SEQ ID NO: 225762 - DNA, 16 bp, P. troglodytes
cattccagagagggtc

SEQ ID NO: 225763 - DNA, 16 bp, P. troglodytes
cattccagagattctg

SEQ ID NO: 225764 - DNA, 16 bp, P. troglodytes
cattccagcctggggt

SEQ ID NO: 225765 - DNA, 16 bp, P. troglodytes
cattccatccagctcc

SEQ ID NO: 225766 - DNA, 16 bp, P. troglodytes
cattcccaccaacagt

SEQ ID NO: 225767 - DNA, 16 bp, P. troglodytes
cattcccactagcaat

SEQ ID NO: 225768 - DNA, 16 bp, P. troglodytes
cattcccagatggtta

SEQ ID NO: 225769 - DNA, 16 bp, P. troglodytes
cattcccagcagcaat

SEQ ID NO: 225770 - DNA, 16 bp, P. troglodytes
cattcccagctaattt

SEQ ID NO: 225771 - DNA, 16 bp, P. troglodytes
cattcccagctacttg

SEQ ID NO: 225772 - DNA, 16 bp, P. troglodytes
cattcccagctgtgat

SEQ ID NO: 225773 - DNA, 16 bp, P. troglodytes
cattcccctcatccag

SEQ ID NO: 225774 - DNA, 16 bp, P. troglodytes
cattccccttaaaaac

SEQ ID NO: 225775 - DNA, 16 bp, P. troglodytes
cattcccttcatcatt

SEQ ID NO: 225776 - DNA, 17 bp, P. troglodytes
cattccctttgaaaacc

SEQ ID NO: 225777 - DNA, 16 bp, P. troglodytes
cattcctgaggaagaa

SEQ ID NO: 225778 - DNA, 16 bp, P. troglodytes
cattcctgagggctcc

SEQ ID NO: 225779 - DNA, 16 bp, P. troglodytes
cattcctgccagcaat

SEQ ID NO: 225780 - DNA, 16 bp, P. troglodytes
cattcctgctctgaaa

SEQ ID NO: 225781 - DNA, 16 bp, P. troglodytes
cattcctggctaattt

SEQ ID NO: 225782 - DNA, 16 bp, P. troglodytes
cattcctgggataaac

SEQ ID NO: 225783 - DNA, 16 bp, P. troglodytes
cattcctgggcacagg

SEQ ID NO: 225784 - DNA, 16 bp, P. troglodytes
cattcctgtagtctca

SEQ ID NO: 225785 - DNA, 16 bp, P. troglodytes
cattcctgtttttgtg

SEQ ID NO: 225786 - DNA, 16 bp, P. troglodytes
cattccttcctgataa

SEQ ID NO: 225787 - DNA, 16 bp, P. troglodytes
cattccttggcttgtg

SEQ ID NO: 225788 - DNA, 16 bp, P. troglodytes
cattcctttcccttta

SEQ ID NO: 225789 - DNA, 16 bp, P. troglodytes
cattcctttcctctgg

SEQ ID NO: 225790 - DNA, 16 bp, P. troglodytes
cattcctttgactcca

SEQ ID NO: 225791 - DNA, 19 bp, P. troglodytes
cattcgggttggttccaag

SEQ ID NO: 225792 - DNA, 16 bp, P. troglodytes
cattctaaagatagag

SEQ ID NO: 225793 - DNA, 16 bp, P. troglodytes
cattctacccaacaac

SEQ ID NO: 225794 - DNA, 16 bp, P. troglodytes
cattctattacaaaga

SEQ ID NO: 225795 - DNA, 16 bp, P. troglodytes
cattctcatgttgcta

SEQ ID NO: 225796 - DNA, 16 bp, P. troglodytes
cattctcatttttaaa

SEQ ID NO: 225797 - DNA, 19 bp, P. troglodytes
cattctcctccctcagcct

SEQ ID NO: 225798 - DNA, 16 bp, P. troglodytes
cattctcctgcctctg

SEQ ID NO: 225799 - DNA, 16 bp, P. troglodytes
cattctctccagcatc

SEQ ID NO: 225800 - DNA, 16 bp, P. troglodytes
cattctctctcctgct

SEQ ID NO: 225801 - DNA, 16 bp, P. troglodytes
cattctctgtccagtt

SEQ ID NO: 225802 - DNA, 16 bp, P. troglodytes
cattctcttttatggc

SEQ ID NO: 225803 - DNA, 16 bp, P. troglodytes
cattctgaaatattta

SEQ ID NO: 225804 - DNA, 16 bp, P. troglodytes
cattctgaacaaacta

SEQ ID NO: 225805 - DNA, 16 bp, P. troglodytes
cattctgagaaacttc

SEQ ID NO: 225806 - DNA, 16 bp, P. troglodytes
cattctgagatactga

SEQ ID NO: 225807 - DNA, 16 bp, P. troglodytes
cattctgcagatgagg

SEQ ID NO: 225808 - DNA, 16 bp, P. troglodytes
cattctgccccagccc

SEQ ID NO: 225809 - DNA, 16 bp, P. troglodytes
cattctgcccctggcc

SEQ ID NO: 225810 - DNA, 16 bp, P. troglodytes
cattctgctgtaaaga

SEQ ID NO: 225811 - DNA, 16 bp, P. troglodytes
cattctggaagacagt

SEQ ID NO: 225812 - DNA, 16 bp, P. troglodytes
cattctggacatagga

SEQ ID NO: 225813 - DNA, 16 bp, P. troglodytes
cattctggagcaggtt

SEQ ID NO: 225814 - DNA, 16 bp, P. troglodytes
cattctggagtctgga

SEQ ID NO: 225815 - DNA, 16 bp, P. troglodytes
cattctggccaacacg

SEQ ID NO: 225816 - DNA, 16 bp, P. troglodytes
cattctgtatttttat

SEQ ID NO: 225817 - DNA, 16 bp, P. troglodytes
cattctgtctcaaaaa

SEQ ID NO: 225818 - DNA, 16 bp, P. troglodytes
cattctgtgtctggct

SEQ ID NO: 225819 - DNA, 16 bp, P. troglodytes
cattcttcacaaaatt

SEQ ID NO: 225820 - DNA, 16 bp, P. troglodytes
cattcttcatgtagtt

SEQ ID NO: 225821 - DNA, 16 bp, P. troglodytes
cattcttccacccaag

SEQ ID NO: 225822 - DNA, 16 bp, P. troglodytes
cattcttccttttgtt

SEQ ID NO: 225823 - DNA, 16 bp, P. troglodytes
cattcttttataaaga

SEQ ID NO: 225824 - DNA, 16 bp, P. troglodytes
cattcttttttaaaca

SEQ ID NO: 225825 - DNA, 16 bp, P. troglodytes
cattgaaaacaaaaca

SEQ ID NO: 225826 - DNA, 16 bp, P. troglodytes
cattgaaaactggcac

SEQ ID NO: 225827 - DNA, 16 bp, P. troglodytes
cattgaaataaaagca

SEQ ID NO: 225828 - DNA, 16 bp, P. troglodytes
cattgaaattttaaaa

SEQ ID NO: 225829 - DNA, 16 bp, P. troglodytes
cattgaacaataactc

SEQ ID NO: 225830 - DNA, 16 bp, P. troglodytes
cattgaaccatcagaa

SEQ ID NO: 225831 - DNA, 17 bp, P. troglodytes
cattgaatctataaatt

SEQ ID NO: 225832 - DNA, 16 bp, P. troglodytes
cattgaatgaaatgtt

SEQ ID NO: 225833 - DNA, 16 bp, P. troglodytes
cattgaatgaatgaat

SEQ ID NO: 225834 - DNA, 16 bp, P. troglodytes
cattgaatttttaaat

SEQ ID NO: 225835 - DNA, 16 bp, P. troglodytes
cattgacatggttaaa

SEQ ID NO: 225836 - DNA, 16 bp, P. troglodytes
cattgaccccacagaa

SEQ ID NO: 225837 - DNA, 16 bp, P. troglodytes
cattgacttcttctct

SEQ ID NO: 225838 - DNA, 16 bp, P. troglodytes
cattgactttcttcat

SEQ ID NO: 225839 - DNA, 16 bp, P. troglodytes
cattgagtgtctgcag

SEQ ID NO: 225840 - DNA, 16 bp, P. troglodytes
cattgatgaaccttga

SEQ ID NO: 225841 - DNA, 16 bp, P. troglodytes
cattgatgaaggaaat

SEQ ID NO: 225842 - DNA, 16 bp, P. troglodytes
cattgattcattaatt

SEQ ID NO: 225843 - DNA, 16 bp, P. troglodytes
cattgatttatatttt

SEQ ID NO: 225844 - DNA, 16 bp, P. troglodytes
cattgattttaaaaaa

SEQ ID NO: 225845 - DNA, 16 bp, P. troglodytes
cattgattttatttat

SEQ ID NO: 225846 - DNA, 16 bp, P. troglodytes
cattgattttttaaaa

SEQ ID NO: 225847 - DNA, 16 bp, P. troglodytes
cattgattttttgaag

SEQ ID NO: 225848 - DNA, 16 bp, P. troglodytes
cattgcaaaatacagt

SEQ ID NO: 225849 - DNA, 16 bp, P. troglodytes
cattgcaaaattataa

SEQ ID NO: 225850 - DNA, 16 bp, P. troglodytes
cattgcacccagcctg

SEQ ID NO: 225851 - DNA, 16 bp, P. troglodytes
cattgcactccagccc

SEQ ID NO: 225852 - DNA, 16 bp, P. troglodytes
cattgcactccagccg

SEQ ID NO: 225853 - DNA, 16 bp, P. troglodytes
cattgcactccagcct

SEQ ID NO: 225854 - DNA, 18 bp, P. troglodytes
cattgcactccagcctgc

SEQ ID NO: 225855 - DNA, 16 bp, P. troglodytes
cattgcagcctccacc

SEQ ID NO: 225856 - DNA, 16 bp, P. troglodytes
cattgcattccagccc

SEQ ID NO: 225857 - DNA, 16 bp, P. troglodytes
cattgcattttaaaat

SEQ ID NO: 225858 - DNA, 16 bp, P. troglodytes
cattgccagcatctgt

SEQ ID NO: 225859 - DNA, 16 bp, P. troglodytes
cattgcccaggctgct

SEQ ID NO: 225860 - DNA, 16 bp, P. troglodytes
cattgcccaggctgga

SEQ ID NO: 225861 - DNA, 16 bp, P. troglodytes
cattgcccagggtggt

SEQ ID NO: 225862 - DNA, 16 bp, P. troglodytes
cattgcccatttttaa

SEQ ID NO: 225863 - DNA, 16 bp, P. troglodytes
cattgcctcagcccaa

SEQ ID NO: 225864 - DNA, 16 bp, P. troglodytes
cattgctattttgata

SEQ ID NO: 225865 - DNA, 16 bp, P. troglodytes
cattgctcagctccca

SEQ ID NO: 225866 - DNA, 16 bp, P. troglodytes
cattgctctgatggcc

SEQ ID NO: 225867 - DNA, 16 bp, P. troglodytes
cattgctgatgaaaat

SEQ ID NO: 225868 - DNA, 16 bp, P. troglodytes
cattgcttcagagggt

SEQ ID NO: 225869 - DNA, 16 bp, P. troglodytes
cattgcttcatttaat

SEQ ID NO: 225870 - DNA, 16 bp, P. troglodytes
cattgcttgtgtgtgt

SEQ ID NO: 225871 - DNA, 16 bp, P. troglodytes
cattgctttggtgttt

SEQ ID NO: 225872 - DNA, 16 bp, P. troglodytes
cattgcttttggcatc

SEQ ID NO: 225873 - DNA, 16 bp, P. troglodytes
cattgcttttgtgttt

SEQ ID NO: 225874 - DNA, 16 bp, P. troglodytes
cattggaagaatcaat

SEQ ID NO: 225875 - DNA, 16 bp, P. troglodytes
cattggagatgactca

SEQ ID NO: 225876 - DNA, 16 bp, P. troglodytes
cattggcatcacctgg

SEQ ID NO: 225877 - DNA, 16 bp, P. troglodytes
cattggccgggcgtgg

SEQ ID NO: 225878 - DNA, 16 bp, P. troglodytes
cattggccttggcaaa

SEQ ID NO: 225879 - DNA, 16 bp, P. troglodytes
cattggctttctgtgc

SEQ ID NO: 225880 - DNA, 16 bp, P. troglodytes
cattgggaggctgagg

SEQ ID NO: 225881 - DNA, 16 bp, P. troglodytes
cattggtcttggcaaa

SEQ ID NO: 225882 - DNA, 16 bp, P. troglodytes
cattggtggcttgatg

SEQ ID NO: 225883 - DNA, 16 bp, P. troglodytes
cattggtgtgctgtat

SEQ ID NO: 225884 - DNA, 16 bp, P. troglodytes
cattggtttgaaagaa

SEQ ID NO: 225885 - DNA, 16 bp, P. troglodytes
cattgtacagatgggg

SEQ ID NO: 225886 - DNA, 16 bp, P. troglodytes
cattgtatacacatat

SEQ ID NO: 225887 - DNA, 16 bp, P. troglodytes
cattgtatatatgtac

SEQ ID NO: 225888 - DNA, 16 bp, P. troglodytes
cattgtatgtttttgg

SEQ ID NO: 225889 - DNA, 16 bp, P. troglodytes
cattgtattttaattt

SEQ ID NO: 225890 - DNA, 16 bp, P. troglodytes
cattgtattttggaag

SEQ ID NO: 225891 - DNA, 16 bp, P. troglodytes
cattgtatttttaaaa

SEQ ID NO: 225892 - DNA, 16 bp, P. troglodytes
cattgtcaataagcag

SEQ ID NO: 225893 - DNA, 16 bp, P. troglodytes
cattgtcaggctgcaa

SEQ ID NO: 225894 - DNA, 16 bp, P. troglodytes
cattgtgaaactctgt

SEQ ID NO: 225895 - DNA, 16 bp, P. troglodytes
cattgtgaaataatta

SEQ ID NO: 225896 - DNA, 16 bp, P. troglodytes
cattgtgacagtatta

SEQ ID NO: 225897 - DNA, 16 bp, P. troglodytes
cattgtggaaaacaat

SEQ ID NO: 225898 - DNA, 16 bp, P. troglodytes
cattgtggcgtgtgcc

SEQ ID NO: 225899 - DNA, 16 bp, P. troglodytes
cattgtggtattaatt

SEQ ID NO: 225900 - DNA, 16 bp, P. troglodytes
cattgtgtgaacatca

SEQ ID NO: 225901 - DNA, 16 bp, P. troglodytes
cattgtgtgtctgtgt

SEQ ID NO: 225902 - DNA, 16 bp, P. troglodytes
cattgtgttaggtatt

SEQ ID NO: 225903 - DNA, 16 bp, P. troglodytes
cattgttaacattttg

SEQ ID NO: 225904 - DNA, 16 bp, P. troglodytes
cattgttcaactccct

SEQ ID NO: 225905 - DNA, 16 bp, P. troglodytes
cattgttcaattccaa

SEQ ID NO: 225906 - DNA, 16 bp, P. troglodytes
cattgttggtagaaat

SEQ ID NO: 225907 - DNA, 16 bp, P. troglodytes
cattgttgttattgtt

SEQ ID NO: 225908 - DNA, 16 bp, P. troglodytes
cattgttgttgttgtt

SEQ ID NO: 225909 - DNA, 16 bp, P. troglodytes
cattgtttctacagat

SEQ ID NO: 225910 - DNA, 16 bp, P. troglodytes
cattgttttaagctgc

SEQ ID NO: 225911 - DNA, 16 bp, P. troglodytes
catttaaaaaaaaatg

SEQ ID NO: 225912 - DNA, 16 bp, P. troglodytes
catttaaaaaaatgaa

SEQ ID NO: 225913 - DNA, 16 bp, P. troglodytes
catttaaaaaataaga

SEQ ID NO: 225914 - DNA, 16 bp, P. troglodytes
catttaaaaaatcatt

SEQ ID NO: 225915 - DNA, 16 bp, P. troglodytes
catttaaaaaatgatt

SEQ ID NO: 225916 - DNA, 16 bp, P. troglodytes
catttaaaaatgcata

SEQ ID NO: 225917 - DNA, 16 bp, P. troglodytes
catttaaaaatgcatt

SEQ ID NO: 225918 - DNA, 16 bp, P. troglodytes
catttaaaaatgggca

SEQ ID NO: 225919 - DNA, 16 bp, P. troglodytes
catttaaaaccaaaga

SEQ ID NO: 225920 - DNA, 16 bp, P. troglodytes
catttaaaagaaagaa

SEQ ID NO: 225921 - DNA, 16 bp, P. troglodytes
catttaaaagatacag

SEQ ID NO: 225922 - DNA, 16 bp, P. troglodytes
catttaaaaggaagaa

SEQ ID NO: 225923 - DNA, 16 bp, P. troglodytes
catttaaaataaaatg

SEQ ID NO: 225924 - DNA, 16 bp, P. troglodytes
catttaaaataagaaa

SEQ ID NO: 225925 - DNA, 16 bp, P. troglodytes
catttaaaatggaaaa

SEQ ID NO: 225926 - DNA, 16 bp, P. troglodytes
catttaaaatgttatt

SEQ ID NO: 225927 - DNA, 16 bp, P. troglodytes
catttaaaccacagca

SEQ ID NO: 225928 - DNA, 16 bp, P. troglodytes
catttaaagtgcacaa

SEQ ID NO: 225929 - DNA, 16 bp, P. troglodytes
catttaaatgaaattt

SEQ ID NO: 225930 - DNA, 16 bp, P. troglodytes
catttaaattgtttct

SEQ ID NO: 225931 - DNA, 16 bp, P. troglodytes
catttaaattgttttt

SEQ ID NO: 225932 - DNA, 16 bp, P. troglodytes
catttaaattttgtag

SEQ ID NO: 225933 - DNA, 16 bp, P. troglodytes
catttaacattaatat

SEQ ID NO: 225934 - DNA, 16 bp, P. troglodytes
catttaacattttaaa

SEQ ID NO: 225935 - DNA, 16 bp, P. troglodytes
catttaagaatgtatt

SEQ ID NO: 225936 - DNA, 16 bp, P. troglodytes
catttaagaattattt

SEQ ID NO: 225937 - DNA, 16 bp, P. troglodytes
catttaaggaagaaaa

SEQ ID NO: 225938 - DNA, 16 bp, P. troglodytes
catttaataaatgaaa

SEQ ID NO: 225939 - DNA, 16 bp, P. troglodytes
catttaataatcagac

SEQ ID NO: 225940 - DNA, 16 bp, P. troglodytes
catttaatcttcccag

SEQ ID NO: 225941 - DNA, 16 bp, P. troglodytes
catttaatgctatgaa

SEQ ID NO: 225942 - DNA, 16 bp, P. troglodytes
catttaattctgctct

SEQ ID NO: 225943 - DNA, 16 bp, P. troglodytes
catttaatttccacaa

SEQ ID NO: 225944 - DNA, 16 bp, P. troglodytes
catttaattttcaaat

SEQ ID NO: 225945 - DNA, 16 bp, P. troglodytes
catttacaaatgaaga

SEQ ID NO: 225946 - DNA, 16 bp, P. troglodytes
catttacagaggagga

SEQ ID NO: 225947 - DNA, 16 bp, P. troglodytes
catttacatctttaat

SEQ ID NO: 225948 - DNA, 17 bp, P. troglodytes
catttacattaggtatt

SEQ ID NO: 225949 - DNA, 16 bp, P. troglodytes
catttacattcaattt

SEQ ID NO: 225950 - DNA, 16 bp, P. troglodytes
catttacattgcatta

SEQ ID NO: 225951 - DNA, 16 bp, P. troglodytes
catttacattttcctt

SEQ ID NO: 225952 - DNA, 16 bp, P. troglodytes
catttaccattccaaa

SEQ ID NO: 225953 - DNA, 16 bp, P. troglodytes
catttaccctgatgtg

SEQ ID NO: 225954 - DNA, 16 bp, P. troglodytes
catttacctcccactt

SEQ ID NO: 225955 - DNA, 16 bp, P. troglodytes
catttactgaacatct

SEQ ID NO: 225956 - DNA, 16 bp, P. troglodytes
catttactgagatggg

SEQ ID NO: 225957 - DNA, 16 bp, P. troglodytes
catttactgagcacct

SEQ ID NO: 225958 - DNA, 16 bp, P. troglodytes
catttactgagcatct

SEQ ID NO: 225959 - DNA, 16 bp, P. troglodytes
catttactgagcattt

SEQ ID NO: 225960 - DNA, 16 bp, P. troglodytes
catttactgagtacct

SEQ ID NO: 225961 - DNA, 16 bp, P. troglodytes
catttactgtgtgcca

SEQ ID NO: 225962 - DNA, 16 bp, P. troglodytes
catttacttctcacag

SEQ ID NO: 225963 - DNA, 16 bp, P. troglodytes
catttagaaaaataat

SEQ ID NO: 225964 - DNA, 16 bp, P. troglodytes
catttagaataaaatc

SEQ ID NO: 225965 - DNA, 16 bp, P. troglodytes
catttagaatggtgat

SEQ ID NO: 225966 - DNA, 16 bp, P. troglodytes
catttagcaaatgttt

SEQ ID NO: 225967 - DNA, 16 bp, P. troglodytes
catttagtccatttat

SEQ ID NO: 225968 - DNA, 16 bp, P. troglodytes
catttataaaatgagg

SEQ ID NO: 225969 - DNA, 16 bp, P. troglodytes
catttatataaaatgt

SEQ ID NO: 225970 - DNA, 16 bp, P. troglodytes
catttatatattgtct

SEQ ID NO: 225971 - DNA, 16 bp, P. troglodytes
catttatatgaaattt

SEQ ID NO: 225972 - DNA, 16 bp, P. troglodytes
catttatattaaatgt

SEQ ID NO: 225973 - DNA, 16 bp, P. troglodytes
catttatatttaaagt

SEQ ID NO: 225974 - DNA, 16 bp, P. troglodytes
catttatcacttccct

SEQ ID NO: 225975 - DNA, 16 bp, P. troglodytes
catttatcattatgta

SEQ ID NO: 225976 - DNA, 16 bp, P. troglodytes
catttatcctagagaa

SEQ ID NO: 225977 - DNA, 16 bp, P. troglodytes
catttatctttgtatt

SEQ ID NO: 225978 - DNA, 16 bp, P. troglodytes
catttatgatttattt

SEQ ID NO: 225979 - DNA, 16 bp, P. troglodytes
catttatgattttaaa

SEQ ID NO: 225980 - DNA, 16 bp, P. troglodytes
catttatgcagccaat

SEQ ID NO: 225981 - DNA, 16 bp, P. troglodytes
catttatgtatatttt

SEQ ID NO: 225982 - DNA, 16 bp, P. troglodytes
catttatgtgttcact

SEQ ID NO: 225983 - DNA, 16 bp, P. troglodytes
catttatgtttaaaaa

SEQ ID NO: 225984 - DNA, 16 bp, P. troglodytes
catttattaagcaccc

SEQ ID NO: 225985 - DNA, 16 bp, P. troglodytes
catttattaagcattt

SEQ ID NO: 225986 - DNA, 16 bp, P. troglodytes
catttattaagtacct

SEQ ID NO: 225987 - DNA, 16 bp, P. troglodytes
catttattatgatgtt

SEQ ID NO: 225988 - DNA, 16 bp, P. troglodytes
catttattattttgta

SEQ ID NO: 225989 - DNA, 16 bp, P. troglodytes
catttattcaacaaat

SEQ ID NO: 225990 - DNA, 16 bp, P. troglodytes
catttattcagcaaat

SEQ ID NO: 225991 - DNA, 16 bp, P. troglodytes
catttattcagcatct

SEQ ID NO: 225992 - DNA, 16 bp, P. troglodytes
catttattgaacactt

SEQ ID NO: 225993 - DNA, 16 bp, P. troglodytes
catttattgagcacct

SEQ ID NO: 225994 - DNA, 16 bp, P. troglodytes
catttattgagcactt

SEQ ID NO: 225995 - DNA, 16 bp, P. troglodytes
catttattgagtgcat

SEQ ID NO: 225996 - DNA, 16 bp, P. troglodytes
catttattgagtttct

SEQ ID NO: 225997 - DNA, 16 bp, P. troglodytes
catttattgggcactt

SEQ ID NO: 225998 - DNA, 16 bp, P. troglodytes
catttatttagatatt

SEQ ID NO: 225999 - DNA, 16 bp, P. troglodytes
catttatttagatctt

SEQ ID NO: 226000 - DNA, 16 bp, P. troglodytes
catttatttatctgtt

SEQ ID NO: 226001 - DNA, 16 bp, P. troglodytes
catttatttatgtatt

SEQ ID NO: 226002 - DNA, 16 bp, P. troglodytes
catttatttcaaaaaa

SEQ ID NO: 226003 - DNA, 16 bp, P. troglodytes
catttatttgaaatgt

SEQ ID NO: 226004 - DNA, 16 bp, P. troglodytes
catttatttgataatt

SEQ ID NO: 226005 - DNA, 16 bp, P. troglodytes
catttatttgctgttt

SEQ ID NO: 226006 - DNA, 16 bp, P. troglodytes
catttatttgtgactt

SEQ ID NO: 226007 - DNA, 16 bp, P. troglodytes
catttatttttaaaag

SEQ ID NO: 226008 - DNA, 16 bp, P. troglodytes
catttatttttccata

SEQ ID NO: 226009 - DNA, 16 bp, P. troglodytes
catttatttttgctct

SEQ ID NO: 226010 - DNA, 16 bp, P. troglodytes
catttcaaagtaaatt

SEQ ID NO: 226011 - DNA, 16 bp, P. troglodytes
catttcaaatatcttt

SEQ ID NO: 226012 - DNA, 16 bp, P. troglodytes
catttcaaatattctc

SEQ ID NO: 226013 - DNA, 16 bp, P. troglodytes
catttcacaaataagg

SEQ ID NO: 226014 - DNA, 16 bp, P. troglodytes
catttcacagaggagg

SEQ ID NO: 226015 - DNA, 16 bp, P. troglodytes
catttcacagataaga

SEQ ID NO: 226016 - DNA, 16 bp, P. troglodytes
catttcacagatgggg

SEQ ID NO: 226017 - DNA, 16 bp, P. troglodytes
catttcacattttatt

SEQ ID NO: 226018 - DNA, 16 bp, P. troglodytes
catttcactccagcct

SEQ ID NO: 226019 - DNA, 16 bp, P. troglodytes
catttcactctagcct

SEQ ID NO: 226020 - DNA, 16 bp, P. troglodytes
catttcagagcccatt

SEQ ID NO: 226021 - DNA, 16 bp, P. troglodytes
catttcagataaagga

SEQ ID NO: 226022 - DNA, 16 bp, P. troglodytes
catttcaggcagaagg

SEQ ID NO: 226023 - DNA, 16 bp, P. troglodytes
catttcagtttgggaa

SEQ ID NO: 226024 - DNA, 16 bp, P. troglodytes
catttcataaatgttt

SEQ ID NO: 226025 - DNA, 16 bp, P. troglodytes
catttcatccatgtcc

SEQ ID NO: 226026 - DNA, 16 bp, P. troglodytes
catttcattgaccaaa

SEQ ID NO: 226027 - DNA, 16 bp, P. troglodytes
catttcatttaaatta

SEQ ID NO: 226028 - DNA, 16 bp, P. troglodytes
catttcatttcatcct

SEQ ID NO: 226029 - DNA, 16 bp, P. troglodytes
catttccaacaagctc

SEQ ID NO: 226030 - DNA, 16 bp, P. troglodytes
catttccacattttca

SEQ ID NO: 226031 - DNA, 16 bp, P. troglodytes
catttccatttgatga

SEQ ID NO: 226032 - DNA, 16 bp, P. troglodytes
catttccctaatgatc

SEQ ID NO: 226033 - DNA, 16 bp, P. troglodytes
catttccctgtcttct

SEQ ID NO: 226034 - DNA, 16 bp, P. troglodytes
catttcctaattgaat

SEQ ID NO: 226035 - DNA, 16 bp, P. troglodytes
catttcctagaatttt

SEQ ID NO: 226036 - DNA, 16 bp, P. troglodytes
catttcctcacctgta

SEQ ID NO: 226037 - DNA, 16 bp, P. troglodytes
catttcctcatctgta

SEQ ID NO: 226038 - DNA, 16 bp, P. troglodytes
catttcctctgagaac

SEQ ID NO: 226039 - DNA, 16 bp, P. troglodytes
catttcctgacttttt

SEQ ID NO: 226040 - DNA, 16 bp, P. troglodytes
catttcctttccaatt

SEQ ID NO: 226041 - DNA, 16 bp, P. troglodytes
catttcctttgaaaat

SEQ ID NO: 226042 - DNA, 16 bp, P. troglodytes
catttccttttgattt

SEQ ID NO: 226043 - DNA, 16 bp, P. troglodytes
catttcctttttctgt

SEQ ID NO: 226044 - DNA, 16 bp, P. troglodytes
catttctaaaatatat

SEQ ID NO: 226045 - DNA, 16 bp, P. troglodytes
catttctaacaaggtc

SEQ ID NO: 226046 - DNA, 16 bp, P. troglodytes
catttctaattctagt

SEQ ID NO: 226047 - DNA, 16 bp, P. troglodytes
catttctacaaagaaa

SEQ ID NO: 226048 - DNA, 16 bp, P. troglodytes
catttctagattattt

SEQ ID NO: 226049 - DNA, 16 bp, P. troglodytes
catttctataaaaata

SEQ ID NO: 226050 - DNA, 16 bp, P. troglodytes
catttctattttaaag

SEQ ID NO: 226051 - DNA, 16 bp, P. troglodytes
catttctcaaagaaga

SEQ ID NO: 226052 - DNA, 16 bp, P. troglodytes
catttctcaaaggaag

SEQ ID NO: 226053 - DNA, 16 bp, P. troglodytes
catttctcagaacata

SEQ ID NO: 226054 - DNA, 16 bp, P. troglodytes
catttctccaaagaga

SEQ ID NO: 226055 - DNA, 16 bp, P. troglodytes
catttctccatctgta

SEQ ID NO: 226056 - DNA, 16 bp, P. troglodytes
catttctccttgctgc

SEQ ID NO: 226057 - DNA, 16 bp, P. troglodytes
catttctctgaagaag

SEQ ID NO: 226058 - DNA, 16 bp, P. troglodytes
catttctgaagctccc

SEQ ID NO: 226059 - DNA, 16 bp, P. troglodytes
catttctgaattattt

SEQ ID NO: 226060 - DNA, 16 bp, P. troglodytes
catttctgactttatc

SEQ ID NO: 226061 - DNA, 16 bp, P. troglodytes
catttctgattgtttt

SEQ ID NO: 226062 - DNA, 16 bp, P. troglodytes
catttctgatttattt

SEQ ID NO: 226063 - DNA, 16 bp, P. troglodytes
catttctgatttcatt

SEQ ID NO: 226064 - DNA, 16 bp, P. troglodytes
catttctggatgtttt

SEQ ID NO: 226065 - DNA, 16 bp, P. troglodytes
catttctgtcattttt

SEQ ID NO: 226066 - DNA, 16 bp, P. troglodytes
catttctgttgttcat

SEQ ID NO: 226067 - DNA, 16 bp, P. troglodytes
catttctgtttataaa

SEQ ID NO: 226068 - DNA, 16 bp, P. troglodytes
catttctgtttattat

SEQ ID NO: 226069 - DNA, 16 bp, P. troglodytes
catttcttcagagaag

SEQ ID NO: 226070 - DNA, 16 bp, P. troglodytes
catttcttccctgctg

SEQ ID NO: 226071 - DNA, 16 bp, P. troglodytes
catttcttccttctgg

SEQ ID NO: 226072 - DNA, 16 bp, P. troglodytes
catttctttaaaaatg

SEQ ID NO: 226073 - DNA, 16 bp, P. troglodytes
catttctttaacaaat

SEQ ID NO: 226074 - DNA, 16 bp, P. troglodytes
catttctttaagaatg

SEQ ID NO: 226075 - DNA, 16 bp, P. troglodytes
catttctttctgcttt

SEQ ID NO: 226076 - DNA, 16 bp, P. troglodytes
catttctttgctcctg

SEQ ID NO: 226077 - DNA, 16 bp, P. troglodytes
catttcttttatggct

SEQ ID NO: 226078 - DNA, 16 bp, P. troglodytes
catttcttttggaaga

SEQ ID NO: 226079 - DNA, 16 bp, P. troglodytes
catttgaaaaatgttt

SEQ ID NO: 226080 - DNA, 16 bp, P. troglodytes
catttgaaaatatttt

SEQ ID NO: 226081 - DNA, 16 bp, P. troglodytes
catttgaaaatcagtt

SEQ ID NO: 226082 - DNA, 16 bp, P. troglodytes
catttgaaatatttat

SEQ ID NO: 226083 - DNA, 16 bp, P. troglodytes
catttgaacctaggag

SEQ ID NO: 226084 - DNA, 16 bp, P. troglodytes
catttgaagcaaattg

SEQ ID NO: 226085 - DNA, 16 bp, P. troglodytes
catttgaatgtcttct

SEQ ID NO: 226086 - DNA, 16 bp, P. troglodytes
catttgaattaatttt

SEQ ID NO: 226087 - DNA, 16 bp, P. troglodytes
catttgaattggtaga

SEQ ID NO: 226088 - DNA, 16 bp, P. troglodytes
catttgaatttcaaat

SEQ ID NO: 226089 - DNA, 16 bp, P. troglodytes
catttgaatttttaat

SEQ ID NO: 226090 - DNA, 16 bp, P. troglodytes
catttgacagataaag

SEQ ID NO: 226091 - DNA, 16 bp, P. troglodytes
catttgacctggcaat

SEQ ID NO: 226092 - DNA, 16 bp, P. troglodytes
catttgagcctaggag

SEQ ID NO: 226093 - DNA, 16 bp, P. troglodytes
catttgagctcaggag

SEQ ID NO: 226094 - DNA, 16 bp, P. troglodytes
catttgataaaatcca

SEQ ID NO: 226095 - DNA, 16 bp, P. troglodytes
catttgataaatattt

SEQ ID NO: 226096 - DNA, 16 bp, P. troglodytes
catttgatccagaaat

SEQ ID NO: 226097 - DNA, 16 bp, P. troglodytes
catttgatcctcacag

SEQ ID NO: 226098 - DNA, 16 bp, P. troglodytes
catttgatgttgtcag

SEQ ID NO: 226099 - DNA, 16 bp, P. troglodytes
catttgattctcataa

SEQ ID NO: 226100 - DNA, 16 bp, P. troglodytes
catttgcaaaatggaa

SEQ ID NO: 226101 - DNA, 16 bp, P. troglodytes
catttgcaaaatggag

SEQ ID NO: 226102 - DNA, 16 bp, P. troglodytes
catttgcaacaatata

SEQ ID NO: 226103 - DNA, 16 bp, P. troglodytes
catttgcaattttttt

SEQ ID NO: 226104 - DNA, 16 bp, P. troglodytes
catttgcattgctata

SEQ ID NO: 226105 - DNA, 16 bp, P. troglodytes
catttgcatttttatt

SEQ ID NO: 226106 - DNA, 16 bp, P. troglodytes
catttgcattttttaa

SEQ ID NO: 226107 - DNA, 16 bp, P. troglodytes
catttgcttagtaaat

SEQ ID NO: 226108 - DNA, 16 bp, P. troglodytes
catttgcttctggtga

SEQ ID NO: 226109 - DNA, 16 bp, P. troglodytes
catttgcttttcaaaa

SEQ ID NO: 226110 - DNA, 16 bp, P. troglodytes
catttggaaaaaaaaa

SEQ ID NO: 226111 - DNA, 16 bp, P. troglodytes
catttggcaaatattt

SEQ ID NO: 226112 - DNA, 16 bp, P. troglodytes
catttgggttgcttct

SEQ ID NO: 226113 - DNA, 17 bp, P. troglodytes
catttgggttggttcca

SEQ ID NO: 226114 - DNA, 16 bp, P. troglodytes
catttggttttctgtt

SEQ ID NO: 226115 - DNA, 16 bp, P. troglodytes
catttgtaaaatggga

SEQ ID NO: 226116 - DNA, 16 bp, P. troglodytes
catttgtaaaatgggg

SEQ ID NO: 226117 - DNA, 16 bp, P. troglodytes
catttgtaaaatgtaa

SEQ ID NO: 226118 - DNA, 16 bp, P. troglodytes
catttgtacattttct

SEQ ID NO: 226119 - DNA, 16 bp, P. troglodytes
catttgtatacatgtg

SEQ ID NO: 226120 - DNA, 16 bp, P. troglodytes
catttgtatttgtatt

SEQ ID NO: 226121 - DNA, 16 bp, P. troglodytes
catttgtccaaaccca

SEQ ID NO: 226122 - DNA, 16 bp, P. troglodytes
catttgtccttttgtg

SEQ ID NO: 226123 - DNA, 16 bp, P. troglodytes
catttgtcttttaaat

SEQ ID NO: 226124 - DNA, 16 bp, P. troglodytes
catttgtctttttggt

SEQ ID NO: 226125 - DNA, 16 bp, P. troglodytes
catttgtgtacagatt

SEQ ID NO: 226126 - DNA, 16 bp, P. troglodytes
catttgtgttttttaa

SEQ ID NO: 226127 - DNA, 16 bp, P. troglodytes
catttgttgaaaaaaa

SEQ ID NO: 226128 - DNA, 16 bp, P. troglodytes
catttgttgaaaaata

SEQ ID NO: 226129 - DNA, 16 bp, P. troglodytes
catttgttgagcactt

SEQ ID NO: 226130 - DNA, 16 bp, P. troglodytes
catttgttgtccccta

SEQ ID NO: 226131 - DNA, 16 bp, P. troglodytes
catttgtttacatgtt

SEQ ID NO: 226132 - DNA, 16 bp, P. troglodytes
catttgtttctcacag

SEQ ID NO: 226133 - DNA, 16 bp, P. troglodytes
catttgttttatgaat

SEQ ID NO: 226134 - DNA, 16 bp, P. troglodytes
catttgtttttccatt

SEQ ID NO: 226135 - DNA, 16 bp, P. troglodytes
cattttaaaaaatctt

SEQ ID NO: 226136 - DNA, 16 bp, P. troglodytes
cattttaaaaagaaaa

SEQ ID NO: 226137 - DNA, 16 bp, P. troglodytes
cattttaaaaagtatt

SEQ ID NO: 226138 - DNA, 16 bp, P. troglodytes
cattttaaaaatacat

SEQ ID NO: 226139 - DNA, 16 bp, P. troglodytes
cattttaaaaatgaac

SEQ ID NO: 226140 - DNA, 16 bp, P. troglodytes
cattttaaaaatgttt

SEQ ID NO: 226141 - DNA, 16 bp, P. troglodytes
cattttaaaaattgtt

SEQ ID NO: 226142 - DNA, 16 bp, P. troglodytes
cattttaaaacagaaa

SEQ ID NO: 226143 - DNA, 16 bp, P. troglodytes
cattttaaaactattt

SEQ ID NO: 226144 - DNA, 16 bp, P. troglodytes
cattttaaaatatgct

SEQ ID NO: 226145 - DNA, 16 bp, P. troglodytes
cattttaaaatgaaaa

SEQ ID NO: 226146 - DNA, 16 bp, P. troglodytes
cattttaaaatgtata

SEQ ID NO: 226147 - DNA, 16 bp, P. troglodytes
cattttaaaattagat

SEQ ID NO: 226148 - DNA, 16 bp, P. troglodytes
cattttaaaattaggt

SEQ ID NO: 226149 - DNA, 16 bp, P. troglodytes
cattttaaagacaaaa

SEQ ID NO: 226150 - DNA, 16 bp, P. troglodytes
cattttaaagacattt

SEQ ID NO: 226151 - DNA, 16 bp, P. troglodytes
cattttaaagtaacta

SEQ ID NO: 226152 - DNA, 16 bp, P. troglodytes
cattttaaagtatata

SEQ ID NO: 226153 - DNA, 16 bp, P. troglodytes
cattttaaatatgaag

SEQ ID NO: 226154 - DNA, 16 bp, P. troglodytes
cattttaaatatttga

SEQ ID NO: 226155 - DNA, 16 bp, P. troglodytes
cattttaaatgaattt

SEQ ID NO: 226156 - DNA, 16 bp, P. troglodytes
cattttaaccaggcat

SEQ ID NO: 226157 - DNA, 16 bp, P. troglodytes
cattttaaccatcttt

SEQ ID NO: 226158 - DNA, 16 bp, P. troglodytes
cattttaactggcatg

SEQ ID NO: 226159 - DNA, 16 bp, P. troglodytes
cattttaacttttaaa

SEQ ID NO: 226160 - DNA, 16 bp, P. troglodytes
cattttaagaaagaac

SEQ ID NO: 226161 - DNA, 16 bp, P. troglodytes
cattttaataaatgta

SEQ ID NO: 226162 - DNA, 16 bp, P. troglodytes
cattttaatagaaaaa

SEQ ID NO: 226163 - DNA, 16 bp, P. troglodytes
cattttaatgatattg

SEQ ID NO: 226164 - DNA, 16 bp, P. troglodytes
cattttaatgtattta

SEQ ID NO: 226165 - DNA, 16 bp, P. troglodytes
cattttaatgtgcatt

SEQ ID NO: 226166 - DNA, 16 bp, P. troglodytes
cattttaatttagaaa

SEQ ID NO: 226167 - DNA, 16 bp, P. troglodytes
cattttacaaaagaaa

SEQ ID NO: 226168 - DNA, 16 bp, P. troglodytes
cattttacaaaggaag

SEQ ID NO: 226169 - DNA, 16 bp, P. troglodytes
cattttacaaatgaga

SEQ ID NO: 226170 - DNA, 16 bp, P. troglodytes
cattttacggatgagg

SEQ ID NO: 226171 - DNA, 16 bp, P. troglodytes
cattttactttaaaaa

SEQ ID NO: 226172 - DNA, 16 bp, P. troglodytes
cattttagaaaatgtt

SEQ ID NO: 226173 - DNA, 16 bp, P. troglodytes
cattttagaaatattt

SEQ ID NO: 226174 - DNA, 16 bp, P. troglodytes
cattttagagatgggg

SEQ ID NO: 226175 - DNA, 16 bp, P. troglodytes
cattttagataaggga

SEQ ID NO: 226176 - DNA, 16 bp, P. troglodytes
cattttaggccaggca

SEQ ID NO: 226177 - DNA, 16 bp, P. troglodytes
cattttagtcatttta

SEQ ID NO: 226178 - DNA, 16 bp, P. troglodytes
cattttagttttaatt

SEQ ID NO: 226179 - DNA, 16 bp, P. troglodytes
cattttataaaataca

SEQ ID NO: 226180 - DNA, 16 bp, P. troglodytes
cattttataactgaaa

SEQ ID NO: 226181 - DNA, 16 bp, P. troglodytes
cattttataagaaaaa

SEQ ID NO: 226182 - DNA, 16 bp, P. troglodytes
cattttatatcaggga

SEQ ID NO: 226183 - DNA, 16 bp, P. troglodytes
cattttatcaaaataa

SEQ ID NO: 226184 - DNA, 16 bp, P. troglodytes
cattttatcttaaaaa

SEQ ID NO: 226185 - DNA, 16 bp, P. troglodytes
cattttatgaaaaaga

SEQ ID NO: 226186 - DNA, 16 bp, P. troglodytes
cattttatgtaagaga

SEQ ID NO: 226187 - DNA, 16 bp, P. troglodytes
cattttatgtaaggga

SEQ ID NO: 226188 - DNA, 16 bp, P. troglodytes
cattttattaggccag

SEQ ID NO: 226189 - DNA, 16 bp, P. troglodytes
cattttattatggctt

SEQ ID NO: 226190 - DNA, 16 bp, P. troglodytes
cattttattcctaaat

SEQ ID NO: 226191 - DNA, 16 bp, P. troglodytes
cattttattgcaatat

SEQ ID NO: 226192 - DNA, 16 bp, P. troglodytes
cattttatttcagttt

SEQ ID NO: 226193 - DNA, 16 bp, P. troglodytes
cattttatttcatgta

SEQ ID NO: 226194 - DNA, 16 bp, P. troglodytes
cattttatttgcaaaa

SEQ ID NO: 226195 - DNA, 16 bp, P. troglodytes
cattttcaaaagcaaa

SEQ ID NO: 226196 - DNA, 16 bp, P. troglodytes
cattttcaaactacag

SEQ ID NO: 226197 - DNA, 16 bp, P. troglodytes
cattttcaaagataaa

SEQ ID NO: 226198 - DNA, 16 bp, P. troglodytes
cattttcaacattttt

SEQ ID NO: 226199 - DNA, 16 bp, P. troglodytes
cattttcaagtgtaca

SEQ ID NO: 226200 - DNA, 16 bp, P. troglodytes
cattttcaataaatct

SEQ ID NO: 226201 - DNA, 16 bp, P. troglodytes
cattttcaattaaaaa

SEQ ID NO: 226202 - DNA, 17 bp, P. troglodytes
cattttcacaatattga

SEQ ID NO: 226203 - DNA, 16 bp, P. troglodytes
cattttcatatgaatt

SEQ ID NO: 226204 - DNA, 16 bp, P. troglodytes
cattttcatattgcta

SEQ ID NO: 226205 - DNA, 16 bp, P. troglodytes
cattttcattctctta

SEQ ID NO: 226206 - DNA, 16 bp, P. troglodytes
cattttcatttcactt

SEQ ID NO: 226207 - DNA, 16 bp, P. troglodytes
cattttcatttccatt

SEQ ID NO: 226208 - DNA, 16 bp, P. troglodytes
cattttcatttctaat

SEQ ID NO: 226209 - DNA, 16 bp, P. troglodytes
cattttcatttctgat

SEQ ID NO: 226210 - DNA, 16 bp, P. troglodytes
cattttcattttgcac

SEQ ID NO: 226211 - DNA, 16 bp, P. troglodytes
cattttcccaaagaag

SEQ ID NO: 226212 - DNA, 16 bp, P. troglodytes
cattttcctaagtgaa

SEQ ID NO: 226213 - DNA, 16 bp, P. troglodytes
cattttcctaatggct

SEQ ID NO: 226214 - DNA, 16 bp, P. troglodytes
cattttcctcatctgc

SEQ ID NO: 226215 - DNA, 16 bp, P. troglodytes
cattttcctcatttta

SEQ ID NO: 226216 - DNA, 16 bp, P. troglodytes
cattttcctgtttctt

SEQ ID NO: 226217 - DNA, 16 bp, P. troglodytes
cattttccttagcaaa

SEQ ID NO: 226218 - DNA, 16 bp, P. troglodytes
cattttccttctgtct

SEQ ID NO: 226219 - DNA, 16 bp, P. troglodytes
cattttctaaaaatat

SEQ ID NO: 226220 - DNA, 16 bp, P. troglodytes
cattttctaacaaaga

SEQ ID NO: 226221 - DNA, 16 bp, P. troglodytes
cattttctagaatttt

SEQ ID NO: 226222 - DNA, 16 bp, P. troglodytes
cattttctagctgtgt

SEQ ID NO: 226223 - DNA, 16 bp, P. troglodytes
cattttctcatgtgtt

SEQ ID NO: 226224 - DNA, 16 bp, P. troglodytes
cattttctctgtattt

SEQ ID NO: 226225 - DNA, 16 bp, P. troglodytes
cattttctcttaaaaa

SEQ ID NO: 226226 - DNA, 16 bp, P. troglodytes
cattttctcttgccac

SEQ ID NO: 226227 - DNA, 16 bp, P. troglodytes
cattttctctttaaaa

SEQ ID NO: 226228 - DNA, 16 bp, P. troglodytes
cattttctggggaaaa

SEQ ID NO: 226229 - DNA, 16 bp, P. troglodytes
cattttcttaaaacaa

SEQ ID NO: 226230 - DNA, 16 bp, P. troglodytes
cattttcttaaaataa

SEQ ID NO: 226231 - DNA, 16 bp, P. troglodytes
cattttcttctgcttt

SEQ ID NO: 226232 - DNA, 16 bp, P. troglodytes
cattttcttcttcctg

SEQ ID NO: 226233 - DNA, 16 bp, P. troglodytes
cattttctttatttag

SEQ ID NO: 226234 - DNA, 16 bp, P. troglodytes
cattttctttgattct

SEQ ID NO: 226235 - DNA, 16 bp, P. troglodytes
cattttcttttgggtt

SEQ ID NO: 226236 - DNA, 16 bp, P. troglodytes
cattttgaaaaaaaaa

SEQ ID NO: 226237 - DNA, 16 bp, P. troglodytes
cattttgaaaaacagt

SEQ ID NO: 226238 - DNA, 16 bp, P. troglodytes
cattttgaaaataaaa

SEQ ID NO: 226239 - DNA, 16 bp, P. troglodytes
cattttgaaaatgaga

SEQ ID NO: 226240 - DNA, 16 bp, P. troglodytes
cattttgaaaatgttt

SEQ ID NO: 226241 - DNA, 16 bp, P. troglodytes
cattttgaagattttt

SEQ ID NO: 226242 - DNA, 16 bp, P. troglodytes
cattttgaattcattt

SEQ ID NO: 226243 - DNA, 16 bp, P. troglodytes
cattttgaggaaaaaa

SEQ ID NO: 226244 - DNA, 16 bp, P. troglodytes
cattttgatttgattt

SEQ ID NO: 226245 - DNA, 16 bp, P. troglodytes
cattttgattttaatt

SEQ ID NO: 226246 - DNA, 16 bp, P. troglodytes
cattttgcaaatgaag

SEQ ID NO: 226247 - DNA, 16 bp, P. troglodytes
cattttgcaagatgaa

SEQ ID NO: 226248 - DNA, 16 bp, P. troglodytes
cattttgcactgggcc

SEQ ID NO: 226249 - DNA, 16 bp, P. troglodytes
cattttgctcttgttg

SEQ ID NO: 226250 - DNA, 16 bp, P. troglodytes
cattttgcttttctct

SEQ ID NO: 226251 - DNA, 16 bp, P. troglodytes
cattttgctttttaaa

SEQ ID NO: 226252 - DNA, 16 bp, P. troglodytes
cattttggaaaaaaaa

SEQ ID NO: 226253 - DNA, 16 bp, P. troglodytes
cattttggaaaatatt

SEQ ID NO: 226254 - DNA, 16 bp, P. troglodytes
cattttggaagacagt

SEQ ID NO: 226255 - DNA, 16 bp, P. troglodytes
cattttggatttggga

SEQ ID NO: 226256 - DNA, 16 bp, P. troglodytes
cattttggattttgga

SEQ ID NO: 226257 - DNA, 16 bp, P. troglodytes
cattttgggaggatga

SEQ ID NO: 226258 - DNA, 16 bp, P. troglodytes
cattttgtaaataaag

SEQ ID NO: 226259 - DNA, 16 bp, P. troglodytes
cattttgtagatgaaa

SEQ ID NO: 226260 - DNA, 16 bp, P. troglodytes
cattttgtatatattt

SEQ ID NO: 226261 - DNA, 16 bp, P. troglodytes
cattttgtgttgctat

SEQ ID NO: 226262 - DNA, 16 bp, P. troglodytes
cattttgttaattgtt

SEQ ID NO: 226263 - DNA, 37 bp, P. troglodytes; identical to SEQ ID NO: 72217

SEQ ID NO: 226264 - DNA, 16 bp, P. troglodytes
cattttgttgcctagg

SEQ ID NO: 226265 - DNA, 16 bp, P. troglodytes
cattttgtttcattta

SEQ ID NO: 226266 - DNA, 16 bp, P. troglodytes
cattttgtttttgaaa

SEQ ID NO: 226267 - DNA, 16 bp, P. troglodytes
catttttaaaagtcta

SEQ ID NO: 226268 - DNA, 16 bp, P. troglodytes
catttttaaaggaaga

SEQ ID NO: 226269 - DNA, 16 bp, P. troglodytes
catttttaaataacca

SEQ ID NO: 226270 - DNA, 16 bp, P. troglodytes
catttttaaatcagat

SEQ ID NO: 226271 - DNA, 16 bp, P. troglodytes
catttttaacaagctc

SEQ ID NO: 226272 - DNA, 16 bp, P. troglodytes
catttttaagcataca

SEQ ID NO: 226273 - DNA, 16 bp, P. troglodytes
catttttaatattttg

SEQ ID NO: 226274 - DNA, 16 bp, P. troglodytes
catttttacaatattg

SEQ ID NO: 226275 - DNA, 16 bp, P. troglodytes
catttttacaccaaat

SEQ ID NO: 226276 - DNA, 16 bp, P. troglodytes
catttttacttgaaaa

SEQ ID NO: 226277 - DNA, 16 bp, P. troglodytes
catttttagaaatatt

SEQ ID NO: 226278 - DNA, 30 bp, P. troglodytes
catttttagtagagacagggtttcaccatg

SEQ ID NO: 226279 - DNA, 16 bp, P. troglodytes
catttttagtggagat

SEQ ID NO: 226280 - DNA, 16 bp, P. troglodytes
catttttataaaactt

SEQ ID NO: 226281 - DNA, 16 bp, P. troglodytes
catttttataaacaaa

SEQ ID NO: 226282 - DNA, 16 bp, P. troglodytes
catttttatacatcaa

SEQ ID NO: 226283 - DNA, 16 bp, P. troglodytes
catttttatatctgta

SEQ ID NO: 226284 - DNA, 16 bp, P. troglodytes
catttttatgatattg

SEQ ID NO: 226285 - DNA, 16 bp, P. troglodytes
catttttatgttttaa

SEQ ID NO: 226286 - DNA, 16 bp, P. troglodytes
catttttcaaaatgta

SEQ ID NO: 226287 - DNA, 16 bp, P. troglodytes
catttttcaaaggaaa

SEQ ID NO: 226288 - DNA, 16 bp, P. troglodytes
catttttcaaataaaa

SEQ ID NO: 226289 - DNA, 16 bp, P. troglodytes
catttttcaagtattt

SEQ ID NO: 226290 - DNA, 16 bp, P. troglodytes
catttttcacctatca

SEQ ID NO: 226291 - DNA, 16 bp, P. troglodytes
catttttcagctccca

SEQ ID NO: 226292 - DNA, 16 bp, P. troglodytes
catttttcatatgttt

SEQ ID NO: 226293 - DNA, 16 bp, P. troglodytes
catttttcatgtgctt

SEQ ID NO: 226294 - DNA, 16 bp, P. troglodytes
catttttcatgttaaa

SEQ ID NO: 226295 - DNA, 16 bp, P. troglodytes
catttttcattctcac

SEQ ID NO: 226296 - DNA, 16 bp, P. troglodytes
catttttccaaagaaa

SEQ ID NO: 226297 - DNA, 16 bp, P. troglodytes
catttttcctaatttg

SEQ ID NO: 226298 - DNA, 16 bp, P. troglodytes
catttttctaatgatt

SEQ ID NO: 226299 - DNA, 16 bp, P. troglodytes
catttttctcatttgt

SEQ ID NO: 226300 - DNA, 16 bp, P. troglodytes
catttttctctctgct

SEQ ID NO: 226301 - DNA, 16 bp, P. troglodytes
catttttctcttgcca

SEQ ID NO: 226302 - DNA, 16 bp, P. troglodytes
catttttctggggaga

SEQ ID NO: 226303 - DNA, 16 bp, P. troglodytes
catttttcttactgat

SEQ ID NO: 226304 - DNA, 16 bp, P. troglodytes
catttttcttagaaaa

SEQ ID NO: 226305 - DNA, 16 bp, P. troglodytes
catttttcttgaaaaa

SEQ ID NO: 226306 - DNA, 16 bp, P. troglodytes
catttttctttaaaaa

SEQ ID NO: 226307 - DNA, 16 bp, P. troglodytes
catttttctttcatgt

SEQ ID NO: 226308 - DNA, 16 bp, P. troglodytes
catttttctttgaaaa

SEQ ID NO: 226309 - DNA, 16 bp, P. troglodytes
catttttgacaaagtt

SEQ ID NO: 226310 - DNA, 16 bp, P. troglodytes
catttttgcatatgtc

SEQ ID NO: 226311 - DNA, 16 bp, P. troglodytes
catttttgtaaaaaaa

SEQ ID NO: 226312 - DNA, 16 bp, P. troglodytes
catttttgtaataaaa

SEQ ID NO: 226313 - DNA, 16 bp, P. troglodytes
catttttgtttataaa

SEQ ID NO: 226314 - DNA, 16 bp, P. troglodytes
catttttgtttctaaa

SEQ ID NO: 226315 - DNA, 16 bp, P. troglodytes
catttttgttttaatc

SEQ ID NO: 226316 - DNA, 16 bp, P. troglodytes
cattttttaaaaacta

SEQ ID NO: 226317 - DNA, 16 bp, P. troglodytes
cattttttaaaaagca

SEQ ID NO: 226318 - DNA, 16 bp, P. troglodytes
cattttttaaaaattc

SEQ ID NO: 226319 - DNA, 16 bp, P. troglodytes
cattttttaaaatttg

SEQ ID NO: 226320 - DNA, 16 bp, P. troglodytes
cattttttaaatcagg

SEQ ID NO: 226321 - DNA, 16 bp, P. troglodytes
cattttttaaatccag

SEQ ID NO: 226322 - DNA, 16 bp, P. troglodytes
cattttttattgaatt

SEQ ID NO: 226323 - DNA, 16 bp, P. troglodytes
cattttttattgtggt

SEQ ID NO: 226324 - DNA, 16 bp, P. troglodytes
cattttttcagatgag

SEQ ID NO: 226325 - DNA, 16 bp, P. troglodytes
cattttttcatatttg

SEQ ID NO: 226326 - DNA, 16 bp, P. troglodytes
cattttttcatgtgtt

SEQ ID NO: 226327 - DNA, 16 bp, P. troglodytes
cattttttcatttgtc

SEQ ID NO: 226328 - DNA, 16 bp, P. troglodytes
cattttttccccatct

SEQ ID NO: 226329 - DNA, 16 bp, P. troglodytes
cattttttgtgtgtga

SEQ ID NO: 226330 - DNA, 16 bp, P. troglodytes
cattttttgtgtgtgt

SEQ ID NO: 226331 - DNA, 16 bp, P. troglodytes
catttttttcataaaa

SEQ ID NO: 226332 - DNA, 16 bp, P. troglodytes
catttttttcatatgt

SEQ ID NO: 226333 - DNA, 16 bp, P. troglodytes
catttttttcatctgt

SEQ ID NO: 226334 - DNA, 16 bp, P. troglodytes
catttttttctaatgt

SEQ ID NO: 226335 - DNA, 16 bp, P. troglodytes
catttttttctagatt

SEQ ID NO: 226336 - DNA, 16 bp, P. troglodytes
catttttttctgcatt

SEQ ID NO: 226337 - DNA, 16 bp, P. troglodytes
cattttttttaatgtg

SEQ ID NO: 226338 - DNA, 16 bp, P. troglodytes
cattttttttcagcac

SEQ ID NO: 226339 - DNA, 16 bp, P. troglodytes
cattttttttgtagag

SEQ ID NO: 226340 - DNA, 16 bp, P. troglodytes
cattttttttttcaga

SEQ ID NO: 226341 - DNA, 16 bp, P. troglodytes
ccaaaaaaatttttta

SEQ ID NO: 226342 - DNA, 16 bp, P. troglodytes
ccaaaaaactattgaa

SEQ ID NO: 226343 - DNA, 16 bp, P. troglodytes
ccaaaaaactgttaga

SEQ ID NO: 226344 - DNA, 16 bp, P. troglodytes
ccaaaaaagcccagga

SEQ ID NO: 226345 - DNA, 16 bp, P. troglodytes
ccaaaaaagtccagga

SEQ ID NO: 226346 - DNA, 16 bp, P. troglodytes
ccaaaaaatatatgaa

SEQ ID NO: 226347 - DNA, 16 bp, P. troglodytes
ccaaaaacaattgcaa

SEQ ID NO: 226348 - DNA, 16 bp, P. troglodytes
ccaaaaactccaccct

SEQ ID NO: 226349 - DNA, 16 bp, P. troglodytes
ccaaaaagctcttaga

SEQ ID NO: 226350 - DNA, 16 bp, P. troglodytes
ccaaaaagctgggatt

SEQ ID NO: 226351 - DNA, 16 bp, P. troglodytes
ccaaaaaggagcccaa

SEQ ID NO: 226352 - DNA, 16 bp, P. troglodytes
ccaaaaataaaattct

SEQ ID NO: 226353 - DNA, 16 bp, P. troglodytes
ccaaaaatgtataaaa

SEQ ID NO: 226354 - DNA, 16 bp, P. troglodytes
ccaaaaattattttta

SEQ ID NO: 226355 - DNA, 16 bp, P. troglodytes
ccaaaaattttcaccg

SEQ ID NO: 226356 - DNA, 16 bp, P. troglodytes
ccaaaacaaagggcta

SEQ ID NO: 226357 - DNA, 16 bp, P. troglodytes
ccaaaacagaactctt

SEQ ID NO: 226358 - DNA, 16 bp, P. troglodytes
ccaaaaccaaggggct

SEQ ID NO: 226359 - DNA, 16 bp, P. troglodytes
ccaaaaccaatgaaag

SEQ ID NO: 226360 - DNA, 16 bp, P. troglodytes
ccaaaaccagaatgcc

SEQ ID NO: 226361 - DNA, 16 bp, P. troglodytes
ccaaaaccaggaaaga

SEQ ID NO: 226362 - DNA, 16 bp, P. troglodytes
ccaaaacctggaagag

SEQ ID NO: 226363 - DNA, 16 bp, P. troglodytes
ccaaaactcatgttga

SEQ ID NO: 226364 - DNA, 16 bp, P. troglodytes
ccaaaactgtgaaaaa

SEQ ID NO: 226365 - DNA, 16 bp, P. troglodytes
ccaaaagaaaatgcaa

SEQ ID NO: 226366 - DNA, 16 bp, P. troglodytes
ccaaaagaaaggaaat

SEQ ID NO: 226367 - DNA, 16 bp, P. troglodytes
ccaaaagactataaat

SEQ ID NO: 226368 - DNA, 16 bp, P. troglodytes
ccaaaagagaagaaat

SEQ ID NO: 226369 - DNA, 16 bp, P. troglodytes
ccaaaagagagaattt

SEQ ID NO: 226370 - DNA, 16 bp, P. troglodytes
ccaaaagatatgttca

SEQ ID NO: 226371 - DNA, 16 bp, P. troglodytes
ccaaaagatgaaaaca

SEQ ID NO: 226372 - DNA, 16 bp, P. troglodytes
ccaaaagattggacat

SEQ ID NO: 226373 - DNA, 16 bp, P. troglodytes
ccaaaagatttgaaat

SEQ ID NO: 226374 - DNA, 16 bp, P. troglodytes
ccaaaagcaagtgcaa

SEQ ID NO: 226375 - DNA, 16 bp, P. troglodytes
ccaaaagctagcagaa

SEQ ID NO: 226376 - DNA, 16 bp, P. troglodytes
ccaaaagctggaagca

SEQ ID NO: 226377 - DNA, 16 bp, P. troglodytes
ccaaaaggaaggaaat

SEQ ID NO: 226378 - DNA, 16 bp, P. troglodytes
ccaaaaggagggaaat

SEQ ID NO: 226379 - DNA, 16 bp, P. troglodytes
ccaaaaggcagaagca

SEQ ID NO: 226380 - DNA, 16 bp, P. troglodytes
ccaaaagtgacaaatg

SEQ ID NO: 226381 - DNA, 16 bp, P. troglodytes
ccaaaataaacaaatg

SEQ ID NO: 226382 - DNA, 16 bp, P. troglodytes
ccaaaatacataaaga

SEQ ID NO: 226383 - DNA, 16 bp, P. troglodytes
ccaaaatattttttaa

SEQ ID NO: 226384 - DNA, 16 bp, P. troglodytes
ccaaaatcaaatgcaa

SEQ ID NO: 226385 - DNA, 16 bp, P. troglodytes
ccaaaatcacacagct

SEQ ID NO: 226386 - DNA, 16 bp, P. troglodytes
ccaaaatccaaagagg

SEQ ID NO: 226387 - DNA, 16 bp, P. troglodytes
ccaaaatcctgggatt

SEQ ID NO: 226388 - DNA, 16 bp, P. troglodytes
ccaaaatccttaacaa

SEQ ID NO: 226389 - DNA, 16 bp, P. troglodytes
ccaaaatctaaaactt

SEQ ID NO: 226390 - DNA, 16 bp, P. troglodytes
ccaaaatctgaaaaaa

SEQ ID NO: 226391 - DNA, 16 bp, P. troglodytes
ccaaaatgcccatcag

SEQ ID NO: 226392 - DNA, 16 bp, P. troglodytes
ccaaaatggaataaaa

SEQ ID NO: 226393 - DNA, 16 bp, P. troglodytes
ccaaaatgtggccaga

SEQ ID NO: 226394 - DNA, 16 bp, P. troglodytes
ccaaaattcacagatg

SEQ ID NO: 226395 - DNA, 16 bp, P. troglodytes
ccaaaatttatatgaa

SEQ ID NO: 226396 - DNA, 16 bp, P. troglodytes
ccaaaatttatatttt

SEQ ID NO: 226397 - DNA, 16 bp, P. troglodytes
ccaaacaccacacgtt

SEQ ID NO: 226398 - DNA, 16 bp, P. troglodytes
ccaaacaccacatatt

SEQ ID NO: 226399 - DNA, 16 bp, P. troglodytes
ccaaaccaattaaatc

SEQ ID NO: 226400 - DNA, 16 bp, P. troglodytes
ccaaacctactgaatc

SEQ ID NO: 226401 - DNA, 16 bp, P. troglodytes
ccaaacctcagttctt

SEQ ID NO: 226402 - DNA, 16 bp, P. troglodytes
ccaaacctccccagac

SEQ ID NO: 226403 - DNA, 16 bp, P. troglodytes
ccaaactatatcaata

SEQ ID NO: 226404 - DNA, 16 bp, P. troglodytes
ccaaactcctggcttc

SEQ ID NO: 226405 - DNA, 16 bp, P. troglodytes
ccaaactgaaactgta

SEQ ID NO: 226406 - DNA, 16 bp, P. troglodytes
ccaaactgtcccacat

SEQ ID NO: 226407 - DNA, 16 bp, P. troglodytes
ccaaactgtgctctga

SEQ ID NO: 226408 - DNA, 16 bp, P. troglodytes
ccaaactgttttccaa

SEQ ID NO: 226409 - DNA, 16 bp, P. troglodytes
ccaaactttcaaagaa

SEQ ID NO: 226410 - DNA, 16 bp, P. troglodytes
ccaaacttttatgctc

SEQ ID NO: 226411 - DNA, 16 bp, P. troglodytes
ccaaagaaaatgaaat

SEQ ID NO: 226412 - DNA, 16 bp, P. troglodytes
ccaaagaaacctgaaa

SEQ ID NO: 226413 - DNA, 16 bp, P. troglodytes
ccaaagaaatgaaaac

SEQ ID NO: 226414 - DNA, 16 bp, P. troglodytes
ccaaagaaatggagat

SEQ ID NO: 226415 - DNA, 16 bp, P. troglodytes
ccaaagaagaaattaa

SEQ ID NO: 226416 - DNA, 16 bp, P. troglodytes
ccaaagaagacatgca

SEQ ID NO: 226417 - DNA, 16 bp, P. troglodytes
ccaaagaagttgaaaa

SEQ ID NO: 226418 - DNA, 16 bp, P. troglodytes
ccaaagaagtttctga

SEQ ID NO: 226419 - DNA, 16 bp, P. troglodytes
ccaaagaatatataca

SEQ ID NO: 226420 - DNA, 16 bp, P. troglodytes
ccaaagaattgaaaac

SEQ ID NO: 226421 - DNA, 16 bp, P. troglodytes
ccaaagacaaaaatca

SEQ ID NO: 226422 - DNA, 16 bp, P. troglodytes
ccaaagactccaccaa

SEQ ID NO: 226423 - DNA, 16 bp, P. troglodytes
ccaaagagaaattctg

SEQ ID NO: 226424 - DNA, 16 bp, P. troglodytes
ccaaagataaagagaa

SEQ ID NO: 226425 - DNA, 16 bp, P. troglodytes
ccaaagatagataaat

SEQ ID NO: 226426 - DNA, 16 bp, P. troglodytes
ccaaagatagcagaag

SEQ ID NO: 226427 - DNA, 16 bp, P. troglodytes
ccaaagcaagaggatc

SEQ ID NO: 226428 - DNA, 16 bp, P. troglodytes
ccaaagcaagaggatt

SEQ ID NO: 226429 - DNA, 16 bp, P. troglodytes
ccaaagcaagtagaag

SEQ ID NO: 226430 - DNA, 16 bp, P. troglodytes
ccaaagcaattctgaa

SEQ ID NO: 226431 - DNA, 16 bp, P. troglodytes
ccaaagcactgtgatt

SEQ ID NO: 226432 - DNA, 16 bp, P. troglodytes
ccaaagcacttggatt

SEQ ID NO: 226433 - DNA, 16 bp, P. troglodytes
ccaaagccaacatcat

SEQ ID NO: 226434 - DNA, 16 bp, P. troglodytes
ccaaagccacacagct

SEQ ID NO: 226435 - DNA, 16 bp, P. troglodytes
ccaaagccagataaag

SEQ ID NO: 226436 - DNA, 16 bp, P. troglodytes
ccaaagccctgggatt

SEQ ID NO: 226437 - DNA, 16 bp, P. troglodytes
ccaaagcctgaaggct

SEQ ID NO: 226438 - DNA, 16 bp, P. troglodytes
ccaaaggaaaagaagt

SEQ ID NO: 226439 - DNA, 16 bp, P. troglodytes
ccaaaggaaagcagct

SEQ ID NO: 226440 - DNA, 16 bp, P. troglodytes
ccaaaggaaaggaagt

SEQ ID NO: 226441 - DNA, 16 bp, P. troglodytes
ccaaaggaaataaaat

SEQ ID NO: 226442 - DNA, 16 bp, P. troglodytes
ccaaaggaaatggaat

SEQ ID NO: 226443 - DNA, 16 bp, P. troglodytes
ccaaaggaagcactaa

SEQ ID NO: 226444 - DNA, 16 bp, P. troglodytes
ccaaaggaatagaaat

SEQ ID NO: 226445 - DNA, 16 bp, P. troglodytes
ccaaaggagacataca

SEQ ID NO: 226446 - DNA, 16 bp, P. troglodytes
ccaaaggcacaggcaa

SEQ ID NO: 226447 - DNA, 16 bp, P. troglodytes
ccaaaggcaggaaaaa

SEQ ID NO: 226448 - DNA, 16 bp, P. troglodytes
ccaaaggccccacctc

SEQ ID NO: 226449 - DNA, 16 bp, P. troglodytes
ccaaaggccccatctc

SEQ ID NO: 226450 - DNA, 16 bp, P. troglodytes
ccaaaggcctcacctt

SEQ ID NO: 226451 - DNA, 16 bp, P. troglodytes
ccaaagtacacaggca

SEQ ID NO: 226452 - DNA, 16 bp, P. troglodytes
ccaaagtactgggaat

SEQ ID NO: 226453 - DNA, 16 bp, P. troglodytes
ccaaagtcaaaatgaa

SEQ ID NO: 226454 - DNA, 16 bp, P. troglodytes
ccaaagtcacacaatt

SEQ ID NO: 226455 - DNA, 16 bp, P. troglodytes
ccaaagtcatacagct

SEQ ID NO: 226456 - DNA, 16 bp, P. troglodytes
ccaaagtgatctcctt

SEQ ID NO: 226457 - DNA, 16 bp, P. troglodytes
ccaaagtgattgtacc

SEQ ID NO: 226458 - DNA, 16 bp, P. troglodytes
ccaaagtgcaaggatt

SEQ ID NO: 226459 - DNA, 16 bp, P. troglodytes
ccaaagtgcaggatta

SEQ ID NO: 226460 - DNA, 16 bp, P. troglodytes
ccaaagtgcatggatt

SEQ ID NO: 226461 - DNA, 16 bp, P. troglodytes
ccaaagtgctgacatt

SEQ ID NO: 226462 - DNA, 16 bp, P. troglodytes
ccaaagtgctgcaatt

SEQ ID NO: 226463 - DNA, 16 bp, P. troglodytes
ccaaagtgctgggata

SEQ ID NO: 226464 - DNA, 16 bp, P. troglodytes
ccaaagtgctgggatc

SEQ ID NO: 226465 - DNA, 16 bp, P. troglodytes
ccaaagtgctggtgtg

SEQ ID NO: 226466 - DNA, 16 bp, P. troglodytes
ccaaagtgctgtgatg

SEQ ID NO: 226467 - DNA, 21 bp, P. troglodytes
ccaaagtgggagcccaggcag

SEQ ID NO: 226468 - DNA, 16 bp, P. troglodytes
ccaaagtgttgagatt

SEQ ID NO: 226469 - DNA, 16 bp, P. troglodytes
ccaaagttctgggaat

SEQ ID NO: 226470 - DNA, 16 bp, P. troglodytes
ccaaagttgagaacca

SEQ ID NO: 226471 - DNA, 16 bp, P. troglodytes
ccaaagttgtttatca

SEQ ID NO: 226472 - DNA, 16 bp, P. troglodytes
ccaaagttttggaatt

SEQ ID NO: 226473 - DNA, 16 bp, P. troglodytes
ccaaataaacagaatt

SEQ ID NO: 226474 - DNA, 16 bp, P. troglodytes
ccaaataaggaagggg

SEQ ID NO: 226475 - DNA, 16 bp, P. troglodytes
ccaaataaggcaaatg

SEQ ID NO: 226476 - DNA, 16 bp, P. troglodytes
ccaaatacacctcttt

SEQ ID NO: 226477 - DNA, 16 bp, P. troglodytes
ccaaataccacaagtt

SEQ ID NO: 226478 - DNA, 16 bp, P. troglodytes
ccaaatactgcatatt

SEQ ID NO: 226479 - DNA, 16 bp, P. troglodytes
ccaaatatataaagaa

SEQ ID NO: 226480 - DNA, 16 bp, P. troglodytes
ccaaatatatatatat

SEQ ID NO: 226481 - DNA, 16 bp, P. troglodytes
ccaaatattttataaa

SEQ ID NO: 226482 - DNA, 16 bp, P. troglodytes
ccaaatcaagaaggca

SEQ ID NO: 226483 - DNA, 16 bp, P. troglodytes
ccaaatccaaaatgct

SEQ ID NO: 226484 - DNA, 16 bp, P. troglodytes
ccaaatccaaagtctc

SEQ ID NO: 226485 - DNA, 16 bp, P. troglodytes
ccaaatccagcctgct

SEQ ID NO: 226486 - DNA, 16 bp, P. troglodytes
ccaaatctcagtggct

SEQ ID NO: 226487 - DNA, 16 bp, P. troglodytes
ccaaatctcatgtcct

SEQ ID NO: 226488 - DNA, 16 bp, P. troglodytes
ccaaatctgaaacttt

SEQ ID NO: 226489 - DNA, 16 bp, P. troglodytes
ccaaatctggcccact

SEQ ID NO: 226490 - DNA, 16 bp, P. troglodytes
ccaaatgaactaaaca

SEQ ID NO: 226491 - DNA, 16 bp, P. troglodytes
ccaaatgaattttaga

SEQ ID NO: 226492 - DNA, 16 bp, P. troglodytes
ccaaatgagaagaaac

SEQ ID NO: 226493 - DNA, 16 bp, P. troglodytes
ccaaatgagttaaaaa

SEQ ID NO: 226494 - DNA, 16 bp, P. troglodytes
ccaaatgatcacaact

SEQ ID NO: 226495 - DNA, 16 bp, P. troglodytes
ccaaatgatttttgac

SEQ ID NO: 226496 - DNA, 16 bp, P. troglodytes
ccaaatgcccatcagt

SEQ ID NO: 226497 - DNA, 16 bp, P. troglodytes
ccaaatgctgcatatt

SEQ ID NO: 226498 - DNA, 16 bp, P. troglodytes
ccaaatggtatttctg

SEQ ID NO: 226499 - DNA, 16 bp, P. troglodytes
ccaaatgtcatgttga

SEQ ID NO: 226500 - DNA, 16 bp, P. troglodytes
ccaaatgttcatcaac

SEQ ID NO: 226501 - DNA, 16 bp, P. troglodytes
ccaaatgttctcattg

SEQ ID NO: 226502 - DNA, 16 bp, P. troglodytes
ccaaattcaaactata

SEQ ID NO: 226503 - DNA, 16 bp, P. troglodytes
ccaaattcctatctaa

SEQ ID NO: 226504 - DNA, 16 bp, P. troglodytes
ccaaattgccgggatt

SEQ ID NO: 226505 - DNA, 16 bp, P. troglodytes
ccaaattgctgggaat

SEQ ID NO: 226506 - DNA, 16 bp, P. troglodytes
ccaaatttgaagaaaa

SEQ ID NO: 226507 - DNA, 16 bp, P. troglodytes
ccaaatttgatgaaaa

SEQ ID NO: 226508 - DNA, 16 bp, P. troglodytes
ccaacaaagaaaagtc

SEQ ID NO: 226509 - DNA, 16 bp, P. troglodytes
ccaacaaatgcagaat

SEQ ID NO: 226510 - DNA, 16 bp, P. troglodytes
ccaacaaatttttgta

SEQ ID NO: 226511 - DNA, 16 bp, P. troglodytes
ccaacaacaaagaatt

SEQ ID NO: 226512 - DNA, 16 bp, P. troglodytes
ccaacaacagaagaat

SEQ ID NO: 226513 - DNA, 16 bp, P. troglodytes
ccaacaaccacagaat

SEQ ID NO: 226514 - DNA, 16 bp, P. troglodytes
ccaacaactacagaat

SEQ ID NO: 226515 - DNA, 16 bp, P. troglodytes
ccaacaattttttttt

SEQ ID NO: 226516 - DNA, 16 bp, P. troglodytes
ccaacacaaaaccagt

SEQ ID NO: 226517 - DNA, 16 bp, P. troglodytes
ccaacacatgcttttt

SEQ ID NO: 226518 - DNA, 16 bp, P. troglodytes
ccaacaccacagacat

SEQ ID NO: 226519 - DNA, 16 bp, P. troglodytes
ccaacactctgttgaa

SEQ ID NO: 226520 - DNA, 16 bp, P. troglodytes
ccaacactgtgggagg

SEQ ID NO: 226521 - DNA, 16 bp, P. troglodytes
ccaacacttcaacact

SEQ ID NO: 226522 - DNA, 16 bp, P. troglodytes
ccaacacttgtcattt

SEQ ID NO: 226523 - DNA, 16 bp, P. troglodytes
ccaacacttgttattt

SEQ ID NO: 226524 - DNA, 16 bp, P. troglodytes
ccaacactttgggagt

SEQ ID NO: 226525 - DNA, 16 bp, P. troglodytes
ccaacactttgtgggg

SEQ ID NO: 226526 - DNA, 16 bp, P. troglodytes
ccaacagcagcagcag

SEQ ID NO: 226527 - DNA, 16 bp, P. troglodytes
ccaacagtgtaaaagc

SEQ ID NO: 226528 - DNA, 16 bp, P. troglodytes
ccaacatagagcttgg

SEQ ID NO: 226529 - DNA, 16 bp, P. troglodytes
ccaacatcatactgaa

SEQ ID NO: 226530 - DNA, 16 bp, P. troglodytes
ccaacatctccccatc

SEQ ID NO: 226531 - DNA, 16 bp, P. troglodytes
ccaacatcttgatttt

SEQ ID NO: 226532 - DNA, 19 bp, P. troglodytes
ccaacatgatgaaacccca

SEQ ID NO: 226533 - DNA, 16 bp, P. troglodytes
ccaacatgcctggcca

SEQ ID NO: 226534 - DNA, 16 bp, P. troglodytes
ccaacatgctaggatt

SEQ ID NO: 226535 - DNA, 16 bp, P. troglodytes
ccaacatgcttggcta

SEQ ID NO: 226536 - DNA, 16 bp, P. troglodytes
ccaacatggaaaaacc

SEQ ID NO: 226537 - DNA, 16 bp, P. troglodytes
ccaacatgggaggatc

SEQ ID NO: 226538 - DNA, 27 bp, P. troglodytes
ccaacatggtgaaaccctgtctctacc

SEQ ID NO: 226539 - DNA, 16 bp, P. troglodytes
ccaacatggtgaaccc

SEQ ID NO: 226540 - DNA, 16 bp, P. troglodytes
ccaacattgagaatta

SEQ ID NO: 226541 - DNA, 16 bp, P. troglodytes
ccaacattggggatta

SEQ ID NO: 226542 - DNA, 16 bp, P. troglodytes
ccaaccaataatttca

SEQ ID NO: 226543 - DNA, 16 bp, P. troglodytes
ccaaccacctcagcct

SEQ ID NO: 226544 - DNA, 16 bp, P. troglodytes
ccaaccagaaaaagtc

SEQ ID NO: 226545 - DNA, 16 bp, P. troglodytes
ccaaccagggtctcca

SEQ ID NO: 226546 - DNA, 16 bp, P. troglodytes
ccaacccagaagccca

SEQ ID NO: 226547 - DNA, 16 bp, P. troglodytes
ccaacccccaggccat

SEQ ID NO: 226548 - DNA, 16 bp, P. troglodytes
ccaaccccgacctcat

SEQ ID NO: 226549 - DNA, 18 bp, P. troglodytes
ccaaccccgtgctctctg

SEQ ID NO: 226550 - DNA, 16 bp, P. troglodytes
ccaacctcagcctccc

SEQ ID NO: 226551 - DNA, 16 bp, P. troglodytes
ccaacctcagcctcct

SEQ ID NO: 226552 - DNA, 16 bp, P. troglodytes
ccaacctctgcctctt

SEQ ID NO: 226553 - DNA, 16 bp, P. troglodytes
ccaacctctggcaacc

SEQ ID NO: 226554 - DNA, 16 bp, P. troglodytes
ccaacctgagcaacaa

SEQ ID NO: 226555 - DNA, 16 bp, P. troglodytes
ccaacctggccagcat

SEQ ID NO: 226556 - DNA, 16 bp, P. troglodytes
ccaacctgggcaacag

SEQ ID NO: 226557 - DNA, 16 bp, P. troglodytes
ccaacctgggcaacgt

SEQ ID NO: 226558 - DNA, 16 bp, P. troglodytes
ccaacctgggtaacat

SEQ ID NO: 226559 - DNA, 16 bp, P. troglodytes
ccaacctggtgaaaac

SEQ ID NO: 226560 - DNA, 16 bp, P. troglodytes
ccaactactgaggagg

SEQ ID NO: 226561 - DNA, 16 bp, P. troglodytes
ccaactcagcctccct

SEQ ID NO: 226562 - DNA, 16 bp, P. troglodytes
ccaactcagcttcctg

SEQ ID NO: 226563 - DNA, 16 bp, P. troglodytes
ccaactccagccccct

SEQ ID NO: 226564 - DNA, 16 bp, P. troglodytes
ccaactcccagcctca

SEQ ID NO: 226565 - DNA, 16 bp, P. troglodytes
ccaactcctggcaacc

SEQ ID NO: 226566 - DNA, 16 bp, P. troglodytes
ccaactctatgttcct

SEQ ID NO: 226567 - DNA, 16 bp, P. troglodytes
ccaactctggacacaa

SEQ ID NO: 226568 - DNA, 16 bp, P. troglodytes
ccaacttcaaagacca

SEQ ID NO: 226569 - DNA, 16 bp, P. troglodytes
ccaacttggcctccca

SEQ ID NO: 226570 - DNA, 16 bp, P. troglodytes
ccaacttttggtttca

SEQ ID NO: 226571 - DNA, 16 bp, P. troglodytes
ccaactttttaaattt

SEQ ID NO: 226572 - DNA, 16 bp, P. troglodytes
ccaagaaaatcctaag

SEQ ID NO: 226573 - DNA, 16 bp, P. troglodytes
ccaagaaagagcccaa

SEQ ID NO: 226574 - DNA, 16 bp, P. troglodytes
ccaagaaagtgaaaga

SEQ ID NO: 226575 - DNA, 16 bp, P. troglodytes
ccaagaaatatatgaa

SEQ ID NO: 226576 - DNA, 16 bp, P. troglodytes
ccaagaacagttttta

SEQ ID NO: 226577 - DNA, 16 bp, P. troglodytes
ccaagaacatacattg

SEQ ID NO: 226578 - DNA, 16 bp, P. troglodytes
ccaagaactttgggag

SEQ ID NO: 226579 - DNA, 16 bp, P. troglodytes
ccaagaagaagttgaa

SEQ ID NO: 226580 - DNA, 16 bp, P. troglodytes
ccaagaagcatatgaa

SEQ ID NO: 226581 - DNA, 16 bp, P. troglodytes
ccaagaagcctttcct

SEQ ID NO: 226582 - DNA, 16 bp, P. troglodytes
ccaagaagctggaatt

SEQ ID NO: 226583 - DNA, 16 bp, P. troglodytes
ccaagaagtatgggac

SEQ ID NO: 226584 - DNA, 16 bp, P. troglodytes
ccaagaattctgtatc

SEQ ID NO: 226585 - DNA, 16 bp, P. troglodytes
ccaagaatttgcattt

SEQ ID NO: 226586 - DNA, 17 bp, P. troglodytes
ccaagacaatcctaagc

SEQ ID NO: 226587 - DNA, 29 bp, P. troglodytes
ccaagacacataattgtcagattcaccaa

SEQ ID NO: 226588 - DNA, 27 bp, P. troglodytes
ccaagacacataattgtcagattcact

SEQ ID NO: 226589 - DNA, 16 bp, P. troglodytes
ccaagacagctactaa

SEQ ID NO: 226590 - DNA, 16 bp, P. troglodytes
ccaagaccaccaaggc

SEQ ID NO: 226591 - DNA, 16 bp, P. troglodytes
ccaagaccaccaaggt

SEQ ID NO: 226592 - DNA, 16 bp, P. troglodytes
ccaagaccaccctggc

SEQ ID NO: 226593 - DNA, 16 bp, P. troglodytes
ccaagaccatcctaag

SEQ ID NO: 226594 - DNA, 16 bp, P. troglodytes
ccaagaccatgcttct

SEQ ID NO: 226595 - DNA, 16 bp, P. troglodytes
ccaagagaaatgaaaa

SEQ ID NO: 226596 - DNA, 16 bp, P. troglodytes
ccaagagagggttctt

SEQ ID NO: 226597 - DNA, 16 bp, P. troglodytes
ccaagaggacccacag

SEQ ID NO: 226598 - DNA, 16 bp, P. troglodytes
ccaagaggcaaaggtt

SEQ ID NO: 226599 - DNA, 16 bp, P. troglodytes
ccaagaggttgaggct

SEQ ID NO: 226600 - DNA, 16 bp, P. troglodytes
ccaagagttcaaggtt

SEQ ID NO: 226601 - DNA, 16 bp, P. troglodytes
ccaagagttcgaggcc

SEQ ID NO: 226602 - DNA, 16 bp, P. troglodytes
ccaagataattcaatg

SEQ ID NO: 226603 - DNA, 16 bp, P. troglodytes
ccaagatagatcatat

SEQ ID NO: 226604 - DNA, 16 bp, P. troglodytes
ccaagatcaagatgct

SEQ ID NO: 226605 - DNA, 16 bp, P. troglodytes
ccaagatcaaggagct

SEQ ID NO: 226606 - DNA, 16 bp, P. troglodytes
ccaagatcatgcagct

SEQ ID NO: 226607 - DNA, 16 bp, P. troglodytes
ccaagatcatgctgct

SEQ ID NO: 226608 - DNA, 16 bp, P. troglodytes
ccaagatcgtgccacc

SEQ ID NO: 226609 - DNA, 16 bp, P. troglodytes
ccaagatggaaggatc

SEQ ID NO: 226610 - DNA, 16 bp, P. troglodytes
ccaagatggccccact

SEQ ID NO: 226611 - DNA, 16 bp, P. troglodytes
ccaagatgggaagatc

SEQ ID NO: 226612 - DNA, 16 bp, P. troglodytes
ccaagattcaaattca

SEQ ID NO: 226613 - DNA, 16 bp, P. troglodytes
ccaagattgcacagct

SEQ ID NO: 226614 - DNA, 16 bp, P. troglodytes
ccaagattgtgccagt

SEQ ID NO: 226615 - DNA, 16 bp, P. troglodytes
ccaagatttatttatt

SEQ ID NO: 226616 - DNA, 16 bp, P. troglodytes
ccaagcaaatggaaaa

SEQ ID NO: 226617 - DNA, 16 bp, P. troglodytes
ccaagcagaagaaaca

SEQ ID NO: 226618 - DNA, 16 bp, P. troglodytes
ccaagcagctgggaat

SEQ ID NO: 226619 - DNA, 16 bp, P. troglodytes
ccaagcataggggctc

SEQ ID NO: 226620 - DNA, 16 bp, P. troglodytes
ccaagcatggaaataa

SEQ ID NO: 226621 - DNA, 16 bp, P. troglodytes
ccaagcatggtggctc

SEQ ID NO: 226622 - DNA, 16 bp, P. troglodytes
ccaagcatggtggtgc

SEQ ID NO: 226623 - DNA, 16 bp, P. troglodytes
ccaagcattgtgctaa

SEQ ID NO: 226624 - DNA, 16 bp, P. troglodytes
ccaagccagaaacctg

SEQ ID NO: 226625 - DNA, 16 bp, P. troglodytes
ccaagccagcagcagc

SEQ ID NO: 226626 - DNA, 16 bp, P. troglodytes
ccaagccaggcatggg

SEQ ID NO: 226627 - DNA, 16 bp, P. troglodytes
ccaagccctgccccac

SEQ ID NO: 226628 - DNA, 16 bp, P. troglodytes
ccaagccctgcctctg

SEQ ID NO: 226629 - DNA, 16 bp, P. troglodytes
ccaagccctttgggag

SEQ ID NO: 226630 - DNA, 16 bp, P. troglodytes
ccaagctaaaggagga

SEQ ID NO: 226631 - DNA, 16 bp, P. troglodytes
ccaagctactcaagag

SEQ ID NO: 226632 - DNA, 16 bp, P. troglodytes
ccaagctactccagag

SEQ ID NO: 226633 - DNA, 16 bp, P. troglodytes
ccaagctctgcctcct

SEQ ID NO: 226634 - DNA, 16 bp, P. troglodytes
ccaagctgaagtacag

SEQ ID NO: 226635 - DNA, 16 bp, P. troglodytes
ccaagctgagaaccaa

SEQ ID NO: 226636 - DNA, 16 bp, P. troglodytes
ccaagctgctcttgaa

SEQ ID NO: 226637 - DNA, 16 bp, P. troglodytes
ccaagctgctgggatt

SEQ ID NO: 226638 - DNA, 16 bp, P. troglodytes
ccaagctggagtggag

SEQ ID NO: 226639 - DNA, 16 bp, P. troglodytes
ccaagctggctgcaga

SEQ ID NO: 226640 - DNA, 16 bp, P. troglodytes
ccaagctgttctcaaa

SEQ ID NO: 226641 - DNA, 16 bp, P. troglodytes
ccaagcttgcagcaca

SEQ ID NO: 226642 - DNA, 16 bp, P. troglodytes
ccaaggaaatgaaaga

SEQ ID NO: 226643 - DNA, 16 bp, P. troglodytes
ccaaggaaatggaaaa

SEQ ID NO: 226644 - DNA, 16 bp, P. troglodytes
ccaaggaacacctgga

SEQ ID NO: 226645 - DNA, 16 bp, P. troglodytes
ccaaggaatgccagga

SEQ ID NO: 226646 - DNA, 16 bp, P. troglodytes
ccaaggaatgtgggtg

SEQ ID NO: 226647 - DNA, 16 bp, P. troglodytes
ccaaggacatgaactc

SEQ ID NO: 226648 - DNA, 16 bp, P. troglodytes
ccaaggagagcagatc

SEQ ID NO: 226649 - DNA, 16 bp, P. troglodytes
ccaaggagatgaaaga

SEQ ID NO: 226650 - DNA, 16 bp, P. troglodytes
ccaaggagatgggaga

SEQ ID NO: 226651 - DNA, 16 bp, P. troglodytes
ccaaggaggtgaaagg

SEQ ID NO: 226652 - DNA, 16 bp, P. troglodytes
ccaaggaggtggaggt

SEQ ID NO: 226653 - DNA, 16 bp, P. troglodytes
ccaaggagtttgagac

SEQ ID NO: 226654 - DNA, 16 bp, P. troglodytes
ccaaggatgtgaaaga

SEQ ID NO: 226655 - DNA, 16 bp, P. troglodytes
ccaaggcagaaggatc

SEQ ID NO: 226656 - DNA, 16 bp, P. troglodytes
ccaaggcaggaggaac

SEQ ID NO: 226657 - DNA, 16 bp, P. troglodytes
ccaaggcaggctgatt

SEQ ID NO: 226658 - DNA, 16 bp, P. troglodytes
ccaaggccacacagcc

SEQ ID NO: 226659 - DNA, 16 bp, P. troglodytes
ccaaggccacagagct

SEQ ID NO: 226660 - DNA, 16 bp, P. troglodytes
ccaaggccagagccag

SEQ ID NO: 226661 - DNA, 16 bp, P. troglodytes
ccaaggccagagtgca

SEQ ID NO: 226662 - DNA, 16 bp, P. troglodytes
ccaaggccccaccaga

SEQ ID NO: 226663 - DNA, 16 bp, P. troglodytes
ccaaggccccagaggg

SEQ ID NO: 226664 - DNA, 16 bp, P. troglodytes
ccaaggccctggtggc

SEQ ID NO: 226665 - DNA, 16 bp, P. troglodytes
ccaaggcgggcagatt

SEQ ID NO: 226666 - DNA, 16 bp, P. troglodytes
ccaaggcgggtagatc

SEQ ID NO: 226667 - DNA, 17 bp, P. troglodytes
ccaaggctcgagaacta

SEQ ID NO: 226668 - DNA, 16 bp, P. troglodytes
ccaaggctgagaacca

SEQ ID NO: 226669 - DNA, 16 bp, P. troglodytes
ccaaggctggagtgca

SEQ ID NO: 226670 - DNA, 16 bp, P. troglodytes
ccaaggctttgggcag

SEQ ID NO: 226671 - DNA, 16 bp, P. troglodytes
ccaagggagctaacca

SEQ ID NO: 226672 - DNA, 16 bp, P. troglodytes
ccaaggggatagtgct

SEQ ID NO: 226673 - DNA, 16 bp, P. troglodytes
ccaaggggcagccaga

SEQ ID NO: 226674 - DNA, 16 bp, P. troglodytes
ccaagggtgagccagg

SEQ ID NO: 226675 - DNA, 16 bp, P. troglodytes
ccaaggtcaaggtgct

SEQ ID NO: 226676 - DNA, 16 bp, P. troglodytes
ccaaggtcacacaact

SEQ ID NO: 226677 - DNA, 16 bp, P. troglodytes
ccaaggtcacacagca

SEQ ID NO: 226678 - DNA, 16 bp, P. troglodytes
ccaaggtcacagagca

SEQ ID NO: 226679 - DNA, 16 bp, P. troglodytes
ccaaggtcacatagct

SEQ ID NO: 226680 - DNA, 16 bp, P. troglodytes
ccaaggtggaagaatc

SEQ ID NO: 226681 - DNA, 16 bp, P. troglodytes
ccaaggtggagaaacc

SEQ ID NO: 226682 - DNA, 16 bp, P. troglodytes
ccaaggtggctggatc

SEQ ID NO: 226683 - DNA, 16 bp, P. troglodytes
ccaaggtgggaagatt

SEQ ID NO: 226684 - DNA, 16 bp, P. troglodytes
ccaaggtgggcagatt

SEQ ID NO: 226685 - DNA, 16 bp, P. troglodytes
ccaaggtgggtggaac

SEQ ID NO: 226686 - DNA, 23 bp, P. troglodytes
ccaaggtgggtggatcacgaggt

SEQ ID NO: 226687 - DNA, 16 bp, P. troglodytes
ccaaggtgggtggatt

SEQ ID NO: 226688 - DNA, 16 bp, P. troglodytes
ccaaggtggttggggc

SEQ ID NO: 226689 - DNA, 16 bp, P. troglodytes
ccaaggttgcagtgag

SEQ ID NO: 226690 - DNA, 16 bp, P. troglodytes
ccaagtagccaaagca

SEQ ID NO: 226691 - DNA, 16 bp, P. troglodytes
ccaagtagctaaaact

SEQ ID NO: 226692 - DNA, 16 bp, P. troglodytes
ccaagtagctgggagc

SEQ ID NO: 226693 - DNA, 17 bp, P. troglodytes
ccaagtagctgggattt

SEQ ID NO: 226694 - DNA, 16 bp, P. troglodytes
ccaagtagctggggac

SEQ ID NO: 226695 - DNA, 16 bp, P. troglodytes
ccaagtatctgggact

SEQ ID NO: 226696 - DNA, 16 bp, P. troglodytes
ccaagtcaaaaccaaa

SEQ ID NO: 226697 - DNA, 18 bp, P. troglodytes
ccaagtcaatcctaagcc

SEQ ID NO: 226698 - DNA, 16 bp, P. troglodytes
ccaagtgctaggatta

SEQ ID NO: 226699 - DNA, 16 bp, P. troglodytes
ccaagtgctgagatta

SEQ ID NO: 226700 - DNA, 16 bp, P. troglodytes
ccaagtgctggaatta

SEQ ID NO: 226701 - DNA, 16 bp, P. troglodytes
ccaagtgctgggacta

SEQ ID NO: 226702 - DNA, 16 bp, P. troglodytes
ccaagtgctgggatta

SEQ ID NO: 226703 - DNA, 16 bp, P. troglodytes
ccaagtggggaggatc

SEQ ID NO: 226704 - DNA, 16 bp, P. troglodytes
ccaagtgtggtggcac

SEQ ID NO: 226705 - DNA, 16 bp, P. troglodytes
ccaagtgtggtggtgg

SEQ ID NO: 226706 - DNA, 17 bp, P. troglodytes
ccaagtgtgtgctcacc

SEQ ID NO: 226707 - DNA, 16 bp, P. troglodytes
ccaagttcaagccatt

SEQ ID NO: 226708 - DNA, 16 bp, P. troglodytes
ccaagttcattctttt

SEQ ID NO: 226709 - DNA, 16 bp, P. troglodytes
ccaagttcttgtctca

SEQ ID NO: 226710 - DNA, 16 bp, P. troglodytes
ccaagttttaaattgt

SEQ ID NO: 226711 - DNA, 16 bp, P. troglodytes
ccaataaaacttattt

SEQ ID NO: 226712 - DNA, 16 bp, P. troglodytes
ccaataaccttgatga

SEQ ID NO: 226713 - DNA, 16 bp, P. troglodytes
ccaataatgctgtggt

SEQ ID NO: 226714 - DNA, 16 bp, P. troglodytes
ccaatactattttgaa

SEQ ID NO: 226715 - DNA, 16 bp, P. troglodytes
ccaatagaaaaatggg

SEQ ID NO: 226716 - DNA, 16 bp, P. troglodytes
ccaataggaagagagg

SEQ ID NO: 226717 - DNA, 16 bp, P. troglodytes
ccaatatccttgaaga

SEQ ID NO: 226718 - DNA, 16 bp, P. troglodytes
ccaatatctcttatga

SEQ ID NO: 226719 - DNA, 16 bp, P. troglodytes
ccaatatggtagccat

SEQ ID NO: 226720 - DNA, 16 bp, P. troglodytes
ccaatcaatcaatcaa

SEQ ID NO: 226721 - DNA, 16 bp, P. troglodytes
ccaatcactaatcaat

SEQ ID NO: 226722 - DNA, 16 bp, P. troglodytes
ccaatcactgtggcca

SEQ ID NO: 226723 - DNA, 18 bp, P. troglodytes
ccaatcagcaggatgtgg

SEQ ID NO: 226724 - DNA, 16 bp, P. troglodytes
ccaatcagctctctgt

SEQ ID NO: 226725 - DNA, 16 bp, P. troglodytes
ccaatctgaaaaggct

SEQ ID NO: 226726 - DNA, 16 bp, P. troglodytes
ccaatgaagaaattaa

SEQ ID NO: 226727 - DNA, 16 bp, P. troglodytes
ccaatgaaggctgtga

SEQ ID NO: 226728 - DNA, 16 bp, P. troglodytes
ccaatgaggaaactga

SEQ ID NO: 226729 - DNA, 16 bp, P. troglodytes
ccaatgcaaaatgaaa

SEQ ID NO: 226730 - DNA, 16 bp, P. troglodytes
ccaatgccatccctcc

SEQ ID NO: 226731 - DNA, 16 bp, P. troglodytes
ccaatggaatattatt

SEQ ID NO: 226732 - DNA, 16 bp, P. troglodytes
ccaatggagctgaaaa

SEQ ID NO: 226733 - DNA, 16 bp, P. troglodytes
ccaatggggcagtcaa

SEQ ID NO: 226734 - DNA, 16 bp, P. troglodytes
ccaatgtgatggtatt

SEQ ID NO: 226735 - DNA, 16 bp, P. troglodytes
ccaatgtgtagtcttt

SEQ ID NO: 226736 - DNA, 16 bp, P. troglodytes
ccaatgttaacatctt

SEQ ID NO: 226737 - DNA, 16 bp, P. troglodytes
ccaattaaaaagtggg

SEQ ID NO: 226738 - DNA, 16 bp, P. troglodytes
ccaattaaaagacaaa

SEQ ID NO: 226739 - DNA, 25 bp, P. troglodytes
ccaattaaaagacacagactggcaa

SEQ ID NO: 226740 - DNA, 16 bp, P. troglodytes
ccaattaaacctgttt

SEQ ID NO: 226741 - DNA, 16 bp, P. troglodytes
ccaattaaatcagaat

SEQ ID NO: 226742 - DNA, 16 bp, P. troglodytes
ccaattaataacctta

SEQ ID NO: 226743 - DNA, 16 bp, P. troglodytes
ccaattagttaatttc

SEQ ID NO: 226744 - DNA, 16 bp, P. troglodytes
ccaattcttctccaca

SEQ ID NO: 226745 - DNA, 16 bp, P. troglodytes
ccaatttggatagaac

SEQ ID NO: 226746 - DNA, 16 bp, P. troglodytes
ccaattttcaacaaaa

SEQ ID NO: 226747 - DNA, 16 bp, P. troglodytes
ccaatttttcactatt

SEQ ID NO: 226748 - DNA, 16 bp, P. troglodytes
ccaatttttgatcaat

SEQ ID NO: 226749 - DNA, 16 bp, P. troglodytes
ccacaaaaaattttta

SEQ ID NO: 226750 - DNA, 16 bp, P. troglodytes
ccacaaaaggcagaaa

SEQ ID NO: 226751 - DNA, 16 bp, P. troglodytes
ccacaaaccaggtggc

SEQ ID NO: 226752 - DNA, 16 bp, P. troglodytes
ccacaaagaaaatgaa

SEQ ID NO: 226753 - DNA, 16 bp, P. troglodytes
ccacaaagagaagccc

SEQ ID NO: 226754 - DNA, 16 bp, P. troglodytes
ccacaaagagtcccca

SEQ ID NO: 226755 - DNA, 16 bp, P. troglodytes
ccacaaagatactcct

SEQ ID NO: 226756 - DNA, 16 bp, P. troglodytes
ccacaaataacatctc

SEQ ID NO: 226757 - DNA, 16 bp, P. troglodytes
ccacaaatatttatta

SEQ ID NO: 226758 - DNA, 16 bp, P. troglodytes
ccacaacacgtgggga

SEQ ID NO: 226759 - DNA, 16 bp, P. troglodytes
ccacaaccacaggcag

SEQ ID NO: 226760 - DNA, 16 bp, P. troglodytes
ccacaaccatgcctgg

SEQ ID NO: 226761 - DNA, 16 bp, P. troglodytes
ccacaacccctgcctc

SEQ ID NO: 226762 - DNA, 16 bp, P. troglodytes
ccacaacctcagcctc

SEQ ID NO: 226763 - DNA, 16 bp, P. troglodytes
ccacaagaatggccat

SEQ ID NO: 226764 - DNA, 16 bp, P. troglodytes
ccacaagaggaagcag

SEQ ID NO: 226765 - DNA, 16 bp, P. troglodytes
ccacaagaggcctctg

SEQ ID NO: 226766 - DNA, 16 bp, P. troglodytes
ccacaagcacaggaaa

SEQ ID NO: 226767 - DNA, 16 bp, P. troglodytes
ccacaagccaaggaac

SEQ ID NO: 226768 - DNA, 16 bp, P. troglodytes
ccacaagctgggtggc

SEQ ID NO: 226769 - DNA, 16 bp, P. troglodytes
ccacaagtcaaggaac

SEQ ID NO: 226770 - DNA, 16 bp, P. troglodytes
ccacaatggtagatcc

SEQ ID NO: 226771 - DNA, 16 bp, P. troglodytes
ccacacaccttggcct

SEQ ID NO: 226772 - DNA, 18 bp, P. troglodytes
ccacacagttaattgaaa

SEQ ID NO: 226773 - DNA, 16 bp, P. troglodytes
ccacacccacctaatt

SEQ ID NO: 226774 - DNA, 16 bp, P. troglodytes
ccacacccagccactg

SEQ ID NO: 226775 - DNA, 16 bp, P. troglodytes
ccacacccagccagct

SEQ ID NO: 226776 - DNA, 16 bp, P. troglodytes
ccacacccagcccagg

SEQ ID NO: 226777 - DNA, 16 bp, P. troglodytes
ccacacccagcccatc

SEQ ID NO: 226778 - DNA, 16 bp, P. troglodytes
ccacacccagcccatg

SEQ ID NO: 226779 - DNA, 16 bp, P. troglodytes
ccacacccagcccctg

SEQ ID NO: 226780 - DNA, 16 bp, P. troglodytes
ccacacccagccctgc

SEQ ID NO: 226781 - DNA, 16 bp, P. troglodytes
ccacacccagcccttc

SEQ ID NO: 226782 - DNA, 16 bp, P. troglodytes
ccacacccagcctaaa

SEQ ID NO: 226783 - DNA, 16 bp, P. troglodytes
ccacacccagcctacc

SEQ ID NO: 226784 - DNA, 16 bp, P. troglodytes
ccacacccagcctaga

SEQ ID NO: 226785 - DNA, 16 bp, P. troglodytes
ccacacccagcctcag

SEQ ID NO: 226786 - DNA, 16 bp, P. troglodytes
ccacacccagcctctt

SEQ ID NO: 226787 - DNA, 16 bp, P. troglodytes
ccacacccagcctgca

SEQ ID NO: 226788 - DNA, 16 bp, P. troglodytes
ccacacccagcctgga

SEQ ID NO: 226789 - DNA, 16 bp, P. troglodytes
ccacacccagccttct

SEQ ID NO: 226790 - DNA, 16 bp, P. troglodytes
ccacacccagctaata

SEQ ID NO: 226791 - DNA, 16 bp, P. troglodytes
ccacacccatttattt

SEQ ID NO: 226792 - DNA, 16 bp, P. troglodytes
ccacaccccagccctg

SEQ ID NO: 226793 - DNA, 16 bp, P. troglodytes
ccacacccggcccctt

SEQ ID NO: 226794 - DNA, 16 bp, P. troglodytes
ccacacccggcctggt

SEQ ID NO: 226795 - DNA, 16 bp, P. troglodytes
ccacacccggccttct

SEQ ID NO: 226796 - DNA, 16 bp, P. troglodytes
ccacacccggcctttt

SEQ ID NO: 226797 - DNA, 16 bp, P. troglodytes
ccacaccctctccagc

SEQ ID NO: 226798 - DNA, 16 bp, P. troglodytes
ccacacctgaccccca

SEQ ID NO: 226799 - DNA, 16 bp, P. troglodytes
ccacacctggccagag

SEQ ID NO: 226800 - DNA, 16 bp, P. troglodytes
ccacacctggccctga

SEQ ID NO: 226801 - DNA, 16 bp, P. troglodytes
ccacacctggccctgc

SEQ ID NO: 226802 - DNA, 16 bp, P. troglodytes
ccacacctggccctgt

SEQ ID NO: 226803 - DNA, 16 bp, P. troglodytes
ccacacctggcctcca

SEQ ID NO: 226804 - DNA, 16 bp, P. troglodytes
ccacacctggcctgca

SEQ ID NO: 226805 - DNA, 16 bp, P. troglodytes
ccacacctggcctgga

SEQ ID NO: 226806 - DNA, 16 bp, P. troglodytes
ccacacctggcctggg

SEQ ID NO: 226807 - DNA, 16 bp, P. troglodytes
ccacacctggcctgtt

SEQ ID NO: 226808 - DNA, 16 bp, P. troglodytes
ccacactgccttccac

SEQ ID NO: 226809 - DNA, 16 bp, P. troglodytes
ccacactggaaggttg

SEQ ID NO: 226810 - DNA, 16 bp, P. troglodytes
ccacactggggattaa

SEQ ID NO: 226811 - DNA, 16 bp, P. troglodytes
ccacactgtcaacatt

SEQ ID NO: 226812 - DNA, 16 bp, P. troglodytes
ccacactgtcttccca

SEQ ID NO: 226813 - DNA, 16 bp, P. troglodytes
ccacactgttttctac

SEQ ID NO: 226814 - DNA, 16 bp, P. troglodytes
ccacactttgagacaa

SEQ ID NO: 226815 - DNA, 16 bp, P. troglodytes
ccacagaaagaaaaat

SEQ ID NO: 226816 - DNA, 16 bp, P. troglodytes
ccacagaagacccaga

SEQ ID NO: 226817 - DNA, 16 bp, P. troglodytes
ccacagaataagagaa

SEQ ID NO: 226818 - DNA, 16 bp, P. troglodytes
ccacagacatgcacca

SEQ ID NO: 226819 - DNA, 16 bp, P. troglodytes
ccacagaccttcacag

SEQ ID NO: 226820 - DNA, 16 bp, P. troglodytes
ccacagactgggaaaa

SEQ ID NO: 226821 - DNA, 16 bp, P. troglodytes
ccacagactgggtagc

SEQ ID NO: 226822 - DNA, 16 bp, P. troglodytes
ccacagagcctggcct

SEQ ID NO: 226823 - DNA, 16 bp, P. troglodytes
ccacagagggcgagcc

SEQ ID NO: 226824 - DNA, 16 bp, P. troglodytes
ccacagatcagaagat

SEQ ID NO: 226825 - DNA, 16 bp, P. troglodytes
ccacagcaagacccac

SEQ ID NO: 226826 - DNA, 16 bp, P. troglodytes
ccacagcacccagctt

SEQ ID NO: 226827 - DNA, 16 bp, P. troglodytes
ccacagcacccaggct

SEQ ID NO: 226828 - DNA, 16 bp, P. troglodytes
ccacagcacccggcct

SEQ ID NO: 226829 - DNA, 16 bp, P. troglodytes
ccacagcactacagcc

SEQ ID NO: 226830 - DNA, 16 bp, P. troglodytes
ccacagcactccaacc

SEQ ID NO: 226831 - DNA, 16 bp, P. troglodytes
ccacagcactccagcc

SEQ ID NO: 226832 - DNA, 16 bp, P. troglodytes
ccacagcagccacagc

SEQ ID NO: 226833 - DNA, 16 bp, P. troglodytes
ccacagcaggataggg

SEQ ID NO: 226834 - DNA, 16 bp, P. troglodytes
ccacagccaacatcac

SEQ ID NO: 226835 - DNA, 16 bp, P. troglodytes
ccacagccagcatcat

SEQ ID NO: 226836 - DNA, 16 bp, P. troglodytes
ccacagcctcaccagc

SEQ ID NO: 226837 - DNA, 16 bp, P. troglodytes
ccacagcctcatcagc

SEQ ID NO: 226838 - DNA, 16 bp, P. troglodytes
ccacagcctccaactc

SEQ ID NO: 226839 - DNA, 16 bp, P. troglodytes
ccacagcctccccagt

SEQ ID NO: 226840 - DNA, 16 bp, P. troglodytes
ccacagcctctgcctc

SEQ ID NO: 226841 - DNA, 16 bp, P. troglodytes
ccacagcgcccagtcc

SEQ ID NO: 226842 - DNA, 16 bp, P. troglodytes
ccacagctcaaggagg

SEQ ID NO: 226843 - DNA, 16 bp, P. troglodytes
ccacagctctggaggc

SEQ ID NO: 226844 - DNA, 16 bp, P. troglodytes
ccacagctgcagctgc

SEQ ID NO: 226845 - DNA, 16 bp, P. troglodytes
ccacagctgccccttt

SEQ ID NO: 226846 - DNA, 16 bp, P. troglodytes
ccacagctggagcagc

SEQ ID NO: 226847 - DNA, 16 bp, P. troglodytes
ccacaggagaaagtgg

SEQ ID NO: 226848 - DNA, 16 bp, P. troglodytes
ccacaggcagtgcagc

SEQ ID NO: 226849 - DNA, 16 bp, P. troglodytes
ccacaggccccatgca

SEQ ID NO: 226850 - DNA, 16 bp, P. troglodytes
ccacaggcctgtgcca

SEQ ID NO: 226851 - DNA, 16 bp, P. troglodytes
ccacaggctgggtggc

SEQ ID NO: 226852 - DNA, 16 bp, P. troglodytes
ccacagggacctctgc

SEQ ID NO: 226853 - DNA, 16 bp, P. troglodytes
ccacagggagaggctc

SEQ ID NO: 226854 - DNA, 16 bp, P. troglodytes
ccacagggctgaggag

SEQ ID NO: 226855 - DNA, 16 bp, P. troglodytes
ccacagtccccaaagt

SEQ ID NO: 226856 - DNA, 16 bp, P. troglodytes
ccacagtgaaacccca

SEQ ID NO: 226857 - DNA, 16 bp, P. troglodytes
ccacagtgccaggcct

SEQ ID NO: 226858 - DNA, 16 bp, P. troglodytes
ccacagtgcccagtcc

SEQ ID NO: 226859 - DNA, 16 bp, P. troglodytes
ccacagtggaaaacag

SEQ ID NO: 226860 - DNA, 16 bp, P. troglodytes
ccacagtggcagagct

SEQ ID NO: 226861 - DNA, 16 bp, P. troglodytes
ccacagtggctgcagc

SEQ ID NO: 226862 - DNA, 16 bp, P. troglodytes
ccacagtgtgtgttgt

SEQ ID NO: 226863 - DNA, 16 bp, P. troglodytes
ccacagttctggaggc

SEQ ID NO: 226864 - DNA, 16 bp, P. troglodytes
ccacatatatatacac

SEQ ID NO: 226865 - DNA, 16 bp, P. troglodytes
ccacatattctttatt

SEQ ID NO: 226866 - DNA, 16 bp, P. troglodytes
ccacatccaagaagaa

SEQ ID NO: 226867 - DNA, 16 bp, P. troglodytes
ccacatcccaaagctg

SEQ ID NO: 226868 - DNA, 16 bp, P. troglodytes
ccacatccttgacagc

SEQ ID NO: 226869 - DNA, 16 bp, P. troglodytes
ccacatctcaccttga

SEQ ID NO: 226870 - DNA, 16 bp, P. troglodytes
ccacatcttagctatt

SEQ ID NO: 226871 - DNA, 16 bp, P. troglodytes
ccacatcttcaccaac

SEQ ID NO: 226872 - DNA, 16 bp, P. troglodytes
ccacatgaatgtcttc

SEQ ID NO: 226873 - DNA, 16 bp, P. troglodytes
ccacatggctgggaaa

SEQ ID NO: 226874 - DNA, 16 bp, P. troglodytes
ccacatggtgaaaccc

SEQ ID NO: 226875 - DNA, 16 bp, P. troglodytes
ccacatgtcatggaag

SEQ ID NO: 226876 - DNA, 16 bp, P. troglodytes
ccacatgtggcccatg

SEQ ID NO: 226877 - DNA, 16 bp, P. troglodytes
ccacatgtggcttttg

SEQ ID NO: 226878 - DNA, 16 bp, P. troglodytes
ccacatgttctcactt

SEQ ID NO: 226879 - DNA, 16 bp, P. troglodytes
ccacattccttggctt

SEQ ID NO: 226880 - DNA, 16 bp, P. troglodytes
ccacattctcaccacc

SEQ ID NO: 226881 - DNA, 16 bp, P. troglodytes
ccacattctctccaac

SEQ ID NO: 226882 - DNA, 16 bp, P. troglodytes
ccacattgcagcccag

SEQ ID NO: 226883 - DNA, 16 bp, P. troglodytes
ccacattggaagaaaa

SEQ ID NO: 226884 - DNA, 16 bp, P. troglodytes
ccacattggaagaaga

SEQ ID NO: 226885 - DNA, 16 bp, P. troglodytes
ccacattgttttaatt

SEQ ID NO: 226886 - DNA, 16 bp, P. troglodytes
ccacatttcaagtgct

SEQ ID NO: 226887 - DNA, 16 bp, P. troglodytes
ccacattttcttaatg

SEQ ID NO: 226888 - DNA, 16 bp, P. troglodytes
ccacatttttactgta

SEQ ID NO: 226889 - DNA, 16 bp, P. troglodytes
ccacatttttctgtct

SEQ ID NO: 226890 - DNA, 16 bp, P. troglodytes
ccacatttttggatat

SEQ ID NO: 226891 - DNA, 16 bp, P. troglodytes
ccaccaaacctggcta

SEQ ID NO: 226892 - DNA, 16 bp, P. troglodytes
ccaccaaatctcatct

SEQ ID NO: 226893 - DNA, 16 bp, P. troglodytes
ccaccaaatctggcta

SEQ ID NO: 226894 - DNA, 16 bp, P. troglodytes
ccaccaacagatgaat

SEQ ID NO: 226895 - DNA, 16 bp, P. troglodytes
ccaccaacaggccctg

SEQ ID NO: 226896 - DNA, 16 bp, P. troglodytes
ccaccaaccctggcta

SEQ ID NO: 226897 - DNA, 16 bp, P. troglodytes
ccaccaagatcaagtt

SEQ ID NO: 226898 - DNA, 16 bp, P. troglodytes
ccaccaagcctggctc

SEQ ID NO: 226899 - DNA, 16 bp, P. troglodytes
ccaccaagctggagca

SEQ ID NO: 226900 - DNA, 16 bp, P. troglodytes
ccaccaatgcccagct

SEQ ID NO: 226901 - DNA, 17 bp, P. troglodytes
ccaccacaaaagaagtg

SEQ ID NO: 226902 - DNA, 16 bp, P. troglodytes
ccaccacaatgcctgg

SEQ ID NO: 226903 - DNA, 16 bp, P. troglodytes
ccaccacacacggcta

SEQ ID NO: 226904 - DNA, 16 bp, P. troglodytes
ccaccacacccagctg

SEQ ID NO: 226905 - DNA, 16 bp, P. troglodytes
ccaccacacccggcct

SEQ ID NO: 226906 - DNA, 16 bp, P. troglodytes
ccaccacacccggcta

SEQ ID NO: 226907 - DNA, 16 bp, P. troglodytes
ccaccacaccctggct

SEQ ID NO: 226908 - DNA, 16 bp, P. troglodytes
ccaccacacctgacta

SEQ ID NO: 226909 - DNA, 16 bp, P. troglodytes
ccaccacacctggaaa

SEQ ID NO: 226910 - DNA, 16 bp, P. troglodytes
ccaccacacctggcca

SEQ ID NO: 226911 - DNA, 16 bp, P. troglodytes
ccaccacacctggccg

SEQ ID NO: 226912 - DNA, 16 bp, P. troglodytes
ccaccacacgtggcct

SEQ ID NO: 226913 - DNA, 16 bp, P. troglodytes
ccaccacactccagca

SEQ ID NO: 226914 - DNA, 16 bp, P. troglodytes
ccaccacagccggcct

SEQ ID NO: 226915 - DNA, 16 bp, P. troglodytes
ccaccacagcctccag

SEQ ID NO: 226916 - DNA, 16 bp, P. troglodytes
ccaccacagctccagg

SEQ ID NO: 226917 - DNA, 16 bp, P. troglodytes
ccaccacagtccccaa

SEQ ID NO: 226918 - DNA, 16 bp, P. troglodytes
ccaccacagtgtaaaa

SEQ ID NO: 226919 - DNA, 16 bp, P. troglodytes
ccaccacatccagcta

SEQ ID NO: 226920 - DNA, 16 bp, P. troglodytes
ccaccacatccctgtt

SEQ ID NO: 226921 - DNA, 16 bp, P. troglodytes
ccaccacatctggctc

SEQ ID NO: 226922 - DNA, 16 bp, P. troglodytes
ccaccacatgaggaca

SEQ ID NO: 226923 - DNA, 16 bp, P. troglodytes
ccaccacattccagcc

SEQ ID NO: 226924 - DNA, 18 bp, P. troglodytes
ccaccaccacacctggct

SEQ ID NO: 226925 - DNA, 16 bp, P. troglodytes
ccaccaccacactggc

SEQ ID NO: 226926 - DNA, 16 bp, P. troglodytes
ccaccaccaccacctg

SEQ ID NO: 226927 - DNA, 21 bp, P. troglodytes
ccaccaccacgcatggctaat

SEQ ID NO: 226928 - DNA, 17 bp, P. troglodytes
ccaccaccacgcctggc

SEQ ID NO: 226929 - DNA, 16 bp, P. troglodytes
ccaccaccacgctggc

SEQ ID NO: 226930 - DNA, 16 bp, P. troglodytes
ccaccaccactgggac

SEQ ID NO: 226931 - DNA, 16 bp, P. troglodytes
ccaccaccaggcctgg

SEQ ID NO: 226932 - DNA, 19 bp, P. troglodytes
ccaccaccatacccagcta

SEQ ID NO: 226933 - DNA, 16 bp, P. troglodytes
ccaccaccatgatcca

SEQ ID NO: 226934 - DNA, 16 bp, P. troglodytes
ccaccaccatgcctaa

SEQ ID NO: 226935 - DNA, 16 bp, P. troglodytes
ccaccaccatggccag

SEQ ID NO: 226936 - DNA, 16 bp, P. troglodytes
ccaccaccatgtccag

SEQ ID NO: 226937 - DNA, 16 bp, P. troglodytes
ccaccaccattcccag

SEQ ID NO: 226938 - DNA, 16 bp, P. troglodytes
ccaccaccctgaccaa

SEQ ID NO: 226939 - DNA, 20 bp, P. troglodytes
ccaccaccctttgctgactc

SEQ ID NO: 226940 - DNA, 16 bp, P. troglodytes
ccaccacctcacctgg

SEQ ID NO: 226941 - DNA, 16 bp, P. troglodytes
ccaccacctcagcctc

SEQ ID NO: 226942 - DNA, 16 bp, P. troglodytes
ccaccacctccagcta

SEQ ID NO: 226943 - DNA, 17 bp, P. troglodytes
ccaccacgccagctaat

SEQ ID NO: 226944 - DNA, 20 bp, P. troglodytes
ccaccacgccaggctaattt

SEQ ID NO: 226945 - DNA, 16 bp, P. troglodytes
ccaccacgccaggctc

SEQ ID NO: 226946 - DNA, 17 bp, P. troglodytes
ccaccacgcccggctaa

SEQ ID NO: 226947 - DNA, 16 bp, P. troglodytes
ccaccacgcctggcaa

SEQ ID NO: 226948 - DNA, 16 bp, P. troglodytes
ccaccacgcctggcca

SEQ ID NO: 226949 - DNA, 16 bp, P. troglodytes
ccaccacggccagcta

SEQ ID NO: 226950 - DNA, 16 bp, P. troglodytes
ccaccacgtccagctt

SEQ ID NO: 226951 - DNA, 16 bp, P. troglodytes
ccaccactcccagata

SEQ ID NO: 226952 - DNA, 16 bp, P. troglodytes
ccaccactcccagcta

SEQ ID NO: 226953 - DNA, 16 bp, P. troglodytes
ccaccactcccggcta

SEQ ID NO: 226954 - DNA, 16 bp, P. troglodytes
ccaccactgcacccag

SEQ ID NO: 226955 - DNA, 16 bp, P. troglodytes
ccaccactgccaccac

SEQ ID NO: 226956 - DNA, 16 bp, P. troglodytes
ccaccactgcccagct

SEQ ID NO: 226957 - DNA, 16 bp, P. troglodytes
ccaccactggactctc

SEQ ID NO: 226958 - DNA, 16 bp, P. troglodytes
ccaccactgtgcccag

SEQ ID NO: 226959 - DNA, 16 bp, P. troglodytes
ccaccacttactagct

SEQ ID NO: 226960 - DNA, 16 bp, P. troglodytes
ccaccacttccagcta

SEQ ID NO: 226961 - DNA, 16 bp, P. troglodytes
ccaccactttaggagg

SEQ ID NO: 226962 - DNA, 16 bp, P. troglodytes
ccaccagaagcaattt

SEQ ID NO: 226963 - DNA, 16 bp, P. troglodytes
ccaccagaagcagttt

SEQ ID NO: 226964 - DNA, 16 bp, P. troglodytes
ccaccagaaggaaaaa

SEQ ID NO: 226965 - DNA, 16 bp, P. troglodytes
ccaccagagggcagca

SEQ ID NO: 226966 - DNA, 16 bp, P. troglodytes
ccaccagatgccagga

SEQ ID NO: 226967 - DNA, 16 bp, P. troglodytes
ccaccagcaatgtgtg

SEQ ID NO: 226968 - DNA, 16 bp, P. troglodytes
ccaccagcagtggatg

SEQ ID NO: 226969 - DNA, 16 bp, P. troglodytes
ccaccagcatcaccac

SEQ ID NO: 226970 - DNA, 16 bp, P. troglodytes
ccaccagcccacttgg

SEQ ID NO: 226971 - DNA, 16 bp, P. troglodytes
ccaccagcccagctaa

SEQ ID NO: 226972 - DNA, 16 bp, P. troglodytes
ccaccagccccagcct

SEQ ID NO: 226973 - DNA, 16 bp, P. troglodytes
ccaccaggactgcctt

SEQ ID NO: 226974 - DNA, 16 bp, P. troglodytes
ccaccaggcaccacct

SEQ ID NO: 226975 - DNA, 16 bp, P. troglodytes
ccaccaggccccagct

SEQ ID NO: 226976 - DNA, 16 bp, P. troglodytes
ccaccaggcctgcctc

SEQ ID NO: 226977 - DNA, 16 bp, P. troglodytes
ccaccaggcctggccg

SEQ ID NO: 226978 - DNA, 16 bp, P. troglodytes
ccaccaggcctggcta

SEQ ID NO: 226979 - DNA, 16 bp, P. troglodytes
ccaccagggccctggg

SEQ ID NO: 226980 - DNA, 16 bp, P. troglodytes
ccaccagggctctggg

SEQ ID NO: 226981 - DNA, 16 bp, P. troglodytes
ccaccaggtggcagca

SEQ ID NO: 226982 - DNA, 16 bp, P. troglodytes
ccaccaggttcctccc

SEQ ID NO: 226983 - DNA, 16 bp, P. troglodytes
ccaccagtcagaatgg

SEQ ID NO: 226984 - DNA, 16 bp, P. troglodytes
ccaccagttagaatgg

SEQ ID NO: 226985 - DNA, 16 bp, P. troglodytes
ccaccataggcttcaa

SEQ ID NO: 226986 - DNA, 16 bp, P. troglodytes
ccaccatatccagcta

SEQ ID NO: 226987 - DNA, 16 bp, P. troglodytes
ccaccatcaaagactt

SEQ ID NO: 226988 - DNA, 16 bp, P. troglodytes
ccaccatcacaatcaa

SEQ ID NO: 226989 - DNA, 16 bp, P. troglodytes
ccaccatccctggcca

SEQ ID NO: 226990 - DNA, 16 bp, P. troglodytes
ccaccatcctccagaa

SEQ ID NO: 226991 - DNA, 16 bp, P. troglodytes
ccaccatcttccagac

SEQ ID NO: 226992 - DNA, 16 bp, P. troglodytes
ccaccatgcccagcca

SEQ ID NO: 226993 - DNA, 16 bp, P. troglodytes
ccaccatgcccagctg

SEQ ID NO: 226994 - DNA, 16 bp, P. troglodytes
ccaccatgcccagctt

SEQ ID NO: 226995 - DNA, 16 bp, P. troglodytes
ccaccatgcccagtct

SEQ ID NO: 226996 - DNA, 16 bp, P. troglodytes
ccaccatgcccatcca

SEQ ID NO: 226997 - DNA, 16 bp, P. troglodytes
ccaccatgcccggctc

SEQ ID NO: 226998 - DNA, 16 bp, P. troglodytes
ccaccatgccctgctg

SEQ ID NO: 226999 - DNA, 16 bp, P. troglodytes
ccaccatgccctggcc

SEQ ID NO: 227000 - DNA, 16 bp, P. troglodytes
ccaccatgcctaacta

SEQ ID NO: 227001 - DNA, 16 bp, P. troglodytes
ccaccatgcctagccg

SEQ ID NO: 227002 - DNA, 16 bp, P. troglodytes
ccaccatgcctagcta

SEQ ID NO: 227003 - DNA, 16 bp, P. troglodytes
ccaccatgcctggctc

SEQ ID NO: 227004 - DNA, 16 bp, P. troglodytes
ccaccatgcctggctg

SEQ ID NO: 227005 - DNA, 16 bp, P. troglodytes
ccaccatgctcagcta

SEQ ID NO: 227006 - DNA, 16 bp, P. troglodytes
ccaccatgcttggcta

SEQ ID NO: 227007 - DNA, 16 bp, P. troglodytes
ccaccatgtctggcta

SEQ ID NO: 227008 - DNA, 16 bp, P. troglodytes
ccaccattcccagccc

SEQ ID NO: 227009 - DNA, 16 bp, P. troglodytes
ccaccattgataggca

SEQ ID NO: 227010 - DNA, 18 bp, P. troglodytes
ccaccattgtgatttgtt

SEQ ID NO: 227011 - DNA, 16 bp, P. troglodytes
ccaccattttgcctct

SEQ ID NO: 227012 - DNA, 16 bp, P. troglodytes
ccacccaaagtgctag

SEQ ID NO: 227013 - DNA, 16 bp, P. troglodytes
ccacccaaatatcatc

SEQ ID NO: 227014 - DNA, 16 bp, P. troglodytes
ccacccaccaggttca

SEQ ID NO: 227015 - DNA, 16 bp, P. troglodytes
ccacccacctctgcct

SEQ ID NO: 227016 - DNA, 16 bp, P. troglodytes
ccacccacctgggcct

SEQ ID NO: 227017 - DNA, 16 bp, P. troglodytes
ccacccacctgggtct

SEQ ID NO: 227018 - DNA, 16 bp, P. troglodytes
ccacccaccttggcca

SEQ ID NO: 227019 - DNA, 16 bp, P. troglodytes
ccacccaccttggccc

SEQ ID NO: 227020 - DNA, 16 bp, P. troglodytes
ccacccactccagcct

SEQ ID NO: 227021 - DNA, 16 bp, P. troglodytes
ccacccagagaagcac

SEQ ID NO: 227022 - DNA, 16 bp, P. troglodytes
ccacccagcagccaga

SEQ ID NO: 227023 - DNA, 16 bp, P. troglodytes
ccacccagcccctggc

SEQ ID NO: 227024 - DNA, 16 bp, P. troglodytes
ccacccaggctgcagt

SEQ ID NO: 227025 - DNA, 16 bp, P. troglodytes
ccacccagtgaggaag

SEQ ID NO: 227026 - DNA, 16 bp, P. troglodytes
ccacccatatcctgct

SEQ ID NO: 227027 - DNA, 16 bp, P. troglodytes
ccacccatatctcatc

SEQ ID NO: 227028 - DNA, 16 bp, P. troglodytes
ccacccatctcagcct

SEQ ID NO: 227029 - DNA, 16 bp, P. troglodytes
ccacccatggctgccc

SEQ ID NO: 227030 - DNA, 16 bp, P. troglodytes
ccaccccacttggcct

SEQ ID NO: 227031 - DNA, 16 bp, P. troglodytes
ccaccccagacccact

SEQ ID NO: 227032 - DNA, 16 bp, P. troglodytes
ccaccccagccagcag

SEQ ID NO: 227033 - DNA, 16 bp, P. troglodytes
ccaccccagcctcctg

SEQ ID NO: 227034 - DNA, 16 bp, P. troglodytes
ccaccccagcttcctg

SEQ ID NO: 227035 - DNA, 16 bp, P. troglodytes
ccacccccatgagcca

SEQ ID NO: 227036 - DNA, 16 bp, P. troglodytes
ccaccccgcctggcct

SEQ ID NO: 227037 - DNA, 16 bp, P. troglodytes
ccacccctgcagcaca

SEQ ID NO: 227038 - DNA, 16 bp, P. troglodytes
ccacccctttccccag

SEQ ID NO: 227039 - DNA, 16 bp, P. troglodytes
ccacccgcctcagcca

SEQ ID NO: 227040 - DNA, 17 bp, P. troglodytes
ccacccgcctcggcctt

SEQ ID NO: 227041 - DNA, 16 bp, P. troglodytes
ccacccgcctttgcct

SEQ ID NO: 227042 - DNA, 16 bp, P. troglodytes
ccaccctgaccaacat

SEQ ID NO: 227043 - DNA, 16 bp, P. troglodytes
ccaccctgcccagctc

SEQ ID NO: 227044 - DNA, 16 bp, P. troglodytes
ccaccctggacaacat

SEQ ID NO: 227045 - DNA, 16 bp, P. troglodytes
ccaccctggatgacag

SEQ ID NO: 227046 - DNA, 16 bp, P. troglodytes
ccaccctggccaagat

SEQ ID NO: 227047 - DNA, 16 bp, P. troglodytes
ccaccctgggcaacaa

SEQ ID NO: 227048 - DNA, 16 bp, P. troglodytes
ccaccctgggcaacat

SEQ ID NO: 227049 - DNA, 16 bp, P. troglodytes
ccaccctgggcaactt

SEQ ID NO: 227050 - DNA, 16 bp, P. troglodytes
ccaccctgggcagcag

SEQ ID NO: 227051 - DNA, 16 bp, P. troglodytes
ccaccctgggcaggcc

SEQ ID NO: 227052 - DNA, 16 bp, P. troglodytes
ccacccttgcagcaaa

SEQ ID NO: 227053 - DNA, 16 bp, P. troglodytes
ccacccttgtggcttt

SEQ ID NO: 227054 - DNA, 16 bp, P. troglodytes
ccaccctttccccaag

SEQ ID NO: 227055 - DNA, 16 bp, P. troglodytes
ccaccctttggcacag

SEQ ID NO: 227056 - DNA, 16 bp, P. troglodytes
ccaccgagcctggcca

SEQ ID NO: 227057 - DNA, 16 bp, P. troglodytes
ccaccgcacccagcag

SEQ ID NO: 227058 - DNA, 16 bp, P. troglodytes
ccaccgcacctggcct

SEQ ID NO: 227059 - DNA, 16 bp, P. troglodytes
ccaccgcagcctccca

SEQ ID NO: 227060 - DNA, 16 bp, P. troglodytes
ccaccgcctcggcctc

SEQ ID NO: 227061 - DNA, 17 bp, P. troglodytes
ccaccgcgcctggcctt

SEQ ID NO: 227062 - DNA, 16 bp, P. troglodytes
ccaccgctcccagctg

SEQ ID NO: 227063 - DNA, 16 bp, P. troglodytes
ccaccgctcccggcca

SEQ ID NO: 227064 - DNA, 16 bp, P. troglodytes
ccaccgctcccggcct

SEQ ID NO: 227065 - DNA, 16 bp, P. troglodytes
ccaccggaaggaacca

SEQ ID NO: 227066 - DNA, 16 bp, P. troglodytes
ccaccgtgcccagcca

SEQ ID NO: 227067 - DNA, 16 bp, P. troglodytes
ccaccgtgcccagctg

SEQ ID NO: 227068 - DNA, 16 bp, P. troglodytes
ccaccgtgcccatccc

SEQ ID NO: 227069 - DNA, 16 bp, P. troglodytes
ccaccgtgcccggcta

SEQ ID NO: 227070 - DNA, 16 bp, P. troglodytes
ccaccgtgcctgacct

SEQ ID NO: 227071 - DNA, 16 bp, P. troglodytes
ccaccgtgcctggcta

SEQ ID NO: 227072 - DNA, 16 bp, P. troglodytes
ccaccgtggctggccc

SEQ ID NO: 227073 - DNA, 16 bp, P. troglodytes
ccaccgtgtctggctg

SEQ ID NO: 227074 - DNA, 16 bp, P. troglodytes
ccacctatgacctcag

SEQ ID NO: 227075 - DNA, 16 bp, P. troglodytes
ccacctatgagtctgt

SEQ ID NO: 227076 - DNA, 16 bp, P. troglodytes
ccacctcacccggcct

SEQ ID NO: 227077 - DNA, 16 bp, P. troglodytes
ccacctcagccaccag

SEQ ID NO: 227078 - DNA, 16 bp, P. troglodytes
ccacctcagccatcca

SEQ ID NO: 227079 - DNA, 16 bp, P. troglodytes
ccacctcagcccccag

SEQ ID NO: 227080 - DNA, 16 bp, P. troglodytes
ccacctcagccctgca

SEQ ID NO: 227081 - DNA, 16 bp, P. troglodytes
ccacctcagcctccgg

SEQ ID NO: 227082 - DNA, 16 bp, P. troglodytes
ccacctcagcctggac

SEQ ID NO: 227083 - DNA, 16 bp, P. troglodytes
ccacctcagccttctg

SEQ ID NO: 227084 - DNA, 16 bp, P. troglodytes
ccacctcagcgtcctg

SEQ ID NO: 227085 - DNA, 16 bp, P. troglodytes
ccacctcagctgcctg

SEQ ID NO: 227086 - DNA, 16 bp, P. troglodytes
ccacctcattctccca

SEQ ID NO: 227087 - DNA, 16 bp, P. troglodytes
ccacctcattctcctg

SEQ ID NO: 227088 - DNA, 16 bp, P. troglodytes
ccacctccaacatggg

SEQ ID NO: 227089 - DNA, 16 bp, P. troglodytes
ccacctccaacattgg

SEQ ID NO: 227090 - DNA, 16 bp, P. troglodytes
ccacctccaactttgg

SEQ ID NO: 227091 - DNA, 16 bp, P. troglodytes
ccacctccagcactgg

SEQ ID NO: 227092 - DNA, 16 bp, P. troglodytes
ccacctccagccctgc

SEQ ID NO: 227093 - DNA, 16 bp, P. troglodytes
ccacctccagcctctg

SEQ ID NO: 227094 - DNA, 16 bp, P. troglodytes
ccacctccagctcctg

SEQ ID NO: 227095 - DNA, 16 bp, P. troglodytes
ccacctccatccatgt

SEQ ID NO: 227096 - DNA, 16 bp, P. troglodytes
ccacctccatctcctg

SEQ ID NO: 227097 - DNA, 16 bp, P. troglodytes
ccacctcccacctcag

SEQ ID NO: 227098 - DNA, 16 bp, P. troglodytes
ccacctcccagctgtg

SEQ ID NO: 227099 - DNA, 16 bp, P. troglodytes
ccacctcccagggttc

SEQ ID NO: 227100 - DNA, 16 bp, P. troglodytes
ccacctcccaggttcc

SEQ ID NO: 227101 - DNA, 16 bp, P. troglodytes
ccacctcctccccagg

SEQ ID NO: 227102 - DNA, 16 bp, P. troglodytes
ccacctcctctccagc

SEQ ID NO: 227103 - DNA, 16 bp, P. troglodytes
ccacctcctgcagctg

SEQ ID NO: 227104 - DNA, 16 bp, P. troglodytes
ccacctcctgcctcag

SEQ ID NO: 227105 - DNA, 16 bp, P. troglodytes
ccacctcctggactca

SEQ ID NO: 227106 - DNA, 16 bp, P. troglodytes
ccacctcctggcctca

SEQ ID NO: 227107 - DNA, 16 bp, P. troglodytes
ccacctcctgggctcc

SEQ ID NO: 227108 - DNA, 16 bp, P. troglodytes
ccacctcgacctccca

SEQ ID NO: 227109 - DNA, 16 bp, P. troglodytes
ccacctcgcctggcta

SEQ ID NO: 227110 - DNA, 16 bp, P. troglodytes
ccacctcggccaccca

SEQ ID NO: 227111 - DNA, 16 bp, P. troglodytes
ccacctcggcttcccg

SEQ ID NO: 227112 - DNA, 16 bp, P. troglodytes
ccacctctacaaaaaa

SEQ ID NO: 227113 - DNA, 16 bp, P. troglodytes
ccacctctcccagcct

SEQ ID NO: 227114 - DNA, 16 bp, P. troglodytes
ccacctctccctcctg

SEQ ID NO: 227115 - DNA, 16 bp, P. troglodytes
ccacctctcctggccc

SEQ ID NO: 227116 - DNA, 16 bp, P. troglodytes
ccacctctgccacctc

SEQ ID NO: 227117 - DNA, 16 bp, P. troglodytes
ccacctctgcccaagc

SEQ ID NO: 227118 - DNA, 16 bp, P. troglodytes
ccacctctgcctccaa

SEQ ID NO: 227119 - DNA, 16 bp, P. troglodytes
ccacctctgcctccag

SEQ ID NO: 227120 - DNA, 16 bp, P. troglodytes
ccacctctgcctcccg

SEQ ID NO: 227121 - DNA, 16 bp, P. troglodytes
ccacctctgcctgcca

SEQ ID NO: 227122 - DNA, 16 bp, P. troglodytes
ccacctctgcgggcag

SEQ ID NO: 227123 - DNA, 16 bp, P. troglodytes
ccacctgaccatcacc

SEQ ID NO: 227124 - DNA, 16 bp, P. troglodytes
ccacctgagccagcag

SEQ ID NO: 227125 - DNA, 19 bp, P. troglodytes
ccacctgaggtcaggagtt

SEQ ID NO: 227126 - DNA, 16 bp, P. troglodytes
ccacctgcactccagc

SEQ ID NO: 227127 - DNA, 16 bp, P. troglodytes
ccacctgcagcccagg

SEQ ID NO: 227128 - DNA, 16 bp, P. troglodytes
ccacctgcagcccctg

SEQ ID NO: 227129 - DNA, 16 bp, P. troglodytes
ccacctgcagccctgg

SEQ ID NO: 227130 - DNA, 17 bp, P. troglodytes
ccacctgcatcggcctc

SEQ ID NO: 227131 - DNA, 16 bp, P. troglodytes
ccacctgcattccttg

SEQ ID NO: 227132 - DNA, 16 bp, P. troglodytes
ccacctgccccagcct

SEQ ID NO: 227133 - DNA, 16 bp, P. troglodytes
ccacctgccgggttca

SEQ ID NO: 227134 - DNA, 16 bp, P. troglodytes
ccacctgcctccacct

SEQ ID NO: 227135 - DNA, 16 bp, P. troglodytes
ccacctgcctccgcct

SEQ ID NO: 227136 - DNA, 16 bp, P. troglodytes
ccacctgcctcggccc

SEQ ID NO: 227137 - DNA, 16 bp, P. troglodytes
ccacctgctgggctca

SEQ ID NO: 227138 - DNA, 16 bp, P. troglodytes
ccacctggaactccag

SEQ ID NO: 227139 - DNA, 16 bp, P. troglodytes
ccacctggacctccca

SEQ ID NO: 227140 - DNA, 16 bp, P. troglodytes
ccacctggccccacct

SEQ ID NO: 227141 - DNA, 16 bp, P. troglodytes
ccacctggctcagcct

SEQ ID NO: 227142 - DNA, 16 bp, P. troglodytes
ccacctggggcctggg

SEQ ID NO: 227143 - DNA, 16 bp, P. troglodytes
ccacctgggttcaagc

SEQ ID NO: 227144 - DNA, 17 bp, P. troglodytes
ccacctgggttcacgcc

SEQ ID NO: 227145 - DNA, 16 bp, P. troglodytes
ccacctggttcctccc

SEQ ID NO: 227146 - DNA, 16 bp, P. troglodytes
ccacctgtgcctccca

SEQ ID NO: 227147 - DNA, 16 bp, P. troglodytes
ccacctgttctccaaa

SEQ ID NO: 227148 - DNA, 16 bp, P. troglodytes
ccacctgtttctctgt

SEQ ID NO: 227149 - DNA, 16 bp, P. troglodytes
ccaccttagccttcca

SEQ ID NO: 227150 - DNA, 16 bp, P. troglodytes
ccaccttcacctcctg

SEQ ID NO: 227151 - DNA, 16 bp, P. troglodytes
ccaccttcatcaatga

SEQ ID NO: 227152 - DNA, 16 bp, P. troglodytes
ccaccttcatcagtga

SEQ ID NO: 227153 - DNA, 16 bp, P. troglodytes
ccaccttccaccatgg

SEQ ID NO: 227154 - DNA, 16 bp, P. troglodytes
ccaccttctgaagctt

SEQ ID NO: 227155 - DNA, 16 bp, P. troglodytes
ccaccttctgtcagat

SEQ ID NO: 227156 - DNA, 16 bp, P. troglodytes
ccaccttgaccttcca

SEQ ID NO: 227157 - DNA, 16 bp, P. troglodytes
ccaccttggccccctc

SEQ ID NO: 227158 - DNA, 16 bp, P. troglodytes
ccaccttggcctccct

SEQ ID NO: 227159 - DNA, 16 bp, P. troglodytes
ccaccttgttctccca

SEQ ID NO: 227160 - DNA, 16 bp, P. troglodytes
ccacctttactaaaaa

SEQ ID NO: 227161 - DNA, 16 bp, P. troglodytes
ccacgacctgctgagg

SEQ ID NO: 227162 - DNA, 17 bp, P. troglodytes
ccacgaggtcaagagat

SEQ ID NO: 227163 - DNA, 16 bp, P. troglodytes
ccacgatgcctggcta

SEQ ID NO: 227164 - DNA, 16 bp, P. troglodytes
ccacgcccagccagaa

SEQ ID NO: 227165 - DNA, 16 bp, P. troglodytes
ccacgcccagccagga

SEQ ID NO: 227166 - DNA, 16 bp, P. troglodytes
ccacgcccagcctcac

SEQ ID NO: 227167 - DNA, 16 bp, P. troglodytes
ccacgcccagcctgga

SEQ ID NO: 227168 - DNA, 16 bp, P. troglodytes
ccacgcccagcctgtg

SEQ ID NO: 227169 - DNA, 16 bp, P. troglodytes
ccacgcccccatcctg

SEQ ID NO: 227170 - DNA, 16 bp, P. troglodytes
ccacgccccgctaatt

SEQ ID NO: 227171 - DNA, 16 bp, P. troglodytes
ccacgcctggcctaga

SEQ ID NO: 227172 - DNA, 16 bp, P. troglodytes
ccacgctggtgtgcag

SEQ ID NO: 227173 - DNA, 16 bp, P. troglodytes
ccacggcgcccggcct

SEQ ID NO: 227174 - DNA, 16 bp, P. troglodytes
ccacggtcttgggcag

SEQ ID NO: 227175 - DNA, 16 bp, P. troglodytes
ccacggtgcccagccc

SEQ ID NO: 227176 - DNA, 16 bp, P. troglodytes
ccacgtccctgcaaag

SEQ ID NO: 227177 - DNA, 16 bp, P. troglodytes
ccacgtccggctaatt

SEQ ID NO: 227178 - DNA, 16 bp, P. troglodytes
ccacgtgaagacacag

SEQ ID NO: 227179 - DNA, 16 bp, P. troglodytes
ccacgtggctggagag

SEQ ID NO: 227180 - DNA, 16 bp, P. troglodytes
ccacgtttgccaggct

SEQ ID NO: 227181 - DNA, 16 bp, P. troglodytes
ccactaaaaggaacca

SEQ ID NO: 227182 - DNA, 16 bp, P. troglodytes
ccactaatgtactttc

SEQ ID NO: 227183 - DNA, 16 bp, P. troglodytes
ccactacacaccagcc

SEQ ID NO: 227184 - DNA, 16 bp, P. troglodytes
ccactacaccccagcc

SEQ ID NO: 227185 - DNA, 16 bp, P. troglodytes
ccactacacccggccc

SEQ ID NO: 227186 - DNA, 16 bp, P. troglodytes
ccactacacctggctg

SEQ ID NO: 227187 - DNA, 16 bp, P. troglodytes
ccactacactcggcta

SEQ ID NO: 227188 - DNA, 16 bp, P. troglodytes
ccactaccaccacagc

SEQ ID NO: 227189 - DNA, 16 bp, P. troglodytes
ccactaccacccagct

SEQ ID NO: 227190 - DNA, 16 bp, P. troglodytes
ccactacgtccagcta

SEQ ID NO: 227191 - DNA, 16 bp, P. troglodytes
ccactaggtggtgccc

SEQ ID NO: 227192 - DNA, 16 bp, P. troglodytes
ccactaggtggtgctg

SEQ ID NO: 227193 - DNA, 16 bp, P. troglodytes
ccactatacctggcta

SEQ ID NO: 227194 - DNA, 16 bp, P. troglodytes
ccactatgactgcact

SEQ ID NO: 227195 - DNA, 16 bp, P. troglodytes
ccactatgagatatca

SEQ ID NO: 227196 - DNA, 23 bp, P. troglodytes
ccactcacaattgcttcaaagag

SEQ ID NO: 227197 - DNA, 16 bp, P. troglodytes
ccactcacctctgcct

SEQ ID NO: 227198 - DNA, 16 bp, P. troglodytes
ccactcaccttctgct

SEQ ID NO: 227199 - DNA, 16 bp, P. troglodytes
ccactcactagctgtg

SEQ ID NO: 227200 - DNA, 16 bp, P. troglodytes
ccactcactcactgac

SEQ ID NO: 227201 - DNA, 16 bp, P. troglodytes
ccactcactccagcct

SEQ ID NO: 227202 - DNA, 16 bp, P. troglodytes
ccactcagcccagcag

SEQ ID NO: 227203 - DNA, 16 bp, P. troglodytes
ccactcaggtggctga

SEQ ID NO: 227204 - DNA, 16 bp, P. troglodytes
ccactcagtctatggt

SEQ ID NO: 227205 - DNA, 16 bp, P. troglodytes
ccactccactccagcc

SEQ ID NO: 227206 - DNA, 16 bp, P. troglodytes
ccactccagatgggcc

SEQ ID NO: 227207 - DNA, 16 bp, P. troglodytes
ccactccagcctaggc

SEQ ID NO: 227208 - DNA, 16 bp, P. troglodytes
ccactccagcctgggc

SEQ ID NO: 227209 - DNA, 16 bp, P. troglodytes
ccactccagcctgggt

SEQ ID NO: 227210 - DNA, 16 bp, P. troglodytes
ccactccagcttcagc

SEQ ID NO: 227211 - DNA, 16 bp, P. troglodytes
ccactccagcttgggt

SEQ ID NO: 227212 - DNA, 16 bp, P. troglodytes
ccactcccagccccag

SEQ ID NO: 227213 - DNA, 16 bp, P. troglodytes
ccactccccttcccag

SEQ ID NO: 227214 - DNA, 16 bp, P. troglodytes
ccactcctgagataac

SEQ ID NO: 227215 - DNA, 16 bp, P. troglodytes
ccactcctgcagcaga

SEQ ID NO: 227216 - DNA, 16 bp, P. troglodytes
ccactcctgccaccct

SEQ ID NO: 227217 - DNA, 16 bp, P. troglodytes
ccactctcaatgcctt

SEQ ID NO: 227218 - DNA, 17 bp, P. troglodytes
ccactctcttctggctt

SEQ ID NO: 227219 - DNA, 16 bp, P. troglodytes
ccactctgcccagcca

SEQ ID NO: 227220 - DNA, 18 bp, P. troglodytes
ccactctgcccgccagag

SEQ ID NO: 227221 - DNA, 16 bp, P. troglodytes
ccactctgcctggcct

SEQ ID NO: 227222 - DNA, 16 bp, P. troglodytes
ccactctggccaacat

SEQ ID NO: 227223 - DNA, 16 bp, P. troglodytes
ccactctgtcaccagg

SEQ ID NO: 227224 - DNA, 16 bp, P. troglodytes
ccactgaacccagcca

SEQ ID NO: 227225 - DNA, 16 bp, P. troglodytes
ccactgaacctaaaat

SEQ ID NO: 227226 - DNA, 16 bp, P. troglodytes
ccactgaagaaggaaa

SEQ ID NO: 227227 - DNA, 16 bp, P. troglodytes
ccactgaagccttgaa

SEQ ID NO: 227228 - DNA, 16 bp, P. troglodytes
ccactgaccccagaga

SEQ ID NO: 227229 - DNA, 16 bp, P. troglodytes
ccactgacctcagcct

SEQ ID NO: 227230 - DNA, 16 bp, P. troglodytes
ccactgagccaggcat

SEQ ID NO: 227231 - DNA, 16 bp, P. troglodytes
ccactgagcccagctg

SEQ ID NO: 227232 - DNA, 16 bp, P. troglodytes
ccactgattcaaatgt

SEQ ID NO: 227233 - DNA, 16 bp, P. troglodytes
ccactgcaaaaacata

SEQ ID NO: 227234 - DNA, 16 bp, P. troglodytes
ccactgcaaccagcca

SEQ ID NO: 227235 - DNA, 16 bp, P. troglodytes
ccactgcacaacagcc

SEQ ID NO: 227236 - DNA, 16 bp, P. troglodytes
ccactgcacaccagcc

SEQ ID NO: 227237 - DNA, 16 bp, P. troglodytes
ccactgcacagcctgg

SEQ ID NO: 227238 - DNA, 16 bp, P. troglodytes
ccactgcaccaggctc

SEQ ID NO: 227239 - DNA, 16 bp, P. troglodytes
ccactgcaccccagct

SEQ ID NO: 227240 - DNA, 17 bp, P. troglodytes
ccactgcacccggccca

SEQ ID NO: 227241 - DNA, 16 bp, P. troglodytes
ccactgcaccgggcct

SEQ ID NO: 227242 - DNA, 16 bp, P. troglodytes
ccactgcacctagcca

SEQ ID NO: 227243 - DNA, 16 bp, P. troglodytes
ccactgcacctgcccc

SEQ ID NO: 227244 - DNA, 16 bp, P. troglodytes
ccactgcacctggaca

SEQ ID NO: 227245 - DNA, 16 bp, P. troglodytes
ccactgcacctgggct

SEQ ID NO: 227246 - DNA, 16 bp, P. troglodytes
ccactgcactcagcct

SEQ ID NO: 227247 - DNA, 16 bp, P. troglodytes
ccactgcactccaact

SEQ ID NO: 227248 - DNA, 16 bp, P. troglodytes
ccactgcactccagca

SEQ ID NO: 227249 - DNA, 17 bp, P. troglodytes
ccactgcactccagccg

SEQ ID NO: 227250 - DNA, 16 bp, P. troglodytes
ccactgcactccagct

SEQ ID NO: 227251 - DNA, 16 bp, P. troglodytes
ccactgcactccagtt

SEQ ID NO: 227252 - DNA, 16 bp, P. troglodytes
ccactgcactccatcc

SEQ ID NO: 227253 - DNA, 16 bp, P. troglodytes
ccactgcactccctcc

SEQ ID NO: 227254 - DNA, 16 bp, P. troglodytes
ccactgcactcctggg

SEQ ID NO: 227255 - DNA, 16 bp, P. troglodytes
ccactgcactctagct

SEQ ID NO: 227256 - DNA, 16 bp, P. troglodytes
ccactgcactgcaacc

SEQ ID NO: 227257 - DNA, 16 bp, P. troglodytes
ccactgcactgcctgg

SEQ ID NO: 227258 - DNA, 16 bp, P. troglodytes
ccactgcacttcagcc

SEQ ID NO: 227259 - DNA, 16 bp, P. troglodytes
ccactgcacttggcct

SEQ ID NO: 227260 - DNA, 16 bp, P. troglodytes
ccactgcagccagcct

SEQ ID NO: 227261 - DNA, 16 bp, P. troglodytes
ccactgcagccagtgt

SEQ ID NO: 227262 - DNA, 16 bp, P. troglodytes
ccactgcagttcagcc

SEQ ID NO: 227263 - DNA, 16 bp, P. troglodytes
ccactgcatctggcct

SEQ ID NO: 227264 - DNA, 16 bp, P. troglodytes
ccactgcattccagct

SEQ ID NO: 227265 - DNA, 16 bp, P. troglodytes
ccactgccaccaccac

SEQ ID NO: 227266 - DNA, 16 bp, P. troglodytes
ccactgccaccactgg

SEQ ID NO: 227267 - DNA, 16 bp, P. troglodytes
ccactgccacgcccag

SEQ ID NO: 227268 - DNA, 16 bp, P. troglodytes
ccactgccactgccac

SEQ ID NO: 227269 - DNA, 16 bp, P. troglodytes
ccactgccactgccct

SEQ ID NO: 227270 - DNA, 16 bp, P. troglodytes
ccactgcccccagcca

SEQ ID NO: 227271 - DNA, 16 bp, P. troglodytes
ccactgcccctggcca

SEQ ID NO: 227272 - DNA, 16 bp, P. troglodytes
ccactgcccctggcct

SEQ ID NO: 227273 - DNA, 16 bp, P. troglodytes
ccactgcccctggcta

SEQ ID NO: 227274 - DNA, 16 bp, P. troglodytes
ccactgccctacagcc

SEQ ID NO: 227275 - DNA, 16 bp, P. troglodytes
ccactgcctgggtgac

SEQ ID NO: 227276 - DNA, 16 bp, P. troglodytes
ccactgccttcctgga

SEQ ID NO: 227277 - DNA, 16 bp, P. troglodytes
ccactgccttctagcc

SEQ ID NO: 227278 - DNA, 16 bp, P. troglodytes
ccactgcgccaggcca

SEQ ID NO: 227279 - DNA, 16 bp, P. troglodytes
ccactgcgccccgcca

SEQ ID NO: 227280 - DNA, 16 bp, P. troglodytes
ccactgcgcctggcta

SEQ ID NO: 227281 - DNA, 16 bp, P. troglodytes
ccactgcgcctggctc

SEQ ID NO: 227282 - DNA, 16 bp, P. troglodytes
ccactgcgcctggctg

SEQ ID NO: 227283 - DNA, 16 bp, P. troglodytes
ccactgcgctccagct

SEQ ID NO: 227284 - DNA, 16 bp, P. troglodytes
ccactgcgtctggcta

SEQ ID NO: 227285 - DNA, 16 bp, P. troglodytes
ccactgctcaagaaaa

SEQ ID NO: 227286 - DNA, 16 bp, P. troglodytes
ccactgctcccggctg

SEQ ID NO: 227287 - DNA, 16 bp, P. troglodytes
ccactgctctcagcct

SEQ ID NO: 227288 - DNA, 16 bp, P. troglodytes
ccactgctctccagca

SEQ ID NO: 227289 - DNA, 16 bp, P. troglodytes
ccactgctctcttcag

SEQ ID NO: 227290 - DNA, 16 bp, P. troglodytes
ccactgctgagtgccc

SEQ ID NO: 227291 - DNA, 16 bp, P. troglodytes
ccactgctgccaccac

SEQ ID NO: 227292 - DNA, 16 bp, P. troglodytes
ccactgctggctttga

SEQ ID NO: 227293 - DNA, 16 bp, P. troglodytes
ccactgcttccagcct

SEQ ID NO: 227294 - DNA, 16 bp, P. troglodytes
ccactggaaaagggaa

SEQ ID NO: 227295 - DNA, 16 bp, P. troglodytes
ccactggaagatcttc

SEQ ID NO: 227296 - DNA, 16 bp, P. troglodytes
ccactggagaagctga

SEQ ID NO: 227297 - DNA, 18 bp, P. troglodytes
ccactggaggctatatga

SEQ ID NO: 227298 - DNA, 16 bp, P. troglodytes
ccactggctccaagcc

SEQ ID NO: 227299 - DNA, 16 bp, P. troglodytes
ccactgggaccctccc

SEQ ID NO: 227300 - DNA, 16 bp, P. troglodytes
ccactgggaggaacga

SEQ ID NO: 227301 - DNA, 16 bp, P. troglodytes
ccactgggcagtgccc

SEQ ID NO: 227302 - DNA, 16 bp, P. troglodytes
ccactgggcccagccc

SEQ ID NO: 227303 - DNA, 16 bp, P. troglodytes
ccactgggctctacca

SEQ ID NO: 227304 - DNA, 16 bp, P. troglodytes
ccactgggtccctcct

SEQ ID NO: 227305 - DNA, 16 bp, P. troglodytes
ccactggtgacacctc

SEQ ID NO: 227306 - DNA, 16 bp, P. troglodytes
ccactggtgcaagtcc

SEQ ID NO: 227307 - DNA, 16 bp, P. troglodytes
ccactgtacccagtct

SEQ ID NO: 227308 - DNA, 16 bp, P. troglodytes
ccactgtccctggccc

SEQ ID NO: 227309 - DNA, 16 bp, P. troglodytes
ccactgtcctccagcc

SEQ ID NO: 227310 - DNA, 16 bp, P. troglodytes
ccactgtctcctggcc

SEQ ID NO: 227311 - DNA, 16 bp, P. troglodytes
ccactgtgccaggctc

SEQ ID NO: 227312 - DNA, 16 bp, P. troglodytes
ccactgtgcccagcct

SEQ ID NO: 227313 - DNA, 16 bp, P. troglodytes
ccactgtgcccagcta

SEQ ID NO: 227314 - DNA, 16 bp, P. troglodytes
ccactgtgccctggcc

SEQ ID NO: 227315 - DNA, 16 bp, P. troglodytes
ccactgtgcctgccct

SEQ ID NO: 227316 - DNA, 16 bp, P. troglodytes
ccactgtgcctggctc

SEQ ID NO: 227317 - DNA, 16 bp, P. troglodytes
ccactgtgcctggctt

SEQ ID NO: 227318 - DNA, 16 bp, P. troglodytes
ccactgtgcctggtgt

SEQ ID NO: 227319 - DNA, 16 bp, P. troglodytes
ccactgtgcctggttg

SEQ ID NO: 227320 - DNA, 16 bp, P. troglodytes
ccactgtgccttgccc

SEQ ID NO: 227321 - DNA, 16 bp, P. troglodytes
ccactgtgctccagac

SEQ ID NO: 227322 - DNA, 16 bp, P. troglodytes
ccactgtgctgcagcc

SEQ ID NO: 227323 - DNA, 16 bp, P. troglodytes
ccactgtggaagacaa

SEQ ID NO: 227324 - DNA, 16 bp, P. troglodytes
ccactgtggtttgaga

SEQ ID NO: 227325 - DNA, 16 bp, P. troglodytes
ccactgtgtccggccc

SEQ ID NO: 227326 - DNA, 16 bp, P. troglodytes
ccactgttttactggg

SEQ ID NO: 227327 - DNA, 16 bp, P. troglodytes
ccacttaaaaggcaga

SEQ ID NO: 227328 - DNA, 16 bp, P. troglodytes
ccacttaccagctgtg

SEQ ID NO: 227329 - DNA, 16 bp, P. troglodytes
ccacttatatgaggta

SEQ ID NO: 227330 - DNA, 16 bp, P. troglodytes
ccacttcaagttgtcc

SEQ ID NO: 227331 - DNA, 16 bp, P. troglodytes
ccacttcagcctcccg

SEQ ID NO: 227332 - DNA, 16 bp, P. troglodytes
ccacttcagcctgggc

SEQ ID NO: 227333 - DNA, 16 bp, P. troglodytes
ccacttcagccttctg

SEQ ID NO: 227334 - DNA, 16 bp, P. troglodytes
ccacttcctggttcat

SEQ ID NO: 227335 - DNA, 16 bp, P. troglodytes
ccacttccttgttgct

SEQ ID NO: 227336 - DNA, 16 bp, P. troglodytes
ccacttctgcctccca

SEQ ID NO: 227337 - DNA, 16 bp, P. troglodytes
ccacttgcagattcca

SEQ ID NO: 227338 - DNA, 16 bp, P. troglodytes
ccacttgggaggcaga

SEQ ID NO: 227339 - DNA, 16 bp, P. troglodytes
ccacttgggcctccca

SEQ ID NO: 227340 - DNA, 16 bp, P. troglodytes
ccacttggttatgatg

SEQ ID NO: 227341 - DNA, 16 bp, P. troglodytes
ccactttacagatgag

SEQ ID NO: 227342 - DNA, 16 bp, P. troglodytes
ccactttcaccacttc

SEQ ID NO: 227343 - DNA, 16 bp, P. troglodytes
ccactttctgatgtgg

SEQ ID NO: 227344 - DNA, 16 bp, P. troglodytes
ccactttgcccagcct

SEQ ID NO: 227345 - DNA, 16 bp, P. troglodytes
ccactttgcctggccc

SEQ ID NO: 227346 - DNA, 16 bp, P. troglodytes
ccactttggcctcccc

SEQ ID NO: 227347 - DNA, 16 bp, P. troglodytes
ccactttgggaggcca

SEQ ID NO: 227348 - DNA, 20 bp, P. troglodytes
ccactttgggaggccgaggt

SEQ ID NO: 227349 - DNA, 18 bp, P. troglodytes
ccactttgggaggctgag

SEQ ID NO: 227350 - DNA, 16 bp, P. troglodytes
ccactttttgattggg

SEQ ID NO: 227351 - DNA, 16 bp, P. troglodytes
ccactttttgattttt

SEQ ID NO: 227352 - DNA, 16 bp, P. troglodytes
ccagaaaaatgaaaac

SEQ ID NO: 227353 - DNA, 16 bp, P. troglodytes
ccagaaaactccaaca

SEQ ID NO: 227354 - DNA, 16 bp, P. troglodytes
ccagaaaaggcaagga

SEQ ID NO: 227355 - DNA, 16 bp, P. troglodytes
ccagaaaatagaagca

SEQ ID NO: 227356 - DNA, 16 bp, P. troglodytes
ccagaaacctctgtgg

SEQ ID NO: 227357 - DNA, 16 bp, P. troglodytes
ccagaaagaaatagaa

SEQ ID NO: 227358 - DNA, 16 bp, P. troglodytes
ccagaaagaaattgaa

SEQ ID NO: 227359 - DNA, 16 bp, P. troglodytes
ccagaaagaagtcaaa

SEQ ID NO: 227360 - DNA, 16 bp, P. troglodytes
ccagaaagcaaggaag

SEQ ID NO: 227361 - DNA, 16 bp, P. troglodytes
ccagaaaggaatgcag

SEQ ID NO: 227362 - DNA, 16 bp, P. troglodytes
ccagaaaggggtccca

SEQ ID NO: 227363 - DNA, 16 bp, P. troglodytes
ccagaaagtcgaggct

SEQ ID NO: 227364 - DNA, 16 bp, P. troglodytes
ccagaaagtggaggtt

SEQ ID NO: 227365 - DNA, 16 bp, P. troglodytes
ccagaaagtggcagag

SEQ ID NO: 227366 - DNA, 16 bp, P. troglodytes
ccagaaataaacaatt

SEQ ID NO: 227367 - DNA, 16 bp, P. troglodytes
ccagaaataaatgaga

SEQ ID NO: 227368 - DNA, 16 bp, P. troglodytes
ccagaaatgtaagaaa

SEQ ID NO: 227369 - DNA, 16 bp, P. troglodytes
ccagaacaggaggaag

SEQ ID NO: 227370 - DNA, 16 bp, P. troglodytes
ccagaacaggcaaatc

SEQ ID NO: 227371 - DNA, 16 bp, P. troglodytes
ccagaacatttccatc

SEQ ID NO: 227372 - DNA, 16 bp, P. troglodytes
ccagaactgtgagaaa

SEQ ID NO: 227373 - DNA, 16 bp, P. troglodytes
ccagaactgtgaggaa

SEQ ID NO: 227374 - DNA, 16 bp, P. troglodytes
ccagaacttccccaac

SEQ ID NO: 227375 - DNA, 16 bp, P. troglodytes
ccagaacttttcatct

SEQ ID NO: 227376 - DNA, 16 bp, P. troglodytes
ccagaagaaaacctag

SEQ ID NO: 227377 - DNA, 16 bp, P. troglodytes
ccagaagaaggcactg

SEQ ID NO: 227378 - DNA, 16 bp, P. troglodytes
ccagaagacaagaaat

SEQ ID NO: 227379 - DNA, 16 bp, P. troglodytes
ccagaagacaagagtg

SEQ ID NO: 227380 - DNA, 16 bp, P. troglodytes
ccagaagacagaggtt

SEQ ID NO: 227381 - DNA, 16 bp, P. troglodytes
ccagaagacagtggag

SEQ ID NO: 227382 - DNA, 16 bp, P. troglodytes
ccagaagactcagcaa

SEQ ID NO: 227383 - DNA, 16 bp, P. troglodytes
ccagaagagaggtaaa

SEQ ID NO: 227384 - DNA, 16 bp, P. troglodytes
ccagaagagagtgcag

SEQ ID NO: 227385 - DNA, 16 bp, P. troglodytes
ccagaagcacaggcaa

SEQ ID NO: 227386 - DNA, 16 bp, P. troglodytes
ccagaagcagaagcct

SEQ ID NO: 227387 - DNA, 16 bp, P. troglodytes
ccagaagcagaagtca

SEQ ID NO: 227388 - DNA, 16 bp, P. troglodytes
ccagaagcagaggctg

SEQ ID NO: 227389 - DNA, 16 bp, P. troglodytes
ccagaagcagatcctg

SEQ ID NO: 227390 - DNA, 16 bp, P. troglodytes
ccagaagcagatgctg

SEQ ID NO: 227391 - DNA, 16 bp, P. troglodytes
ccagaagcagatgctt

SEQ ID NO: 227392 - DNA, 16 bp, P. troglodytes
ccagaagccaaggaga

SEQ ID NO: 227393 - DNA, 16 bp, P. troglodytes
ccagaagcccagcaga

SEQ ID NO: 227394 - DNA, 16 bp, P. troglodytes
ccagaagcccctctca

SEQ ID NO: 227395 - DNA, 16 bp, P. troglodytes
ccagaagcctgacatg

SEQ ID NO: 227396 - DNA, 16 bp, P. troglodytes
ccagaagctagaaaga

SEQ ID NO: 227397 - DNA, 16 bp, P. troglodytes
ccagaagctctccaaa

SEQ ID NO: 227398 - DNA, 16 bp, P. troglodytes
ccagaagctgagcaga

SEQ ID NO: 227399 - DNA, 16 bp, P. troglodytes
ccagaagctgatgctg

SEQ ID NO: 227400 - DNA, 16 bp, P. troglodytes
ccagaagctggaggag

SEQ ID NO: 227401 - DNA, 16 bp, P. troglodytes
ccagaaggaaaggaga

SEQ ID NO: 227402 - DNA, 16 bp, P. troglodytes
ccagaaggaaccagcc

SEQ ID NO: 227403 - DNA, 16 bp, P. troglodytes
ccagaaggaagaaatt

SEQ ID NO: 227404 - DNA, 16 bp, P. troglodytes
ccagaaggaatgctga

SEQ ID NO: 227405 - DNA, 16 bp, P. troglodytes
ccagaaggagagaaga

SEQ ID NO: 227406 - DNA, 16 bp, P. troglodytes
ccagaaggtcaaggct

SEQ ID NO: 227407 - DNA, 16 bp, P. troglodytes
ccagaagtacaaagaa

SEQ ID NO: 227408 - DNA, 16 bp, P. troglodytes
ccagaagtagatgctg

SEQ ID NO: 227409 - DNA, 16 bp, P. troglodytes
ccagaagtctgaagtc

SEQ ID NO: 227410 - DNA, 17 bp, P. troglodytes
ccagaagttcaagacca

SEQ ID NO: 227411 - DNA, 16 bp, P. troglodytes
ccagaagttccaggct

SEQ ID NO: 227412 - DNA, 17 bp, P. troglodytes
ccagaagtttgagacca

SEQ ID NO: 227413 - DNA, 16 bp, P. troglodytes
ccagaagtttgaggct

SEQ ID NO: 227414 - DNA, 16 bp, P. troglodytes
ccagaatacacaagga

SEQ ID NO: 227415 - DNA, 16 bp, P. troglodytes
ccagaataggtaaatt

SEQ ID NO: 227416 - DNA, 16 bp, P. troglodytes
ccagaatataaaaaga

SEQ ID NO: 227417 - DNA, 16 bp, P. troglodytes
ccagaatatacaagaa

SEQ ID NO: 227418 - DNA, 16 bp, P. troglodytes
ccagaatatataaaaa

SEQ ID NO: 227419 - DNA, 16 bp, P. troglodytes
ccagaatatataaata

SEQ ID NO: 227420 - DNA, 16 bp, P. troglodytes
ccagaatatataagga

SEQ ID NO: 227421 - DNA, 16 bp, P. troglodytes
ccagaatattttaaaa

SEQ ID NO: 227422 - DNA, 16 bp, P. troglodytes
ccagaatcacctggag

SEQ ID NO: 227423 - DNA, 16 bp, P. troglodytes
ccagaatccacaaaga

SEQ ID NO: 227424 - DNA, 16 bp, P. troglodytes
ccagaatctaccagga

SEQ ID NO: 227425 - DNA, 16 bp, P. troglodytes
ccagaatctctgggaa

SEQ ID NO: 227426 - DNA, 16 bp, P. troglodytes
ccagaatcttcaaaga

SEQ ID NO: 227427 - DNA, 16 bp, P. troglodytes
ccagaatctttttttt

SEQ ID NO: 227428 - DNA, 16 bp, P. troglodytes
ccagaatggcagatcc

SEQ ID NO: 227429 - DNA, 16 bp, P. troglodytes
ccagaattcaagacca

SEQ ID NO: 227430 - DNA, 16 bp, P. troglodytes
ccagaatttaattttt

SEQ ID NO: 227431 - DNA, 16 bp, P. troglodytes
ccagaatttcatattt

SEQ ID NO: 227432 - DNA, 16 bp, P. troglodytes
ccagaatttccttcct

SEQ ID NO: 227433 - DNA, 16 bp, P. troglodytes
ccagaatttctacttg

SEQ ID NO: 227434 - DNA, 16 bp, P. troglodytes
ccagacactgagtctg

SEQ ID NO: 227435 - DNA, 16 bp, P. troglodytes
ccagacaggctgtgaa

SEQ ID NO: 227436 - DNA, 16 bp, P. troglodytes
ccagacatacaaagaa

SEQ ID NO: 227437 - DNA, 16 bp, P. troglodytes
ccagacatggtggtgt

SEQ ID NO: 227438 - DNA, 16 bp, P. troglodytes
ccagacattgctaaat

SEQ ID NO: 227439 - DNA, 16 bp, P. troglodytes
ccagaccagcagcatc

SEQ ID NO: 227440 - DNA, 16 bp, P. troglodytes
ccagaccagcccgggc

SEQ ID NO: 227441 - DNA, 16 bp, P. troglodytes
ccagaccagcctgatc

SEQ ID NO: 227442 - DNA, 16 bp, P. troglodytes
ccagaccatatcattc

SEQ ID NO: 227443 - DNA, 16 bp, P. troglodytes
ccagaccatcctgact

SEQ ID NO: 227444 - DNA, 16 bp, P. troglodytes
ccagaccatcctggcc

SEQ ID NO: 227445 - DNA, 16 bp, P. troglodytes
ccagaccattaaaact

SEQ ID NO: 227446 - DNA, 16 bp, P. troglodytes
ccagacccagggctta

SEQ ID NO: 227447 - DNA, 16 bp, P. troglodytes
ccagaccccaaaagag

SEQ ID NO: 227448 - DNA, 16 bp, P. troglodytes
ccagaccccaagacag

SEQ ID NO: 227449 - DNA, 16 bp, P. troglodytes
ccagaccccaagggag

SEQ ID NO: 227450 - DNA, 16 bp, P. troglodytes
ccagaccccagagtgg

SEQ ID NO: 227451 - DNA, 16 bp, P. troglodytes
ccagaccctgtctcca

SEQ ID NO: 227452 - DNA, 16 bp, P. troglodytes
ccagacctactgaatc

SEQ ID NO: 227453 - DNA, 16 bp, P. troglodytes
ccagacctattgaatc

SEQ ID NO: 227454 - DNA, 16 bp, P. troglodytes
ccagactagccaacat

SEQ ID NO: 227455 - DNA, 16 bp, P. troglodytes
ccagactccagaattg

SEQ ID NO: 227456 - DNA, 16 bp, P. troglodytes
ccagactctgtctcaa

SEQ ID NO: 227457 - DNA, 16 bp, P. troglodytes
ccagactgcagtgcaa

SEQ ID NO: 227458 - DNA, 16 bp, P. troglodytes
ccagactgcctcttta

SEQ ID NO: 227459 - DNA, 16 bp, P. troglodytes
ccagactggagcacag

SEQ ID NO: 227460 - DNA, 16 bp, P. troglodytes
ccagactgggcaatat

SEQ ID NO: 227461 - DNA, 18 bp, P. troglodytes
ccagactgggtagccagg

SEQ ID NO: 227462 - DNA, 16 bp, P. troglodytes
ccagactggtcctgaa

SEQ ID NO: 227463 - DNA, 16 bp, P. troglodytes
ccagactttatttgga

SEQ ID NO: 227464 - DNA, 16 bp, P. troglodytes
ccagagaaaaaggtcg

SEQ ID NO: 227465 - DNA, 16 bp, P. troglodytes
ccagagaaaagaaaat

SEQ ID NO: 227466 - DNA, 16 bp, P. troglodytes
ccagagaaaagagtag

SEQ ID NO: 227467 - DNA, 16 bp, P. troglodytes
ccagagaaagccaaat

SEQ ID NO: 227468 - DNA, 16 bp, P. troglodytes
ccagagaaggaggaag

SEQ ID NO: 227469 - DNA, 16 bp, P. troglodytes
ccagagacatgccagc

SEQ ID NO: 227470 - DNA, 16 bp, P. troglodytes
ccagagacccttgttc

SEQ ID NO: 227471 - DNA, 16 bp, P. troglodytes
ccagagagagaaagag

SEQ ID NO: 227472 - DNA, 16 bp, P. troglodytes
ccagagaggggcaggg

SEQ ID NO: 227473 - DNA, 16 bp, P. troglodytes
ccagagatcaggagtt

SEQ ID NO: 227474 - DNA, 16 bp, P. troglodytes
ccagagatctgcagag

SEQ ID NO: 227475 - DNA, 16 bp, P. troglodytes
ccagagatgaagccca

SEQ ID NO: 227476 - DNA, 16 bp, P. troglodytes
ccagagatgatttaaa

SEQ ID NO: 227477 - DNA, 16 bp, P. troglodytes
ccagagatgcaaggat

SEQ ID NO: 227478 - DNA, 16 bp, P. troglodytes
ccagagatgcagggat

SEQ ID NO: 227479 - DNA, 16 bp, P. troglodytes
ccagagattctgctac

SEQ ID NO: 227480 - DNA, 16 bp, P. troglodytes
ccagagcaacttcatc

SEQ ID NO: 227481 - DNA, 16 bp, P. troglodytes
ccagagcaacttccag

SEQ ID NO: 227482 - DNA, 16 bp, P. troglodytes
ccagagcaagaccctg

SEQ ID NO: 227483 - DNA, 16 bp, P. troglodytes
ccagagcaagactcca

SEQ ID NO: 227484 - DNA, 16 bp, P. troglodytes
ccagagcaatcaggca

SEQ ID NO: 227485 - DNA, 16 bp, P. troglodytes
ccagagcagcttccag

SEQ ID NO: 227486 - DNA, 16 bp, P. troglodytes
ccagagcaggaacaag

SEQ ID NO: 227487 - DNA, 16 bp, P. troglodytes
ccagagcagggcagag

SEQ ID NO: 227488 - DNA, 16 bp, P. troglodytes
ccagagcattttgcat

SEQ ID NO: 227489 - DNA, 16 bp, P. troglodytes
ccagagcccagcccag

SEQ ID NO: 227490 - DNA, 16 bp, P. troglodytes
ccagagcctgggaagg

SEQ ID NO: 227491 - DNA, 16 bp, P. troglodytes
ccagagctcactgcag

SEQ ID NO: 227492 - DNA, 16 bp, P. troglodytes
ccagagctctcctgtg

SEQ ID NO: 227493 - DNA, 16 bp, P. troglodytes
ccagagctggagtgca

SEQ ID NO: 227494 - DNA, 16 bp, P. troglodytes
ccagagctgtgaggaa

SEQ ID NO: 227495 - DNA, 16 bp, P. troglodytes
ccagaggaaagaacag

SEQ ID NO: 227496 - DNA, 16 bp, P. troglodytes
ccagaggaaaggaatg

SEQ ID NO: 227497 - DNA, 16 bp, P. troglodytes
ccagaggaagaagcag

SEQ ID NO: 227498 - DNA, 16 bp, P. troglodytes
ccagaggaagagagag

SEQ ID NO: 227499 - DNA, 16 bp, P. troglodytes
ccagaggaagcagaat

SEQ ID NO: 227500 - DNA, 16 bp, P. troglodytes
ccagaggaaggagcag

SEQ ID NO: 227501 - DNA, 16 bp, P. troglodytes
ccagaggcacaaggag

SEQ ID NO: 227502 - DNA, 16 bp, P. troglodytes
ccagaggcagaaacag

SEQ ID NO: 227503 - DNA, 16 bp, P. troglodytes
ccagaggcctgggagg

SEQ ID NO: 227504 - DNA, 16 bp, P. troglodytes
ccagaggctgagaagg

SEQ ID NO: 227505 - DNA, 16 bp, P. troglodytes
ccagaggctgagatgg

SEQ ID NO: 227506 - DNA, 16 bp, P. troglodytes
ccagaggctgagcaga

SEQ ID NO: 227507 - DNA, 16 bp, P. troglodytes
ccagaggctggaaagg

SEQ ID NO: 227508 - DNA, 16 bp, P. troglodytes
ccagaggctgggaaga

SEQ ID NO: 227509 - DNA, 16 bp, P. troglodytes
ccagaggctggggatg

SEQ ID NO: 227510 - DNA, 16 bp, P. troglodytes
ccagaggctgggggag

SEQ ID NO: 227511 - DNA, 16 bp, P. troglodytes
ccagaggcttaggagg

SEQ ID NO: 227512 - DNA, 16 bp, P. troglodytes
ccagaggggcagccac

SEQ ID NO: 227513 - DNA, 16 bp, P. troglodytes
ccagagggggctgagg

SEQ ID NO: 227514 - DNA, 16 bp, P. troglodytes
ccagaggtcacacagc

SEQ ID NO: 227515 - DNA, 16 bp, P. troglodytes
ccagaggtgcaaggag

SEQ ID NO: 227516 - DNA, 16 bp, P. troglodytes
ccagagtacagtggca

SEQ ID NO: 227517 - DNA, 16 bp, P. troglodytes
ccagagtattgggatt

SEQ ID NO: 227518 - DNA, 16 bp, P. troglodytes
ccagagtcaaagccaa

SEQ ID NO: 227519 - DNA, 16 bp, P. troglodytes
ccagagtgcagtggcg

SEQ ID NO: 227520 - DNA, 16 bp, P. troglodytes
ccagagtggctgttta

SEQ ID NO: 227521 - DNA, 16 bp, P. troglodytes
ccagagttttgggtcc

SEQ ID NO: 227522 - DNA, 16 bp, P. troglodytes
ccagatagctgggatt

SEQ ID NO: 227523 - DNA, 16 bp, P. troglodytes
ccagatatggtggtgt

SEQ ID NO: 227524 - DNA, 16 bp, P. troglodytes
ccagatattgtcaaat

SEQ ID NO: 227525 - DNA, 16 bp, P. troglodytes
ccagatcacaccactg

SEQ ID NO: 227526 - DNA, 16 bp, P. troglodytes
ccagatctcatgagaa

SEQ ID NO: 227527 - DNA, 16 bp, P. troglodytes
ccagatcttctgattt

SEQ ID NO: 227528 - DNA, 16 bp, P. troglodytes
ccagatctttgaggaa

SEQ ID NO: 227529 - DNA, 16 bp, P. troglodytes
ccagatcttttttttt

SEQ ID NO: 227530 - DNA, 16 bp, P. troglodytes
ccagatgcagcccctc

SEQ ID NO: 227531 - DNA, 16 bp, P. troglodytes
ccagatgccattaaga

SEQ ID NO: 227532 - DNA, 16 bp, P. troglodytes
ccagatgctggtgcca

SEQ ID NO: 227533 - DNA, 16 bp, P. troglodytes
ccagatggagctgaaa

SEQ ID NO: 227534 - DNA, 16 bp, P. troglodytes
ccagatggataaactg

SEQ ID NO: 227535 - DNA, 16 bp, P. troglodytes
ccagatggcttcacag

SEQ ID NO: 227536 - DNA, 16 bp, P. troglodytes
ccagatggcttcactg

SEQ ID NO: 227537 - DNA, 16 bp, P. troglodytes
ccagatggcttcatgg

SEQ ID NO: 227538 - DNA, 16 bp, P. troglodytes
ccagatggggtggctg

SEQ ID NO: 227539 - DNA, 16 bp, P. troglodytes
ccagattaatcttcct

SEQ ID NO: 227540 - DNA, 16 bp, P. troglodytes
ccagattattttgaag

SEQ ID NO: 227541 - DNA, 16 bp, P. troglodytes
ccagattctttttttt

SEQ ID NO: 227542 - DNA, 16 bp, P. troglodytes
ccagattggaaaggaa

SEQ ID NO: 227543 - DNA, 16 bp, P. troglodytes
ccagcaaacacatgaa

SEQ ID NO: 227544 - DNA, 16 bp, P. troglodytes
ccagcaaactgaatcc

SEQ ID NO: 227545 - DNA, 16 bp, P. troglodytes
ccagcaacatttgttg

SEQ ID NO: 227546 - DNA, 16 bp, P. troglodytes
ccagcaaccccactgc

SEQ ID NO: 227547 - DNA, 16 bp, P. troglodytes
ccagcaactcaggagg

SEQ ID NO: 227548 - DNA, 16 bp, P. troglodytes
ccagcaagagaacaaa

SEQ ID NO: 227549 - DNA, 16 bp, P. troglodytes
ccagcaatccttccac

SEQ ID NO: 227550 - DNA, 16 bp, P. troglodytes
ccagcaatctgtgttt

SEQ ID NO: 227551 - DNA, 16 bp, P. troglodytes
ccagcaatgatagact

SEQ ID NO: 227552 - DNA, 16 bp, P. troglodytes
ccagcaatggggaaag

SEQ ID NO: 227553 - DNA, 16 bp, P. troglodytes
ccagcaatgtataaaa

SEQ ID NO: 227554 - DNA, 16 bp, P. troglodytes
ccagcaatgtataaga

SEQ ID NO: 227555 - DNA, 16 bp, P. troglodytes
ccagcaattccattcc

SEQ ID NO: 227556 - DNA, 16 bp, P. troglodytes
ccagcacacctggccc

SEQ ID NO: 227557 - DNA, 16 bp, P. troglodytes
ccagcacagccctggg

SEQ ID NO: 227558 - DNA, 16 bp, P. troglodytes
ccagcaccagcccaga

SEQ ID NO: 227559 - DNA, 16 bp, P. troglodytes
ccagcaccagcctgaa

SEQ ID NO: 227560 - DNA, 16 bp, P. troglodytes
ccagcaccagggaaag

SEQ ID NO: 227561 - DNA, 16 bp, P. troglodytes
ccagcacccagcacag

SEQ ID NO: 227562 - DNA, 16 bp, P. troglodytes
ccagcacctcagaatg

SEQ ID NO: 227563 - DNA, 16 bp, P. troglodytes
ccagcacctgtagttt

SEQ ID NO: 227564 - DNA, 16 bp, P. troglodytes
ccagcaccttgatctt

SEQ ID NO: 227565 - DNA, 16 bp, P. troglodytes
ccagcaccttgggaag

SEQ ID NO: 227566 - DNA, 16 bp, P. troglodytes
ccagcactcaggaggc

SEQ ID NO: 227567 - DNA, 16 bp, P. troglodytes
ccagcactctggaggc

SEQ ID NO: 227568 - DNA, 16 bp, P. troglodytes
ccagcactgggaggcc

SEQ ID NO: 227569 - DNA, 16 bp, P. troglodytes
ccagcactggggaggc

SEQ ID NO: 227570 - DNA, 16 bp, P. troglodytes
ccagcacttccctgcc

SEQ ID NO: 227571 - DNA, 16 bp, P. troglodytes
ccagcacttcggcagg

SEQ ID NO: 227572 - DNA, 16 bp, P. troglodytes
ccagcacttctgggag

SEQ ID NO: 227573 - DNA, 16 bp, P. troglodytes
ccagcacttgggaggg

SEQ ID NO: 227574 - DNA, 16 bp, P. troglodytes
ccagcacttggggaga

SEQ ID NO: 227575 - DNA, 16 bp, P. troglodytes
ccagcacttggtgagg

SEQ ID NO: 227576 - DNA, 16 bp, P. troglodytes
ccagcactttgaggag

SEQ ID NO: 227577 - DNA, 16 bp, P. troglodytes
ccagcactttgcaaag

SEQ ID NO: 227578 - DNA, 16 bp, P. troglodytes
ccagcactttgcaggg

SEQ ID NO: 227579 - DNA, 16 bp, P. troglodytes
ccagcactttggtagc

SEQ ID NO: 227580 - DNA, 16 bp, P. troglodytes
ccagcactttgtggag

SEQ ID NO: 227581 - DNA, 16 bp, P. troglodytes
ccagcagaagaaagaa

SEQ ID NO: 227582 - DNA, 16 bp, P. troglodytes
ccagcagagctaccag

SEQ ID NO: 227583 - DNA, 16 bp, P. troglodytes
ccagcagagggcagca

SEQ ID NO: 227584 - DNA, 16 bp, P. troglodytes
ccagcagagggcagtg

SEQ ID NO: 227585 - DNA, 16 bp, P. troglodytes
ccagcagatccaatgg

SEQ ID NO: 227586 - DNA, 16 bp, P. troglodytes
ccagcagatgcctgaa

SEQ ID NO: 227587 - DNA, 16 bp, P. troglodytes
ccagcagcacaacaaa

SEQ ID NO: 227588 - DNA, 16 bp, P. troglodytes
ccagcagcacctcaaa

SEQ ID NO: 227589 - DNA, 16 bp, P. troglodytes
ccagcagcactttggg

SEQ ID NO: 227590 - DNA, 16 bp, P. troglodytes
ccagcagcagagacca

SEQ ID NO: 227591 - DNA, 16 bp, P. troglodytes
ccagcagcagcaacct

SEQ ID NO: 227592 - DNA, 16 bp, P. troglodytes
ccagcagcagcagcat

SEQ ID NO: 227593 - DNA, 16 bp, P. troglodytes
ccagcagcagctgcag

SEQ ID NO: 227594 - DNA, 16 bp, P. troglodytes
ccagcagcagctgctg

SEQ ID NO: 227595 - DNA, 16 bp, P. troglodytes
ccagcagcatttgttg

SEQ ID NO: 227596 - DNA, 16 bp, P. troglodytes
ccagcagccaccagaa

SEQ ID NO: 227597 - DNA, 16 bp, P. troglodytes
ccagcagcccctccca

SEQ ID NO: 227598 - DNA, 16 bp, P. troglodytes
ccagcagcccctgcag

SEQ ID NO: 227599 - DNA, 16 bp, P. troglodytes
ccagcagccctcaggg

SEQ ID NO: 227600 - DNA, 16 bp, P. troglodytes
ccagcagctcaggagg

SEQ ID NO: 227601 - DNA, 16 bp, P. troglodytes
ccagcagctcattgag

SEQ ID NO: 227602 - DNA, 16 bp, P. troglodytes
ccagcagctccagcca

SEQ ID NO: 227603 - DNA, 16 bp, P. troglodytes
ccagcagctgcagagg

SEQ ID NO: 227604 - DNA, 16 bp, P. troglodytes
ccagcagctgcagcag

SEQ ID NO: 227605 - DNA, 17 bp, P. troglodytes
ccagcagctgctgtgct

SEQ ID NO: 227606 - DNA, 16 bp, P. troglodytes
ccagcagctgggactg

SEQ ID NO: 227607 - DNA, 16 bp, P. troglodytes
ccagcaggaggctgag

SEQ ID NO: 227608 - DNA, 16 bp, P. troglodytes
ccagcaggcagctgga

SEQ ID NO: 227609 - DNA, 16 bp, P. troglodytes
ccagcagggaaaatgc

SEQ ID NO: 227610 - DNA, 16 bp, P. troglodytes
ccagcagggctggccg

SEQ ID NO: 227611 - DNA, 16 bp, P. troglodytes
ccagcagggggcagca

SEQ ID NO: 227612 - DNA, 16 bp, P. troglodytes
ccagcaggtggaggct

SEQ ID NO: 227613 - DNA, 16 bp, P. troglodytes
ccagcaggtggcagca

SEQ ID NO: 227614 - DNA, 16 bp, P. troglodytes
ccagcagtggaacaaa

SEQ ID NO: 227615 - DNA, 16 bp, P. troglodytes
ccagcagtggcagcag

SEQ ID NO: 227616 - DNA, 16 bp, P. troglodytes
ccagcagtgggatttc

SEQ ID NO: 227617 - DNA, 16 bp, P. troglodytes
ccagcataaatgggtt

SEQ ID NO: 227618 - DNA, 16 bp, P. troglodytes
ccagcatacctggcta

SEQ ID NO: 227619 - DNA, 16 bp, P. troglodytes
ccagcatcatcatgat

SEQ ID NO: 227620 - DNA, 16 bp, P. troglodytes
ccagcatcatttattt

SEQ ID NO: 227621 - DNA, 16 bp, P. troglodytes
ccagcatctgctcctg

SEQ ID NO: 227622 - DNA, 16 bp, P. troglodytes
ccagcatgacacatgt

SEQ ID NO: 227623 - DNA, 17 bp, P. troglodytes
ccagcatgcagctggag

SEQ ID NO: 227624 - DNA, 16 bp, P. troglodytes
ccagcatgcctggcct

SEQ ID NO: 227625 - DNA, 16 bp, P. troglodytes
ccagcatggctaggat

SEQ ID NO: 227626 - DNA, 16 bp, P. troglodytes
ccagcatgggcaacat

SEQ ID NO: 227627 - DNA, 16 bp, P. troglodytes
ccagcatgggccacag

SEQ ID NO: 227628 - DNA, 16 bp, P. troglodytes
ccagcattccctgcag

SEQ ID NO: 227629 - DNA, 16 bp, P. troglodytes
ccagcattccttcctg

SEQ ID NO: 227630 - DNA, 16 bp, P. troglodytes
ccagccaagcccagcc

SEQ ID NO: 227631 - DNA, 16 bp, P. troglodytes
ccagccaaggcaacag

SEQ ID NO: 227632 - DNA, 16 bp, P. troglodytes
ccagccaagggaggcg

SEQ ID NO: 227633 - DNA, 16 bp, P. troglodytes
ccagccacaaaaagac

SEQ ID NO: 227634 - DNA, 16 bp, P. troglodytes
ccagccacactgacct

SEQ ID NO: 227635 - DNA, 16 bp, P. troglodytes
ccagccacagaaagac

SEQ ID NO: 227636 - DNA, 16 bp, P. troglodytes
ccagccacagcctccc

SEQ ID NO: 227637 - DNA, 16 bp, P. troglodytes
ccagccacccaggagg

SEQ ID NO: 227638 - DNA, 16 bp, P. troglodytes
ccagccaccccgtccg

SEQ ID NO: 227639 - DNA, 16 bp, P. troglodytes
ccagccacctcagcct

SEQ ID NO: 227640 - DNA, 16 bp, P. troglodytes
ccagccacgtggaact

SEQ ID NO: 227641 - DNA, 16 bp, P. troglodytes
ccagccagaaatctct

SEQ ID NO: 227642 - DNA, 16 bp, P. troglodytes
ccagccagcagcggca

SEQ ID NO: 227643 - DNA, 16 bp, P. troglodytes
ccagccagcatcatga

SEQ ID NO: 227644 - DNA, 16 bp, P. troglodytes
ccagccagcctgggca

SEQ ID NO: 227645 - DNA, 16 bp, P. troglodytes
ccagccaggccaacag

SEQ ID NO: 227646 - DNA, 16 bp, P. troglodytes
ccagccaggccaacgt

SEQ ID NO: 227647 - DNA, 19 bp, P. troglodytes
ccagccaggcgcagtggct

SEQ ID NO: 227648 - DNA, 16 bp, P. troglodytes
ccagccatcccattgc

SEQ ID NO: 227649 - DNA, 16 bp, P. troglodytes
ccagccatgaggaact

SEQ ID NO: 227650 - DNA, 16 bp, P. troglodytes
ccagccatggtggttc

SEQ ID NO: 227651 - DNA, 16 bp, P. troglodytes
ccagccattcaggagg

SEQ ID NO: 227652 - DNA, 16 bp, P. troglodytes
ccagccatttggaact

SEQ ID NO: 227653 - DNA, 16 bp, P. troglodytes
ccagcccagagagggg

SEQ ID NO: 227654 - DNA, 16 bp, P. troglodytes
ccagcccagagccagg

SEQ ID NO: 227655 - DNA, 16 bp, P. troglodytes
ccagcccagagcccag

SEQ ID NO: 227656 - DNA, 16 bp, P. troglodytes
ccagcccagagctggg

SEQ ID NO: 227657 - DNA, 16 bp, P. troglodytes
ccagcccagcccagct

SEQ ID NO: 227658 - DNA, 16 bp, P. troglodytes
ccagcccagcccagga

SEQ ID NO: 227659 - DNA, 16 bp, P. troglodytes
ccagcccagcccaggc

SEQ ID NO: 227660 - DNA, 16 bp, P. troglodytes
ccagcccagccccagg

SEQ ID NO: 227661 - DNA, 16 bp, P. troglodytes
ccagcccagcccctgc

SEQ ID NO: 227662 - DNA, 16 bp, P. troglodytes
ccagcccagcctgggc

SEQ ID NO: 227663 - DNA, 16 bp, P. troglodytes
ccagcccagctcccca

SEQ ID NO: 227664 - DNA, 16 bp, P. troglodytes
ccagcccaggaagcca

SEQ ID NO: 227665 - DNA, 16 bp, P. troglodytes
ccagcccaggaagggg

SEQ ID NO: 227666 - DNA, 16 bp, P. troglodytes
ccagcccaggagttca

SEQ ID NO: 227667 - DNA, 16 bp, P. troglodytes
ccagcccaggcccagc

SEQ ID NO: 227668 - DNA, 16 bp, P. troglodytes
ccagcccaggcctccc

SEQ ID NO: 227669 - DNA, 16 bp, P. troglodytes
ccagcccaggtgacag

SEQ ID NO: 227670 - DNA, 16 bp, P. troglodytes
ccagcccatgaaagca

SEQ ID NO: 227671 - DNA, 16 bp, P. troglodytes
ccagccccactggcct

SEQ ID NO: 227672 - DNA, 16 bp, P. troglodytes
ccagccccagcccctg

SEQ ID NO: 227673 - DNA, 16 bp, P. troglodytes
ccagccccagcctcag

SEQ ID NO: 227674 - DNA, 16 bp, P. troglodytes
ccagccccagcctggg

SEQ ID NO: 227675 - DNA, 16 bp, P. troglodytes
ccagccccagctctgc

SEQ ID NO: 227676 - DNA, 16 bp, P. troglodytes
ccagccccaggcagtg

SEQ ID NO: 227677 - DNA, 16 bp, P. troglodytes
ccagccccaggcccag

SEQ ID NO: 227678 - DNA, 16 bp, P. troglodytes
ccagccccaggctctg

SEQ ID NO: 227679 - DNA, 16 bp, P. troglodytes
ccagcccccagccctg

SEQ ID NO: 227680 - DNA, 16 bp, P. troglodytes
ccagcccccagccttc

SEQ ID NO: 227681 - DNA, 16 bp, P. troglodytes
ccagcccctccccagg

SEQ ID NO: 227682 - DNA, 16 bp, P. troglodytes
ccagcccctgccaacc

SEQ ID NO: 227683 - DNA, 16 bp, P. troglodytes
ccagcccctgccccag

SEQ ID NO: 227684 - DNA, 16 bp, P. troglodytes
ccagcccctggcaccc

SEQ ID NO: 227685 - DNA, 16 bp, P. troglodytes
ccagcccctggcagcc

SEQ ID NO: 227686 - DNA, 16 bp, P. troglodytes
ccagcccctggccctg

SEQ ID NO: 227687 - DNA, 16 bp, P. troglodytes
ccagccctgcagcccc

SEQ ID NO: 227688 - DNA, 16 bp, P. troglodytes
ccagccctgccagcac

SEQ ID NO: 227689 - DNA, 16 bp, P. troglodytes
ccagccctgcccacag

SEQ ID NO: 227690 - DNA, 16 bp, P. troglodytes
ccagccctgcccagcc

SEQ ID NO: 227691 - DNA, 16 bp, P. troglodytes
ccagccctgccctcag

SEQ ID NO: 227692 - DNA, 16 bp, P. troglodytes
ccagccctgcctccca

SEQ ID NO: 227693 - DNA, 16 bp, P. troglodytes
ccagccctgcctgccc

SEQ ID NO: 227694 - DNA, 16 bp, P. troglodytes
ccagccctgcctgggc

SEQ ID NO: 227695 - DNA, 16 bp, P. troglodytes
ccagccctgctcctcc

SEQ ID NO: 227696 - DNA, 16 bp, P. troglodytes
ccagccctgctggccc

SEQ ID NO: 227697 - DNA, 16 bp, P. troglodytes
ccagccctggccccag

SEQ ID NO: 227698 - DNA, 16 bp, P. troglodytes
ccagccctggccctgg

SEQ ID NO: 227699 - DNA, 16 bp, P. troglodytes
ccagccctggcctccc

SEQ ID NO: 227700 - DNA, 16 bp, P. troglodytes
ccagccctggctctgc

SEQ ID NO: 227701 - DNA, 16 bp, P. troglodytes
ccagccctgggcagtg

SEQ ID NO: 227702 - DNA, 16 bp, P. troglodytes
ccagccctgggccctg

SEQ ID NO: 227703 - DNA, 16 bp, P. troglodytes
ccagccctggtgacag

SEQ ID NO: 227704 - DNA, 16 bp, P. troglodytes
ccagcccttccttccc

SEQ ID NO: 227705 - DNA, 18 bp, P. troglodytes
ccagccggcttcacctct

SEQ ID NO: 227706 - DNA, 16 bp, P. troglodytes
ccagccggtccctccg

SEQ ID NO: 227707 - DNA, 16 bp, P. troglodytes
ccagccgtggtggtgg

SEQ ID NO: 227708 - DNA, 16 bp, P. troglodytes
ccagcctcaagtattt

SEQ ID NO: 227709 - DNA, 16 bp, P. troglodytes
ccagcctcagccccag

SEQ ID NO: 227710 - DNA, 16 bp, P. troglodytes
ccagcctcagcctcct

SEQ ID NO: 227711 - DNA, 16 bp, P. troglodytes
ccagcctcagcctgcc

SEQ ID NO: 227712 - DNA, 16 bp, P. troglodytes
ccagcctcagcttcct

SEQ ID NO: 227713 - DNA, 16 bp, P. troglodytes
ccagcctcagtctccc

SEQ ID NO: 227714 - DNA, 16 bp, P. troglodytes
ccagcctccagaaccg

SEQ ID NO: 227715 - DNA, 16 bp, P. troglodytes
ccagcctccagaactg

SEQ ID NO: 227716 - DNA, 16 bp, P. troglodytes
ccagcctccagatctg

SEQ ID NO: 227717 - DNA, 16 bp, P. troglodytes
ccagcctcccaagaag

SEQ ID NO: 227718 - DNA, 18 bp, P. troglodytes
ccagcctcccgagtagct

SEQ ID NO: 227719 - DNA, 16 bp, P. troglodytes
ccagcctcctccctgc

SEQ ID NO: 227720 - DNA, 16 bp, P. troglodytes
ccagcctcctcctcct

SEQ ID NO: 227721 - DNA, 16 bp, P. troglodytes
ccagcctcctctccct

SEQ ID NO: 227722 - DNA, 16 bp, P. troglodytes
ccagcctcctgcctca

SEQ ID NO: 227723 - DNA, 16 bp, P. troglodytes
ccagcctcctgctgcc

SEQ ID NO: 227724 - DNA, 16 bp, P. troglodytes
ccagcctcggcaacac

SEQ ID NO: 227725 - DNA, 16 bp, P. troglodytes
ccagcctcggcctccc

SEQ ID NO: 227726 - DNA, 16 bp, P. troglodytes
ccagcctcggccttcc

SEQ ID NO: 227727 - DNA, 16 bp, P. troglodytes
ccagcctcggtctccc

SEQ ID NO: 227728 - DNA, 16 bp, P. troglodytes
ccagcctctagaacag

SEQ ID NO: 227729 - DNA, 16 bp, P. troglodytes
ccagcctctccctgga

SEQ ID NO: 227730 - DNA, 16 bp, P. troglodytes
ccagcctctctgagcc

SEQ ID NO: 227731 - DNA, 18 bp, P. troglodytes
ccagcctctctttgcttt

SEQ ID NO: 227732 - DNA, 16 bp, P. troglodytes
ccagcctctttttctt

SEQ ID NO: 227733 - DNA, 16 bp, P. troglodytes
ccagcctgacaaatat

SEQ ID NO: 227734 - DNA, 16 bp, P. troglodytes
ccagcctgagcaatgg

SEQ ID NO: 227735 - DNA, 16 bp, P. troglodytes
ccagcctgagctacaa

SEQ ID NO: 227736 - DNA, 16 bp, P. troglodytes
ccagcctgaggaacat

SEQ ID NO: 227737 - DNA, 16 bp, P. troglodytes
ccagcctgagtcacag

SEQ ID NO: 227738 - DNA, 16 bp, P. troglodytes
ccagcctgattttttt

SEQ ID NO: 227739 - DNA, 16 bp, P. troglodytes
ccagcctgccagcctg

SEQ ID NO: 227740 - DNA, 16 bp, P. troglodytes
ccagcctgcccagcat

SEQ ID NO: 227741 - DNA, 16 bp, P. troglodytes
ccagcctgccctgcct

SEQ ID NO: 227742 - DNA, 16 bp, P. troglodytes
ccagcctgcccttcct

SEQ ID NO: 227743 - DNA, 16 bp, P. troglodytes
ccagcctgcgcaacat

SEQ ID NO: 227744 - DNA, 16 bp, P. troglodytes
ccagcctgctccaccc

SEQ ID NO: 227745 - DNA, 16 bp, P. troglodytes
ccagcctgctgacaga

SEQ ID NO: 227746 - DNA, 16 bp, P. troglodytes
ccagcctggacaactt

SEQ ID NO: 227747 - DNA, 16 bp, P. troglodytes
ccagcctggagacaaa

SEQ ID NO: 227748 - DNA, 16 bp, P. troglodytes
ccagcctggagagcag

SEQ ID NO: 227749 - DNA, 16 bp, P. troglodytes
ccagcctggagccagg

SEQ ID NO: 227750 - DNA, 16 bp, P. troglodytes
ccagcctggaggacag

SEQ ID NO: 227751 - DNA, 16 bp, P. troglodytes
ccagcctggcaaaaga

SEQ ID NO: 227752 - DNA, 16 bp, P. troglodytes
ccagcctggccaatgc

SEQ ID NO: 227753 - DNA, 16 bp, P. troglodytes
ccagcctggccaatgg

SEQ ID NO: 227754 - DNA, 16 bp, P. troglodytes
ccagcctggccacaca

SEQ ID NO: 227755 - DNA, 16 bp, P. troglodytes
ccagcctggccagcag

SEQ ID NO: 227756 - DNA, 16 bp, P. troglodytes
ccagcctggccagcct

SEQ ID NO: 227757 - DNA, 16 bp, P. troglodytes
ccagcctggccccagc

SEQ ID NO: 227758 - DNA, 16 bp, P. troglodytes
ccagcctggcccctgc

SEQ ID NO: 227759 - DNA, 16 bp, P. troglodytes
ccagcctggccctgcc

SEQ ID NO: 227760 - DNA, 16 bp, P. troglodytes
ccagcctggccctggg

SEQ ID NO: 227761 - DNA, 16 bp, P. troglodytes
ccagcctggctgacag

SEQ ID NO: 227762 - DNA, 16 bp, P. troglodytes
ccagcctggctgagag

SEQ ID NO: 227763 - DNA, 16 bp, P. troglodytes
ccagcctggctggcag

SEQ ID NO: 227764 - DNA, 16 bp, P. troglodytes
ccagcctgggagcctg

SEQ ID NO: 227765 - DNA, 16 bp, P. troglodytes
ccagcctgggagtcag

SEQ ID NO: 227766 - DNA, 16 bp, P. troglodytes
ccagcctgggcaaaca

SEQ ID NO: 227767 - DNA, 16 bp, P. troglodytes
ccagcctgggcaatac

SEQ ID NO: 227768 - DNA, 16 bp, P. troglodytes
ccagcctgggcagcaa

SEQ ID NO: 227769 - DNA, 16 bp, P. troglodytes
ccagcctgggcagcct

SEQ ID NO: 227770 - DNA, 16 bp, P. troglodytes
ccagcctgggcagctg

SEQ ID NO: 227771 - DNA, 16 bp, P. troglodytes
ccagcctgggcatcag

SEQ ID NO: 227772 - DNA, 16 bp, P. troglodytes
ccagcctgggccacat

SEQ ID NO: 227773 - DNA, 16 bp, P. troglodytes
ccagcctgggcctccc

SEQ ID NO: 227774 - DNA, 16 bp, P. troglodytes
ccagcctgggcctggg

SEQ ID NO: 227775 - DNA, 18 bp, P. troglodytes
ccagcctgggcgacacag

SEQ ID NO: 227776 - DNA, 16 bp, P. troglodytes
ccagcctgggcgacag

SEQ ID NO: 227777 - DNA, 16 bp, P. troglodytes
ccagcctgggctgcag

SEQ ID NO: 227778 - DNA, 16 bp, P. troglodytes
ccagcctgggctggac

SEQ ID NO: 227779 - DNA, 16 bp, P. troglodytes
ccagcctgggctggag

SEQ ID NO: 227780 - DNA, 16 bp, P. troglodytes
ccagcctggggacaaa

SEQ ID NO: 227781 - DNA, 16 bp, P. troglodytes
ccagcctggggacaag

SEQ ID NO: 227782 - DNA, 16 bp, P. troglodytes
ccagcctggggagcag

SEQ ID NO: 227783 - DNA, 16 bp, P. troglodytes
ccagcctggggcacag

SEQ ID NO: 227784 - DNA, 16 bp, P. troglodytes
ccagcctggggcctgg

SEQ ID NO: 227785 - DNA, 16 bp, P. troglodytes
ccagcctggggtgggg

SEQ ID NO: 227786 - DNA, 16 bp, P. troglodytes
ccagcctgggtgaaca

SEQ ID NO: 227787 - DNA, 16 bp, P. troglodytes
ccagcctgggtgaagg

SEQ ID NO: 227788 - DNA, 16 bp, P. troglodytes
ccagcctgggtgacat

SEQ ID NO: 227789 - DNA, 16 bp, P. troglodytes
ccagcctggtggcaga

SEQ ID NO: 227790 - DNA, 16 bp, P. troglodytes
ccagcctgtggcttgt

SEQ ID NO: 227791 - DNA, 16 bp, P. troglodytes
ccagccttcagaactg

SEQ ID NO: 227792 - DNA, 16 bp, P. troglodytes
ccagccttgccaacat

SEQ ID NO: 227793 - DNA, 16 bp, P. troglodytes
ccagccttgcctccca

SEQ ID NO: 227794 - DNA, 16 bp, P. troglodytes
ccagccttgtgacaga

SEQ ID NO: 227795 - DNA, 16 bp, P. troglodytes
ccagcctttctttctt

SEQ ID NO: 227796 - DNA, 16 bp, P. troglodytes
ccagcgagatcaatgc

SEQ ID NO: 227797 - DNA, 16 bp, P. troglodytes
ccagcgctggagtgca

SEQ ID NO: 227798 - DNA, 16 bp, P. troglodytes
ccagcgctttgggaag

SEQ ID NO: 227799 - DNA, 16 bp, P. troglodytes
ccagcggcagctcacg

SEQ ID NO: 227800 - DNA, 16 bp, P. troglodytes
ccagcgtctgttattt

SEQ ID NO: 227801 - DNA, 25 bp, P. troglodytes
ccagcgttcagcatatggaggatcc

SEQ ID NO: 227802 - DNA, 16 bp, P. troglodytes
ccagctaatatttaaa

SEQ ID NO: 227803 - DNA, 17 bp, P. troglodytes
ccagctaatttttaaat

SEQ ID NO: 227804 - DNA, 16 bp, P. troglodytes
ccagctacactggcct

SEQ ID NO: 227805 - DNA, 16 bp, P. troglodytes
ccagctacctgggagg

SEQ ID NO: 227806 - DNA, 16 bp, P. troglodytes
ccagctacctgggcat

SEQ ID NO: 227807 - DNA, 16 bp, P. troglodytes
ccagctactcagcagg

SEQ ID NO: 227808 - DNA, 16 bp, P. troglodytes
ccagctactccggaag

SEQ ID NO: 227809 - DNA, 16 bp, P. troglodytes
ccagctactctgaggc

SEQ ID NO: 227810 - DNA, 16 bp, P. troglodytes
ccagctactggggacg

SEQ ID NO: 227811 - DNA, 16 bp, P. troglodytes
ccagctacttgagaag

SEQ ID NO: 227812 - DNA, 16 bp, P. troglodytes
ccagctacttgcaagg

SEQ ID NO: 227813 - DNA, 16 bp, P. troglodytes
ccagctatgaccacat

SEQ ID NO: 227814 - DNA, 16 bp, P. troglodytes
ccagctatttgggggg

SEQ ID NO: 227815 - DNA, 16 bp, P. troglodytes
ccagctcagctcagcc

SEQ ID NO: 227816 - DNA, 16 bp, P. troglodytes
ccagctcagctgcagt

SEQ ID NO: 227817 - DNA, 16 bp, P. troglodytes
ccagctcatttttgta

SEQ ID NO: 227818 - DNA, 16 bp, P. troglodytes
ccagctccaccacttc

SEQ ID NO: 227819 - DNA, 16 bp, P. troglodytes
ccagctccagccccag

SEQ ID NO: 227820 - DNA, 16 bp, P. troglodytes
ccagctccagcctcag

SEQ ID NO: 227821 - DNA, 16 bp, P. troglodytes
ccagctccagcctggg

SEQ ID NO: 227822 - DNA, 16 bp, P. troglodytes
ccagctccatccaagt

SEQ ID NO: 227823 - DNA, 16 bp, P. troglodytes
ccagctccatccatgg

SEQ ID NO: 227824 - DNA, 16 bp, P. troglodytes
ccagctccccagctcc

SEQ ID NO: 227825 - DNA, 16 bp, P. troglodytes
ccagctccctcagcct

SEQ ID NO: 227826 - DNA, 16 bp, P. troglodytes
ccagctccctccagcc

SEQ ID NO: 227827 - DNA, 16 bp, P. troglodytes
ccagctccctgcctcc

SEQ ID NO: 227828 - DNA, 16 bp, P. troglodytes
ccagctcccttgcccc

SEQ ID NO: 227829 - DNA, 16 bp, P. troglodytes
ccagctccgcctcctg

SEQ ID NO: 227830 - DNA, 16 bp, P. troglodytes
ccagctcctcaggagg

SEQ ID NO: 227831 - DNA, 16 bp, P. troglodytes
ccagctcctcctccca

SEQ ID NO: 227832 - DNA, 16 bp, P. troglodytes
ccagctcctgagttca

SEQ ID NO: 227833 - DNA, 16 bp, P. troglodytes
ccagctcctggtggct

SEQ ID NO: 227834 - DNA, 16 bp, P. troglodytes
ccagctccttcagctg

SEQ ID NO: 227835 - DNA, 16 bp, P. troglodytes
ccagctccttgggagg

SEQ ID NO: 227836 - DNA, 16 bp, P. troglodytes
ccagctctcttcctgc

SEQ ID NO: 227837 - DNA, 16 bp, P. troglodytes
ccagctctgccacttg

SEQ ID NO: 227838 - DNA, 16 bp, P. troglodytes
ccagctctgggggcag

SEQ ID NO: 227839 - DNA, 16 bp, P. troglodytes
ccagctcttctttgca

SEQ ID NO: 227840 - DNA, 16 bp, P. troglodytes
ccagctctttctcttt

SEQ ID NO: 227841 - DNA, 16 bp, P. troglodytes
ccagctctttgggaag

SEQ ID NO: 227842 - DNA, 16 bp, P. troglodytes
ccagctcttttttttt

SEQ ID NO: 227843 - DNA, 16 bp, P. troglodytes
ccagctgacagccagc

SEQ ID NO: 227844 - DNA, 16 bp, P. troglodytes
ccagctgacatcttga

SEQ ID NO: 227845 - DNA, 16 bp, P. troglodytes
ccagctgcaaaagaaa

SEQ ID NO: 227846 - DNA, 16 bp, P. troglodytes
ccagctgcagagagga

SEQ ID NO: 227847 - DNA, 16 bp, P. troglodytes
ccagctgcagcctcac

SEQ ID NO: 227848 - DNA, 16 bp, P. troglodytes
ccagctgccatgctgt

SEQ ID NO: 227849 - DNA, 16 bp, P. troglodytes
ccagctgccccgtctg

SEQ ID NO: 227850 - DNA, 16 bp, P. troglodytes
ccagctgcctgggagg

SEQ ID NO: 227851 - DNA, 16 bp, P. troglodytes
ccagctgctcagaggc

SEQ ID NO: 227852 - DNA, 16 bp, P. troglodytes
ccagctgctcaggaag

SEQ ID NO: 227853 - DNA, 16 bp, P. troglodytes
ccagctgctccggagg

SEQ ID NO: 227854 - DNA, 16 bp, P. troglodytes
ccagctgctcgggagg

SEQ ID NO: 227855 - DNA, 16 bp, P. troglodytes
ccagctgcttgggatg

SEQ ID NO: 227856 - DNA, 16 bp, P. troglodytes
ccagctggagctctcc

SEQ ID NO: 227857 - DNA, 16 bp, P. troglodytes
ccagctggagttctgg

SEQ ID NO: 227858 - DNA, 16 bp, P. troglodytes
ccagctgggcgcagtg

SEQ ID NO: 227859 - DNA, 16 bp, P. troglodytes
ccagctgggctcagtg

SEQ ID NO: 227860 - DNA, 16 bp, P. troglodytes
ccagctggtccctcca

SEQ ID NO: 227861 - DNA, 16 bp, P. troglodytes
ccagctgtggtggtgg

SEQ ID NO: 227862 - DNA, 16 bp, P. troglodytes
ccagctgtgtgccagg

SEQ ID NO: 227863 - DNA, 16 bp, P. troglodytes
ccagctgtgtggcctg

SEQ ID NO: 227864 - DNA, 16 bp, P. troglodytes
ccagctgtgtggcctt

SEQ ID NO: 227865 - DNA, 16 bp, P. troglodytes
ccagctgtgtggcttt

SEQ ID NO: 227866 - DNA, 16 bp, P. troglodytes
ccagcttagagaagaa

SEQ ID NO: 227867 - DNA, 16 bp, P. troglodytes
ccagcttattttttgt

SEQ ID NO: 227868 - DNA, 16 bp, P. troglodytes
ccagcttcaataatta

SEQ ID NO: 227869 - DNA, 16 bp, P. troglodytes
ccagcttcagcctccc

SEQ ID NO: 227870 - DNA, 16 bp, P. troglodytes
ccagcttcaggtattt

SEQ ID NO: 227871 - DNA, 16 bp, P. troglodytes
ccagcttcattctttt

SEQ ID NO: 227872 - DNA, 16 bp, P. troglodytes
ccagcttccagaggcc

SEQ ID NO: 227873 - DNA, 16 bp, P. troglodytes
ccagcttccatctccc

SEQ ID NO: 227874 - DNA, 16 bp, P. troglodytes
ccagcttctctggagg

SEQ ID NO: 227875 - DNA, 16 bp, P. troglodytes
ccagcttctggggagg

SEQ ID NO: 227876 - DNA, 16 bp, P. troglodytes
ccagcttctggtgact

SEQ ID NO: 227877 - DNA, 16 bp, P. troglodytes
ccagcttctggtggct

SEQ ID NO: 227878 - DNA, 16 bp, P. troglodytes
ccagcttgcccttgaa

SEQ ID NO: 227879 - DNA, 16 bp, P. troglodytes
ccagcttggagaacag

SEQ ID NO: 227880 - DNA, 16 bp, P. troglodytes
ccagcttggccaagat

SEQ ID NO: 227881 - DNA, 16 bp, P. troglodytes
ccagcttggcccacat

SEQ ID NO: 227882 - DNA, 16 bp, P. troglodytes
ccagcttggttctttt

SEQ ID NO: 227883 - DNA, 16 bp, P. troglodytes
ccagcttttgcctgtt

SEQ ID NO: 227884 - DNA, 16 bp, P. troglodytes
ccaggaaaaacaaaat

SEQ ID NO: 227885 - DNA, 16 bp, P. troglodytes
ccaggaaaacattttt

SEQ ID NO: 227886 - DNA, 16 bp, P. troglodytes
ccaggaaaagctgcag

SEQ ID NO: 227887 - DNA, 16 bp, P. troglodytes
ccaggaaaccatgctt

SEQ ID NO: 227888 - DNA, 16 bp, P. troglodytes
ccaggaaagaattcag

SEQ ID NO: 227889 - DNA, 16 bp, P. troglodytes
ccaggaaaggggcagg

SEQ ID NO: 227890 - DNA, 16 bp, P. troglodytes
ccaggaaatcaaggct

SEQ ID NO: 227891 - DNA, 16 bp, P. troglodytes
ccaggaactgaatcag

SEQ ID NO: 227892 - DNA, 16 bp, P. troglodytes
ccaggaagaaagtgaa

SEQ ID NO: 227893 - DNA, 16 bp, P. troglodytes
ccaggaagaaatccaa

SEQ ID NO: 227894 - DNA, 16 bp, P. troglodytes
ccaggaagaaggtgaa

SEQ ID NO: 227895 - DNA, 16 bp, P. troglodytes
ccaggaagaagttgac

SEQ ID NO: 227896 - DNA, 16 bp, P. troglodytes
ccaggaagaatgaggt

SEQ ID NO: 227897 - DNA, 16 bp, P. troglodytes
ccaggaagagagctct

SEQ ID NO: 227898 - DNA, 16 bp, P. troglodytes
ccaggaagagagtcct

SEQ ID NO: 227899 - DNA, 16 bp, P. troglodytes
ccaggaagaggttgaa

SEQ ID NO: 227900 - DNA, 16 bp, P. troglodytes
ccaggaagatgttgaa

SEQ ID NO: 227901 - DNA, 16 bp, P. troglodytes
ccaggaagcagaggct

SEQ ID NO: 227902 - DNA, 16 bp, P. troglodytes
ccaggaagccagccct

SEQ ID NO: 227903 - DNA, 16 bp, P. troglodytes
ccaggaagccttccct

SEQ ID NO: 227904 - DNA, 16 bp, P. troglodytes
ccaggaagctgggatt

SEQ ID NO: 227905 - DNA, 16 bp, P. troglodytes
ccaggaagctttccct

SEQ ID NO: 227906 - DNA, 16 bp, P. troglodytes
ccaggaaggagtgcag

SEQ ID NO: 227907 - DNA, 16 bp, P. troglodytes
ccaggaaggcagtggg

SEQ ID NO: 227908 - DNA, 16 bp, P. troglodytes
ccaggaagtccaggct

SEQ ID NO: 227909 - DNA, 16 bp, P. troglodytes
ccaggaagtggagctt

SEQ ID NO: 227910 - DNA, 16 bp, P. troglodytes
ccaggaataaatccca

SEQ ID NO: 227911 - DNA, 16 bp, P. troglodytes
ccaggaatctacattt

SEQ ID NO: 227912 - DNA, 16 bp, P. troglodytes
ccaggaatgcattcct

SEQ ID NO: 227913 - DNA, 16 bp, P. troglodytes
ccaggaatggtggcat

SEQ ID NO: 227914 - DNA, 16 bp, P. troglodytes
ccaggaattccaggct

SEQ ID NO: 227915 - DNA, 16 bp, P. troglodytes
ccaggaatttgggacc

SEQ ID NO: 227916 - DNA, 23 bp, P. troglodytes
ccaggaccagatggattcacagc

SEQ ID NO: 227917 - DNA, 16 bp, P. troglodytes
ccaggacccaggaggc

SEQ ID NO: 227918 - DNA, 16 bp, P. troglodytes
ccaggacctgatggct

SEQ ID NO: 227919 - DNA, 16 bp, P. troglodytes
ccaggaccttgggagg

SEQ ID NO: 227920 - DNA, 16 bp, P. troglodytes
ccaggactggagtgca

SEQ ID NO: 227921 - DNA, 16 bp, P. troglodytes
ccaggagaaactgcag

SEQ ID NO: 227922 - DNA, 16 bp, P. troglodytes
ccaggagaaagtggca

SEQ ID NO: 227923 - DNA, 16 bp, P. troglodytes
ccaggagaaggagcag

SEQ ID NO: 227924 - DNA, 16 bp, P. troglodytes
ccaggagacaagcaaa

SEQ ID NO: 227925 - DNA, 16 bp, P. troglodytes
ccaggagacagaggct

SEQ ID NO: 227926 - DNA, 16 bp, P. troglodytes
ccaggagacggagttt

SEQ ID NO: 227927 - DNA, 16 bp, P. troglodytes
ccaggagagaatggga

SEQ ID NO: 227928 - DNA, 16 bp, P. troglodytes
ccaggagatcaaggct

SEQ ID NO: 227929 - DNA, 16 bp, P. troglodytes
ccaggagcaatggctc

SEQ ID NO: 227930 - DNA, 16 bp, P. troglodytes
ccaggagcagcagcag

SEQ ID NO: 227931 - DNA, 16 bp, P. troglodytes
ccaggagcagggagag

SEQ ID NO: 227932 - DNA, 16 bp, P. troglodytes
ccaggagcagtggttc

SEQ ID NO: 227933 - DNA, 16 bp, P. troglodytes
ccaggagcccagctgg

SEQ ID NO: 227934 - DNA, 16 bp, P. troglodytes
ccaggagccccaggtt

SEQ ID NO: 227935 - DNA, 16 bp, P. troglodytes
ccaggagcccccagcc

SEQ ID NO: 227936 - DNA, 16 bp, P. troglodytes
ccaggagctcaagact

SEQ ID NO: 227937 - DNA, 16 bp, P. troglodytes
ccaggagctcaagatc

SEQ ID NO: 227938 - DNA, 16 bp, P. troglodytes
ccaggagctccaatgt

SEQ ID NO: 227939 - DNA, 16 bp, P. troglodytes
ccaggagctcgaggct

SEQ ID NO: 227940 - DNA, 16 bp, P. troglodytes
ccaggagctggaggag

SEQ ID NO: 227941 - DNA, 16 bp, P. troglodytes
ccaggagctggaggct

SEQ ID NO: 227942 - DNA, 16 bp, P. troglodytes
ccaggagctgggagag

SEQ ID NO: 227943 - DNA, 16 bp, P. troglodytes
ccaggagctggggaag

SEQ ID NO: 227944 - DNA, 16 bp, P. troglodytes
ccaggaggaagaggct

SEQ ID NO: 227945 - DNA, 16 bp, P. troglodytes
ccaggaggcagaaatt

SEQ ID NO: 227946 - DNA, 16 bp, P. troglodytes
ccaggaggcagagggt

SEQ ID NO: 227947 - DNA, 16 bp, P. troglodytes
ccaggaggccagggct

SEQ ID NO: 227948 - DNA, 16 bp, P. troglodytes
ccaggaggcctgcctg

SEQ ID NO: 227949 - DNA, 16 bp, P. troglodytes
ccaggaggcggaggag

SEQ ID NO: 227950 - DNA, 16 bp, P. troglodytes
ccaggagggagggcag

SEQ ID NO: 227951 - DNA, 16 bp, P. troglodytes
ccaggagggcagaggt

SEQ ID NO: 227952 - DNA, 16 bp, P. troglodytes
ccaggaggggagctgt

SEQ ID NO: 227953 - DNA, 16 bp, P. troglodytes
ccaggaggtcaaggat

SEQ ID NO: 227954 - DNA, 16 bp, P. troglodytes
ccaggaggtgaagatt

SEQ ID NO: 227955 - DNA, 16 bp, P. troglodytes
ccaggaggtgaagctt

SEQ ID NO: 227956 - DNA, 16 bp, P. troglodytes
ccaggagtcccagacc

SEQ ID NO: 227957 - DNA, 16 bp, P. troglodytes
ccaggagtcggaggct

SEQ ID NO: 227958 - DNA, 16 bp, P. troglodytes
ccaggagtgggaggct

SEQ ID NO: 227959 - DNA, 16 bp, P. troglodytes
ccaggagttcaaaacc

SEQ ID NO: 227960 - DNA, 16 bp, P. troglodytes
ccaggagttcaaatcc

SEQ ID NO: 227961 - DNA, 16 bp, P. troglodytes
ccaggagttcaagggc

SEQ ID NO: 227962 - DNA, 16 bp, P. troglodytes
ccaggagttccaggat

SEQ ID NO: 227963 - DNA, 18 bp, P. troglodytes
ccaggagttcgagaccaa

SEQ ID NO: 227964 - DNA, 16 bp, P. troglodytes
ccaggagttctgggct

SEQ ID NO: 227965 - DNA, 16 bp, P. troglodytes
ccaggagttggagatt

SEQ ID NO: 227966 - DNA, 20 bp, P. troglodytes
ccaggagtttgagaccagca

SEQ ID NO: 227967 - DNA, 16 bp, P. troglodytes
ccaggagtttgaggtg

SEQ ID NO: 227968 - DNA, 16 bp, P. troglodytes
ccaggagtttgaggtt

SEQ ID NO: 227969 - DNA, 16 bp, P. troglodytes
ccaggagtttgggatc

SEQ ID NO: 227970 - DNA, 16 bp, P. troglodytes
ccaggataatctccct

SEQ ID NO: 227971 - DNA, 16 bp, P. troglodytes
ccaggatgctcttgat

SEQ ID NO: 227972 - DNA, 16 bp, P. troglodytes
ccaggatggactgcag

SEQ ID NO: 227973 - DNA, 16 bp, P. troglodytes
ccaggatggagggtct

SEQ ID NO: 227974 - DNA, 16 bp, P. troglodytes
ccaggatgggctccat

SEQ ID NO: 227975 - DNA, 16 bp, P. troglodytes
ccaggatggggtgcag

SEQ ID NO: 227976 - DNA, 16 bp, P. troglodytes
ccaggatggtcccaat

SEQ ID NO: 227977 - DNA, 20 bp, P. troglodytes
ccaggatggtctcgatctca

SEQ ID NO: 227978 - DNA, 26 bp, P. troglodytes
ccaggatggtctcgatctcctgacct

SEQ ID NO: 227979 - DNA, 24 bp, P. troglodytes
ccaggatggtctcgatctcctgat

SEQ ID NO: 227980 - DNA, 16 bp, P. troglodytes
ccaggatggtcttgaa

SEQ ID NO: 227981 - DNA, 16 bp, P. troglodytes
ccaggatggtttcaat

SEQ ID NO: 227982 - DNA, 16 bp, P. troglodytes
ccaggatgtcaaggct

SEQ ID NO: 227983 - DNA, 16 bp, P. troglodytes
ccaggattcagaaagc

SEQ ID NO: 227984 - DNA, 16 bp, P. troglodytes
ccaggattgcaacccc

SEQ ID NO: 227985 - DNA, 16 bp, P. troglodytes
ccaggatttgaaccca

SEQ ID NO: 227986 - DNA, 16 bp, P. troglodytes
ccaggatttgaatcca

SEQ ID NO: 227987 - DNA, 16 bp, P. troglodytes
ccaggatttttttttt

SEQ ID NO: 227988 - DNA, 16 bp, P. troglodytes
ccaggcaaccactgat

SEQ ID NO: 227989 - DNA, 16 bp, P. troglodytes
ccaggcaagagaaaga

SEQ ID NO: 227990 - DNA, 16 bp, P. troglodytes
ccaggcaaggtggcgg

SEQ ID NO: 227991 - DNA, 16 bp, P. troglodytes
ccaggcacagaaagat

SEQ ID NO: 227992 - DNA, 16 bp, P. troglodytes
ccaggcacagctgcag

SEQ ID NO: 227993 - DNA, 16 bp, P. troglodytes
ccaggcacaggggctc

SEQ ID NO: 227994 - DNA, 16 bp, P. troglodytes
ccaggcacagtgctgg

SEQ ID NO: 227995 - DNA, 16 bp, P. troglodytes
ccaggcacagtggcac

SEQ ID NO: 227996 - DNA, 16 bp, P. troglodytes
ccaggcacagtggcag

SEQ ID NO: 227997 - DNA, 16 bp, P. troglodytes
ccaggcacagtggctt

SEQ ID NO: 227998 - DNA, 16 bp, P. troglodytes
ccaggcaccagcacag

SEQ ID NO: 227999 - DNA, 16 bp, P. troglodytes
ccaggcactggagata

SEQ ID NO: 228000 - DNA, 16 bp, P. troglodytes
ccaggcactgggctaa

SEQ ID NO: 228001 - DNA, 16 bp, P. troglodytes
ccaggcactgtactaa

SEQ ID NO: 228002 - DNA, 16 bp, P. troglodytes
ccaggcactgtcctgg

SEQ ID NO: 228003 - DNA, 16 bp, P. troglodytes
ccaggcactgtgctaa

SEQ ID NO: 228004 - DNA, 16 bp, P. troglodytes
ccaggcactgtgctga

SEQ ID NO: 228005 - DNA, 16 bp, P. troglodytes
ccaggcactgttctag

SEQ ID NO: 228006 - DNA, 16 bp, P. troglodytes
ccaggcactgttttag

SEQ ID NO: 228007 - DNA, 16 bp, P. troglodytes
ccaggcagaagaaaca

SEQ ID NO: 228008 - DNA, 16 bp, P. troglodytes
ccaggcagaggaggca

SEQ ID NO: 228009 - DNA, 16 bp, P. troglodytes
ccaggcagaggggcag

SEQ ID NO: 228010 - DNA, 16 bp, P. troglodytes
ccaggcagaggggctc

SEQ ID NO: 228011 - DNA, 16 bp, P. troglodytes
ccaggcagcagcagca

SEQ ID NO: 228012 - DNA, 16 bp, P. troglodytes
ccaggcagcctggctc

SEQ ID NO: 228013 - DNA, 16 bp, P. troglodytes
ccaggcagctgctgcc

SEQ ID NO: 228014 - DNA, 16 bp, P. troglodytes
ccaggcaggaagaagg

SEQ ID NO: 228015 - DNA, 16 bp, P. troglodytes
ccaggcagggctgggg

SEQ ID NO: 228016 - DNA, 16 bp, P. troglodytes
ccaggcagggtggctg

SEQ ID NO: 228017 - DNA, 16 bp, P. troglodytes
ccaggcagtacttgct

SEQ ID NO: 228018 - DNA, 16 bp, P. troglodytes
ccaggcagtggtcact

SEQ ID NO: 228019 - DNA, 16 bp, P. troglodytes
ccaggcagtggtgtga

SEQ ID NO: 228020 - DNA, 16 bp, P. troglodytes
ccaggcatggtggcac

SEQ ID NO: 228021 - DNA, 16 bp, P. troglodytes
ccaggcatggtggctt

SEQ ID NO: 228022 - DNA, 16 bp, P. troglodytes
ccaggcatggtggggg

SEQ ID NO: 228023 - DNA, 16 bp, P. troglodytes
ccaggcattgtgctag

SEQ ID NO: 228024 - DNA, 16 bp, P. troglodytes
ccaggcattgtggcat

SEQ ID NO: 228025 - DNA, 16 bp, P. troglodytes
ccaggcattgttccag

SEQ ID NO: 228026 - DNA, 16 bp, P. troglodytes
ccaggcattgttctaa

SEQ ID NO: 228027 - DNA, 16 bp, P. troglodytes
ccaggccaagtgggtg

SEQ ID NO: 228028 - DNA, 16 bp, P. troglodytes
ccaggccacacagcag

SEQ ID NO: 228029 - DNA, 16 bp, P. troglodytes
ccaggccacaccccag

SEQ ID NO: 228030 - DNA, 16 bp, P. troglodytes
ccaggccacagaccag

SEQ ID NO: 228031 - DNA, 16 bp, P. troglodytes
ccaggccagcccagga

SEQ ID NO: 228032 - DNA, 16 bp, P. troglodytes
ccaggccagcctggcc

SEQ ID NO: 228033 - DNA, 16 bp, P. troglodytes
ccaggccaggcccagg

SEQ ID NO: 228034 - DNA, 16 bp, P. troglodytes
ccaggccagggccagg

SEQ ID NO: 228035 - DNA, 16 bp, P. troglodytes
ccaggccagggctggg

SEQ ID NO: 228036 - DNA, 16 bp, P. troglodytes
ccaggccatgctgatg

SEQ ID NO: 228037 - DNA, 16 bp, P. troglodytes
ccaggcccaccccaga

SEQ ID NO: 228038 - DNA, 16 bp, P. troglodytes
ccaggcccagccccag

SEQ ID NO: 228039 - DNA, 16 bp, P. troglodytes
ccaggcccagccctgg

SEQ ID NO: 228040 - DNA, 16 bp, P. troglodytes
ccaggcccagctactt

SEQ ID NO: 228041 - DNA, 16 bp, P. troglodytes
ccaggcccaggcccag

SEQ ID NO: 228042 - DNA, 16 bp, P. troglodytes
ccaggcccaggccctg

SEQ ID NO: 228043 - DNA, 16 bp, P. troglodytes
ccaggcccagggtcct

SEQ ID NO: 228044 - DNA, 16 bp, P. troglodytes
ccaggccccacctcca

SEQ ID NO: 228045 - DNA, 16 bp, P. troglodytes
ccaggccccaggctgg

SEQ ID NO: 228046 - DNA, 16 bp, P. troglodytes
ccaggccccaggtggg

SEQ ID NO: 228047 - DNA, 16 bp, P. troglodytes
ccaggcccccagcctc

SEQ ID NO: 228048 - DNA, 16 bp, P. troglodytes
ccaggccccgcctcca

SEQ ID NO: 228049 - DNA, 16 bp, P. troglodytes
ccaggcccctcctctg

SEQ ID NO: 228050 - DNA, 16 bp, P. troglodytes
ccaggccctgcccacc

SEQ ID NO: 228051 - DNA, 16 bp, P. troglodytes
ccaggccctgccccca

SEQ ID NO: 228052 - DNA, 16 bp, P. troglodytes
ccaggccctgcccctc

SEQ ID NO: 228053 - DNA, 16 bp, P. troglodytes
ccaggccctgcccctg

SEQ ID NO: 228054 - DNA, 16 bp, P. troglodytes
ccaggccctgcctccc

SEQ ID NO: 228055 - DNA, 16 bp, P. troglodytes
ccaggccctgggccag

SEQ ID NO: 228056 - DNA, 16 bp, P. troglodytes
ccaggccctgggctgg

SEQ ID NO: 228057 - DNA, 16 bp, P. troglodytes
ccaggccctgtctcaa

SEQ ID NO: 228058 - DNA, 16 bp, P. troglodytes
ccaggccggagtgcag

SEQ ID NO: 228059 - DNA, 17 bp, P. troglodytes
ccaggccgggcgcggtg

SEQ ID NO: 228060 - DNA, 16 bp, P. troglodytes
ccaggcctcagctgcc

SEQ ID NO: 228061 - DNA, 16 bp, P. troglodytes
ccaggcctcagtttcc

SEQ ID NO: 228062 - DNA, 16 bp, P. troglodytes
ccaggcctcagttttc

SEQ ID NO: 228063 - DNA, 16 bp, P. troglodytes
ccaggcctcctgcctc

SEQ ID NO: 228064 - DNA, 16 bp, P. troglodytes
ccaggcctcctgctct

SEQ ID NO: 228065 - DNA, 16 bp, P. troglodytes
ccaggcctctctcctg

SEQ ID NO: 228066 - DNA, 16 bp, P. troglodytes
ccaggcctctgggcct

SEQ ID NO: 228067 - DNA, 16 bp, P. troglodytes
ccaggcctgccctgaa

SEQ ID NO: 228068 - DNA, 16 bp, P. troglodytes
ccaggcctgccctgca

SEQ ID NO: 228069 - DNA, 16 bp, P. troglodytes
ccaggcctgccttcca

SEQ ID NO: 228070 - DNA, 16 bp, P. troglodytes
ccaggcctggcatggt

SEQ ID NO: 228071 - DNA, 16 bp, P. troglodytes
ccaggcctggccctgc

SEQ ID NO: 228072 - DNA, 16 bp, P. troglodytes
ccaggcctgggccagg

SEQ ID NO: 228073 - DNA, 16 bp, P. troglodytes
ccaggcctgggcctgc

SEQ ID NO: 228074 - DNA, 16 bp, P. troglodytes
ccaggcctggggcagg

SEQ ID NO: 228075 - DNA, 16 bp, P. troglodytes
ccaggcctggtggcgg

SEQ ID NO: 228076 - DNA, 16 bp, P. troglodytes
ccaggcctgtgatgag

SEQ ID NO: 228077 - DNA, 16 bp, P. troglodytes
ccaggcgcagcagctc

SEQ ID NO: 228078 - DNA, 16 bp, P. troglodytes
ccaggcgcgggggctc

SEQ ID NO: 228079 - DNA, 17 bp, P. troglodytes
ccaggcgcggtggctca

SEQ ID NO: 228080 - DNA, 16 bp, P. troglodytes
ccaggcgggtggatca

SEQ ID NO: 228081 - DNA, 16 bp, P. troglodytes
ccaggcgtggcagcag

SEQ ID NO: 228082 - DNA, 16 bp, P. troglodytes
ccaggcgtggtgctgt

SEQ ID NO: 228083 - DNA, 16 bp, P. troglodytes
ccaggcgtggtggagc

SEQ ID NO: 228084 - DNA, 16 bp, P. troglodytes
ccaggcgtggtggcct

SEQ ID NO: 228085 - DNA, 16 bp, P. troglodytes
ccaggctaatttttct

SEQ ID NO: 228086 - DNA, 16 bp, P. troglodytes
ccaggctagaaggcag

SEQ ID NO: 228087 - DNA, 16 bp, P. troglodytes
ccaggctagtctcgat

SEQ ID NO: 228088 - DNA, 16 bp, P. troglodytes
ccaggctcaagaaatc

SEQ ID NO: 228089 - DNA, 16 bp, P. troglodytes
ccaggctcagagaggt

SEQ ID NO: 228090 - DNA, 16 bp, P. troglodytes
ccaggctcagcctccc

SEQ ID NO: 228091 - DNA, 16 bp, P. troglodytes
ccaggctccagtgcag

SEQ ID NO: 228092 - DNA, 16 bp, P. troglodytes
ccaggctcctcctccc

SEQ ID NO: 228093 - DNA, 17 bp, P. troglodytes
ccaggctcggtggctca

SEQ ID NO: 228094 - DNA, 16 bp, P. troglodytes
ccaggctctgagctgg

SEQ ID NO: 228095 - DNA, 16 bp, P. troglodytes
ccaggctctgggctgg

SEQ ID NO: 228096 - DNA, 16 bp, P. troglodytes
ccaggctctggtgatc

SEQ ID NO: 228097 - DNA, 16 bp, P. troglodytes
ccaggctgaagtccag

SEQ ID NO: 228098 - DNA, 16 bp, P. troglodytes
ccaggctgacctcaag

SEQ ID NO: 228099 - DNA, 16 bp, P. troglodytes
ccaggctgaggtgcag

SEQ ID NO: 228100 - DNA, 16 bp, P. troglodytes
ccaggctgcagcctca

SEQ ID NO: 228101 - DNA, 16 bp, P. troglodytes
ccaggctgcaggctgg

SEQ ID NO: 228102 - DNA, 16 bp, P. troglodytes
ccaggctgcagggcag

SEQ ID NO: 228103 - DNA, 16 bp, P. troglodytes
ccaggctgccagtccc

SEQ ID NO: 228104 - DNA, 16 bp, P. troglodytes
ccaggctgccagttcc

SEQ ID NO: 228105 - DNA, 16 bp, P. troglodytes
ccaggctgccctcgaa

SEQ ID NO: 228106 - DNA, 16 bp, P. troglodytes
ccaggctggaaagcag

SEQ ID NO: 228107 - DNA, 16 bp, P. troglodytes
ccaggctggagaacaa

SEQ ID NO: 228108 - DNA, 16 bp, P. troglodytes
ccaggctggagaggag

SEQ ID NO: 228109 - DNA, 16 bp, P. troglodytes
ccaggctggagtgagt

SEQ ID NO: 228110 - DNA, 16 bp, P. troglodytes
ccaggctggagtgcgc

SEQ ID NO: 228111 - DNA, 16 bp, P. troglodytes
ccaggctggagtgtga

SEQ ID NO: 228112 - DNA, 16 bp, P. troglodytes
ccaggctggatgcaat

SEQ ID NO: 228113 - DNA, 16 bp, P. troglodytes
ccaggctggatggagt

SEQ ID NO: 228114 - DNA, 16 bp, P. troglodytes
ccaggctggatttgaa

SEQ ID NO: 228115 - DNA, 16 bp, P. troglodytes
ccaggctggccaggct

SEQ ID NO: 228116 - DNA, 16 bp, P. troglodytes
ccaggctggctcactg

SEQ ID NO: 228117 - DNA, 16 bp, P. troglodytes
ccaggctgggcagcag

SEQ ID NO: 228118 - DNA, 16 bp, P. troglodytes
ccaggctgggccaggc

SEQ ID NO: 228119 - DNA, 16 bp, P. troglodytes
ccaggctgggctcagc

SEQ ID NO: 228120 - DNA, 16 bp, P. troglodytes
ccaggctgggcttgaa

SEQ ID NO: 228121 - DNA, 16 bp, P. troglodytes
ccaggctggtactggg

SEQ ID NO: 228122 - DNA, 16 bp, P. troglodytes
ccaggctggtctcctg

SEQ ID NO: 228123 - DNA, 16 bp, P. troglodytes
ccaggctgtaatgcag

SEQ ID NO: 228124 - DNA, 16 bp, P. troglodytes
ccaggctgtctgcctg

SEQ ID NO: 228125 - DNA, 16 bp, P. troglodytes
ccaggctgtgaatttt

SEQ ID NO: 228126 - DNA, 16 bp, P. troglodytes
ccaggcttggcctccc

SEQ ID NO: 228127 - DNA, 16 bp, P. troglodytes
ccaggcttgtctggaa

SEQ ID NO: 228128 - DNA, 16 bp, P. troglodytes
ccaggctttggaatca

SEQ ID NO: 228129 - DNA, 16 bp, P. troglodytes
ccagggaaggaggaag

SEQ ID NO: 228130 - DNA, 16 bp, P. troglodytes
ccagggacagaatgat

SEQ ID NO: 228131 - DNA, 16 bp, P. troglodytes
ccagggaccagtttca

SEQ ID NO: 228132 - DNA, 16 bp, P. troglodytes
ccagggaccccctccc

SEQ ID NO: 228133 - DNA, 16 bp, P. troglodytes
ccagggaggcggaggt

SEQ ID NO: 228134 - DNA, 16 bp, P. troglodytes
ccagggagggcatgga

SEQ ID NO: 228135 - DNA, 16 bp, P. troglodytes
ccagggatgaaactga

SEQ ID NO: 228136 - DNA, 16 bp, P. troglodytes
ccagggatgcaagaat

SEQ ID NO: 228137 - DNA, 16 bp, P. troglodytes
ccagggatgcaatatt

SEQ ID NO: 228138 - DNA, 16 bp, P. troglodytes
ccagggatgctgttaa

SEQ ID NO: 228139 - DNA, 16 bp, P. troglodytes
ccagggatggagccca

SEQ ID NO: 228140 - DNA, 16 bp, P. troglodytes
ccagggcaggatgcag

SEQ ID NO: 228141 - DNA, 16 bp, P. troglodytes
ccagggcagggcaggg

SEQ ID NO: 228142 - DNA, 16 bp, P. troglodytes
ccagggccagcagggc

SEQ ID NO: 228143 - DNA, 16 bp, P. troglodytes
ccagggccaggtgcgg

SEQ ID NO: 228144 - DNA, 16 bp, P. troglodytes
ccagggcccagggcag

SEQ ID NO: 228145 - DNA, 16 bp, P. troglodytes
ccagggccccagcctg

SEQ ID NO: 228146 - DNA, 16 bp, P. troglodytes
ccagggccgggcacag

SEQ ID NO: 228147 - DNA, 16 bp, P. troglodytes
ccagggcctgctgggg

SEQ ID NO: 228148 - DNA, 16 bp, P. troglodytes
ccagggcctgctgtgg

SEQ ID NO: 228149 - DNA, 16 bp, P. troglodytes
ccagggcctgggagga

SEQ ID NO: 228150 - DNA, 16 bp, P. troglodytes
ccagggctccctggag

SEQ ID NO: 228151 - DNA, 16 bp, P. troglodytes
ccagggctctttggag

SEQ ID NO: 228152 - DNA, 16 bp, P. troglodytes
ccagggctgaggcagg

SEQ ID NO: 228153 - DNA, 16 bp, P. troglodytes
ccagggctgggcctgg

SEQ ID NO: 228154 - DNA, 16 bp, P. troglodytes
ccagggctgggctcag

SEQ ID NO: 228155 - DNA, 16 bp, P. troglodytes
ccagggctggggaggg

SEQ ID NO: 228156 - DNA, 16 bp, P. troglodytes
ccaggggagaatctgt

SEQ ID NO: 228157 - DNA, 16 bp, P. troglodytes
ccaggggattctgatg

SEQ ID NO: 228158 - DNA, 16 bp, P. troglodytes
ccaggggctctgggag

SEQ ID NO: 228159 - DNA, 16 bp, P. troglodytes
ccaggggctggaggga

SEQ ID NO: 228160 - DNA, 16 bp, P. troglodytes
ccaggggctggggaga

SEQ ID NO: 228161 - DNA, 16 bp, P. troglodytes
ccaggggctgggggca

SEQ ID NO: 228162 - DNA, 16 bp, P. troglodytes
ccaggggctgtgggag

SEQ ID NO: 228163 - DNA, 16 bp, P. troglodytes
ccagggggctgagcag

SEQ ID NO: 228164 - DNA, 16 bp, P. troglodytes
ccaggggtggtggcat

SEQ ID NO: 228165 - DNA, 16 bp, P. troglodytes
ccagggtaattaggca

SEQ ID NO: 228166 - DNA, 16 bp, P. troglodytes
ccagggtcacacagca

SEQ ID NO: 228167 - DNA, 16 bp, P. troglodytes
ccagggtcactcagct

SEQ ID NO: 228168 - DNA, 16 bp, P. troglodytes
ccagggtgaaattaaa

SEQ ID NO: 228169 - DNA, 16 bp, P. troglodytes
ccagggtgacagagtg

SEQ ID NO: 228170 - DNA, 16 bp, P. troglodytes
ccagggtgatctcaaa

SEQ ID NO: 228171 - DNA, 16 bp, P. troglodytes
ccagggtgggcagatc

SEQ ID NO: 228172 - DNA, 16 bp, P. troglodytes
ccagggttcaagtgat

SEQ ID NO: 228173 - DNA, 16 bp, P. troglodytes
ccaggtaattctgatg

SEQ ID NO: 228174 - DNA, 16 bp, P. troglodytes
ccaggtacttgggggg

SEQ ID NO: 228175 - DNA, 16 bp, P. troglodytes
ccaggtatgaagccaa

SEQ ID NO: 228176 - DNA, 16 bp, P. troglodytes
ccaggtcacacagcag

SEQ ID NO: 228177 - DNA, 16 bp, P. troglodytes
ccaggtcacacagctg

SEQ ID NO: 228178 - DNA, 16 bp, P. troglodytes
ccaggtcacactgatg

SEQ ID NO: 228179 - DNA, 16 bp, P. troglodytes
ccaggtcatgctaatg

SEQ ID NO: 228180 - DNA, 16 bp, P. troglodytes
ccaggtccagggcccc

SEQ ID NO: 228181 - DNA, 16 bp, P. troglodytes
ccaggtcccccagcag

SEQ ID NO: 228182 - DNA, 16 bp, P. troglodytes
ccaggtccctccccca

SEQ ID NO: 228183 - DNA, 16 bp, P. troglodytes
ccaggtccctcctcca

SEQ ID NO: 228184 - DNA, 16 bp, P. troglodytes
ccaggtcctatgtcca

SEQ ID NO: 228185 - DNA, 16 bp, P. troglodytes
ccaggtcctcttcaga

SEQ ID NO: 228186 - DNA, 16 bp, P. troglodytes
ccaggtctcaagtgat

SEQ ID NO: 228187 - DNA, 16 bp, P. troglodytes
ccaggtctctcccatg

SEQ ID NO: 228188 - DNA, 16 bp, P. troglodytes
ccaggtctgtctgact

SEQ ID NO: 228189 - DNA, 16 bp, P. troglodytes
ccaggtgaggtggcat

SEQ ID NO: 228190 - DNA, 16 bp, P. troglodytes
ccaggtgaggtggtgg

SEQ ID NO: 228191 - DNA, 19 bp, P. troglodytes
ccaggtgatccacctgcct

SEQ ID NO: 228192 - DNA, 16 bp, P. troglodytes
ccaggtgatgccaatg

SEQ ID NO: 228193 - DNA, 16 bp, P. troglodytes
ccaggtgatgctgatg

SEQ ID NO: 228194 - DNA, 16 bp, P. troglodytes
ccaggtgatgctggtg

SEQ ID NO: 228195 - DNA, 16 bp, P. troglodytes
ccaggtgattctgatg

SEQ ID NO: 228196 - DNA, 16 bp, P. troglodytes
ccaggtgcactgctca

SEQ ID NO: 228197 - DNA, 16 bp, P. troglodytes
ccaggtgcactgcttg

SEQ ID NO: 228198 - DNA, 16 bp, P. troglodytes
ccaggtgcaggggctt

SEQ ID NO: 228199 - DNA, 16 bp, P. troglodytes
ccaggtgcagtggctc

SEQ ID NO: 228200 - DNA, 16 bp, P. troglodytes
ccaggtgcagtggctt

SEQ ID NO: 228201 - DNA, 16 bp, P. troglodytes
ccaggtgcagtggttc

SEQ ID NO: 228202 - DNA, 16 bp, P. troglodytes
ccaggtgctctgtccc

SEQ ID NO: 228203 - DNA, 16 bp, P. troglodytes
ccaggtgctgctgctg

SEQ ID NO: 228204 - DNA, 16 bp, P. troglodytes
ccaggtgggggcaggg

SEQ ID NO: 228205 - DNA, 16 bp, P. troglodytes
ccaggtggtcaaggct

SEQ ID NO: 228206 - DNA, 16 bp, P. troglodytes
ccaggtgtgatggtgc

SEQ ID NO: 228207 - DNA, 16 bp, P. troglodytes
ccaggtgtgggcaggg

SEQ ID NO: 228208 - DNA, 16 bp, P. troglodytes
ccaggtgtgggggctc

SEQ ID NO: 228209 - DNA, 16 bp, P. troglodytes
ccaggtgtggtgacgg

SEQ ID NO: 228210 - DNA, 16 bp, P. troglodytes
ccaggtgtggtgactt

SEQ ID NO: 228211 - DNA, 16 bp, P. troglodytes
ccaggtgtggtgatgg

SEQ ID NO: 228212 - DNA, 17 bp, P. troglodytes
ccaggtgttcaagacca

SEQ ID NO: 228213 - DNA, 16 bp, P. troglodytes
ccaggtgttgctgatg

SEQ ID NO: 228214 - DNA, 16 bp, P. troglodytes
ccaggtgttgtggtgc

SEQ ID NO: 228215 - DNA, 16 bp, P. troglodytes
ccaggtgtttgagatc

SEQ ID NO: 228216 - DNA, 16 bp, P. troglodytes
ccaggttcaggccatt

SEQ ID NO: 228217 - DNA, 16 bp, P. troglodytes
ccaggttctcacattg

SEQ ID NO: 228218 - DNA, 16 bp, P. troglodytes
ccaggttggtctcaaa

SEQ ID NO: 228219 - DNA, 16 bp, P. troglodytes
ccaggttgtccatcag

SEQ ID NO: 228220 - DNA, 16 bp, P. troglodytes
ccaggttgttcttgaa

SEQ ID NO: 228221 - DNA, 16 bp, P. troglodytes
ccagtaatatataaaa

SEQ ID NO: 228222 - DNA, 16 bp, P. troglodytes
ccagtaatggcatggc

SEQ ID NO: 228223 - DNA, 16 bp, P. troglodytes
ccagtacaatgttgaa

SEQ ID NO: 228224 - DNA, 16 bp, P. troglodytes
ccagtaccagctgctg

SEQ ID NO: 228225 - DNA, 16 bp, P. troglodytes
ccagtactttggaaag

SEQ ID NO: 228226 - DNA, 16 bp, P. troglodytes
ccagtagctggggcta

SEQ ID NO: 228227 - DNA, 16 bp, P. troglodytes
ccagtaggggcggact

SEQ ID NO: 228228 - DNA, 16 bp, P. troglodytes
ccagtatttcattgag

SEQ ID NO: 228229 - DNA, 16 bp, P. troglodytes
ccagtatttttttgag

SEQ ID NO: 228230 - DNA, 16 bp, P. troglodytes
ccagtcagaatggcta

SEQ ID NO: 228231 - DNA, 16 bp, P. troglodytes
ccagtcagtggagcag

SEQ ID NO: 228232 - DNA, 16 bp, P. troglodytes
ccagtcataatggcta

SEQ ID NO: 228233 - DNA, 16 bp, P. troglodytes
ccagtcatggctaaaa

SEQ ID NO: 228234 - DNA, 16 bp, P. troglodytes
ccagtcattttatttt

SEQ ID NO: 228235 - DNA, 16 bp, P. troglodytes
ccagtccaccaactca

SEQ ID NO: 228236 - DNA, 16 bp, P. troglodytes
ccagtccctggtgcca

SEQ ID NO: 228237 - DNA, 16 bp, P. troglodytes
ccagtcctatcagatt

SEQ ID NO: 228238 - DNA, 16 bp, P. troglodytes
ccagtccttctgaaac

SEQ ID NO: 228239 - DNA, 16 bp, P. troglodytes
ccagtctcaagtgatc

SEQ ID NO: 228240 - DNA, 16 bp, P. troglodytes
ccagtctccagagctg

SEQ ID NO: 228241 - DNA, 16 bp, P. troglodytes
ccagtctctacaaaaa

SEQ ID NO: 228242 - DNA, 16 bp, P. troglodytes
ccagtctctgcctcca

SEQ ID NO: 228243 - DNA, 16 bp, P. troglodytes
ccagtctctgcttctg

SEQ ID NO: 228244 - DNA, 16 bp, P. troglodytes
ccagtctgaccaacat

SEQ ID NO: 228245 - DNA, 16 bp, P. troglodytes
ccagtctgagtgacag

SEQ ID NO: 228246 - DNA, 16 bp, P. troglodytes
ccagtctggccaacat

SEQ ID NO: 228247 - DNA, 16 bp, P. troglodytes
ccagtctggccaatgt

SEQ ID NO: 228248 - DNA, 16 bp, P. troglodytes
ccagtctggccagcat

SEQ ID NO: 228249 - DNA, 16 bp, P. troglodytes
ccagtctgggcaacaa

SEQ ID NO: 228250 - DNA, 16 bp, P. troglodytes
ccagtctgggtaacat

SEQ ID NO: 228251 - DNA, 16 bp, P. troglodytes
ccagtctgtggcccag

SEQ ID NO: 228252 - DNA, 16 bp, P. troglodytes
ccagtgaaacagaaca

SEQ ID NO: 228253 - DNA, 16 bp, P. troglodytes
ccagtgaaagcagctg

SEQ ID NO: 228254 - DNA, 16 bp, P. troglodytes
ccagtgagctgagatc

SEQ ID NO: 228255 - DNA, 16 bp, P. troglodytes
ccagtgagcttggaag

SEQ ID NO: 228256 - DNA, 16 bp, P. troglodytes
ccagtgaggaggaaca

SEQ ID NO: 228257 - DNA, 16 bp, P. troglodytes
ccagtgagtggcagag

SEQ ID NO: 228258 - DNA, 16 bp, P. troglodytes
ccagtgatgaagagca

SEQ ID NO: 228259 - DNA, 16 bp, P. troglodytes
ccagtgatgatgaaca

SEQ ID NO: 228260 - DNA, 16 bp, P. troglodytes
ccagtgatgatgacca

SEQ ID NO: 228261 - DNA, 16 bp, P. troglodytes
ccagtgatgatgagct

SEQ ID NO: 228262 - DNA, 16 bp, P. troglodytes
ccagtgattctgatgc

SEQ ID NO: 228263 - DNA, 16 bp, P. troglodytes
ccagtgcactgcagcc

SEQ ID NO: 228264 - DNA, 16 bp, P. troglodytes
ccagtgcagattgccc

SEQ ID NO: 228265 - DNA, 16 bp, P. troglodytes
ccagtgcagtccagcc

SEQ ID NO: 228266 - DNA, 16 bp, P. troglodytes
ccagtgccacactgtt

SEQ ID NO: 228267 - DNA, 16 bp, P. troglodytes
ccagtgccctccagcc

SEQ ID NO: 228268 - DNA, 16 bp, P. troglodytes
ccagtgcctcagtttc

SEQ ID NO: 228269 - DNA, 16 bp, P. troglodytes
ccagtgcctggcacac

SEQ ID NO: 228270 - DNA, 16 bp, P. troglodytes
ccagtgctggatgctt

SEQ ID NO: 228271 - DNA, 16 bp, P. troglodytes
ccagtgctggctgctg

SEQ ID NO: 228272 - DNA, 16 bp, P. troglodytes
ccagtgctgtgctggc

SEQ ID NO: 228273 - DNA, 16 bp, P. troglodytes
ccagtggcacctggaa

SEQ ID NO: 228274 - DNA, 16 bp, P. troglodytes
ccagtgggtttttttt

SEQ ID NO: 228275 - DNA, 16 bp, P. troglodytes
ccagtggttcatgcct

SEQ ID NO: 228276 - DNA, 16 bp, P. troglodytes
ccagtggttctcaaag

SEQ ID NO: 228277 - DNA, 16 bp, P. troglodytes
ccagtgtcaaccagga

SEQ ID NO: 228278 - DNA, 16 bp, P. troglodytes
ccagtgtctgggaaga

SEQ ID NO: 228279 - DNA, 17 bp, P. troglodytes
ccagtgtgagcaacaca

SEQ ID NO: 228280 - DNA, 16 bp, P. troglodytes
ccagtgtgatggtatt

SEQ ID NO: 228281 - DNA, 16 bp, P. troglodytes
ccagtgtgcccaggat

SEQ ID NO: 228282 - DNA, 16 bp, P. troglodytes
ccagtgtgggatccac

SEQ ID NO: 228283 - DNA, 17 bp, P. troglodytes
ccagtgtgtgacgttcc

SEQ ID NO: 228284 - DNA, 16 bp, P. troglodytes
ccagtgtgtggtgttc

SEQ ID NO: 228285 - DNA, 16 bp, P. troglodytes
ccagtgttgagtgcat

SEQ ID NO: 228286 - DNA, 16 bp, P. troglodytes
ccagtgttggaagtgg

SEQ ID NO: 228287 - DNA, 16 bp, P. troglodytes
ccagtgttggagctgg

SEQ ID NO: 228288 - DNA, 16 bp, P. troglodytes
ccagtgttggagttgg

SEQ ID NO: 228289 - DNA, 16 bp, P. troglodytes
ccagtgtttcccaaac

SEQ ID NO: 228290 - DNA, 16 bp, P. troglodytes
ccagtgtttctcaaag

SEQ ID NO: 228291 - DNA, 16 bp, P. troglodytes
ccagttaatttttaaa

SEQ ID NO: 228292 - DNA, 35 bp, P. troglodytes
ccagttagaatggtgatcattaaaaagtcaggaaa

SEQ ID NO: 228293 - DNA, 17 bp, P. troglodytes
ccagttagagtggcgat

SEQ ID NO: 228294 - DNA, 16 bp, P. troglodytes
ccagttcaagcaattc

SEQ ID NO: 228295 - DNA, 17 bp, P. troglodytes
ccagttcaagtgattct

SEQ ID NO: 228296 - DNA, 16 bp, P. troglodytes
ccagttcactctgatg

SEQ ID NO: 228297 - DNA, 16 bp, P. troglodytes
ccagttccaaagttgc

SEQ ID NO: 228298 - DNA, 16 bp, P. troglodytes
ccagttctcagatctc

SEQ ID NO: 228299 - DNA, 16 bp, P. troglodytes
ccagttgctccagcac

SEQ ID NO: 228300 - DNA, 16 bp, P. troglodytes
ccagttggcttcaccc

SEQ ID NO: 228301 - DNA, 16 bp, P. troglodytes
ccagttgtgacagcca

SEQ ID NO: 228302 - DNA, 16 bp, P. troglodytes
ccagtttacagataag

SEQ ID NO: 228303 - DNA, 16 bp, P. troglodytes
ccagtttacagtccca

SEQ ID NO: 228304 - DNA, 16 bp, P. troglodytes
ccagtttatggcattt

SEQ ID NO: 228305 - DNA, 16 bp, P. troglodytes
ccagtttcaggtgttt

SEQ ID NO: 228306 - DNA, 16 bp, P. troglodytes
ccagtttcctcccaca

SEQ ID NO: 228307 - DNA, 16 bp, P. troglodytes
ccagtttccttcttct

SEQ ID NO: 228308 - DNA, 16 bp, P. troglodytes
ccagtttgcacaggga

SEQ ID NO: 228309 - DNA, 16 bp, P. troglodytes
ccagtttgggtgacag

SEQ ID NO: 228310 - DNA, 16 bp, P. troglodytes
ccagtttgtggtactt

SEQ ID NO: 228311 - DNA, 16 bp, P. troglodytes
ccagttttagttttct

SEQ ID NO: 228312 - DNA, 16 bp, P. troglodytes
ccagttttccaaagtg

SEQ ID NO: 228313 - DNA, 16 bp, P. troglodytes
ccagttttgttctttt

SEQ ID NO: 228314 - DNA, 16 bp, P. troglodytes
ccagttttgtttcctt

SEQ ID NO: 228315 - DNA, 16 bp, P. troglodytes
ccagtttttgcccttt

SEQ ID NO: 228316 - DNA, 16 bp, P. troglodytes
ccagttttttaaaaaa

SEQ ID NO: 228317 - DNA, 16 bp, P. troglodytes
ccataaagaagaataa

SEQ ID NO: 228318 - DNA, 16 bp, P. troglodytes
ccataaattgggtggc

SEQ ID NO: 228319 - DNA, 16 bp, P. troglodytes
ccataatgtgagtggg

SEQ ID NO: 228320 - DNA, 16 bp, P. troglodytes
ccataatttaaaaatc

SEQ ID NO: 228321 - DNA, 16 bp, P. troglodytes
ccatactcttctcatg

SEQ ID NO: 228322 - DNA, 16 bp, P. troglodytes
ccatagattagttttg

SEQ ID NO: 228323 - DNA, 16 bp, P. troglodytes
ccatagctttcatcag

SEQ ID NO: 228324 - DNA, 16 bp, P. troglodytes
ccataggctgcagaat

SEQ ID NO: 228325 - DNA, 16 bp, P. troglodytes
ccataggttttgatat

SEQ ID NO: 228326 - DNA, 16 bp, P. troglodytes
ccataggttttggtgt

SEQ ID NO: 228327 - DNA, 16 bp, P. troglodytes
ccatagtttatttaac

SEQ ID NO: 228328 - DNA, 16 bp, P. troglodytes
ccatataattcaccca

SEQ ID NO: 228329 - DNA, 16 bp, P. troglodytes
ccatatatgtatatat

SEQ ID NO: 228330 - DNA, 16 bp, P. troglodytes
ccatatctagaaaacc

SEQ ID NO: 228331 - DNA, 16 bp, P. troglodytes
ccatatgctgaagaat

SEQ ID NO: 228332 - DNA, 16 bp, P. troglodytes
ccatattttcttaatc

SEQ ID NO: 228333 - DNA, 16 bp, P. troglodytes
ccatatttttgcaact

SEQ ID NO: 228334 - DNA, 16 bp, P. troglodytes
ccatcaaaatcccaat

SEQ ID NO: 228335 - DNA, 16 bp, P. troglodytes
ccatcaacagtgtata

SEQ ID NO: 228336 - DNA, 16 bp, P. troglodytes
ccatcaacagttgaat

SEQ ID NO: 228337 - DNA, 16 bp, P. troglodytes
ccatcaaggaaatgca

SEQ ID NO: 228338 - DNA, 16 bp, P. troglodytes
ccatcaaggctaggaa

SEQ ID NO: 228339 - DNA, 16 bp, P. troglodytes
ccatcaatgatagact

SEQ ID NO: 228340 - DNA, 16 bp, P. troglodytes
ccatcacacccaacta

SEQ ID NO: 228341 - DNA, 16 bp, P. troglodytes
ccatcacacccagcaa

SEQ ID NO: 228342 - DNA, 16 bp, P. troglodytes
ccatcacacctggcta

SEQ ID NO: 228343 - DNA, 16 bp, P. troglodytes
ccatcacatctggcta

SEQ ID NO: 228344 - DNA, 16 bp, P. troglodytes
ccatcaccaccatcaa

SEQ ID NO: 228345 - DNA, 16 bp, P. troglodytes
ccatcaccatcatcca

SEQ ID NO: 228346 - DNA, 16 bp, P. troglodytes
ccatcacctccagatg

SEQ ID NO: 228347 - DNA, 16 bp, P. troglodytes
ccatcacgagcatgtc

SEQ ID NO: 228348 - DNA, 16 bp, P. troglodytes
ccatcactactaaaaa

SEQ ID NO: 228349 - DNA, 16 bp, P. troglodytes
ccatcagaaggaagcc

SEQ ID NO: 228350 - DNA, 16 bp, P. troglodytes
ccatcagatctcatca

SEQ ID NO: 228351 - DNA, 16 bp, P. troglodytes
ccatcagatcttgtga

SEQ ID NO: 228352 - DNA, 16 bp, P. troglodytes
ccatcagcaccatcca

SEQ ID NO: 228353 - DNA, 16 bp, P. troglodytes
ccatcagctctcatga

SEQ ID NO: 228354 - DNA, 16 bp, P. troglodytes
ccatcaggcctgccct

SEQ ID NO: 228355 - DNA, 16 bp, P. troglodytes
ccatcaggttctgggc

SEQ ID NO: 228356 - DNA, 16 bp, P. troglodytes
ccatcagtctatgtgt

SEQ ID NO: 228357 - DNA, 16 bp, P. troglodytes
ccatcatctcagtcca

SEQ ID NO: 228358 - DNA, 16 bp, P. troglodytes
ccatcatgaattaatt

SEQ ID NO: 228359 - DNA, 16 bp, P. troglodytes
ccatcatggcaaaacc

SEQ ID NO: 228360 - DNA, 16 bp, P. troglodytes
ccatccaacagcaaca

SEQ ID NO: 228361 - DNA, 16 bp, P. troglodytes
ccatccaagtactaac

SEQ ID NO: 228362 - DNA, 16 bp, P. troglodytes
ccatccacccatcatc

SEQ ID NO: 228363 - DNA, 16 bp, P. troglodytes
ccatccacctctgcct

SEQ ID NO: 228364 - DNA, 16 bp, P. troglodytes
ccatccacctgcctca

SEQ ID NO: 228365 - DNA, 16 bp, P. troglodytes
ccatccagaaaaacat

SEQ ID NO: 228366 - DNA, 16 bp, P. troglodytes
ccatccagcctgggca

SEQ ID NO: 228367 - DNA, 16 bp, P. troglodytes
ccatccagcctgggcg

SEQ ID NO: 228368 - DNA, 16 bp, P. troglodytes
ccatccagctttgctc

SEQ ID NO: 228369 - DNA, 16 bp, P. troglodytes
ccatccatccatccgt

SEQ ID NO: 228370 - DNA, 16 bp, P. troglodytes
ccatccatctccagaa

SEQ ID NO: 228371 - DNA, 16 bp, P. troglodytes
ccatcccagcctccca

SEQ ID NO: 228372 - DNA, 17 bp, P. troglodytes
ccatccccagtatggat

SEQ ID NO: 228373 - DNA, 16 bp, P. troglodytes
ccatccccatcaaggt

SEQ ID NO: 228374 - DNA, 16 bp, P. troglodytes
ccatcccccaggctgg

SEQ ID NO: 228375 - DNA, 16 bp, P. troglodytes
ccatcccccttctggc

SEQ ID NO: 228376 - DNA, 16 bp, P. troglodytes
ccatccccttgatgct

SEQ ID NO: 228377 - DNA, 16 bp, P. troglodytes
ccatcctcagcctccc

SEQ ID NO: 228378 - DNA, 16 bp, P. troglodytes
ccatcctcctcagcct

SEQ ID NO: 228379 - DNA, 16 bp, P. troglodytes
ccatcctcttggtgct

SEQ ID NO: 228380 - DNA, 16 bp, P. troglodytes
ccatcctggacaacag

SEQ ID NO: 228381 - DNA, 16 bp, P. troglodytes
ccatcctggccaactt

SEQ ID NO: 228382 - DNA, 16 bp, P. troglodytes
ccatcctggcctccca

SEQ ID NO: 228383 - DNA, 16 bp, P. troglodytes
ccatcctggctaacaa

SEQ ID NO: 228384 - DNA, 16 bp, P. troglodytes
ccatcctgggcaatgt

SEQ ID NO: 228385 - DNA, 16 bp, P. troglodytes
ccatcctgggcagcag

SEQ ID NO: 228386 - DNA, 16 bp, P. troglodytes
ccatcctgggcagcat

SEQ ID NO: 228387 - DNA, 16 bp, P. troglodytes
ccatcctgggctacat

SEQ ID NO: 228388 - DNA, 16 bp, P. troglodytes
ccatcctgggctgcat

SEQ ID NO: 228389 - DNA, 16 bp, P. troglodytes
ccatcctggtcaacac

SEQ ID NO: 228390 - DNA, 16 bp, P. troglodytes
ccatcctgttctcatg

SEQ ID NO: 228391 - DNA, 16 bp, P. troglodytes
ccatccttggcctccc

SEQ ID NO: 228392 - DNA, 16 bp, P. troglodytes
ccatcgctactaaaaa

SEQ ID NO: 228393 - DNA, 16 bp, P. troglodytes
ccatctaactgtattt

SEQ ID NO: 228394 - DNA, 16 bp, P. troglodytes
ccatctaatttttata

SEQ ID NO: 228395 - DNA, 16 bp, P. troglodytes
ccatctcaaacaaaac

SEQ ID NO: 228396 - DNA, 16 bp, P. troglodytes
ccatctcaaagagaaa

SEQ ID NO: 228397 - DNA, 16 bp, P. troglodytes
ccatctcagcctccct

SEQ ID NO: 228398 - DNA, 22 bp, P. troglodytes
ccatctcatgtgcagagacaca

SEQ ID NO: 228399 - DNA, 16 bp, P. troglodytes
ccatctccaaaaagaa

SEQ ID NO: 228400 - DNA, 16 bp, P. troglodytes
ccatctccatagtttt

SEQ ID NO: 228401 - DNA, 16 bp, P. troglodytes
ccatctcccaggctca

SEQ ID NO: 228402 - DNA, 16 bp, P. troglodytes
ccatctccttcatggc

SEQ ID NO: 228403 - DNA, 16 bp, P. troglodytes
ccatctctaaaaaaat

SEQ ID NO: 228404 - DNA, 16 bp, P. troglodytes
ccatctctaataataa

SEQ ID NO: 228405 - DNA, 16 bp, P. troglodytes
ccatctctacaaaaag

SEQ ID NO: 228406 - DNA, 16 bp, P. troglodytes
ccatctctacaaaaca

SEQ ID NO: 228407 - DNA, 16 bp, P. troglodytes
ccatctctacaaagaa

SEQ ID NO: 228408 - DNA, 16 bp, P. troglodytes
ccatctctacaagaaa

SEQ ID NO: 228409 - DNA, 16 bp, P. troglodytes
ccatctctacacaaaa

SEQ ID NO: 228410 - DNA, 16 bp, P. troglodytes
ccatctctacccaaaa

SEQ ID NO: 228411 - DNA, 16 bp, P. troglodytes
ccatctctactaaagg

SEQ ID NO: 228412 - DNA, 16 bp, P. troglodytes
ccatctctactgaaaa

SEQ ID NO: 228413 - DNA, 16 bp, P. troglodytes
ccatctctataatttt

SEQ ID NO: 228414 - DNA, 16 bp, P. troglodytes
ccatctctattaaaaa

SEQ ID NO: 228415 - DNA, 16 bp, P. troglodytes
ccatctctcaggctca

SEQ ID NO: 228416 - DNA, 16 bp, P. troglodytes
ccatctctctctgtct

SEQ ID NO: 228417 - DNA, 16 bp, P. troglodytes
ccatctctgcatccct

SEQ ID NO: 228418 - DNA, 16 bp, P. troglodytes
ccatctctgcctccca

SEQ ID NO: 228419 - DNA, 16 bp, P. troglodytes
ccatctctggaaaaaa

SEQ ID NO: 228420 - DNA, 16 bp, P. troglodytes
ccatctctgggcctca

SEQ ID NO: 228421 - DNA, 16 bp, P. troglodytes
ccatctctgtctctct

SEQ ID NO: 228422 - DNA, 16 bp, P. troglodytes
ccatctcttagaaaaa

SEQ ID NO: 228423 - DNA, 16 bp, P. troglodytes
ccatctctttgaaatg

SEQ ID NO: 228424 - DNA, 16 bp, P. troglodytes
ccatctcttttttaaa

SEQ ID NO: 228425 - DNA, 16 bp, P. troglodytes
ccatctgacaaagggc

SEQ ID NO: 228426 - DNA, 16 bp, P. troglodytes
ccatctgaggtaccag

SEQ ID NO: 228427 - DNA, 16 bp, P. troglodytes
ccatctgaggtcagga

SEQ ID NO: 228428 - DNA, 16 bp, P. troglodytes
ccatctgccatccatt

SEQ ID NO: 228429 - DNA, 16 bp, P. troglodytes
ccatctgctcctggac

SEQ ID NO: 228430 - DNA, 16 bp, P. troglodytes
ccatctggaggtgatg

SEQ ID NO: 228431 - DNA, 16 bp, P. troglodytes
ccatctgtaaaaaaaa

SEQ ID NO: 228432 - DNA, 16 bp, P. troglodytes
ccatctgtaaaatgag

SEQ ID NO: 228433 - DNA, 16 bp, P. troglodytes
ccatctgtatatcctc

SEQ ID NO: 228434 - DNA, 18 bp, P. troglodytes
ccatctgtcacccctttc

SEQ ID NO: 228435 - DNA, 16 bp, P. troglodytes
ccatctgtctgtccat

SEQ ID NO: 228436 - DNA, 16 bp, P. troglodytes
ccatctgtctgtctat

SEQ ID NO: 228437 - DNA, 16 bp, P. troglodytes
ccatctgtgtatcttt

SEQ ID NO: 228438 - DNA, 16 bp, P. troglodytes
ccatctgttctttgtt

SEQ ID NO: 228439 - DNA, 16 bp, P. troglodytes
ccatcttaaataaata

SEQ ID NO: 228440 - DNA, 16 bp, P. troglodytes
ccatcttaaattaatt

SEQ ID NO: 228441 - DNA, 16 bp, P. troglodytes
ccatcttaaccatttt

SEQ ID NO: 228442 - DNA, 16 bp, P. troglodytes
ccatcttcaagaaaag

SEQ ID NO: 228443 - DNA, 16 bp, P. troglodytes
ccatcttccagacccc

SEQ ID NO: 228444 - DNA, 16 bp, P. troglodytes
ccatcttccagtaatt

SEQ ID NO: 228445 - DNA, 16 bp, P. troglodytes
ccatcttcccagaatc

SEQ ID NO: 228446 - DNA, 16 bp, P. troglodytes
ccatcttgaaaaacaa

SEQ ID NO: 228447 - DNA, 16 bp, P. troglodytes
ccatcttggaagcaga

SEQ ID NO: 228448 - DNA, 16 bp, P. troglodytes
ccatcttggaagcggc

SEQ ID NO: 228449 - DNA, 16 bp, P. troglodytes
ccatcttggccaggat

SEQ ID NO: 228450 - DNA, 16 bp, P. troglodytes
ccatcttggctcactg

SEQ ID NO: 228451 - DNA, 16 bp, P. troglodytes
ccatcttgggagcagc

SEQ ID NO: 228452 - DNA, 16 bp, P. troglodytes
ccatctttacaaaaca

SEQ ID NO: 228453 - DNA, 16 bp, P. troglodytes
ccatctttaccaaaaa

SEQ ID NO: 228454 - DNA, 16 bp, P. troglodytes
ccatctttatgtctgt

SEQ ID NO: 228455 - DNA, 16 bp, P. troglodytes
ccatctttatttaaaa

SEQ ID NO: 228456 - DNA, 16 bp, P. troglodytes
ccatctttctgtctct

SEQ ID NO: 228457 - DNA, 16 bp, P. troglodytes
ccatcttttttaaaaa

SEQ ID NO: 228458 - DNA, 16 bp, P. troglodytes
ccatgaaaaaggatga

SEQ ID NO: 228459 - DNA, 16 bp, P. troglodytes
ccatgaaaaatctgaa

SEQ ID NO: 228460 - DNA, 16 bp, P. troglodytes
ccatgaaagcagccag

SEQ ID NO: 228461 - DNA, 16 bp, P. troglodytes
ccatgaacaaagtggc

SEQ ID NO: 228462 - DNA, 16 bp, P. troglodytes
ccatgaagaaagtgaa

SEQ ID NO: 228463 - DNA, 16 bp, P. troglodytes
ccatgaagctggccct

SEQ ID NO: 228464 - DNA, 16 bp, P. troglodytes
ccatgaaggcagagac

SEQ ID NO: 228465 - DNA, 16 bp, P. troglodytes
ccatgaagggaggaaa

SEQ ID NO: 228466 - DNA, 16 bp, P. troglodytes
ccatgaaggtctgcag

SEQ ID NO: 228467 - DNA, 16 bp, P. troglodytes
ccatgacacatgtata

SEQ ID NO: 228468 - DNA, 19 bp, P. troglodytes
ccatgacgcctggctaatt

SEQ ID NO: 228469 - DNA, 16 bp, P. troglodytes
ccatgagagcagagac

SEQ ID NO: 228470 - DNA, 17 bp, P. troglodytes
ccatgagcatggaatgt

SEQ ID NO: 228471 - DNA, 18 bp, P. troglodytes
ccatgagcatggaatgtt

SEQ ID NO: 228472 - DNA, 16 bp, P. troglodytes
ccatgagccactgtgc

SEQ ID NO: 228473 - DNA, 16 bp, P. troglodytes
ccatgagggcagagcc

SEQ ID NO: 228474 - DNA, 16 bp, P. troglodytes
ccatgagtgtgccact

SEQ ID NO: 228475 - DNA, 16 bp, P. troglodytes
ccatgagtttgaggtt

SEQ ID NO: 228476 - DNA, 17 bp, P. troglodytes
ccatgatccacccgcct

SEQ ID NO: 228477 - DNA, 16 bp, P. troglodytes
ccatgatctaatcatc

SEQ ID NO: 228478 - DNA, 16 bp, P. troglodytes
ccatgatctgccacag

SEQ ID NO: 228479 - DNA, 16 bp, P. troglodytes
ccatgatgaaacccta

SEQ ID NO: 228480 - DNA, 16 bp, P. troglodytes
ccatgatgacaatggc

SEQ ID NO: 228481 - DNA, 18 bp, P. troglodytes
ccatgatgacaatggcgg

SEQ ID NO: 228482 - DNA, 16 bp, P. troglodytes
ccatgatgcccacctg

SEQ ID NO: 228483 - DNA, 16 bp, P. troglodytes
ccatgatggaaaggaa

SEQ ID NO: 228484 - DNA, 16 bp, P. troglodytes
ccatgattataagttt

SEQ ID NO: 228485 - DNA, 16 bp, P. troglodytes
ccatgattcagttacc

SEQ ID NO: 228486 - DNA, 16 bp, P. troglodytes
ccatgattgtaagttc

SEQ ID NO: 228487 - DNA, 16 bp, P. troglodytes
ccatgattgtgaggct

SEQ ID NO: 228488 - DNA, 16 bp, P. troglodytes
ccatgcaagtccaaaa

SEQ ID NO: 228489 - DNA, 16 bp, P. troglodytes
ccatgcaagtctgaaa

SEQ ID NO: 228490 - DNA, 16 bp, P. troglodytes
ccatgcaccaccacgc

SEQ ID NO: 228491 - DNA, 16 bp, P. troglodytes
ccatgcatccaacaaa

SEQ ID NO: 228492 - DNA, 16 bp, P. troglodytes
ccatgcatgcatccat

SEQ ID NO: 228493 - DNA, 16 bp, P. troglodytes
ccatgcccagccaagc

SEQ ID NO: 228494 - DNA, 16 bp, P. troglodytes
ccatgcccagccaata

SEQ ID NO: 228495 - DNA, 16 bp, P. troglodytes
ccatgcccagccagca

SEQ ID NO: 228496 - DNA, 16 bp, P. troglodytes
ccatgcccagccaggc

SEQ ID NO: 228497 - DNA, 16 bp, P. troglodytes
ccatgcccagcccacc

SEQ ID NO: 228498 - DNA, 16 bp, P. troglodytes
ccatgcccagccccat

SEQ ID NO: 228499 - DNA, 16 bp, P. troglodytes
ccatgcccagccctgg

SEQ ID NO: 228500 - DNA, 16 bp, P. troglodytes
ccatgcccagccctgt

SEQ ID NO: 228501 - DNA, 16 bp, P. troglodytes
ccatgcccagccgaga

SEQ ID NO: 228502 - DNA, 16 bp, P. troglodytes
ccatgcccagcctatt

SEQ ID NO: 228503 - DNA, 16 bp, P. troglodytes
ccatgcccagcctctc

SEQ ID NO: 228504 - DNA, 16 bp, P. troglodytes
ccatgcccagcctgac

SEQ ID NO: 228505 - DNA, 16 bp, P. troglodytes
ccatgcccagcctgag

SEQ ID NO: 228506 - DNA, 16 bp, P. troglodytes
ccatgcccagcctggc

SEQ ID NO: 228507 - DNA, 16 bp, P. troglodytes
ccatgcccagcctgtg

SEQ ID NO: 228508 - DNA, 16 bp, P. troglodytes
ccatgcccagctaatg

SEQ ID NO: 228509 - DNA, 16 bp, P. troglodytes
ccatgcccagctggca

SEQ ID NO: 228510 - DNA, 16 bp, P. troglodytes
ccatgcctgagccccc

SEQ ID NO: 228511 - DNA, 17 bp, P. troglodytes
ccatgcctgagcctccc

SEQ ID NO: 228512 - DNA, 16 bp, P. troglodytes
ccatgcctggccaaag

SEQ ID NO: 228513 - DNA, 16 bp, P. troglodytes
ccatgcctggcccagc

SEQ ID NO: 228514 - DNA, 16 bp, P. troglodytes
ccatgcctggccccaa

SEQ ID NO: 228515 - DNA, 16 bp, P. troglodytes
ccatgcctggccctaa

SEQ ID NO: 228516 - DNA, 16 bp, P. troglodytes
ccatgcctggccctga

SEQ ID NO: 228517 - DNA, 16 bp, P. troglodytes
ccatgcctggcccttc

SEQ ID NO: 228518 - DNA, 16 bp, P. troglodytes
ccatgcctggcctctt

SEQ ID NO: 228519 - DNA, 16 bp, P. troglodytes
ccatgcctggccttct

SEQ ID NO: 228520 - DNA, 16 bp, P. troglodytes
ccatgcctggcctttt

SEQ ID NO: 228521 - DNA, 16 bp, P. troglodytes
ccatgcctggcttatt

SEQ ID NO: 228522 - DNA, 16 bp, P. troglodytes
ccatgcgttctcatca

SEQ ID NO: 228523 - DNA, 16 bp, P. troglodytes
ccatgctatacattag

SEQ ID NO: 228524 - DNA, 16 bp, P. troglodytes
ccatgctgaactgagt

SEQ ID NO: 228525 - DNA, 16 bp, P. troglodytes
ccatgctgagctgtga

SEQ ID NO: 228526 - DNA, 16 bp, P. troglodytes
ccatgctggagtacag

SEQ ID NO: 228527 - DNA, 16 bp, P. troglodytes
ccatgctggccaacat

SEQ ID NO: 228528 - DNA, 16 bp, P. troglodytes
ccatgctggggtgcag

SEQ ID NO: 228529 - DNA, 16 bp, P. troglodytes
ccatgctgtgaggaag

SEQ ID NO: 228530 - DNA, 16 bp, P. troglodytes
ccatgctgttctcatg

SEQ ID NO: 228531 - DNA, 16 bp, P. troglodytes
ccatgctgtttttggt

SEQ ID NO: 228532 - DNA, 16 bp, P. troglodytes
ccatgcttcccaggct

SEQ ID NO: 228533 - DNA, 16 bp, P. troglodytes
ccatgcttttggactt

SEQ ID NO: 228534 - DNA, 16 bp, P. troglodytes
ccatggaaagtgaaac

SEQ ID NO: 228535 - DNA, 16 bp, P. troglodytes
ccatggaccacacttt

SEQ ID NO: 228536 - DNA, 16 bp, P. troglodytes
ccatggagaggaagga

SEQ ID NO: 228537 - DNA, 16 bp, P. troglodytes
ccatggagtgggtggg

SEQ ID NO: 228538 - DNA, 16 bp, P. troglodytes
ccatggataccaaaat

SEQ ID NO: 228539 - DNA, 16 bp, P. troglodytes
ccatggcacatgttta

SEQ ID NO: 228540 - DNA, 16 bp, P. troglodytes
ccatggcacccaggct

SEQ ID NO: 228541 - DNA, 16 bp, P. troglodytes
ccatggccatgaaaat

SEQ ID NO: 228542 - DNA, 16 bp, P. troglodytes
ccatggctaaaatggg

SEQ ID NO: 228543 - DNA, 19 bp, P. troglodytes
ccatggctcacacctgtaa

SEQ ID NO: 228544 - DNA, 16 bp, P. troglodytes
ccatggctcacatctg

SEQ ID NO: 228545 - DNA, 16 bp, P. troglodytes
ccatggctggagcagc

SEQ ID NO: 228546 - DNA, 16 bp, P. troglodytes
ccatggctggctcctt

SEQ ID NO: 228547 - DNA, 16 bp, P. troglodytes
ccatgggatgcaaggc

SEQ ID NO: 228548 - DNA, 16 bp, P. troglodytes
ccatgggccttgggtg

SEQ ID NO: 228549 - DNA, 16 bp, P. troglodytes
ccatggggtgcccaga

SEQ ID NO: 228550 - DNA, 16 bp, P. troglodytes
ccatgggtgtatatgt

SEQ ID NO: 228551 - DNA, 16 bp, P. troglodytes
ccatggtgaaaccctg

SEQ ID NO: 228552 - DNA, 16 bp, P. troglodytes
ccatggtgaccaggct

SEQ ID NO: 228553 - DNA, 16 bp, P. troglodytes
ccatggtgcaatctca

SEQ ID NO: 228554 - DNA, 16 bp, P. troglodytes
ccatggtgcccagcct

SEQ ID NO: 228555 - DNA, 16 bp, P. troglodytes
ccatggtgcctggcca

SEQ ID NO: 228556 - DNA, 16 bp, P. troglodytes
ccatggtggaagacag

SEQ ID NO: 228557 - DNA, 16 bp, P. troglodytes
ccatggtggcaggcac

SEQ ID NO: 228558 - DNA, 16 bp, P. troglodytes
ccatggtggccaggct

SEQ ID NO: 228559 - DNA, 16 bp, P. troglodytes
ccatggtggtgcatgc

SEQ ID NO: 228560 - DNA, 16 bp, P. troglodytes
ccatggtggtttgttg

SEQ ID NO: 228561 - DNA, 16 bp, P. troglodytes
ccatggtgtgtgtgtg

SEQ ID NO: 228562 - DNA, 16 bp, P. troglodytes
ccatggttgtttgctg

SEQ ID NO: 228563 - DNA, 16 bp, P. troglodytes
ccatgtaacaaacctg

SEQ ID NO: 228564 - DNA, 16 bp, P. troglodytes
ccatgtaaggtcacat

SEQ ID NO: 228565 - DNA, 16 bp, P. troglodytes
ccatgtctgccaggct

SEQ ID NO: 228566 - DNA, 16 bp, P. troglodytes
ccatgtctgtctgtct

SEQ ID NO: 228567 - DNA, 16 bp, P. troglodytes
ccatgtgaagaagaac

SEQ ID NO: 228568 - DNA, 16 bp, P. troglodytes
ccatgtgaagacagag

SEQ ID NO: 228569 - DNA, 16 bp, P. troglodytes
ccatgtgacacactgg

SEQ ID NO: 228570 - DNA, 16 bp, P. troglodytes
ccatgtgacctcattt

SEQ ID NO: 228571 - DNA, 16 bp, P. troglodytes
ccatgtgactggggag

SEQ ID NO: 228572 - DNA, 16 bp, P. troglodytes
ccatgtgaggacacag

SEQ ID NO: 228573 - DNA, 16 bp, P. troglodytes
ccatgtgaggatacag

SEQ ID NO: 228574 - DNA, 16 bp, P. troglodytes
ccatgtgatgccctgt

SEQ ID NO: 228575 - DNA, 16 bp, P. troglodytes
ccatgtgatgccttct

SEQ ID NO: 228576 - DNA, 16 bp, P. troglodytes
ccatgtgatttgcttt

SEQ ID NO: 228577 - DNA, 16 bp, P. troglodytes
ccatgtgctgaggaga

SEQ ID NO: 228578 - DNA, 16 bp, P. troglodytes
ccatgtgggccaggat

SEQ ID NO: 228579 - DNA, 16 bp, P. troglodytes
ccatgtgtcaggggag

SEQ ID NO: 228580 - DNA, 16 bp, P. troglodytes
ccatgtgtgcatgtgt

SEQ ID NO: 228581 - DNA, 16 bp, P. troglodytes
ccatgtgtggtggtgt

SEQ ID NO: 228582 - DNA, 16 bp, P. troglodytes
ccatgtgttttcatta

SEQ ID NO: 228583 - DNA, 16 bp, P. troglodytes
ccatgttatgatgcag

SEQ ID NO: 228584 - DNA, 16 bp, P. troglodytes
ccatgttcactttggg

SEQ ID NO: 228585 - DNA, 16 bp, P. troglodytes
ccatgttcatagcagc

SEQ ID NO: 228586 - DNA, 16 bp, P. troglodytes
ccatgttgacttctga

SEQ ID NO: 228587 - DNA, 16 bp, P. troglodytes
ccatgttgccgaggct

SEQ ID NO: 228588 - DNA, 16 bp, P. troglodytes
ccatgttgctgcatgt

SEQ ID NO: 228589 - DNA, 21 bp, P. troglodytes
ccatgttggtcaggatggtct

SEQ ID NO: 228590 - DNA, 16 bp, P. troglodytes
ccatgttgtccaggcc

SEQ ID NO: 228591 - DNA, 16 bp, P. troglodytes
ccatgtttatttattt

SEQ ID NO: 228592 - DNA, 16 bp, P. troglodytes
ccatgttttcttttct

SEQ ID NO: 228593 - DNA, 16 bp, P. troglodytes
ccatgtttttgcaaat

SEQ ID NO: 228594 - DNA, 16 bp, P. troglodytes
ccattaaaaaaatttt

SEQ ID NO: 228595 - DNA, 16 bp, P. troglodytes
ccattaaaaagaaaga

SEQ ID NO: 228596 - DNA, 16 bp, P. troglodytes
ccattaaaactctttt

SEQ ID NO: 228597 - DNA, 16 bp, P. troglodytes
ccattaaaactttatt

SEQ ID NO: 228598 - DNA, 16 bp, P. troglodytes
ccattaaaagtaatga

SEQ ID NO: 228599 - DNA, 16 bp, P. troglodytes
ccattaaaatgcaaat

SEQ ID NO: 228600 - DNA, 16 bp, P. troglodytes
ccattaagtaattttt

SEQ ID NO: 228601 - DNA, 16 bp, P. troglodytes
ccattactgccttctt

SEQ ID NO: 228602 - DNA, 16 bp, P. troglodytes
ccattagcagtcactc

SEQ ID NO: 228603 - DNA, 16 bp, P. troglodytes
ccattagttctgtccc

SEQ ID NO: 228604 - DNA, 16 bp, P. troglodytes
ccattatcttcagcaa

SEQ ID NO: 228605 - DNA, 16 bp, P. troglodytes
ccattatcttcatgtt

SEQ ID NO: 228606 - DNA, 16 bp, P. troglodytes
ccattatgcatatgtt

SEQ ID NO: 228607 - DNA, 16 bp, P. troglodytes
ccattattctcagcaa

SEQ ID NO: 228608 - DNA, 20 bp, P. troglodytes
ccattatttctgcatatcag

SEQ ID NO: 228609 - DNA, 16 bp, P. troglodytes
ccattattttcaatgg

SEQ ID NO: 228610 - DNA, 16 bp, P. troglodytes
ccattattttcttaaa

SEQ ID NO: 228611 - DNA, 16 bp, P. troglodytes
ccattattttgcattt

SEQ ID NO: 228612 - DNA, 16 bp, P. troglodytes
ccattcactcatttat

SEQ ID NO: 228613 - DNA, 16 bp, P. troglodytes
ccattcaggacacagg

SEQ ID NO: 228614 - DNA, 16 bp, P. troglodytes
ccattcaggaggctga

SEQ ID NO: 228615 - DNA, 16 bp, P. troglodytes
ccattcataattgcca

SEQ ID NO: 228616 - DNA, 16 bp, P. troglodytes
ccattcatatcctttg

SEQ ID NO: 228617 - DNA, 16 bp, P. troglodytes
ccattcatatgtcttc

SEQ ID NO: 228618 - DNA, 16 bp, P. troglodytes
ccattcatctccagaa

SEQ ID NO: 228619 - DNA, 16 bp, P. troglodytes
ccattcattcaacaaa

SEQ ID NO: 228620 - DNA, 16 bp, P. troglodytes
ccattcattcattcat

SEQ ID NO: 228621 - DNA, 16 bp, P. troglodytes
ccattcatttgctgat

SEQ ID NO: 228622 - DNA, 16 bp, P. troglodytes
ccattccactccactc

SEQ ID NO: 228623 - DNA, 16 bp, P. troglodytes
ccattcccctgcctca

SEQ ID NO: 228624 - DNA, 16 bp, P. troglodytes
ccattcctactaaaaa

SEQ ID NO: 228625 - DNA, 16 bp, P. troglodytes
ccattcctcagggtga

SEQ ID NO: 228626 - DNA, 16 bp, P. troglodytes
ccattcctctgtcctc

SEQ ID NO: 228627 - DNA, 16 bp, P. troglodytes
ccattcctgctgctat

SEQ ID NO: 228628 - DNA, 16 bp, P. troglodytes
ccattcctttattttg

SEQ ID NO: 228629 - DNA, 16 bp, P. troglodytes
ccattcgtgagggatc

SEQ ID NO: 228630 - DNA, 16 bp, P. troglodytes
ccattctaacaggtat

SEQ ID NO: 228631 - DNA, 16 bp, P. troglodytes
ccattctcctgctgca

SEQ ID NO: 228632 - DNA, 16 bp, P. troglodytes
ccattctccttcctca

SEQ ID NO: 228633 - DNA, 16 bp, P. troglodytes
ccattctgagtggtgt

SEQ ID NO: 228634 - DNA, 16 bp, P. troglodytes
ccattctggggcctgg

SEQ ID NO: 228635 - DNA, 16 bp, P. troglodytes
ccattctgtgcctttt

SEQ ID NO: 228636 - DNA, 16 bp, P. troglodytes
ccattctgttttccat

SEQ ID NO: 228637 - DNA, 16 bp, P. troglodytes
ccattcttcccatctc

SEQ ID NO: 228638 - DNA, 16 bp, P. troglodytes
ccattcttctgcttca

SEQ ID NO: 228639 - DNA, 16 bp, P. troglodytes
ccattcttttttatgg

SEQ ID NO: 228640 - DNA, 16 bp, P. troglodytes
ccattgaagatgccat

SEQ ID NO: 228641 - DNA, 16 bp, P. troglodytes
ccattgaattgtacac

SEQ ID NO: 228642 - DNA, 16 bp, P. troglodytes
ccattgcacctggccc

SEQ ID NO: 228643 - DNA, 16 bp, P. troglodytes
ccattgcacctggccg

SEQ ID NO: 228644 - DNA, 16 bp, P. troglodytes
ccattgcactccagat

SEQ ID NO: 228645 - DNA, 16 bp, P. troglodytes
ccattgcactccagca

SEQ ID NO: 228646 - DNA, 16 bp, P. troglodytes
ccattgcactccagct

SEQ ID NO: 228647 - DNA, 16 bp, P. troglodytes
ccattgcactccatcc

SEQ ID NO: 228648 - DNA, 16 bp, P. troglodytes
ccattgcccaggctga

SEQ ID NO: 228649 - DNA, 16 bp, P. troglodytes
ccattgcccaggcttg

SEQ ID NO: 228650 - DNA, 16 bp, P. troglodytes
ccattgcgttccagcc

SEQ ID NO: 228651 - DNA, 16 bp, P. troglodytes
ccattgctctccagcc

SEQ ID NO: 228652 - DNA, 16 bp, P. troglodytes
ccattgctgataccct

SEQ ID NO: 228653 - DNA, 16 bp, P. troglodytes
ccattgcttcagaagg

SEQ ID NO: 228654 - DNA, 16 bp, P. troglodytes
ccattgcttgcattac

SEQ ID NO: 228655 - DNA, 16 bp, P. troglodytes
ccattgtactccagct

SEQ ID NO: 228656 - DNA, 16 bp, P. troglodytes
ccattgtagagttatt

SEQ ID NO: 228657 - DNA, 16 bp, P. troglodytes
ccattgtatatttttg

SEQ ID NO: 228658 - DNA, 16 bp, P. troglodytes
ccattgtcaacattag

SEQ ID NO: 228659 - DNA, 16 bp, P. troglodytes
ccattgtgcccagcca

SEQ ID NO: 228660 - DNA, 16 bp, P. troglodytes
ccattgttgaccaaaa

SEQ ID NO: 228661 - DNA, 16 bp, P. troglodytes
ccattgtttataaatt

SEQ ID NO: 228662 - DNA, 16 bp, P. troglodytes
ccatttaaaaatcaga

SEQ ID NO: 228663 - DNA, 16 bp, P. troglodytes
ccatttaaaaattgga

SEQ ID NO: 228664 - DNA, 16 bp, P. troglodytes
ccatttaaaaattttt

SEQ ID NO: 228665 - DNA, 16 bp, P. troglodytes
ccatttaacagatgag

SEQ ID NO: 228666 - DNA, 16 bp, P. troglodytes
ccatttaaccagtctc

SEQ ID NO: 228667 - DNA, 16 bp, P. troglodytes
ccatttaagtctttaa

SEQ ID NO: 228668 - DNA, 16 bp, P. troglodytes
ccatttaatttttgta

SEQ ID NO: 228669 - DNA, 16 bp, P. troglodytes
ccatttacatagcatt

SEQ ID NO: 228670 - DNA, 16 bp, P. troglodytes
ccatttacatttcagg

SEQ ID NO: 228671 - DNA, 16 bp, P. troglodytes
ccatttcaaaacaaaa

SEQ ID NO: 228672 - DNA, 16 bp, P. troglodytes
ccatttcacagaagag

SEQ ID NO: 228673 - DNA, 16 bp, P. troglodytes
ccatttcacagatgag

SEQ ID NO: 228674 - DNA, 16 bp, P. troglodytes
ccatttcatagatgaa

SEQ ID NO: 228675 - DNA, 16 bp, P. troglodytes
ccatttcatttcttat

SEQ ID NO: 228676 - DNA, 16 bp, P. troglodytes
ccatttccaaataagg

SEQ ID NO: 228677 - DNA, 16 bp, P. troglodytes
ccatttccaagacaaa

SEQ ID NO: 228678 - DNA, 16 bp, P. troglodytes
ccatttcccaggctca

SEQ ID NO: 228679 - DNA, 16 bp, P. troglodytes
ccatttcctcttctgt

SEQ ID NO: 228680 - DNA, 16 bp, P. troglodytes
ccatttcctggggaga

SEQ ID NO: 228681 - DNA, 16 bp, P. troglodytes
ccatttctacaaagaa

SEQ ID NO: 228682 - DNA, 16 bp, P. troglodytes
ccatttctccaagaag

SEQ ID NO: 228683 - DNA, 16 bp, P. troglodytes
ccatttctccatttct

SEQ ID NO: 228684 - DNA, 16 bp, P. troglodytes
ccatttcttctagatt

SEQ ID NO: 228685 - DNA, 16 bp, P. troglodytes
ccatttcttgtttttc

SEQ ID NO: 228686 - DNA, 16 bp, P. troglodytes
ccatttgagccagcaa

SEQ ID NO: 228687 - DNA, 16 bp, P. troglodytes
ccatttgatagatgag

SEQ ID NO: 228688 - DNA, 16 bp, P. troglodytes
ccatttgatgatggag

SEQ ID NO: 228689 - DNA, 16 bp, P. troglodytes
ccatttgccccaagaa

SEQ ID NO: 228690 - DNA, 16 bp, P. troglodytes
ccatttgggcagacac

SEQ ID NO: 228691 - DNA, 16 bp, P. troglodytes
ccatttggtccagcaa

SEQ ID NO: 228692 - DNA, 16 bp, P. troglodytes
ccatttgtaaattttt

SEQ ID NO: 228693 - DNA, 16 bp, P. troglodytes
ccatttgtatgaaatt

SEQ ID NO: 228694 - DNA, 16 bp, P. troglodytes
ccatttgtatgacttc

SEQ ID NO: 228695 - DNA, 16 bp, P. troglodytes
ccatttgtccatgttt

SEQ ID NO: 228696 - DNA, 16 bp, P. troglodytes
ccattttaaagaagaa

SEQ ID NO: 228697 - DNA, 16 bp, P. troglodytes
ccattttaactgtttt

SEQ ID NO: 228698 - DNA, 16 bp, P. troglodytes
ccattttaatcttgct

SEQ ID NO: 228699 - DNA, 16 bp, P. troglodytes
ccattttacaaaagag

SEQ ID NO: 228700 - DNA, 16 bp, P. troglodytes
ccattttacagaggag

SEQ ID NO: 228701 - DNA, 16 bp, P. troglodytes
ccattttacagataag

SEQ ID NO: 228702 - DNA, 16 bp, P. troglodytes
ccattttacagatgga

SEQ ID NO: 228703 - DNA, 16 bp, P. troglodytes
ccattttacagatggg

SEQ ID NO: 228704 - DNA, 16 bp, P. troglodytes
ccattttacaggtgag

SEQ ID NO: 228705 - DNA, 16 bp, P. troglodytes
ccattttacatgtgag

SEQ ID NO: 228706 - DNA, 16 bp, P. troglodytes
ccattttataaaagag

SEQ ID NO: 228707 - DNA, 16 bp, P. troglodytes
ccattttataagtgag

SEQ ID NO: 228708 - DNA, 16 bp, P. troglodytes
ccattttatagatgaa

SEQ ID NO: 228709 - DNA, 16 bp, P. troglodytes
ccattttatagattag

SEQ ID NO: 228710 - DNA, 16 bp, P. troglodytes
ccattttatatttcca

SEQ ID NO: 228711 - DNA, 16 bp, P. troglodytes
ccattttattgtttta

SEQ ID NO: 228712 - DNA, 16 bp, P. troglodytes
ccattttcaaactgct

SEQ ID NO: 228713 - DNA, 16 bp, P. troglodytes
ccattttcaccatatt

SEQ ID NO: 228714 - DNA, 16 bp, P. troglodytes
ccattttcattatatt

SEQ ID NO: 228715 - DNA, 16 bp, P. troglodytes
ccattttccaaataaa

SEQ ID NO: 228716 - DNA, 16 bp, P. troglodytes
ccattttcttgctttt

SEQ ID NO: 228717 - DNA, 16 bp, P. troglodytes
ccattttgagttattt

SEQ ID NO: 228718 - DNA, 16 bp, P. troglodytes
ccattttgcagatgga

SEQ ID NO: 228719 - DNA, 16 bp, P. troglodytes
ccattttgctgatgtc

SEQ ID NO: 228720 - DNA, 16 bp, P. troglodytes
ccattttggaaaactg

SEQ ID NO: 228721 - DNA, 16 bp, P. troglodytes
ccattttggttaggga

SEQ ID NO: 228722 - DNA, 16 bp, P. troglodytes
ccattttgtatctttt

SEQ ID NO: 228723 - DNA, 16 bp, P. troglodytes
ccatttttaaatcaag

SEQ ID NO: 228724 - DNA, 16 bp, P. troglodytes
ccatttttatgtccat

SEQ ID NO: 228725 - DNA, 16 bp, P. troglodytes
ccatttttgttaaaaa

SEQ ID NO: 228726 - DNA, 16 bp, P. troglodytes
ccattttttaaaaaaa

SEQ ID NO: 228727 - DNA, 16 bp, P. troglodytes
ccattttttaagtgta

SEQ ID NO: 228728 - DNA, 16 bp, P. troglodytes
ccattttttgaggaga

SEQ ID NO: 228729 - DNA, 16 bp, P. troglodytes
ccatttttttgtgtgt

SEQ ID NO: 228730 - DNA, 16 bp, P. troglodytes
cccaaaaacctatgga

SEQ ID NO: 228731 - DNA, 16 bp, P. troglodytes
cccaaaacaattataa

SEQ ID NO: 228732 - DNA, 16 bp, P. troglodytes
cccaaaagacacaatc

SEQ ID NO: 228733 - DNA, 16 bp, P. troglodytes
cccaaaagattataaa

SEQ ID NO: 228734 - DNA, 16 bp, P. troglodytes
cccaaaagtgctggga

SEQ ID NO: 228735 - DNA, 16 bp, P. troglodytes
cccaaaagtggaattg

SEQ ID NO: 228736 - DNA, 16 bp, P. troglodytes
cccaaaatgcagggat

SEQ ID NO: 228737 - DNA, 16 bp, P. troglodytes
cccaaaatgctggatt

SEQ ID NO: 228738 - DNA, 16 bp, P. troglodytes
cccaaaccccagcatc

SEQ ID NO: 228739 - DNA, 16 bp, P. troglodytes
cccaaactgaaactct

SEQ ID NO: 228740 - DNA, 16 bp, P. troglodytes
cccaaactggagtgca

SEQ ID NO: 228741 - DNA, 16 bp, P. troglodytes
cccaaactgggtaatt

SEQ ID NO: 228742 - DNA, 16 bp, P. troglodytes
cccaaagaaatacaaa

SEQ ID NO: 228743 - DNA, 16 bp, P. troglodytes
cccaaagaaatgaaat

SEQ ID NO: 228744 - DNA, 16 bp, P. troglodytes
cccaaagaactgaaaa

SEQ ID NO: 228745 - DNA, 16 bp, P. troglodytes
cccaaagaccccacct

SEQ ID NO: 228746 - DNA, 16 bp, P. troglodytes
cccaaagattctgatt

SEQ ID NO: 228747 - DNA, 16 bp, P. troglodytes
cccaaagccttgggca

SEQ ID NO: 228748 - DNA, 16 bp, P. troglodytes
cccaaagctctggaat

SEQ ID NO: 228749 - DNA, 16 bp, P. troglodytes
cccaaaggaaaagaag

SEQ ID NO: 228750 - DNA, 16 bp, P. troglodytes
cccaaaggaattgaaa

SEQ ID NO: 228751 - DNA, 16 bp, P. troglodytes
cccaaagtccattaca

SEQ ID NO: 228752 - DNA, 16 bp, P. troglodytes
cccaaagtcttaactt

SEQ ID NO: 228753 - DNA, 16 bp, P. troglodytes
cccaaagtgcctggga

SEQ ID NO: 228754 - DNA, 16 bp, P. troglodytes
cccaaagtgctggact

SEQ ID NO: 228755 - DNA, 16 bp, P. troglodytes
cccaaagtgctggagt

SEQ ID NO: 228756 - DNA, 16 bp, P. troglodytes
cccaaagtgctgggga

SEQ ID NO: 228757 - DNA, 16 bp, P. troglodytes
cccaaagtggccattt

SEQ ID NO: 228758 - DNA, 16 bp, P. troglodytes
cccaaagtgtaggatt

SEQ ID NO: 228759 - DNA, 16 bp, P. troglodytes
cccaaataaaatcaga

SEQ ID NO: 228760 - DNA, 16 bp, P. troglodytes
cccaaatactgtgctg

SEQ ID NO: 228761 - DNA, 17 bp, P. troglodytes
cccaaatagctgggatc

SEQ ID NO: 228762 - DNA, 16 bp, P. troglodytes
cccaaatcctataaaa

SEQ ID NO: 228763 - DNA, 16 bp, P. troglodytes
cccaaatctcacaaat

SEQ ID NO: 228764 - DNA, 16 bp, P. troglodytes
cccaaatgtccatcca

SEQ ID NO: 228765 - DNA, 16 bp, P. troglodytes
cccaaatgttgcattt

SEQ ID NO: 228766 - DNA, 16 bp, P. troglodytes
cccaaattcctgggct

SEQ ID NO: 228767 - DNA, 16 bp, P. troglodytes
cccaaatttgaatgtt

SEQ ID NO: 228768 - DNA, 16 bp, P. troglodytes
cccaacaagctcctca

SEQ ID NO: 228769 - DNA, 16 bp, P. troglodytes
cccaacactgttgcac

SEQ ID NO: 228770 - DNA, 16 bp, P. troglodytes
cccaacacttcaggag

SEQ ID NO: 228771 - DNA, 17 bp, P. troglodytes
cccaacactttaccact

SEQ ID NO: 228772 - DNA, 17 bp, P. troglodytes
cccaacatggtgaaacc

SEQ ID NO: 228773 - DNA, 16 bp, P. troglodytes
cccaacattataacaa

SEQ ID NO: 228774 - DNA, 24 bp, P. troglodytes
cccaacattttgggaggccaaggc

SEQ ID NO: 228775 - DNA, 16 bp, P. troglodytes
cccaaccacgtggaac

SEQ ID NO: 228776 - DNA, 16 bp, P. troglodytes
cccaacccctgagcca

SEQ ID NO: 228777 - DNA, 16 bp, P. troglodytes
cccaacctcagctgat

SEQ ID NO: 228778 - DNA, 16 bp, P. troglodytes
cccaacctcaggcaat

SEQ ID NO: 228779 - DNA, 16 bp, P. troglodytes
cccaacctcccaggct

SEQ ID NO: 228780 - DNA, 16 bp, P. troglodytes
cccaacctgggcaaca

SEQ ID NO: 228781 - DNA, 16 bp, P. troglodytes
cccaacctttttggca

SEQ ID NO: 228782 - DNA, 16 bp, P. troglodytes
cccaactacatgggag

SEQ ID NO: 228783 - DNA, 16 bp, P. troglodytes
cccaactcagcctcct

SEQ ID NO: 228784 - DNA, 16 bp, P. troglodytes
cccaactcctggcctc

SEQ ID NO: 228785 - DNA, 16 bp, P. troglodytes
cccaactctacaaaaa

SEQ ID NO: 228786 - DNA, 16 bp, P. troglodytes
cccaactctttgggag

SEQ ID NO: 228787 - DNA, 16 bp, P. troglodytes
cccaagaaaattgaaa

SEQ ID NO: 228788 - DNA, 16 bp, P. troglodytes
cccaagaagattctgt

SEQ ID NO: 228789 - DNA, 16 bp, P. troglodytes
cccaagaagcagagaa

SEQ ID NO: 228790 - DNA, 16 bp, P. troglodytes
cccaagactacaccag

SEQ ID NO: 228791 - DNA, 16 bp, P. troglodytes
cccaagaggtggaggc

SEQ ID NO: 228792 - DNA, 16 bp, P. troglodytes
cccaagagttagagac

SEQ ID NO: 228793 - DNA, 16 bp, P. troglodytes
cccaagatggtggtgg

SEQ ID NO: 228794 - DNA, 16 bp, P. troglodytes
cccaagcatgtgcaca

SEQ ID NO: 228795 - DNA, 16 bp, P. troglodytes
cccaagccatgcagaa

SEQ ID NO: 228796 - DNA, 16 bp, P. troglodytes
cccaagccatgtggaa

SEQ ID NO: 228797 - DNA, 16 bp, P. troglodytes
cccaagccctgccccg

SEQ ID NO: 228798 - DNA, 16 bp, P. troglodytes
cccaagccctgccctg

SEQ ID NO: 228799 - DNA, 16 bp, P. troglodytes
cccaagccctggcagc

SEQ ID NO: 228800 - DNA, 16 bp, P. troglodytes
cccaagctctacattg

SEQ ID NO: 228801 - DNA, 16 bp, P. troglodytes
cccaagctggagagca

SEQ ID NO: 228802 - DNA, 16 bp, P. troglodytes
cccaagctggagtgaa

SEQ ID NO: 228803 - DNA, 16 bp, P. troglodytes
cccaagctggagttca

SEQ ID NO: 228804 - DNA, 16 bp, P. troglodytes
cccaaggccctggtgg

SEQ ID NO: 228805 - DNA, 16 bp, P. troglodytes
cccaaggccttgggag

SEQ ID NO: 228806 - DNA, 16 bp, P. troglodytes
cccaagggaggtcccc

SEQ ID NO: 228807 - DNA, 18 bp, P. troglodytes
cccaagggctgaggagtg

SEQ ID NO: 228808 - DNA, 16 bp, P. troglodytes
cccaagggttcaagaa

SEQ ID NO: 228809 - DNA, 17 bp, P. troglodytes
cccaaggtcacacagcc

SEQ ID NO: 228810 - DNA, 16 bp, P. troglodytes
cccaaggtcacacggc

SEQ ID NO: 228811 - DNA, 16 bp, P. troglodytes
cccaaggtcacagggc

SEQ ID NO: 228812 - DNA, 16 bp, P. troglodytes
cccaaggtcaggagtt

SEQ ID NO: 228813 - DNA, 16 bp, P. troglodytes
cccaaggtcatgcagc

SEQ ID NO: 228814 - DNA, 16 bp, P. troglodytes
cccaaggtgatggtat

SEQ ID NO: 228815 - DNA, 16 bp, P. troglodytes
cccaaggtgctgggag

SEQ ID NO: 228816 - DNA, 16 bp, P. troglodytes
cccaaggttgcacagc

SEQ ID NO: 228817 - DNA, 16 bp, P. troglodytes
cccaagtactcaggag

SEQ ID NO: 228818 - DNA, 16 bp, P. troglodytes
cccaagtagccgggac

SEQ ID NO: 228819 - DNA, 16 bp, P. troglodytes
cccaagtagctggggc

SEQ ID NO: 228820 - DNA, 16 bp, P. troglodytes
cccaagtagttgggag

SEQ ID NO: 228821 - DNA, 16 bp, P. troglodytes
cccaagtatataaagc

SEQ ID NO: 228822 - DNA, 16 bp, P. troglodytes
cccaagtgctgttggg

SEQ ID NO: 228823 - DNA, 16 bp, P. troglodytes
cccaagtggcagagca

SEQ ID NO: 228824 - DNA, 16 bp, P. troglodytes
cccaagtgtccaacaa

SEQ ID NO: 228825 - DNA, 16 bp, P. troglodytes
cccaagttggagtgca

SEQ ID NO: 228826 - DNA, 16 bp, P. troglodytes
cccaatagttatattt

SEQ ID NO: 228827 - DNA, 16 bp, P. troglodytes
cccaatcaaaagaaag

SEQ ID NO: 228828 - DNA, 16 bp, P. troglodytes
cccaatcatagctcac

SEQ ID NO: 228829 - DNA, 16 bp, P. troglodytes
cccaatctcaggcagt

SEQ ID NO: 228830 - DNA, 16 bp, P. troglodytes
cccaatctgtggtatt

SEQ ID NO: 228831 - DNA, 16 bp, P. troglodytes
cccaatcttcagcaac

SEQ ID NO: 228832 - DNA, 16 bp, P. troglodytes
cccaatgctctccctc

SEQ ID NO: 228833 - DNA, 16 bp, P. troglodytes
cccaattatttatttt

SEQ ID NO: 228834 - DNA, 16 bp, P. troglodytes
cccaattcttctccac

SEQ ID NO: 228835 - DNA, 16 bp, P. troglodytes
cccacaaaatgagaga

SEQ ID NO: 228836 - DNA, 16 bp, P. troglodytes
cccacaaccaatcaga

SEQ ID NO: 228837 - DNA, 16 bp, P. troglodytes
cccacaagagaaagaa

SEQ ID NO: 228838 - DNA, 16 bp, P. troglodytes
cccacaaggaaattcc

SEQ ID NO: 228839 - DNA, 16 bp, P. troglodytes
cccacaaggaatttcc

SEQ ID NO: 228840 - DNA, 16 bp, P. troglodytes
cccacaaggtccctcc

SEQ ID NO: 228841 - DNA, 16 bp, P. troglodytes
cccacaataggccatc

SEQ ID NO: 228842 - DNA, 16 bp, P. troglodytes
cccacacaaagtccct

SEQ ID NO: 228843 - DNA, 16 bp, P. troglodytes
cccacacatgcacaca

SEQ ID NO: 228844 - DNA, 16 bp, P. troglodytes
cccacacctgcacaca

SEQ ID NO: 228845 - DNA, 16 bp, P. troglodytes
cccacactgtcttcca

SEQ ID NO: 228846 - DNA, 16 bp, P. troglodytes
cccacagaaatacaaa

SEQ ID NO: 228847 - DNA, 16 bp, P. troglodytes
cccacagaatcatgag

SEQ ID NO: 228848 - DNA, 16 bp, P. troglodytes
cccacagcccagcctc

SEQ ID NO: 228849 - DNA, 16 bp, P. troglodytes
cccacagctctggagg

SEQ ID NO: 228850 - DNA, 16 bp, P. troglodytes
cccacagctgcccctt

SEQ ID NO: 228851 - DNA, 16 bp, P. troglodytes
cccacaggcacaggca

SEQ ID NO: 228852 - DNA, 16 bp, P. troglodytes
cccacagggcttttcc

SEQ ID NO: 228853 - DNA, 16 bp, P. troglodytes
cccacagtgctggggt

SEQ ID NO: 228854 - DNA, 16 bp, P. troglodytes
cccacatcaaaggcag

SEQ ID NO: 228855 - DNA, 16 bp, P. troglodytes
cccacatcagcctccc

SEQ ID NO: 228856 - DNA, 16 bp, P. troglodytes
cccacatctcagacaa

SEQ ID NO: 228857 - DNA, 16 bp, P. troglodytes
cccacatttctcttcc

SEQ ID NO: 228858 - DNA, 16 bp, P. troglodytes
cccacattttcatttt

SEQ ID NO: 228859 - DNA, 16 bp, P. troglodytes
cccaccaagagtcacc

SEQ ID NO: 228860 - DNA, 16 bp, P. troglodytes
cccaccaagcccagct

SEQ ID NO: 228861 - DNA, 16 bp, P. troglodytes
cccaccacagccttcc

SEQ ID NO: 228862 - DNA, 20 bp, P. troglodytes
cccaccacagtccccagagt

SEQ ID NO: 228863 - DNA, 16 bp, P. troglodytes
cccaccaccactcctg

SEQ ID NO: 228864 - DNA, 16 bp, P. troglodytes
cccaccaccactgcca

SEQ ID NO: 228865 - DNA, 16 bp, P. troglodytes
cccaccacccttgcca

SEQ ID NO: 228866 - DNA, 16 bp, P. troglodytes
cccaccaccttgccca

SEQ ID NO: 228867 - DNA, 16 bp, P. troglodytes
cccaccaccttgctcc

SEQ ID NO: 228868 - DNA, 16 bp, P. troglodytes
cccaccactgccactg

SEQ ID NO: 228869 - DNA, 16 bp, P. troglodytes
cccaccaggcctcacc

SEQ ID NO: 228870 - DNA, 16 bp, P. troglodytes
cccaccaggtccatcc

SEQ ID NO: 228871 - DNA, 16 bp, P. troglodytes
cccaccaggtcctgcc

SEQ ID NO: 228872 - DNA, 16 bp, P. troglodytes
cccaccatctcagccc

SEQ ID NO: 228873 - DNA, 16 bp, P. troglodytes
cccaccatctgggaag

SEQ ID NO: 228874 - DNA, 16 bp, P. troglodytes
cccaccatgcctggct

SEQ ID NO: 228875 - DNA, 16 bp, P. troglodytes
cccaccatggcctccc

SEQ ID NO: 228876 - DNA, 16 bp, P. troglodytes
cccaccattgccgagg

SEQ ID NO: 228877 - DNA, 16 bp, P. troglodytes
cccacccacacccagt

SEQ ID NO: 228878 - DNA, 16 bp, P. troglodytes
cccacccacagaggga

SEQ ID NO: 228879 - DNA, 16 bp, P. troglodytes
cccacccactttggcc

SEQ ID NO: 228880 - DNA, 16 bp, P. troglodytes
cccacccagaagcaga

SEQ ID NO: 228881 - DNA, 16 bp, P. troglodytes
cccacccaggctggag

SEQ ID NO: 228882 - DNA, 16 bp, P. troglodytes
cccacccatggccacc

SEQ ID NO: 228883 - DNA, 16 bp, P. troglodytes
cccaccccagccctgg

SEQ ID NO: 228884 - DNA, 16 bp, P. troglodytes
cccacccccagagatt

SEQ ID NO: 228885 - DNA, 16 bp, P. troglodytes
cccacccccagagttt

SEQ ID NO: 228886 - DNA, 16 bp, P. troglodytes
cccacccccagctctg

SEQ ID NO: 228887 - DNA, 16 bp, P. troglodytes
cccacccctgccctgg

SEQ ID NO: 228888 - DNA, 23 bp, P. troglodytes
cccacccggaactccagctggcc

SEQ ID NO: 228889 - DNA, 16 bp, P. troglodytes
cccaccctctggtaac

SEQ ID NO: 228890 - DNA, 16 bp, P. troglodytes
cccaccctggcctctc

SEQ ID NO: 228891 - DNA, 16 bp, P. troglodytes
cccaccctgtgtccac

SEQ ID NO: 228892 - DNA, 16 bp, P. troglodytes
cccacccttctgagtc

SEQ ID NO: 228893 - DNA, 17 bp, P. troglodytes
cccacccttgagaatgt

SEQ ID NO: 228894 - DNA, 16 bp, P. troglodytes
cccaccgccatgcctg

SEQ ID NO: 228895 - DNA, 16 bp, P. troglodytes
cccaccgggtccctcc

SEQ ID NO: 228896 - DNA, 16 bp, P. troglodytes
cccacctaggcctccc

SEQ ID NO: 228897 - DNA, 23 bp, P. troglodytes
cccacctatgagtgagaatatgc

SEQ ID NO: 228898 - DNA, 16 bp, P. troglodytes
cccacctcagactccc

SEQ ID NO: 228899 - DNA, 16 bp, P. troglodytes
cccacctcagcatctc

SEQ ID NO: 228900 - DNA, 16 bp, P. troglodytes
cccacctcagccatcc

SEQ ID NO: 228901 - DNA, 16 bp, P. troglodytes
cccacctcagccctct

SEQ ID NO: 228902 - DNA, 16 bp, P. troglodytes
cccacctcagcgtcct

SEQ ID NO: 228903 - DNA, 16 bp, P. troglodytes
cccacctcagcttccc

SEQ ID NO: 228904 - DNA, 16 bp, P. troglodytes
cccacctcaggcctcc

SEQ ID NO: 228905 - DNA, 16 bp, P. troglodytes
cccacctcaggctcct

SEQ ID NO: 228906 - DNA, 16 bp, P. troglodytes
cccacctcagggcctt

SEQ ID NO: 228907 - DNA, 16 bp, P. troglodytes
cccacctcagtctcca

SEQ ID NO: 228908 - DNA, 16 bp, P. troglodytes
cccacctccaaccctg

SEQ ID NO: 228909 - DNA, 16 bp, P. troglodytes
cccacctccacctctg

SEQ ID NO: 228910 - DNA, 16 bp, P. troglodytes
cccacctcccaagtag

SEQ ID NO: 228911 - DNA, 16 bp, P. troglodytes
cccacctcccgacagg

SEQ ID NO: 228912 - DNA, 16 bp, P. troglodytes
cccacctccctcctgg

SEQ ID NO: 228913 - DNA, 16 bp, P. troglodytes
cccacctcctccagga

SEQ ID NO: 228914 - DNA, 16 bp, P. troglodytes
cccacctcctggtatt

SEQ ID NO: 228915 - DNA, 16 bp, P. troglodytes
cccacctcggcctcct

SEQ ID NO: 228916 - DNA, 16 bp, P. troglodytes
cccacctcggtctccc

SEQ ID NO: 228917 - DNA, 16 bp, P. troglodytes
cccacctcggtctcct

SEQ ID NO: 228918 - DNA, 16 bp, P. troglodytes
cccacctctaaaaaaa

SEQ ID NO: 228919 - DNA, 16 bp, P. troglodytes
cccacctctacagaaa

SEQ ID NO: 228920 - DNA, 16 bp, P. troglodytes
cccacctctcagcctc

SEQ ID NO: 228921 - DNA, 16 bp, P. troglodytes
cccacctctgcctcct

SEQ ID NO: 228922 - DNA, 16 bp, P. troglodytes
cccacctgcctctgcc

SEQ ID NO: 228923 - DNA, 16 bp, P. troglodytes
cccaccttcagcctcc

SEQ ID NO: 228924 - DNA, 16 bp, P. troglodytes
cccaccttggccccca

SEQ ID NO: 228925 - DNA, 16 bp, P. troglodytes
cccaccttggccctcc

SEQ ID NO: 228926 - DNA, 16 bp, P. troglodytes
cccaccttggcctcct

SEQ ID NO: 228927 - DNA, 16 bp, P. troglodytes
cccaccttggcctctc

SEQ ID NO: 228928 - DNA, 16 bp, P. troglodytes
cccaccttgtcctccc

SEQ ID NO: 228929 - DNA, 16 bp, P. troglodytes
cccaccttgtcttccc

SEQ ID NO: 228930 - DNA, 16 bp, P. troglodytes
cccacctttactaaaa

SEQ ID NO: 228931 - DNA, 16 bp, P. troglodytes
cccacctttgagtggt

SEQ ID NO: 228932 - DNA, 19 bp, P. troglodytes
cccacgcccagctaatttt

SEQ ID NO: 228933 - DNA, 18 bp, P. troglodytes
cccacgcctggctaattt

SEQ ID NO: 228934 - DNA, 16 bp, P. troglodytes
cccacgctggaatgca

SEQ ID NO: 228935 - DNA, 16 bp, P. troglodytes
cccacgctggagtgca

SEQ ID NO: 228936 - DNA, 16 bp, P. troglodytes
cccacggtctccctct

SEQ ID NO: 228937 - DNA, 16 bp, P. troglodytes
cccactaccacacctg

SEQ ID NO: 228938 - DNA, 16 bp, P. troglodytes
cccactattattgtgt

SEQ ID NO: 228939 - DNA, 16 bp, P. troglodytes
cccactcatgagggct

SEQ ID NO: 228940 - DNA, 16 bp, P. troglodytes
cccactccagcctggg

SEQ ID NO: 228941 - DNA, 17 bp, P. troglodytes
cccactccctcagcttg

SEQ ID NO: 228942 - DNA, 16 bp, P. troglodytes
cccactcctcagtacc

SEQ ID NO: 228943 - DNA, 16 bp, P. troglodytes
cccactctacagatga

SEQ ID NO: 228944 - DNA, 16 bp, P. troglodytes
cccactctgtccccca

SEQ ID NO: 228945 - DNA, 16 bp, P. troglodytes
cccactgacctgcacc

SEQ ID NO: 228946 - DNA, 16 bp, P. troglodytes
cccactgagcaccttg

SEQ ID NO: 228947 - DNA, 16 bp, P. troglodytes
cccactgcagccagca

SEQ ID NO: 228948 - DNA, 16 bp, P. troglodytes
cccactgccaccacca

SEQ ID NO: 228949 - DNA, 16 bp, P. troglodytes
cccactgcccttccca

SEQ ID NO: 228950 - DNA, 16 bp, P. troglodytes
cccactgcctggcaca

SEQ ID NO: 228951 - DNA, 16 bp, P. troglodytes
cccactgctgctgctg

SEQ ID NO: 228952 - DNA, 16 bp, P. troglodytes
cccactggggcttcag

SEQ ID NO: 228953 - DNA, 16 bp, P. troglodytes
cccactggttccctcc

SEQ ID NO: 228954 - DNA, 16 bp, P. troglodytes
cccactgtctcagccc

SEQ ID NO: 228955 - DNA, 16 bp, P. troglodytes
cccactgtctgacact

SEQ ID NO: 228956 - DNA, 32 bp, P. troglodytes
cccactgtctggcactccctagtgagatgaac

SEQ ID NO: 228957 - DNA, 16 bp, P. troglodytes
cccactgtctgggaag

SEQ ID NO: 228958 - DNA, 16 bp, P. troglodytes
cccactgtctgttttt

SEQ ID NO: 228959 - DNA, 16 bp, P. troglodytes
cccacttcagccccct

SEQ ID NO: 228960 - DNA, 16 bp, P. troglodytes
cccactttatagataa

SEQ ID NO: 228961 - DNA, 16 bp, P. troglodytes
cccactttggcatccc

SEQ ID NO: 228962 - DNA, 16 bp, P. troglodytes
cccactttggcctccc

SEQ ID NO: 228963 - DNA, 16 bp, P. troglodytes
cccactttgttctttt

SEQ ID NO: 228964 - DNA, 16 bp, P. troglodytes
cccactttttgctggg

SEQ ID NO: 228965 - DNA, 16 bp, P. troglodytes
cccagaaaaccctaaa

SEQ ID NO: 228966 - DNA, 16 bp, P. troglodytes
cccagaaaatgagttt

SEQ ID NO: 228967 - DNA, 16 bp, P. troglodytes
cccagaaactcaggag

SEQ ID NO: 228968 - DNA, 16 bp, P. troglodytes
cccagaaataaacaat

SEQ ID NO: 228969 - DNA, 16 bp, P. troglodytes
cccagaaataagacca

SEQ ID NO: 228970 - DNA, 16 bp, P. troglodytes
cccagaaatttgaggc

SEQ ID NO: 228971 - DNA, 16 bp, P. troglodytes
cccagaaccaaagcca

SEQ ID NO: 228972 - DNA, 16 bp, P. troglodytes
cccagaacttggggag

SEQ ID NO: 228973 - DNA, 16 bp, P. troglodytes
cccagaagaagatggc

SEQ ID NO: 228974 - DNA, 16 bp, P. troglodytes
cccagaagcagatgcc

SEQ ID NO: 228975 - DNA, 16 bp, P. troglodytes
cccagaaggagaagag

SEQ ID NO: 228976 - DNA, 16 bp, P. troglodytes
cccagaaggccaaggc

SEQ ID NO: 228977 - DNA, 16 bp, P. troglodytes
cccagaaggtcaagac

SEQ ID NO: 228978 - DNA, 16 bp, P. troglodytes
cccagaagttcaaagc

SEQ ID NO: 228979 - DNA, 16 bp, P. troglodytes
cccagaatagccaaag

SEQ ID NO: 228980 - DNA, 16 bp, P. troglodytes
cccagaatgtgactgt

SEQ ID NO: 228981 - DNA, 16 bp, P. troglodytes
cccagacacctggaat

SEQ ID NO: 228982 - DNA, 16 bp, P. troglodytes
cccagacccttcagga

SEQ ID NO: 228983 - DNA, 16 bp, P. troglodytes
cccagacctgctgaat

SEQ ID NO: 228984 - DNA, 17 bp, P. troglodytes
cccagacggggcggctg

SEQ ID NO: 228985 - DNA, 16 bp, P. troglodytes
cccagactcagcctca

SEQ ID NO: 228986 - DNA, 16 bp, P. troglodytes
cccagactggaatgca

SEQ ID NO: 228987 - DNA, 16 bp, P. troglodytes
cccagactggagtaca

SEQ ID NO: 228988 - DNA, 16 bp, P. troglodytes
cccagactggagtgca

SEQ ID NO: 228989 - DNA, 16 bp, P. troglodytes
cccagactggagttca

SEQ ID NO: 228990 - DNA, 16 bp, P. troglodytes
cccagactggtcttca

SEQ ID NO: 228991 - DNA, 16 bp, P. troglodytes
cccagacttctgacct

SEQ ID NO: 228992 - DNA, 16 bp, P. troglodytes
cccagactttaccact

SEQ ID NO: 228993 - DNA, 16 bp, P. troglodytes
cccagagaaacctgaa

SEQ ID NO: 228994 - DNA, 16 bp, P. troglodytes
cccagagaggtgaagg

SEQ ID NO: 228995 - DNA, 16 bp, P. troglodytes
cccagagatgtccatg

SEQ ID NO: 228996 - DNA, 16 bp, P. troglodytes
cccagagattctgatg

SEQ ID NO: 228997 - DNA, 16 bp, P. troglodytes
cccagagcactttagc

SEQ ID NO: 228998 - DNA, 16 bp, P. troglodytes
cccagagcctcagttt

SEQ ID NO: 228999 - DNA, 16 bp, P. troglodytes
cccagagctttgggag

SEQ ID NO: 229000 - DNA, 16 bp, P. troglodytes
cccagaggaaaggaat

SEQ ID NO: 229001 - DNA, 16 bp, P. troglodytes
cccagaggaagagaag

SEQ ID NO: 229002 - DNA, 16 bp, P. troglodytes
cccagaggagcagcag

SEQ ID NO: 229003 - DNA, 16 bp, P. troglodytes
cccagaggatggggaa

SEQ ID NO: 229004 - DNA, 16 bp, P. troglodytes
cccagaggccccacct

SEQ ID NO: 229005 - DNA, 16 bp, P. troglodytes
cccagaggggcagcca

SEQ ID NO: 229006 - DNA, 16 bp, P. troglodytes
cccagaggtaaccact

SEQ ID NO: 229007 - DNA, 16 bp, P. troglodytes
cccagagtttctgact

SEQ ID NO: 229008 - DNA, 16 bp, P. troglodytes
cccagatacctgggag

SEQ ID NO: 229009 - DNA, 16 bp, P. troglodytes
cccagatcttgatttc

SEQ ID NO: 229010 - DNA, 16 bp, P. troglodytes
cccagatggcccttcc

SEQ ID NO: 229011 - DNA, 16 bp, P. troglodytes
cccagatggcctgaag

SEQ ID NO: 229012 - DNA, 16 bp, P. troglodytes
cccagatggggcagcc

SEQ ID NO: 229013 - DNA, 16 bp, P. troglodytes
cccagcaaagccacag

SEQ ID NO: 229014 - DNA, 16 bp, P. troglodytes
cccagcaaagccatgg

SEQ ID NO: 229015 - DNA, 16 bp, P. troglodytes
cccagcaacagtgtaa

SEQ ID NO: 229016 - DNA, 16 bp, P. troglodytes
cccagcaattcctctt

SEQ ID NO: 229017 - DNA, 16 bp, P. troglodytes
cccagcacagtgcctg

SEQ ID NO: 229018 - DNA, 16 bp, P. troglodytes
cccagcacagtgtctg

SEQ ID NO: 229019 - DNA, 16 bp, P. troglodytes
cccagcaccacacctg

SEQ ID NO: 229020 - DNA, 16 bp, P. troglodytes
cccagcaccatctgtt

SEQ ID NO: 229021 - DNA, 16 bp, P. troglodytes
cccagcactgcaggag

SEQ ID NO: 229022 - DNA, 16 bp, P. troglodytes
cccagcactgccagcc

SEQ ID NO: 229023 - DNA, 16 bp, P. troglodytes
cccagcactgtggcag

SEQ ID NO: 229024 - DNA, 16 bp, P. troglodytes
cccagcactgtggggg

SEQ ID NO: 229025 - DNA, 16 bp, P. troglodytes
cccagcactttcgggg

SEQ ID NO: 229026 - DNA, 16 bp, P. troglodytes
cccagcactttgaggg

SEQ ID NO: 229027 - DNA, 16 bp, P. troglodytes
cccagcagaagaaaat

SEQ ID NO: 229028 - DNA, 16 bp, P. troglodytes
cccagcagagcagtca

SEQ ID NO: 229029 - DNA, 16 bp, P. troglodytes
cccagcagaggctgca

SEQ ID NO: 229030 - DNA, 18 bp, P. troglodytes
cccagcagctcattgaga

SEQ ID NO: 229031 - DNA, 16 bp, P. troglodytes
cccagcaggcctgagc

SEQ ID NO: 229032 - DNA, 16 bp, P. troglodytes
cccagcaggctgtgct

SEQ ID NO: 229033 - DNA, 16 bp, P. troglodytes
cccagcagttcaagac

SEQ ID NO: 229034 - DNA, 16 bp, P. troglodytes
cccagcattatgggag

SEQ ID NO: 229035 - DNA, 16 bp, P. troglodytes
cccagcatttggaagg

SEQ ID NO: 229036 - DNA, 16 bp, P. troglodytes
cccagccaaaaatttt

SEQ ID NO: 229037 - DNA, 16 bp, P. troglodytes
cccagccaaaccatat

SEQ ID NO: 229038 - DNA, 16 bp, P. troglodytes
cccagccaagcccagc

SEQ ID NO: 229039 - DNA, 16 bp, P. troglodytes
cccagccaatgactga

SEQ ID NO: 229040 - DNA, 16 bp, P. troglodytes
cccagccacactggcc

SEQ ID NO: 229041 - DNA, 16 bp, P. troglodytes
cccagccaccatgctg

SEQ ID NO: 229042 - DNA, 16 bp, P. troglodytes
cccagccactccagcc

SEQ ID NO: 229043 - DNA, 16 bp, P. troglodytes
cccagccactctggag

SEQ ID NO: 229044 - DNA, 16 bp, P. troglodytes
cccagccacttgggaa

SEQ ID NO: 229045 - DNA, 16 bp, P. troglodytes
cccagccacttgggag

SEQ ID NO: 229046 - DNA, 16 bp, P. troglodytes
cccagccagaagccag

SEQ ID NO: 229047 - DNA, 16 bp, P. troglodytes
cccagccagcagcagc

SEQ ID NO: 229048 - DNA, 16 bp, P. troglodytes
cccagccagccccagg

SEQ ID NO: 229049 - DNA, 16 bp, P. troglodytes
cccagccagctgcccc

SEQ ID NO: 229050 - DNA, 16 bp, P. troglodytes
cccagccaggcgcggt

SEQ ID NO: 229051 - DNA, 16 bp, P. troglodytes
cccagcccactgccac

SEQ ID NO: 229052 - DNA, 16 bp, P. troglodytes
cccagcccagcccaga

SEQ ID NO: 229053 - DNA, 16 bp, P. troglodytes
cccagcccagcctggc

SEQ ID NO: 229054 - DNA, 16 bp, P. troglodytes
cccagcccaggccagc

SEQ ID NO: 229055 - DNA, 16 bp, P. troglodytes
cccagcccaggcctgg

SEQ ID NO: 229056 - DNA, 16 bp, P. troglodytes
cccagcccagggcctg

SEQ ID NO: 229057 - DNA, 16 bp, P. troglodytes
cccagcccagtccagc

SEQ ID NO: 229058 - DNA, 16 bp, P. troglodytes
cccagccccagcacag

SEQ ID NO: 229059 - DNA, 16 bp, P. troglodytes
cccagccccagccctg

SEQ ID NO: 229060 - DNA, 16 bp, P. troglodytes
cccagccccagcctca

SEQ ID NO: 229061 - DNA, 16 bp, P. troglodytes
cccagccccagctcca

SEQ ID NO: 229062 - DNA, 16 bp, P. troglodytes
cccagcccccaacagg

SEQ ID NO: 229063 - DNA, 16 bp, P. troglodytes
cccagcccccagcctg

SEQ ID NO: 229064 - DNA, 16 bp, P. troglodytes
cccagcccccagcctt

SEQ ID NO: 229065 - DNA, 16 bp, P. troglodytes
cccagcccctcccagg

SEQ ID NO: 229066 - DNA, 16 bp, P. troglodytes
cccagcccctctccag

SEQ ID NO: 229067 - DNA, 16 bp, P. troglodytes
cccagcccctgacagg

SEQ ID NO: 229068 - DNA, 16 bp, P. troglodytes
cccagcccctgccctg

SEQ ID NO: 229069 - DNA, 16 bp, P. troglodytes
cccagcccctggaaac

SEQ ID NO: 229070 - DNA, 16 bp, P. troglodytes
cccagcccctggcacc

SEQ ID NO: 229071 - DNA, 16 bp, P. troglodytes
cccagcccctggcagc

SEQ ID NO: 229072 - DNA, 16 bp, P. troglodytes
cccagccctgaccctg

SEQ ID NO: 229073 - DNA, 16 bp, P. troglodytes
cccagccctgccacct

SEQ ID NO: 229074 - DNA, 16 bp, P. troglodytes
cccagccctgccagcc

SEQ ID NO: 229075 - DNA, 16 bp, P. troglodytes
cccagccctgcccagc

SEQ ID NO: 229076 - DNA, 16 bp, P. troglodytes
cccagccctgcccctg

SEQ ID NO: 229077 - DNA, 16 bp, P. troglodytes
cccagccctgccctgc

SEQ ID NO: 229078 - DNA, 16 bp, P. troglodytes
cccagccctgccctgg

SEQ ID NO: 229079 - DNA, 16 bp, P. troglodytes
cccagccctgcctctc

SEQ ID NO: 229080 - DNA, 16 bp, P. troglodytes
cccagccctgcctctg

SEQ ID NO: 229081 - DNA, 16 bp, P. troglodytes
cccagccctgcctgcc

SEQ ID NO: 229082 - DNA, 16 bp, P. troglodytes
cccagccctgctcctg

SEQ ID NO: 229083 - DNA, 16 bp, P. troglodytes
cccagccctgctgctg

SEQ ID NO: 229084 - DNA, 16 bp, P. troglodytes
cccagccctggcccag

SEQ ID NO: 229085 - DNA, 16 bp, P. troglodytes
cccagccctggccctg

SEQ ID NO: 229086 - DNA, 16 bp, P. troglodytes
cccagccctgtgcctg

SEQ ID NO: 229087 - DNA, 16 bp, P. troglodytes
cccagcccttcaggag

SEQ ID NO: 229088 - DNA, 16 bp, P. troglodytes
cccagcccttgcctgg

SEQ ID NO: 229089 - DNA, 16 bp, P. troglodytes
cccagcccttgggagg

SEQ ID NO: 229090 - DNA, 16 bp, P. troglodytes
cccagccctttggggg

SEQ ID NO: 229091 - DNA, 16 bp, P. troglodytes
cccagccgctccagcc

SEQ ID NO: 229092 - DNA, 16 bp, P. troglodytes
cccagcctcagatgat

SEQ ID NO: 229093 - DNA, 16 bp, P. troglodytes
cccagcctcagtttct

SEQ ID NO: 229094 - DNA, 16 bp, P. troglodytes
cccagcctccagaacc

SEQ ID NO: 229095 - DNA, 16 bp, P. troglodytes
cccagcctccaggccc

SEQ ID NO: 229096 - DNA, 16 bp, P. troglodytes
cccagcctccatcttt

SEQ ID NO: 229097 - DNA, 16 bp, P. troglodytes
cccagcctcccagcca

SEQ ID NO: 229098 - DNA, 16 bp, P. troglodytes
cccagcctcccctgca

SEQ ID NO: 229099 - DNA, 16 bp, P. troglodytes
cccagcctcctgggtt

SEQ ID NO: 229100 - DNA, 18 bp, P. troglodytes
cccagcctcgctgccgcc

SEQ ID NO: 229101 - DNA, 16 bp, P. troglodytes
cccagcctctgggaac

SEQ ID NO: 229102 - DNA, 16 bp, P. troglodytes
cccagcctctggtcac

SEQ ID NO: 229103 - DNA, 16 bp, P. troglodytes
cccagcctcttctctc

SEQ ID NO: 229104 - DNA, 16 bp, P. troglodytes
cccagcctctttttat

SEQ ID NO: 229105 - DNA, 16 bp, P. troglodytes
cccagcctgcagaacc

SEQ ID NO: 229106 - DNA, 16 bp, P. troglodytes
cccagcctgccctgcc

SEQ ID NO: 229107 - DNA, 16 bp, P. troglodytes
cccagcctgcctgcct

SEQ ID NO: 229108 - DNA, 16 bp, P. troglodytes
cccagcctggagtgca

SEQ ID NO: 229109 - DNA, 16 bp, P. troglodytes
cccagcctggccaaca

SEQ ID NO: 229110 - DNA, 16 bp, P. troglodytes
cccagcctggggtgca

SEQ ID NO: 229111 - DNA, 16 bp, P. troglodytes
cccagcctgggtgaca

SEQ ID NO: 229112 - DNA, 16 bp, P. troglodytes
cccagccttctttttt

SEQ ID NO: 229113 - DNA, 16 bp, P. troglodytes
cccagccttgctgctg

SEQ ID NO: 229114 - DNA, 16 bp, P. troglodytes
cccagcgtggtggcgc

SEQ ID NO: 229115 - DNA, 16 bp, P. troglodytes
cccagctaattttgtg

SEQ ID NO: 229116 - DNA, 16 bp, P. troglodytes
cccagctaatttttta

SEQ ID NO: 229117 - DNA, 16 bp, P. troglodytes
cccagctactccacag

SEQ ID NO: 229118 - DNA, 16 bp, P. troglodytes
cccagctactccagac

SEQ ID NO: 229119 - DNA, 16 bp, P. troglodytes
cccagctactccagcc

SEQ ID NO: 229120 - DNA, 16 bp, P. troglodytes
cccagctactcggagg

SEQ ID NO: 229121 - DNA, 16 bp, P. troglodytes
cccagctactgagggg

SEQ ID NO: 229122 - DNA, 16 bp, P. troglodytes
cccagctactgggaga

SEQ ID NO: 229123 - DNA, 16 bp, P. troglodytes
cccagctcaagcagag

SEQ ID NO: 229124 - DNA, 16 bp, P. troglodytes
cccagctcagcctcct

SEQ ID NO: 229125 - DNA, 16 bp, P. troglodytes
cccagctcattttaaa

SEQ ID NO: 229126 - DNA, 16 bp, P. troglodytes
cccagctcatttttaa

SEQ ID NO: 229127 - DNA, 16 bp, P. troglodytes
cccagctcattttttt

SEQ ID NO: 229128 - DNA, 16 bp, P. troglodytes
cccagctccagccctg

SEQ ID NO: 229129 - DNA, 16 bp, P. troglodytes
cccagctccaggtggc

SEQ ID NO: 229130 - DNA, 16 bp, P. troglodytes
cccagctcccacacag

SEQ ID NO: 229131 - DNA, 16 bp, P. troglodytes
cccagctcccagccca

SEQ ID NO: 229132 - DNA, 16 bp, P. troglodytes
cccagctcccaggcag

SEQ ID NO: 229133 - DNA, 16 bp, P. troglodytes
cccagctcccttgcct

SEQ ID NO: 229134 - DNA, 16 bp, P. troglodytes
cccagctcctgcctcc

SEQ ID NO: 229135 - DNA, 16 bp, P. troglodytes
cccagctcctggcagc

SEQ ID NO: 229136 - DNA, 16 bp, P. troglodytes
cccagctctcaggagg

SEQ ID NO: 229137 - DNA, 16 bp, P. troglodytes
cccagctctctgggag

SEQ ID NO: 229138 - DNA, 16 bp, P. troglodytes
cccagctctgccatct

SEQ ID NO: 229139 - DNA, 16 bp, P. troglodytes
cccagctctgcccctc

SEQ ID NO: 229140 - DNA, 16 bp, P. troglodytes
cccagctctgcctccc

SEQ ID NO: 229141 - DNA, 16 bp, P. troglodytes
cccagctctgctgctg

SEQ ID NO: 229142 - DNA, 16 bp, P. troglodytes
cccagctctgggctgg

SEQ ID NO: 229143 - DNA, 16 bp, P. troglodytes
cccagctctgtcacct

SEQ ID NO: 229144 - DNA, 16 bp, P. troglodytes
cccagctcttccactt

SEQ ID NO: 229145 - DNA, 16 bp, P. troglodytes
cccagctgagcccagc

SEQ ID NO: 229146 - DNA, 16 bp, P. troglodytes
cccagctgatcttgaa

SEQ ID NO: 229147 - DNA, 16 bp, P. troglodytes
cccagctgccagggag

SEQ ID NO: 229148 - DNA, 16 bp, P. troglodytes
cccagctgccccatct

SEQ ID NO: 229149 - DNA, 16 bp, P. troglodytes
cccagctgctaaggag

SEQ ID NO: 229150 - DNA, 16 bp, P. troglodytes
cccagctgctcaggag

SEQ ID NO: 229151 - DNA, 16 bp, P. troglodytes
cccagctgctcatgag

SEQ ID NO: 229152 - DNA, 16 bp, P. troglodytes
cccagctgctcgagag

SEQ ID NO: 229153 - DNA, 16 bp, P. troglodytes
cccagctgctgaggag

SEQ ID NO: 229154 - DNA, 16 bp, P. troglodytes
cccagctgcttcagct

SEQ ID NO: 229155 - DNA, 16 bp, P. troglodytes
cccagctgcttggagg

SEQ ID NO: 229156 - DNA, 17 bp, P. troglodytes
cccagctgctttgttta

SEQ ID NO: 229157 - DNA, 16 bp, P. troglodytes
cccagctgtaaaatgg

SEQ ID NO: 229158 - DNA, 16 bp, P. troglodytes
cccagctgtgccactt

SEQ ID NO: 229159 - DNA, 16 bp, P. troglodytes
cccagcttatttattt

SEQ ID NO: 229160 - DNA, 16 bp, P. troglodytes
cccagcttgcagacag

SEQ ID NO: 229161 - DNA, 16 bp, P. troglodytes
cccagcttttcctttt

SEQ ID NO: 229162 - DNA, 16 bp, P. troglodytes
cccagcttttgcccat

SEQ ID NO: 229163 - DNA, 16 bp, P. troglodytes
cccaggaagaagagga

SEQ ID NO: 229164 - DNA, 16 bp, P. troglodytes
cccaggaagaggaggt

SEQ ID NO: 229165 - DNA, 16 bp, P. troglodytes
cccaggaagcagagat

SEQ ID NO: 229166 - DNA, 16 bp, P. troglodytes
cccaggaagctcagag

SEQ ID NO: 229167 - DNA, 16 bp, P. troglodytes
cccaggaagctgggac

SEQ ID NO: 229168 - DNA, 16 bp, P. troglodytes
cccaggaaggagaaaa

SEQ ID NO: 229169 - DNA, 16 bp, P. troglodytes
cccaggaaggaggagg

SEQ ID NO: 229170 - DNA, 16 bp, P. troglodytes
cccaggaagtccagct

SEQ ID NO: 229171 - DNA, 16 bp, P. troglodytes
cccaggaagtgcaaga

SEQ ID NO: 229172 - DNA, 16 bp, P. troglodytes
cccaggaatgcaaggg

SEQ ID NO: 229173 - DNA, 16 bp, P. troglodytes
cccaggaattgaagac

SEQ ID NO: 229174 - DNA, 16 bp, P. troglodytes
cccaggaatttgaagc

SEQ ID NO: 229175 - DNA, 16 bp, P. troglodytes
cccaggaatttgaggt

SEQ ID NO: 229176 - DNA, 16 bp, P. troglodytes
cccaggaccaaatgga

SEQ ID NO: 229177 - DNA, 16 bp, P. troglodytes
cccaggacccaggacc

SEQ ID NO: 229178 - DNA, 16 bp, P. troglodytes
cccaggagaaagaggt

SEQ ID NO: 229179 - DNA, 16 bp, P. troglodytes
cccaggagacagaggt

SEQ ID NO: 229180 - DNA, 16 bp, P. troglodytes
cccaggagaccaaggc

SEQ ID NO: 229181 - DNA, 16 bp, P. troglodytes
cccaggagactgaggc

SEQ ID NO: 229182 - DNA, 16 bp, P. troglodytes
cccaggagactgaggt

SEQ ID NO: 229183 - DNA, 16 bp, P. troglodytes
cccaggagagaggcct

SEQ ID NO: 229184 - DNA, 16 bp, P. troglodytes
cccaggagatggaggc

SEQ ID NO: 229185 - DNA, 16 bp, P. troglodytes
cccaggagatgggggt

SEQ ID NO: 229186 - DNA, 16 bp, P. troglodytes
cccaggagcagaggtt

SEQ ID NO: 229187 - DNA, 16 bp, P. troglodytes
cccaggagcccaggag

SEQ ID NO: 229188 - DNA, 16 bp, P. troglodytes
cccaggagctccaggc

SEQ ID NO: 229189 - DNA, 16 bp, P. troglodytes
cccaggagctgagcag

SEQ ID NO: 229190 - DNA, 16 bp, P. troglodytes
cccaggaggaagaggc

SEQ ID NO: 229191 - DNA, 16 bp, P. troglodytes
cccaggaggaggagat

SEQ ID NO: 229192 - DNA, 16 bp, P. troglodytes
cccaggaggaggagga

SEQ ID NO: 229193 - DNA, 16 bp, P. troglodytes
cccaggaggcacaggc

SEQ ID NO: 229194 - DNA, 16 bp, P. troglodytes
cccaggaggcagaact

SEQ ID NO: 229195 - DNA, 16 bp, P. troglodytes
cccaggaggcagaaga

SEQ ID NO: 229196 - DNA, 16 bp, P. troglodytes
cccaggaggcagagaa

SEQ ID NO: 229197 - DNA, 16 bp, P. troglodytes
cccaggaggcagagct

SEQ ID NO: 229198 - DNA, 16 bp, P. troglodytes
cccaggaggcagagga

SEQ ID NO: 229199 - DNA, 16 bp, P. troglodytes
cccaggaggcagagtt

SEQ ID NO: 229200 - DNA, 16 bp, P. troglodytes
cccaggaggcgaaggt

SEQ ID NO: 229201 - DNA, 20 bp, P. troglodytes
cccaggaggcggagcttgca

SEQ ID NO: 229202 - DNA, 16 bp, P. troglodytes
cccaggaggcggaggc

SEQ ID NO: 229203 - DNA, 16 bp, P. troglodytes
cccaggagggagaggt

SEQ ID NO: 229204 - DNA, 17 bp, P. troglodytes
cccaggagggggagctt

SEQ ID NO: 229205 - DNA, 16 bp, P. troglodytes
cccaggagggtggatc

SEQ ID NO: 229206 - DNA, 16 bp, P. troglodytes
cccaggaggtgaaagt

SEQ ID NO: 229207 - DNA, 16 bp, P. troglodytes
cccaggaggtggagga

SEQ ID NO: 229208 - DNA, 16 bp, P. troglodytes
cccaggaggttaaggt

SEQ ID NO: 229209 - DNA, 24 bp, P. troglodytes
cccaggaggttgaggctgcagtga

SEQ ID NO: 229210 - DNA, 16 bp, P. troglodytes
cccaggagtccgaggc

SEQ ID NO: 229211 - DNA, 16 bp, P. troglodytes
cccaggagtctgaggc

SEQ ID NO: 229212 - DNA, 16 bp, P. troglodytes
cccaggagttccaaac

SEQ ID NO: 229213 - DNA, 16 bp, P. troglodytes
cccaggagttccagcc

SEQ ID NO: 229214 - DNA, 16 bp, P. troglodytes
cccaggagttccaggc

SEQ ID NO: 229215 - DNA, 16 bp, P. troglodytes
cccaggagtttgagag

SEQ ID NO: 229216 - DNA, 16 bp, P. troglodytes
cccaggagtttgagat

SEQ ID NO: 229217 - DNA, 16 bp, P. troglodytes
cccaggagttttagac

SEQ ID NO: 229218 - DNA, 16 bp, P. troglodytes
cccaggatcaatattg

SEQ ID NO: 229219 - DNA, 16 bp, P. troglodytes
cccaggatctgatggc

SEQ ID NO: 229220 - DNA, 16 bp, P. troglodytes
cccaggatggagagca

SEQ ID NO: 229221 - DNA, 17 bp, P. troglodytes
cccaggatggagtgcaa

SEQ ID NO: 229222 - DNA, 16 bp, P. troglodytes
cccaggatggggtgca

SEQ ID NO: 229223 - DNA, 16 bp, P. troglodytes
cccaggcaaaagtttg

SEQ ID NO: 229224 - DNA, 16 bp, P. troglodytes
cccaggcaacagtgtg

SEQ ID NO: 229225 - DNA, 16 bp, P. troglodytes
cccaggcagcacagct

SEQ ID NO: 229226 - DNA, 16 bp, P. troglodytes
cccaggcaggaggcca

SEQ ID NO: 229227 - DNA, 16 bp, P. troglodytes
cccaggcaggagtgca

SEQ ID NO: 229228 - DNA, 16 bp, P. troglodytes
cccaggcaggagtgcg

SEQ ID NO: 229229 - DNA, 16 bp, P. troglodytes
cccaggcaggatggag

SEQ ID NO: 229230 - DNA, 16 bp, P. troglodytes
cccaggcagtgcagct

SEQ ID NO: 229231 - DNA, 16 bp, P. troglodytes
cccaggccagagtaca

SEQ ID NO: 229232 - DNA, 16 bp, P. troglodytes
cccaggccagagtgca

SEQ ID NO: 229233 - DNA, 16 bp, P. troglodytes
cccaggccagcagctg

SEQ ID NO: 229234 - DNA, 16 bp, P. troglodytes
cccaggccaggcacag

SEQ ID NO: 229235 - DNA, 16 bp, P. troglodytes
cccaggccaggccagg

SEQ ID NO: 229236 - DNA, 16 bp, P. troglodytes
cccaggccaggctgga

SEQ ID NO: 229237 - DNA, 16 bp, P. troglodytes
cccaggccatggactg

SEQ ID NO: 229238 - DNA, 16 bp, P. troglodytes
cccaggcccagctctg

SEQ ID NO: 229239 - DNA, 16 bp, P. troglodytes
cccaggccccagcctc

SEQ ID NO: 229240 - DNA, 16 bp, P. troglodytes
cccaggcccccaagag

SEQ ID NO: 229241 - DNA, 16 bp, P. troglodytes
cccaggcccctcccag

SEQ ID NO: 229242 - DNA, 16 bp, P. troglodytes
cccaggccctgcccca

SEQ ID NO: 229243 - DNA, 16 bp, P. troglodytes
cccaggccctgccctc

SEQ ID NO: 229244 - DNA, 16 bp, P. troglodytes
cccaggccctgccctg

SEQ ID NO: 229245 - DNA, 16 bp, P. troglodytes
cccaggccgatctcaa

SEQ ID NO: 229246 - DNA, 16 bp, P. troglodytes
cccaggccggagtgca

SEQ ID NO: 229247 - DNA, 16 bp, P. troglodytes
cccaggcctccccagc

SEQ ID NO: 229248 - DNA, 16 bp, P. troglodytes
cccaggcctctctcct

SEQ ID NO: 229249 - DNA, 16 bp, P. troglodytes
cccaggcctgtgccca

SEQ ID NO: 229250 - DNA, 17 bp, P. troglodytes
cccaggcgggtggatca

SEQ ID NO: 229251 - DNA, 16 bp, P. troglodytes
cccaggctaagcccca

SEQ ID NO: 229252 - DNA, 16 bp, P. troglodytes
cccaggctagagtgaa

SEQ ID NO: 229253 - DNA, 16 bp, P. troglodytes
cccaggctagagtgca

SEQ ID NO: 229254 - DNA, 16 bp, P. troglodytes
cccaggctagagtgga

SEQ ID NO: 229255 - DNA, 16 bp, P. troglodytes
cccaggctagagtgta

SEQ ID NO: 229256 - DNA, 16 bp, P. troglodytes
cccaggctcaaatgat

SEQ ID NO: 229257 - DNA, 16 bp, P. troglodytes
cccaggctcaagcgat

SEQ ID NO: 229258 - DNA, 16 bp, P. troglodytes
cccaggctcagccaga

SEQ ID NO: 229259 - DNA, 16 bp, P. troglodytes
cccaggctccagaagc

SEQ ID NO: 229260 - DNA, 16 bp, P. troglodytes
cccaggctctgccctc

SEQ ID NO: 229261 - DNA, 16 bp, P. troglodytes
cccaggctctgcctct

SEQ ID NO: 229262 - DNA, 16 bp, P. troglodytes
cccaggctgaagccat

SEQ ID NO: 229263 - DNA, 16 bp, P. troglodytes
cccaggctgaagggca

SEQ ID NO: 229264 - DNA, 16 bp, P. troglodytes
cccaggctgaagtgat

SEQ ID NO: 229265 - DNA, 16 bp, P. troglodytes
cccaggctgaagtgca

SEQ ID NO: 229266 - DNA, 16 bp, P. troglodytes
cccaggctgcactgca

SEQ ID NO: 229267 - DNA, 16 bp, P. troglodytes
cccaggctgcagtaca

SEQ ID NO: 229268 - DNA, 16 bp, P. troglodytes
cccaggctgcagtgca

SEQ ID NO: 229269 - DNA, 16 bp, P. troglodytes
cccaggctgcagtgga

SEQ ID NO: 229270 - DNA, 16 bp, P. troglodytes
cccaggctgcagtgta

SEQ ID NO: 229271 - DNA, 16 bp, P. troglodytes
cccaggctgcctggct

SEQ ID NO: 229272 - DNA, 16 bp, P. troglodytes
cccaggctgctctcca

SEQ ID NO: 229273 - DNA, 16 bp, P. troglodytes
cccaggctggaatgca

SEQ ID NO: 229274 - DNA, 16 bp, P. troglodytes
cccaggctggaatgcc

SEQ ID NO: 229275 - DNA, 16 bp, P. troglodytes
cccaggctggaatgcg

SEQ ID NO: 229276 - DNA, 16 bp, P. troglodytes
cccaggctggaatgta

SEQ ID NO: 229277 - DNA, 16 bp, P. troglodytes
cccaggctggactgca

SEQ ID NO: 229278 - DNA, 16 bp, P. troglodytes
cccaggctggagagca

SEQ ID NO: 229279 - DNA, 16 bp, P. troglodytes
cccaggctggagcaca

SEQ ID NO: 229280 - DNA, 16 bp, P. troglodytes
cccaggctggagcgca

SEQ ID NO: 229281 - DNA, 16 bp, P. troglodytes
cccaggctggagggca

SEQ ID NO: 229282 - DNA, 16 bp, P. troglodytes
cccaggctggaggtgc

SEQ ID NO: 229283 - DNA, 16 bp, P. troglodytes
cccaggctggagtaca

SEQ ID NO: 229284 - DNA, 16 bp, P. troglodytes
cccaggctggagtcag

SEQ ID NO: 229285 - DNA, 16 bp, P. troglodytes
cccaggctggagtcca

SEQ ID NO: 229286 - DNA, 16 bp, P. troglodytes
cccaggctggagtgaa

SEQ ID NO: 229287 - DNA, 16 bp, P. troglodytes
cccaggctggagtgca

SEQ ID NO: 229288 - DNA, 16 bp, P. troglodytes
cccaggctggagtgcc

SEQ ID NO: 229289 - DNA, 16 bp, P. troglodytes
cccaggctggagtgcg

SEQ ID NO: 229290 - DNA, 16 bp, P. troglodytes
cccaggctggagtgct

SEQ ID NO: 229291 - DNA, 16 bp, P. troglodytes
cccaggctggagtgga

SEQ ID NO: 229292 - DNA, 16 bp, P. troglodytes
cccaggctggagtggc

SEQ ID NO: 229293 - DNA, 16 bp, P. troglodytes
cccaggctggagtgta

SEQ ID NO: 229294 - DNA, 16 bp, P. troglodytes
cccaggctggagtgtg

SEQ ID NO: 229295 - DNA, 16 bp, P. troglodytes
cccaggctggagttca

SEQ ID NO: 229296 - DNA, 16 bp, P. troglodytes
cccaggctggattgca

SEQ ID NO: 229297 - DNA, 16 bp, P. troglodytes
cccaggctggcatgca

SEQ ID NO: 229298 - DNA, 16 bp, P. troglodytes
cccaggctggcctcag

SEQ ID NO: 229299 - DNA, 16 bp, P. troglodytes
cccaggctggcgtgca

SEQ ID NO: 229300 - DNA, 16 bp, P. troglodytes
cccaggctggctggag

SEQ ID NO: 229301 - DNA, 16 bp, P. troglodytes
cccaggctggcttcaa

SEQ ID NO: 229302 - DNA, 16 bp, P. troglodytes
cccaggctggggcaca

SEQ ID NO: 229303 - DNA, 16 bp, P. troglodytes
cccaggctggggtgaa

SEQ ID NO: 229304 - DNA, 16 bp, P. troglodytes
cccaggctggggtgca

SEQ ID NO: 229305 - DNA, 16 bp, P. troglodytes
cccaggctggtcctgg

SEQ ID NO: 229306 - DNA, 22 bp, P. troglodytes
cccaggctggtctcaaactccc

SEQ ID NO: 229307 - DNA, 16 bp, P. troglodytes
cccaggctggtgtgca

SEQ ID NO: 229308 - DNA, 16 bp, P. troglodytes
cccaggctgtagtgca

SEQ ID NO: 229309 - DNA, 16 bp, P. troglodytes
cccaggctgtagtgct

SEQ ID NO: 229310 - DNA, 16 bp, P. troglodytes
cccaggctgttctcca

SEQ ID NO: 229311 - DNA, 16 bp, P. troglodytes
cccaggcttgagtgca

SEQ ID NO: 229312 - DNA, 16 bp, P. troglodytes
cccaggctttagtgca

SEQ ID NO: 229313 - DNA, 16 bp, P. troglodytes
cccagggaagccaaaa

SEQ ID NO: 229314 - DNA, 16 bp, P. troglodytes
cccagggaagccaaag

SEQ ID NO: 229315 - DNA, 16 bp, P. troglodytes
cccagggaccagcacc

SEQ ID NO: 229316 - DNA, 16 bp, P. troglodytes
cccagggaggcagagg

SEQ ID NO: 229317 - DNA, 16 bp, P. troglodytes
cccagggatgtaagga

SEQ ID NO: 229318 - DNA, 16 bp, P. troglodytes
cccagggcagggcagg

SEQ ID NO: 229319 - DNA, 16 bp, P. troglodytes
cccagggccaggcagg

SEQ ID NO: 229320 - DNA, 16 bp, P. troglodytes
cccagggccaggtacc

SEQ ID NO: 229321 - DNA, 16 bp, P. troglodytes
cccagggccctgctgc

SEQ ID NO: 229322 - DNA, 16 bp, P. troglodytes
cccagggccctggtgg

SEQ ID NO: 229323 - DNA, 16 bp, P. troglodytes
cccagggcctggcaca

SEQ ID NO: 229324 - DNA, 16 bp, P. troglodytes
cccagggcctggccca

SEQ ID NO: 229325 - DNA, 16 bp, P. troglodytes
cccagggcctggggga

SEQ ID NO: 229326 - DNA, 16 bp, P. troglodytes
cccagggccttgctgc

SEQ ID NO: 229327 - DNA, 16 bp, P. troglodytes
cccagggctctggtgg

SEQ ID NO: 229328 - DNA, 16 bp, P. troglodytes
cccagggctggagtgc

SEQ ID NO: 229329 - DNA, 16 bp, P. troglodytes
cccagggctgggcaca

SEQ ID NO: 229330 - DNA, 16 bp, P. troglodytes
cccagggctggggctg

SEQ ID NO: 229331 - DNA, 16 bp, P. troglodytes
cccaggggacagaggt

SEQ ID NO: 229332 - DNA, 16 bp, P. troglodytes
cccaggggatggaggt

SEQ ID NO: 229333 - DNA, 16 bp, P. troglodytes
cccaggggcaggcagg

SEQ ID NO: 229334 - DNA, 16 bp, P. troglodytes
cccaggggctcttcag

SEQ ID NO: 229335 - DNA, 16 bp, P. troglodytes
cccagggggagataat

SEQ ID NO: 229336 - DNA, 16 bp, P. troglodytes
cccagggtccctgcct

SEQ ID NO: 229337 - DNA, 16 bp, P. troglodytes
cccaggtacctgggag

SEQ ID NO: 229338 - DNA, 16 bp, P. troglodytes
cccaggtatctgggat

SEQ ID NO: 229339 - DNA, 16 bp, P. troglodytes
cccaggtcaagtgatt

SEQ ID NO: 229340 - DNA, 16 bp, P. troglodytes
cccaggtccatggaaa

SEQ ID NO: 229341 - DNA, 16 bp, P. troglodytes
cccaggtcctgcagga

SEQ ID NO: 229342 - DNA, 16 bp, P. troglodytes
cccaggtctcctgcct

SEQ ID NO: 229343 - DNA, 16 bp, P. troglodytes
cccaggtgatccaccc

SEQ ID NO: 229344 - DNA, 16 bp, P. troglodytes
cccaggtgattccaat

SEQ ID NO: 229345 - DNA, 16 bp, P. troglodytes
cccaggtgcagctgca

SEQ ID NO: 229346 - DNA, 16 bp, P. troglodytes
cccaggtggacttcag

SEQ ID NO: 229347 - DNA, 16 bp, P. troglodytes
cccaggtggctgaggc

SEQ ID NO: 229348 - DNA, 16 bp, P. troglodytes
cccaggtgggcagatc

SEQ ID NO: 229349 - DNA, 16 bp, P. troglodytes
cccaggttagagtgca

SEQ ID NO: 229350 - DNA, 16 bp, P. troglodytes
cccaggttcagatgat

SEQ ID NO: 229351 - DNA, 16 bp, P. troglodytes
cccaggttggagtgca

SEQ ID NO: 229352 - DNA, 16 bp, P. troglodytes
cccaggttggtcttca

SEQ ID NO: 229353 - DNA, 16 bp, P. troglodytes
cccagtaatggaattg

SEQ ID NO: 229354 - DNA, 16 bp, P. troglodytes
cccagtaatggatggc

SEQ ID NO: 229355 - DNA, 16 bp, P. troglodytes
cccagtactttgggaa

SEQ ID NO: 229356 - DNA, 16 bp, P. troglodytes
cccagtagagactctg

SEQ ID NO: 229357 - DNA, 16 bp, P. troglodytes
cccagtagctgagatt

SEQ ID NO: 229358 - DNA, 16 bp, P. troglodytes
cccagtcccatcgacc

SEQ ID NO: 229359 - DNA, 16 bp, P. troglodytes
cccagtctcaaaaata

SEQ ID NO: 229360 - DNA, 16 bp, P. troglodytes
cccagtctctaaaaaa

SEQ ID NO: 229361 - DNA, 16 bp, P. troglodytes
cccagtctctacaaaa

SEQ ID NO: 229362 - DNA, 16 bp, P. troglodytes
cccagtctggagtgca

SEQ ID NO: 229363 - DNA, 16 bp, P. troglodytes
cccagtctggtctcca

SEQ ID NO: 229364 - DNA, 16 bp, P. troglodytes
cccagtgatcccatta

SEQ ID NO: 229365 - DNA, 16 bp, P. troglodytes
cccagtgcaaaataaa

SEQ ID NO: 229366 - DNA, 16 bp, P. troglodytes
cccagtgcaggatcca

SEQ ID NO: 229367 - DNA, 16 bp, P. troglodytes
cccagtgccttgggag

SEQ ID NO: 229368 - DNA, 16 bp, P. troglodytes
cccagtggcgcctgga

SEQ ID NO: 229369 - DNA, 16 bp, P. troglodytes
cccagtggctcacatc

SEQ ID NO: 229370 - DNA, 16 bp, P. troglodytes
cccagtgggtggaggt

SEQ ID NO: 229371 - DNA, 16 bp, P. troglodytes
cccagtggtgcctgga

SEQ ID NO: 229372 - DNA, 16 bp, P. troglodytes
cccagtggttggaact

SEQ ID NO: 229373 - DNA, 16 bp, P. troglodytes
cccagtgtctattgtt

SEQ ID NO: 229374 - DNA, 16 bp, P. troglodytes
cccagtgtctattttt

SEQ ID NO: 229375 - DNA, 16 bp, P. troglodytes
cccagtgtctcttgtt

SEQ ID NO: 229376 - DNA, 16 bp, P. troglodytes
cccagtgtctgttgtt

SEQ ID NO: 229377 - DNA, 16 bp, P. troglodytes
cccagtgtggactctg

SEQ ID NO: 229378 - DNA, 16 bp, P. troglodytes
cccagtgtggtggtgt

SEQ ID NO: 229379 - DNA, 16 bp, P. troglodytes
cccagtgttggagaag

SEQ ID NO: 229380 - DNA, 16 bp, P. troglodytes
cccagttaagttttgt

SEQ ID NO: 229381 - DNA, 16 bp, P. troglodytes
cccagttcaagagatt

SEQ ID NO: 229382 - DNA, 16 bp, P. troglodytes
cccagttgagaaccat

SEQ ID NO: 229383 - DNA, 16 bp, P. troglodytes
cccagtttcaagtgat

SEQ ID NO: 229384 - DNA, 16 bp, P. troglodytes
cccagtttcagttttc

SEQ ID NO: 229385 - DNA, 16 bp, P. troglodytes
cccagtttcctccaat

SEQ ID NO: 229386 - DNA, 16 bp, P. troglodytes
cccagtttctttcttt

SEQ ID NO: 229387 - DNA, 16 bp, P. troglodytes
cccagtttgcagatga

SEQ ID NO: 229388 - DNA, 16 bp, P. troglodytes
cccataaaattataat

SEQ ID NO: 229389 - DNA, 16 bp, P. troglodytes
cccataaatatataca

SEQ ID NO: 229390 - DNA, 16 bp, P. troglodytes
cccataactttgggag

SEQ ID NO: 229391 - DNA, 16 bp, P. troglodytes
cccatactgttttcat

SEQ ID NO: 229392 - DNA, 16 bp, P. troglodytes
cccatagtcccagcac

SEQ ID NO: 229393 - DNA, 16 bp, P. troglodytes
cccatatatatatata

SEQ ID NO: 229394 - DNA, 16 bp, P. troglodytes
cccatcaaaaactggg

SEQ ID NO: 229395 - DNA, 16 bp, P. troglodytes
cccatcaaaaagtgtg

SEQ ID NO: 229396 - DNA, 16 bp, P. troglodytes
cccatcaaaatgccac

SEQ ID NO: 229397 - DNA, 16 bp, P. troglodytes
cccatcaagaggtgga

SEQ ID NO: 229398 - DNA, 16 bp, P. troglodytes
cccatcactttggaag

SEQ ID NO: 229399 - DNA, 16 bp, P. troglodytes
cccatcattttcaggt

SEQ ID NO: 229400 - DNA, 16 bp, P. troglodytes
cccatccagaccccaa

SEQ ID NO: 229401 - DNA, 16 bp, P. troglodytes
cccatccatctcactg

SEQ ID NO: 229402 - DNA, 16 bp, P. troglodytes
cccatccctacaaaaa

SEQ ID NO: 229403 - DNA, 16 bp, P. troglodytes
cccatcctcaatctgg

SEQ ID NO: 229404 - DNA, 16 bp, P. troglodytes
cccatcctctggcaca

SEQ ID NO: 229405 - DNA, 24 bp, P. troglodytes
cccatcctggccaacatggtgaaa

SEQ ID NO: 229406 - DNA, 23 bp, P. troglodytes
cccatcgtctgagatgtggggag

SEQ ID NO: 229407 - DNA, 16 bp, P. troglodytes
cccatctcagccccct

SEQ ID NO: 229408 - DNA, 16 bp, P. troglodytes
cccatctcagcctcca

SEQ ID NO: 229409 - DNA, 16 bp, P. troglodytes
cccatctccacaaaaa

SEQ ID NO: 229410 - DNA, 16 bp, P. troglodytes
cccatctctaaacaaa

SEQ ID NO: 229411 - DNA, 17 bp, P. troglodytes
cccatctctacaaaaaa

SEQ ID NO: 229412 - DNA, 16 bp, P. troglodytes
cccatctctacaaaag

SEQ ID NO: 229413 - DNA, 16 bp, P. troglodytes
cccatctctacaaaat

SEQ ID NO: 229414 - DNA, 16 bp, P. troglodytes
cccatctctaccagaa

SEQ ID NO: 229415 - DNA, 16 bp, P. troglodytes
cccatctctgccttca

SEQ ID NO: 229416 - DNA, 16 bp, P. troglodytes
cccatctctgggcctc

SEQ ID NO: 229417 - DNA, 16 bp, P. troglodytes
cccatctgacaaggga

SEQ ID NO: 229418 - DNA, 16 bp, P. troglodytes
cccatctttacaaaaa

SEQ ID NO: 229419 - DNA, 23 bp, P. troglodytes
cccatctttgtggttttatctac

SEQ ID NO: 229420 - DNA, 16 bp, P. troglodytes
cccatgaaaacagcca

SEQ ID NO: 229421 - DNA, 16 bp, P. troglodytes
cccatgaaaccattct

SEQ ID NO: 229422 - DNA, 16 bp, P. troglodytes
cccatgaaagtagcca

SEQ ID NO: 229423 - DNA, 16 bp, P. troglodytes
cccatgaaggcagctg

SEQ ID NO: 229424 - DNA, 16 bp, P. troglodytes
cccatgaggccccacc

SEQ ID NO: 229425 - DNA, 16 bp, P. troglodytes
cccatgagggcaggga

SEQ ID NO: 229426 - DNA, 16 bp, P. troglodytes
cccatgcccacccaga

SEQ ID NO: 229427 - DNA, 16 bp, P. troglodytes
cccatgcccacctgga

SEQ ID NO: 229428 - DNA, 16 bp, P. troglodytes
cccatgcccagctaat

SEQ ID NO: 229429 - DNA, 17 bp, P. troglodytes
cccatgcccagctaatt

SEQ ID NO: 229430 - DNA, 16 bp, P. troglodytes
cccatgcccatggagc

SEQ ID NO: 229431 - DNA, 16 bp, P. troglodytes
cccatgcctcagcctc

SEQ ID NO: 229432 - DNA, 18 bp, P. troglodytes
cccatgcctggctaattt

SEQ ID NO: 229433 - DNA, 16 bp, P. troglodytes
cccatgcctgtaatcc

SEQ ID NO: 229434 - DNA, 16 bp, P. troglodytes
cccatggagaatggag

SEQ ID NO: 229435 - DNA, 16 bp, P. troglodytes
cccatggcaggatcca

SEQ ID NO: 229436 - DNA, 16 bp, P. troglodytes
cccatggcccctccca

SEQ ID NO: 229437 - DNA, 16 bp, P. troglodytes
cccatggctgcccatg

SEQ ID NO: 229438 - DNA, 16 bp, P. troglodytes
cccatggctttgctgg

SEQ ID NO: 229439 - DNA, 16 bp, P. troglodytes
cccatggtcacacagc

SEQ ID NO: 229440 - DNA, 16 bp, P. troglodytes
cccatggtctcagccc

SEQ ID NO: 229441 - DNA, 16 bp, P. troglodytes
cccatgtccctacaaa

SEQ ID NO: 229442 - DNA, 16 bp, P. troglodytes
cccatgtctacaaaaa

SEQ ID NO: 229443 - DNA, 16 bp, P. troglodytes
cccatgtgtcatagga

SEQ ID NO: 229444 - DNA, 16 bp, P. troglodytes
cccatgtgtgatgttc

SEQ ID NO: 229445 - DNA, 16 bp, P. troglodytes
cccatgttcactgcag

SEQ ID NO: 229446 - DNA, 16 bp, P. troglodytes
cccatgttttaattgg

SEQ ID NO: 229447 - DNA, 16 bp, P. troglodytes
cccattagcagtcatt

SEQ ID NO: 229448 - DNA, 16 bp, P. troglodytes
cccattctctgggttg

SEQ ID NO: 229449 - DNA, 16 bp, P. troglodytes
cccattctgagcccag

SEQ ID NO: 229450 - DNA, 16 bp, P. troglodytes
cccattcttgggtatg

SEQ ID NO: 229451 - DNA, 16 bp, P. troglodytes
cccattgccttgaagg

SEQ ID NO: 229452 - DNA, 16 bp, P. troglodytes
cccattggttattttt

SEQ ID NO: 229453 - DNA, 16 bp, P. troglodytes
cccatttaaaaaaata

SEQ ID NO: 229454 - DNA, 16 bp, P. troglodytes
cccatttataatagct

SEQ ID NO: 229455 - DNA, 16 bp, P. troglodytes
cccatttatatttaag

SEQ ID NO: 229456 - DNA, 16 bp, P. troglodytes
cccatttatgagggct

SEQ ID NO: 229457 - DNA, 16 bp, P. troglodytes
cccatttcacagagga

SEQ ID NO: 229458 - DNA, 16 bp, P. troglodytes
cccatttcacaggtga

SEQ ID NO: 229459 - DNA, 16 bp, P. troglodytes
cccatttctttaaaaa

SEQ ID NO: 229460 - DNA, 16 bp, P. troglodytes
cccatttgacaaatga

SEQ ID NO: 229461 - DNA, 16 bp, P. troglodytes
cccatttgacagatga

SEQ ID NO: 229462 - DNA, 16 bp, P. troglodytes
cccattttaaaaattg

SEQ ID NO: 229463 - DNA, 16 bp, P. troglodytes
cccattttaaagatgg

SEQ ID NO: 229464 - DNA, 16 bp, P. troglodytes
cccattttacagacaa

SEQ ID NO: 229465 - DNA, 16 bp, P. troglodytes
cccattttacagatgg

SEQ ID NO: 229466 - DNA, 16 bp, P. troglodytes
cccattttctggggag

SEQ ID NO: 229467 - DNA, 16 bp, P. troglodytes
cccattttgaacttga

SEQ ID NO: 229468 - DNA, 16 bp, P. troglodytes
cccattttgcagatga

SEQ ID NO: 229469 - DNA, 16 bp, P. troglodytes
cccattttggcctccc

SEQ ID NO: 229470 - DNA, 16 bp, P. troglodytes
ccccaaaaaaagatat

SEQ ID NO: 229471 - DNA, 16 bp, P. troglodytes
ccccaaaacaattaca

SEQ ID NO: 229472 - DNA, 16 bp, P. troglodytes
ccccaaaatgtataaa

SEQ ID NO: 229473 - DNA, 16 bp, P. troglodytes
ccccaaaattagccag

SEQ ID NO: 229474 - DNA, 16 bp, P. troglodytes
ccccaaaattcgtatg

SEQ ID NO: 229475 - DNA, 16 bp, P. troglodytes
ccccaaagaattgaaa

SEQ ID NO: 229476 - DNA, 16 bp, P. troglodytes
ccccaaagcaacagaa

SEQ ID NO: 229477 - DNA, 16 bp, P. troglodytes
ccccaaagcaattaca

SEQ ID NO: 229478 - DNA, 16 bp, P. troglodytes
ccccaaagcacaagag

SEQ ID NO: 229479 - DNA, 19 bp, P. troglodytes
ccccaaagtgctgggatta

SEQ ID NO: 229480 - DNA, 19 bp, P. troglodytes
ccccaaagtgctgggattg

SEQ ID NO: 229481 - DNA, 19 bp, P. troglodytes
ccccaaagtgttgggatta

SEQ ID NO: 229482 - DNA, 16 bp, P. troglodytes
ccccaaatcaacagga

SEQ ID NO: 229483 - DNA, 16 bp, P. troglodytes
ccccaaatgtcaatag

SEQ ID NO: 229484 - DNA, 16 bp, P. troglodytes
ccccaaccccaggcag

SEQ ID NO: 229485 - DNA, 16 bp, P. troglodytes
ccccaactctgtgctc

SEQ ID NO: 229486 - DNA, 16 bp, P. troglodytes
ccccaactcttaaaaa

SEQ ID NO: 229487 - DNA, 16 bp, P. troglodytes
ccccaagacacataat

SEQ ID NO: 229488 - DNA, 16 bp, P. troglodytes
ccccaagagtgcagag

SEQ ID NO: 229489 - DNA, 16 bp, P. troglodytes
ccccaagcagctggga

SEQ ID NO: 229490 - DNA, 16 bp, P. troglodytes
ccccaagctttggcag

SEQ ID NO: 229491 - DNA, 16 bp, P. troglodytes
ccccacaacaaagaat

SEQ ID NO: 229492 - DNA, 16 bp, P. troglodytes
ccccacaataaagaat

SEQ ID NO: 229493 - DNA, 16 bp, P. troglodytes
ccccacacacagtccc

SEQ ID NO: 229494 - DNA, 16 bp, P. troglodytes
ccccacacagagtccc

SEQ ID NO: 229495 - DNA, 16 bp, P. troglodytes
ccccacagcctgccca

SEQ ID NO: 229496 - DNA, 16 bp, P. troglodytes
ccccacaggccagcag

SEQ ID NO: 229497 - DNA, 16 bp, P. troglodytes
ccccaccaaaaagtgg

SEQ ID NO: 229498 - DNA, 16 bp, P. troglodytes
ccccaccaaattcata

SEQ ID NO: 229499 - DNA, 16 bp, P. troglodytes
ccccaccaagctcgag

SEQ ID NO: 229500 - DNA, 16 bp, P. troglodytes
ccccaccagggccctg

SEQ ID NO: 229501 - DNA, 16 bp, P. troglodytes
ccccacccacatcctg

SEQ ID NO: 229502 - DNA, 16 bp, P. troglodytes
ccccacccaggccctg

SEQ ID NO: 229503 - DNA, 16 bp, P. troglodytes
ccccaccccaggacag

SEQ ID NO: 229504 - DNA, 16 bp, P. troglodytes
ccccaccccaggcctg

SEQ ID NO: 229505 - DNA, 16 bp, P. troglodytes
ccccaccccataacag

SEQ ID NO: 229506 - DNA, 16 bp, P. troglodytes
ccccaccccatcctgt

SEQ ID NO: 229507 - DNA, 16 bp, P. troglodytes
ccccaccccctaacag

SEQ ID NO: 229508 - DNA, 16 bp, P. troglodytes
ccccaccccctgacaa

SEQ ID NO: 229509 - DNA, 16 bp, P. troglodytes
ccccacctccaacttt

SEQ ID NO: 229510 - DNA, 16 bp, P. troglodytes
ccccacctctgggggc

SEQ ID NO: 229511 - DNA, 17 bp, P. troglodytes
ccccacctgacccagaa

SEQ ID NO: 229512 - DNA, 16 bp, P. troglodytes
ccccacctgcccagct

SEQ ID NO: 229513 - DNA, 16 bp, P. troglodytes
ccccacgcccagctaa

SEQ ID NO: 229514 - DNA, 16 bp, P. troglodytes
ccccacggagcccagc

SEQ ID NO: 229515 - DNA, 16 bp, P. troglodytes
ccccacggcagtgtct

SEQ ID NO: 229516 - DNA, 16 bp, P. troglodytes
ccccactccagcctgg

SEQ ID NO: 229517 - DNA, 16 bp, P. troglodytes
ccccactcctggctgc

SEQ ID NO: 229518 - DNA, 16 bp, P. troglodytes
ccccactctgctggta

SEQ ID NO: 229519 - DNA, 16 bp, P. troglodytes
ccccactgggtggcta

SEQ ID NO: 229520 - DNA, 18 bp, P. troglodytes
ccccacttatgagtgaga

SEQ ID NO: 229521 - DNA, 16 bp, P. troglodytes
ccccacttccctgaca

SEQ ID NO: 229522 - DNA, 16 bp, P. troglodytes
ccccacttggcctccc

SEQ ID NO: 229523 - DNA, 16 bp, P. troglodytes
ccccactttacagata

SEQ ID NO: 229524 - DNA, 16 bp, P. troglodytes
ccccactttacagatg

SEQ ID NO: 229525 - DNA, 16 bp, P. troglodytes
ccccagaagcagaagc

SEQ ID NO: 229526 - DNA, 16 bp, P. troglodytes
ccccagacaggccctg

SEQ ID NO: 229527 - DNA, 16 bp, P. troglodytes
ccccagacctacagaa

SEQ ID NO: 229528 - DNA, 16 bp, P. troglodytes
ccccagacctcctgaa

SEQ ID NO: 229529 - DNA, 16 bp, P. troglodytes
ccccagactgggtgac

SEQ ID NO: 229530 - DNA, 16 bp, P. troglodytes
ccccagagagctcctt

SEQ ID NO: 229531 - DNA, 16 bp, P. troglodytes
ccccagagatctgtgg

SEQ ID NO: 229532 - DNA, 16 bp, P. troglodytes
ccccagagcacttcag

SEQ ID NO: 229533 - DNA, 16 bp, P. troglodytes
ccccagagcactttag

SEQ ID NO: 229534 - DNA, 16 bp, P. troglodytes
ccccagagcactttgg

SEQ ID NO: 229535 - DNA, 16 bp, P. troglodytes
ccccagaggcccagct

SEQ ID NO: 229536 - DNA, 16 bp, P. troglodytes
ccccagagggcatgtt

SEQ ID NO: 229537 - DNA, 18 bp, P. troglodytes
ccccagagtgctgggatt

SEQ ID NO: 229538 - DNA, 33 bp, P. troglodytes
ccccagagttcaggacaggtagaaaggatgaat

SEQ ID NO: 229539 - DNA, 16 bp, P. troglodytes
ccccagatgcccagct

SEQ ID NO: 229540 - DNA, 16 bp, P. troglodytes
ccccagcaagacagaa

SEQ ID NO: 229541 - DNA, 16 bp, P. troglodytes
ccccagcaccatttat

SEQ ID NO: 229542 - DNA, 16 bp, P. troglodytes
ccccagcacccagcat

SEQ ID NO: 229543 - DNA, 16 bp, P. troglodytes
ccccagcacctggcac

SEQ ID NO: 229544 - DNA, 16 bp, P. troglodytes
ccccagcacttgggag

SEQ ID NO: 229545 - DNA, 16 bp, P. troglodytes
ccccagcactttggga

SEQ ID NO: 229546 - DNA, 16 bp, P. troglodytes
ccccagcagctgggac

SEQ ID NO: 229547 - DNA, 16 bp, P. troglodytes
ccccagcaggccccag

SEQ ID NO: 229548 - DNA, 16 bp, P. troglodytes
ccccagcagtgctggc

SEQ ID NO: 229549 - DNA, 16 bp, P. troglodytes
ccccagccaccagtca

SEQ ID NO: 229550 - DNA, 16 bp, P. troglodytes
ccccagccagcagcag

SEQ ID NO: 229551 - DNA, 16 bp, P. troglodytes
ccccagcccagaactc

SEQ ID NO: 229552 - DNA, 16 bp, P. troglodytes
ccccagcccagccctg

SEQ ID NO: 229553 - DNA, 16 bp, P. troglodytes
ccccagccccagctgg

SEQ ID NO: 229554 - DNA, 16 bp, P. troglodytes
ccccagcccctgcctg

SEQ ID NO: 229555 - DNA, 16 bp, P. troglodytes
ccccagcccctgggaa

SEQ ID NO: 229556 - DNA, 16 bp, P. troglodytes
ccccagccctgccctg

SEQ ID NO: 229557 - DNA, 16 bp, P. troglodytes
ccccagccctggccct

SEQ ID NO: 229558 - DNA, 16 bp, P. troglodytes
ccccagccctggcctc

SEQ ID NO: 229559 - DNA, 16 bp, P. troglodytes
ccccagcctcagccca

SEQ ID NO: 229560 - DNA, 16 bp, P. troglodytes
ccccagcctcagcctc

SEQ ID NO: 229561 - DNA, 16 bp, P. troglodytes
ccccagcctcccaaat

SEQ ID NO: 229562 - DNA, 16 bp, P. troglodytes
ccccagcctcccaggg

SEQ ID NO: 229563 - DNA, 16 bp, P. troglodytes
ccccagcctcctgcct

SEQ ID NO: 229564 - DNA, 16 bp, P. troglodytes
ccccagcctcctgggt

SEQ ID NO: 229565 - DNA, 16 bp, P. troglodytes
ccccagcctctctgcc

SEQ ID NO: 229566 - DNA, 16 bp, P. troglodytes
ccccagcctgcactga

SEQ ID NO: 229567 - DNA, 16 bp, P. troglodytes
ccccagcctggcccag

SEQ ID NO: 229568 - DNA, 16 bp, P. troglodytes
ccccagcctggcctcc

SEQ ID NO: 229569 - DNA, 16 bp, P. troglodytes
ccccagcctgggagac

SEQ ID NO: 229570 - DNA, 16 bp, P. troglodytes
ccccagccttccaaag

SEQ ID NO: 229571 - DNA, 16 bp, P. troglodytes
ccccagccttccaagt

SEQ ID NO: 229572 - DNA, 25 bp, P. troglodytes
ccccagctacttgggaggctgaggc

SEQ ID NO: 229573 - DNA, 16 bp, P. troglodytes
ccccagctcaagccat

SEQ ID NO: 229574 - DNA, 16 bp, P. troglodytes
ccccagctcagcctcc

SEQ ID NO: 229575 - DNA, 16 bp, P. troglodytes
ccccagctccagccct

SEQ ID NO: 229576 - DNA, 16 bp, P. troglodytes
ccccagctccagctcc

SEQ ID NO: 229577 - DNA, 16 bp, P. troglodytes
ccccagctccaggcag

SEQ ID NO: 229578 - DNA, 16 bp, P. troglodytes
ccccagctcctggtaa

SEQ ID NO: 229579 - DNA, 16 bp, P. troglodytes
ccccagctccttcagc

SEQ ID NO: 229580 - DNA, 16 bp, P. troglodytes
ccccagctctacaaaa

SEQ ID NO: 229581 - DNA, 16 bp, P. troglodytes
ccccagctctgccctc

SEQ ID NO: 229582 - DNA, 16 bp, P. troglodytes
ccccagctctgcctcc

SEQ ID NO: 229583 - DNA, 16 bp, P. troglodytes
ccccagctgctcctcc

SEQ ID NO: 229584 - DNA, 16 bp, P. troglodytes
ccccagctgtggctca

SEQ ID NO: 229585 - DNA, 16 bp, P. troglodytes
ccccagcttactgcct

SEQ ID NO: 229586 - DNA, 16 bp, P. troglodytes
ccccagcttctcagga

SEQ ID NO: 229587 - DNA, 16 bp, P. troglodytes
ccccaggacctcagaa

SEQ ID NO: 229588 - DNA, 16 bp, P. troglodytes
ccccaggagaggccag

SEQ ID NO: 229589 - DNA, 16 bp, P. troglodytes
ccccaggaggaggagg

SEQ ID NO: 229590 - DNA, 16 bp, P. troglodytes
ccccaggaggtcctga

SEQ ID NO: 229591 - DNA, 16 bp, P. troglodytes
ccccaggcaagaaggg

SEQ ID NO: 229592 - DNA, 16 bp, P. troglodytes
ccccaggcaggaaggg

SEQ ID NO: 229593 - DNA, 16 bp, P. troglodytes
ccccaggcaggaggcc

SEQ ID NO: 229594 - DNA, 16 bp, P. troglodytes
ccccaggcagtgaggg

SEQ ID NO: 229595 - DNA, 16 bp, P. troglodytes
ccccaggccacacagc

SEQ ID NO: 229596 - DNA, 16 bp, P. troglodytes
ccccaggcccagccct

SEQ ID NO: 229597 - DNA, 16 bp, P. troglodytes
ccccaggcctggccca

SEQ ID NO: 229598 - DNA, 16 bp, P. troglodytes
ccccaggccttggcag

SEQ ID NO: 229599 - DNA, 16 bp, P. troglodytes
ccccaggctcaagcaa

SEQ ID NO: 229600 - DNA, 16 bp, P. troglodytes
ccccaggctgcacagc

SEQ ID NO: 229601 - DNA, 16 bp, P. troglodytes
ccccaggctgcagtgc

SEQ ID NO: 229602 - DNA, 16 bp, P. troglodytes
ccccagggaagccatt

SEQ ID NO: 229603 - DNA, 16 bp, P. troglodytes
ccccagggaaggggag

SEQ ID NO: 229604 - DNA, 16 bp, P. troglodytes
ccccagggaccagtgc

SEQ ID NO: 229605 - DNA, 16 bp, P. troglodytes
ccccagggcctttgct

SEQ ID NO: 229606 - DNA, 16 bp, P. troglodytes
ccccagggctggggcc

SEQ ID NO: 229607 - DNA, 16 bp, P. troglodytes
ccccaggtcagagact

SEQ ID NO: 229608 - DNA, 16 bp, P. troglodytes
ccccaggtgatgtctg

SEQ ID NO: 229609 - DNA, 16 bp, P. troglodytes
ccccagtacctgggat

SEQ ID NO: 229610 - DNA, 16 bp, P. troglodytes
ccccagtatttcaaca

SEQ ID NO: 229611 - DNA, 16 bp, P. troglodytes
ccccagtccctggcaa

SEQ ID NO: 229612 - DNA, 16 bp, P. troglodytes
ccccagtctcccaaag

SEQ ID NO: 229613 - DNA, 16 bp, P. troglodytes
ccccagtctcctgagt

SEQ ID NO: 229614 - DNA, 16 bp, P. troglodytes
ccccagtgcccagaga

SEQ ID NO: 229615 - DNA, 16 bp, P. troglodytes
ccccagtgctggaggt

SEQ ID NO: 229616 - DNA, 16 bp, P. troglodytes
ccccagtgggtgcctg

SEQ ID NO: 229617 - DNA, 16 bp, P. troglodytes
ccccagtgtatgttct

SEQ ID NO: 229618 - DNA, 16 bp, P. troglodytes
ccccagtgtgtgttct

SEQ ID NO: 229619 - DNA, 16 bp, P. troglodytes
ccccagttccaggtgg

SEQ ID NO: 229620 - DNA, 16 bp, P. troglodytes
ccccagttgagccttc

SEQ ID NO: 229621 - DNA, 16 bp, P. troglodytes
ccccagtttatgtttt

SEQ ID NO: 229622 - DNA, 16 bp, P. troglodytes
ccccagtttcctcctc

SEQ ID NO: 229623 - DNA, 16 bp, P. troglodytes
ccccataaatgtcttc

SEQ ID NO: 229624 - DNA, 16 bp, P. troglodytes
ccccatacagagtccc

SEQ ID NO: 229625 - DNA, 16 bp, P. troglodytes
ccccataccttgccct

SEQ ID NO: 229626 - DNA, 16 bp, P. troglodytes
ccccatcactctcttt

SEQ ID NO: 229627 - DNA, 16 bp, P. troglodytes
ccccatcagagagaga

SEQ ID NO: 229628 - DNA, 16 bp, P. troglodytes
ccccatcagcaagaag

SEQ ID NO: 229629 - DNA, 16 bp, P. troglodytes
ccccatcatcctgaag

SEQ ID NO: 229630 - DNA, 16 bp, P. troglodytes
ccccatccatcttgct

SEQ ID NO: 229631 - DNA, 16 bp, P. troglodytes
ccccatcccctggcag

SEQ ID NO: 229632 - DNA, 16 bp, P. troglodytes
ccccatcctcatgacc

SEQ ID NO: 229633 - DNA, 16 bp, P. troglodytes
ccccatcctctccagc

SEQ ID NO: 229634 - DNA, 16 bp, P. troglodytes
ccccatctatacaaaa

SEQ ID NO: 229635 - DNA, 17 bp, P. troglodytes
ccccatctctaaaaaaa

SEQ ID NO: 229636 - DNA, 16 bp, P. troglodytes
ccccatctctaaaaca

SEQ ID NO: 229637 - DNA, 16 bp, P. troglodytes
ccccatctctacaata

SEQ ID NO: 229638 - DNA, 16 bp, P. troglodytes
ccccatctctacataa

SEQ ID NO: 229639 - DNA, 16 bp, P. troglodytes
ccccatctgggaggtg

SEQ ID NO: 229640 - DNA, 16 bp, P. troglodytes
ccccatctttagaaaa

SEQ ID NO: 229641 - DNA, 16 bp, P. troglodytes
ccccatgacaggcccc

SEQ ID NO: 229642 - DNA, 16 bp, P. troglodytes
ccccatgacccaatca

SEQ ID NO: 229643 - DNA, 16 bp, P. troglodytes
ccccatgactcaatca

SEQ ID NO: 229644 - DNA, 16 bp, P. troglodytes
ccccatgatccagaca

SEQ ID NO: 229645 - DNA, 16 bp, P. troglodytes
ccccatgattcaatta

SEQ ID NO: 229646 - DNA, 16 bp, P. troglodytes
ccccatgcctcctgac

SEQ ID NO: 229647 - DNA, 16 bp, P. troglodytes
ccccatgcctggctaa

SEQ ID NO: 229648 - DNA, 16 bp, P. troglodytes
ccccatgctgctgttc

SEQ ID NO: 229649 - DNA, 16 bp, P. troglodytes
ccccatgcttttctca

SEQ ID NO: 229650 - DNA, 16 bp, P. troglodytes
ccccatgggaaggcag

SEQ ID NO: 229651 - DNA, 16 bp, P. troglodytes
ccccatgtagctggga

SEQ ID NO: 229652 - DNA, 16 bp, P. troglodytes
ccccattgtgtgatgt

SEQ ID NO: 229653 - DNA, 16 bp, P. troglodytes
ccccattgtgtgtttt

SEQ ID NO: 229654 - DNA, 16 bp, P. troglodytes
ccccatttaaaagtgg

SEQ ID NO: 229655 - DNA, 16 bp, P. troglodytes
ccccatttcctgtttt

SEQ ID NO: 229656 - DNA, 16 bp, P. troglodytes
ccccatttccttgctg

SEQ ID NO: 229657 - DNA, 16 bp, P. troglodytes
ccccatttctacaaaa

SEQ ID NO: 229658 - DNA, 16 bp, P. troglodytes
ccccattttatacatg

SEQ ID NO: 229659 - DNA, 16 bp, P. troglodytes
ccccattttgcagatg

SEQ ID NO: 229660 - DNA, 16 bp, P. troglodytes
cccccaaaagtgctgg

SEQ ID NO: 229661 - DNA, 16 bp, P. troglodytes
cccccaaaatcacact

SEQ ID NO: 229662 - DNA, 16 bp, P. troglodytes
cccccaaaatgctggg

SEQ ID NO: 229663 - DNA, 16 bp, P. troglodytes
cccccaaatatatttt

SEQ ID NO: 229664 - DNA, 16 bp, P. troglodytes
cccccaacacccctgt

SEQ ID NO: 229665 - DNA, 16 bp, P. troglodytes
cccccaacaggccctg

SEQ ID NO: 229666 - DNA, 16 bp, P. troglodytes
cccccaaccccttgtg

SEQ ID NO: 229667 - DNA, 16 bp, P. troglodytes
cccccaaccttggcct

SEQ ID NO: 229668 - DNA, 16 bp, P. troglodytes
cccccacaggccctgg

SEQ ID NO: 229669 - DNA, 16 bp, P. troglodytes
cccccacctcagcttc

SEQ ID NO: 229670 - DNA, 16 bp, P. troglodytes
cccccacctcctgggc

SEQ ID NO: 229671 - DNA, 16 bp, P. troglodytes
cccccacctggtggtc

SEQ ID NO: 229672 - DNA, 16 bp, P. troglodytes
cccccactcctgcctg

SEQ ID NO: 229673 - DNA, 16 bp, P. troglodytes
cccccactctcttttg

SEQ ID NO: 229674 - DNA, 16 bp, P. troglodytes
cccccactgcagctgg

SEQ ID NO: 229675 - DNA, 16 bp, P. troglodytes
cccccagaatctaaaa

SEQ ID NO: 229676 - DNA, 16 bp, P. troglodytes
cccccagagcctccag

SEQ ID NO: 229677 - DNA, 16 bp, P. troglodytes
cccccagcacccagag

SEQ ID NO: 229678 - DNA, 16 bp, P. troglodytes
cccccagcccctgaca

SEQ ID NO: 229679 - DNA, 16 bp, P. troglodytes
cccccagcccctgctg

SEQ ID NO: 229680 - DNA, 16 bp, P. troglodytes
cccccagcccctggaa

SEQ ID NO: 229681 - DNA, 16 bp, P. troglodytes
cccccagccctgcctg

SEQ ID NO: 229682 - DNA, 16 bp, P. troglodytes
cccccagccctggcct

SEQ ID NO: 229683 - DNA, 16 bp, P. troglodytes
cccccagcctcactgc

SEQ ID NO: 229684 - DNA, 16 bp, P. troglodytes
cccccagcctctggca

SEQ ID NO: 229685 - DNA, 16 bp, P. troglodytes
cccccagccttgctgc

SEQ ID NO: 229686 - DNA, 16 bp, P. troglodytes
cccccagctaattttt

SEQ ID NO: 229687 - DNA, 16 bp, P. troglodytes
cccccagctcctgtct

SEQ ID NO: 229688 - DNA, 16 bp, P. troglodytes
cccccagctggagtgc

SEQ ID NO: 229689 - DNA, 16 bp, P. troglodytes
cccccaggcccagctg

SEQ ID NO: 229690 - DNA, 16 bp, P. troglodytes
cccccaggccctggca

SEQ ID NO: 229691 - DNA, 16 bp, P. troglodytes
cccccaggccctgggt

SEQ ID NO: 229692 - DNA, 16 bp, P. troglodytes
cccccagggaccagca

SEQ ID NO: 229693 - DNA, 16 bp, P. troglodytes
cccccagtgtgactgt

SEQ ID NO: 229694 - DNA, 16 bp, P. troglodytes
cccccatccatggaaa

SEQ ID NO: 229695 - DNA, 16 bp, P. troglodytes
cccccatcccctgaca

SEQ ID NO: 229696 - DNA, 16 bp, P. troglodytes
cccccatcctgtgcct

SEQ ID NO: 229697 - DNA, 16 bp, P. troglodytes
cccccatctttaaaaa

SEQ ID NO: 229698 - DNA, 16 bp, P. troglodytes
cccccattgtatctag

SEQ ID NO: 229699 - DNA, 16 bp, P. troglodytes
ccccccaccaagctgg

SEQ ID NO: 229700 - DNA, 16 bp, P. troglodytes
ccccccagcaggggca

SEQ ID NO: 229701 - DNA, 16 bp, P. troglodytes
ccccccaggaaagtgg

SEQ ID NO: 229702 - DNA, 16 bp, P. troglodytes
ccccccttttttttaa

SEQ ID NO: 229703 - DNA, 16 bp, P. troglodytes
cccccgagtccccaaa

SEQ ID NO: 229704 - DNA, 16 bp, P. troglodytes
cccccgggcccagctg

SEQ ID NO: 229705 - DNA, 16 bp, P. troglodytes
cccccgtgattcagtt

SEQ ID NO: 229706 - DNA, 16 bp, P. troglodytes
ccccctatgttgccca

SEQ ID NO: 229707 - DNA, 16 bp, P. troglodytes
ccccctccgggaggga

SEQ ID NO: 229708 - DNA, 16 bp, P. troglodytes
ccccctgccacctcag

SEQ ID NO: 229709 - DNA, 16 bp, P. troglodytes
ccccctgcctggccag

SEQ ID NO: 229710 - DNA, 16 bp, P. troglodytes
ccccctgctccacggc

SEQ ID NO: 229711 - DNA, 16 bp, P. troglodytes
ccccctgctccatggc

SEQ ID NO: 229712 - DNA, 16 bp, P. troglodytes
ccccctggattcaagc

SEQ ID NO: 229713 - DNA, 16 bp, P. troglodytes
ccccgagggctgctgg

SEQ ID NO: 229714 - DNA, 16 bp, P. troglodytes
ccccggaggctgaggc

SEQ ID NO: 229715 - DNA, 16 bp, P. troglodytes
ccccggaggtggaggc

SEQ ID NO: 229716 - DNA, 16 bp, P. troglodytes
ccccggctctacaaaa

SEQ ID NO: 229717 - DNA, 16 bp, P. troglodytes
ccccgggaggtggagg

SEQ ID NO: 229718 - DNA, 16 bp, P. troglodytes
ccccgggcagtgaggg

SEQ ID NO: 229719 - DNA, 18 bp, P. troglodytes
ccccgggtccccttattt

SEQ ID NO: 229720 - DNA, 16 bp, P. troglodytes
ccccgggttcaagaga

SEQ ID NO: 229721 - DNA, 18 bp, P. troglodytes
ccccgggttcatgccatt

SEQ ID NO: 229722 - DNA, 16 bp, P. troglodytes
ccccgtctgggaggtg

SEQ ID NO: 229723 - DNA, 16 bp, P. troglodytes
ccccgtgggacaaaag

SEQ ID NO: 229724 - DNA, 16 bp, P. troglodytes
cccctacttcacacca

SEQ ID NO: 229725 - DNA, 16 bp, P. troglodytes
cccctagcccctggca

SEQ ID NO: 229726 - DNA, 16 bp, P. troglodytes
cccctagtgctgtctc

SEQ ID NO: 229727 - DNA, 16 bp, P. troglodytes
cccctcacccatcatg

SEQ ID NO: 229728 - DNA, 16 bp, P. troglodytes
cccctcactgcccagg

SEQ ID NO: 229729 - DNA, 16 bp, P. troglodytes
cccctcaggttcaagc

SEQ ID NO: 229730 - DNA, 16 bp, P. troglodytes
cccctcatccatgtcc

SEQ ID NO: 229731 - DNA, 16 bp, P. troglodytes
cccctcccaccacagg

SEQ ID NO: 229732 - DNA, 16 bp, P. troglodytes
cccctcccagccctgg

SEQ ID NO: 229733 - DNA, 16 bp, P. troglodytes
cccctcccagtgtcca

SEQ ID NO: 229734 - DNA, 16 bp, P. troglodytes
cccctcccccagaaaa

SEQ ID NO: 229735 - DNA, 16 bp, P. troglodytes
cccctcccctgccagg

SEQ ID NO: 229736 - DNA, 16 bp, P. troglodytes
cccctccctgtggtgc

SEQ ID NO: 229737 - DNA, 16 bp, P. troglodytes
cccctcccttcacagg

SEQ ID NO: 229738 - DNA, 16 bp, P. troglodytes
cccctccgggccccag

SEQ ID NO: 229739 - DNA, 16 bp, P. troglodytes
cccctcctccagcctt

SEQ ID NO: 229740 - DNA, 16 bp, P. troglodytes
cccctcctccaggaag

SEQ ID NO: 229741 - DNA, 16 bp, P. troglodytes
cccctcctctcagcca

SEQ ID NO: 229742 - DNA, 16 bp, P. troglodytes
cccctcggcctcccaa

SEQ ID NO: 229743 - DNA, 16 bp, P. troglodytes
cccctctcacactttg

SEQ ID NO: 229744 - DNA, 16 bp, P. troglodytes
cccctctcctggctgc

SEQ ID NO: 229745 - DNA, 16 bp, P. troglodytes
cccctctctctgcagc

SEQ ID NO: 229746 - DNA, 16 bp, P. troglodytes
cccctctctgagcctc

SEQ ID NO: 229747 - DNA, 16 bp, P. troglodytes
cccctctgcctcccaa

SEQ ID NO: 229748 - DNA, 37 bp, P. troglodytes
cccctctgcctggctgcccagtctggaaagtgaggag

SEQ ID NO: 229749 - DNA, 16 bp, P. troglodytes
cccctctggcccagag

SEQ ID NO: 229750 - DNA, 16 bp, P. troglodytes
cccctgaagtccagcc

SEQ ID NO: 229751 - DNA, 16 bp, P. troglodytes
cccctgacccctgagc

SEQ ID NO: 229752 - DNA, 16 bp, P. troglodytes
cccctgacctcaagca

SEQ ID NO: 229753 - DNA, 16 bp, P. troglodytes
cccctgagacagagtc

SEQ ID NO: 229754 - DNA, 16 bp, P. troglodytes
cccctgagctcaggag

SEQ ID NO: 229755 - DNA, 16 bp, P. troglodytes
cccctgaggactggag

SEQ ID NO: 229756 - DNA, 16 bp, P. troglodytes
cccctgaggtcaagag

SEQ ID NO: 229757 - DNA, 16 bp, P. troglodytes
cccctgagtcctcaaa

SEQ ID NO: 229758 - DNA, 16 bp, P. troglodytes
cccctgcacctggcct

SEQ ID NO: 229759 - DNA, 16 bp, P. troglodytes
cccctgcagcaaactt

SEQ ID NO: 229760 - DNA, 16 bp, P. troglodytes
cccctgcagtcccagc

SEQ ID NO: 229761 - DNA, 16 bp, P. troglodytes
cccctgcccacaaaac

SEQ ID NO: 229762 - DNA, 16 bp, P. troglodytes
cccctgcccagccctg

SEQ ID NO: 229763 - DNA, 16 bp, P. troglodytes
cccctgcccagggagc

SEQ ID NO: 229764 - DNA, 16 bp, P. troglodytes
cccctgcctcagcttc

SEQ ID NO: 229765 - DNA, 16 bp, P. troglodytes
cccctgcctgcaaaac

SEQ ID NO: 229766 - DNA, 16 bp, P. troglodytes
cccctgcctgccccag

SEQ ID NO: 229767 - DNA, 16 bp, P. troglodytes
cccctgcctgggctcc

SEQ ID NO: 229768 - DNA, 16 bp, P. troglodytes
cccctgcctgtggagt

SEQ ID NO: 229769 - DNA, 16 bp, P. troglodytes
cccctgctgggaggtg

SEQ ID NO: 229770 - DNA, 16 bp, P. troglodytes
cccctggactccagcc

SEQ ID NO: 229771 - DNA, 16 bp, P. troglodytes
cccctggatgcccagc

SEQ ID NO: 229772 - DNA, 16 bp, P. troglodytes
cccctggccacccaga

SEQ ID NO: 229773 - DNA, 16 bp, P. troglodytes
cccctggctaattttt

SEQ ID NO: 229774 - DNA, 16 bp, P. troglodytes
cccctgggatggagct

SEQ ID NO: 229775 - DNA, 16 bp, P. troglodytes
cccctgggccctgaat

SEQ ID NO: 229776 - DNA, 16 bp, P. troglodytes
cccctgggtggagatt

SEQ ID NO: 229777 - DNA, 16 bp, P. troglodytes
cccctggttaattttt

SEQ ID NO: 229778 - DNA, 16 bp, P. troglodytes
cccctggttgagaacc

SEQ ID NO: 229779 - DNA, 16 bp, P. troglodytes
cccctgtacaagctct

SEQ ID NO: 229780 - DNA, 16 bp, P. troglodytes
cccctgtcacctgact

SEQ ID NO: 229781 - DNA, 16 bp, P. troglodytes
cccctgtctcaaaaaa

SEQ ID NO: 229782 - DNA, 16 bp, P. troglodytes
cccctgtctcagcctc

SEQ ID NO: 229783 - DNA, 16 bp, P. troglodytes
cccctgtctccacaaa

SEQ ID NO: 229784 - DNA, 16 bp, P. troglodytes
cccctgtgacctgcac

SEQ ID NO: 229785 - DNA, 16 bp, P. troglodytes
cccctgtgacttgcac

SEQ ID NO: 229786 - DNA, 16 bp, P. troglodytes
cccctgtgctccacct

SEQ ID NO: 229787 - DNA, 16 bp, P. troglodytes
cccctgtggataccaa

SEQ ID NO: 229788 - DNA, 16 bp, P. troglodytes
ccccttcaagctggct

SEQ ID NO: 229789 - DNA, 16 bp, P. troglodytes
ccccttcatcttctgc

SEQ ID NO: 229790 - DNA, 16 bp, P. troglodytes
ccccttccaaatctca

SEQ ID NO: 229791 - DNA, 16 bp, P. troglodytes
ccccttccaccctgtg

SEQ ID NO: 229792 - DNA, 16 bp, P. troglodytes
ccccttccacgctgtg

SEQ ID NO: 229793 - DNA, 16 bp, P. troglodytes
ccccttcccttcccag

SEQ ID NO: 229794 - DNA, 16 bp, P. troglodytes
ccccttcctgggatgg

SEQ ID NO: 229795 - DNA, 16 bp, P. troglodytes
ccccttcctgtctcca

SEQ ID NO: 229796 - DNA, 16 bp, P. troglodytes
ccccttgagcttcctg

SEQ ID NO: 229797 - DNA, 16 bp, P. troglodytes
cccctttaaatattga

SEQ ID NO: 229798 - DNA, 21 bp, P. troglodytes
cccctttgactgtaattttcc

SEQ ID NO: 229799 - DNA, 16 bp, P. troglodytes
cccgacctcatgatct

SEQ ID NO: 229800 - DNA, 16 bp, P. troglodytes
cccgactaattttttt

SEQ ID NO: 229801 - DNA, 16 bp, P. troglodytes
cccgagactgggtgat

SEQ ID NO: 229802 - DNA, 16 bp, P. troglodytes
cccgaggcaggagaat

SEQ ID NO: 229803 - DNA, 16 bp, P. troglodytes
cccgaggcaggcagat

SEQ ID NO: 229804 - DNA, 18 bp, P. troglodytes
cccgaggcgggtggatca

SEQ ID NO: 229805 - DNA, 16 bp, P. troglodytes
cccgaggtcacacagc

SEQ ID NO: 229806 - DNA, 16 bp, P. troglodytes
cccgcaagcagaggga

SEQ ID NO: 229807 - DNA, 16 bp, P. troglodytes
cccgcacctggctcgg

SEQ ID NO: 229808 - DNA, 16 bp, P. troglodytes
cccgccaccatggccg

SEQ ID NO: 229809 - DNA, 16 bp, P. troglodytes
cccgccattgctcagg

SEQ ID NO: 229810 - DNA, 16 bp, P. troglodytes
cccgcccaccttggcc

SEQ ID NO: 229811 - DNA, 16 bp, P. troglodytes
cccgcctcagactcct

SEQ ID NO: 229812 - DNA, 16 bp, P. troglodytes
cccgcctcagcatccc

SEQ ID NO: 229813 - DNA, 16 bp, P. troglodytes
cccgcctcagcctccg

SEQ ID NO: 229814 - DNA, 16 bp, P. troglodytes
cccgcctcagcctctc

SEQ ID NO: 229815 - DNA, 16 bp, P. troglodytes
cccgcctcagctccca

SEQ ID NO: 229816 - DNA, 16 bp, P. troglodytes
cccgcctcaggctcct

SEQ ID NO: 229817 - DNA, 16 bp, P. troglodytes
cccgcctcggcctcca

SEQ ID NO: 229818 - DNA, 16 bp, P. troglodytes
cccgcctctgcctcca

SEQ ID NO: 229819 - DNA, 16 bp, P. troglodytes
cccgcctgcctgcctg

SEQ ID NO: 229820 - DNA, 16 bp, P. troglodytes
cccgcctgggcctcct

SEQ ID NO: 229821 - DNA, 17 bp, P. troglodytes
cccgcctgtagtcccag

SEQ ID NO: 229822 - DNA, 16 bp, P. troglodytes
cccgccttagcctccc

SEQ ID NO: 229823 - DNA, 16 bp, P. troglodytes
cccgccttagcctctc

SEQ ID NO: 229824 - DNA, 16 bp, P. troglodytes
cccgcgcctggctcag

SEQ ID NO: 229825 - DNA, 16 bp, P. troglodytes
cccgctgcagcctccc

SEQ ID NO: 229826 - DNA, 16 bp, P. troglodytes
cccgcttaggcctccc

SEQ ID NO: 229827 - DNA, 16 bp, P. troglodytes
cccggaagatggaggt

SEQ ID NO: 229828 - DNA, 16 bp, P. troglodytes
cccggaggcagaagtt

SEQ ID NO: 229829 - DNA, 16 bp, P. troglodytes
cccggcaaatttttgt

SEQ ID NO: 229830 - DNA, 16 bp, P. troglodytes
cccggcatggtggtgg

SEQ ID NO: 229831 - DNA, 16 bp, P. troglodytes
cccggccaccccgtct

SEQ ID NO: 229832 - DNA, 16 bp, P. troglodytes
cccggccagcatggtg

SEQ ID NO: 229833 - DNA, 16 bp, P. troglodytes
cccggccaggcgcggt

SEQ ID NO: 229834 - DNA, 22 bp, P. troglodytes
cccggccgccatcccatctagg

SEQ ID NO: 229835 - DNA, 16 bp, P. troglodytes
cccggcctgatttttt

SEQ ID NO: 229836 - DNA, 16 bp, P. troglodytes
cccggccttctttttt

SEQ ID NO: 229837 - DNA, 16 bp, P. troglodytes
cccggctaacttttgt

SEQ ID NO: 229838 - DNA, 16 bp, P. troglodytes
cccggctaatttgtat

SEQ ID NO: 229839 - DNA, 16 bp, P. troglodytes
cccggctacctgggag

SEQ ID NO: 229840 - DNA, 16 bp, P. troglodytes
cccggctcaagtgatc

SEQ ID NO: 229841 - DNA, 16 bp, P. troglodytes
cccgggaagcagagat

SEQ ID NO: 229842 - DNA, 16 bp, P. troglodytes
cccgggagcagaggtt

SEQ ID NO: 229843 - DNA, 16 bp, P. troglodytes
cccgggagccggaggt

SEQ ID NO: 229844 - DNA, 16 bp, P. troglodytes
cccgggagctggaggt

SEQ ID NO: 229845 - DNA, 16 bp, P. troglodytes
cccgggaggaggaggc

SEQ ID NO: 229846 - DNA, 16 bp, P. troglodytes
cccgggaggcagagct

SEQ ID NO: 229847 - DNA, 16 bp, P. troglodytes
cccgggaggcagaggc

SEQ ID NO: 229848 - DNA, 16 bp, P. troglodytes
cccgggaggcaggagg

SEQ ID NO: 229849 - DNA, 16 bp, P. troglodytes
cccgggaggccgaggc

SEQ ID NO: 229850 - DNA, 16 bp, P. troglodytes
cccgggaggcggcggt

SEQ ID NO: 229851 - DNA, 16 bp, P. troglodytes
cccgggctccagcgat

SEQ ID NO: 229852 - DNA, 16 bp, P. troglodytes
cccggggaggcagagg

SEQ ID NO: 229853 - DNA, 16 bp, P. troglodytes
cccgggtggcagaggt

SEQ ID NO: 229854 - DNA, 18 bp, P. troglodytes
cccggtgcgggatccact

SEQ ID NO: 229855 - DNA, 16 bp, P. troglodytes
cccgtaatcccagctg

SEQ ID NO: 229856 - DNA, 17 bp, P. troglodytes
cccgtagtgctgggatt

SEQ ID NO: 229857 - DNA, 16 bp, P. troglodytes
cccgtctcagcctccc

SEQ ID NO: 229858 - DNA, 16 bp, P. troglodytes
cccgtctctacaaaaa

SEQ ID NO: 229859 - DNA, 16 bp, P. troglodytes
cccgtctctaccaaat

SEQ ID NO: 229860 - DNA, 16 bp, P. troglodytes
cccgtctctaccgaaa

SEQ ID NO: 229861 - DNA, 16 bp, P. troglodytes
cccgtctctactaata

SEQ ID NO: 229862 - DNA, 16 bp, P. troglodytes
cccgtctctagaaaaa

SEQ ID NO: 229863 - DNA, 16 bp, P. troglodytes
cccgtctgtagtaaaa

SEQ ID NO: 229864 - DNA, 16 bp, P. troglodytes
cccgtctttaataaaa

SEQ ID NO: 229865 - DNA, 16 bp, P. troglodytes
cccgtctttacaaaaa

SEQ ID NO: 229866 - DNA, 17 bp, P. troglodytes
cccgtgacacagcctca

SEQ ID NO: 229867 - DNA, 16 bp, P. troglodytes
cccgtgccaccacgcc

SEQ ID NO: 229868 - DNA, 16 bp, P. troglodytes
cccgtggggcagggct

SEQ ID NO: 229869 - DNA, 16 bp, P. troglodytes
ccctaaatccttaaaa

SEQ ID NO: 229870 - DNA, 16 bp, P. troglodytes
ccctaaatgccatcac

SEQ ID NO: 229871 - DNA, 16 bp, P. troglodytes
ccctaaccccaggctg

SEQ ID NO: 229872 - DNA, 16 bp, P. troglodytes
ccctaactctcttcaa

SEQ ID NO: 229873 - DNA, 16 bp, P. troglodytes
ccctaagcagtttcca

SEQ ID NO: 229874 - DNA, 16 bp, P. troglodytes
ccctaagtgtgtcttt

SEQ ID NO: 229875 - DNA, 16 bp, P. troglodytes
ccctaataagcctgag

SEQ ID NO: 229876 - DNA, 16 bp, P. troglodytes
ccctaatggagaacct

SEQ ID NO: 229877 - DNA, 16 bp, P. troglodytes
ccctaatggcttccct

SEQ ID NO: 229878 - DNA, 16 bp, P. troglodytes
ccctaccatgcccagc

SEQ ID NO: 229879 - DNA, 16 bp, P. troglodytes
ccctacccagagagga

SEQ ID NO: 229880 - DNA, 16 bp, P. troglodytes
ccctacctcagcctcc

SEQ ID NO: 229881 - DNA, 16 bp, P. troglodytes
ccctaccttgtgctgc

SEQ ID NO: 229882 - DNA, 16 bp, P. troglodytes
ccctacgaaggacatg

SEQ ID NO: 229883 - DNA, 16 bp, P. troglodytes
ccctactatgtgtcag

SEQ ID NO: 229884 - DNA, 16 bp, P. troglodytes
ccctactgacaccttg

SEQ ID NO: 229885 - DNA, 16 bp, P. troglodytes
ccctactgggaggtgc

SEQ ID NO: 229886 - DNA, 16 bp, P. troglodytes
ccctagaagaacacct

SEQ ID NO: 229887 - DNA, 16 bp, P. troglodytes
ccctagagatctgtgg

SEQ ID NO: 229888 - DNA, 16 bp, P. troglodytes
ccctagatgctgccat

SEQ ID NO: 229889 - DNA, 16 bp, P. troglodytes
ccctagcagaggttct

SEQ ID NO: 229890 - DNA, 16 bp, P. troglodytes
ccctagctgcaaggga

SEQ ID NO: 229891 - DNA, 16 bp, P. troglodytes
ccctaggcctcccaaa

SEQ ID NO: 229892 - DNA, 16 bp, P. troglodytes
ccctaggtccctccca

SEQ ID NO: 229893 - DNA, 16 bp, P. troglodytes
ccctatcaaaatatca

SEQ ID NO: 229894 - DNA, 16 bp, P. troglodytes
ccctatgtacctcttc

SEQ ID NO: 229895 - DNA, 16 bp, P. troglodytes
ccctatgtatctcttc

SEQ ID NO: 229896 - DNA, 16 bp, P. troglodytes
ccctattttaaagtca

SEQ ID NO: 229897 - DNA, 16 bp, P. troglodytes
ccctatttttcagatg

SEQ ID NO: 229898 - DNA, 16 bp, P. troglodytes
ccctcaaaccttgtta

SEQ ID NO: 229899 - DNA, 17 bp, P. troglodytes
ccctcaaagggaagccc

SEQ ID NO: 229900 - DNA, 16 bp, P. troglodytes
ccctcaacctcctgag

SEQ ID NO: 229901 - DNA, 16 bp, P. troglodytes
ccctcaagaatggctt

SEQ ID NO: 229902 - DNA, 16 bp, P. troglodytes
ccctcaagcaggcccc

SEQ ID NO: 229903 - DNA, 16 bp, P. troglodytes
ccctcaccagaagcca

SEQ ID NO: 229904 - DNA, 16 bp, P. troglodytes
ccctcaccagacatca

SEQ ID NO: 229905 - DNA, 17 bp, P. troglodytes
ccctcaccccacgacag

SEQ ID NO: 229906 - DNA, 16 bp, P. troglodytes
ccctcacctcccagac

SEQ ID NO: 229907 - DNA, 16 bp, P. troglodytes
ccctcagaaataacgc

SEQ ID NO: 229908 - DNA, 16 bp, P. troglodytes
ccctcagacccaggag

SEQ ID NO: 229909 - DNA, 16 bp, P. troglodytes
ccctcagactggggct

SEQ ID NO: 229910 - DNA, 16 bp, P. troglodytes
ccctcagagcctccag

SEQ ID NO: 229911 - DNA, 16 bp, P. troglodytes
ccctcagcccctggca

SEQ ID NO: 229912 - DNA, 16 bp, P. troglodytes
ccctcagcctcagcct

SEQ ID NO: 229913 - DNA, 23 bp, P. troglodytes
ccctcagctgcaggtctgttgga

SEQ ID NO: 229914 - DNA, 16 bp, P. troglodytes
ccctcagggagctcac

SEQ ID NO: 229915 - DNA, 16 bp, P. troglodytes
ccctcagtcaaattct

SEQ ID NO: 229916 - DNA, 16 bp, P. troglodytes
ccctcatgaatggatt

SEQ ID NO: 229917 - DNA, 16 bp, P. troglodytes
ccctcatgaatgggat

SEQ ID NO: 229918 - DNA, 16 bp, P. troglodytes
ccctcatgctgttttc

SEQ ID NO: 229919 - DNA, 16 bp, P. troglodytes
ccctcatggagaacct

SEQ ID NO: 229920 - DNA, 17 bp, P. troglodytes
ccctccaaaggatcaca

SEQ ID NO: 229921 - DNA, 16 bp, P. troglodytes
ccctccaatggcttcc

SEQ ID NO: 229922 - DNA, 16 bp, P. troglodytes
ccctccaccacgcctg

SEQ ID NO: 229923 - DNA, 16 bp, P. troglodytes
ccctccactgttgtcc

SEQ ID NO: 229924 - DNA, 16 bp, P. troglodytes
ccctccagcccctggc

SEQ ID NO: 229925 - DNA, 16 bp, P. troglodytes
ccctccagcctcagcc

SEQ ID NO: 229926 - DNA, 16 bp, P. troglodytes
ccctccagcctgggcc

SEQ ID NO: 229927 - DNA, 16 bp, P. troglodytes
ccctccataatgtgag

SEQ ID NO: 229928 - DNA, 16 bp, P. troglodytes
ccctccatgggctcct

SEQ ID NO: 229929 - DNA, 16 bp, P. troglodytes
ccctcccaaggtgctg

SEQ ID NO: 229930 - DNA, 16 bp, P. troglodytes
ccctcccacagcacat

SEQ ID NO: 229931 - DNA, 16 bp, P. troglodytes
ccctcccacctcagtc

SEQ ID NO: 229932 - DNA, 16 bp, P. troglodytes
ccctcccagccctggc

SEQ ID NO: 229933 - DNA, 16 bp, P. troglodytes
ccctcccagccctggg

SEQ ID NO: 229934 - DNA, 16 bp, P. troglodytes
ccctcccagcctccag

SEQ ID NO: 229935 - DNA, 16 bp, P. troglodytes
ccctcccaggttcaag

SEQ ID NO: 229936 - DNA, 16 bp, P. troglodytes
ccctccccaagtttgc

SEQ ID NO: 229937 - DNA, 16 bp, P. troglodytes
ccctccccaggctctg

SEQ ID NO: 229938 - DNA, 16 bp, P. troglodytes
ccctccccagtagctg

SEQ ID NO: 229939 - DNA, 16 bp, P. troglodytes
ccctccccagtctctg

SEQ ID NO: 229940 - DNA, 16 bp, P. troglodytes
ccctcccccagccagg

SEQ ID NO: 229941 - DNA, 16 bp, P. troglodytes
ccctccccctgccaag

SEQ ID NO: 229942 - DNA, 16 bp, P. troglodytes
ccctcccctgacacat

SEQ ID NO: 229943 - DNA, 16 bp, P. troglodytes
ccctcccctgacaggc

SEQ ID NO: 229944 - DNA, 16 bp, P. troglodytes
ccctccccttgagtgt

SEQ ID NO: 229945 - DNA, 16 bp, P. troglodytes
ccctcccgggttcaag

SEQ ID NO: 229946 - DNA, 16 bp, P. troglodytes
ccctccctcctggctg

SEQ ID NO: 229947 - DNA, 16 bp, P. troglodytes
ccctccctgggcctca

SEQ ID NO: 229948 - DNA, 16 bp, P. troglodytes
ccctcccttttggagt

SEQ ID NO: 229949 - DNA, 16 bp, P. troglodytes
ccctccgcccagcagc

SEQ ID NO: 229950 - DNA, 16 bp, P. troglodytes
ccctccgtgggctgca

SEQ ID NO: 229951 - DNA, 16 bp, P. troglodytes
ccctcctcactctgct

SEQ ID NO: 229952 - DNA, 16 bp, P. troglodytes
ccctcctcagcttccc

SEQ ID NO: 229953 - DNA, 16 bp, P. troglodytes
ccctcctcagtctcct

SEQ ID NO: 229954 - DNA, 16 bp, P. troglodytes
ccctcctccagcctct

SEQ ID NO: 229955 - DNA, 16 bp, P. troglodytes
ccctcctcccccaggg

SEQ ID NO: 229956 - DNA, 16 bp, P. troglodytes
ccctcctcctcagcct

SEQ ID NO: 229957 - DNA, 16 bp, P. troglodytes
ccctcctccttaattt

SEQ ID NO: 229958 - DNA, 16 bp, P. troglodytes
ccctcctgcaaccaat

SEQ ID NO: 229959 - DNA, 20 bp, P. troglodytes
ccctcctgcctcagcctccc

SEQ ID NO: 229960 - DNA, 16 bp, P. troglodytes
ccctcctgcctcccag

SEQ ID NO: 229961 - DNA, 16 bp, P. troglodytes
ccctcctgcctgggcc

SEQ ID NO: 229962 - DNA, 16 bp, P. troglodytes
ccctcctgccttggct

SEQ ID NO: 229963 - DNA, 16 bp, P. troglodytes
ccctcctgctgccttg

SEQ ID NO: 229964 - DNA, 16 bp, P. troglodytes
ccctcctggacggggc

SEQ ID NO: 229965 - DNA, 16 bp, P. troglodytes
ccctcctgggttcaag

SEQ ID NO: 229966 - DNA, 16 bp, P. troglodytes
ccctccttggccaccc

SEQ ID NO: 229967 - DNA, 16 bp, P. troglodytes
ccctcgacctcccaaa

SEQ ID NO: 229968 - DNA, 16 bp, P. troglodytes
ccctcgccagacacca

SEQ ID NO: 229969 - DNA, 16 bp, P. troglodytes
ccctctaaacactgct

SEQ ID NO: 229970 - DNA, 16 bp, P. troglodytes
ccctctacacattgct

SEQ ID NO: 229971 - DNA, 16 bp, P. troglodytes
ccctctactgacaaag

SEQ ID NO: 229972 - DNA, 16 bp, P. troglodytes
ccctctcactgtgtcc

SEQ ID NO: 229973 - DNA, 16 bp, P. troglodytes
ccctctcattttacag

SEQ ID NO: 229974 - DNA, 16 bp, P. troglodytes
ccctctcgcccaggct

SEQ ID NO: 229975 - DNA, 16 bp, P. troglodytes
ccctctctacaaaaaa

SEQ ID NO: 229976 - DNA, 16 bp, P. troglodytes
ccctctctgagccttg

SEQ ID NO: 229977 - DNA, 16 bp, P. troglodytes
ccctctctggagcaat

SEQ ID NO: 229978 - DNA, 16 bp, P. troglodytes
ccctctcttctagctt

SEQ ID NO: 229979 - DNA, 16 bp, P. troglodytes
ccctctcttgggatct

SEQ ID NO: 229980 - DNA, 16 bp, P. troglodytes
ccctctgagatgaaac

SEQ ID NO: 229981 - DNA, 16 bp, P. troglodytes
ccctctgagccaggtg

SEQ ID NO: 229982 - DNA, 16 bp, P. troglodytes
ccctctgaggctcacc

SEQ ID NO: 229983 - DNA, 16 bp, P. troglodytes
ccctctgcagccactg

SEQ ID NO: 229984 - DNA, 16 bp, P. troglodytes
ccctctgcagccgctg

SEQ ID NO: 229985 - DNA, 16 bp, P. troglodytes
ccctctgcagctgctg

SEQ ID NO: 229986 - DNA, 16 bp, P. troglodytes
ccctctgccacctcca

SEQ ID NO: 229987 - DNA, 16 bp, P. troglodytes
ccctctgcctcagttt

SEQ ID NO: 229988 - DNA, 16 bp, P. troglodytes
ccctctgcctccaggg

SEQ ID NO: 229989 - DNA, 16 bp, P. troglodytes
ccctctgcctgcctca

SEQ ID NO: 229990 - DNA, 16 bp, P. troglodytes
ccctctgcctggccgc

SEQ ID NO: 229991 - DNA, 16 bp, P. troglodytes
ccctctgctgcccagg

SEQ ID NO: 229992 - DNA, 16 bp, P. troglodytes
ccctctgctgctgctg

SEQ ID NO: 229993 - DNA, 16 bp, P. troglodytes
ccctctggcccaggga

SEQ ID NO: 229994 - DNA, 16 bp, P. troglodytes
ccctctgggcctcagt

SEQ ID NO: 229995 - DNA, 16 bp, P. troglodytes
ccctctgggctccaca

SEQ ID NO: 229996 - DNA, 16 bp, P. troglodytes
ccctctgtaaaatggg

SEQ ID NO: 229997 - DNA, 16 bp, P. troglodytes
ccctctgtcacccagt

SEQ ID NO: 229998 - DNA, 16 bp, P. troglodytes
ccctctgtctcctggg

SEQ ID NO: 229999 - DNA, 16 bp, P. troglodytes
ccctctgtgcctcagt

SEQ ID NO: 230000 - DNA, 16 bp, P. troglodytes
ccctctgtttcccagg

SEQ ID NO: 230001 - DNA, 16 bp, P. troglodytes
ccctcttcaataaatg

SEQ ID NO: 230002 - DNA, 16 bp, P. troglodytes
ccctcttcaccttctg

SEQ ID NO: 230003 - DNA, 16 bp, P. troglodytes
ccctctttaataaatg

SEQ ID NO: 230004 - DNA, 16 bp, P. troglodytes
ccctctttgccttctg

SEQ ID NO: 230005 - DNA, 16 bp, P. troglodytes
ccctgaaaaagaaaaa

SEQ ID NO: 230006 - DNA, 16 bp, P. troglodytes
ccctgaaatgtctgat

SEQ ID NO: 230007 - DNA, 16 bp, P. troglodytes
ccctgaaccctgagta

SEQ ID NO: 230008 - DNA, 16 bp, P. troglodytes
ccctgaactcctggcc

SEQ ID NO: 230009 - DNA, 16 bp, P. troglodytes
ccctgaactggaataa

SEQ ID NO: 230010 - DNA, 16 bp, P. troglodytes
ccctgaagactttcca

SEQ ID NO: 230011 - DNA, 16 bp, P. troglodytes
ccctgaagccccagag

SEQ ID NO: 230012 - DNA, 16 bp, P. troglodytes
ccctgaaggaaaggac

SEQ ID NO: 230013 - DNA, 16 bp, P. troglodytes
ccctgaaggacagtgg

SEQ ID NO: 230014 - DNA, 16 bp, P. troglodytes
ccctgaaggctcagag

SEQ ID NO: 230015 - DNA, 16 bp, P. troglodytes
ccctgaagggaaagac

SEQ ID NO: 230016 - DNA, 16 bp, P. troglodytes
ccctgacaacaccttg

SEQ ID NO: 230017 - DNA, 16 bp, P. troglodytes
ccctgacccccatgcc

SEQ ID NO: 230018 - DNA, 16 bp, P. troglodytes
ccctgaccctccactg

SEQ ID NO: 230019 - DNA, 16 bp, P. troglodytes
ccctgaccctgaccct

SEQ ID NO: 230020 - DNA, 17 bp, P. troglodytes
ccctgacctcaagtgat

SEQ ID NO: 230021 - DNA, 17 bp, P. troglodytes
ccctgacctcaggtgat

SEQ ID NO: 230022 - DNA, 16 bp, P. troglodytes
ccctgacctcgtgatc

SEQ ID NO: 230023 - DNA, 16 bp, P. troglodytes
ccctgacttcaggtga

SEQ ID NO: 230024 - DNA, 16 bp, P. troglodytes
ccctgagataactttg

SEQ ID NO: 230025 - DNA, 16 bp, P. troglodytes
ccctgagcaagaagga

SEQ ID NO: 230026 - DNA, 16 bp, P. troglodytes
ccctgagcagagaatc

SEQ ID NO: 230027 - DNA, 16 bp, P. troglodytes
ccctgagcccagggag

SEQ ID NO: 230028 - DNA, 16 bp, P. troglodytes
ccctgagcctccattt

SEQ ID NO: 230029 - DNA, 16 bp, P. troglodytes
ccctgagcctgcaggg

SEQ ID NO: 230030 - DNA, 16 bp, P. troglodytes
ccctgagcctggccca

SEQ ID NO: 230031 - DNA, 16 bp, P. troglodytes
ccctgagctagataca

SEQ ID NO: 230032 - DNA, 16 bp, P. troglodytes
ccctgagctctgtgag

SEQ ID NO: 230033 - DNA, 16 bp, P. troglodytes
ccctgagcttgctttc

SEQ ID NO: 230034 - DNA, 18 bp, P. troglodytes
ccctgaggaatggccaca

SEQ ID NO: 230035 - DNA, 16 bp, P. troglodytes
ccctgaggtcacacag

SEQ ID NO: 230036 - DNA, 17 bp, P. troglodytes
ccctgaggtcgggagtt

SEQ ID NO: 230037 - DNA, 16 bp, P. troglodytes
ccctgaggtctcccca

SEQ ID NO: 230038 - DNA, 16 bp, P. troglodytes
ccctgagttcccaaag

SEQ ID NO: 230039 - DNA, 16 bp, P. troglodytes
ccctgatctcagactt

SEQ ID NO: 230040 - DNA, 16 bp, P. troglodytes
ccctgattactaatga

SEQ ID NO: 230041 - DNA, 16 bp, P. troglodytes
ccctgattttatcatt

SEQ ID NO: 230042 - DNA, 16 bp, P. troglodytes
ccctgcaaagccatct

SEQ ID NO: 230043 - DNA, 16 bp, P. troglodytes
ccctgcaaaggacaca

SEQ ID NO: 230044 - DNA, 16 bp, P. troglodytes
ccctgcaaagtcacag

SEQ ID NO: 230045 - DNA, 16 bp, P. troglodytes
ccctgcacaaattctc

SEQ ID NO: 230046 - DNA, 16 bp, P. troglodytes
ccctgcactccagccc

SEQ ID NO: 230047 - DNA, 16 bp, P. troglodytes
ccctgcactctctctc

SEQ ID NO: 230048 - DNA, 16 bp, P. troglodytes
ccctgcactgcagcct

SEQ ID NO: 230049 - DNA, 16 bp, P. troglodytes
ccctgcagcccctggc

SEQ ID NO: 230050 - DNA, 16 bp, P. troglodytes
ccctgcagccctgcag

SEQ ID NO: 230051 - DNA, 16 bp, P. troglodytes
ccctgcagcctcagcc

SEQ ID NO: 230052 - DNA, 16 bp, P. troglodytes
ccctgcagcctctgct

SEQ ID NO: 230053 - DNA, 16 bp, P. troglodytes
ccctgcaggcagtcag

SEQ ID NO: 230054 - DNA, 16 bp, P. troglodytes
ccctgcatgcattagc

SEQ ID NO: 230055 - DNA, 16 bp, P. troglodytes
ccctgcatttgcatat

SEQ ID NO: 230056 - DNA, 16 bp, P. troglodytes
ccctgccaacaccttg

SEQ ID NO: 230057 - DNA, 16 bp, P. troglodytes
ccctgccaactcagaa

SEQ ID NO: 230058 - DNA, 16 bp, P. troglodytes
ccctgccacacacaca

SEQ ID NO: 230059 - DNA, 16 bp, P. troglodytes
ccctgccagccagaga

SEQ ID NO: 230060 - DNA, 16 bp, P. troglodytes
ccctgcccactgcctg

SEQ ID NO: 230061 - DNA, 16 bp, P. troglodytes
ccctgcccagaaggaa

SEQ ID NO: 230062 - DNA, 16 bp, P. troglodytes
ccctgcccagccagcc

SEQ ID NO: 230063 - DNA, 16 bp, P. troglodytes
ccctgcccagcccagc

SEQ ID NO: 230064 - DNA, 16 bp, P. troglodytes
ccctgcccagcctcct

SEQ ID NO: 230065 - DNA, 16 bp, P. troglodytes
ccctgccccagcccag

SEQ ID NO: 230066 - DNA, 16 bp, P. troglodytes
ccctgccccaggcctc

SEQ ID NO: 230067 - DNA, 16 bp, P. troglodytes
ccctgcccccagagct

SEQ ID NO: 230068 - DNA, 17 bp, P. troglodytes
ccctgcccccagaggtg

SEQ ID NO: 230069 - DNA, 16 bp, P. troglodytes
ccctgcccctacagca

SEQ ID NO: 230070 - DNA, 16 bp, P. troglodytes
ccctgcccctgcagca

SEQ ID NO: 230071 - DNA, 16 bp, P. troglodytes
ccctgccctcagagag

SEQ ID NO: 230072 - DNA, 16 bp, P. troglodytes
ccctgccctcaggaag

SEQ ID NO: 230073 - DNA, 16 bp, P. troglodytes
ccctgccctcctgggc

SEQ ID NO: 230074 - DNA, 16 bp, P. troglodytes
ccctgccctgccactg

SEQ ID NO: 230075 - DNA, 16 bp, P. troglodytes
ccctgccctgcccagc

SEQ ID NO: 230076 - DNA, 16 bp, P. troglodytes
ccctgccctgccctca

SEQ ID NO: 230077 - DNA, 16 bp, P. troglodytes
ccctgccctgctctgc

SEQ ID NO: 230078 - DNA, 16 bp, P. troglodytes
ccctgccctggccctg

SEQ ID NO: 230079 - DNA, 16 bp, P. troglodytes
ccctgcccttccccag

SEQ ID NO: 230080 - DNA, 16 bp, P. troglodytes
ccctgcccttggggag

SEQ ID NO: 230081 - DNA, 16 bp, P. troglodytes
ccctgcctcagccacc

SEQ ID NO: 230082 - DNA, 16 bp, P. troglodytes
ccctgcctcagcctcc

SEQ ID NO: 230083 - DNA, 16 bp, P. troglodytes
ccctgcctcagcctct

SEQ ID NO: 230084 - DNA, 16 bp, P. troglodytes
ccctgcctcagcctgc

SEQ ID NO: 230085 - DNA, 16 bp, P. troglodytes
ccctgcctcagccttc

SEQ ID NO: 230086 - DNA, 16 bp, P. troglodytes
ccctgcctcagggcct

SEQ ID NO: 230087 - DNA, 16 bp, P. troglodytes
ccctgcctccacttgc

SEQ ID NO: 230088 - DNA, 16 bp, P. troglodytes
ccctgcctccagaccc

SEQ ID NO: 230089 - DNA, 16 bp, P. troglodytes
ccctgcctcctgggct

SEQ ID NO: 230090 - DNA, 16 bp, P. troglodytes
ccctgcctctgccctg

SEQ ID NO: 230091 - DNA, 16 bp, P. troglodytes
ccctgcctgcccagcc

SEQ ID NO: 230092 - DNA, 16 bp, P. troglodytes
ccctgcctgcctccca

SEQ ID NO: 230093 - DNA, 16 bp, P. troglodytes
ccctgcctggccagcc

SEQ ID NO: 230094 - DNA, 16 bp, P. troglodytes
ccctgcctggtgaaga

SEQ ID NO: 230095 - DNA, 16 bp, P. troglodytes
ccctgccttgcctttc

SEQ ID NO: 230096 - DNA, 16 bp, P. troglodytes
ccctgcggccttccgc

SEQ ID NO: 230097 - DNA, 16 bp, P. troglodytes
ccctgcggccttccgt

SEQ ID NO: 230098 - DNA, 16 bp, P. troglodytes
ccctgctcacaccttg

SEQ ID NO: 230099 - DNA, 16 bp, P. troglodytes
ccctgctcagagagga

SEQ ID NO: 230100 - DNA, 16 bp, P. troglodytes
ccctgctcagcctccc

SEQ ID NO: 230101 - DNA, 16 bp, P. troglodytes
ccctgctcagcctcct

SEQ ID NO: 230102 - DNA, 16 bp, P. troglodytes
ccctgctcctgcagca

SEQ ID NO: 230103 - DNA, 16 bp, P. troglodytes
ccctgctctgtgcagc

SEQ ID NO: 230104 - DNA, 16 bp, P. troglodytes
ccctgctgcagctggc

SEQ ID NO: 230105 - DNA, 16 bp, P. troglodytes
ccctgctgcccaggct

SEQ ID NO: 230106 - DNA, 16 bp, P. troglodytes
ccctgctgccctgcac

SEQ ID NO: 230107 - DNA, 18 bp, P. troglodytes
ccctgctgctgctgctgc

SEQ ID NO: 230108 - DNA, 16 bp, P. troglodytes
ccctgctggcaccctg

SEQ ID NO: 230109 - DNA, 16 bp, P. troglodytes
ccctgctggccaggct

SEQ ID NO: 230110 - DNA, 16 bp, P. troglodytes
ccctgctggccccagg

SEQ ID NO: 230111 - DNA, 16 bp, P. troglodytes
ccctgctggccccggg

SEQ ID NO: 230112 - DNA, 16 bp, P. troglodytes
ccctgctggccctggg

SEQ ID NO: 230113 - DNA, 16 bp, P. troglodytes
ccctgctgtgtggcct

SEQ ID NO: 230114 - DNA, 16 bp, P. troglodytes
ccctgcttctgctggc

SEQ ID NO: 230115 - DNA, 16 bp, P. troglodytes
ccctgctttcatggag

SEQ ID NO: 230116 - DNA, 16 bp, P. troglodytes
ccctggaaaccactaa

SEQ ID NO: 230117 - DNA, 16 bp, P. troglodytes
ccctggaacctgtgaa

SEQ ID NO: 230118 - DNA, 16 bp, P. troglodytes
ccctggaacttctaag

SEQ ID NO: 230119 - DNA, 16 bp, P. troglodytes
ccctggaagtggaggt

SEQ ID NO: 230120 - DNA, 16 bp, P. troglodytes
ccctggaagttgaggc

SEQ ID NO: 230121 - DNA, 16 bp, P. troglodytes
ccctggaatgcaaggt

SEQ ID NO: 230122 - DNA, 16 bp, P. troglodytes
ccctggaccagatgga

SEQ ID NO: 230123 - DNA, 16 bp, P. troglodytes
ccctggaccctgctga

SEQ ID NO: 230124 - DNA, 16 bp, P. troglodytes
ccctggagacggaggt

SEQ ID NO: 230125 - DNA, 16 bp, P. troglodytes
ccctggagccagactg

SEQ ID NO: 230126 - DNA, 16 bp, P. troglodytes
ccctggagcccaggaa

SEQ ID NO: 230127 - DNA, 16 bp, P. troglodytes
ccctggagcccaggag

SEQ ID NO: 230128 - DNA, 16 bp, P. troglodytes
ccctggaggaggaggt

SEQ ID NO: 230129 - DNA, 16 bp, P. troglodytes
ccctggaggcagagct

SEQ ID NO: 230130 - DNA, 16 bp, P. troglodytes
ccctggaggcccagct

SEQ ID NO: 230131 - DNA, 16 bp, P. troglodytes
ccctggaggccgaggt

SEQ ID NO: 230132 - DNA, 16 bp, P. troglodytes
ccctggaggcggagct

SEQ ID NO: 230133 - DNA, 16 bp, P. troglodytes
ccctggagggcttgtt

SEQ ID NO: 230134 - DNA, 16 bp, P. troglodytes
ccctggagtctctctg

SEQ ID NO: 230135 - DNA, 16 bp, P. troglodytes
ccctggagtttgaggt

SEQ ID NO: 230136 - DNA, 16 bp, P. troglodytes
ccctggcaagggtggt

SEQ ID NO: 230137 - DNA, 16 bp, P. troglodytes
ccctggcaccagctgc

SEQ ID NO: 230138 - DNA, 16 bp, P. troglodytes
ccctggcactggctgc

SEQ ID NO: 230139 - DNA, 16 bp, P. troglodytes
ccctggcatcccaaag

SEQ ID NO: 230140 - DNA, 16 bp, P. troglodytes
ccctggccacccagaa

SEQ ID NO: 230141 - DNA, 16 bp, P. troglodytes
ccctggccagaacatc

SEQ ID NO: 230142 - DNA, 16 bp, P. troglodytes
ccctggcccctgccaa

SEQ ID NO: 230143 - DNA, 16 bp, P. troglodytes
ccctggccctgccctg

SEQ ID NO: 230144 - DNA, 16 bp, P. troglodytes
ccctggccctggccca

SEQ ID NO: 230145 - DNA, 16 bp, P. troglodytes
ccctggccctggccct

SEQ ID NO: 230146 - DNA, 16 bp, P. troglodytes
ccctggcctcctgcag

SEQ ID NO: 230147 - DNA, 16 bp, P. troglodytes
ccctggcctgtcttca

SEQ ID NO: 230148 - DNA, 16 bp, P. troglodytes
ccctggctcctgcctg

SEQ ID NO: 230149 - DNA, 16 bp, P. troglodytes
ccctggctggagcgca

SEQ ID NO: 230150 - DNA, 16 bp, P. troglodytes
ccctggctggtctgga

SEQ ID NO: 230151 - DNA, 16 bp, P. troglodytes
ccctggcttgggccca

SEQ ID NO: 230152 - DNA, 16 bp, P. troglodytes
ccctgggagaggccag

SEQ ID NO: 230153 - DNA, 16 bp, P. troglodytes
ccctgggaggctgggg

SEQ ID NO: 230154 - DNA, 16 bp, P. troglodytes
ccctgggaggggaggg

SEQ ID NO: 230155 - DNA, 16 bp, P. troglodytes
ccctgggatggagccc

SEQ ID NO: 230156 - DNA, 16 bp, P. troglodytes
ccctgggcaccctcag

SEQ ID NO: 230157 - DNA, 16 bp, P. troglodytes
ccctgggcaggttccc

SEQ ID NO: 230158 - DNA, 16 bp, P. troglodytes
ccctgggcagtgaggg

SEQ ID NO: 230159 - DNA, 16 bp, P. troglodytes
ccctgggccagcagca

SEQ ID NO: 230160 - DNA, 16 bp, P. troglodytes
ccctgggccatggacc

SEQ ID NO: 230161 - DNA, 16 bp, P. troglodytes
ccctgggcccagccca

SEQ ID NO: 230162 - DNA, 16 bp, P. troglodytes
ccctgggccctgccca

SEQ ID NO: 230163 - DNA, 16 bp, P. troglodytes
ccctgggcctcagctt

SEQ ID NO: 230164 - DNA, 16 bp, P. troglodytes
ccctgggcctggacca

SEQ ID NO: 230165 - DNA, 16 bp, P. troglodytes
ccctgggcctggcaca

SEQ ID NO: 230166 - DNA, 16 bp, P. troglodytes
ccctgggcctggccca

SEQ ID NO: 230167 - DNA, 16 bp, P. troglodytes
ccctgggcctggccta

SEQ ID NO: 230168 - DNA, 16 bp, P. troglodytes
ccctgggcctggctca

SEQ ID NO: 230169 - DNA, 16 bp, P. troglodytes
ccctgggcctgggcca

SEQ ID NO: 230170 - DNA, 16 bp, P. troglodytes
ccctgggcgggccagg

SEQ ID NO: 230171 - DNA, 16 bp, P. troglodytes
ccctgggggtggaggt

SEQ ID NO: 230172 - DNA, 17 bp, P. troglodytes
ccctgggttcaagtgat

SEQ ID NO: 230173 - DNA, 16 bp, P. troglodytes
ccctggtaccaaaaag

SEQ ID NO: 230174 - DNA, 16 bp, P. troglodytes
ccctggtcctggccca

SEQ ID NO: 230175 - DNA, 16 bp, P. troglodytes
ccctggtgccagctgc

SEQ ID NO: 230176 - DNA, 16 bp, P. troglodytes
ccctggtgtgtgctgt

SEQ ID NO: 230177 - DNA, 16 bp, P. troglodytes
ccctgtattattcctg

SEQ ID NO: 230178 - DNA, 16 bp, P. troglodytes
ccctgtatttctttct

SEQ ID NO: 230179 - DNA, 16 bp, P. troglodytes
ccctgtcaaagcaaga

SEQ ID NO: 230180 - DNA, 16 bp, P. troglodytes
ccctgtcacccaagct

SEQ ID NO: 230181 - DNA, 16 bp, P. troglodytes
ccctgtcacccagtct

SEQ ID NO: 230182 - DNA, 16 bp, P. troglodytes
ccctgtcccagcccca

SEQ ID NO: 230183 - DNA, 16 bp, P. troglodytes
ccctgtccccaccctg

SEQ ID NO: 230184 - DNA, 16 bp, P. troglodytes
ccctgtcccccaggct

SEQ ID NO: 230185 - DNA, 16 bp, P. troglodytes
ccctgtccctattaaa

SEQ ID NO: 230186 - DNA, 16 bp, P. troglodytes
ccctgtccctgccctg

SEQ ID NO: 230187 - DNA, 16 bp, P. troglodytes
ccctgtcctcaccctc

SEQ ID NO: 230188 - DNA, 16 bp, P. troglodytes
ccctgtcctgccctgc

SEQ ID NO: 230189 - DNA, 18 bp, P. troglodytes
ccctgtctcaaaaaaaac

SEQ ID NO: 230190 - DNA, 16 bp, P. troglodytes
ccctgtctccacaaaa

SEQ ID NO: 230191 - DNA, 16 bp, P. troglodytes
ccctgtctctaaaact

SEQ ID NO: 230192 - DNA, 16 bp, P. troglodytes
ccctgtctctgcaaaa

SEQ ID NO: 230193 - DNA, 16 bp, P. troglodytes
ccctgtcttcttctga

SEQ ID NO: 230194 - DNA, 16 bp, P. troglodytes
ccctgtcttgtgccag

SEQ ID NO: 230195 - DNA, 16 bp, P. troglodytes
ccctgtgacccctccc

SEQ ID NO: 230196 - DNA, 16 bp, P. troglodytes
ccctgtgagtgaaatg

SEQ ID NO: 230197 - DNA, 16 bp, P. troglodytes
ccctgtgatcccagca

SEQ ID NO: 230198 - DNA, 16 bp, P. troglodytes
ccctgtgcaaactggt

SEQ ID NO: 230199 - DNA, 16 bp, P. troglodytes
ccctgtgccaggcact

SEQ ID NO: 230200 - DNA, 16 bp, P. troglodytes
ccctgtgctccagcct

SEQ ID NO: 230201 - DNA, 16 bp, P. troglodytes
ccctgtgctgggcact

SEQ ID NO: 230202 - DNA, 16 bp, P. troglodytes
ccctgtgggaggtgat

SEQ ID NO: 230203 - DNA, 16 bp, P. troglodytes
ccctgtggttctgcag

SEQ ID NO: 230204 - DNA, 16 bp, P. troglodytes
ccctgtgtcacccagg

SEQ ID NO: 230205 - DNA, 16 bp, P. troglodytes
ccctgtgtcccagccg

SEQ ID NO: 230206 - DNA, 16 bp, P. troglodytes
ccctgttgcccaggct

SEQ ID NO: 230207 - DNA, 16 bp, P. troglodytes
ccctgtttcaaaaaaa

SEQ ID NO: 230208 - DNA, 16 bp, P. troglodytes
ccctgtttcctggtga

SEQ ID NO: 230209 - DNA, 16 bp, P. troglodytes
ccctgtttctaaaaaa

SEQ ID NO: 230210 - DNA, 16 bp, P. troglodytes
ccctgtttgcctgtgt

SEQ ID NO: 230211 - DNA, 27 bp, P. troglodytes
cccttaatccattcaaccctgagtgga

SEQ ID NO: 230212 - DNA, 16 bp, P. troglodytes
cccttaccagaagcag

SEQ ID NO: 230213 - DNA, 16 bp, P. troglodytes
cccttataatcctttt

SEQ ID NO: 230214 - DNA, 16 bp, P. troglodytes
cccttatctctcacca

SEQ ID NO: 230215 - DNA, 16 bp, P. troglodytes
cccttcaaaaaaatta

SEQ ID NO: 230216 - DNA, 16 bp, P. troglodytes
cccttcacttatgaag

SEQ ID NO: 230217 - DNA, 16 bp, P. troglodytes
cccttcactttctgcc

SEQ ID NO: 230218 - DNA, 16 bp, P. troglodytes
cccttcaggacaggat

SEQ ID NO: 230219 - DNA, 16 bp, P. troglodytes
cccttcatgctaaaca

SEQ ID NO: 230220 - DNA, 16 bp, P. troglodytes
cccttccacagtgtgg

SEQ ID NO: 230221 - DNA, 16 bp, P. troglodytes
cccttcccaaaactaa

SEQ ID NO: 230222 - DNA, 16 bp, P. troglodytes
cccttcccacatgcct

SEQ ID NO: 230223 - DNA, 16 bp, P. troglodytes
cccttccccagcctcg

SEQ ID NO: 230224 - DNA, 16 bp, P. troglodytes
cccttcccccaagtcc

SEQ ID NO: 230225 - DNA, 16 bp, P. troglodytes
cccttcccctgagccc

SEQ ID NO: 230226 - DNA, 16 bp, P. troglodytes
cccttcccctgcccag

SEQ ID NO: 230227 - DNA, 16 bp, P. troglodytes
cccttccctgcctcca

SEQ ID NO: 230228 - DNA, 16 bp, P. troglodytes
cccttccctgtctcac

SEQ ID NO: 230229 - DNA, 16 bp, P. troglodytes
cccttccctgtgtcca

SEQ ID NO: 230230 - DNA, 16 bp, P. troglodytes
cccttcctcactgccc

SEQ ID NO: 230231 - DNA, 16 bp, P. troglodytes
cccttcctccatctgc

SEQ ID NO: 230232 - DNA, 16 bp, P. troglodytes
cccttcctccccaggc

SEQ ID NO: 230233 - DNA, 16 bp, P. troglodytes
cccttcctccctccag

SEQ ID NO: 230234 - DNA, 16 bp, P. troglodytes
cccttcctgtctccat

SEQ ID NO: 230235 - DNA, 16 bp, P. troglodytes
cccttcctgtgtctat

SEQ ID NO: 230236 - DNA, 16 bp, P. troglodytes
cccttctcagcctccc

SEQ ID NO: 230237 - DNA, 16 bp, P. troglodytes
cccttctcagcctctg

SEQ ID NO: 230238 - DNA, 16 bp, P. troglodytes
cccttctcctcccagc

SEQ ID NO: 230239 - DNA, 16 bp, P. troglodytes
cccttctcttcccagc

SEQ ID NO: 230240 - DNA, 16 bp, P. troglodytes
cccttctgagtctcca

SEQ ID NO: 230241 - DNA, 16 bp, P. troglodytes
cccttctgccatgtga

SEQ ID NO: 230242 - DNA, 16 bp, P. troglodytes
cccttctggcccagag

SEQ ID NO: 230243 - DNA, 16 bp, P. troglodytes
cccttctgggatgaag

SEQ ID NO: 230244 - DNA, 16 bp, P. troglodytes
cccttctttaaaaaaa

SEQ ID NO: 230245 - DNA, 16 bp, P. troglodytes
cccttctttacaaaaa

SEQ ID NO: 230246 - DNA, 16 bp, P. troglodytes
cccttgagaactggaa

SEQ ID NO: 230247 - DNA, 16 bp, P. troglodytes
cccttgagcccaagag

SEQ ID NO: 230248 - DNA, 16 bp, P. troglodytes
cccttgagcctaggag

SEQ ID NO: 230249 - DNA, 16 bp, P. troglodytes
cccttgagctcaggag

SEQ ID NO: 230250 - DNA, 16 bp, P. troglodytes
cccttgaggaatcacc

SEQ ID NO: 230251 - DNA, 16 bp, P. troglodytes
cccttgcacttcctgg

SEQ ID NO: 230252 - DNA, 16 bp, P. troglodytes
cccttgccatgtgatg

SEQ ID NO: 230253 - DNA, 16 bp, P. troglodytes
cccttgccttctgcca

SEQ ID NO: 230254 - DNA, 16 bp, P. troglodytes
cccttgccttgtgatc

SEQ ID NO: 230255 - DNA, 16 bp, P. troglodytes
cccttgctggcaagga

SEQ ID NO: 230256 - DNA, 16 bp, P. troglodytes
cccttgctgtgcagaa

SEQ ID NO: 230257 - DNA, 16 bp, P. troglodytes
cccttggctgccccag

SEQ ID NO: 230258 - DNA, 16 bp, P. troglodytes
cccttggctggggaag

SEQ ID NO: 230259 - DNA, 16 bp, P. troglodytes
cccttgggcccaggag

SEQ ID NO: 230260 - DNA, 16 bp, P. troglodytes
cccttgggcttcccag

SEQ ID NO: 230261 - DNA, 16 bp, P. troglodytes
cccttggggtctggat

SEQ ID NO: 230262 - DNA, 16 bp, P. troglodytes
cccttggtgctgtcat

SEQ ID NO: 230263 - DNA, 16 bp, P. troglodytes
ccctttaaaaaatcaa

SEQ ID NO: 230264 - DNA, 16 bp, P. troglodytes
ccctttagcatttctt

SEQ ID NO: 230265 - DNA, 16 bp, P. troglodytes
ccctttattttgaacc

SEQ ID NO: 230266 - DNA, 16 bp, P. troglodytes
ccctttcatttctgat

SEQ ID NO: 230267 - DNA, 16 bp, P. troglodytes
ccctttccacaggcag

SEQ ID NO: 230268 - DNA, 16 bp, P. troglodytes
ccctttccagcctctg

SEQ ID NO: 230269 - DNA, 16 bp, P. troglodytes
ccctttccagtaacac

SEQ ID NO: 230270 - DNA, 16 bp, P. troglodytes
ccctttcccagtcaaa

SEQ ID NO: 230271 - DNA, 16 bp, P. troglodytes
ccctttctctaaaaaa

SEQ ID NO: 230272 - DNA, 16 bp, P. troglodytes
ccctttctcttaaaaa

SEQ ID NO: 230273 - DNA, 16 bp, P. troglodytes
ccctttggtgataagt

SEQ ID NO: 230274 - DNA, 16 bp, P. troglodytes
cccttttaaatataag

SEQ ID NO: 230275 - DNA, 16 bp, P. troglodytes
cccttttttttgagac

SEQ ID NO: 230276 - DNA, 16 bp, P. troglodytes
ccgaaacctctgcctc

SEQ ID NO: 230277 - DNA, 16 bp, P. troglodytes
ccgaatctcactctgt

SEQ ID NO: 230278 - DNA, 16 bp, P. troglodytes
ccgaccccacaacagg

SEQ ID NO: 230279 - DNA, 16 bp, P. troglodytes
ccgacctcaggtcatc

SEQ ID NO: 230280 - DNA, 16 bp, P. troglodytes
ccgactaatttttgta

SEQ ID NO: 230281 - DNA, 16 bp, P. troglodytes
ccgactgcactccagc

SEQ ID NO: 230282 - DNA, 16 bp, P. troglodytes
ccgagatgggagaatc

SEQ ID NO: 230283 - DNA, 16 bp, P. troglodytes
ccgagcctcagtttcc

SEQ ID NO: 230284 - DNA, 16 bp, P. troglodytes
ccgagcctccccaacg

SEQ ID NO: 230285 - DNA, 16 bp, P. troglodytes
ccgagcgtggtggtgg

SEQ ID NO: 230286 - DNA, 16 bp, P. troglodytes
ccgagctcaagcaatc

SEQ ID NO: 230287 - DNA, 16 bp, P. troglodytes
ccgaggaatggtgcca

SEQ ID NO: 230288 - DNA, 16 bp, P. troglodytes
ccgaggcagaagaatc

SEQ ID NO: 230289 - DNA, 16 bp, P. troglodytes
ccgaggcaggaagatc

SEQ ID NO: 230290 - DNA, 16 bp, P. troglodytes
ccgaggcaggaggatg

SEQ ID NO: 230291 - DNA, 16 bp, P. troglodytes
ccgaggcaggaggatt

SEQ ID NO: 230292 - DNA, 17 bp, P. troglodytes
ccgaggcaggcagatcg

SEQ ID NO: 230293 - DNA, 17 bp, P. troglodytes
ccgaggcaggtgggtca

SEQ ID NO: 230294 - DNA, 16 bp, P. troglodytes
ccgaggccgaggaggc

SEQ ID NO: 230295 - DNA, 16 bp, P. troglodytes
ccgaggcctccccagc

SEQ ID NO: 230296 - DNA, 25 bp, P. troglodytes
ccgaggcgggcggatcacctgaggt

SEQ ID NO: 230297 - DNA, 16 bp, P. troglodytes
ccgaggctgaggaggc

SEQ ID NO: 230298 - DNA, 16 bp, P. troglodytes
ccgaggctggcagatc

SEQ ID NO: 230299 - DNA, 16 bp, P. troglodytes
ccgaggtcaggagttc

SEQ ID NO: 230300 - DNA, 18 bp, P. troglodytes
ccgaggtgggcagatcag

SEQ ID NO: 230301 - DNA, 16 bp, P. troglodytes
ccgagtgtggtggtgt

SEQ ID NO: 230302 - DNA, 16 bp, P. troglodytes
ccgagttcaagcagtt

SEQ ID NO: 230303 - DNA, 16 bp, P. troglodytes
ccgattttcaaaggga

SEQ ID NO: 230304 - DNA, 17 bp, P. troglodytes
ccgcaaatgctgctgcc

SEQ ID NO: 230305 - DNA, 16 bp, P. troglodytes
ccgcaacctcctcctc

SEQ ID NO: 230306 - DNA, 16 bp, P. troglodytes
ccgcacccagccaaga

SEQ ID NO: 230307 - DNA, 16 bp, P. troglodytes
ccgcacccagcccaga

SEQ ID NO: 230308 - DNA, 16 bp, P. troglodytes
ccgcacccagcctgcc

SEQ ID NO: 230309 - DNA, 16 bp, P. troglodytes
ccgcacccagcctgtt

SEQ ID NO: 230310 - DNA, 16 bp, P. troglodytes
ccgcacctggccaaag

SEQ ID NO: 230311 - DNA, 16 bp, P. troglodytes
ccgcacctggccaagg

SEQ ID NO: 230312 - DNA, 16 bp, P. troglodytes
ccgcacctggcctcca

SEQ ID NO: 230313 - DNA, 16 bp, P. troglodytes
ccgcactccagcctgg

SEQ ID NO: 230314 - DNA, 16 bp, P. troglodytes
ccgcactttgggaggc

SEQ ID NO: 230315 - DNA, 16 bp, P. troglodytes
ccgcagcctctgcctc

SEQ ID NO: 230316 - DNA, 17 bp, P. troglodytes
ccgcatcctccgcctcc

SEQ ID NO: 230317 - DNA, 16 bp, P. troglodytes
ccgccaccacacctga

SEQ ID NO: 230318 - DNA, 16 bp, P. troglodytes
ccgccaccacggctgg

SEQ ID NO: 230319 - DNA, 16 bp, P. troglodytes
ccgccacgcctgactg

SEQ ID NO: 230320 - DNA, 16 bp, P. troglodytes
ccgccagcctcggcct

SEQ ID NO: 230321 - DNA, 16 bp, P. troglodytes
ccgccatgcccggcct

SEQ ID NO: 230322 - DNA, 16 bp, P. troglodytes
ccgccatgcctggccc

SEQ ID NO: 230323 - DNA, 17 bp, P. troglodytes
ccgccattgccgaggct

SEQ ID NO: 230324 - DNA, 16 bp, P. troglodytes
ccgcccaccctggcct

SEQ ID NO: 230325 - DNA, 16 bp, P. troglodytes
ccgcccagctcggcct

SEQ ID NO: 230326 - DNA, 16 bp, P. troglodytes
ccgcccgccacagcct

SEQ ID NO: 230327 - DNA, 17 bp, P. troglodytes
ccgcccgcctaggcctc

SEQ ID NO: 230328 - DNA, 16 bp, P. troglodytes
ccgccctcctcagcct

SEQ ID NO: 230329 - DNA, 16 bp, P. troglodytes
ccgccctcctgggcct

SEQ ID NO: 230330 - DNA, 16 bp, P. troglodytes
ccgccctgtgtccatg

SEQ ID NO: 230331 - DNA, 16 bp, P. troglodytes
ccgccgcctcagcctc

SEQ ID NO: 230332 - DNA, 16 bp, P. troglodytes
ccgccgggcgcagtgg

SEQ ID NO: 230333 - DNA, 16 bp, P. troglodytes
ccgcctcaccctcctg

SEQ ID NO: 230334 - DNA, 16 bp, P. troglodytes
ccgcctcagcctctca

SEQ ID NO: 230335 - DNA, 16 bp, P. troglodytes
ccgcctcatcctccca

SEQ ID NO: 230336 - DNA, 16 bp, P. troglodytes
ccgcctcccagcgcag

SEQ ID NO: 230337 - DNA, 16 bp, P. troglodytes
ccgcctcccaggctga

SEQ ID NO: 230338 - DNA, 16 bp, P. troglodytes
ccgcctcctccagcct

SEQ ID NO: 230339 - DNA, 16 bp, P. troglodytes
ccgcctcctggactca

SEQ ID NO: 230340 - DNA, 18 bp, P. troglodytes
ccgcctcggcctcccaac

SEQ ID NO: 230341 - DNA, 17 bp, P. troglodytes
ccgcctcggcctcccag

SEQ ID NO: 230342 - DNA, 16 bp, P. troglodytes
ccgcctcggcctcctg

SEQ ID NO: 230343 - DNA, 16 bp, P. troglodytes
ccgcctggccagccgc

SEQ ID NO: 230344 - DNA, 16 bp, P. troglodytes
ccgcctgtggtcccag

SEQ ID NO: 230345 - DNA, 16 bp, P. troglodytes
ccgccttcgcctccca

SEQ ID NO: 230346 - DNA, 16 bp, P. troglodytes
ccgccttgggcctccc

SEQ ID NO: 230347 - DNA, 16 bp, P. troglodytes
ccgccttggtctccca

SEQ ID NO: 230348 - DNA, 16 bp, P. troglodytes
ccgcgcccagccagtg

SEQ ID NO: 230349 - DNA, 16 bp, P. troglodytes
ccgcgcccagcccctg

SEQ ID NO: 230350 - DNA, 16 bp, P. troglodytes
ccgcgcccagcctaca

SEQ ID NO: 230351 - DNA, 16 bp, P. troglodytes
ccgcgcccagcctctc

SEQ ID NO: 230352 - DNA, 16 bp, P. troglodytes
ccgcgcccagcctgtt

SEQ ID NO: 230353 - DNA, 16 bp, P. troglodytes
ccgcgcccggccataa

SEQ ID NO: 230354 - DNA, 16 bp, P. troglodytes
ccgcgcccggccttgg

SEQ ID NO: 230355 - DNA, 16 bp, P. troglodytes
ccgcgcctggccagcc

SEQ ID NO: 230356 - DNA, 16 bp, P. troglodytes
ccgcgcctggcctacc

SEQ ID NO: 230357 - DNA, 16 bp, P. troglodytes
ccgcgcctggcctgct

SEQ ID NO: 230358 - DNA, 16 bp, P. troglodytes
ccgctgcacccggcct

SEQ ID NO: 230359 - DNA, 16 bp, P. troglodytes
ccgctgcacctggcct

SEQ ID NO: 230360 - DNA, 16 bp, P. troglodytes
ccgctggcctcagcct

SEQ ID NO: 230361 - DNA, 16 bp, P. troglodytes
ccgcttcagcctcccg

SEQ ID NO: 230362 - DNA, 16 bp, P. troglodytes
ccgcttggtgcagagc

SEQ ID NO: 230363 - DNA, 16 bp, P. troglodytes
ccgctttccctccaag

SEQ ID NO: 230364 - DNA, 16 bp, P. troglodytes
ccggacatgttccaag

SEQ ID NO: 230365 - DNA, 16 bp, P. troglodytes
ccggagccagctccct

SEQ ID NO: 230366 - DNA, 16 bp, P. troglodytes
ccggagcctgaggcag

SEQ ID NO: 230367 - DNA, 16 bp, P. troglodytes
ccggagctcaggagtt

SEQ ID NO: 230368 - DNA, 16 bp, P. troglodytes
ccggaggctgagggag

SEQ ID NO: 230369 - DNA, 17 bp, P. troglodytes
ccggagtctcgctctgt

SEQ ID NO: 230370 - DNA, 16 bp, P. troglodytes
ccggcacagtggctca

SEQ ID NO: 230371 - DNA, 16 bp, P. troglodytes
ccggccaccctgtctg

SEQ ID NO: 230372 - DNA, 17 bp, P. troglodytes
ccggccacctcggcctc

SEQ ID NO: 230373 - DNA, 17 bp, P. troglodytes
ccggccaggcatggtgg

SEQ ID NO: 230374 - DNA, 16 bp, P. troglodytes
ccggccaggcgtggtg

SEQ ID NO: 230375 - DNA, 16 bp, P. troglodytes
ccggccctgccagccc

SEQ ID NO: 230376 - DNA, 16 bp, P. troglodytes
ccggccgggtgcagtg

SEQ ID NO: 230377 - DNA, 16 bp, P. troglodytes
ccggcctcagcctccc

SEQ ID NO: 230378 - DNA, 16 bp, P. troglodytes
ccggcctcagcctctc

SEQ ID NO: 230379 - DNA, 16 bp, P. troglodytes
ccggcctcccaaagtg

SEQ ID NO: 230380 - DNA, 16 bp, P. troglodytes
ccggctctggccttgg

SEQ ID NO: 230381 - DNA, 16 bp, P. troglodytes
ccggctgggcttctgg

SEQ ID NO: 230382 - DNA, 16 bp, P. troglodytes
ccggctgtatgaggtg

SEQ ID NO: 230383 - DNA, 16 bp, P. troglodytes
ccgggagctggaggtt

SEQ ID NO: 230384 - DNA, 16 bp, P. troglodytes
ccgggaggcagggctt

SEQ ID NO: 230385 - DNA, 16 bp, P. troglodytes
ccgggaggccgaggtt

SEQ ID NO: 230386 - DNA, 16 bp, P. troglodytes
ccgggaggcggagctg

SEQ ID NO: 230387 - DNA, 16 bp, P. troglodytes
ccgggaggcggatgtt

SEQ ID NO: 230388 - DNA, 16 bp, P. troglodytes
ccgggaggtggaggct

SEQ ID NO: 230389 - DNA, 16 bp, P. troglodytes
ccgggagttcaaggct

SEQ ID NO: 230390 - DNA, 16 bp, P. troglodytes
ccgggatgcaaggctg

SEQ ID NO: 230391 - DNA, 16 bp, P. troglodytes
ccgggcacagaaagac

SEQ ID NO: 230392 - DNA, 16 bp, P. troglodytes
ccgggcacagtggctt

SEQ ID NO: 230393 - DNA, 16 bp, P. troglodytes
ccgggcactgtggctc

SEQ ID NO: 230394 - DNA, 16 bp, P. troglodytes
ccgggcatggtggctg

SEQ ID NO: 230395 - DNA, 16 bp, P. troglodytes
ccgggcatgttggctc

SEQ ID NO: 230396 - DNA, 16 bp, P. troglodytes
ccgggccaggaacaat

SEQ ID NO: 230397 - DNA, 16 bp, P. troglodytes
ccgggccctgtggctc

SEQ ID NO: 230398 - DNA, 16 bp, P. troglodytes
ccgggcctggtggcac

SEQ ID NO: 230399 - DNA, 17 bp, P. troglodytes
ccgggccttagctgcct

SEQ ID NO: 230400 - DNA, 19 bp, P. troglodytes
ccgggcgcagtggctcacc

SEQ ID NO: 230401 - DNA, 16 bp, P. troglodytes
ccgggcgtgctggcag

SEQ ID NO: 230402 - DNA, 16 bp, P. troglodytes
ccggggaggtggaggc

SEQ ID NO: 230403 - DNA, 16 bp, P. troglodytes
ccggggaggttgaggc

SEQ ID NO: 230404 - DNA, 16 bp, P. troglodytes
ccggggcctgttgggg

SEQ ID NO: 230405 - DNA, 17 bp, P. troglodytes
ccggggtgggtggatca

SEQ ID NO: 230406 - DNA, 16 bp, P. troglodytes
ccggggttcaagcaat

SEQ ID NO: 230407 - DNA, 17 bp, P. troglodytes
ccggggttcaagcgatt

SEQ ID NO: 230408 - DNA, 17 bp, P. troglodytes
ccggggttcacgccatt

SEQ ID NO: 230409 - DNA, 16 bp, P. troglodytes
ccggggtttcaccatg

SEQ ID NO: 230410 - DNA, 16 bp, P. troglodytes
ccgggtgtggtggctt

SEQ ID NO: 230411 - DNA, 16 bp, P. troglodytes
ccgggttcaggcaatt

SEQ ID NO: 230412 - DNA, 16 bp, P. troglodytes
ccggtcgtggtggcac

SEQ ID NO: 230413 - DNA, 16 bp, P. troglodytes
ccggtggctcacgcct

SEQ ID NO: 230414 - DNA, 16 bp, P. troglodytes
ccggtgggaggtgatt

SEQ ID NO: 230415 - DNA, 16 bp, P. troglodytes
ccggtgtctgaggagt

SEQ ID NO: 230416 - DNA, 16 bp, P. troglodytes
ccggtgtggtggcaca

SEQ ID NO: 230417 - DNA, 17 bp, P. troglodytes
ccggttcaagcaattct

SEQ ID NO: 230418 - DNA, 16 bp, P. troglodytes
ccgtctcaacaacaac

SEQ ID NO: 230419 - DNA, 16 bp, P. troglodytes
ccgtctctacaaaaaa

SEQ ID NO: 230420 - DNA, 16 bp, P. troglodytes
ccgtctctaccaaaaa

SEQ ID NO: 230421 - DNA, 16 bp, P. troglodytes
ccgtcttactaaaaat

SEQ ID NO: 230422 - DNA, 16 bp, P. troglodytes
ccgtgaggccaagaac

SEQ ID NO: 230423 - DNA, 16 bp, P. troglodytes
ccgtgcccagccagca

SEQ ID NO: 230424 - DNA, 16 bp, P. troglodytes
ccgtgcccagccaggt

SEQ ID NO: 230425 - DNA, 16 bp, P. troglodytes
ccgtgcccagcccacc

SEQ ID NO: 230426 - DNA, 16 bp, P. troglodytes
ccgtgcccagcccctc

SEQ ID NO: 230427 - DNA, 16 bp, P. troglodytes
ccgtgcccagccctgt

SEQ ID NO: 230428 - DNA, 16 bp, P. troglodytes
ccgtgcccagcctgag

SEQ ID NO: 230429 - DNA, 16 bp, P. troglodytes
ccgtgcccagcctgcc

SEQ ID NO: 230430 - DNA, 16 bp, P. troglodytes
ccgtgcccagcctgtg

SEQ ID NO: 230431 - DNA, 16 bp, P. troglodytes
ccgtgcccagctggaa

SEQ ID NO: 230432 - DNA, 16 bp, P. troglodytes
ccgtgcccggcccttt

SEQ ID NO: 230433 - DNA, 16 bp, P. troglodytes
ccgtgcccggcctgag

SEQ ID NO: 230434 - DNA, 16 bp, P. troglodytes
ccgtgcctcagtttcc

SEQ ID NO: 230435 - DNA, 16 bp, P. troglodytes
ccgtgcctggcccagg

SEQ ID NO: 230436 - DNA, 16 bp, P. troglodytes
ccgtgcctggccccac

SEQ ID NO: 230437 - DNA, 16 bp, P. troglodytes
ccgtgcctggccctga

SEQ ID NO: 230438 - DNA, 16 bp, P. troglodytes
ccgtgcgcccgcactc

SEQ ID NO: 230439 - DNA, 16 bp, P. troglodytes
ccgtgctggagtgcag

SEQ ID NO: 230440 - DNA, 16 bp, P. troglodytes
ccgtggctcacatctg

SEQ ID NO: 230441 - DNA, 16 bp, P. troglodytes
ccgtggctcacgcctg

SEQ ID NO: 230442 - DNA, 16 bp, P. troglodytes
ccgtggctcatgcctg

SEQ ID NO: 230443 - DNA, 16 bp, P. troglodytes
ccgtgggctcctgtgc

SEQ ID NO: 230444 - DNA, 16 bp, P. troglodytes
ccgtggtggcaggtgc

SEQ ID NO: 230445 - DNA, 16 bp, P. troglodytes
ccgttccaaatgggag

SEQ ID NO: 230446 - DNA, 16 bp, P. troglodytes
ccgttccagccaatgg

SEQ ID NO: 230447 - DNA, 16 bp, P. troglodytes
ccgttctcacactgct

SEQ ID NO: 230448 - DNA, 16 bp, P. troglodytes
ccgttttcacactgct

SEQ ID NO: 230449 - DNA, 16 bp, P. troglodytes
ccgttttttaagcctg

SEQ ID NO: 230450 - DNA, 16 bp, P. troglodytes
cctaaaacaccaaaag

SEQ ID NO: 230451 - DNA, 16 bp, P. troglodytes
cctaaaaccataaaat

SEQ ID NO: 230452 - DNA, 16 bp, P. troglodytes
cctaaaactcaacaac

SEQ ID NO: 230453 - DNA, 16 bp, P. troglodytes
cctaaaataaaagtta

SEQ ID NO: 230454 - DNA, 16 bp, P. troglodytes
cctaaaatgtataaaa

SEQ ID NO: 230455 - DNA, 16 bp, P. troglodytes
cctaaaattcatatgt

SEQ ID NO: 230456 - DNA, 16 bp, P. troglodytes
cctaaacccaggaggc

SEQ ID NO: 230457 - DNA, 16 bp, P. troglodytes
cctaaagctataaaaa

SEQ ID NO: 230458 - DNA, 16 bp, P. troglodytes
cctaaaggacctgcct

SEQ ID NO: 230459 - DNA, 16 bp, P. troglodytes
cctaaagtcacatagc

SEQ ID NO: 230460 - DNA, 16 bp, P. troglodytes
cctaaatatatatttt

SEQ ID NO: 230461 - DNA, 16 bp, P. troglodytes
cctaaatatctttgtt

SEQ ID NO: 230462 - DNA, 16 bp, P. troglodytes
cctaaatccagtgaca

SEQ ID NO: 230463 - DNA, 16 bp, P. troglodytes
cctaaatttaagagct

SEQ ID NO: 230464 - DNA, 16 bp, P. troglodytes
cctaacacagtgaaac

SEQ ID NO: 230465 - DNA, 16 bp, P. troglodytes
cctaacactggagttc

SEQ ID NO: 230466 - DNA, 16 bp, P. troglodytes
cctaaccaaaatgaaa

SEQ ID NO: 230467 - DNA, 16 bp, P. troglodytes
cctaacccccagcacc

SEQ ID NO: 230468 - DNA, 16 bp, P. troglodytes
cctaacccccagtgcc

SEQ ID NO: 230469 - DNA, 16 bp, P. troglodytes
cctaagaaatgagata

SEQ ID NO: 230470 - DNA, 16 bp, P. troglodytes
cctaagacaattcttc

SEQ ID NO: 230471 - DNA, 16 bp, P. troglodytes
cctaaggaggggtgaa

SEQ ID NO: 230472 - DNA, 16 bp, P. troglodytes
cctaaggctgctgtaa

SEQ ID NO: 230473 - DNA, 16 bp, P. troglodytes
cctaaggctgttttac

SEQ ID NO: 230474 - DNA, 16 bp, P. troglodytes
cctaagtaaactaact

SEQ ID NO: 230475 - DNA, 16 bp, P. troglodytes
cctaataaaaaggagt

SEQ ID NO: 230476 - DNA, 16 bp, P. troglodytes
cctaataccaaaacca

SEQ ID NO: 230477 - DNA, 16 bp, P. troglodytes
cctaatgaacatagat

SEQ ID NO: 230478 - DNA, 16 bp, P. troglodytes
cctaatgtaaatgaca

SEQ ID NO: 230479 - DNA, 16 bp, P. troglodytes
cctaattccagaacat

SEQ ID NO: 230480 - DNA, 16 bp, P. troglodytes
cctaattctgtgaaga

SEQ ID NO: 230481 - DNA, 16 bp, P. troglodytes
cctaatttttgtgttt

SEQ ID NO: 230482 - DNA, 16 bp, P. troglodytes
cctacaaagccacagg

SEQ ID NO: 230483 - DNA, 16 bp, P. troglodytes
cctacaagctagaaga

SEQ ID NO: 230484 - DNA, 16 bp, P. troglodytes
cctacaatattcagta

SEQ ID NO: 230485 - DNA, 16 bp, P. troglodytes
cctacaccacaagggc

SEQ ID NO: 230486 - DNA, 16 bp, P. troglodytes
cctacagaattggaga

SEQ ID NO: 230487 - DNA, 16 bp, P. troglodytes
cctacaggaagccctc

SEQ ID NO: 230488 - DNA, 16 bp, P. troglodytes
cctacagtattcacta

SEQ ID NO: 230489 - DNA, 16 bp, P. troglodytes
cctacagtctcagcta

SEQ ID NO: 230490 - DNA, 16 bp, P. troglodytes
cctacagttgggcaaa

SEQ ID NO: 230491 - DNA, 16 bp, P. troglodytes
cctacattccttggct

SEQ ID NO: 230492 - DNA, 17 bp, P. troglodytes
cctaccaatatgtgatg

SEQ ID NO: 230493 - DNA, 16 bp, P. troglodytes
cctaccaccatgcccg

SEQ ID NO: 230494 - DNA, 16 bp, P. troglodytes
cctaccaggccccacc

SEQ ID NO: 230495 - DNA, 16 bp, P. troglodytes
cctaccaggttcaagc

SEQ ID NO: 230496 - DNA, 16 bp, P. troglodytes
cctaccatgtacccac

SEQ ID NO: 230497 - DNA, 16 bp, P. troglodytes
cctaccatgtgccagg

SEQ ID NO: 230498 - DNA, 16 bp, P. troglodytes
cctacccaaatcttat

SEQ ID NO: 230499 - DNA, 16 bp, P. troglodytes
cctacctaggcctccc

SEQ ID NO: 230500 - DNA, 16 bp, P. troglodytes
cctacctcaacctctc

SEQ ID NO: 230501 - DNA, 16 bp, P. troglodytes
cctacctcagccttcc

SEQ ID NO: 230502 - DNA, 16 bp, P. troglodytes
cctacctcagtgactt

SEQ ID NO: 230503 - DNA, 16 bp, P. troglodytes
cctacctcataggatt

SEQ ID NO: 230504 - DNA, 16 bp, P. troglodytes
cctacctgacttcaaa

SEQ ID NO: 230505 - DNA, 16 bp, P. troglodytes
cctacgtgtccatcaa

SEQ ID NO: 230506 - DNA, 16 bp, P. troglodytes
cctactacatgccaga

SEQ ID NO: 230507 - DNA, 16 bp, P. troglodytes
cctactatgtgcccag

SEQ ID NO: 230508 - DNA, 16 bp, P. troglodytes
cctactatgtgtcaga

SEQ ID NO: 230509 - DNA, 16 bp, P. troglodytes
cctactatgtgtcagg

SEQ ID NO: 230510 - DNA, 16 bp, P. troglodytes
cctactcaagcctcag

SEQ ID NO: 230511 - DNA, 16 bp, P. troglodytes
cctactccagtatgac

SEQ ID NO: 230512 - DNA, 16 bp, P. troglodytes
cctactcctggtacca

SEQ ID NO: 230513 - DNA, 16 bp, P. troglodytes
cctactctctgttctt

SEQ ID NO: 230514 - DNA, 16 bp, P. troglodytes
cctactgtgtgccagg

SEQ ID NO: 230515 - DNA, 16 bp, P. troglodytes
cctactgtgttccagg

SEQ ID NO: 230516 - DNA, 16 bp, P. troglodytes
cctacttcagatgcca

SEQ ID NO: 230517 - DNA, 16 bp, P. troglodytes
cctacttgagggagga

SEQ ID NO: 230518 - DNA, 16 bp, P. troglodytes
cctactttcagttctt

SEQ ID NO: 230519 - DNA, 16 bp, P. troglodytes
cctagaactgtgcctg

SEQ ID NO: 230520 - DNA, 16 bp, P. troglodytes
cctagaacttaaagaa

SEQ ID NO: 230521 - DNA, 16 bp, P. troglodytes
cctagaagtgaaattg

SEQ ID NO: 230522 - DNA, 16 bp, P. troglodytes
cctagagaaagatatt

SEQ ID NO: 230523 - DNA, 16 bp, P. troglodytes
cctagagaagagcaac

SEQ ID NO: 230524 - DNA, 16 bp, P. troglodytes
cctagaggcagaggtt

SEQ ID NO: 230525 - DNA, 16 bp, P. troglodytes
cctagataatttttgt

SEQ ID NO: 230526 - DNA, 16 bp, P. troglodytes
cctagatatttgactt

SEQ ID NO: 230527 - DNA, 16 bp, P. troglodytes
cctagatccctcacat

SEQ ID NO: 230528 - DNA, 16 bp, P. troglodytes
cctagatgacagcaca

SEQ ID NO: 230529 - DNA, 16 bp, P. troglodytes
cctagatgacgggttg

SEQ ID NO: 230530 - DNA, 16 bp, P. troglodytes
cctagattacttatga

SEQ ID NO: 230531 - DNA, 16 bp, P. troglodytes
cctagatttcagaggg

SEQ ID NO: 230532 - DNA, 16 bp, P. troglodytes
cctagattttcttcta

SEQ ID NO: 230533 - DNA, 16 bp, P. troglodytes
cctagcacagtgcttg

SEQ ID NO: 230534 - DNA, 16 bp, P. troglodytes
cctagcacagtgtctg

SEQ ID NO: 230535 - DNA, 16 bp, P. troglodytes
cctagcacatagtagg

SEQ ID NO: 230536 - DNA, 16 bp, P. troglodytes
cctagccaagctgaca

SEQ ID NO: 230537 - DNA, 16 bp, P. troglodytes
cctagccaagggaagc

SEQ ID NO: 230538 - DNA, 16 bp, P. troglodytes
cctagccatgtggaat

SEQ ID NO: 230539 - DNA, 16 bp, P. troglodytes
cctagccctgccccca

SEQ ID NO: 230540 - DNA, 16 bp, P. troglodytes
cctagcctaccttaaa

SEQ ID NO: 230541 - DNA, 16 bp, P. troglodytes
cctagcctcagcctcc

SEQ ID NO: 230542 - DNA, 16 bp, P. troglodytes
cctagctaacactgtg

SEQ ID NO: 230543 - DNA, 16 bp, P. troglodytes
cctaggaaagaggctg

SEQ ID NO: 230544 - DNA, 16 bp, P. troglodytes
cctaggaagctaatac

SEQ ID NO: 230545 - DNA, 16 bp, P. troglodytes
cctaggaatcccactt

SEQ ID NO: 230546 - DNA, 16 bp, P. troglodytes
cctaggaatgcagccc

SEQ ID NO: 230547 - DNA, 16 bp, P. troglodytes
cctaggagtagaattt

SEQ ID NO: 230548 - DNA, 16 bp, P. troglodytes
cctaggcctcccaaaa

SEQ ID NO: 230549 - DNA, 16 bp, P. troglodytes
cctaggctcaagggat

SEQ ID NO: 230550 - DNA, 16 bp, P. troglodytes
cctaggctggaatgca

SEQ ID NO: 230551 - DNA, 16 bp, P. troglodytes
cctaggctggagtaca

SEQ ID NO: 230552 - DNA, 16 bp, P. troglodytes
cctaggctggagtgca

SEQ ID NO: 230553 - DNA, 16 bp, P. troglodytes
cctaggctggagtgta

SEQ ID NO: 230554 - DNA, 16 bp, P. troglodytes
cctaggtgacagagct

SEQ ID NO: 230555 - DNA, 16 bp, P. troglodytes
cctaggtgatccaccc

SEQ ID NO: 230556 - DNA, 16 bp, P. troglodytes
cctagtctctgtgccc

SEQ ID NO: 230557 - DNA, 16 bp, P. troglodytes
cctagtctgtggcttg

SEQ ID NO: 230558 - DNA, 16 bp, P. troglodytes
cctataaaatggaaat

SEQ ID NO: 230559 - DNA, 16 bp, P. troglodytes
cctataaagagactta

SEQ ID NO: 230560 - DNA, 16 bp, P. troglodytes
cctataaccccagcta

SEQ ID NO: 230561 - DNA, 16 bp, P. troglodytes
cctatagtcccagctc

SEQ ID NO: 230562 - DNA, 16 bp, P. troglodytes
cctatagtgaaaaagg

SEQ ID NO: 230563 - DNA, 16 bp, P. troglodytes
cctatatatatatata

SEQ ID NO: 230564 - DNA, 16 bp, P. troglodytes
cctatatcaaaaaaga

SEQ ID NO: 230565 - DNA, 16 bp, P. troglodytes
cctatatcaaaacatc

SEQ ID NO: 230566 - DNA, 16 bp, P. troglodytes
cctatatggtctaaaa

SEQ ID NO: 230567 - DNA, 16 bp, P. troglodytes
cctatcaaaatgccaa

SEQ ID NO: 230568 - DNA, 16 bp, P. troglodytes
cctatcatgggacttt

SEQ ID NO: 230569 - DNA, 16 bp, P. troglodytes
cctatcattggagatg

SEQ ID NO: 230570 - DNA, 18 bp, P. troglodytes
cctatctcagtagatgga

SEQ ID NO: 230571 - DNA, 16 bp, P. troglodytes
cctatctctacaaaaa

SEQ ID NO: 230572 - DNA, 16 bp, P. troglodytes
cctatggtagaaaagg

SEQ ID NO: 230573 - DNA, 16 bp, P. troglodytes
cctatgttttcttcta

SEQ ID NO: 230574 - DNA, 16 bp, P. troglodytes
cctatgttttctttta

SEQ ID NO: 230575 - DNA, 16 bp, P. troglodytes
cctattcaaaaataaa

SEQ ID NO: 230576 - DNA, 16 bp, P. troglodytes
cctattgctcccaggc

SEQ ID NO: 230577 - DNA, 16 bp, P. troglodytes
cctattgcttctgttt

SEQ ID NO: 230578 - DNA, 16 bp, P. troglodytes
cctattggcacagctg

SEQ ID NO: 230579 - DNA, 16 bp, P. troglodytes
cctatttccttcagtt

SEQ ID NO: 230580 - DNA, 16 bp, P. troglodytes
cctattttacagatga

SEQ ID NO: 230581 - DNA, 16 bp, P. troglodytes
cctcaaaaaattaaac

SEQ ID NO: 230582 - DNA, 16 bp, P. troglodytes
cctcaaaactcttcca

SEQ ID NO: 230583 - DNA, 16 bp, P. troglodytes
cctcaaaatggcaaat

SEQ ID NO: 230584 - DNA, 16 bp, P. troglodytes
cctcaaacagagattt

SEQ ID NO: 230585 - DNA, 16 bp, P. troglodytes
cctcaaacagctaaaa

SEQ ID NO: 230586 - DNA, 16 bp, P. troglodytes
cctcaaacccctgggc

SEQ ID NO: 230587 - DNA, 17 bp, P. troglodytes
cctcaaactcctgggct

SEQ ID NO: 230588 - DNA, 16 bp, P. troglodytes
cctcaaacttctggac

SEQ ID NO: 230589 - DNA, 16 bp, P. troglodytes
cctcaaagtcatccac

SEQ ID NO: 230590 - DNA, 16 bp, P. troglodytes
cctcaaatccctgggc

SEQ ID NO: 230591 - DNA, 16 bp, P. troglodytes
cctcaaattcctcatc

SEQ ID NO: 230592 - DNA, 16 bp, P. troglodytes
cctcaacaaatgcaaa

SEQ ID NO: 230593 - DNA, 16 bp, P. troglodytes
cctcaaccacctgggc

SEQ ID NO: 230594 - DNA, 16 bp, P. troglodytes
cctcaaccccccaggc

SEQ ID NO: 230595 - DNA, 16 bp, P. troglodytes
cctcaacccctggcaa

SEQ ID NO: 230596 - DNA, 16 bp, P. troglodytes
cctcaacctcccaagt

SEQ ID NO: 230597 - DNA, 16 bp, P. troglodytes
cctcaacctcccaggc

SEQ ID NO: 230598 - DNA, 16 bp, P. troglodytes
cctcaacctccccggc

SEQ ID NO: 230599 - DNA, 16 bp, P. troglodytes
cctcaacctcctcagt

SEQ ID NO: 230600 - DNA, 16 bp, P. troglodytes
cctcaacctctgcctc

SEQ ID NO: 230601 - DNA, 16 bp, P. troglodytes
cctcaaccttctgggc

SEQ ID NO: 230602 - DNA, 16 bp, P. troglodytes
cctcaactcttgccct

SEQ ID NO: 230603 - DNA, 16 bp, P. troglodytes
cctcaactttctgggc

SEQ ID NO: 230604 - DNA, 16 bp, P. troglodytes
cctcaagaggagagga

SEQ ID NO: 230605 - DNA, 17 bp, P. troglodytes
cctcaagcagtcctcct

SEQ ID NO: 230606 - DNA, 16 bp, P. troglodytes
cctcaagcctcccaaa

SEQ ID NO: 230607 - DNA, 16 bp, P. troglodytes
cctcaagcgcagccag

SEQ ID NO: 230608 - DNA, 16 bp, P. troglodytes
cctcaagctcctggac

SEQ ID NO: 230609 - DNA, 16 bp, P. troglodytes
cctcaaggaaccagaa

SEQ ID NO: 230610 - DNA, 16 bp, P. troglodytes
cctcaaggaggtggag

SEQ ID NO: 230611 - DNA, 16 bp, P. troglodytes
cctcaaggatttagaa

SEQ ID NO: 230612 - DNA, 16 bp, P. troglodytes
cctcaaggctcatcca

SEQ ID NO: 230613 - DNA, 16 bp, P. troglodytes
cctcaaggcttccctt

SEQ ID NO: 230614 - DNA, 16 bp, P. troglodytes
cctcaaggtcatcaaa

SEQ ID NO: 230615 - DNA, 16 bp, P. troglodytes
cctcaagtagctggaa

SEQ ID NO: 230616 - DNA, 16 bp, P. troglodytes
cctcaagtgatacacc

SEQ ID NO: 230617 - DNA, 16 bp, P. troglodytes
cctcaagtgatccccc

SEQ ID NO: 230618 - DNA, 21 bp, P. troglodytes
cctcaagtgatccgcccgcct

SEQ ID NO: 230619 - DNA, 16 bp, P. troglodytes
cctcaagtgatctgcc

SEQ ID NO: 230620 - DNA, 18 bp, P. troglodytes
cctcaagtgatctgcctg

SEQ ID NO: 230621 - DNA, 16 bp, P. troglodytes
cctcaataaagctatt

SEQ ID NO: 230622 - DNA, 16 bp, P. troglodytes
cctcaatagctgggat

SEQ ID NO: 230623 - DNA, 16 bp, P. troglodytes
cctcaatctcccaagt

SEQ ID NO: 230624 - DNA, 16 bp, P. troglodytes
cctcaatgattttctt

SEQ ID NO: 230625 - DNA, 16 bp, P. troglodytes
cctcaatttcagaact

SEQ ID NO: 230626 - DNA, 16 bp, P. troglodytes
cctcaatttttggaat

SEQ ID NO: 230627 - DNA, 16 bp, P. troglodytes
cctcacacagagtccc

SEQ ID NO: 230628 - DNA, 16 bp, P. troglodytes
cctcacagagaacctc

SEQ ID NO: 230629 - DNA, 16 bp, P. troglodytes
cctcacagcaacccca

SEQ ID NO: 230630 - DNA, 16 bp, P. troglodytes
cctcacagccctcaga

SEQ ID NO: 230631 - DNA, 16 bp, P. troglodytes
cctcacatgacagaag

SEQ ID NO: 230632 - DNA, 16 bp, P. troglodytes
cctcacatggctgggt

SEQ ID NO: 230633 - DNA, 16 bp, P. troglodytes
cctcaccaccatctgt

SEQ ID NO: 230634 - DNA, 16 bp, P. troglodytes
cctcaccagacacaga

SEQ ID NO: 230635 - DNA, 16 bp, P. troglodytes
cctcaccagataccaa

SEQ ID NO: 230636 - DNA, 16 bp, P. troglodytes
cctcaccagatgccag

SEQ ID NO: 230637 - DNA, 16 bp, P. troglodytes
cctcaccatcatctgt

SEQ ID NO: 230638 - DNA, 16 bp, P. troglodytes
cctcacccagctaatt

SEQ ID NO: 230639 - DNA, 16 bp, P. troglodytes
cctcacccaggctgga

SEQ ID NO: 230640 - DNA, 16 bp, P. troglodytes
cctcaccccagccctg

SEQ ID NO: 230641 - DNA, 16 bp, P. troglodytes
cctcacccgggaagtg

SEQ ID NO: 230642 - DNA, 16 bp, P. troglodytes
cctcaccctccccagt

SEQ ID NO: 230643 - DNA, 16 bp, P. troglodytes
cctcaccctcctgggt

SEQ ID NO: 230644 - DNA, 16 bp, P. troglodytes
cctcacccttcaaagt

SEQ ID NO: 230645 - DNA, 16 bp, P. troglodytes
cctcacctcagcctcc

SEQ ID NO: 230646 - DNA, 16 bp, P. troglodytes
cctcacctctctgggc

SEQ ID NO: 230647 - DNA, 16 bp, P. troglodytes
cctcaccttcccaagt

SEQ ID NO: 230648 - DNA, 16 bp, P. troglodytes
cctcactctgtcacca

SEQ ID NO: 230649 - DNA, 16 bp, P. troglodytes
cctcactgcaacctcc

SEQ ID NO: 230650 - DNA, 16 bp, P. troglodytes
cctcactgcaacctct

SEQ ID NO: 230651 - DNA, 16 bp, P. troglodytes
cctcactgggctaaaa

SEQ ID NO: 230652 - DNA, 16 bp, P. troglodytes
cctcactgggtgggac

SEQ ID NO: 230653 - DNA, 16 bp, P. troglodytes
cctcacttataagtgg

SEQ ID NO: 230654 - DNA, 16 bp, P. troglodytes
cctcacttcccaggtg

SEQ ID NO: 230655 - DNA, 16 bp, P. troglodytes
cctcagaaataatgcc

SEQ ID NO: 230656 - DNA, 26 bp, P. troglodytes
cctcagaaataatgctgcatatctac

SEQ ID NO: 230657 - DNA, 16 bp, P. troglodytes
cctcagaaccagggaa

SEQ ID NO: 230658 - DNA, 16 bp, P. troglodytes
cctcagaagaaaccaa

SEQ ID NO: 230659 - DNA, 17 bp, P. troglodytes
cctcagacccaccagcc

SEQ ID NO: 230660 - DNA, 16 bp, P. troglodytes
cctcagactcctaggc

SEQ ID NO: 230661 - DNA, 16 bp, P. troglodytes
cctcagactcctgggt

SEQ ID NO: 230662 - DNA, 16 bp, P. troglodytes
cctcagaggtggaggt

SEQ ID NO: 230663 - DNA, 16 bp, P. troglodytes
cctcagatatttcttt

SEQ ID NO: 230664 - DNA, 16 bp, P. troglodytes
cctcagatcatccacc

SEQ ID NO: 230665 - DNA, 16 bp, P. troglodytes
cctcagcaaatacaaa

SEQ ID NO: 230666 - DNA, 16 bp, P. troglodytes
cctcagcaaatgtgaa

SEQ ID NO: 230667 - DNA, 16 bp, P. troglodytes
cctcagcaacatgcaa

SEQ ID NO: 230668 - DNA, 16 bp, P. troglodytes
cctcagcaatggcggg

SEQ ID NO: 230669 - DNA, 17 bp, P. troglodytes
cctcagcacagaccctt

SEQ ID NO: 230670 - DNA, 16 bp, P. troglodytes
cctcagcacccccaag

SEQ ID NO: 230671 - DNA, 16 bp, P. troglodytes
cctcagcagcagcagc

SEQ ID NO: 230672 - DNA, 16 bp, P. troglodytes
cctcagcatcctaagt

SEQ ID NO: 230673 - DNA, 16 bp, P. troglodytes
cctcagccaaccaagt

SEQ ID NO: 230674 - DNA, 16 bp, P. troglodytes
cctcagccacctgagc

SEQ ID NO: 230675 - DNA, 16 bp, P. troglodytes
cctcagccatgtggag

SEQ ID NO: 230676 - DNA, 16 bp, P. troglodytes
cctcagcccagttctg

SEQ ID NO: 230677 - DNA, 16 bp, P. troglodytes
cctcagccccacaagt

SEQ ID NO: 230678 - DNA, 16 bp, P. troglodytes
cctcagcccccaaagt

SEQ ID NO: 230679 - DNA, 16 bp, P. troglodytes
cctcagccccccaaat

SEQ ID NO: 230680 - DNA, 16 bp, P. troglodytes
cctcagccccctccag

SEQ ID NO: 230681 - DNA, 16 bp, P. troglodytes
cctcagccccctgagt

SEQ ID NO: 230682 - DNA, 16 bp, P. troglodytes
cctcagcccctccagt

SEQ ID NO: 230683 - DNA, 16 bp, P. troglodytes
cctcagccctcccaag

SEQ ID NO: 230684 - DNA, 16 bp, P. troglodytes
cctcagcctcataaag

SEQ ID NO: 230685 - DNA, 16 bp, P. troglodytes
cctcagcctccaagtg

SEQ ID NO: 230686 - DNA, 18 bp, P. troglodytes
cctcagcctcccaaagtt

SEQ ID NO: 230687 - DNA, 16 bp, P. troglodytes
cctcagcctcccaacc

SEQ ID NO: 230688 - DNA, 16 bp, P. troglodytes
cctcagcctcccaggt

SEQ ID NO: 230689 - DNA, 16 bp, P. troglodytes
cctcagcctcccagtg

SEQ ID NO: 230690 - DNA, 16 bp, P. troglodytes
cctcagcctcccccag

SEQ ID NO: 230691 - DNA, 16 bp, P. troglodytes
cctcagcctcccgggt

SEQ ID NO: 230692 - DNA, 16 bp, P. troglodytes
cctcagcctcctcatt

SEQ ID NO: 230693 - DNA, 16 bp, P. troglodytes
cctcagcctcctcctc

SEQ ID NO: 230694 - DNA, 16 bp, P. troglodytes
cctcagcctcctctcc

SEQ ID NO: 230695 - DNA, 26 bp, P. troglodytes
cctcagcctcctgagtagctgagact

SEQ ID NO: 230696 - DNA, 16 bp, P. troglodytes
cctcagcctcctgatg

SEQ ID NO: 230697 - DNA, 16 bp, P. troglodytes
cctcagcctcctgggc

SEQ ID NO: 230698 - DNA, 16 bp, P. troglodytes
cctcagcctcctggtt

SEQ ID NO: 230699 - DNA, 16 bp, P. troglodytes
cctcagcctccttagt

SEQ ID NO: 230700 - DNA, 16 bp, P. troglodytes
cctcagcctcggcctc

SEQ ID NO: 230701 - DNA, 16 bp, P. troglodytes
cctcagcctctcaaat

SEQ ID NO: 230702 - DNA, 16 bp, P. troglodytes
cctcagcctctccagc

SEQ ID NO: 230703 - DNA, 16 bp, P. troglodytes
cctcagcctctccagt

SEQ ID NO: 230704 - DNA, 16 bp, P. troglodytes
cctcagcctctccgag

SEQ ID NO: 230705 - DNA, 16 bp, P. troglodytes
cctcagcctctggaat

SEQ ID NO: 230706 - DNA, 16 bp, P. troglodytes
cctcagcctctggggt

SEQ ID NO: 230707 - DNA, 16 bp, P. troglodytes
cctcagcctgctgagc

SEQ ID NO: 230708 - DNA, 16 bp, P. troglodytes
cctcagccttccaggt

SEQ ID NO: 230709 - DNA, 16 bp, P. troglodytes
cctcagccttcctgag

SEQ ID NO: 230710 - DNA, 16 bp, P. troglodytes
cctcagccttggcctc

SEQ ID NO: 230711 - DNA, 16 bp, P. troglodytes
cctcagctactcggga

SEQ ID NO: 230712 - DNA, 21 bp, P. troglodytes
cctcagctcactgcaacctct

SEQ ID NO: 230713 - DNA, 20 bp, P. troglodytes
cctcagctcactgcaagctc

SEQ ID NO: 230714 - DNA, 16 bp, P. troglodytes
cctcagctgccaggca

SEQ ID NO: 230715 - DNA, 16 bp, P. troglodytes
cctcagctgcctcatc

SEQ ID NO: 230716 - DNA, 16 bp, P. troglodytes
cctcagctgggaacat

SEQ ID NO: 230717 - DNA, 16 bp, P. troglodytes
cctcagctgtaaaatg

SEQ ID NO: 230718 - DNA, 16 bp, P. troglodytes
cctcagcttcccaaga

SEQ ID NO: 230719 - DNA, 16 bp, P. troglodytes
cctcagcttcctcagc

SEQ ID NO: 230720 - DNA, 16 bp, P. troglodytes
cctcagcttcctcctc

SEQ ID NO: 230721 - DNA, 16 bp, P. troglodytes
cctcagcttctccagt

SEQ ID NO: 230722 - DNA, 16 bp, P. troglodytes
cctcagcttctgaagt

SEQ ID NO: 230723 - DNA, 16 bp, P. troglodytes
cctcagcttgcagagg

SEQ ID NO: 230724 - DNA, 16 bp, P. troglodytes
cctcagctttttcatc

SEQ ID NO: 230725 - DNA, 16 bp, P. troglodytes
cctcaggaaacttaca

SEQ ID NO: 230726 - DNA, 16 bp, P. troglodytes
cctcaggaagcttaca

SEQ ID NO: 230727 - DNA, 16 bp, P. troglodytes
cctcaggaagcttcca

SEQ ID NO: 230728 - DNA, 16 bp, P. troglodytes
cctcaggaagtttcca

SEQ ID NO: 230729 - DNA, 17 bp, P. troglodytes
cctcaggaccctgtgat

SEQ ID NO: 230730 - DNA, 16 bp, P. troglodytes
cctcaggagatctgcc

SEQ ID NO: 230731 - DNA, 16 bp, P. troglodytes
cctcaggaggctgaga

SEQ ID NO: 230732 - DNA, 16 bp, P. troglodytes
cctcaggcaagtcact

SEQ ID NO: 230733 - DNA, 16 bp, P. troglodytes
cctcaggcagtgcagg

SEQ ID NO: 230734 - DNA, 16 bp, P. troglodytes
cctcaggcattccttt

SEQ ID NO: 230735 - DNA, 16 bp, P. troglodytes
cctcaggcctgtgccc

SEQ ID NO: 230736 - DNA, 16 bp, P. troglodytes
cctcaggctccccagt

SEQ ID NO: 230737 - DNA, 16 bp, P. troglodytes
cctcaggctcctcatc

SEQ ID NO: 230738 - DNA, 16 bp, P. troglodytes
cctcaggctgcttcca

SEQ ID NO: 230739 - DNA, 16 bp, P. troglodytes
cctcaggcttactagg

SEQ ID NO: 230740 - DNA, 16 bp, P. troglodytes
cctcaggtcatcctcc

SEQ ID NO: 230741 - DNA, 16 bp, P. troglodytes
cctcaggtcgggagtt

SEQ ID NO: 230742 - DNA, 16 bp, P. troglodytes
cctcaggttcccaaag

SEQ ID NO: 230743 - DNA, 16 bp, P. troglodytes
cctcagtatcctcatc

SEQ ID NO: 230744 - DNA, 16 bp, P. troglodytes
cctcagtcccaggcaa

SEQ ID NO: 230745 - DNA, 16 bp, P. troglodytes
cctcagtctctccttc

SEQ ID NO: 230746 - DNA, 16 bp, P. troglodytes
cctcagtctctctctc

SEQ ID NO: 230747 - DNA, 16 bp, P. troglodytes
cctcagtctgggtggg

SEQ ID NO: 230748 - DNA, 16 bp, P. troglodytes
cctcagtgatctgccc

SEQ ID NO: 230749 - DNA, 16 bp, P. troglodytes
cctcagtgtccttgtc

SEQ ID NO: 230750 - DNA, 16 bp, P. troglodytes
cctcagttacttcatc

SEQ ID NO: 230751 - DNA, 16 bp, P. troglodytes
cctcagttcctcacca

SEQ ID NO: 230752 - DNA, 16 bp, P. troglodytes
cctcagtttccacctc

SEQ ID NO: 230753 - DNA, 16 bp, P. troglodytes
cctcagtttcccaatc

SEQ ID NO: 230754 - DNA, 16 bp, P. troglodytes
cctcagtttcccatct

SEQ ID NO: 230755 - DNA, 16 bp, P. troglodytes
cctcagtttccccact

SEQ ID NO: 230756 - DNA, 16 bp, P. troglodytes
cctcagtttcccccat

SEQ ID NO: 230757 - DNA, 16 bp, P. troglodytes
cctcagtttcctcctg

SEQ ID NO: 230758 - DNA, 16 bp, P. troglodytes
cctcagtttcctctcc

SEQ ID NO: 230759 - DNA, 16 bp, P. troglodytes
cctcagtttcttcatc

SEQ ID NO: 230760 - DNA, 16 bp, P. troglodytes
cctcagtttgcccatc

SEQ ID NO: 230761 - DNA, 16 bp, P. troglodytes
cctcagttttcccatt

SEQ ID NO: 230762 - DNA, 16 bp, P. troglodytes
cctcagttttctcatc

SEQ ID NO: 230763 - DNA, 16 bp, P. troglodytes
cctcataaaatcagtt

SEQ ID NO: 230764 - DNA, 16 bp, P. troglodytes
cctcatatattttgga

SEQ ID NO: 230765 - DNA, 16 bp, P. troglodytes
cctcatcaaagaagat

SEQ ID NO: 230766 - DNA, 16 bp, P. troglodytes
cctcatcaataaaatg

SEQ ID NO: 230767 - DNA, 16 bp, P. troglodytes
cctcatcagcatctat

SEQ ID NO: 230768 - DNA, 16 bp, P. troglodytes
cctcatcagcctggcc

SEQ ID NO: 230769 - DNA, 16 bp, P. troglodytes
cctcatcatctcagcc

SEQ ID NO: 230770 - DNA, 16 bp, P. troglodytes
cctcatcctcctgagc

SEQ ID NO: 230771 - DNA, 16 bp, P. troglodytes
cctcatcctcctgggc

SEQ ID NO: 230772 - DNA, 16 bp, P. troglodytes
cctcatctccttcagg

SEQ ID NO: 230773 - DNA, 16 bp, P. troglodytes
cctcatctgggaagtg

SEQ ID NO: 230774 - DNA, 16 bp, P. troglodytes
cctcatctgtaaaaca

SEQ ID NO: 230775 - DNA, 16 bp, P. troglodytes
cctcatctgtaaaata

SEQ ID NO: 230776 - DNA, 18 bp, P. troglodytes
cctcatctgtaaaatgga

SEQ ID NO: 230777 - DNA, 16 bp, P. troglodytes
cctcatctgtgaaatg

SEQ ID NO: 230778 - DNA, 16 bp, P. troglodytes
cctcatcttcccaaag

SEQ ID NO: 230779 - DNA, 16 bp, P. troglodytes
cctcatcttcctgtct

SEQ ID NO: 230780 - DNA, 16 bp, P. troglodytes
cctcatgaaatgagtt

SEQ ID NO: 230781 - DNA, 16 bp, P. troglodytes
cctcatgacctagtca

SEQ ID NO: 230782 - DNA, 16 bp, P. troglodytes
cctcatgagccaacct

SEQ ID NO: 230783 - DNA, 16 bp, P. troglodytes
cctcatgatctgccag

SEQ ID NO: 230784 - DNA, 16 bp, P. troglodytes
cctcatgatcttcctg

SEQ ID NO: 230785 - DNA, 16 bp, P. troglodytes
cctcatgatgagatta

SEQ ID NO: 230786 - DNA, 16 bp, P. troglodytes
cctcatgcctgtaatc

SEQ ID NO: 230787 - DNA, 16 bp, P. troglodytes
cctcatgtgatctgcc

SEQ ID NO: 230788 - DNA, 16 bp, P. troglodytes
cctcatgtgtaaaatg

SEQ ID NO: 230789 - DNA, 16 bp, P. troglodytes
cctcatgttgtacatt

SEQ ID NO: 230790 - DNA, 16 bp, P. troglodytes
cctcattcaccttctg

SEQ ID NO: 230791 - DNA, 16 bp, P. troglodytes
cctcattgcaacctct

SEQ ID NO: 230792 - DNA, 16 bp, P. troglodytes
cctcatttaaaaaatg

SEQ ID NO: 230793 - DNA, 16 bp, P. troglodytes
cctcatttaatcctca

SEQ ID NO: 230794 - DNA, 16 bp, P. troglodytes
cctcatttgtaaaata

SEQ ID NO: 230795 - DNA, 16 bp, P. troglodytes
cctcatttgtaaaatg

SEQ ID NO: 230796 - DNA, 16 bp, P. troglodytes
cctcattttacagaca

SEQ ID NO: 230797 - DNA, 16 bp, P. troglodytes
cctcattttacagatg

SEQ ID NO: 230798 - DNA, 16 bp, P. troglodytes
cctcattttatagctg

SEQ ID NO: 230799 - DNA, 16 bp, P. troglodytes
cctcattttccagatg

SEQ ID NO: 230800 - DNA, 16 bp, P. troglodytes
cctcattttgcagata

SEQ ID NO: 230801 - DNA, 16 bp, P. troglodytes
cctcatttttcctgga

SEQ ID NO: 230802 - DNA, 16 bp, P. troglodytes
cctccaaaagtactgg

SEQ ID NO: 230803 - DNA, 16 bp, P. troglodytes
cctccaaaattcctat

SEQ ID NO: 230804 - DNA, 16 bp, P. troglodytes
cctccaaagactaaac

SEQ ID NO: 230805 - DNA, 16 bp, P. troglodytes
cctccaaataccatca

SEQ ID NO: 230806 - DNA, 16 bp, P. troglodytes
cctccaaatcttggct

SEQ ID NO: 230807 - DNA, 16 bp, P. troglodytes
cctccaacactcagga

SEQ ID NO: 230808 - DNA, 16 bp, P. troglodytes
cctccaactttcttct

SEQ ID NO: 230809 - DNA, 16 bp, P. troglodytes
cctccaagaaataggg

SEQ ID NO: 230810 - DNA, 16 bp, P. troglodytes
cctccaagccaggtgc

SEQ ID NO: 230811 - DNA, 16 bp, P. troglodytes
cctccacagctgctgg

SEQ ID NO: 230812 - DNA, 16 bp, P. troglodytes
cctccacatcttgtcc

SEQ ID NO: 230813 - DNA, 16 bp, P. troglodytes
cctccaccactcagta

SEQ ID NO: 230814 - DNA, 16 bp, P. troglodytes
cctccaccccagcctg

SEQ ID NO: 230815 - DNA, 16 bp, P. troglodytes
cctccaccccggacac

SEQ ID NO: 230816 - DNA, 16 bp, P. troglodytes
cctccaccctctgggt

SEQ ID NO: 230817 - DNA, 16 bp, P. troglodytes
cctccacctacatttc

SEQ ID NO: 230818 - DNA, 16 bp, P. troglodytes
cctccacctccagcct

SEQ ID NO: 230819 - DNA, 16 bp, P. troglodytes
cctccacctcccaagt

SEQ ID NO: 230820 - DNA, 22 bp, P. troglodytes
cctccacctcccaggttcaagc

SEQ ID NO: 230821 - DNA, 19 bp, P. troglodytes
cctccacctcccaggttcg

SEQ ID NO: 230822 - DNA, 16 bp, P. troglodytes
cctccacctccccaag

SEQ ID NO: 230823 - DNA, 16 bp, P. troglodytes
cctccacctccccagg

SEQ ID NO: 230824 - DNA, 16 bp, P. troglodytes
cctccacctccccagt

SEQ ID NO: 230825 - DNA, 16 bp, P. troglodytes
cctccacctcccggtt

SEQ ID NO: 230826 - DNA, 16 bp, P. troglodytes
cctccacctccctcag

SEQ ID NO: 230827 - DNA, 16 bp, P. troglodytes
cctccacctccggagt

SEQ ID NO: 230828 - DNA, 16 bp, P. troglodytes
cctccacctccggggt

SEQ ID NO: 230829 - DNA, 16 bp, P. troglodytes
cctccacctccgggtt

SEQ ID NO: 230830 - DNA, 16 bp, P. troglodytes
cctccacctcctcggt

SEQ ID NO: 230831 - DNA, 16 bp, P. troglodytes
cctccacctcctggat

SEQ ID NO: 230832 - DNA, 16 bp, P. troglodytes
cctccacctcctggct

SEQ ID NO: 230833 - DNA, 16 bp, P. troglodytes
cctccacctcctgtgt

SEQ ID NO: 230834 - DNA, 16 bp, P. troglodytes
cctccacctctgccca

SEQ ID NO: 230835 - DNA, 16 bp, P. troglodytes
cctccacctctgcctc

SEQ ID NO: 230836 - DNA, 16 bp, P. troglodytes
cctccaccttctgggc

SEQ ID NO: 230837 - DNA, 16 bp, P. troglodytes
cctccactccccaggt

SEQ ID NO: 230838 - DNA, 16 bp, P. troglodytes
cctccacttcattttt

SEQ ID NO: 230839 - DNA, 16 bp, P. troglodytes
cctccacttcccgagt

SEQ ID NO: 230840 - DNA, 16 bp, P. troglodytes
cctccacttcccgggc

SEQ ID NO: 230841 - DNA, 16 bp, P. troglodytes
cctccagaactgtgaa

SEQ ID NO: 230842 - DNA, 16 bp, P. troglodytes
cctccagaactgtgag

SEQ ID NO: 230843 - DNA, 16 bp, P. troglodytes
cctccagaagctggaa

SEQ ID NO: 230844 - DNA, 16 bp, P. troglodytes
cctccagaccccaaaa

SEQ ID NO: 230845 - DNA, 16 bp, P. troglodytes
cctccagagaagctgg

SEQ ID NO: 230846 - DNA, 16 bp, P. troglodytes
cctccagagcagctgg

SEQ ID NO: 230847 - DNA, 16 bp, P. troglodytes
cctccagagctgtgag

SEQ ID NO: 230848 - DNA, 16 bp, P. troglodytes
cctccagagtacctgg

SEQ ID NO: 230849 - DNA, 16 bp, P. troglodytes
cctccagattagctgg

SEQ ID NO: 230850 - DNA, 16 bp, P. troglodytes
cctccagattttgttc

SEQ ID NO: 230851 - DNA, 16 bp, P. troglodytes
cctccagcactgtgag

SEQ ID NO: 230852 - DNA, 16 bp, P. troglodytes
cctccagccccaggca

SEQ ID NO: 230853 - DNA, 16 bp, P. troglodytes
cctccagcctccagcc

SEQ ID NO: 230854 - DNA, 16 bp, P. troglodytes
cctccagcctcctcat

SEQ ID NO: 230855 - DNA, 16 bp, P. troglodytes
cctccagcctcctcca

SEQ ID NO: 230856 - DNA, 19 bp, P. troglodytes
cctccagcctgggcaacag

SEQ ID NO: 230857 - DNA, 16 bp, P. troglodytes
cctccagcctgggcag

SEQ ID NO: 230858 - DNA, 21 bp, P. troglodytes
cctccagcctgggcgacagag

SEQ ID NO: 230859 - DNA, 16 bp, P. troglodytes
cctccagcctggggga

SEQ ID NO: 230860 - DNA, 16 bp, P. troglodytes
cctccagcctgggtga

SEQ ID NO: 230861 - DNA, 16 bp, P. troglodytes
cctccagccttggcct

SEQ ID NO: 230862 - DNA, 16 bp, P. troglodytes
cctccagctccatcaa

SEQ ID NO: 230863 - DNA, 16 bp, P. troglodytes
cctccagctccctcca

SEQ ID NO: 230864 - DNA, 16 bp, P. troglodytes
cctccagctctatcta

SEQ ID NO: 230865 - DNA, 16 bp, P. troglodytes
cctccagctgcagcca

SEQ ID NO: 230866 - DNA, 16 bp, P. troglodytes
cctccagctttggtct

SEQ ID NO: 230867 - DNA, 16 bp, P. troglodytes
cctccagctttttctt

SEQ ID NO: 230868 - DNA, 16 bp, P. troglodytes
cctccaggaaaccttc

SEQ ID NO: 230869 - DNA, 16 bp, P. troglodytes
cctccaggaacctcca

SEQ ID NO: 230870 - DNA, 16 bp, P. troglodytes
cctccaggaagccctc

SEQ ID NO: 230871 - DNA, 16 bp, P. troglodytes
cctccaggaagcctcc

SEQ ID NO: 230872 - DNA, 16 bp, P. troglodytes
cctccaggaagcctgc

SEQ ID NO: 230873 - DNA, 16 bp, P. troglodytes
cctccaggatctagaa

SEQ ID NO: 230874 - DNA, 16 bp, P. troglodytes
cctccaggcctgggcc

SEQ ID NO: 230875 - DNA, 16 bp, P. troglodytes
cctccaggctcaagtg

SEQ ID NO: 230876 - DNA, 16 bp, P. troglodytes
cctccagggctcaaat

SEQ ID NO: 230877 - DNA, 16 bp, P. troglodytes
cctccagggctcaagc

SEQ ID NO: 230878 - DNA, 16 bp, P. troglodytes
cctccagggttcaagc

SEQ ID NO: 230879 - DNA, 16 bp, P. troglodytes
cctccagggtttaagc

SEQ ID NO: 230880 - DNA, 16 bp, P. troglodytes
cctccaggtccatcca

SEQ ID NO: 230881 - DNA, 16 bp, P. troglodytes
cctccagtctctgcct

SEQ ID NO: 230882 - DNA, 16 bp, P. troglodytes
cctccagttttgttct

SEQ ID NO: 230883 - DNA, 16 bp, P. troglodytes
cctccatccatgttgc

SEQ ID NO: 230884 - DNA, 16 bp, P. troglodytes
cctccatctcagcctc

SEQ ID NO: 230885 - DNA, 16 bp, P. troglodytes
cctccatctcccagct

SEQ ID NO: 230886 - DNA, 16 bp, P. troglodytes
cctccatctccctggt

SEQ ID NO: 230887 - DNA, 16 bp, P. troglodytes
cctccatctcctggct

SEQ ID NO: 230888 - DNA, 16 bp, P. troglodytes
cctccatcttcaagaa

SEQ ID NO: 230889 - DNA, 16 bp, P. troglodytes
cctccatgggctgcat

SEQ ID NO: 230890 - DNA, 16 bp, P. troglodytes
cctccattgcccaggc

SEQ ID NO: 230891 - DNA, 16 bp, P. troglodytes
cctccatttcctcatg

SEQ ID NO: 230892 - DNA, 16 bp, P. troglodytes
cctccatttgccttgt

SEQ ID NO: 230893 - DNA, 16 bp, P. troglodytes
cctccattttcttatc

SEQ ID NO: 230894 - DNA, 16 bp, P. troglodytes
cctcccaaagatgtcc

SEQ ID NO: 230895 - DNA, 16 bp, P. troglodytes
cctcccaaagcactga

SEQ ID NO: 230896 - DNA, 16 bp, P. troglodytes
cctcccaaaggctcca

SEQ ID NO: 230897 - DNA, 16 bp, P. troglodytes
cctcccaaagggctag

SEQ ID NO: 230898 - DNA, 16 bp, P. troglodytes
cctcccaaagtgccca

SEQ ID NO: 230899 - DNA, 16 bp, P. troglodytes
cctcccaaagtgctaa

SEQ ID NO: 230900 - DNA, 16 bp, P. troglodytes
cctcccaaagtgctgc

SEQ ID NO: 230901 - DNA, 16 bp, P. troglodytes
cctcccaaagtgctgt

SEQ ID NO: 230902 - DNA, 21 bp, P. troglodytes
cctcccaaagtgttgggatta

SEQ ID NO: 230903 - DNA, 16 bp, P. troglodytes
cctcccaagcagctgc

SEQ ID NO: 230904 - DNA, 16 bp, P. troglodytes
cctcccaaggctaaac

SEQ ID NO: 230905 - DNA, 17 bp, P. troglodytes
cctcccaagtagctggc

SEQ ID NO: 230906 - DNA, 16 bp, P. troglodytes
cctcccaagtttaagc

SEQ ID NO: 230907 - DNA, 16 bp, P. troglodytes
cctcccacactgggga

SEQ ID NO: 230908 - DNA, 16 bp, P. troglodytes
cctcccacagcgctgg

SEQ ID NO: 230909 - DNA, 16 bp, P. troglodytes
cctcccacagtgctga

SEQ ID NO: 230910 - DNA, 16 bp, P. troglodytes
cctcccaccacaggcc

SEQ ID NO: 230911 - DNA, 16 bp, P. troglodytes
cctcccaccagatccc

SEQ ID NO: 230912 - DNA, 16 bp, P. troglodytes
cctcccaccaggcacc

SEQ ID NO: 230913 - DNA, 16 bp, P. troglodytes
cctcccaccaggccct

SEQ ID NO: 230914 - DNA, 16 bp, P. troglodytes
cctcccaccagggccc

SEQ ID NO: 230915 - DNA, 16 bp, P. troglodytes
cctcccaccaggtgcc

SEQ ID NO: 230916 - DNA, 16 bp, P. troglodytes
cctcccacctaaacct

SEQ ID NO: 230917 - DNA, 16 bp, P. troglodytes
cctcccacctcagctg

SEQ ID NO: 230918 - DNA, 16 bp, P. troglodytes
cctcccacctctgcct

SEQ ID NO: 230919 - DNA, 16 bp, P. troglodytes
cctcccacctgggcct

SEQ ID NO: 230920 - DNA, 16 bp, P. troglodytes
cctcccacctgtgcct

SEQ ID NO: 230921 - DNA, 16 bp, P. troglodytes
cctcccaccttcagcc

SEQ ID NO: 230922 - DNA, 16 bp, P. troglodytes
cctcccaccttgacct

SEQ ID NO: 230923 - DNA, 16 bp, P. troglodytes
cctcccacggggtccc

SEQ ID NO: 230924 - DNA, 16 bp, P. troglodytes
cctcccactgggcccc

SEQ ID NO: 230925 - DNA, 16 bp, P. troglodytes
cctcccagactcaggc

SEQ ID NO: 230926 - DNA, 16 bp, P. troglodytes
cctcccagagcactgg

SEQ ID NO: 230927 - DNA, 16 bp, P. troglodytes
cctcccagattcacgc

SEQ ID NO: 230928 - DNA, 16 bp, P. troglodytes
cctcccagcacctcca

SEQ ID NO: 230929 - DNA, 16 bp, P. troglodytes
cctcccagccacctgc

SEQ ID NO: 230930 - DNA, 16 bp, P. troglodytes
cctcccagcccagcct

SEQ ID NO: 230931 - DNA, 16 bp, P. troglodytes
cctcccagccctgcag

SEQ ID NO: 230932 - DNA, 16 bp, P. troglodytes
cctcccagccctgggc

SEQ ID NO: 230933 - DNA, 16 bp, P. troglodytes
cctcccagcttcaagc

SEQ ID NO: 230934 - DNA, 16 bp, P. troglodytes
cctcccaggatcaagc

SEQ ID NO: 230935 - DNA, 16 bp, P. troglodytes
cctcccaggctaagcc

SEQ ID NO: 230936 - DNA, 16 bp, P. troglodytes
cctcccaggctcaagc

SEQ ID NO: 230937 - DNA, 16 bp, P. troglodytes
cctcccaggctgaagc

SEQ ID NO: 230938 - DNA, 16 bp, P. troglodytes
cctcccaggtccaagc

SEQ ID NO: 230939 - DNA, 16 bp, P. troglodytes
cctcccaggttcaaac

SEQ ID NO: 230940 - DNA, 16 bp, P. troglodytes
cctcccaggttcacac

SEQ ID NO: 230941 - DNA, 20 bp, P. troglodytes
cctcccaggttcacaccatt

SEQ ID NO: 230942 - DNA, 17 bp, P. troglodytes
cctcccaggttcacgcc

SEQ ID NO: 230943 - DNA, 16 bp, P. troglodytes
cctcccaggttcatgc

SEQ ID NO: 230944 - DNA, 16 bp, P. troglodytes
cctcccaggttcctgc

SEQ ID NO: 230945 - DNA, 16 bp, P. troglodytes
cctcccaggttgatgc

SEQ ID NO: 230946 - DNA, 16 bp, P. troglodytes
cctcccatcttggcct

SEQ ID NO: 230947 - DNA, 16 bp, P. troglodytes
cctcccatgacacatg

SEQ ID NO: 230948 - DNA, 16 bp, P. troglodytes
cctcccatggctcccc

SEQ ID NO: 230949 - DNA, 16 bp, P. troglodytes
cctcccattacaggcc

SEQ ID NO: 230950 - DNA, 16 bp, P. troglodytes
cctccccaacagctgg

SEQ ID NO: 230951 - DNA, 16 bp, P. troglodytes
cctccccaagcctcag

SEQ ID NO: 230952 - DNA, 16 bp, P. troglodytes
cctccccacctcctgg

SEQ ID NO: 230953 - DNA, 16 bp, P. troglodytes
cctccccactctgcct

SEQ ID NO: 230954 - DNA, 16 bp, P. troglodytes
cctccccactgcagcc

SEQ ID NO: 230955 - DNA, 16 bp, P. troglodytes
cctccccagactccaa

SEQ ID NO: 230956 - DNA, 16 bp, P. troglodytes
cctccccagcatctgt

SEQ ID NO: 230957 - DNA, 16 bp, P. troglodytes
cctccccagccatgca

SEQ ID NO: 230958 - DNA, 16 bp, P. troglodytes
cctccccagccctgct

SEQ ID NO: 230959 - DNA, 16 bp, P. troglodytes
cctccccagctgtgtg

SEQ ID NO: 230960 - DNA, 16 bp, P. troglodytes
cctccccaggcccagc

SEQ ID NO: 230961 - DNA, 16 bp, P. troglodytes
cctccccagtggctgg

SEQ ID NO: 230962 - DNA, 16 bp, P. troglodytes
cctccccatggggcag

SEQ ID NO: 230963 - DNA, 16 bp, P. troglodytes
cctcccccagccaagg

SEQ ID NO: 230964 - DNA, 16 bp, P. troglodytes
cctcccccagccctgg

SEQ ID NO: 230965 - DNA, 16 bp, P. troglodytes
cctcccccagcctctg

SEQ ID NO: 230966 - DNA, 16 bp, P. troglodytes
cctcccccagcctggc

SEQ ID NO: 230967 - DNA, 16 bp, P. troglodytes
cctcccccagctccag

SEQ ID NO: 230968 - DNA, 16 bp, P. troglodytes
cctcccccagctcctg

SEQ ID NO: 230969 - DNA, 16 bp, P. troglodytes
cctcccccaggaagcc

SEQ ID NO: 230970 - DNA, 16 bp, P. troglodytes
cctcccccaggccctg

SEQ ID NO: 230971 - DNA, 16 bp, P. troglodytes
cctccccctgggtctc

SEQ ID NO: 230972 - DNA, 16 bp, P. troglodytes
cctccccgcagggcag

SEQ ID NO: 230973 - DNA, 16 bp, P. troglodytes
cctccccggttcacac

SEQ ID NO: 230974 - DNA, 16 bp, P. troglodytes
cctcccctctctgggc

SEQ ID NO: 230975 - DNA, 16 bp, P. troglodytes
cctcccctgcctgggc

SEQ ID NO: 230976 - DNA, 16 bp, P. troglodytes
cctcccctgctgcagc

SEQ ID NO: 230977 - DNA, 16 bp, P. troglodytes
cctccccttcagcctc

SEQ ID NO: 230978 - DNA, 16 bp, P. troglodytes
cctcccctttccacag

SEQ ID NO: 230979 - DNA, 16 bp, P. troglodytes
cctcccgaagtgatgg

SEQ ID NO: 230980 - DNA, 16 bp, P. troglodytes
cctcccgaggaaatct

SEQ ID NO: 230981 - DNA, 16 bp, P. troglodytes
cctcccgagtgcctgg

SEQ ID NO: 230982 - DNA, 16 bp, P. troglodytes
cctcccgcgttcacgc

SEQ ID NO: 230983 - DNA, 16 bp, P. troglodytes
cctcccgctttggcct

SEQ ID NO: 230984 - DNA, 17 bp, P. troglodytes
cctcccggattcacgcc

SEQ ID NO: 230985 - DNA, 16 bp, P. troglodytes
cctcccggatttaagc

SEQ ID NO: 230986 - DNA, 16 bp, P. troglodytes
cctcccggctcagcct

SEQ ID NO: 230987 - DNA, 16 bp, P. troglodytes
cctcccgggctcaagc

SEQ ID NO: 230988 - DNA, 16 bp, P. troglodytes
cctcccgggctcaagg

SEQ ID NO: 230989 - DNA, 16 bp, P. troglodytes
cctcccgggctgaagc

SEQ ID NO: 230990 - DNA, 16 bp, P. troglodytes
cctcccgggtgcaagt

SEQ ID NO: 230991 - DNA, 16 bp, P. troglodytes
cctcccgggttcaaac

SEQ ID NO: 230992 - DNA, 17 bp, P. troglodytes
cctcccgggttcacacc

SEQ ID NO: 230993 - DNA, 16 bp, P. troglodytes
cctcccgggttcaccc

SEQ ID NO: 230994 - DNA, 16 bp, P. troglodytes
cctcccgggttcacga

SEQ ID NO: 230995 - DNA, 17 bp, P. troglodytes
cctcccgggttcacgcc

SEQ ID NO: 230996 - DNA, 16 bp, P. troglodytes
cctcccgggttcagga

SEQ ID NO: 230997 - DNA, 16 bp, P. troglodytes
cctcccgggttcatgc

SEQ ID NO: 230998 - DNA, 16 bp, P. troglodytes
cctcccgggttcatgt

SEQ ID NO: 230999 - DNA, 16 bp, P. troglodytes
cctcccgggttcccac

SEQ ID NO: 231000 - DNA, 16 bp, P. troglodytes
cctcccgggttcctgc

SEQ ID NO: 231001 - DNA, 16 bp, P. troglodytes
cctcccgggtttaagc

SEQ ID NO: 231002 - DNA, 20 bp, P. troglodytes
cctcccgggtttacgccatt

SEQ ID NO: 231003 - DNA, 17 bp, P. troglodytes
cctcccgtgttcacacc

SEQ ID NO: 231004 - DNA, 16 bp, P. troglodytes
cctccctaactccttt

SEQ ID NO: 231005 - DNA, 16 bp, P. troglodytes
cctccctcaaaaaaaa

SEQ ID NO: 231006 - DNA, 16 bp, P. troglodytes
cctccctccaggtccc

SEQ ID NO: 231007 - DNA, 16 bp, P. troglodytes
cctccctcccagctgc

SEQ ID NO: 231008 - DNA, 16 bp, P. troglodytes
cctccctccctctcag

SEQ ID NO: 231009 - DNA, 16 bp, P. troglodytes
cctccctccctgggct

SEQ ID NO: 231010 - DNA, 16 bp, P. troglodytes
cctccctcctgggcct

SEQ ID NO: 231011 - DNA, 16 bp, P. troglodytes
cctccctgaccagaga

SEQ ID NO: 231012 - DNA, 16 bp, P. troglodytes
cctccctgagcctcag

SEQ ID NO: 231013 - DNA, 16 bp, P. troglodytes
cctccctgcagggcag

SEQ ID NO: 231014 - DNA, 16 bp, P. troglodytes
cctccctgccctgggc

SEQ ID NO: 231015 - DNA, 16 bp, P. troglodytes
cctccctgctctgtgc

SEQ ID NO: 231016 - DNA, 16 bp, P. troglodytes
cctccctgctgcagcc

SEQ ID NO: 231017 - DNA, 16 bp, P. troglodytes
cctccctggacctcag

SEQ ID NO: 231018 - DNA, 16 bp, P. troglodytes
cctccctggactcagg

SEQ ID NO: 231019 - DNA, 16 bp, P. troglodytes
cctccctggcagctgg

SEQ ID NO: 231020 - DNA, 16 bp, P. troglodytes
cctccctggcctgaag

SEQ ID NO: 231021 - DNA, 16 bp, P. troglodytes
cctccctgggccccag

SEQ ID NO: 231022 - DNA, 16 bp, P. troglodytes
cctccctggtagctag

SEQ ID NO: 231023 - DNA, 16 bp, P. troglodytes
cctccctggttcaagc

SEQ ID NO: 231024 - DNA, 16 bp, P. troglodytes
cctccctgtatccatg

SEQ ID NO: 231025 - DNA, 16 bp, P. troglodytes
cctccctgtgtccctg

SEQ ID NO: 231026 - DNA, 16 bp, P. troglodytes
cctcccttatccatgg

SEQ ID NO: 231027 - DNA, 16 bp, P. troglodytes
cctcccttcctatttg

SEQ ID NO: 231028 - DNA, 16 bp, P. troglodytes
cctccgcccagcagcc

SEQ ID NO: 231029 - DNA, 16 bp, P. troglodytes
cctccgcctccagagt

SEQ ID NO: 231030 - DNA, 16 bp, P. troglodytes
cctccgcctcccaaac

SEQ ID NO: 231031 - DNA, 16 bp, P. troglodytes
cctccgccttccggat

SEQ ID NO: 231032 - DNA, 17 bp, P. troglodytes
cctccgctgctgatacc

SEQ ID NO: 231033 - DNA, 16 bp, P. troglodytes
cctccggccttggcct

SEQ ID NO: 231034 - DNA, 16 bp, P. troglodytes
cctccgtctcaaaaaa

SEQ ID NO: 231035 - DNA, 16 bp, P. troglodytes
cctcctaaggagctgg

SEQ ID NO: 231036 - DNA, 16 bp, P. troglodytes
cctcctaccacagcct

SEQ ID NO: 231037 - DNA, 16 bp, P. troglodytes
cctcctatcttggcct

SEQ ID NO: 231038 - DNA, 16 bp, P. troglodytes
cctcctatgtagctgg

SEQ ID NO: 231039 - DNA, 16 bp, P. troglodytes
cctcctatgttttctt

SEQ ID NO: 231040 - DNA, 16 bp, P. troglodytes
cctcctcaagctcatc

SEQ ID NO: 231041 - DNA, 16 bp, P. troglodytes
cctcctcaatttcttt

SEQ ID NO: 231042 - DNA, 16 bp, P. troglodytes
cctcctcactgctgag

SEQ ID NO: 231043 - DNA, 16 bp, P. troglodytes
cctcctcagagaagcc

SEQ ID NO: 231044 - DNA, 16 bp, P. troglodytes
cctcctcagaggaaag

SEQ ID NO: 231045 - DNA, 16 bp, P. troglodytes
cctcctcagccagggc

SEQ ID NO: 231046 - DNA, 16 bp, P. troglodytes
cctcctcagcccctca

SEQ ID NO: 231047 - DNA, 16 bp, P. troglodytes
cctcctcagcctcaca

SEQ ID NO: 231048 - DNA, 16 bp, P. troglodytes
cctcctcagcctccag

SEQ ID NO: 231049 - DNA, 16 bp, P. troglodytes
cctcctcagcctccca

SEQ ID NO: 231050 - DNA, 16 bp, P. troglodytes
cctcctcagcctccga

SEQ ID NO: 231051 - DNA, 16 bp, P. troglodytes
cctcctcagcctggac

SEQ ID NO: 231052 - DNA, 16 bp, P. troglodytes
cctcctcagctcaagt

SEQ ID NO: 231053 - DNA, 16 bp, P. troglodytes
cctcctcagtctccca

SEQ ID NO: 231054 - DNA, 16 bp, P. troglodytes
cctcctcatccttcaa

SEQ ID NO: 231055 - DNA, 16 bp, P. troglodytes
cctcctccaagaagcc

SEQ ID NO: 231056 - DNA, 16 bp, P. troglodytes
cctcctccagcccctg

SEQ ID NO: 231057 - DNA, 16 bp, P. troglodytes
cctcctccagcctcct

SEQ ID NO: 231058 - DNA, 16 bp, P. troglodytes
cctcctccaggaagcc

SEQ ID NO: 231059 - DNA, 16 bp, P. troglodytes
cctcctccaggcagcc

SEQ ID NO: 231060 - DNA, 16 bp, P. troglodytes
cctcctccagggagcc

SEQ ID NO: 231061 - DNA, 16 bp, P. troglodytes
cctcctccatgaagcc

SEQ ID NO: 231062 - DNA, 16 bp, P. troglodytes
cctcctcccactgtcc

SEQ ID NO: 231063 - DNA, 16 bp, P. troglodytes
cctcctcccagccctg

SEQ ID NO: 231064 - DNA, 16 bp, P. troglodytes
cctcctcccagcctct

SEQ ID NO: 231065 - DNA, 16 bp, P. troglodytes
cctcctcccgggttca

SEQ ID NO: 231066 - DNA, 16 bp, P. troglodytes
cctcctccctcagacc

SEQ ID NO: 231067 - DNA, 16 bp, P. troglodytes
cctcctccctcagact

SEQ ID NO: 231068 - DNA, 16 bp, P. troglodytes
cctcctccctcagcct

SEQ ID NO: 231069 - DNA, 16 bp, P. troglodytes
cctcctccctgcctgg

SEQ ID NO: 231070 - DNA, 16 bp, P. troglodytes
cctcctccctgggcag

SEQ ID NO: 231071 - DNA, 16 bp, P. troglodytes
cctcctcctccaggca

SEQ ID NO: 231072 - DNA, 16 bp, P. troglodytes
cctcctcctccagggt

SEQ ID NO: 231073 - DNA, 16 bp, P. troglodytes
cctcctcctcccaagt

SEQ ID NO: 231074 - DNA, 16 bp, P. troglodytes
cctcctcctccccagt

SEQ ID NO: 231075 - DNA, 16 bp, P. troglodytes
cctcctcctcccgagt

SEQ ID NO: 231076 - DNA, 16 bp, P. troglodytes
cctcctcctcctccag

SEQ ID NO: 231077 - DNA, 16 bp, P. troglodytes
cctcctcctcctgcca

SEQ ID NO: 231078 - DNA, 16 bp, P. troglodytes
cctcctcctcctgggc

SEQ ID NO: 231079 - DNA, 16 bp, P. troglodytes
cctcctcctctcccag

SEQ ID NO: 231080 - DNA, 16 bp, P. troglodytes
cctcctcctggaagcc

SEQ ID NO: 231081 - DNA, 16 bp, P. troglodytes
cctcctcctggattca

SEQ ID NO: 231082 - DNA, 16 bp, P. troglodytes
cctcctcctggctgct

SEQ ID NO: 231083 - DNA, 16 bp, P. troglodytes
cctcctcctgggagcc

SEQ ID NO: 231084 - DNA, 16 bp, P. troglodytes
cctcctcctggggctg

SEQ ID NO: 231085 - DNA, 16 bp, P. troglodytes
cctcctccttgtacct

SEQ ID NO: 231086 - DNA, 16 bp, P. troglodytes
cctcctcggcctccaa

SEQ ID NO: 231087 - DNA, 16 bp, P. troglodytes
cctcctctctccccag

SEQ ID NO: 231088 - DNA, 16 bp, P. troglodytes
cctcctctctgctgag

SEQ ID NO: 231089 - DNA, 16 bp, P. troglodytes
cctcctctctgggcag

SEQ ID NO: 231090 - DNA, 16 bp, P. troglodytes
cctcctctgtgcccag

SEQ ID NO: 231091 - DNA, 16 bp, P. troglodytes
cctcctcttcctcagc

SEQ ID NO: 231092 - DNA, 16 bp, P. troglodytes
cctcctgaaggaagga

SEQ ID NO: 231093 - DNA, 16 bp, P. troglodytes
cctcctgaaggatctg

SEQ ID NO: 231094 - DNA, 16 bp, P. troglodytes
cctcctgagaagctgg

SEQ ID NO: 231095 - DNA, 16 bp, P. troglodytes
cctcctgagcagccgg

SEQ ID NO: 231096 - DNA, 16 bp, P. troglodytes
cctcctgagggctgtg

SEQ ID NO: 231097 - DNA, 16 bp, P. troglodytes
cctcctgagtcactgg

SEQ ID NO: 231098 - DNA, 16 bp, P. troglodytes
cctcctgagtgctggg

SEQ ID NO: 231099 - DNA, 16 bp, P. troglodytes
cctcctgatggggaga

SEQ ID NO: 231100 - DNA, 16 bp, P. troglodytes
cctcctgcagcagcag

SEQ ID NO: 231101 - DNA, 16 bp, P. troglodytes
cctcctgcagcctctg

SEQ ID NO: 231102 - DNA, 19 bp, P. troglodytes
cctcctgcctcagcctcct

SEQ ID NO: 231103 - DNA, 16 bp, P. troglodytes
cctcctgcctcagttt

SEQ ID NO: 231104 - DNA, 16 bp, P. troglodytes
cctcctgcctcctggg

SEQ ID NO: 231105 - DNA, 16 bp, P. troglodytes
cctcctgcctcggctt

SEQ ID NO: 231106 - DNA, 16 bp, P. troglodytes
cctcctgcctggcctc

SEQ ID NO: 231107 - DNA, 16 bp, P. troglodytes
cctcctgcctgggcct

SEQ ID NO: 231108 - DNA, 16 bp, P. troglodytes
cctcctgcctgggtct

SEQ ID NO: 231109 - DNA, 16 bp, P. troglodytes
cctcctgccttcagcc

SEQ ID NO: 231110 - DNA, 16 bp, P. troglodytes
cctcctgccttggcat

SEQ ID NO: 231111 - DNA, 16 bp, P. troglodytes
cctcctgccttggcca

SEQ ID NO: 231112 - DNA, 16 bp, P. troglodytes
cctcctgctcccacca

SEQ ID NO: 231113 - DNA, 16 bp, P. troglodytes
cctcctgctgctgctg

SEQ ID NO: 231114 - DNA, 16 bp, P. troglodytes
cctcctgctggctctg

SEQ ID NO: 231115 - DNA, 16 bp, P. troglodytes
cctcctgcttctgcct

SEQ ID NO: 231116 - DNA, 16 bp, P. troglodytes
cctcctggactcaagc

SEQ ID NO: 231117 - DNA, 16 bp, P. troglodytes
cctcctggactcaggc

SEQ ID NO: 231118 - DNA, 16 bp, P. troglodytes
cctcctggaggaggtg

SEQ ID NO: 231119 - DNA, 16 bp, P. troglodytes
cctcctggattcaagc

SEQ ID NO: 231120 - DNA, 16 bp, P. troglodytes
cctcctggcctcagcc

SEQ ID NO: 231121 - DNA, 16 bp, P. troglodytes
cctcctggctgccttc

SEQ ID NO: 231122 - DNA, 16 bp, P. troglodytes
cctcctggctgctttc

SEQ ID NO: 231123 - DNA, 16 bp, P. troglodytes
cctcctgggcctccag

SEQ ID NO: 231124 - DNA, 16 bp, P. troglodytes
cctcctgggcctcctg

SEQ ID NO: 231125 - DNA, 17 bp, P. troglodytes
cctcctgggctcaagca

SEQ ID NO: 231126 - DNA, 16 bp, P. troglodytes
cctcctgggctccagc

SEQ ID NO: 231127 - DNA, 16 bp, P. troglodytes
cctcctgggtacaagc

SEQ ID NO: 231128 - DNA, 16 bp, P. troglodytes
cctcctgggtagctgg

SEQ ID NO: 231129 - DNA, 17 bp, P. troglodytes
cctcctgggtagctgga

SEQ ID NO: 231130 - DNA, 20 bp, P. troglodytes
cctcctgggttcacaccatt

SEQ ID NO: 231131 - DNA, 17 bp, P. troglodytes
cctcctgggttcacgcc

SEQ ID NO: 231132 - DNA, 16 bp, P. troglodytes
cctcctgggttcacgt

SEQ ID NO: 231133 - DNA, 16 bp, P. troglodytes
cctcctgggttcatgc

SEQ ID NO: 231134 - DNA, 16 bp, P. troglodytes
cctcctgggttcatgt

SEQ ID NO: 231135 - DNA, 16 bp, P. troglodytes
cctcctgggttccagc

SEQ ID NO: 231136 - DNA, 16 bp, P. troglodytes
cctcctgggttgctgg

SEQ ID NO: 231137 - DNA, 16 bp, P. troglodytes
cctcctgtcactatca

SEQ ID NO: 231138 - DNA, 16 bp, P. troglodytes
cctcctgtcagatcaa

SEQ ID NO: 231139 - DNA, 16 bp, P. troglodytes
cctcctgtcagatcag

SEQ ID NO: 231140 - DNA, 16 bp, P. troglodytes
cctcctgtctcagact

SEQ ID NO: 231141 - DNA, 16 bp, P. troglodytes
cctcctgtctcagctt

SEQ ID NO: 231142 - DNA, 16 bp, P. troglodytes
cctcctgtgtcagcct

SEQ ID NO: 231143 - DNA, 16 bp, P. troglodytes
cctccttcagcctccc

SEQ ID NO: 231144 - DNA, 16 bp, P. troglodytes
cctccttcccagctgc

SEQ ID NO: 231145 - DNA, 16 bp, P. troglodytes
cctccttcctcagccc

SEQ ID NO: 231146 - DNA, 16 bp, P. troglodytes
cctccttcctggctgc

SEQ ID NO: 231147 - DNA, 16 bp, P. troglodytes
cctccttcctgggcct

SEQ ID NO: 231148 - DNA, 16 bp, P. troglodytes
cctccttccttcccag

SEQ ID NO: 231149 - DNA, 16 bp, P. troglodytes
cctccttgagctgctg

SEQ ID NO: 231150 - DNA, 16 bp, P. troglodytes
cctccttgggcctcag

SEQ ID NO: 231151 - DNA, 16 bp, P. troglodytes
cctccttgtgcctctg

SEQ ID NO: 231152 - DNA, 16 bp, P. troglodytes
cctcctttctcagcag

SEQ ID NO: 231153 - DNA, 16 bp, P. troglodytes
cctcgcagccctcgct

SEQ ID NO: 231154 - DNA, 16 bp, P. troglodytes
cctcgcccagctaatt

SEQ ID NO: 231155 - DNA, 16 bp, P. troglodytes
cctcgctcgctcttgg

SEQ ID NO: 231156 - DNA, 16 bp, P. troglodytes
cctcgctggatcagaa

SEQ ID NO: 231157 - DNA, 16 bp, P. troglodytes
cctcggccccctgagt

SEQ ID NO: 231158 - DNA, 16 bp, P. troglodytes
cctcggcctcccaaaa

SEQ ID NO: 231159 - DNA, 19 bp, P. troglodytes
cctcggcctcccaaaatgt

SEQ ID NO: 231160 - DNA, 17 bp, P. troglodytes
cctcggcctcccaaaga

SEQ ID NO: 231161 - DNA, 16 bp, P. troglodytes
cctcggcctcccaaat

SEQ ID NO: 231162 - DNA, 16 bp, P. troglodytes
cctcggcctcccaagc

SEQ ID NO: 231163 - DNA, 20 bp, P. troglodytes
cctcggcctcccaagtagct

SEQ ID NO: 231164 - DNA, 16 bp, P. troglodytes
cctcggcctcggcctc

SEQ ID NO: 231165 - DNA, 17 bp, P. troglodytes
cctcggcgacagagcaa

SEQ ID NO: 231166 - DNA, 16 bp, P. troglodytes
cctcggcttcccgagt

SEQ ID NO: 231167 - DNA, 16 bp, P. troglodytes
cctcgtctctacaaaa

SEQ ID NO: 231168 - DNA, 16 bp, P. troglodytes
cctcgtgatccgccgg

SEQ ID NO: 231169 - DNA, 16 bp, P. troglodytes
cctctacaccaataac

SEQ ID NO: 231170 - DNA, 16 bp, P. troglodytes
cctctacccactgctt

SEQ ID NO: 231171 - DNA, 16 bp, P. troglodytes
cctctacccttcccag

SEQ ID NO: 231172 - DNA, 16 bp, P. troglodytes
cctctacctcagcctc

SEQ ID NO: 231173 - DNA, 16 bp, P. troglodytes
cctctacctccagggt

SEQ ID NO: 231174 - DNA, 16 bp, P. troglodytes
cctctacctccccagt

SEQ ID NO: 231175 - DNA, 16 bp, P. troglodytes
cctctacctcctgagc

SEQ ID NO: 231176 - DNA, 16 bp, P. troglodytes
cctctacctcctggct

SEQ ID NO: 231177 - DNA, 16 bp, P. troglodytes
cctctacctctcaggt

SEQ ID NO: 231178 - DNA, 17 bp, P. troglodytes
cctctactaaaaataca

SEQ ID NO: 231179 - DNA, 16 bp, P. troglodytes
cctctactcctccaaa

SEQ ID NO: 231180 - DNA, 20 bp, P. troglodytes
cctctactgaaaatacaaaa

SEQ ID NO: 231181 - DNA, 16 bp, P. troglodytes
cctctagaactgtgag

SEQ ID NO: 231182 - DNA, 16 bp, P. troglodytes
cctctagagtagctag

SEQ ID NO: 231183 - DNA, 16 bp, P. troglodytes
cctctagtaaaaatac

SEQ ID NO: 231184 - DNA, 16 bp, P. troglodytes
cctctagtagtctgca

SEQ ID NO: 231185 - DNA, 16 bp, P. troglodytes
cctctatctcccaggt

SEQ ID NO: 231186 - DNA, 16 bp, P. troglodytes
cctctatgtcttttca

SEQ ID NO: 231187 - DNA, 16 bp, P. troglodytes
cctctatgtgtctgtg

SEQ ID NO: 231188 - DNA, 16 bp, P. troglodytes
cctctcaaagtgctga

SEQ ID NO: 231189 - DNA, 16 bp, P. troglodytes
cctctcaacactgtta

SEQ ID NO: 231190 - DNA, 16 bp, P. troglodytes
cctctcaacatgctgg

SEQ ID NO: 231191 - DNA, 16 bp, P. troglodytes
cctctcacccaggctg

SEQ ID NO: 231192 - DNA, 16 bp, P. troglodytes
cctctcacctcaacct

SEQ ID NO: 231193 - DNA, 16 bp, P. troglodytes
cctctcacctccgcct

SEQ ID NO: 231194 - DNA, 16 bp, P. troglodytes
cctctcagagcctcag

SEQ ID NO: 231195 - DNA, 16 bp, P. troglodytes
cctctcagattcaagc

SEQ ID NO: 231196 - DNA, 16 bp, P. troglodytes
cctctcagtactgctt

SEQ ID NO: 231197 - DNA, 16 bp, P. troglodytes
cctctccaaggagaac

SEQ ID NO: 231198 - DNA, 16 bp, P. troglodytes
cctctccacagctggt

SEQ ID NO: 231199 - DNA, 16 bp, P. troglodytes
cctctccacagggcag

SEQ ID NO: 231200 - DNA, 16 bp, P. troglodytes
cctctccactgagagc

SEQ ID NO: 231201 - DNA, 16 bp, P. troglodytes
cctctccagaagcaga

SEQ ID NO: 231202 - DNA, 16 bp, P. troglodytes
cctctccagcatttgg

SEQ ID NO: 231203 - DNA, 16 bp, P. troglodytes
cctctccaggcctcag

SEQ ID NO: 231204 - DNA, 16 bp, P. troglodytes
cctctccaggctcagg

SEQ ID NO: 231205 - DNA, 16 bp, P. troglodytes
cctctccatgtggcct

SEQ ID NO: 231206 - DNA, 16 bp, P. troglodytes
cctctcccagccccag

SEQ ID NO: 231207 - DNA, 16 bp, P. troglodytes
cctctcccagcctcgc

SEQ ID NO: 231208 - DNA, 16 bp, P. troglodytes
cctctcccagctcctg

SEQ ID NO: 231209 - DNA, 16 bp, P. troglodytes
cctctcccaggttcaa

SEQ ID NO: 231210 - DNA, 16 bp, P. troglodytes
cctctcccagtccatt

SEQ ID NO: 231211 - DNA, 16 bp, P. troglodytes
cctctcccatcccaga

SEQ ID NO: 231212 - DNA, 16 bp, P. troglodytes
cctctccccacagtct

SEQ ID NO: 231213 - DNA, 16 bp, P. troglodytes
cctctccccagcctgg

SEQ ID NO: 231214 - DNA, 16 bp, P. troglodytes
cctctccctcccaggc

SEQ ID NO: 231215 - DNA, 16 bp, P. troglodytes
cctctccctcctgcca

SEQ ID NO: 231216 - DNA, 16 bp, P. troglodytes
cctctccctgcagccc

SEQ ID NO: 231217 - DNA, 16 bp, P. troglodytes
cctctccctgctccca

SEQ ID NO: 231218 - DNA, 16 bp, P. troglodytes
cctctcctcccagcct

SEQ ID NO: 231219 - DNA, 20 bp, P. troglodytes
cctctcctcctccaaaggaa

SEQ ID NO: 231220 - DNA, 16 bp, P. troglodytes
cctctcctcttccaaa

SEQ ID NO: 231221 - DNA, 16 bp, P. troglodytes
cctctcctgccatgtg

SEQ ID NO: 231222 - DNA, 16 bp, P. troglodytes
cctctcctgcccccag

SEQ ID NO: 231223 - DNA, 16 bp, P. troglodytes
cctctcctgcctccca

SEQ ID NO: 231224 - DNA, 16 bp, P. troglodytes
cctctccttgggcctc

SEQ ID NO: 231225 - DNA, 17 bp, P. troglodytes
cctctcgggttcacgcc

SEQ ID NO: 231226 - DNA, 16 bp, P. troglodytes
cctctctaaaatgtat

SEQ ID NO: 231227 - DNA, 16 bp, P. troglodytes
cctctctaagccttag

SEQ ID NO: 231228 - DNA, 16 bp, P. troglodytes
cctctctatgcctcag

SEQ ID NO: 231229 - DNA, 16 bp, P. troglodytes
cctctctccttggcct

SEQ ID NO: 231230 - DNA, 16 bp, P. troglodytes
cctctctctctgtgtg

SEQ ID NO: 231231 - DNA, 16 bp, P. troglodytes
cctctctctgggtctc

SEQ ID NO: 231232 - DNA, 16 bp, P. troglodytes
cctctctcttttgtaa

SEQ ID NO: 231233 - DNA, 16 bp, P. troglodytes
cctctctgaaccttag

SEQ ID NO: 231234 - DNA, 16 bp, P. troglodytes
cctctctgagcctctg

SEQ ID NO: 231235 - DNA, 16 bp, P. troglodytes
cctctctgagctcagt

SEQ ID NO: 231236 - DNA, 16 bp, P. troglodytes
cctctctgaggaagtg

SEQ ID NO: 231237 - DNA, 16 bp, P. troglodytes
cctctctgctgagagc

SEQ ID NO: 231238 - DNA, 16 bp, P. troglodytes
cctctctggacttcag

SEQ ID NO: 231239 - DNA, 16 bp, P. troglodytes
cctctctggctagggc

SEQ ID NO: 231240 - DNA, 16 bp, P. troglodytes
cctctctgggatgaag

SEQ ID NO: 231241 - DNA, 16 bp, P. troglodytes
cctctctgggcagctc

SEQ ID NO: 231242 - DNA, 16 bp, P. troglodytes
cctctctgggcctcag

SEQ ID NO: 231243 - DNA, 16 bp, P. troglodytes
cctctctgggcctgat

SEQ ID NO: 231244 - DNA, 16 bp, P. troglodytes
cctctctgggcctggg

SEQ ID NO: 231245 - DNA, 16 bp, P. troglodytes
cctctctgggccttgg

SEQ ID NO: 231246 - DNA, 16 bp, P. troglodytes
cctctctgggctggct

SEQ ID NO: 231247 - DNA, 16 bp, P. troglodytes
cctctctgggctttgg

SEQ ID NO: 231248 - DNA, 16 bp, P. troglodytes
cctctctgggtttcag

SEQ ID NO: 231249 - DNA, 16 bp, P. troglodytes
cctctctgtcacctga

SEQ ID NO: 231250 - DNA, 16 bp, P. troglodytes
cctctctgtgcctctg

SEQ ID NO: 231251 - DNA, 16 bp, P. troglodytes
cctctctgtgtccctg

SEQ ID NO: 231252 - DNA, 16 bp, P. troglodytes
cctctctgtgttcatg

SEQ ID NO: 231253 - DNA, 16 bp, P. troglodytes
cctctcttcatggcct

SEQ ID NO: 231254 - DNA, 16 bp, P. troglodytes
cctctcttcctgtttg

SEQ ID NO: 231255 - DNA, 16 bp, P. troglodytes
cctctgaaacctgggt

SEQ ID NO: 231256 - DNA, 16 bp, P. troglodytes
cctctgaaagcaccca

SEQ ID NO: 231257 - DNA, 16 bp, P. troglodytes
cctctgaagccttctt

SEQ ID NO: 231258 - DNA, 16 bp, P. troglodytes
cctctgactcccaaag

SEQ ID NO: 231259 - DNA, 16 bp, P. troglodytes
cctctgagatctggaa

SEQ ID NO: 231260 - DNA, 16 bp, P. troglodytes
cctctgagcccaggcc

SEQ ID NO: 231261 - DNA, 16 bp, P. troglodytes
cctctgagcctgtttc

SEQ ID NO: 231262 - DNA, 16 bp, P. troglodytes
cctctgcaagctgagg

SEQ ID NO: 231263 - DNA, 16 bp, P. troglodytes
cctctgcacctgcctg

SEQ ID NO: 231264 - DNA, 16 bp, P. troglodytes
cctctgcacttcagcc

SEQ ID NO: 231265 - DNA, 16 bp, P. troglodytes
cctctgcagcaaactt

SEQ ID NO: 231266 - DNA, 16 bp, P. troglodytes
cctctgcagcttcctc

SEQ ID NO: 231267 - DNA, 16 bp, P. troglodytes
cctctgccaggccacc

SEQ ID NO: 231268 - DNA, 16 bp, P. troglodytes
cctctgccaggccgcc

SEQ ID NO: 231269 - DNA, 16 bp, P. troglodytes
cctctgcccacctgcc

SEQ ID NO: 231270 - DNA, 16 bp, P. troglodytes
cctctgcccagcagcc

SEQ ID NO: 231271 - DNA, 16 bp, P. troglodytes
cctctgcccagccacc

SEQ ID NO: 231272 - DNA, 16 bp, P. troglodytes
cctctgcccagctgcc

SEQ ID NO: 231273 - DNA, 16 bp, P. troglodytes
cctctgccccagcctc

SEQ ID NO: 231274 - DNA, 16 bp, P. troglodytes
cctctgccccccaaag

SEQ ID NO: 231275 - DNA, 16 bp, P. troglodytes
cctctgccccccaggt

SEQ ID NO: 231276 - DNA, 16 bp, P. troglodytes
cctctgccccctgggc

SEQ ID NO: 231277 - DNA, 16 bp, P. troglodytes
cctctgcccctcaggt

SEQ ID NO: 231278 - DNA, 16 bp, P. troglodytes
cctctgcccctccagg

SEQ ID NO: 231279 - DNA, 16 bp, P. troglodytes
cctctgcccggccacc

SEQ ID NO: 231280 - DNA, 16 bp, P. troglodytes
cctctgccctcccagg

SEQ ID NO: 231281 - DNA, 16 bp, P. troglodytes
cctctgccctgccacc

SEQ ID NO: 231282 - DNA, 16 bp, P. troglodytes
cctctgccctgccctg

SEQ ID NO: 231283 - DNA, 16 bp, P. troglodytes
cctctgcctccagagt

SEQ ID NO: 231284 - DNA, 16 bp, P. troglodytes
cctctgcctccaggct

SEQ ID NO: 231285 - DNA, 16 bp, P. troglodytes
cctctgcctcccaaat

SEQ ID NO: 231286 - DNA, 16 bp, P. troglodytes
cctctgcctcccaagc

SEQ ID NO: 231287 - DNA, 16 bp, P. troglodytes
cctctgcctcccagga

SEQ ID NO: 231288 - DNA, 16 bp, P. troglodytes
cctctgcctccccagg

SEQ ID NO: 231289 - DNA, 16 bp, P. troglodytes
cctctgcctccctgca

SEQ ID NO: 231290 - DNA, 16 bp, P. troglodytes
cctctgcctcctcagc

SEQ ID NO: 231291 - DNA, 16 bp, P. troglodytes
cctctgcctcctcagt

SEQ ID NO: 231292 - DNA, 16 bp, P. troglodytes
cctctgcctcctccca

SEQ ID NO: 231293 - DNA, 16 bp, P. troglodytes
cctctgcctcctgaag

SEQ ID NO: 231294 - DNA, 16 bp, P. troglodytes
cctctgcctcctgctt

SEQ ID NO: 231295 - DNA, 16 bp, P. troglodytes
cctctgcctcctgggc

SEQ ID NO: 231296 - DNA, 16 bp, P. troglodytes
cctctgcctcctggtt

SEQ ID NO: 231297 - DNA, 16 bp, P. troglodytes
cctctgcctccttggc

SEQ ID NO: 231298 - DNA, 16 bp, P. troglodytes
cctctgcctctcccca

SEQ ID NO: 231299 - DNA, 16 bp, P. troglodytes
cctctgcctctcgggt

SEQ ID NO: 231300 - DNA, 20 bp, P. troglodytes
cctctgcctctcgggttcaa

SEQ ID NO: 231301 - DNA, 16 bp, P. troglodytes
cctctgcctgggacac

SEQ ID NO: 231302 - DNA, 16 bp, P. troglodytes
cctctgcctgttctgc

SEQ ID NO: 231303 - DNA, 16 bp, P. troglodytes
cctctgccttcccagt

SEQ ID NO: 231304 - DNA, 16 bp, P. troglodytes
cctctgccttcctggc

SEQ ID NO: 231305 - DNA, 16 bp, P. troglodytes
cctctgcgtcctgggt

SEQ ID NO: 231306 - DNA, 16 bp, P. troglodytes
cctctgctgctgctgc

SEQ ID NO: 231307 - DNA, 16 bp, P. troglodytes
cctctgctgctgctgt

SEQ ID NO: 231308 - DNA, 16 bp, P. troglodytes
cctctgctgtggctcc

SEQ ID NO: 231309 - DNA, 16 bp, P. troglodytes
cctctgcttccctggc

SEQ ID NO: 231310 - DNA, 16 bp, P. troglodytes
cctctgcttccctggt

SEQ ID NO: 231311 - DNA, 16 bp, P. troglodytes
cctctgcttcctgggc

SEQ ID NO: 231312 - DNA, 16 bp, P. troglodytes
cctctgcttctggtga

SEQ ID NO: 231313 - DNA, 16 bp, P. troglodytes
cctctgcttttcttaa

SEQ ID NO: 231314 - DNA, 16 bp, P. troglodytes
cctctggaaaactcca

SEQ ID NO: 231315 - DNA, 16 bp, P. troglodytes
cctctggaagctttgt

SEQ ID NO: 231316 - DNA, 16 bp, P. troglodytes
cctctggcccaggaca

SEQ ID NO: 231317 - DNA, 16 bp, P. troglodytes
cctctggcctcagtct

SEQ ID NO: 231318 - DNA, 16 bp, P. troglodytes
cctctggctagggctg

SEQ ID NO: 231319 - DNA, 16 bp, P. troglodytes
cctctggctcccaggt

SEQ ID NO: 231320 - DNA, 16 bp, P. troglodytes
cctctggctcctgggc

SEQ ID NO: 231321 - DNA, 16 bp, P. troglodytes
cctctggctttgttct

SEQ ID NO: 231322 - DNA, 16 bp, P. troglodytes
cctctggggctccagg

SEQ ID NO: 231323 - DNA, 16 bp, P. troglodytes
cctctggggttcaagc

SEQ ID NO: 231324 - DNA, 16 bp, P. troglodytes
cctctgggttcaagtg

SEQ ID NO: 231325 - DNA, 16 bp, P. troglodytes
cctctggtggctgctg

SEQ ID NO: 231326 - DNA, 19 bp, P. troglodytes
cctctgtcgcctaggctgg

SEQ ID NO: 231327 - DNA, 16 bp, P. troglodytes
cctctgtctcccaggt

SEQ ID NO: 231328 - DNA, 16 bp, P. troglodytes
cctctgtctccccagc

SEQ ID NO: 231329 - DNA, 16 bp, P. troglodytes
cctctgtctccccagt

SEQ ID NO: 231330 - DNA, 16 bp, P. troglodytes
cctctgtctcccgggc

SEQ ID NO: 231331 - DNA, 16 bp, P. troglodytes
cctctgtctccctaga

SEQ ID NO: 231332 - DNA, 16 bp, P. troglodytes
cctctgtctctctgtc

SEQ ID NO: 231333 - DNA, 16 bp, P. troglodytes
cctctgtgccaggcac

SEQ ID NO: 231334 - DNA, 16 bp, P. troglodytes
cctctgtgctctgcct

SEQ ID NO: 231335 - DNA, 16 bp, P. troglodytes
cctctgtgtccctaga

SEQ ID NO: 231336 - DNA, 16 bp, P. troglodytes
cctctgtgtcctcatc

SEQ ID NO: 231337 - DNA, 16 bp, P. troglodytes
cctctgtgtctgtgtc

SEQ ID NO: 231338 - DNA, 17 bp, P. troglodytes
cctctgttgcccaggct

SEQ ID NO: 231339 - DNA, 16 bp, P. troglodytes
cctctgtttaaaaaaa

SEQ ID NO: 231340 - DNA, 16 bp, P. troglodytes
cctcttatctcagcct

SEQ ID NO: 231341 - DNA, 16 bp, P. troglodytes
cctcttcaccttgctc

SEQ ID NO: 231342 - DNA, 16 bp, P. troglodytes
cctcttcactccagcc

SEQ ID NO: 231343 - DNA, 16 bp, P. troglodytes
cctcttcactctgatg

SEQ ID NO: 231344 - DNA, 16 bp, P. troglodytes
cctcttcatgttaaaa

SEQ ID NO: 231345 - DNA, 16 bp, P. troglodytes
cctcttccaacattgg

SEQ ID NO: 231346 - DNA, 16 bp, P. troglodytes
cctcttccagcttctg

SEQ ID NO: 231347 - DNA, 16 bp, P. troglodytes
cctcttcccagcccca

SEQ ID NO: 231348 - DNA, 16 bp, P. troglodytes
cctcttcctcccaggt

SEQ ID NO: 231349 - DNA, 16 bp, P. troglodytes
cctcttcctggaagcc

SEQ ID NO: 231350 - DNA, 16 bp, P. troglodytes
cctcttcctggtttgc

SEQ ID NO: 231351 - DNA, 16 bp, P. troglodytes
cctcttccttccccag

SEQ ID NO: 231352 - DNA, 16 bp, P. troglodytes
cctcttcgaggagaac

SEQ ID NO: 231353 - DNA, 16 bp, P. troglodytes
cctcttctcacagctg

SEQ ID NO: 231354 - DNA, 16 bp, P. troglodytes
cctcttctcatagctc

SEQ ID NO: 231355 - DNA, 16 bp, P. troglodytes
cctcttctcctacaaa

SEQ ID NO: 231356 - DNA, 16 bp, P. troglodytes
cctcttctcctccaaa

SEQ ID NO: 231357 - DNA, 16 bp, P. troglodytes
cctcttctgcctgggc

SEQ ID NO: 231358 - DNA, 16 bp, P. troglodytes
cctcttcttataagaa

SEQ ID NO: 231359 - DNA, 16 bp, P. troglodytes
cctcttgagtgctttg

SEQ ID NO: 231360 - DNA, 16 bp, P. troglodytes
cctcttgcattagcat

SEQ ID NO: 231361 - DNA, 16 bp, P. troglodytes
cctcttgccttctagg

SEQ ID NO: 231362 - DNA, 16 bp, P. troglodytes
cctcttgccttgacct

SEQ ID NO: 231363 - DNA, 16 bp, P. troglodytes
cctcttggccaagagg

SEQ ID NO: 231364 - DNA, 16 bp, P. troglodytes
cctcttgtgctgagtc

SEQ ID NO: 231365 - DNA, 16 bp, P. troglodytes
cctctttccaaataag

SEQ ID NO: 231366 - DNA, 16 bp, P. troglodytes
cctctttcctgtaaca

SEQ ID NO: 231367 - DNA, 16 bp, P. troglodytes
cctctttcttttgtat

SEQ ID NO: 231368 - DNA, 16 bp, P. troglodytes
cctctttggaaaaagc

SEQ ID NO: 231369 - DNA, 16 bp, P. troglodytes
cctctttggattccag

SEQ ID NO: 231370 - DNA, 16 bp, P. troglodytes
cctctttgggcttcag

SEQ ID NO: 231371 - DNA, 16 bp, P. troglodytes
cctctttggggttctg

SEQ ID NO: 231372 - DNA, 16 bp, P. troglodytes
cctcttttataaggac

SEQ ID NO: 231373 - DNA, 16 bp, P. troglodytes
cctgaaaaaatgctca

SEQ ID NO: 231374 - DNA, 16 bp, P. troglodytes
cctgaaaaagaattca

SEQ ID NO: 231375 - DNA, 16 bp, P. troglodytes
cctgaaaaccttccag

SEQ ID NO: 231376 - DNA, 16 bp, P. troglodytes
cctgaaaatgtggaaa

SEQ ID NO: 231377 - DNA, 16 bp, P. troglodytes
cctgaaactttcctga

SEQ ID NO: 231378 - DNA, 16 bp, P. troglodytes
cctgaaagaaataaaa

SEQ ID NO: 231379 - DNA, 16 bp, P. troglodytes
cctgaaagactactgg

SEQ ID NO: 231380 - DNA, 16 bp, P. troglodytes
cctgaaagcactgagg

SEQ ID NO: 231381 - DNA, 16 bp, P. troglodytes
cctgaaagccccactc

SEQ ID NO: 231382 - DNA, 16 bp, P. troglodytes
cctgaaagtgatgagg

SEQ ID NO: 231383 - DNA, 16 bp, P. troglodytes
cctgaaatattttttt

SEQ ID NO: 231384 - DNA, 16 bp, P. troglodytes
cctgaacagcctgcag

SEQ ID NO: 231385 - DNA, 16 bp, P. troglodytes
cctgaacataggagaa

SEQ ID NO: 231386 - DNA, 16 bp, P. troglodytes
cctgaacattttcttt

SEQ ID NO: 231387 - DNA, 16 bp, P. troglodytes
cctgaacccagaaggc

SEQ ID NO: 231388 - DNA, 16 bp, P. troglodytes
cctgaacccaggaggc

SEQ ID NO: 231389 - DNA, 16 bp, P. troglodytes
cctgaacctgagaggc

SEQ ID NO: 231390 - DNA, 16 bp, P. troglodytes
cctgaacctggaaggc

SEQ ID NO: 231391 - DNA, 16 bp, P. troglodytes
cctgaacctgggaggc

SEQ ID NO: 231392 - DNA, 16 bp, P. troglodytes
cctgaactcaggagtt

SEQ ID NO: 231393 - DNA, 16 bp, P. troglodytes
cctgaactcctgggct

SEQ ID NO: 231394 - DNA, 16 bp, P. troglodytes
cctgaagaactgtgag

SEQ ID NO: 231395 - DNA, 16 bp, P. troglodytes
cctgaagaacttcctt

SEQ ID NO: 231396 - DNA, 16 bp, P. troglodytes
cctgaagaccttccag

SEQ ID NO: 231397 - DNA, 16 bp, P. troglodytes
cctgaagactgaggac

SEQ ID NO: 231398 - DNA, 16 bp, P. troglodytes
cctgaagcagctggct

SEQ ID NO: 231399 - DNA, 16 bp, P. troglodytes
cctgaaggactactgg

SEQ ID NO: 231400 - DNA, 16 bp, P. troglodytes
cctgaaggccccacct

SEQ ID NO: 231401 - DNA, 16 bp, P. troglodytes
cctgaagtgcagggat

SEQ ID NO: 231402 - DNA, 16 bp, P. troglodytes
cctgaagtgttttcca

SEQ ID NO: 231403 - DNA, 16 bp, P. troglodytes
cctgaagttgggagtt

SEQ ID NO: 231404 - DNA, 16 bp, P. troglodytes
cctgaagttttatttt

SEQ ID NO: 231405 - DNA, 16 bp, P. troglodytes
cctgaataacttttgg

SEQ ID NO: 231406 - DNA, 16 bp, P. troglodytes
cctgaatctttttttt

SEQ ID NO: 231407 - DNA, 16 bp, P. troglodytes
cctgaatgaccactgg

SEQ ID NO: 231408 - DNA, 16 bp, P. troglodytes
cctgaatgcccatcaa

SEQ ID NO: 231409 - DNA, 16 bp, P. troglodytes
cctgaattctttcttt

SEQ ID NO: 231410 - DNA, 16 bp, P. troglodytes
cctgaattctttttca

SEQ ID NO: 231411 - DNA, 16 bp, P. troglodytes
cctgacaaaaacaagg

SEQ ID NO: 231412 - DNA, 16 bp, P. troglodytes
cctgacaaaaagaagc

SEQ ID NO: 231413 - DNA, 16 bp, P. troglodytes
cctgacaaaaataaga

SEQ ID NO: 231414 - DNA, 16 bp, P. troglodytes
cctgacacacagcagg

SEQ ID NO: 231415 - DNA, 16 bp, P. troglodytes
cctgacacatagtagg

SEQ ID NO: 231416 - DNA, 16 bp, P. troglodytes
cctgacacctccccag

SEQ ID NO: 231417 - DNA, 17 bp, P. troglodytes
cctgaccaatatgatga

SEQ ID NO: 231418 - DNA, 16 bp, P. troglodytes
cctgaccacatggaga

SEQ ID NO: 231419 - DNA, 16 bp, P. troglodytes
cctgaccacgtgatcc

SEQ ID NO: 231420 - DNA, 16 bp, P. troglodytes
cctgaccatgtgatcc

SEQ ID NO: 231421 - DNA, 16 bp, P. troglodytes
cctgacccacatggag

SEQ ID NO: 231422 - DNA, 16 bp, P. troglodytes
cctgacccccaagcag

SEQ ID NO: 231423 - DNA, 16 bp, P. troglodytes
cctgacccctgacccc

SEQ ID NO: 231424 - DNA, 16 bp, P. troglodytes
cctgacccctgaccct

SEQ ID NO: 231425 - DNA, 16 bp, P. troglodytes
cctgacccctgacctc

SEQ ID NO: 231426 - DNA, 17 bp, P. troglodytes
cctgacccctgagcagc

SEQ ID NO: 231427 - DNA, 16 bp, P. troglodytes
cctgaccctgaccctg

SEQ ID NO: 231428 - DNA, 24 bp, P. troglodytes
cctgacctaagcctggtagttaaa

SEQ ID NO: 231429 - DNA, 16 bp, P. troglodytes
cctgacctcaagcaac

SEQ ID NO: 231430 - DNA, 16 bp, P. troglodytes
cctgacctcagatgac

SEQ ID NO: 231431 - DNA, 16 bp, P. troglodytes
cctgacctcaggagtt

SEQ ID NO: 231432 - DNA, 16 bp, P. troglodytes
cctgacctctgacctc

SEQ ID NO: 231433 - DNA, 17 bp, P. troglodytes
cctgacctctgatgatc

SEQ ID NO: 231434 - DNA, 16 bp, P. troglodytes
cctgacctgtgatctg

SEQ ID NO: 231435 - DNA, 16 bp, P. troglodytes
cctgaccttgcaatcc

SEQ ID NO: 231436 - DNA, 16 bp, P. troglodytes
cctgaccttgtgattc

SEQ ID NO: 231437 - DNA, 16 bp, P. troglodytes
cctgacgtcaggagtt

SEQ ID NO: 231438 - DNA, 16 bp, P. troglodytes
cctgactcagcctctg

SEQ ID NO: 231439 - DNA, 16 bp, P. troglodytes
cctgactggggctgct

SEQ ID NO: 231440 - DNA, 16 bp, P. troglodytes
cctgacttcaaaatac

SEQ ID NO: 231441 - DNA, 16 bp, P. troglodytes
cctgacttcaactata

SEQ ID NO: 231442 - DNA, 16 bp, P. troglodytes
cctgacttcagggaag

SEQ ID NO: 231443 - DNA, 16 bp, P. troglodytes
cctgactttaaaatat

SEQ ID NO: 231444 - DNA, 16 bp, P. troglodytes
cctgagaaaaacaaac

SEQ ID NO: 231445 - DNA, 16 bp, P. troglodytes
cctgagaaccaggagc

SEQ ID NO: 231446 - DNA, 16 bp, P. troglodytes
cctgagaaccaggagt

SEQ ID NO: 231447 - DNA, 16 bp, P. troglodytes
cctgagactcagagag

SEQ ID NO: 231448 - DNA, 16 bp, P. troglodytes
cctgagagatgggaaa

SEQ ID NO: 231449 - DNA, 16 bp, P. troglodytes
cctgagagcacagcgg

SEQ ID NO: 231450 - DNA, 16 bp, P. troglodytes
cctgagattaaaaaaa

SEQ ID NO: 231451 - DNA, 16 bp, P. troglodytes
cctgagcaacaagaat

SEQ ID NO: 231452 - DNA, 16 bp, P. troglodytes
cctgagcaacataaca

SEQ ID NO: 231453 - DNA, 16 bp, P. troglodytes
cctgagcaacatggtg

SEQ ID NO: 231454 - DNA, 16 bp, P. troglodytes
cctgagcagcagggac

SEQ ID NO: 231455 - DNA, 16 bp, P. troglodytes
cctgagccaaggaggt

SEQ ID NO: 231456 - DNA, 16 bp, P. troglodytes
cctgagccaccgcgcc

SEQ ID NO: 231457 - DNA, 16 bp, P. troglodytes
cctgagccagaaggga

SEQ ID NO: 231458 - DNA, 16 bp, P. troglodytes
cctgagcccaggagtt

SEQ ID NO: 231459 - DNA, 16 bp, P. troglodytes
cctgagcccagggagg

SEQ ID NO: 231460 - DNA, 16 bp, P. troglodytes
cctgagccctccccag

SEQ ID NO: 231461 - DNA, 16 bp, P. troglodytes
cctgagcctcagttcc

SEQ ID NO: 231462 - DNA, 16 bp, P. troglodytes
cctgagcctcccccac

SEQ ID NO: 231463 - DNA, 16 bp, P. troglodytes
cctgagcctcctgagt

SEQ ID NO: 231464 - DNA, 16 bp, P. troglodytes
cctgagcctgggaagt

SEQ ID NO: 231465 - DNA, 16 bp, P. troglodytes
cctgagccttctgagt

SEQ ID NO: 231466 - DNA, 16 bp, P. troglodytes
cctgagctcaaagtga

SEQ ID NO: 231467 - DNA, 16 bp, P. troglodytes
cctgagctcagcctcc

SEQ ID NO: 231468 - DNA, 16 bp, P. troglodytes
cctgagctcaggagtt

SEQ ID NO: 231469 - DNA, 16 bp, P. troglodytes
cctgagctcagggagg

SEQ ID NO: 231470 - DNA, 16 bp, P. troglodytes
cctgagctcaggggtt

SEQ ID NO: 231471 - DNA, 16 bp, P. troglodytes
cctgagctccgcctcc

SEQ ID NO: 231472 - DNA, 16 bp, P. troglodytes
cctgagctcttgtctg

SEQ ID NO: 231473 - DNA, 16 bp, P. troglodytes
cctgagctgtactttg

SEQ ID NO: 231474 - DNA, 16 bp, P. troglodytes
cctgagctgtatcttg

SEQ ID NO: 231475 - DNA, 16 bp, P. troglodytes
cctgaggaaagggaga

SEQ ID NO: 231476 - DNA, 16 bp, P. troglodytes
cctgaggaactgtgag

SEQ ID NO: 231477 - DNA, 16 bp, P. troglodytes
cctgaggaagaagaaa

SEQ ID NO: 231478 - DNA, 16 bp, P. troglodytes
cctgaggaagaagaga

SEQ ID NO: 231479 - DNA, 16 bp, P. troglodytes
cctgaggaagagaaag

SEQ ID NO: 231480 - DNA, 16 bp, P. troglodytes
cctgaggaatggtgcc

SEQ ID NO: 231481 - DNA, 16 bp, P. troglodytes
cctgaggagctggaat

SEQ ID NO: 231482 - DNA, 16 bp, P. troglodytes
cctgaggcaggagaat

SEQ ID NO: 231483 - DNA, 16 bp, P. troglodytes
cctgaggcaggaggat

SEQ ID NO: 231484 - DNA, 16 bp, P. troglodytes
cctgaggcatgagaat

SEQ ID NO: 231485 - DNA, 16 bp, P. troglodytes
cctgaggccacacagc

SEQ ID NO: 231486 - DNA, 16 bp, P. troglodytes
cctgaggccaggagtt

SEQ ID NO: 231487 - DNA, 16 bp, P. troglodytes
cctgaggcctccctgg

SEQ ID NO: 231488 - DNA, 16 bp, P. troglodytes
cctgaggcctccgcag

SEQ ID NO: 231489 - DNA, 16 bp, P. troglodytes
cctgaggcctcctgag

SEQ ID NO: 231490 - DNA, 16 bp, P. troglodytes
cctgaggcctctccag

SEQ ID NO: 231491 - DNA, 16 bp, P. troglodytes
cctgaggcctctctcc

SEQ ID NO: 231492 - DNA, 16 bp, P. troglodytes
cctgaggcgggagaat

SEQ ID NO: 231493 - DNA, 16 bp, P. troglodytes
cctgaggctgaggtgg

SEQ ID NO: 231494 - DNA, 16 bp, P. troglodytes
cctgaggctgcacagg

SEQ ID NO: 231495 - DNA, 16 bp, P. troglodytes
cctgagggactgtgcc

SEQ ID NO: 231496 - DNA, 16 bp, P. troglodytes
cctgagggcagggcct

SEQ ID NO: 231497 - DNA, 16 bp, P. troglodytes
cctgagggctgtgtca

SEQ ID NO: 231498 - DNA, 16 bp, P. troglodytes
cctgaggggcctggag

SEQ ID NO: 231499 - DNA, 16 bp, P. troglodytes
cctgagggggaaaaaa

SEQ ID NO: 231500 - DNA, 16 bp, P. troglodytes
cctgagggtggggcct

SEQ ID NO: 231501 - DNA, 16 bp, P. troglodytes
cctgaggtcaatagtt

SEQ ID NO: 231502 - DNA, 16 bp, P. troglodytes
cctgaggtcacagagc

SEQ ID NO: 231503 - DNA, 16 bp, P. troglodytes
cctgaggtcaggagat

SEQ ID NO: 231504 - DNA, 16 bp, P. troglodytes
cctgaggtcagggagt

SEQ ID NO: 231505 - DNA, 16 bp, P. troglodytes
cctgaggtcagggatt

SEQ ID NO: 231506 - DNA, 16 bp, P. troglodytes
cctgaggtgaagagtt

SEQ ID NO: 231507 - DNA, 17 bp, P. troglodytes
cctgaggttagaagttc

SEQ ID NO: 231508 - DNA, 16 bp, P. troglodytes
cctgaggttgggagtt

SEQ ID NO: 231509 - DNA, 16 bp, P. troglodytes
cctgagtagctgggca

SEQ ID NO: 231510 - DNA, 16 bp, P. troglodytes
cctgagtctccagctt

SEQ ID NO: 231511 - DNA, 16 bp, P. troglodytes
cctgagtctggtgggg

SEQ ID NO: 231512 - DNA, 16 bp, P. troglodytes
cctgagtgaactccca

SEQ ID NO: 231513 - DNA, 16 bp, P. troglodytes
cctgagtgcagtggca

SEQ ID NO: 231514 - DNA, 16 bp, P. troglodytes
cctgagtgcctgggac

SEQ ID NO: 231515 - DNA, 16 bp, P. troglodytes
cctgagtggttgggac

SEQ ID NO: 231516 - DNA, 16 bp, P. troglodytes
cctgagtgtgtgcaca

SEQ ID NO: 231517 - DNA, 16 bp, P. troglodytes
cctgagttcaggagtt

SEQ ID NO: 231518 - DNA, 16 bp, P. troglodytes
cctgagttctagtttc

SEQ ID NO: 231519 - DNA, 16 bp, P. troglodytes
cctgagtttttctttt

SEQ ID NO: 231520 - DNA, 16 bp, P. troglodytes
cctgataaacaacttc

SEQ ID NO: 231521 - DNA, 16 bp, P. troglodytes
cctgataaacccatca

SEQ ID NO: 231522 - DNA, 16 bp, P. troglodytes
cctgatcagtcagcag

SEQ ID NO: 231523 - DNA, 16 bp, P. troglodytes
cctgatcatagctcac

SEQ ID NO: 231524 - DNA, 16 bp, P. troglodytes
cctgatcccattcctc

SEQ ID NO: 231525 - DNA, 16 bp, P. troglodytes
cctgatgaagctgaaa

SEQ ID NO: 231526 - DNA, 16 bp, P. troglodytes
cctgatgaagctgagg

SEQ ID NO: 231527 - DNA, 16 bp, P. troglodytes
cctgatgactaatgac

SEQ ID NO: 231528 - DNA, 16 bp, P. troglodytes
cctgatgacttcactg

SEQ ID NO: 231529 - DNA, 16 bp, P. troglodytes
cctgatgatctgaggt

SEQ ID NO: 231530 - DNA, 16 bp, P. troglodytes
cctgatgcaggaaatg

SEQ ID NO: 231531 - DNA, 16 bp, P. troglodytes
cctgatggagctaaaa

SEQ ID NO: 231532 - DNA, 16 bp, P. troglodytes
cctgatggccctggcc

SEQ ID NO: 231533 - DNA, 16 bp, P. troglodytes
cctgatgggaggtgat

SEQ ID NO: 231534 - DNA, 16 bp, P. troglodytes
cctgatgtaaatgatg

SEQ ID NO: 231535 - DNA, 16 bp, P. troglodytes
cctgatgtaattatta

SEQ ID NO: 231536 - DNA, 16 bp, P. troglodytes
cctgattcatgaatca

SEQ ID NO: 231537 - DNA, 16 bp, P. troglodytes
cctgattgcccttgcc

SEQ ID NO: 231538 - DNA, 16 bp, P. troglodytes
cctgatttcaaattat

SEQ ID NO: 231539 - DNA, 16 bp, P. troglodytes
cctgatttgatcatta

SEQ ID NO: 231540 - DNA, 16 bp, P. troglodytes
cctgcaaagccaaagg

SEQ ID NO: 231541 - DNA, 16 bp, P. troglodytes
cctgcaaagcctaaaa

SEQ ID NO: 231542 - DNA, 16 bp, P. troglodytes
cctgcaaagcctgaaa

SEQ ID NO: 231543 - DNA, 16 bp, P. troglodytes
cctgcaaagtgctggg

SEQ ID NO: 231544 - DNA, 16 bp, P. troglodytes
cctgcaaatcctgcca

SEQ ID NO: 231545 - DNA, 16 bp, P. troglodytes
cctgcaacctctgcct

SEQ ID NO: 231546 - DNA, 16 bp, P. troglodytes
cctgcaatcccagcag

SEQ ID NO: 231547 - DNA, 18 bp, P. troglodytes
cctgcaatcgcaggcact

SEQ ID NO: 231548 - DNA, 16 bp, P. troglodytes
cctgcaattacttttg

SEQ ID NO: 231549 - DNA, 16 bp, P. troglodytes
cctgcacaaagccttg

SEQ ID NO: 231550 - DNA, 16 bp, P. troglodytes
cctgcacaacctctct

SEQ ID NO: 231551 - DNA, 16 bp, P. troglodytes
cctgcacaagctctct

SEQ ID NO: 231552 - DNA, 16 bp, P. troglodytes
cctgcacaagctctgt

SEQ ID NO: 231553 - DNA, 17 bp, P. troglodytes
cctgcacaatatgcaca

SEQ ID NO: 231554 - DNA, 16 bp, P. troglodytes
cctgcacacattctct

SEQ ID NO: 231555 - DNA, 16 bp, P. troglodytes
cctgcacagcctgcag

SEQ ID NO: 231556 - DNA, 16 bp, P. troglodytes
cctgcacagctaagtg

SEQ ID NO: 231557 - DNA, 16 bp, P. troglodytes
cctgcacagttgaaaa

SEQ ID NO: 231558 - DNA, 16 bp, P. troglodytes
cctgcacatggacccc

SEQ ID NO: 231559 - DNA, 16 bp, P. troglodytes
cctgcacatgtaccca

SEQ ID NO: 231560 - DNA, 25 bp, P. troglodytes
cctgcacccaggtgaaataaacagc

SEQ ID NO: 231561 - DNA, 16 bp, P. troglodytes
cctgcacccccatgtt

SEQ ID NO: 231562 - DNA, 16 bp, P. troglodytes
cctgcacctgcacctg

SEQ ID NO: 231563 - DNA, 16 bp, P. troglodytes
cctgcacctgcccatc

SEQ ID NO: 231564 - DNA, 16 bp, P. troglodytes
cctgcacctggaaaag

SEQ ID NO: 231565 - DNA, 16 bp, P. troglodytes
cctgcacctggaactg

SEQ ID NO: 231566 - DNA, 16 bp, P. troglodytes
cctgcacctggagatg

SEQ ID NO: 231567 - DNA, 17 bp, P. troglodytes
cctgcacgttgtgcact

SEQ ID NO: 231568 - DNA, 16 bp, P. troglodytes
cctgcactccagccca

SEQ ID NO: 231569 - DNA, 17 bp, P. troglodytes
cctgcactcggagcagc

SEQ ID NO: 231570 - DNA, 16 bp, P. troglodytes
cctgcagaaccaggag

SEQ ID NO: 231571 - DNA, 16 bp, P. troglodytes
cctgcagaactgcgag

SEQ ID NO: 231572 - DNA, 16 bp, P. troglodytes
cctgcagaatgagaga

SEQ ID NO: 231573 - DNA, 16 bp, P. troglodytes
cctgcagagaggagct

SEQ ID NO: 231574 - DNA, 16 bp, P. troglodytes
cctgcagagctgtgag

SEQ ID NO: 231575 - DNA, 16 bp, P. troglodytes
cctgcagcagaggggc

SEQ ID NO: 231576 - DNA, 16 bp, P. troglodytes
cctgcagcagcagcag

SEQ ID NO: 231577 - DNA, 16 bp, P. troglodytes
cctgcagccagcattg

SEQ ID NO: 231578 - DNA, 16 bp, P. troglodytes
cctgcagcccaccatg

SEQ ID NO: 231579 - DNA, 16 bp, P. troglodytes
cctgcagccccagccc

SEQ ID NO: 231580 - DNA, 16 bp, P. troglodytes
cctgcagcccctgccc

SEQ ID NO: 231581 - DNA, 16 bp, P. troglodytes
cctgcagcccctgcct

SEQ ID NO: 231582 - DNA, 16 bp, P. troglodytes
cctgcagccctggtgt

SEQ ID NO: 231583 - DNA, 16 bp, P. troglodytes
cctgcagcctcagcct

SEQ ID NO: 231584 - DNA, 16 bp, P. troglodytes
cctgcagcctccacct

SEQ ID NO: 231585 - DNA, 16 bp, P. troglodytes
cctgcagctctgggag

SEQ ID NO: 231586 - DNA, 16 bp, P. troglodytes
cctgcagctgagggcc

SEQ ID NO: 231587 - DNA, 16 bp, P. troglodytes
cctgcagctgaggggt

SEQ ID NO: 231588 - DNA, 16 bp, P. troglodytes
cctgcagctgagggtc

SEQ ID NO: 231589 - DNA, 16 bp, P. troglodytes
cctgcagctgcaggca

SEQ ID NO: 231590 - DNA, 16 bp, P. troglodytes
cctgcaggccaaatct

SEQ ID NO: 231591 - DNA, 16 bp, P. troglodytes
cctgcaggccagcacc

SEQ ID NO: 231592 - DNA, 16 bp, P. troglodytes
cctgcagggaagcccc

SEQ ID NO: 231593 - DNA, 16 bp, P. troglodytes
cctgcagggaggcagc

SEQ ID NO: 231594 - DNA, 16 bp, P. troglodytes
cctgcagggtggccat

SEQ ID NO: 231595 - DNA, 16 bp, P. troglodytes
cctgcaggtgcacaga

SEQ ID NO: 231596 - DNA, 16 bp, P. troglodytes
cctgcaggtgtgcaga

SEQ ID NO: 231597 - DNA, 16 bp, P. troglodytes
cctgcagtgagcccag

SEQ ID NO: 231598 - DNA, 19 bp, P. troglodytes
cctgcagtgagccgagatc

SEQ ID NO: 231599 - DNA, 16 bp, P. troglodytes
cctgcagtgcccagga

SEQ ID NO: 231600 - DNA, 16 bp, P. troglodytes
cctgcagtgctgggat

SEQ ID NO: 231601 - DNA, 16 bp, P. troglodytes
cctgcataagctctct

SEQ ID NO: 231602 - DNA, 16 bp, P. troglodytes
cctgcatcccttggct

SEQ ID NO: 231603 - DNA, 16 bp, P. troglodytes
cctgcatctgcctccc

SEQ ID NO: 231604 - DNA, 16 bp, P. troglodytes
cctgcattcctggtat

SEQ ID NO: 231605 - DNA, 16 bp, P. troglodytes
cctgccaacagccaca

SEQ ID NO: 231606 - DNA, 16 bp, P. troglodytes
cctgccacaacaccca

SEQ ID NO: 231607 - DNA, 16 bp, P. troglodytes
cctgccacagcctctt

SEQ ID NO: 231608 - DNA, 16 bp, P. troglodytes
cctgccaccacactcg

SEQ ID NO: 231609 - DNA, 16 bp, P. troglodytes
cctgccaccacgactg

SEQ ID NO: 231610 - DNA, 16 bp, P. troglodytes
cctgccaccctgccca

SEQ ID NO: 231611 - DNA, 16 bp, P. troglodytes
cctgccacctgttttt

SEQ ID NO: 231612 - DNA, 16 bp, P. troglodytes
cctgccactgccacca

SEQ ID NO: 231613 - DNA, 16 bp, P. troglodytes
cctgccactgccactg

SEQ ID NO: 231614 - DNA, 16 bp, P. troglodytes
cctgccactgtgcccg

SEQ ID NO: 231615 - DNA, 16 bp, P. troglodytes
cctgccactttgttta

SEQ ID NO: 231616 - DNA, 16 bp, P. troglodytes
cctgccagagaacaaa

SEQ ID NO: 231617 - DNA, 16 bp, P. troglodytes
cctgccagccccagcc

SEQ ID NO: 231618 - DNA, 16 bp, P. troglodytes
cctgccagccctgccc

SEQ ID NO: 231619 - DNA, 16 bp, P. troglodytes
cctgccagctcaagtg

SEQ ID NO: 231620 - DNA, 16 bp, P. troglodytes
cctgccaggctgagtg

SEQ ID NO: 231621 - DNA, 16 bp, P. troglodytes
cctgccagtgcccaaa

SEQ ID NO: 231622 - DNA, 16 bp, P. troglodytes
cctgccatcatgccca

SEQ ID NO: 231623 - DNA, 16 bp, P. troglodytes
cctgcccaaagtgctg

SEQ ID NO: 231624 - DNA, 16 bp, P. troglodytes
cctgcccaaggtcacc

SEQ ID NO: 231625 - DNA, 16 bp, P. troglodytes
cctgcccacctcggcc

SEQ ID NO: 231626 - DNA, 16 bp, P. troglodytes
cctgcccacctctcca

SEQ ID NO: 231627 - DNA, 16 bp, P. troglodytes
cctgcccacctctgcc

SEQ ID NO: 231628 - DNA, 16 bp, P. troglodytes
cctgcccacctgccca

SEQ ID NO: 231629 - DNA, 16 bp, P. troglodytes
cctgcccacctgcctg

SEQ ID NO: 231630 - DNA, 16 bp, P. troglodytes
cctgcccactgaggtg

SEQ ID NO: 231631 - DNA, 16 bp, P. troglodytes
cctgcccagaaggaaa

SEQ ID NO: 231632 - DNA, 16 bp, P. troglodytes
cctgcccagccatgtg

SEQ ID NO: 231633 - DNA, 16 bp, P. troglodytes
cctgcccagcccacag

SEQ ID NO: 231634 - DNA, 16 bp, P. troglodytes
cctgcccagcccacca

SEQ ID NO: 231635 - DNA, 16 bp, P. troglodytes
cctgcccagcccagcc

SEQ ID NO: 231636 - DNA, 16 bp, P. troglodytes
cctgcccagcccctgc

SEQ ID NO: 231637 - DNA, 16 bp, P. troglodytes
cctgcccagccctgcc

SEQ ID NO: 231638 - DNA, 16 bp, P. troglodytes
cctgcccagcctcctg

SEQ ID NO: 231639 - DNA, 16 bp, P. troglodytes
cctgcccagctcctgg

SEQ ID NO: 231640 - DNA, 16 bp, P. troglodytes
cctgcccagggtcaca

SEQ ID NO: 231641 - DNA, 16 bp, P. troglodytes
cctgcccagtgaggag

SEQ ID NO: 231642 - DNA, 16 bp, P. troglodytes
cctgcccagtgcctgg

SEQ ID NO: 231643 - DNA, 16 bp, P. troglodytes
cctgcccatctgcatg

SEQ ID NO: 231644 - DNA, 16 bp, P. troglodytes
cctgccccagccctgg

SEQ ID NO: 231645 - DNA, 16 bp, P. troglodytes
cctgccccagcctcac

SEQ ID NO: 231646 - DNA, 16 bp, P. troglodytes
cctgccccagctcctg

SEQ ID NO: 231647 - DNA, 16 bp, P. troglodytes
cctgccccagcttccc

SEQ ID NO: 231648 - DNA, 16 bp, P. troglodytes
cctgccccaggacctt

SEQ ID NO: 231649 - DNA, 16 bp, P. troglodytes
cctgccccaggcctgg

SEQ ID NO: 231650 - DNA, 16 bp, P. troglodytes
cctgcccccaaaggtg

SEQ ID NO: 231651 - DNA, 16 bp, P. troglodytes
cctgcccccagccctg

SEQ ID NO: 231652 - DNA, 16 bp, P. troglodytes
cctgcccctcagcctc

SEQ ID NO: 231653 - DNA, 16 bp, P. troglodytes
cctgcccctgcagcaa

SEQ ID NO: 231654 - DNA, 16 bp, P. troglodytes
cctgcccctgcccaca

SEQ ID NO: 231655 - DNA, 16 bp, P. troglodytes
cctgcccctgccctgg

SEQ ID NO: 231656 - DNA, 16 bp, P. troglodytes
cctgcccctgctcctg

SEQ ID NO: 231657 - DNA, 16 bp, P. troglodytes
cctgcccctgtctgcc

SEQ ID NO: 231658 - DNA, 16 bp, P. troglodytes
cctgccccttccaagt

SEQ ID NO: 231659 - DNA, 16 bp, P. troglodytes
cctgcccctttccacc

SEQ ID NO: 231660 - DNA, 17 bp, P. troglodytes
cctgccccttttgcttt

SEQ ID NO: 231661 - DNA, 16 bp, P. troglodytes
cctgccctagagatct

SEQ ID NO: 231662 - DNA, 16 bp, P. troglodytes
cctgccctcaaacatc

SEQ ID NO: 231663 - DNA, 16 bp, P. troglodytes
cctgccctcaaagagc

SEQ ID NO: 231664 - DNA, 16 bp, P. troglodytes
cctgccctcagcctcc

SEQ ID NO: 231665 - DNA, 16 bp, P. troglodytes
cctgccctcatggagc

SEQ ID NO: 231666 - DNA, 16 bp, P. troglodytes
cctgccctccaggagc

SEQ ID NO: 231667 - DNA, 16 bp, P. troglodytes
cctgccctcctggagc

SEQ ID NO: 231668 - DNA, 16 bp, P. troglodytes
cctgccctctggtggc

SEQ ID NO: 231669 - DNA, 16 bp, P. troglodytes
cctgccctgcccacct

SEQ ID NO: 231670 - DNA, 16 bp, P. troglodytes
cctgccctgccctggc

SEQ ID NO: 231671 - DNA, 16 bp, P. troglodytes
cctgccctgccctggg

SEQ ID NO: 231672 - DNA, 16 bp, P. troglodytes
cctgccctgcctgcct

SEQ ID NO: 231673 - DNA, 16 bp, P. troglodytes
cctgccctgccttgcc

SEQ ID NO: 231674 - DNA, 16 bp, P. troglodytes
cctgccctgctcctca

SEQ ID NO: 231675 - DNA, 16 bp, P. troglodytes
cctgccctggaacatc

SEQ ID NO: 231676 - DNA, 16 bp, P. troglodytes
cctgccctggccctgg

SEQ ID NO: 231677 - DNA, 16 bp, P. troglodytes
cctgccctggcctctc

SEQ ID NO: 231678 - DNA, 16 bp, P. troglodytes
cctgccctggccttcc

SEQ ID NO: 231679 - DNA, 16 bp, P. troglodytes
cctgccctgggccagg

SEQ ID NO: 231680 - DNA, 16 bp, P. troglodytes
cctgccctgggccctg

SEQ ID NO: 231681 - DNA, 16 bp, P. troglodytes
cctgccctgtccccag

SEQ ID NO: 231682 - DNA, 16 bp, P. troglodytes
cctgccctgtgtccat

SEQ ID NO: 231683 - DNA, 16 bp, P. troglodytes
cctgccgtggcctccc

SEQ ID NO: 231684 - DNA, 16 bp, P. troglodytes
cctgcctaccagacac

SEQ ID NO: 231685 - DNA, 16 bp, P. troglodytes
cctgcctaggcctcca

SEQ ID NO: 231686 - DNA, 16 bp, P. troglodytes
cctgcctcacccctgc

SEQ ID NO: 231687 - DNA, 16 bp, P. troglodytes
cctgcctcagactcct

SEQ ID NO: 231688 - DNA, 16 bp, P. troglodytes
cctgcctcagcatccc

SEQ ID NO: 231689 - DNA, 16 bp, P. troglodytes
cctgcctcagcatctg

SEQ ID NO: 231690 - DNA, 16 bp, P. troglodytes
cctgcctcagccccag

SEQ ID NO: 231691 - DNA, 16 bp, P. troglodytes
cctgcctcagcctcca

SEQ ID NO: 231692 - DNA, 16 bp, P. troglodytes
cctgcctcagcctcgg

SEQ ID NO: 231693 - DNA, 16 bp, P. troglodytes
cctgcctcagcctgct

SEQ ID NO: 231694 - DNA, 16 bp, P. troglodytes
cctgcctcagccttcc

SEQ ID NO: 231695 - DNA, 16 bp, P. troglodytes
cctgcctcagcttctc

SEQ ID NO: 231696 - DNA, 16 bp, P. troglodytes
cctgcctcaggatccc

SEQ ID NO: 231697 - DNA, 16 bp, P. troglodytes
cctgcctcaggccccc

SEQ ID NO: 231698 - DNA, 16 bp, P. troglodytes
cctgcctcaggctcct

SEQ ID NO: 231699 - DNA, 16 bp, P. troglodytes
cctgcctcagtctctc

SEQ ID NO: 231700 - DNA, 16 bp, P. troglodytes
cctgcctcagtgtccc

SEQ ID NO: 231701 - DNA, 16 bp, P. troglodytes
cctgcctcagtttccc

SEQ ID NO: 231702 - DNA, 16 bp, P. troglodytes
cctgcctcagtttcct

SEQ ID NO: 231703 - DNA, 16 bp, P. troglodytes
cctgcctcatcctcct

SEQ ID NO: 231704 - DNA, 16 bp, P. troglodytes
cctgcctcatctcccc

SEQ ID NO: 231705 - DNA, 16 bp, P. troglodytes
cctgcctccacctgcc

SEQ ID NO: 231706 - DNA, 16 bp, P. troglodytes
cctgcctccaccttcc

SEQ ID NO: 231707 - DNA, 16 bp, P. troglodytes
cctgcctccatttccc

SEQ ID NO: 231708 - DNA, 16 bp, P. troglodytes
cctgcctcccattctg

SEQ ID NO: 231709 - DNA, 16 bp, P. troglodytes
cctgcctccctgcctg

SEQ ID NO: 231710 - DNA, 16 bp, P. troglodytes
cctgcctccgcctctg

SEQ ID NO: 231711 - DNA, 16 bp, P. troglodytes
cctgcctcctccagcc

SEQ ID NO: 231712 - DNA, 16 bp, P. troglodytes
cctgcctcctccagga

SEQ ID NO: 231713 - DNA, 16 bp, P. troglodytes
cctgcctcctcttcca

SEQ ID NO: 231714 - DNA, 16 bp, P. troglodytes
cctgcctcctgccacc

SEQ ID NO: 231715 - DNA, 16 bp, P. troglodytes
cctgcctcctgcccac

SEQ ID NO: 231716 - DNA, 16 bp, P. troglodytes
cctgcctcctgccctg

SEQ ID NO: 231717 - DNA, 16 bp, P. troglodytes
cctgcctcctgctgcc

SEQ ID NO: 231718 - DNA, 16 bp, P. troglodytes
cctgcctcctgggttt

SEQ ID NO: 231719 - DNA, 16 bp, P. troglodytes
cctgcctcgacttccc

SEQ ID NO: 231720 - DNA, 16 bp, P. troglodytes
cctgcctcggccaccc

SEQ ID NO: 231721 - DNA, 16 bp, P. troglodytes
cctgcctcggcctacc

SEQ ID NO: 231722 - DNA, 16 bp, P. troglodytes
cctgcctcggcctcct

SEQ ID NO: 231723 - DNA, 16 bp, P. troglodytes
cctgcctcggccttgc

SEQ ID NO: 231724 - DNA, 16 bp, P. troglodytes
cctgcctcggtttccc

SEQ ID NO: 231725 - DNA, 16 bp, P. troglodytes
cctgcctctaaaaaaa

SEQ ID NO: 231726 - DNA, 16 bp, P. troglodytes
cctgcctctacctccc

SEQ ID NO: 231727 - DNA, 16 bp, P. troglodytes
cctgcctctagtaaaa

SEQ ID NO: 231728 - DNA, 16 bp, P. troglodytes
cctgcctctcagcctc

SEQ ID NO: 231729 - DNA, 16 bp, P. troglodytes
cctgcctctcccacct

SEQ ID NO: 231730 - DNA, 16 bp, P. troglodytes
cctgcctctctcccca

SEQ ID NO: 231731 - DNA, 16 bp, P. troglodytes
cctgcctctgcatccc

SEQ ID NO: 231732 - DNA, 16 bp, P. troglodytes
cctgcctctgccccag

SEQ ID NO: 231733 - DNA, 16 bp, P. troglodytes
cctgcctctgcctcca

SEQ ID NO: 231734 - DNA, 16 bp, P. troglodytes
cctgcctctgcctctg

SEQ ID NO: 231735 - DNA, 16 bp, P. troglodytes
cctgcctctgctccca

SEQ ID NO: 231736 - DNA, 16 bp, P. troglodytes
cctgcctctgtctctg

SEQ ID NO: 231737 - DNA, 16 bp, P. troglodytes
cctgcctctttgcaga

SEQ ID NO: 231738 - DNA, 16 bp, P. troglodytes
cctgcctgagtctcag

SEQ ID NO: 231739 - DNA, 16 bp, P. troglodytes
cctgcctgccagagaa

SEQ ID NO: 231740 - DNA, 16 bp, P. troglodytes
cctgcctgccctgcct

SEQ ID NO: 231741 - DNA, 16 bp, P. troglodytes
cctgcctgcctcagcc

SEQ ID NO: 231742 - DNA, 16 bp, P. troglodytes
cctgcctgcctcctgc

SEQ ID NO: 231743 - DNA, 16 bp, P. troglodytes
cctgcctgcctctcca

SEQ ID NO: 231744 - DNA, 16 bp, P. troglodytes
cctgcctgcctgccct

SEQ ID NO: 231745 - DNA, 16 bp, P. troglodytes
cctgcctgcctgcctc

SEQ ID NO: 231746 - DNA, 16 bp, P. troglodytes
cctgcctgcctgtctc

SEQ ID NO: 231747 - DNA, 16 bp, P. troglodytes
cctgcctgccttcctg

SEQ ID NO: 231748 - DNA, 16 bp, P. troglodytes
cctgcctgccttggct

SEQ ID NO: 231749 - DNA, 16 bp, P. troglodytes
cctgcctgctcctggc

SEQ ID NO: 231750 - DNA, 16 bp, P. troglodytes
cctgcctgctgccatg

SEQ ID NO: 231751 - DNA, 16 bp, P. troglodytes
cctgcctgctggctct

SEQ ID NO: 231752 - DNA, 16 bp, P. troglodytes
cctgcctggaatgccc

SEQ ID NO: 231753 - DNA, 16 bp, P. troglodytes
cctgcctggaatgttc

SEQ ID NO: 231754 - DNA, 16 bp, P. troglodytes
cctgcctggatgacag

SEQ ID NO: 231755 - DNA, 16 bp, P. troglodytes
cctgcctggcaccaca

SEQ ID NO: 231756 - DNA, 16 bp, P. troglodytes
cctgcctggcccctgc

SEQ ID NO: 231757 - DNA, 16 bp, P. troglodytes
cctgcctggccctggg

SEQ ID NO: 231758 - DNA, 16 bp, P. troglodytes
cctgcctggcctccca

SEQ ID NO: 231759 - DNA, 16 bp, P. troglodytes
cctgcctgggcagcag

SEQ ID NO: 231760 - DNA, 16 bp, P. troglodytes
cctgcctgggtctccc

SEQ ID NO: 231761 - DNA, 16 bp, P. troglodytes
cctgcctgggtgacac

SEQ ID NO: 231762 - DNA, 16 bp, P. troglodytes
cctgcctgtagtccca

SEQ ID NO: 231763 - DNA, 16 bp, P. troglodytes
cctgcctgtctgcctg

SEQ ID NO: 231764 - DNA, 16 bp, P. troglodytes
cctgcctgtgcctccc

SEQ ID NO: 231765 - DNA, 16 bp, P. troglodytes
cctgcctgtgtccatg

SEQ ID NO: 231766 - DNA, 16 bp, P. troglodytes
cctgccttatcctccc

SEQ ID NO: 231767 - DNA, 16 bp, P. troglodytes
cctgccttcagcaaga

SEQ ID NO: 231768 - DNA, 16 bp, P. troglodytes
cctgccttgccttgcc

SEQ ID NO: 231769 - DNA, 16 bp, P. troglodytes
cctgccttgcttttct

SEQ ID NO: 231770 - DNA, 16 bp, P. troglodytes
cctgccttggccccca

SEQ ID NO: 231771 - DNA, 16 bp, P. troglodytes
cctgccttggccgccc

SEQ ID NO: 231772 - DNA, 16 bp, P. troglodytes
cctgccttggcctcac

SEQ ID NO: 231773 - DNA, 16 bp, P. troglodytes
cctgccttggctttcc

SEQ ID NO: 231774 - DNA, 16 bp, P. troglodytes
cctgccttggtccccc

SEQ ID NO: 231775 - DNA, 16 bp, P. troglodytes
cctgccttgtgaggtg

SEQ ID NO: 231776 - DNA, 16 bp, P. troglodytes
cctgccttgtgccctg

SEQ ID NO: 231777 - DNA, 16 bp, P. troglodytes
cctgcctttaaaaaaa

SEQ ID NO: 231778 - DNA, 16 bp, P. troglodytes
cctgcctttagcaaga

SEQ ID NO: 231779 - DNA, 16 bp, P. troglodytes
cctgcctttgatgtgg

SEQ ID NO: 231780 - DNA, 16 bp, P. troglodytes
cctgctaattaaaaaa

SEQ ID NO: 231781 - DNA, 16 bp, P. troglodytes
cctgctcacccactgc

SEQ ID NO: 231782 - DNA, 16 bp, P. troglodytes
cctgctcagagaggag

SEQ ID NO: 231783 - DNA, 16 bp, P. troglodytes
cctgctcatgcctgac

SEQ ID NO: 231784 - DNA, 16 bp, P. troglodytes
cctgctccagccacgt

SEQ ID NO: 231785 - DNA, 16 bp, P. troglodytes
cctgctcccacactgt

SEQ ID NO: 231786 - DNA, 16 bp, P. troglodytes
cctgctcccagaggtg

SEQ ID NO: 231787 - DNA, 16 bp, P. troglodytes
cctgctcctccttcac

SEQ ID NO: 231788 - DNA, 16 bp, P. troglodytes
cctgctcctgcagcaa

SEQ ID NO: 231789 - DNA, 16 bp, P. troglodytes
cctgctcctgcctgcc

SEQ ID NO: 231790 - DNA, 16 bp, P. troglodytes
cctgctcctgctttgc

SEQ ID NO: 231791 - DNA, 16 bp, P. troglodytes
cctgctccttcctctg

SEQ ID NO: 231792 - DNA, 16 bp, P. troglodytes
cctgctctcagcctcc

SEQ ID NO: 231793 - DNA, 16 bp, P. troglodytes
cctgctctgccctgac

SEQ ID NO: 231794 - DNA, 16 bp, P. troglodytes
cctgctctgccctgcc

SEQ ID NO: 231795 - DNA, 16 bp, P. troglodytes
cctgctctgtccccag

SEQ ID NO: 231796 - DNA, 16 bp, P. troglodytes
cctgctctgtgccagg

SEQ ID NO: 231797 - DNA, 16 bp, P. troglodytes
cctgctctgtgccctg

SEQ ID NO: 231798 - DNA, 16 bp, P. troglodytes
cctgctgagccaggca

SEQ ID NO: 231799 - DNA, 16 bp, P. troglodytes
cctgctgagtttcaga

SEQ ID NO: 231800 - DNA, 16 bp, P. troglodytes
cctgctgatctgacag

SEQ ID NO: 231801 - DNA, 16 bp, P. troglodytes
cctgctgatggacatt

SEQ ID NO: 231802 - DNA, 16 bp, P. troglodytes
cctgctgcagcctctg

SEQ ID NO: 231803 - DNA, 16 bp, P. troglodytes
cctgctgcagctggtg

SEQ ID NO: 231804 - DNA, 16 bp, P. troglodytes
cctgctgccatccgtg

SEQ ID NO: 231805 - DNA, 16 bp, P. troglodytes
cctgctgcccaggctg

SEQ ID NO: 231806 - DNA, 16 bp, P. troglodytes
cctgctgctgcactgt

SEQ ID NO: 231807 - DNA, 16 bp, P. troglodytes
cctgctgctgctcctg

SEQ ID NO: 231808 - DNA, 16 bp, P. troglodytes
cctgctgctgctgctt

SEQ ID NO: 231809 - DNA, 16 bp, P. troglodytes
cctgctgctgcttctc

SEQ ID NO: 231810 - DNA, 16 bp, P. troglodytes
cctgctggcaccttga

SEQ ID NO: 231811 - DNA, 16 bp, P. troglodytes
cctgctggccaggctg

SEQ ID NO: 231812 - DNA, 16 bp, P. troglodytes
cctgctggcctgtggg

SEQ ID NO: 231813 - DNA, 16 bp, P. troglodytes
cctgctggctctgagg

SEQ ID NO: 231814 - DNA, 16 bp, P. troglodytes
cctgctggctttggag

SEQ ID NO: 231815 - DNA, 16 bp, P. troglodytes
cctgctgggaggtgtt

SEQ ID NO: 231816 - DNA, 16 bp, P. troglodytes
cctgctgggcgtggtg

SEQ ID NO: 231817 - DNA, 16 bp, P. troglodytes
cctgctggggcactgc

SEQ ID NO: 231818 - DNA, 16 bp, P. troglodytes
cctgctgtatccccag

SEQ ID NO: 231819 - DNA, 16 bp, P. troglodytes
cctgctgtggcctccc

SEQ ID NO: 231820 - DNA, 16 bp, P. troglodytes
cctgctgtggctgagc

SEQ ID NO: 231821 - DNA, 16 bp, P. troglodytes
cctgctgtgtaccagg

SEQ ID NO: 231822 - DNA, 16 bp, P. troglodytes
cctgctgtgtccccag

SEQ ID NO: 231823 - DNA, 16 bp, P. troglodytes
cctgcttcaccttttg

SEQ ID NO: 231824 - DNA, 16 bp, P. troglodytes
cctgcttcagactcct

SEQ ID NO: 231825 - DNA, 16 bp, P. troglodytes
cctgcttcagccaccc

SEQ ID NO: 231826 - DNA, 16 bp, P. troglodytes
cctgcttcagcctccc

SEQ ID NO: 231827 - DNA, 16 bp, P. troglodytes
cctgcttcatccatgt

SEQ ID NO: 231828 - DNA, 16 bp, P. troglodytes
cctgcttcatcctccc

SEQ ID NO: 231829 - DNA, 16 bp, P. troglodytes
cctgcttccactcttg

SEQ ID NO: 231830 - DNA, 16 bp, P. troglodytes
cctgcttcccctttgc

SEQ ID NO: 231831 - DNA, 16 bp, P. troglodytes
cctgcttcctcttgtg

SEQ ID NO: 231832 - DNA, 16 bp, P. troglodytes
cctgcttcctgcttcc

SEQ ID NO: 231833 - DNA, 16 bp, P. troglodytes
cctgcttcctgggttc

SEQ ID NO: 231834 - DNA, 16 bp, P. troglodytes
cctgcttcggcctcca

SEQ ID NO: 231835 - DNA, 16 bp, P. troglodytes
cctgcttcggcctccc

SEQ ID NO: 231836 - DNA, 16 bp, P. troglodytes
cctgcttctcctttgc

SEQ ID NO: 231837 - DNA, 16 bp, P. troglodytes
cctgcttgtacctctg

SEQ ID NO: 231838 - DNA, 16 bp, P. troglodytes
cctgctttcattcttt

SEQ ID NO: 231839 - DNA, 16 bp, P. troglodytes
cctgcttttatttcct

SEQ ID NO: 231840 - DNA, 16 bp, P. troglodytes
cctgctttttattctg

SEQ ID NO: 231841 - DNA, 16 bp, P. troglodytes
cctggaaaagagctac

SEQ ID NO: 231842 - DNA, 16 bp, P. troglodytes
cctggaaaagccacag

SEQ ID NO: 231843 - DNA, 16 bp, P. troglodytes
cctggaaaagctgcag

SEQ ID NO: 231844 - DNA, 16 bp, P. troglodytes
cctggaaacagactcg

SEQ ID NO: 231845 - DNA, 16 bp, P. troglodytes
cctggaaagccacagg

SEQ ID NO: 231846 - DNA, 16 bp, P. troglodytes
cctggaacagaaaaag

SEQ ID NO: 231847 - DNA, 16 bp, P. troglodytes
cctggaaccaaccccc

SEQ ID NO: 231848 - DNA, 16 bp, P. troglodytes
cctggaaccaatcttc

SEQ ID NO: 231849 - DNA, 16 bp, P. troglodytes
cctggaactcctggcc

SEQ ID NO: 231850 - DNA, 16 bp, P. troglodytes
cctggaactggctgga

SEQ ID NO: 231851 - DNA, 16 bp, P. troglodytes
cctggaagccccttcc

SEQ ID NO: 231852 - DNA, 16 bp, P. troglodytes
cctggaagcctagaaa

SEQ ID NO: 231853 - DNA, 16 bp, P. troglodytes
cctggaaggcagagat

SEQ ID NO: 231854 - DNA, 16 bp, P. troglodytes
cctggaaggcagagct

SEQ ID NO: 231855 - DNA, 16 bp, P. troglodytes
cctggaaggtgaaggt

SEQ ID NO: 231856 - DNA, 16 bp, P. troglodytes
cctggaatcaaccatt

SEQ ID NO: 231857 - DNA, 16 bp, P. troglodytes
cctggaatcccaacac

SEQ ID NO: 231858 - DNA, 16 bp, P. troglodytes
cctggaatcccagtgc

SEQ ID NO: 231859 - DNA, 16 bp, P. troglodytes
cctggaatctgtgaat

SEQ ID NO: 231860 - DNA, 16 bp, P. troglodytes
cctggaatgcagtggc

SEQ ID NO: 231861 - DNA, 16 bp, P. troglodytes
cctggaatgccctttc

SEQ ID NO: 231862 - DNA, 16 bp, P. troglodytes
cctggaatgggggcct

SEQ ID NO: 231863 - DNA, 16 bp, P. troglodytes
cctggacaacaagaac

SEQ ID NO: 231864 - DNA, 16 bp, P. troglodytes
cctggacaacacagag

SEQ ID NO: 231865 - DNA, 16 bp, P. troglodytes
cctggacaacagggca

SEQ ID NO: 231866 - DNA, 16 bp, P. troglodytes
cctggacaacatgttg

SEQ ID NO: 231867 - DNA, 16 bp, P. troglodytes
cctggacactggacaa

SEQ ID NO: 231868 - DNA, 16 bp, P. troglodytes
cctggacagagtgagg

SEQ ID NO: 231869 - DNA, 16 bp, P. troglodytes
cctggacagcctgcag

SEQ ID NO: 231870 - DNA, 16 bp, P. troglodytes
cctggacaggacacca

SEQ ID NO: 231871 - DNA, 16 bp, P. troglodytes
cctggacatccaggta

SEQ ID NO: 231872 - DNA, 16 bp, P. troglodytes
cctggaccagacagat

SEQ ID NO: 231873 - DNA, 16 bp, P. troglodytes
cctggaccagcctgct

SEQ ID NO: 231874 - DNA, 16 bp, P. troglodytes
cctggacctcagtttc

SEQ ID NO: 231875 - DNA, 16 bp, P. troglodytes
cctggacctcccgggc

SEQ ID NO: 231876 - DNA, 16 bp, P. troglodytes
cctggacctggcccag

SEQ ID NO: 231877 - DNA, 16 bp, P. troglodytes
cctggactccagcctg

SEQ ID NO: 231878 - DNA, 16 bp, P. troglodytes
cctggactcctgggtc

SEQ ID NO: 231879 - DNA, 16 bp, P. troglodytes
cctggactgtgtgctc

SEQ ID NO: 231880 - DNA, 16 bp, P. troglodytes
cctggagaaagtcctt

SEQ ID NO: 231881 - DNA, 16 bp, P. troglodytes
cctggagaacagagtg

SEQ ID NO: 231882 - DNA, 16 bp, P. troglodytes
cctggagaacattatg

SEQ ID NO: 231883 - DNA, 16 bp, P. troglodytes
cctggagaactgtgag

SEQ ID NO: 231884 - DNA, 16 bp, P. troglodytes
cctggagaatattcca

SEQ ID NO: 231885 - DNA, 16 bp, P. troglodytes
cctggagacagcatca

SEQ ID NO: 231886 - DNA, 16 bp, P. troglodytes
cctggagacattttcc

SEQ ID NO: 231887 - DNA, 16 bp, P. troglodytes
cctggagacccagctg

SEQ ID NO: 231888 - DNA, 16 bp, P. troglodytes
cctggagaggctgagg

SEQ ID NO: 231889 - DNA, 16 bp, P. troglodytes
cctggagagggtggct

SEQ ID NO: 231890 - DNA, 16 bp, P. troglodytes
cctggagatctgcctg

SEQ ID NO: 231891 - DNA, 16 bp, P. troglodytes
cctggagcagctggga

SEQ ID NO: 231892 - DNA, 16 bp, P. troglodytes
cctggagcccagtagc

SEQ ID NO: 231893 - DNA, 16 bp, P. troglodytes
cctggagcccccagga

SEQ ID NO: 231894 - DNA, 16 bp, P. troglodytes
cctggagcctcagttt

SEQ ID NO: 231895 - DNA, 16 bp, P. troglodytes
cctggagcctggagcc

SEQ ID NO: 231896 - DNA, 16 bp, P. troglodytes
cctggagctatagaga

SEQ ID NO: 231897 - DNA, 16 bp, P. troglodytes
cctggagctgagacaa

SEQ ID NO: 231898 - DNA, 16 bp, P. troglodytes
cctggagctggaggag

SEQ ID NO: 231899 - DNA, 16 bp, P. troglodytes
cctggagctgggggag

SEQ ID NO: 231900 - DNA, 16 bp, P. troglodytes
cctggaggaaaaaaaa

SEQ ID NO: 231901 - DNA, 16 bp, P. troglodytes
cctggaggaagaggca

SEQ ID NO: 231902 - DNA, 16 bp, P. troglodytes
cctggaggaggaggag

SEQ ID NO: 231903 - DNA, 16 bp, P. troglodytes
cctggaggaggaggca

SEQ ID NO: 231904 - DNA, 16 bp, P. troglodytes
cctggaggaggaggtt

SEQ ID NO: 231905 - DNA, 16 bp, P. troglodytes
cctggaggaggtgatg

SEQ ID NO: 231906 - DNA, 16 bp, P. troglodytes
cctggaggaggtggag

SEQ ID NO: 231907 - DNA, 16 bp, P. troglodytes
cctggaggaggtggca

SEQ ID NO: 231908 - DNA, 16 bp, P. troglodytes
cctggaggaggtggcc

SEQ ID NO: 231909 - DNA, 16 bp, P. troglodytes
cctggaggaggtggtg

SEQ ID NO: 231910 - DNA, 16 bp, P. troglodytes
cctggaggcccagctg

SEQ ID NO: 231911 - DNA, 16 bp, P. troglodytes
cctggaggcccaggag

SEQ ID NO: 231912 - DNA, 16 bp, P. troglodytes
cctggaggctgggagg

SEQ ID NO: 231913 - DNA, 16 bp, P. troglodytes
cctggaggcttcatct

SEQ ID NO: 231914 - DNA, 16 bp, P. troglodytes
cctggagggtggcatg

SEQ ID NO: 231915 - DNA, 16 bp, P. troglodytes
cctggagggtggtgtg

SEQ ID NO: 231916 - DNA, 16 bp, P. troglodytes
cctggaggtagaggtt

SEQ ID NO: 231917 - DNA, 16 bp, P. troglodytes
cctggaggtggagctt

SEQ ID NO: 231918 - DNA, 16 bp, P. troglodytes
cctggagtgcagtggt

SEQ ID NO: 231919 - DNA, 16 bp, P. troglodytes
cctggagtttgaggct

SEQ ID NO: 231920 - DNA, 16 bp, P. troglodytes
cctggatattagacct

SEQ ID NO: 231921 - DNA, 16 bp, P. troglodytes
cctggatgacagtgag

SEQ ID NO: 231922 - DNA, 16 bp, P. troglodytes
cctggatgacagtgtg

SEQ ID NO: 231923 - DNA, 16 bp, P. troglodytes
cctggatgaccaggca

SEQ ID NO: 231924 - DNA, 16 bp, P. troglodytes
cctggatgagagagtg

SEQ ID NO: 231925 - DNA, 16 bp, P. troglodytes
cctggatgagagtgag

SEQ ID NO: 231926 - DNA, 16 bp, P. troglodytes
cctggatgcccaggaa

SEQ ID NO: 231927 - DNA, 16 bp, P. troglodytes
cctggatgcccaggca

SEQ ID NO: 231928 - DNA, 16 bp, P. troglodytes
cctggatggagctgga

SEQ ID NO: 231929 - DNA, 16 bp, P. troglodytes
cctggatggagttgga

SEQ ID NO: 231930 - DNA, 16 bp, P. troglodytes
cctggatggtcttgat

SEQ ID NO: 231931 - DNA, 16 bp, P. troglodytes
cctggatgtccaggca

SEQ ID NO: 231932 - DNA, 16 bp, P. troglodytes
cctggatgtgaggcat

SEQ ID NO: 231933 - DNA, 16 bp, P. troglodytes
cctggattcaaattct

SEQ ID NO: 231934 - DNA, 16 bp, P. troglodytes
cctggattcaagagat

SEQ ID NO: 231935 - DNA, 16 bp, P. troglodytes
cctggattccagcgat

SEQ ID NO: 231936 - DNA, 16 bp, P. troglodytes
cctggattccttagct

SEQ ID NO: 231937 - DNA, 16 bp, P. troglodytes
cctggattttcttcta

SEQ ID NO: 231938 - DNA, 16 bp, P. troglodytes
cctggcaaactcctat

SEQ ID NO: 231939 - DNA, 16 bp, P. troglodytes
cctggcaaaggcccca

SEQ ID NO: 231940 - DNA, 16 bp, P. troglodytes
cctggcaaattttgta

SEQ ID NO: 231941 - DNA, 16 bp, P. troglodytes
cctggcaacatagtga

SEQ ID NO: 231942 - DNA, 16 bp, P. troglodytes
cctggcaaccactgat

SEQ ID NO: 231943 - DNA, 16 bp, P. troglodytes
cctggcacacagtaag

SEQ ID NO: 231944 - DNA, 16 bp, P. troglodytes
cctggcacagagcaga

SEQ ID NO: 231945 - DNA, 16 bp, P. troglodytes
cctggcacagagtggg

SEQ ID NO: 231946 - DNA, 16 bp, P. troglodytes
cctggcacagtgccta

SEQ ID NO: 231947 - DNA, 16 bp, P. troglodytes
cctggcacagtgcttg

SEQ ID NO: 231948 - DNA, 16 bp, P. troglodytes
cctggcacataataag

SEQ ID NO: 231949 - DNA, 16 bp, P. troglodytes
cctggcacatagtaaa

SEQ ID NO: 231950 - DNA, 16 bp, P. troglodytes
cctggcacccagcagg

SEQ ID NO: 231951 - DNA, 16 bp, P. troglodytes
cctggcacctccctcc

SEQ ID NO: 231952 - DNA, 16 bp, P. troglodytes
cctggcacgatggctc

SEQ ID NO: 231953 - DNA, 16 bp, P. troglodytes
cctggcaggaggtgat

SEQ ID NO: 231954 - DNA, 16 bp, P. troglodytes
cctggcaggggagggg

SEQ ID NO: 231955 - DNA, 16 bp, P. troglodytes
cctggcatcccaggga

SEQ ID NO: 231956 - DNA, 16 bp, P. troglodytes
cctggcatggtggtgg

SEQ ID NO: 231957 - DNA, 16 bp, P. troglodytes
cctggccaaagtggca

SEQ ID NO: 231958 - DNA, 16 bp, P. troglodytes
cctggccaacaatgtg

SEQ ID NO: 231959 - DNA, 17 bp, P. troglodytes
cctggccaacacggaga

SEQ ID NO: 231960 - DNA, 16 bp, P. troglodytes
cctggccaacatgaca

SEQ ID NO: 231961 - DNA, 16 bp, P. troglodytes
cctggccaacatgagg

SEQ ID NO: 231962 - DNA, 16 bp, P. troglodytes
cctggccaacatgggg

SEQ ID NO: 231963 - DNA, 16 bp, P. troglodytes
cctggccaaccccagg

SEQ ID NO: 231964 - DNA, 16 bp, P. troglodytes
cctggccaacgtgctg

SEQ ID NO: 231965 - DNA, 17 bp, P. troglodytes
cctggccaacgtggaga

SEQ ID NO: 231966 - DNA, 16 bp, P. troglodytes
cctggccaagatgatg

SEQ ID NO: 231967 - DNA, 16 bp, P. troglodytes
cctggccaatgtggca

SEQ ID NO: 231968 - DNA, 17 bp, P. troglodytes
cctggccagcaaggtga

SEQ ID NO: 231969 - DNA, 16 bp, P. troglodytes
cctggccagcatggtg

SEQ ID NO: 231970 - DNA, 16 bp, P. troglodytes
cctggccagccgcccc

SEQ ID NO: 231971 - DNA, 16 bp, P. troglodytes
cctggccagcctggcc

SEQ ID NO: 231972 - DNA, 16 bp, P. troglodytes
cctggccagctgcccc

SEQ ID NO: 231973 - DNA, 16 bp, P. troglodytes
cctggccaggatggtg

SEQ ID NO: 231974 - DNA, 17 bp, P. troglodytes
cctggccaggcgcagtg

SEQ ID NO: 231975 - DNA, 16 bp, P. troglodytes
cctggcccagagcagg

SEQ ID NO: 231976 - DNA, 16 bp, P. troglodytes
cctggcccagcccctg

SEQ ID NO: 231977 - DNA, 16 bp, P. troglodytes
cctggcccagcctccc

SEQ ID NO: 231978 - DNA, 16 bp, P. troglodytes
cctggcccagcctcct

SEQ ID NO: 231979 - DNA, 16 bp, P. troglodytes
cctggcccaggcccag

SEQ ID NO: 231980 - DNA, 16 bp, P. troglodytes
cctggcccaggcctgg

SEQ ID NO: 231981 - DNA, 16 bp, P. troglodytes
cctggcccagggcccc

SEQ ID NO: 231982 - DNA, 16 bp, P. troglodytes
cctggccccacccaca

SEQ ID NO: 231983 - DNA, 16 bp, P. troglodytes
cctggccccaccccag

SEQ ID NO: 231984 - DNA, 16 bp, P. troglodytes
cctggccccagcccag

SEQ ID NO: 231985 - DNA, 16 bp, P. troglodytes
cctggcccctgcccac

SEQ ID NO: 231986 - DNA, 16 bp, P. troglodytes
cctggcccctgcccca

SEQ ID NO: 231987 - DNA, 16 bp, P. troglodytes
cctggcccctgcctgc

SEQ ID NO: 231988 - DNA, 16 bp, P. troglodytes
cctggccctgccactt

SEQ ID NO: 231989 - DNA, 16 bp, P. troglodytes
cctggccctgcccagc

SEQ ID NO: 231990 - DNA, 16 bp, P. troglodytes
cctggccctgccccac

SEQ ID NO: 231991 - DNA, 16 bp, P. troglodytes
cctggccctgccccag

SEQ ID NO: 231992 - DNA, 16 bp, P. troglodytes
cctggccctgccccca

SEQ ID NO: 231993 - DNA, 16 bp, P. troglodytes
cctggccctgcccctg

SEQ ID NO: 231994 - DNA, 16 bp, P. troglodytes
cctggccctgcccttg

SEQ ID NO: 231995 - DNA, 16 bp, P. troglodytes
cctggccctgcctctg

SEQ ID NO: 231996 - DNA, 16 bp, P. troglodytes
cctggccctgcctggc

SEQ ID NO: 231997 - DNA, 16 bp, P. troglodytes
cctggccctgcctttg

SEQ ID NO: 231998 - DNA, 16 bp, P. troglodytes
cctggccctgctgctg

SEQ ID NO: 231999 - DNA, 16 bp, P. troglodytes
cctggccctggcccat

SEQ ID NO: 232000 - DNA, 16 bp, P. troglodytes
cctggccctggcccca

SEQ ID NO: 232001 - DNA, 16 bp, P. troglodytes
cctggccctggccctg

SEQ ID NO: 232002 - DNA, 16 bp, P. troglodytes
cctggccctgggctgg

SEQ ID NO: 232003 - DNA, 16 bp, P. troglodytes
cctggccggcatggtg

SEQ ID NO: 232004 - DNA, 16 bp, P. troglodytes
cctggcctatttttaa

SEQ ID NO: 232005 - DNA, 16 bp, P. troglodytes
cctggcctcaagttat

SEQ ID NO: 232006 - DNA, 16 bp, P. troglodytes
cctggcctccctcctg

SEQ ID NO: 232007 - DNA, 16 bp, P. troglodytes
cctggcctcctacctg

SEQ ID NO: 232008 - DNA, 16 bp, P. troglodytes
cctggcctcctcctgc

SEQ ID NO: 232009 - DNA, 16 bp, P. troglodytes
cctggcctcctgccct

SEQ ID NO: 232010 - DNA, 16 bp, P. troglodytes
cctggcctcctgcctc

SEQ ID NO: 232011 - DNA, 16 bp, P. troglodytes
cctggcctcctggcct

SEQ ID NO: 232012 - DNA, 16 bp, P. troglodytes
cctggcctccttcctt

SEQ ID NO: 232013 - DNA, 16 bp, P. troglodytes
cctggcctcggcctcc

SEQ ID NO: 232014 - DNA, 16 bp, P. troglodytes
cctggcctctcccagc

SEQ ID NO: 232015 - DNA, 16 bp, P. troglodytes
cctggcctctgcccac

SEQ ID NO: 232016 - DNA, 16 bp, P. troglodytes
cctggcctctgttttt

SEQ ID NO: 232017 - DNA, 16 bp, P. troglodytes
cctggcctggcctggc

SEQ ID NO: 232018 - DNA, 16 bp, P. troglodytes
cctggccttcactgtc

SEQ ID NO: 232019 - DNA, 16 bp, P. troglodytes
cctggccttggccctg

SEQ ID NO: 232020 - DNA, 16 bp, P. troglodytes
cctggccttggcctcc

SEQ ID NO: 232021 - DNA, 16 bp, P. troglodytes
cctggcctttctttct

SEQ ID NO: 232022 - DNA, 16 bp, P. troglodytes
cctggccttttccagc

SEQ ID NO: 232023 - DNA, 16 bp, P. troglodytes
cctggcctttttaaaa

SEQ ID NO: 232024 - DNA, 16 bp, P. troglodytes
cctggcgtggtggcgc

SEQ ID NO: 232025 - DNA, 16 bp, P. troglodytes
cctggctaacttttgt

SEQ ID NO: 232026 - DNA, 16 bp, P. troglodytes
cctggctaactttttt

SEQ ID NO: 232027 - DNA, 16 bp, P. troglodytes
cctggctaattatttg

SEQ ID NO: 232028 - DNA, 16 bp, P. troglodytes
cctggctaattcttat

SEQ ID NO: 232029 - DNA, 16 bp, P. troglodytes
cctggctaattgtgtg

SEQ ID NO: 232030 - DNA, 16 bp, P. troglodytes
cctggctactttttta

SEQ ID NO: 232031 - DNA, 16 bp, P. troglodytes
cctggctcactggctt

SEQ ID NO: 232032 - DNA, 16 bp, P. troglodytes
cctggctcagcctctt

SEQ ID NO: 232033 - DNA, 16 bp, P. troglodytes
cctggctcagggagct

SEQ ID NO: 232034 - DNA, 16 bp, P. troglodytes
cctggctcatagtagg

SEQ ID NO: 232035 - DNA, 16 bp, P. troglodytes
cctggctcatctcatt

SEQ ID NO: 232036 - DNA, 16 bp, P. troglodytes
cctggctccagcccca

SEQ ID NO: 232037 - DNA, 16 bp, P. troglodytes
cctggctctcaggcct

SEQ ID NO: 232038 - DNA, 16 bp, P. troglodytes
cctggctctgccacct

SEQ ID NO: 232039 - DNA, 16 bp, P. troglodytes
cctggctctgcctcct

SEQ ID NO: 232040 - DNA, 16 bp, P. troglodytes
cctggctctgcctttt

SEQ ID NO: 232041 - DNA, 16 bp, P. troglodytes
cctggctctgctgcct

SEQ ID NO: 232042 - DNA, 16 bp, P. troglodytes
cctggctctgtcattt

SEQ ID NO: 232043 - DNA, 16 bp, P. troglodytes
cctggctgaatttttt

SEQ ID NO: 232044 - DNA, 16 bp, P. troglodytes
cctggctgaccccagg

SEQ ID NO: 232045 - DNA, 16 bp, P. troglodytes
cctggctgcagaaagg

SEQ ID NO: 232046 - DNA, 16 bp, P. troglodytes
cctggctgcccttaac

SEQ ID NO: 232047 - DNA, 16 bp, P. troglodytes
cctggctgggcctcag

SEQ ID NO: 232048 - DNA, 16 bp, P. troglodytes
cctggctggggaggcc

SEQ ID NO: 232049 - DNA, 16 bp, P. troglodytes
cctggctggttttttt

SEQ ID NO: 232050 - DNA, 16 bp, P. troglodytes
cctggctgtgtgacct

SEQ ID NO: 232051 - DNA, 16 bp, P. troglodytes
cctggcttcctcccag

SEQ ID NO: 232052 - DNA, 16 bp, P. troglodytes
cctggcttctccctgc

SEQ ID NO: 232053 - DNA, 16 bp, P. troglodytes
cctggcttggagggtc

SEQ ID NO: 232054 - DNA, 16 bp, P. troglodytes
cctggctttgttcttt

SEQ ID NO: 232055 - DNA, 16 bp, P. troglodytes
cctgggaaacaagagc

SEQ ID NO: 232056 - DNA, 16 bp, P. troglodytes
cctgggaaacacagtg

SEQ ID NO: 232057 - DNA, 16 bp, P. troglodytes
cctgggaaacagagta

SEQ ID NO: 232058 - DNA, 16 bp, P. troglodytes
cctgggaaacataatg

SEQ ID NO: 232059 - DNA, 16 bp, P. troglodytes
cctgggaaagggagag

SEQ ID NO: 232060 - DNA, 16 bp, P. troglodytes
cctgggaagtcaaggt

SEQ ID NO: 232061 - DNA, 16 bp, P. troglodytes
cctgggaagttgaggt

SEQ ID NO: 232062 - DNA, 16 bp, P. troglodytes
cctgggacagaaggga

SEQ ID NO: 232063 - DNA, 16 bp, P. troglodytes
cctgggagaaaatatt

SEQ ID NO: 232064 - DNA, 16 bp, P. troglodytes
cctgggagacaagagc

SEQ ID NO: 232065 - DNA, 16 bp, P. troglodytes
cctgggagacagagcg

SEQ ID NO: 232066 - DNA, 16 bp, P. troglodytes
cctgggagacagagga

SEQ ID NO: 232067 - DNA, 16 bp, P. troglodytes
cctgggagccagaggt

SEQ ID NO: 232068 - DNA, 16 bp, P. troglodytes
cctgggagccaggcag

SEQ ID NO: 232069 - DNA, 16 bp, P. troglodytes
cctgggagcggaggtt

SEQ ID NO: 232070 - DNA, 16 bp, P. troglodytes
cctgggagcttgttag

SEQ ID NO: 232071 - DNA, 16 bp, P. troglodytes
cctgggaggaaccatc

SEQ ID NO: 232072 - DNA, 16 bp, P. troglodytes
cctgggaggaggagct

SEQ ID NO: 232073 - DNA, 16 bp, P. troglodytes
cctgggaggcagaagc

SEQ ID NO: 232074 - DNA, 16 bp, P. troglodytes
cctgggaggcaggcag

SEQ ID NO: 232075 - DNA, 17 bp, P. troglodytes
cctgggaggctgaggtg

SEQ ID NO: 232076 - DNA, 16 bp, P. troglodytes
cctgggaggctgcagt

SEQ ID NO: 232077 - DNA, 16 bp, P. troglodytes
cctgggagggagaggt

SEQ ID NO: 232078 - DNA, 16 bp, P. troglodytes
cctgggagggagggag

SEQ ID NO: 232079 - DNA, 16 bp, P. troglodytes
cctgggagggtggggc

SEQ ID NO: 232080 - DNA, 16 bp, P. troglodytes
cctgggaggtgaaggc

SEQ ID NO: 232081 - DNA, 16 bp, P. troglodytes
cctgggaggttgaggc

SEQ ID NO: 232082 - DNA, 16 bp, P. troglodytes
cctgggagttcaaggt

SEQ ID NO: 232083 - DNA, 16 bp, P. troglodytes
cctgggagtttgaggc

SEQ ID NO: 232084 - DNA, 16 bp, P. troglodytes
cctgggatcaaatgat

SEQ ID NO: 232085 - DNA, 16 bp, P. troglodytes
cctgggatccagtgat

SEQ ID NO: 232086 - DNA, 16 bp, P. troglodytes
cctgggatgaatccca

SEQ ID NO: 232087 - DNA, 16 bp, P. troglodytes
cctgggattacaggca

SEQ ID NO: 232088 - DNA, 16 bp, P. troglodytes
cctgggattacaggtg

SEQ ID NO: 232089 - DNA, 16 bp, P. troglodytes
cctgggcaacaaagag

SEQ ID NO: 232090 - DNA, 16 bp, P. troglodytes
cctgggcaacaaagtg

SEQ ID NO: 232091 - DNA, 16 bp, P. troglodytes
cctgggcaacaacagc

SEQ ID NO: 232092 - DNA, 16 bp, P. troglodytes
cctgggcaacaagaag

SEQ ID NO: 232093 - DNA, 16 bp, P. troglodytes
cctgggcaacaaggag

SEQ ID NO: 232094 - DNA, 16 bp, P. troglodytes
cctgggcaacactgtg

SEQ ID NO: 232095 - DNA, 16 bp, P. troglodytes
cctgggcaacagaata

SEQ ID NO: 232096 - DNA, 16 bp, P. troglodytes
cctgggcaacagatga

SEQ ID NO: 232097 - DNA, 16 bp, P. troglodytes
cctgggcaacagcgtg

SEQ ID NO: 232098 - DNA, 16 bp, P. troglodytes
cctgggcaacagtggg

SEQ ID NO: 232099 - DNA, 16 bp, P. troglodytes
cctgggcaaccagagc

SEQ ID NO: 232100 - DNA, 16 bp, P. troglodytes
cctgggcaagaagagc

SEQ ID NO: 232101 - DNA, 16 bp, P. troglodytes
cctgggcaagagagag

SEQ ID NO: 232102 - DNA, 16 bp, P. troglodytes
cctgggcaatgcagtg

SEQ ID NO: 232103 - DNA, 16 bp, P. troglodytes
cctgggcaatggagta

SEQ ID NO: 232104 - DNA, 16 bp, P. troglodytes
cctgggcaccatggtg

SEQ ID NO: 232105 - DNA, 16 bp, P. troglodytes
cctgggcagctctgcc

SEQ ID NO: 232106 - DNA, 16 bp, P. troglodytes
cctgggcagggcaggg

SEQ ID NO: 232107 - DNA, 16 bp, P. troglodytes
cctgggcagtatagtg

SEQ ID NO: 232108 - DNA, 16 bp, P. troglodytes
cctgggcatcatggca

SEQ ID NO: 232109 - DNA, 16 bp, P. troglodytes
cctgggcatcatggtg

SEQ ID NO: 232110 - DNA, 16 bp, P. troglodytes
cctgggcatccaggtg

SEQ ID NO: 232111 - DNA, 17 bp, P. troglodytes
cctgggcatggtggtgc

SEQ ID NO: 232112 - DNA, 16 bp, P. troglodytes
cctgggccacaatgga

SEQ ID NO: 232113 - DNA, 16 bp, P. troglodytes
cctgggccacagactg

SEQ ID NO: 232114 - DNA, 16 bp, P. troglodytes
cctgggccacagggtg

SEQ ID NO: 232115 - DNA, 16 bp, P. troglodytes
cctgggccagagtgag

SEQ ID NO: 232116 - DNA, 17 bp, P. troglodytes
cctgggccagcagctgc

SEQ ID NO: 232117 - DNA, 16 bp, P. troglodytes
cctgggccagcggctg

SEQ ID NO: 232118 - DNA, 16 bp, P. troglodytes
cctgggccaggcccag

SEQ ID NO: 232119 - DNA, 16 bp, P. troglodytes
cctgggccaggccctg

SEQ ID NO: 232120 - DNA, 16 bp, P. troglodytes
cctgggccaggctggg

SEQ ID NO: 232121 - DNA, 16 bp, P. troglodytes
cctgggccagggcagg

SEQ ID NO: 232122 - DNA, 16 bp, P. troglodytes
cctgggccaggtgcag

SEQ ID NO: 232123 - DNA, 16 bp, P. troglodytes
cctgggcccagcccac

SEQ ID NO: 232124 - DNA, 16 bp, P. troglodytes
cctgggcccagcccag

SEQ ID NO: 232125 - DNA, 16 bp, P. troglodytes
cctgggcccaggagtt

SEQ ID NO: 232126 - DNA, 16 bp, P. troglodytes
cctgggccccaccctg

SEQ ID NO: 232127 - DNA, 16 bp, P. troglodytes
cctgggccccagcccc

SEQ ID NO: 232128 - DNA, 16 bp, P. troglodytes
cctgggccccccaaag

SEQ ID NO: 232129 - DNA, 16 bp, P. troglodytes
cctgggcccggcccac

SEQ ID NO: 232130 - DNA, 16 bp, P. troglodytes
cctgggccctgccctc

SEQ ID NO: 232131 - DNA, 16 bp, P. troglodytes
cctgggccctgccctg

SEQ ID NO: 232132 - DNA, 16 bp, P. troglodytes
cctgggcctcagcctc

SEQ ID NO: 232133 - DNA, 16 bp, P. troglodytes
cctgggcctcagtgtc

SEQ ID NO: 232134 - DNA, 16 bp, P. troglodytes
cctgggcctcagtttc

SEQ ID NO: 232135 - DNA, 16 bp, P. troglodytes
cctgggcctccccaag

SEQ ID NO: 232136 - DNA, 16 bp, P. troglodytes
cctgggcctctgggcc

SEQ ID NO: 232137 - DNA, 16 bp, P. troglodytes
cctgggcctggcccag

SEQ ID NO: 232138 - DNA, 16 bp, P. troglodytes
cctgggcctggccctg

SEQ ID NO: 232139 - DNA, 16 bp, P. troglodytes
cctgggcctggcctgg

SEQ ID NO: 232140 - DNA, 16 bp, P. troglodytes
cctgggcctggctcac

SEQ ID NO: 232141 - DNA, 16 bp, P. troglodytes
cctgggcctgggcctg

SEQ ID NO: 232142 - DNA, 17 bp, P. troglodytes
cctgggcgacaaaggga

SEQ ID NO: 232143 - DNA, 16 bp, P. troglodytes
cctgggcgacagcaag

SEQ ID NO: 232144 - DNA, 16 bp, P. troglodytes
cctgggcgacagcatg

SEQ ID NO: 232145 - DNA, 16 bp, P. troglodytes
cctgggcgagagcgag

SEQ ID NO: 232146 - DNA, 16 bp, P. troglodytes
cctgggctacaagagc

SEQ ID NO: 232147 - DNA, 16 bp, P. troglodytes
cctgggctacagaggg

SEQ ID NO: 232148 - DNA, 16 bp, P. troglodytes
cctgggctacatggtg

SEQ ID NO: 232149 - DNA, 16 bp, P. troglodytes
cctgggctcaagcaat

SEQ ID NO: 232150 - DNA, 16 bp, P. troglodytes
cctgggctcaagcgac

SEQ ID NO: 232151 - DNA, 16 bp, P. troglodytes
cctgggctcaggagtt

SEQ ID NO: 232152 - DNA, 16 bp, P. troglodytes
cctgggctcaggggat

SEQ ID NO: 232153 - DNA, 16 bp, P. troglodytes
cctgggctcaggtgat

SEQ ID NO: 232154 - DNA, 16 bp, P. troglodytes
cctgggctccagcagt

SEQ ID NO: 232155 - DNA, 16 bp, P. troglodytes
cctgggctgaagagat

SEQ ID NO: 232156 - DNA, 16 bp, P. troglodytes
cctgggctgcagagtg

SEQ ID NO: 232157 - DNA, 16 bp, P. troglodytes
cctgggctgcccactg

SEQ ID NO: 232158 - DNA, 16 bp, P. troglodytes
cctgggctggcctggc

SEQ ID NO: 232159 - DNA, 16 bp, P. troglodytes
cctgggctgggcctgg

SEQ ID NO: 232160 - DNA, 16 bp, P. troglodytes
cctgggctgggtgcag

SEQ ID NO: 232161 - DNA, 16 bp, P. troglodytes
cctgggcttaggtgat

SEQ ID NO: 232162 - DNA, 16 bp, P. troglodytes
cctggggaaaggggca

SEQ ID NO: 232163 - DNA, 16 bp, P. troglodytes
cctggggaacaagagc

SEQ ID NO: 232164 - DNA, 16 bp, P. troglodytes
cctggggaagctgagg

SEQ ID NO: 232165 - DNA, 21 bp, P. troglodytes
cctggggaaggaatgcattcc

SEQ ID NO: 232166 - DNA, 16 bp, P. troglodytes
cctggggaaggaggag

SEQ ID NO: 232167 - DNA, 16 bp, P. troglodytes
cctggggactggggac

SEQ ID NO: 232168 - DNA, 16 bp, P. troglodytes
cctggggaggagggga

SEQ ID NO: 232169 - DNA, 16 bp, P. troglodytes
cctggggaggcagagg

SEQ ID NO: 232170 - DNA, 16 bp, P. troglodytes
cctggggaggctgagg

SEQ ID NO: 232171 - DNA, 16 bp, P. troglodytes
cctggggaggtggagg

SEQ ID NO: 232172 - DNA, 16 bp, P. troglodytes
cctggggcagaggcag

SEQ ID NO: 232173 - DNA, 16 bp, P. troglodytes
cctggggcaggggctg

SEQ ID NO: 232174 - DNA, 16 bp, P. troglodytes
cctggggcagtgggcc

SEQ ID NO: 232175 - DNA, 16 bp, P. troglodytes
cctggggccagcaggg

SEQ ID NO: 232176 - DNA, 16 bp, P. troglodytes
cctggggccccagcct

SEQ ID NO: 232177 - DNA, 16 bp, P. troglodytes
cctggggcctggggcc

SEQ ID NO: 232178 - DNA, 16 bp, P. troglodytes
cctggggcctggggga

SEQ ID NO: 232179 - DNA, 16 bp, P. troglodytes
cctggggctggaggag

SEQ ID NO: 232180 - DNA, 16 bp, P. troglodytes
cctggggctggcaggg

SEQ ID NO: 232181 - DNA, 16 bp, P. troglodytes
cctggggctggctggg

SEQ ID NO: 232182 - DNA, 16 bp, P. troglodytes
cctggggctggggctg

SEQ ID NO: 232183 - DNA, 16 bp, P. troglodytes
cctgggggaaggggag

SEQ ID NO: 232184 - DNA, 16 bp, P. troglodytes
cctgggggacaaaatc

SEQ ID NO: 232185 - DNA, 16 bp, P. troglodytes
cctgggggacacagtg

SEQ ID NO: 232186 - DNA, 16 bp, P. troglodytes
cctgggggacagggcg

SEQ ID NO: 232187 - DNA, 16 bp, P. troglodytes
cctgggggacagggtg

SEQ ID NO: 232188 - DNA, 16 bp, P. troglodytes
cctgggggaggggcag

SEQ ID NO: 232189 - DNA, 16 bp, P. troglodytes
cctgggggatggaggt

SEQ ID NO: 232190 - DNA, 16 bp, P. troglodytes
cctgggggctgggctg

SEQ ID NO: 232191 - DNA, 16 bp, P. troglodytes
cctggggtcaggagtt

SEQ ID NO: 232192 - DNA, 16 bp, P. troglodytes
cctgggtcacagagca

SEQ ID NO: 232193 - DNA, 16 bp, P. troglodytes
cctgggtcctgcagga

SEQ ID NO: 232194 - DNA, 16 bp, P. troglodytes
cctgggtctccagctc

SEQ ID NO: 232195 - DNA, 16 bp, P. troglodytes
cctgggtgacagcaaa

SEQ ID NO: 232196 - DNA, 16 bp, P. troglodytes
cctgggtgaggaaata

SEQ ID NO: 232197 - DNA, 16 bp, P. troglodytes
cctgggtgcagctgca

SEQ ID NO: 232198 - DNA, 16 bp, P. troglodytes
cctgggtggcagtgag

SEQ ID NO: 232199 - DNA, 16 bp, P. troglodytes
cctgggtgtcagcagc

SEQ ID NO: 232200 - DNA, 16 bp, P. troglodytes
cctgggtgtgtctctg

SEQ ID NO: 232201 - DNA, 16 bp, P. troglodytes
cctgggttatccaggt

SEQ ID NO: 232202 - DNA, 16 bp, P. troglodytes
cctgggttcaaaccct

SEQ ID NO: 232203 - DNA, 16 bp, P. troglodytes
cctgggttcaaatcct

SEQ ID NO: 232204 - DNA, 16 bp, P. troglodytes
cctgggttcaactgaa

SEQ ID NO: 232205 - DNA, 16 bp, P. troglodytes
cctgggttcaagcctc

SEQ ID NO: 232206 - DNA, 16 bp, P. troglodytes
cctgggttcaagtcct

SEQ ID NO: 232207 - DNA, 16 bp, P. troglodytes
cctggtacagtggctc

SEQ ID NO: 232208 - DNA, 16 bp, P. troglodytes
cctggtcaacctggtg

SEQ ID NO: 232209 - DNA, 16 bp, P. troglodytes
cctggtcaacgtggtg

SEQ ID NO: 232210 - DNA, 16 bp, P. troglodytes
cctggtcaccatggtg

SEQ ID NO: 232211 - DNA, 16 bp, P. troglodytes
cctggtccatggaaat

SEQ ID NO: 232212 - DNA, 16 bp, P. troglodytes
cctggtctcgaactcc

SEQ ID NO: 232213 - DNA, 16 bp, P. troglodytes
cctggtcttgaactcc

SEQ ID NO: 232214 - DNA, 16 bp, P. troglodytes
cctggtgacagaatga

SEQ ID NO: 232215 - DNA, 16 bp, P. troglodytes
cctggtgcagtggctt

SEQ ID NO: 232216 - DNA, 16 bp, P. troglodytes
cctggtgcccaaaagg

SEQ ID NO: 232217 - DNA, 16 bp, P. troglodytes
cctggtgcctggcaca

SEQ ID NO: 232218 - DNA, 16 bp, P. troglodytes
cctggtgctggctgtg

SEQ ID NO: 232219 - DNA, 16 bp, P. troglodytes
cctggtgctgtgctgg

SEQ ID NO: 232220 - DNA, 16 bp, P. troglodytes
cctggtggcacacacc

SEQ ID NO: 232221 - DNA, 16 bp, P. troglodytes
cctggtggcgggtgcc

SEQ ID NO: 232222 - DNA, 17 bp, P. troglodytes
cctggtggctcatgcct

SEQ ID NO: 232223 - DNA, 16 bp, P. troglodytes
cctggtgggtttgtgg

SEQ ID NO: 232224 - DNA, 16 bp, P. troglodytes
cctggtggtgacagaa

SEQ ID NO: 232225 - DNA, 16 bp, P. troglodytes
cctggtggtgtgtgcc

SEQ ID NO: 232226 - DNA, 16 bp, P. troglodytes
cctggtggttaaaata

SEQ ID NO: 232227 - DNA, 16 bp, P. troglodytes
cctggttaaaatggat

SEQ ID NO: 232228 - DNA, 16 bp, P. troglodytes
cctggttcctctggct

SEQ ID NO: 232229 - DNA, 16 bp, P. troglodytes
cctggttctctggcct

SEQ ID NO: 232230 - DNA, 16 bp, P. troglodytes
cctggtttcagccccc

SEQ ID NO: 232231 - DNA, 16 bp, P. troglodytes
cctggttttcctccta

SEQ ID NO: 232232 - DNA, 16 bp, P. troglodytes
cctggttttgaggctt

SEQ ID NO: 232233 - DNA, 16 bp, P. troglodytes
cctgtaaaaatcaaaa

SEQ ID NO: 232234 - DNA, 16 bp, P. troglodytes
cctgtaaatgttacct

SEQ ID NO: 232235 - DNA, 16 bp, P. troglodytes
cctgtaaccccaacac

SEQ ID NO: 232236 - DNA, 16 bp, P. troglodytes
cctgtaagcccagcta

SEQ ID NO: 232237 - DNA, 16 bp, P. troglodytes
cctgtaataccagcta

SEQ ID NO: 232238 - DNA, 16 bp, P. troglodytes
cctgtaatcacagaac

SEQ ID NO: 232239 - DNA, 16 bp, P. troglodytes
cctgtaatccagcact

SEQ ID NO: 232240 - DNA, 16 bp, P. troglodytes
cctgtaatccagcatt

SEQ ID NO: 232241 - DNA, 18 bp, P. troglodytes
cctgtaatcccaacactg

SEQ ID NO: 232242 - DNA, 16 bp, P. troglodytes
cctgtaatcccagaca

SEQ ID NO: 232243 - DNA, 16 bp, P. troglodytes
cctgtaatcccagcca

SEQ ID NO: 232244 - DNA, 16 bp, P. troglodytes
cctgtaatcccagctt

SEQ ID NO: 232245 - DNA, 16 bp, P. troglodytes
cctgtaatcctaacta

SEQ ID NO: 232246 - DNA, 18 bp, P. troglodytes
cctgtaatctcagctact

SEQ ID NO: 232247 - DNA, 18 bp, P. troglodytes
cctgtaattccagctaca

SEQ ID NO: 232248 - DNA, 16 bp, P. troglodytes
cctgtaattccagctc

SEQ ID NO: 232249 - DNA, 16 bp, P. troglodytes
cctgtaattgcagcta

SEQ ID NO: 232250 - DNA, 16 bp, P. troglodytes
cctgtaatttttcttt

SEQ ID NO: 232251 - DNA, 16 bp, P. troglodytes
cctgtacaagctctct

SEQ ID NO: 232252 - DNA, 16 bp, P. troglodytes
cctgtaccccaaaaac

SEQ ID NO: 232253 - DNA, 16 bp, P. troglodytes
cctgtacctcctgggt

SEQ ID NO: 232254 - DNA, 16 bp, P. troglodytes
cctgtactcccagcca

SEQ ID NO: 232255 - DNA, 16 bp, P. troglodytes
cctgtagtccaagcta

SEQ ID NO: 232256 - DNA, 16 bp, P. troglodytes
cctgtagtcccagctc

SEQ ID NO: 232257 - DNA, 16 bp, P. troglodytes
cctgtagtcccagctg

SEQ ID NO: 232258 - DNA, 16 bp, P. troglodytes
cctgtagtcccagctt

SEQ ID NO: 232259 - DNA, 16 bp, P. troglodytes
cctgtagtcctagctg

SEQ ID NO: 232260 - DNA, 16 bp, P. troglodytes
cctgtagtctcaacta

SEQ ID NO: 232261 - DNA, 16 bp, P. troglodytes
cctgtatactttaaat

SEQ ID NO: 232262 - DNA, 16 bp, P. troglodytes
cctgtatctattaaaa

SEQ ID NO: 232263 - DNA, 16 bp, P. troglodytes
cctgtattaaaatatc

SEQ ID NO: 232264 - DNA, 16 bp, P. troglodytes
cctgtattcccagtta

SEQ ID NO: 232265 - DNA, 16 bp, P. troglodytes
cctgtattcctagcac

SEQ ID NO: 232266 - DNA, 19 bp, P. troglodytes
cctgtcaaaacaggccact

SEQ ID NO: 232267 - DNA, 16 bp, P. troglodytes
cctgtcagccagttaa

SEQ ID NO: 232268 - DNA, 16 bp, P. troglodytes
cctgtcatccaggctg

SEQ ID NO: 232269 - DNA, 16 bp, P. troglodytes
cctgtcccagcctcct

SEQ ID NO: 232270 - DNA, 16 bp, P. troglodytes
cctgtcccagctctgc

SEQ ID NO: 232271 - DNA, 16 bp, P. troglodytes
cctgtccccagcccca

SEQ ID NO: 232272 - DNA, 16 bp, P. troglodytes
cctgtccccagcccct

SEQ ID NO: 232273 - DNA, 16 bp, P. troglodytes
cctgtccccagccctg

SEQ ID NO: 232274 - DNA, 16 bp, P. troglodytes
cctgtcccctccccag

SEQ ID NO: 232275 - DNA, 16 bp, P. troglodytes
cctgtccctacaaaaa

SEQ ID NO: 232276 - DNA, 16 bp, P. troglodytes
cctgtcctagagatct

SEQ ID NO: 232277 - DNA, 16 bp, P. troglodytes
cctgtcctcctgctct

SEQ ID NO: 232278 - DNA, 16 bp, P. troglodytes
cctgtctaaaacaaac

SEQ ID NO: 232279 - DNA, 18 bp, P. troglodytes
cctgtctcaaaaaagaaa

SEQ ID NO: 232280 - DNA, 16 bp, P. troglodytes
cctgtctcaaaagaaa

SEQ ID NO: 232281 - DNA, 16 bp, P. troglodytes
cctgtctcaaataaat

SEQ ID NO: 232282 - DNA, 16 bp, P. troglodytes
cctgtctcagaaataa

SEQ ID NO: 232283 - DNA, 16 bp, P. troglodytes
cctgtctcaggctcct

SEQ ID NO: 232284 - DNA, 16 bp, P. troglodytes
cctgtctcagtcttcc

SEQ ID NO: 232285 - DNA, 16 bp, P. troglodytes
cctgtctccaaaaaag

SEQ ID NO: 232286 - DNA, 16 bp, P. troglodytes
cctgtctcccaagtag

SEQ ID NO: 232287 - DNA, 16 bp, P. troglodytes
cctgtctcgaaaataa

SEQ ID NO: 232288 - DNA, 16 bp, P. troglodytes
cctgtctcggcctccc

SEQ ID NO: 232289 - DNA, 16 bp, P. troglodytes
cctgtctctaaaaaat

SEQ ID NO: 232290 - DNA, 16 bp, P. troglodytes
cctgtctctaaaatga

SEQ ID NO: 232291 - DNA, 16 bp, P. troglodytes
cctgtctctacaaaaa

SEQ ID NO: 232292 - DNA, 16 bp, P. troglodytes
cctgtctctacaaaat

SEQ ID NO: 232293 - DNA, 16 bp, P. troglodytes
cctgtctctgaaaaag

SEQ ID NO: 232294 - DNA, 16 bp, P. troglodytes
cctgtctctgaaaaca

SEQ ID NO: 232295 - DNA, 16 bp, P. troglodytes
cctgtctcttaagaaa

SEQ ID NO: 232296 - DNA, 16 bp, P. troglodytes
cctgtctcttgaaaaa

SEQ ID NO: 232297 - DNA, 16 bp, P. troglodytes
cctgtctgcctcctgc

SEQ ID NO: 232298 - DNA, 16 bp, P. troglodytes
cctgtcttctgagccc

SEQ ID NO: 232299 - DNA, 16 bp, P. troglodytes
cctgtcttctgtgttg

SEQ ID NO: 232300 - DNA, 16 bp, P. troglodytes
cctgtcttgaaaaaaa

SEQ ID NO: 232301 - DNA, 16 bp, P. troglodytes
cctgtgaaaagccact

SEQ ID NO: 232302 - DNA, 16 bp, P. troglodytes
cctgtgaaactgtgag

SEQ ID NO: 232303 - DNA, 16 bp, P. troglodytes
cctgtgaccccagcac

SEQ ID NO: 232304 - DNA, 16 bp, P. troglodytes
cctgtgactgtgacct

SEQ ID NO: 232305 - DNA, 16 bp, P. troglodytes
cctgtgataaagttta

SEQ ID NO: 232306 - DNA, 16 bp, P. troglodytes
cctgtgatcccagctc

SEQ ID NO: 232307 - DNA, 16 bp, P. troglodytes
cctgtgatgggaggga

SEQ ID NO: 232308 - DNA, 16 bp, P. troglodytes
cctgtgattctgtttt

SEQ ID NO: 232309 - DNA, 16 bp, P. troglodytes
cctgtgattggctgaa

SEQ ID NO: 232310 - DNA, 16 bp, P. troglodytes
cctgtgatttttcttt

SEQ ID NO: 232311 - DNA, 16 bp, P. troglodytes
cctgtgcaacagagca

SEQ ID NO: 232312 - DNA, 16 bp, P. troglodytes
cctgtgcacatcctcc

SEQ ID NO: 232313 - DNA, 16 bp, P. troglodytes
cctgtgcagcctgcag

SEQ ID NO: 232314 - DNA, 16 bp, P. troglodytes
cctgtgccacctcagg

SEQ ID NO: 232315 - DNA, 16 bp, P. troglodytes
cctgtgcccactgtct

SEQ ID NO: 232316 - DNA, 16 bp, P. troglodytes
cctgtgccctgtgccc

SEQ ID NO: 232317 - DNA, 16 bp, P. troglodytes
cctgtgcctggaaaag

SEQ ID NO: 232318 - DNA, 16 bp, P. troglodytes
cctgtgcctgggaggg

SEQ ID NO: 232319 - DNA, 16 bp, P. troglodytes
cctgtgccttgtagga

SEQ ID NO: 232320 - DNA, 16 bp, P. troglodytes
cctgtgctcaagcgat

SEQ ID NO: 232321 - DNA, 16 bp, P. troglodytes
cctgtgctgggccctg

SEQ ID NO: 232322 - DNA, 16 bp, P. troglodytes
cctgtgctgtgtgcag

SEQ ID NO: 232323 - DNA, 16 bp, P. troglodytes
cctgtgcttttggtgt

SEQ ID NO: 232324 - DNA, 16 bp, P. troglodytes
cctgtggaatcatgag

SEQ ID NO: 232325 - DNA, 16 bp, P. troglodytes
cctgtggcccaggctg

SEQ ID NO: 232326 - DNA, 16 bp, P. troglodytes
cctgtggccttgggca

SEQ ID NO: 232327 - DNA, 16 bp, P. troglodytes
cctgtggctcacacct

SEQ ID NO: 232328 - DNA, 16 bp, P. troglodytes
cctgtgggggcagggc

SEQ ID NO: 232329 - DNA, 16 bp, P. troglodytes
cctgtggggtctgcac

SEQ ID NO: 232330 - DNA, 16 bp, P. troglodytes
cctgtgggtacacaga

SEQ ID NO: 232331 - DNA, 16 bp, P. troglodytes
cctgtggtcaccacca

SEQ ID NO: 232332 - DNA, 16 bp, P. troglodytes
cctgtggtcccagcca

SEQ ID NO: 232333 - DNA, 16 bp, P. troglodytes
cctgtggtcccaggta

SEQ ID NO: 232334 - DNA, 16 bp, P. troglodytes
cctgtggtcccagtta

SEQ ID NO: 232335 - DNA, 16 bp, P. troglodytes
cctgtggtctcagcca

SEQ ID NO: 232336 - DNA, 16 bp, P. troglodytes
cctgtggtgccaggca

SEQ ID NO: 232337 - DNA, 16 bp, P. troglodytes
cctgtggttccagcta

SEQ ID NO: 232338 - DNA, 16 bp, P. troglodytes
cctgtgtacacacaca

SEQ ID NO: 232339 - DNA, 16 bp, P. troglodytes
cctgtgtcctcatctg

SEQ ID NO: 232340 - DNA, 16 bp, P. troglodytes
cctgtgtcctctctcc

SEQ ID NO: 232341 - DNA, 16 bp, P. troglodytes
cctgtgtctaaaaata

SEQ ID NO: 232342 - DNA, 16 bp, P. troglodytes
cctgtgtgatcttggg

SEQ ID NO: 232343 - DNA, 16 bp, P. troglodytes
cctgtgtgtatgtgtg

SEQ ID NO: 232344 - DNA, 16 bp, P. troglodytes
cctgtgtgtccatgtg

SEQ ID NO: 232345 - DNA, 16 bp, P. troglodytes
cctgtgtgtctctgtg

SEQ ID NO: 232346 - DNA, 16 bp, P. troglodytes
cctgtgtgtgtctctg

SEQ ID NO: 232347 - DNA, 16 bp, P. troglodytes
cctgtgttctgttcca

SEQ ID NO: 232348 - DNA, 16 bp, P. troglodytes
cctgtgttgtgggagg

SEQ ID NO: 232349 - DNA, 16 bp, P. troglodytes
cctgtgtttgctgaga

SEQ ID NO: 232350 - DNA, 16 bp, P. troglodytes
cctgtgttttcttcta

SEQ ID NO: 232351 - DNA, 16 bp, P. troglodytes
cctgttaggaaccagg

SEQ ID NO: 232352 - DNA, 16 bp, P. troglodytes
cctgttaggaacctgg

SEQ ID NO: 232353 - DNA, 16 bp, P. troglodytes
cctgttatctcagcac

SEQ ID NO: 232354 - DNA, 16 bp, P. troglodytes
cctgttccttcctctg

SEQ ID NO: 232355 - DNA, 16 bp, P. troglodytes
cctgttcctttctctg

SEQ ID NO: 232356 - DNA, 16 bp, P. troglodytes
cctgttctcactcata

SEQ ID NO: 232357 - DNA, 16 bp, P. troglodytes
cctgttctggacattt

SEQ ID NO: 232358 - DNA, 16 bp, P. troglodytes
cctgttgccaaggctg

SEQ ID NO: 232359 - DNA, 16 bp, P. troglodytes
cctgttgcctgggctg

SEQ ID NO: 232360 - DNA, 16 bp, P. troglodytes
cctgttgtggggaggg

SEQ ID NO: 232361 - DNA, 16 bp, P. troglodytes
cctgtttccaaaaaaa

SEQ ID NO: 232362 - DNA, 16 bp, P. troglodytes
cctgtttctacaaaaa

SEQ ID NO: 232363 - DNA, 16 bp, P. troglodytes
cctgtttctccacaac

SEQ ID NO: 232364 - DNA, 16 bp, P. troglodytes
cctgtttgctgttgtt

SEQ ID NO: 232365 - DNA, 16 bp, P. troglodytes
cctgttttatagcact

SEQ ID NO: 232366 - DNA, 16 bp, P. troglodytes
cctgttttcccatctg

SEQ ID NO: 232367 - DNA, 16 bp, P. troglodytes
cctgttttctcatttg

SEQ ID NO: 232368 - DNA, 16 bp, P. troglodytes
cctgttttgttcactg

SEQ ID NO: 232369 - DNA, 16 bp, P. troglodytes
cctgtttttgtaaata

SEQ ID NO: 232370 - DNA, 16 bp, P. troglodytes
ccttaaaaaggaagga

SEQ ID NO: 232371 - DNA, 16 bp, P. troglodytes
ccttaaaaatattatg

SEQ ID NO: 232372 - DNA, 16 bp, P. troglodytes
ccttaaaaatgaaatt

SEQ ID NO: 232373 - DNA, 16 bp, P. troglodytes
ccttaaaagggccagg

SEQ ID NO: 232374 - DNA, 16 bp, P. troglodytes
ccttaaacaaaaatca

SEQ ID NO: 232375 - DNA, 16 bp, P. troglodytes
ccttaaccttttttcc

SEQ ID NO: 232376 - DNA, 17 bp, P. troglodytes
ccttaactgatgacatt

SEQ ID NO: 232377 - DNA, 16 bp, P. troglodytes
ccttaactttggcaaa

SEQ ID NO: 232378 - DNA, 16 bp, P. troglodytes
ccttacaagaagagaa

SEQ ID NO: 232379 - DNA, 16 bp, P. troglodytes
ccttacagagaaaata

SEQ ID NO: 232380 - DNA, 16 bp, P. troglodytes
ccttacaggccaggag

SEQ ID NO: 232381 - DNA, 16 bp, P. troglodytes
ccttacagtgtaaaca

SEQ ID NO: 232382 - DNA, 17 bp, P. troglodytes
ccttacctcagatgatc

SEQ ID NO: 232383 - DNA, 16 bp, P. troglodytes
ccttaccttctgccat

SEQ ID NO: 232384 - DNA, 16 bp, P. troglodytes
ccttactaaaaataca

SEQ ID NO: 232385 - DNA, 16 bp, P. troglodytes
ccttactctacaatcc

SEQ ID NO: 232386 - DNA, 16 bp, P. troglodytes
ccttagcaaatgcaaa

SEQ ID NO: 232387 - DNA, 16 bp, P. troglodytes
ccttagccccctgagt

SEQ ID NO: 232388 - DNA, 16 bp, P. troglodytes
ccttagcctcctgtgt

SEQ ID NO: 232389 - DNA, 16 bp, P. troglodytes
ccttagcctggatttc

SEQ ID NO: 232390 - DNA, 16 bp, P. troglodytes
ccttaggaatctactt

SEQ ID NO: 232391 - DNA, 17 bp, P. troglodytes
ccttagggctggaggtg

SEQ ID NO: 232392 - DNA, 16 bp, P. troglodytes
ccttataaattaccca

SEQ ID NO: 232393 - DNA, 16 bp, P. troglodytes
ccttataagagggagg

SEQ ID NO: 232394 - DNA, 16 bp, P. troglodytes
ccttatgagaatccaa

SEQ ID NO: 232395 - DNA, 16 bp, P. troglodytes
ccttatgtataaaatg

SEQ ID NO: 232396 - DNA, 16 bp, P. troglodytes
ccttatttggaaaaaa

SEQ ID NO: 232397 - DNA, 16 bp, P. troglodytes
ccttattttacagaag

SEQ ID NO: 232398 - DNA, 16 bp, P. troglodytes
ccttattttgttgttg

SEQ ID NO: 232399 - DNA, 16 bp, P. troglodytes
ccttcaaaaaataaat

SEQ ID NO: 232400 - DNA, 16 bp, P. troglodytes
ccttcaaaaaatgaat

SEQ ID NO: 232401 - DNA, 16 bp, P. troglodytes
ccttcaaaagtgaaag

SEQ ID NO: 232402 - DNA, 16 bp, P. troglodytes
ccttcaacctcatgaa

SEQ ID NO: 232403 - DNA, 16 bp, P. troglodytes
ccttcaactgattaga

SEQ ID NO: 232404 - DNA, 16 bp, P. troglodytes
ccttcaaggagctcac

SEQ ID NO: 232405 - DNA, 16 bp, P. troglodytes
ccttcaattcctgggc

SEQ ID NO: 232406 - DNA, 16 bp, P. troglodytes
ccttcacattttttcc

SEQ ID NO: 232407 - DNA, 16 bp, P. troglodytes
ccttcacccaggctgg

SEQ ID NO: 232408 - DNA, 16 bp, P. troglodytes
ccttcactgaagtctt

SEQ ID NO: 232409 - DNA, 16 bp, P. troglodytes
ccttcactttcagtct

SEQ ID NO: 232410 - DNA, 16 bp, P. troglodytes
ccttcagaatacagcc

SEQ ID NO: 232411 - DNA, 16 bp, P. troglodytes
ccttcagaatgaagac

SEQ ID NO: 232412 - DNA, 16 bp, P. troglodytes
ccttcagaccccagaa

SEQ ID NO: 232413 - DNA, 16 bp, P. troglodytes
ccttcagattcagact

SEQ ID NO: 232414 - DNA, 16 bp, P. troglodytes
ccttcagcagccacca

SEQ ID NO: 232415 - DNA, 16 bp, P. troglodytes
ccttcagcccctctcc

SEQ ID NO: 232416 - DNA, 16 bp, P. troglodytes
ccttcagctcctgtat

SEQ ID NO: 232417 - DNA, 16 bp, P. troglodytes
ccttcagctttatcct

SEQ ID NO: 232418 - DNA, 16 bp, P. troglodytes
ccttcaggaactcttt

SEQ ID NO: 232419 - DNA, 16 bp, P. troglodytes
ccttcaggaacttttc

SEQ ID NO: 232420 - DNA, 16 bp, P. troglodytes
ccttcaggaatgaaag

SEQ ID NO: 232421 - DNA, 16 bp, P. troglodytes
ccttcaggagctcctt

SEQ ID NO: 232422 - DNA, 16 bp, P. troglodytes
ccttcagggatgtcct

SEQ ID NO: 232423 - DNA, 16 bp, P. troglodytes
ccttcaggtctcagct

SEQ ID NO: 232424 - DNA, 16 bp, P. troglodytes
ccttcatcaatgatct

SEQ ID NO: 232425 - DNA, 16 bp, P. troglodytes
ccttcatcttggactt

SEQ ID NO: 232426 - DNA, 16 bp, P. troglodytes
ccttcatgctgttctc

SEQ ID NO: 232427 - DNA, 16 bp, P. troglodytes
ccttcatttccacctt

SEQ ID NO: 232428 - DNA, 16 bp, P. troglodytes
ccttcatttctgattt

SEQ ID NO: 232429 - DNA, 16 bp, P. troglodytes
ccttcattttgacttt

SEQ ID NO: 232430 - DNA, 16 bp, P. troglodytes
ccttccaaactcttcc

SEQ ID NO: 232431 - DNA, 16 bp, P. troglodytes
ccttccaaagtcctgg

SEQ ID NO: 232432 - DNA, 16 bp, P. troglodytes
ccttccaagcctctgg

SEQ ID NO: 232433 - DNA, 16 bp, P. troglodytes
ccttccacactgtgga

SEQ ID NO: 232434 - DNA, 16 bp, P. troglodytes
ccttccaccaggattg

SEQ ID NO: 232435 - DNA, 16 bp, P. troglodytes
ccttccacctgtgagc

SEQ ID NO: 232436 - DNA, 16 bp, P. troglodytes
ccttccaccttgacct

SEQ ID NO: 232437 - DNA, 16 bp, P. troglodytes
ccttccaggcagaggg

SEQ ID NO: 232438 - DNA, 16 bp, P. troglodytes
ccttccaggtttaagc

SEQ ID NO: 232439 - DNA, 16 bp, P. troglodytes
ccttccagtgggacag

SEQ ID NO: 232440 - DNA, 16 bp, P. troglodytes
ccttccatcatgactg

SEQ ID NO: 232441 - DNA, 16 bp, P. troglodytes
ccttccatccttccat

SEQ ID NO: 232442 - DNA, 16 bp, P. troglodytes
ccttccatctcttctg

SEQ ID NO: 232443 - DNA, 16 bp, P. troglodytes
ccttcccagcatctgg

SEQ ID NO: 232444 - DNA, 16 bp, P. troglodytes
ccttcccagcctcctg

SEQ ID NO: 232445 - DNA, 16 bp, P. troglodytes
ccttcccagcctctgg

SEQ ID NO: 232446 - DNA, 16 bp, P. troglodytes
ccttccccaaggagac

SEQ ID NO: 232447 - DNA, 16 bp, P. troglodytes
ccttccccagccctgg

SEQ ID NO: 232448 - DNA, 16 bp, P. troglodytes
ccttcccccaagtccc

SEQ ID NO: 232449 - DNA, 16 bp, P. troglodytes
ccttcccccagcctca

SEQ ID NO: 232450 - DNA, 16 bp, P. troglodytes
ccttcccctggaagct

SEQ ID NO: 232451 - DNA, 16 bp, P. troglodytes
ccttccccttcccagt

SEQ ID NO: 232452 - DNA, 16 bp, P. troglodytes
ccttccccttccccag

SEQ ID NO: 232453 - DNA, 16 bp, P. troglodytes
ccttccctcaggtgct

SEQ ID NO: 232454 - DNA, 16 bp, P. troglodytes
ccttccctcagtccct

SEQ ID NO: 232455 - DNA, 16 bp, P. troglodytes
ccttccctctgcttga

SEQ ID NO: 232456 - DNA, 16 bp, P. troglodytes
ccttccctgaccccca

SEQ ID NO: 232457 - DNA, 16 bp, P. troglodytes
ccttccctgactaccc

SEQ ID NO: 232458 - DNA, 16 bp, P. troglodytes
ccttccctgggccaga

SEQ ID NO: 232459 - DNA, 16 bp, P. troglodytes
ccttccgggttcaagc

SEQ ID NO: 232460 - DNA, 16 bp, P. troglodytes
ccttcctcacaaggtg

SEQ ID NO: 232461 - DNA, 16 bp, P. troglodytes
ccttcctcactgccct

SEQ ID NO: 232462 - DNA, 16 bp, P. troglodytes
ccttcctcaggctccc

SEQ ID NO: 232463 - DNA, 16 bp, P. troglodytes
ccttcctcctggctgc

SEQ ID NO: 232464 - DNA, 16 bp, P. troglodytes
ccttcctgaggcctca

SEQ ID NO: 232465 - DNA, 16 bp, P. troglodytes
ccttcctgcctcagct

SEQ ID NO: 232466 - DNA, 16 bp, P. troglodytes
ccttcctgcctgcctt

SEQ ID NO: 232467 - DNA, 16 bp, P. troglodytes
ccttcctgctgccttg

SEQ ID NO: 232468 - DNA, 16 bp, P. troglodytes
ccttcctgggcctcag

SEQ ID NO: 232469 - DNA, 16 bp, P. troglodytes
ccttcctgtatccatg

SEQ ID NO: 232470 - DNA, 16 bp, P. troglodytes
ccttccttagcctcct

SEQ ID NO: 232471 - DNA, 16 bp, P. troglodytes
ccttcgtctcccaggt

SEQ ID NO: 232472 - DNA, 16 bp, P. troglodytes
ccttctacacactgct

SEQ ID NO: 232473 - DNA, 16 bp, P. troglodytes
ccttctaccatgatta

SEQ ID NO: 232474 - DNA, 16 bp, P. troglodytes
ccttctcagcctccag

SEQ ID NO: 232475 - DNA, 16 bp, P. troglodytes
ccttctcagcctctgg

SEQ ID NO: 232476 - DNA, 16 bp, P. troglodytes
ccttctcatccttcaa

SEQ ID NO: 232477 - DNA, 16 bp, P. troglodytes
ccttctcatgctgcta

SEQ ID NO: 232478 - DNA, 16 bp, P. troglodytes
ccttctcctggctcat

SEQ ID NO: 232479 - DNA, 16 bp, P. troglodytes
ccttctctctgtgtct

SEQ ID NO: 232480 - DNA, 16 bp, P. troglodytes
ccttctctgactctga

SEQ ID NO: 232481 - DNA, 16 bp, P. troglodytes
ccttctctgcctccca

SEQ ID NO: 232482 - DNA, 16 bp, P. troglodytes
ccttctctgggccttg

SEQ ID NO: 232483 - DNA, 16 bp, P. troglodytes
ccttctctgtgccagg

SEQ ID NO: 232484 - DNA, 16 bp, P. troglodytes
ccttctctgtgtcctc

SEQ ID NO: 232485 - DNA, 16 bp, P. troglodytes
ccttctgacctcattt

SEQ ID NO: 232486 - DNA, 16 bp, P. troglodytes
ccttctgacctttcag

SEQ ID NO: 232487 - DNA, 16 bp, P. troglodytes
ccttctgagaccacct

SEQ ID NO: 232488 - DNA, 16 bp, P. troglodytes
ccttctgccatgatgg

SEQ ID NO: 232489 - DNA, 16 bp, P. troglodytes
ccttctgcctcggcct

SEQ ID NO: 232490 - DNA, 16 bp, P. troglodytes
ccttctgcctgaagga

SEQ ID NO: 232491 - DNA, 16 bp, P. troglodytes
ccttctgcctggaata

SEQ ID NO: 232492 - DNA, 16 bp, P. troglodytes
ccttctgccttggcct

SEQ ID NO: 232493 - DNA, 16 bp, P. troglodytes
ccttctgcgttggtct

SEQ ID NO: 232494 - DNA, 16 bp, P. troglodytes
ccttctgctccagcca

SEQ ID NO: 232495 - DNA, 16 bp, P. troglodytes
ccttctgctgtgattg

SEQ ID NO: 232496 - DNA, 16 bp, P. troglodytes
ccttctgggagcccag

SEQ ID NO: 232497 - DNA, 16 bp, P. troglodytes
ccttctgggttccagc

SEQ ID NO: 232498 - DNA, 16 bp, P. troglodytes
ccttctgtctcagcct

SEQ ID NO: 232499 - DNA, 16 bp, P. troglodytes
ccttctgtcttggcct

SEQ ID NO: 232500 - DNA, 16 bp, P. troglodytes
ccttctgtttcttcag

SEQ ID NO: 232501 - DNA, 16 bp, P. troglodytes
ccttcttctggaagct

SEQ ID NO: 232502 - DNA, 16 bp, P. troglodytes
ccttcttctgtattcc

SEQ ID NO: 232503 - DNA, 16 bp, P. troglodytes
ccttcttgctggtggg

SEQ ID NO: 232504 - DNA, 16 bp, P. troglodytes
ccttcttgctgtgtca

SEQ ID NO: 232505 - DNA, 16 bp, P. troglodytes
ccttgaaaaagaagaa

SEQ ID NO: 232506 - DNA, 16 bp, P. troglodytes
ccttgaaaaggaagga

SEQ ID NO: 232507 - DNA, 16 bp, P. troglodytes
ccttgaacctgggggg

SEQ ID NO: 232508 - DNA, 18 bp, P. troglodytes
ccttgaacttaattatga

SEQ ID NO: 232509 - DNA, 16 bp, P. troglodytes
ccttgaagaacattga

SEQ ID NO: 232510 - DNA, 16 bp, P. troglodytes
ccttgaccctggactt

SEQ ID NO: 232511 - DNA, 16 bp, P. troglodytes
ccttgacctcacaaag

SEQ ID NO: 232512 - DNA, 17 bp, P. troglodytes
ccttgacctcaggtgat

SEQ ID NO: 232513 - DNA, 16 bp, P. troglodytes
ccttgacctgctgggc

SEQ ID NO: 232514 - DNA, 16 bp, P. troglodytes
ccttgaccttggactt

SEQ ID NO: 232515 - DNA, 16 bp, P. troglodytes
ccttgactcaaaaaaa

SEQ ID NO: 232516 - DNA, 16 bp, P. troglodytes
ccttgacttcagactt

SEQ ID NO: 232517 - DNA, 16 bp, P. troglodytes
ccttgagcagctctgc

SEQ ID NO: 232518 - DNA, 16 bp, P. troglodytes
ccttgagccccagatc

SEQ ID NO: 232519 - DNA, 16 bp, P. troglodytes
ccttgagccctggagt

SEQ ID NO: 232520 - DNA, 16 bp, P. troglodytes
ccttgagctgtggtgg

SEQ ID NO: 232521 - DNA, 16 bp, P. troglodytes
ccttgaggccaggagg

SEQ ID NO: 232522 - DNA, 16 bp, P. troglodytes
ccttgatccatcttga

SEQ ID NO: 232523 - DNA, 16 bp, P. troglodytes
ccttgatcttctgggc

SEQ ID NO: 232524 - DNA, 16 bp, P. troglodytes
ccttgatcttgaactt

SEQ ID NO: 232525 - DNA, 16 bp, P. troglodytes
ccttgatcttgcactt

SEQ ID NO: 232526 - DNA, 16 bp, P. troglodytes
ccttgatggtggcact

SEQ ID NO: 232527 - DNA, 16 bp, P. troglodytes
ccttgattcctggacc

SEQ ID NO: 232528 - DNA, 16 bp, P. troglodytes
ccttgattttagccca

SEQ ID NO: 232529 - DNA, 16 bp, P. troglodytes
ccttgcaccccaggga

SEQ ID NO: 232530 - DNA, 16 bp, P. troglodytes
ccttgcagaactgtga

SEQ ID NO: 232531 - DNA, 16 bp, P. troglodytes
ccttgcagcaacatgg

SEQ ID NO: 232532 - DNA, 16 bp, P. troglodytes
ccttgcaggctgtaac

SEQ ID NO: 232533 - DNA, 20 bp, P. troglodytes
ccttgcagtttgatctcaga

SEQ ID NO: 232534 - DNA, 16 bp, P. troglodytes
ccttgcatcccatgga

SEQ ID NO: 232535 - DNA, 16 bp, P. troglodytes
ccttgcattcctggaa

SEQ ID NO: 232536 - DNA, 16 bp, P. troglodytes
ccttgccagggcccca

SEQ ID NO: 232537 - DNA, 16 bp, P. troglodytes
ccttgccccttccacc

SEQ ID NO: 232538 - DNA, 16 bp, P. troglodytes
ccttgccctgcttcag

SEQ ID NO: 232539 - DNA, 16 bp, P. troglodytes
ccttgccctgtcaccc

SEQ ID NO: 232540 - DNA, 16 bp, P. troglodytes
ccttgcctcaggtgat

SEQ ID NO: 232541 - DNA, 16 bp, P. troglodytes
ccttgcctccctccag

SEQ ID NO: 232542 - DNA, 16 bp, P. troglodytes
ccttgcctgctgccat

SEQ ID NO: 232543 - DNA, 16 bp, P. troglodytes
ccttgccttctccagc

SEQ ID NO: 232544 - DNA, 16 bp, P. troglodytes
ccttgcctttttcctg

SEQ ID NO: 232545 - DNA, 16 bp, P. troglodytes
ccttgcgcttcccggg

SEQ ID NO: 232546 - DNA, 17 bp, P. troglodytes
ccttgctctgtcaccca

SEQ ID NO: 232547 - DNA, 16 bp, P. troglodytes
ccttgctgaagttgct

SEQ ID NO: 232548 - DNA, 16 bp, P. troglodytes
ccttgctggatgcttc

SEQ ID NO: 232549 - DNA, 16 bp, P. troglodytes
ccttgctgtgtgacct

SEQ ID NO: 232550 - DNA, 16 bp, P. troglodytes
ccttgctttcccttca

SEQ ID NO: 232551 - DNA, 16 bp, P. troglodytes
ccttggaaaaactggc

SEQ ID NO: 232552 - DNA, 16 bp, P. troglodytes
ccttggaaaagaattt

SEQ ID NO: 232553 - DNA, 23 bp, P. troglodytes
ccttggacaatacctggctttcc

SEQ ID NO: 232554 - DNA, 16 bp, P. troglodytes
ccttggagaagtggct

SEQ ID NO: 232555 - DNA, 16 bp, P. troglodytes
ccttggcagcttacat

SEQ ID NO: 232556 - DNA, 16 bp, P. troglodytes
ccttggcagcttctat

SEQ ID NO: 232557 - DNA, 16 bp, P. troglodytes
ccttggccctccaaag

SEQ ID NO: 232558 - DNA, 16 bp, P. troglodytes
ccttggccgcccaaag

SEQ ID NO: 232559 - DNA, 16 bp, P. troglodytes
ccttggcctcccaaat

SEQ ID NO: 232560 - DNA, 16 bp, P. troglodytes
ccttggcctcccaatg

SEQ ID NO: 232561 - DNA, 16 bp, P. troglodytes
ccttggcctcctagag

SEQ ID NO: 232562 - DNA, 16 bp, P. troglodytes
ccttggccttccaagt

SEQ ID NO: 232563 - DNA, 16 bp, P. troglodytes
ccttggctcaagagat

SEQ ID NO: 232564 - DNA, 16 bp, P. troglodytes
ccttggctcaggtgat

SEQ ID NO: 232565 - DNA, 16 bp, P. troglodytes
ccttggctgggggagg

SEQ ID NO: 232566 - DNA, 16 bp, P. troglodytes
ccttggcttcccacag

SEQ ID NO: 232567 - DNA, 16 bp, P. troglodytes
ccttgggagcccatcc

SEQ ID NO: 232568 - DNA, 17 bp, P. troglodytes
ccttgggatgctgttga

SEQ ID NO: 232569 - DNA, 16 bp, P. troglodytes
ccttgggcaagccatt

SEQ ID NO: 232570 - DNA, 16 bp, P. troglodytes
ccttgggcaagttact

SEQ ID NO: 232571 - DNA, 16 bp, P. troglodytes
ccttgggcagctcctt

SEQ ID NO: 232572 - DNA, 16 bp, P. troglodytes
ccttgggcggtatggc

SEQ ID NO: 232573 - DNA, 16 bp, P. troglodytes
ccttggggaagaggga

SEQ ID NO: 232574 - DNA, 16 bp, P. troglodytes
ccttggggagggctgc

SEQ ID NO: 232575 - DNA, 24 bp, P. troglodytes
ccttgggtggtcgatgggactggg

SEQ ID NO: 232576 - DNA, 16 bp, P. troglodytes
ccttggtctccaaaag

SEQ ID NO: 232577 - DNA, 16 bp, P. troglodytes
ccttggtctctcaaag

SEQ ID NO: 232578 - DNA, 16 bp, P. troglodytes
ccttggtgacacagca

SEQ ID NO: 232579 - DNA, 16 bp, P. troglodytes
ccttggtgagcctctg

SEQ ID NO: 232580 - DNA, 16 bp, P. troglodytes
ccttggttcaagggat

SEQ ID NO: 232581 - DNA, 16 bp, P. troglodytes
ccttggttgagaacca

SEQ ID NO: 232582 - DNA, 16 bp, P. troglodytes
ccttggtttctccatc

SEQ ID NO: 232583 - DNA, 16 bp, P. troglodytes
ccttggtttggcttcc

SEQ ID NO: 232584 - DNA, 16 bp, P. troglodytes
ccttggttttcttcta

SEQ ID NO: 232585 - DNA, 16 bp, P. troglodytes
ccttgtaatataattt

SEQ ID NO: 232586 - DNA, 16 bp, P. troglodytes
ccttgtaatttcttct

SEQ ID NO: 232587 - DNA, 16 bp, P. troglodytes
ccttgtaattttctgt

SEQ ID NO: 232588 - DNA, 16 bp, P. troglodytes
ccttgtagtataattt

SEQ ID NO: 232589 - DNA, 16 bp, P. troglodytes
ccttgtagtatagtat

SEQ ID NO: 232590 - DNA, 16 bp, P. troglodytes
ccttgtcagcatctgt

SEQ ID NO: 232591 - DNA, 16 bp, P. troglodytes
ccttgtctcaaaaaaa

SEQ ID NO: 232592 - DNA, 16 bp, P. troglodytes
ccttgtctcaaaataa

SEQ ID NO: 232593 - DNA, 16 bp, P. troglodytes
ccttgtctctgtctct

SEQ ID NO: 232594 - DNA, 16 bp, P. troglodytes
ccttgtctgccagttg

SEQ ID NO: 232595 - DNA, 16 bp, P. troglodytes
ccttgtctggttttag

SEQ ID NO: 232596 - DNA, 16 bp, P. troglodytes
ccttgtctttttccag

SEQ ID NO: 232597 - DNA, 16 bp, P. troglodytes
ccttgtgaagaaggtg

SEQ ID NO: 232598 - DNA, 17 bp, P. troglodytes
ccttgtgacccccactc

SEQ ID NO: 232599 - DNA, 16 bp, P. troglodytes
ccttgtgatctgccca

SEQ ID NO: 232600 - DNA, 16 bp, P. troglodytes
ccttgtgatgcacctg

SEQ ID NO: 232601 - DNA, 16 bp, P. troglodytes
ccttgtgcttcctgag

SEQ ID NO: 232602 - DNA, 16 bp, P. troglodytes
ccttgtggcagttaga

SEQ ID NO: 232603 - DNA, 16 bp, P. troglodytes
ccttgtgtcaaaaaaa

SEQ ID NO: 232604 - DNA, 16 bp, P. troglodytes
ccttgttaaccaggat

SEQ ID NO: 232605 - DNA, 16 bp, P. troglodytes
ccttgttgctgtgtcc

SEQ ID NO: 232606 - DNA, 16 bp, P. troglodytes
ccttgttggaagcaag

SEQ ID NO: 232607 - DNA, 16 bp, P. troglodytes
ccttgtttgcagatgg

SEQ ID NO: 232608 - DNA, 16 bp, P. troglodytes
cctttaaaaaggccaa

SEQ ID NO: 232609 - DNA, 16 bp, P. troglodytes
cctttaaaaatatttt

SEQ ID NO: 232610 - DNA, 16 bp, P. troglodytes
cctttaaaaatgtgaa

SEQ ID NO: 232611 - DNA, 16 bp, P. troglodytes
cctttaaaatgcattt

SEQ ID NO: 232612 - DNA, 16 bp, P. troglodytes
cctttaaaatttaaaa

SEQ ID NO: 232613 - DNA, 16 bp, P. troglodytes
cctttaaagttttttt

SEQ ID NO: 232614 - DNA, 16 bp, P. troglodytes
cctttaagaactgtaa

SEQ ID NO: 232615 - DNA, 16 bp, P. troglodytes
cctttaagattttttt

SEQ ID NO: 232616 - DNA, 16 bp, P. troglodytes
cctttacagaaaatat

SEQ ID NO: 232617 - DNA, 20 bp, P. troglodytes
cctttacagacaagcaaatg

SEQ ID NO: 232618 - DNA, 17 bp, P. troglodytes
cctttactaaaaataca

SEQ ID NO: 232619 - DNA, 16 bp, P. troglodytes
cctttataaatgaccc

SEQ ID NO: 232620 - DNA, 16 bp, P. troglodytes
cctttataaattatct

SEQ ID NO: 232621 - DNA, 16 bp, P. troglodytes
cctttataaattatgc

SEQ ID NO: 232622 - DNA, 16 bp, P. troglodytes
cctttcacctgcccca

SEQ ID NO: 232623 - DNA, 16 bp, P. troglodytes
cctttcatgtgaaatc

SEQ ID NO: 232624 - DNA, 16 bp, P. troglodytes
cctttcatttcaactt

SEQ ID NO: 232625 - DNA, 16 bp, P. troglodytes
cctttccaaaggaggc

SEQ ID NO: 232626 - DNA, 16 bp, P. troglodytes
cctttccaaatgggag

SEQ ID NO: 232627 - DNA, 16 bp, P. troglodytes
cctttccacactgccc

SEQ ID NO: 232628 - DNA, 16 bp, P. troglodytes
cctttccccattgctc

SEQ ID NO: 232629 - DNA, 16 bp, P. troglodytes
cctttcccctttaaat

SEQ ID NO: 232630 - DNA, 16 bp, P. troglodytes
cctttccctactttat

SEQ ID NO: 232631 - DNA, 16 bp, P. troglodytes
cctttccctctggctg

SEQ ID NO: 232632 - DNA, 16 bp, P. troglodytes
cctttcctagaaagtt

SEQ ID NO: 232633 - DNA, 16 bp, P. troglodytes
cctttcctcagtgtgt

SEQ ID NO: 232634 - DNA, 16 bp, P. troglodytes
cctttcctggaaaact

SEQ ID NO: 232635 - DNA, 16 bp, P. troglodytes
cctttctaaaccaaag

SEQ ID NO: 232636 - DNA, 16 bp, P. troglodytes
cctttctagggacatg

SEQ ID NO: 232637 - DNA, 16 bp, P. troglodytes
cctttctccagtgtat

SEQ ID NO: 232638 - DNA, 16 bp, P. troglodytes
cctttctctggtgcct

SEQ ID NO: 232639 - DNA, 16 bp, P. troglodytes
cctttctctgtggctg

SEQ ID NO: 232640 - DNA, 16 bp, P. troglodytes
cctttctggatggaac

SEQ ID NO: 232641 - DNA, 16 bp, P. troglodytes
cctttctgggcttcag

SEQ ID NO: 232642 - DNA, 16 bp, P. troglodytes
cctttctgtttattag

SEQ ID NO: 232643 - DNA, 16 bp, P. troglodytes
cctttcttggttttgg

SEQ ID NO: 232644 - DNA, 16 bp, P. troglodytes
cctttctttgtgttat

SEQ ID NO: 232645 - DNA, 16 bp, P. troglodytes
cctttgaaaacaggca

SEQ ID NO: 232646 - DNA, 16 bp, P. troglodytes
cctttgacccagaaat

SEQ ID NO: 232647 - DNA, 16 bp, P. troglodytes
cctttgactccatgcc

SEQ ID NO: 232648 - DNA, 16 bp, P. troglodytes
cctttgagaatctgat

SEQ ID NO: 232649 - DNA, 16 bp, P. troglodytes
cctttgagcatcatgt

SEQ ID NO: 232650 - DNA, 16 bp, P. troglodytes
cctttgatccagcaat

SEQ ID NO: 232651 - DNA, 16 bp, P. troglodytes
cctttgatgcacaaaa

SEQ ID NO: 232652 - DNA, 16 bp, P. troglodytes
cctttgcacccttcat

SEQ ID NO: 232653 - DNA, 16 bp, P. troglodytes
cctttgcacctgctct

SEQ ID NO: 232654 - DNA, 16 bp, P. troglodytes
cctttgcagaaaaagt

SEQ ID NO: 232655 - DNA, 16 bp, P. troglodytes
cctttgcagggacctg

SEQ ID NO: 232656 - DNA, 16 bp, P. troglodytes
cctttgcatcagcatg

SEQ ID NO: 232657 - DNA, 16 bp, P. troglodytes
cctttgcatcttcata

SEQ ID NO: 232658 - DNA, 16 bp, P. troglodytes
cctttgccttctacca

SEQ ID NO: 232659 - DNA, 16 bp, P. troglodytes
cctttgctcattttct

SEQ ID NO: 232660 - DNA, 16 bp, P. troglodytes
cctttgctccagttcc

SEQ ID NO: 232661 - DNA, 16 bp, P. troglodytes
cctttgctggttcctc

SEQ ID NO: 232662 - DNA, 16 bp, P. troglodytes
cctttggaggagaaaa

SEQ ID NO: 232663 - DNA, 16 bp, P. troglodytes
cctttggatacatacc

SEQ ID NO: 232664 - DNA, 16 bp, P. troglodytes
cctttggatgttaatc

SEQ ID NO: 232665 - DNA, 16 bp, P. troglodytes
cctttgggaagctgag

SEQ ID NO: 232666 - DNA, 16 bp, P. troglodytes
cctttgggttccatgt

SEQ ID NO: 232667 - DNA, 16 bp, P. troglodytes
cctttggtgaaaaagg

SEQ ID NO: 232668 - DNA, 16 bp, P. troglodytes
cctttggtgtctggct

SEQ ID NO: 232669 - DNA, 16 bp, P. troglodytes
cctttgtaaatatttt

SEQ ID NO: 232670 - DNA, 16 bp, P. troglodytes
cctttgtcatccaggc

SEQ ID NO: 232671 - DNA, 16 bp, P. troglodytes
cctttgtgagctgtaa

SEQ ID NO: 232672 - DNA, 16 bp, P. troglodytes
cctttgtggaagtcag

SEQ ID NO: 232673 - DNA, 16 bp, P. troglodytes
cctttgttgaaaataa

SEQ ID NO: 232674 - DNA, 16 bp, P. troglodytes
cctttgttgaaaatga

SEQ ID NO: 232675 - DNA, 16 bp, P. troglodytes
cctttgttgaaaatta

SEQ ID NO: 232676 - DNA, 16 bp, P. troglodytes
cctttgtttagcatat

SEQ ID NO: 232677 - DNA, 16 bp, P. troglodytes
ccttttaaaaaaattt

SEQ ID NO: 232678 - DNA, 16 bp, P. troglodytes
ccttttaaaaaatgtt

SEQ ID NO: 232679 - DNA, 16 bp, P. troglodytes
ccttttaaaatataaa

SEQ ID NO: 232680 - DNA, 16 bp, P. troglodytes
ccttttaaaattgaat

SEQ ID NO: 232681 - DNA, 31 bp, P. troglodytes
ccttttagaaaacatggagttgttcctttgg

SEQ ID NO: 232682 - DNA, 16 bp, P. troglodytes
ccttttatagaaaaag

SEQ ID NO: 232683 - DNA, 16 bp, P. troglodytes
ccttttattttgagct

SEQ ID NO: 232684 - DNA, 16 bp, P. troglodytes
ccttttcaagaaatgg

SEQ ID NO: 232685 - DNA, 16 bp, P. troglodytes
ccttttcaataaatag

SEQ ID NO: 232686 - DNA, 16 bp, P. troglodytes
ccttttctataaaatg

SEQ ID NO: 232687 - DNA, 16 bp, P. troglodytes
ccttttctctctggct

SEQ ID NO: 232688 - DNA, 16 bp, P. troglodytes
ccttttctggttttgg

SEQ ID NO: 232689 - DNA, 16 bp, P. troglodytes
ccttttcttataaatt

SEQ ID NO: 232690 - DNA, 16 bp, P. troglodytes
ccttttcttcacatct

SEQ ID NO: 232691 - DNA, 16 bp, P. troglodytes
ccttttggcagagtct

SEQ ID NO: 232692 - DNA, 16 bp, P. troglodytes
ccttttggttcctaaa

SEQ ID NO: 232693 - DNA, 16 bp, P. troglodytes
ccttttgtatctggct

SEQ ID NO: 232694 - DNA, 16 bp, P. troglodytes
ccttttgtgactggct

SEQ ID NO: 232695 - DNA, 16 bp, P. troglodytes
ccttttgtggttccat

SEQ ID NO: 232696 - DNA, 16 bp, P. troglodytes
ccttttgttttttaaa

SEQ ID NO: 232697 - DNA, 16 bp, P. troglodytes
cctttttaaaaaaaat

SEQ ID NO: 232698 - DNA, 16 bp, P. troglodytes
cctttttaaaaaataa

SEQ ID NO: 232699 - DNA, 16 bp, P. troglodytes
cctttttaaaaataca

SEQ ID NO: 232700 - DNA, 16 bp, P. troglodytes
cctttttaaagaaaaa

SEQ ID NO: 232701 - DNA, 16 bp, P. troglodytes
cctttttaattttctg

SEQ ID NO: 232702 - DNA, 16 bp, P. troglodytes
cctttttctctctcag

SEQ ID NO: 232703 - DNA, 16 bp, P. troglodytes
cctttttctggagaac

SEQ ID NO: 232704 - DNA, 16 bp, P. troglodytes
cctttttctttataaa

SEQ ID NO: 232705 - DNA, 16 bp, P. troglodytes
cctttttgatttcttc

SEQ ID NO: 232706 - DNA, 16 bp, P. troglodytes
cctttttgcccttctg

SEQ ID NO: 232707 - DNA, 16 bp, P. troglodytes
cctttttgttgctgag

SEQ ID NO: 232708 - DNA, 16 bp, P. troglodytes
ccttttttaaaaaaaa

SEQ ID NO: 232709 - DNA, 16 bp, P. troglodytes
ccttttttaaaaaatt

SEQ ID NO: 232710 - DNA, 16 bp, P. troglodytes
ccttttttaaaaataa

SEQ ID NO: 232711 - DNA, 16 bp, P. troglodytes
ccttttttgggggggg

SEQ ID NO: 232712 - DNA, 16 bp, P. troglodytes
cctttttttaaaaaaa

SEQ ID NO: 232713 - DNA, 16 bp, P. troglodytes
ccttttttttaaaaaa

SEQ ID NO: 232714 - DNA, 16 bp, P. troglodytes
cctttttttttgagac

SEQ ID NO: 232715 - DNA, 16 bp, P. troglodytes
ccttttttttttaaga

SEQ ID NO: 232716 - DNA, 16 bp, P. troglodytes
ccttttttttttgaga

SEQ ID NO: 232717 - DNA, 16 bp, P. troglodytes
cgaaaccccatctcca

SEQ ID NO: 232718 - DNA, 18 bp, P. troglodytes
cgaaaccccatctctacc

SEQ ID NO: 232719 - DNA, 16 bp, P. troglodytes
cgaaaccccatctgta

SEQ ID NO: 232720 - DNA, 18 bp, P. troglodytes
cgaaaccccgtctctaca

SEQ ID NO: 232721 - DNA, 16 bp, P. troglodytes
cgaaaccccttctcta

SEQ ID NO: 232722 - DNA, 16 bp, P. troglodytes
cgaaaccctgtctcta

SEQ ID NO: 232723 - DNA, 16 bp, P. troglodytes
cgaacccaccagaaga

SEQ ID NO: 232724 - DNA, 16 bp, P. troglodytes
cgaacccctgacctta

SEQ ID NO: 232725 - DNA, 17 bp, P. troglodytes
cgaacccgggaggtgga

SEQ ID NO: 232726 - DNA, 16 bp, P. troglodytes
cgaactcatgacctcg

SEQ ID NO: 232727 - DNA, 16 bp, P. troglodytes
cgaactcctgacctcg

SEQ ID NO: 232728 - DNA, 16 bp, P. troglodytes
cgaactcctgatgtca

SEQ ID NO: 232729 - DNA, 17 bp, P. troglodytes
cgaactcctgggctcat

SEQ ID NO: 232730 - DNA, 16 bp, P. troglodytes
cgaactgctgacctca

SEQ ID NO: 232731 - DNA, 16 bp, P. troglodytes
cgaagtcctgacctca

SEQ ID NO: 232732 - DNA, 16 bp, P. troglodytes
cgaagtcctgagctca

SEQ ID NO: 232733 - DNA, 16 bp, P. troglodytes
cgaagtgctggaatta

SEQ ID NO: 232734 - DNA, 16 bp, P. troglodytes
cgaatgttctcactca

SEQ ID NO: 232735 - DNA, 16 bp, P. troglodytes
cgaattcctgacctca

SEQ ID NO: 232736 - DNA, 26 bp, P. troglodytes
cgacaaagggctaatatccagaatct

SEQ ID NO: 232737 - DNA, 16 bp, P. troglodytes
cgacagaatgagaccc

SEQ ID NO: 232738 - DNA, 16 bp, P. troglodytes
cgacagagactccgtc

SEQ ID NO: 232739 - DNA, 16 bp, P. troglodytes
cgacagagagagagac

SEQ ID NO: 232740 - DNA, 18 bp, P. troglodytes
cgacagagcaagaccctg

SEQ ID NO: 232741 - DNA, 16 bp, P. troglodytes
cgacagagcaagacgc

SEQ ID NO: 232742 - DNA, 16 bp, P. troglodytes
cgacagagcgagaccc

SEQ ID NO: 232743 - DNA, 16 bp, P. troglodytes
cgacagagcgagactg

SEQ ID NO: 232744 - DNA, 16 bp, P. troglodytes
cgacagagcgagactt

SEQ ID NO: 232745 - DNA, 16 bp, P. troglodytes
cgacagagtgagaccc

SEQ ID NO: 232746 - DNA, 17 bp, P. troglodytes
cgacagagtgagactct

SEQ ID NO: 232747 - DNA, 16 bp, P. troglodytes
cgacagagtgagactg

SEQ ID NO: 232748 - DNA, 16 bp, P. troglodytes
cgacagagtgagattc

SEQ ID NO: 232749 - DNA, 16 bp, P. troglodytes
cgacagagtgggactc

SEQ ID NO: 232750 - DNA, 16 bp, P. troglodytes
cgacaggaggcagagc

SEQ ID NO: 232751 - DNA, 16 bp, P. troglodytes
cgacaggccccagtgt

SEQ ID NO: 232752 - DNA, 16 bp, P. troglodytes
cgaccaccaccatgcc

SEQ ID NO: 232753 - DNA, 18 bp, P. troglodytes
cgaccatcctggctaaca

SEQ ID NO: 232754 - DNA, 16 bp, P. troglodytes
cgaccccacaggcagt

SEQ ID NO: 232755 - DNA, 21 bp, P. troglodytes
cgacctcaggtgatccaccca

SEQ ID NO: 232756 - DNA, 24 bp, P. troglodytes
cgacctcaggtgatccacccacct

SEQ ID NO: 232757 - DNA, 29 bp, P. troglodytes
cgacctcaggtgatccacccgcctcggcc

SEQ ID NO: 232758 - DNA, 24 bp, P. troglodytes
cgacctcaggtgatccgcccgcct

SEQ ID NO: 232759 - DNA, 24 bp, P. troglodytes
cgacctcaggtgatccgcctgcct

SEQ ID NO: 232760 - DNA, 16 bp, P. troglodytes
cgacctcccgggctca

SEQ ID NO: 232761 - DNA, 17 bp, P. troglodytes
cgacctcgtgatccgcc

SEQ ID NO: 232762 - DNA, 16 bp, P. troglodytes
cgacctgatggagctg

SEQ ID NO: 232763 - DNA, 16 bp, P. troglodytes
cgacggagcaagactc

SEQ ID NO: 232764 - DNA, 16 bp, P. troglodytes
cgactcactgccacct

SEQ ID NO: 232765 - DNA, 16 bp, P. troglodytes
cgactccatctcaaaa

SEQ ID NO: 232766 - DNA, 17 bp, P. troglodytes
cgactctagaggatccc

SEQ ID NO: 232767 - DNA, 16 bp, P. troglodytes
cgagaacacgccactg

SEQ ID NO: 232768 - DNA, 16 bp, P. troglodytes
cgagaactacatgaag

SEQ ID NO: 232769 - DNA, 16 bp, P. troglodytes
cgagaagggaagttta

SEQ ID NO: 232770 - DNA, 16 bp, P. troglodytes
cgagaccaacctggac

SEQ ID NO: 232771 - DNA, 16 bp, P. troglodytes
cgagaccacgccactg

SEQ ID NO: 232772 - DNA, 16 bp, P. troglodytes
cgagaccagccaggcc

SEQ ID NO: 232773 - DNA, 16 bp, P. troglodytes
cgagaccagcctggaa

SEQ ID NO: 232774 - DNA, 16 bp, P. troglodytes
cgagaccagcctggca

SEQ ID NO: 232775 - DNA, 16 bp, P. troglodytes
cgagaccagcctggta

SEQ ID NO: 232776 - DNA, 16 bp, P. troglodytes
cgagaccatcctgggc

SEQ ID NO: 232777 - DNA, 19 bp, P. troglodytes
cgagaccctgtctcaaaac

SEQ ID NO: 232778 - DNA, 16 bp, P. troglodytes
cgagactccatcttgg

SEQ ID NO: 232779 - DNA, 16 bp, P. troglodytes
cgagactctgtccaaa

SEQ ID NO: 232780 - DNA, 16 bp, P. troglodytes
cgagactctgtctaaa

SEQ ID NO: 232781 - DNA, 16 bp, P. troglodytes
cgagactgggtaattt

SEQ ID NO: 232782 - DNA, 16 bp, P. troglodytes
cgagaggcagaggttg

SEQ ID NO: 232783 - DNA, 16 bp, P. troglodytes
cgagaggctgagacag

SEQ ID NO: 232784 - DNA, 16 bp, P. troglodytes
cgagagttcaagacca

SEQ ID NO: 232785 - DNA, 16 bp, P. troglodytes
cgagatcacgcccctg

SEQ ID NO: 232786 - DNA, 18 bp, P. troglodytes
cgagccaagatcgcacca

SEQ ID NO: 232787 - DNA, 16 bp, P. troglodytes
cgagccactgcactgc

SEQ ID NO: 232788 - DNA, 19 bp, P. troglodytes
cgagccgagatcgcgccat

SEQ ID NO: 232789 - DNA, 16 bp, P. troglodytes
cgagcgaaactccatc

SEQ ID NO: 232790 - DNA, 16 bp, P. troglodytes
cgagcgagagagagag

SEQ ID NO: 232791 - DNA, 16 bp, P. troglodytes
cgagctcaggagttca

SEQ ID NO: 232792 - DNA, 16 bp, P. troglodytes
cgagctccgcctcccg

SEQ ID NO: 232793 - DNA, 16 bp, P. troglodytes
cgagctcctgacctca

SEQ ID NO: 232794 - DNA, 16 bp, P. troglodytes
cgaggagctgaatgtt

SEQ ID NO: 232795 - DNA, 16 bp, P. troglodytes
cgaggcagagagagag

SEQ ID NO: 232796 - DNA, 16 bp, P. troglodytes
cgaggcaggaggatcc

SEQ ID NO: 232797 - DNA, 16 bp, P. troglodytes
cgaggcaggtggatcc

SEQ ID NO: 232798 - DNA, 16 bp, P. troglodytes
cgaggcaggtggatcg

SEQ ID NO: 232799 - DNA, 16 bp, P. troglodytes
cgaggcatgcggatca

SEQ ID NO: 232800 - DNA, 16 bp, P. troglodytes
cgaggccaggagatca

SEQ ID NO: 232801 - DNA, 17 bp, P. troglodytes
cgaggccatcctggcca

SEQ ID NO: 232802 - DNA, 16 bp, P. troglodytes
cgaggccgaggcaggc

SEQ ID NO: 232803 - DNA, 16 bp, P. troglodytes
cgaggcgggtggatct

SEQ ID NO: 232804 - DNA, 16 bp, P. troglodytes
cgaggctgaggcgggc

SEQ ID NO: 232805 - DNA, 16 bp, P. troglodytes
cgaggctgtggtgagc

SEQ ID NO: 232806 - DNA, 16 bp, P. troglodytes
cgagggagggacctgg

SEQ ID NO: 232807 - DNA, 16 bp, P. troglodytes
cgaggtcaggaggtgg

SEQ ID NO: 232808 - DNA, 16 bp, P. troglodytes
cgaggtcaggagttcc

SEQ ID NO: 232809 - DNA, 25 bp, P. troglodytes
cgaggtgggcggatcacctgaggtt

SEQ ID NO: 232810 - DNA, 16 bp, P. troglodytes
cgaggtgggtggattg

SEQ ID NO: 232811 - DNA, 17 bp, P. troglodytes
cgaggtttcaccatgtt

SEQ ID NO: 232812 - DNA, 16 bp, P. troglodytes
cgagtagccgggatta

SEQ ID NO: 232813 - DNA, 17 bp, P. troglodytes
cgagtagctggaattat

SEQ ID NO: 232814 - DNA, 17 bp, P. troglodytes
cgagtagctgggactat

SEQ ID NO: 232815 - DNA, 16 bp, P. troglodytes
cgagtagctggtacta

SEQ ID NO: 232816 - DNA, 16 bp, P. troglodytes
cgagtagctggtatta

SEQ ID NO: 232817 - DNA, 16 bp, P. troglodytes
cgagtagctgtgatta

SEQ ID NO: 232818 - DNA, 16 bp, P. troglodytes
cgagtctcgctctgtc

SEQ ID NO: 232819 - DNA, 16 bp, P. troglodytes
cgagtcttgctctgtc

SEQ ID NO: 232820 - DNA, 16 bp, P. troglodytes
cgagtgtgtgtgtgtg

SEQ ID NO: 232821 - DNA, 16 bp, P. troglodytes
cgatagagtgagattc

SEQ ID NO: 232822 - DNA, 16 bp, P. troglodytes
cgatatcagctcactg

SEQ ID NO: 232823 - DNA, 16 bp, P. troglodytes
cgatcaaactactccg

SEQ ID NO: 232824 - DNA, 16 bp, P. troglodytes
cgatccacccacctca

SEQ ID NO: 232825 - DNA, 16 bp, P. troglodytes
cgatccacccaccttg

SEQ ID NO: 232826 - DNA, 17 bp, P. troglodytes
cgatccacctgcctcag

SEQ ID NO: 232827 - DNA, 19 bp, P. troglodytes
cgatcccacagaaatacaa

SEQ ID NO: 232828 - DNA, 18 bp, P. troglodytes
cgatccgcccgccttggc

SEQ ID NO: 232829 - DNA, 16 bp, P. troglodytes
cgatcctccaacctca

SEQ ID NO: 232830 - DNA, 16 bp, P. troglodytes
cgatcctcccgcctct

SEQ ID NO: 232831 - DNA, 16 bp, P. troglodytes
cgatctcctgacgtca

SEQ ID NO: 232832 - DNA, 16 bp, P. troglodytes
cgatctcctgcccttg

SEQ ID NO: 232833 - DNA, 16 bp, P. troglodytes
cgatctcggctcacta

SEQ ID NO: 232834 - DNA, 20 bp, P. troglodytes
cgatctcggctcactgcaaa

SEQ ID NO: 232835 - DNA, 16 bp, P. troglodytes
cgatctgcccacctca

SEQ ID NO: 232836 - DNA, 16 bp, P. troglodytes
cgatctgcccaccttg

SEQ ID NO: 232837 - DNA, 19 bp, P. troglodytes
cgatctgcccgcctcggcc

SEQ ID NO: 232838 - DNA, 17 bp, P. troglodytes
cgatctgcctgcctcgg

SEQ ID NO: 232839 - DNA, 17 bp, P. troglodytes
cgatctgcctgcttcag

SEQ ID NO: 232840 - DNA, 16 bp, P. troglodytes
cgatgctcctgctctg

SEQ ID NO: 232841 - DNA, 16 bp, P. troglodytes
cgatggaagatgaaat

SEQ ID NO: 232842 - DNA, 16 bp, P. troglodytes
cgatggcaggtgcctg

SEQ ID NO: 232843 - DNA, 16 bp, P. troglodytes
cgatggctcacacctg

SEQ ID NO: 232844 - DNA, 20 bp, P. troglodytes
cgatggctcacgcctgtaat

SEQ ID NO: 232845 - DNA, 16 bp, P. troglodytes
cgatggctcacgtctg

SEQ ID NO: 232846 - DNA, 18 bp, P. troglodytes
cgattctcccatctcagc

SEQ ID NO: 232847 - DNA, 16 bp, P. troglodytes
cgattctccttgcctc

SEQ ID NO: 232848 - DNA, 18 bp, P. troglodytes
cgattgtcctgcctcagc

SEQ ID NO: 232849 - DNA, 16 bp, P. troglodytes
cgattttcctgcttca

SEQ ID NO: 232850 - DNA, 16 bp, P. troglodytes
cgcaaggctgaggcag

SEQ ID NO: 232851 - DNA, 16 bp, P. troglodytes
cgcaatggcacgatct

SEQ ID NO: 232852 - DNA, 16 bp, P. troglodytes
cgcaccgtgcgcgagc

SEQ ID NO: 232853 - DNA, 16 bp, P. troglodytes
cgcaccgtgtgcgagc

SEQ ID NO: 232854 - DNA, 16 bp, P. troglodytes
cgcactccagcctagg

SEQ ID NO: 232855 - DNA, 16 bp, P. troglodytes
cgcactccagcctggg

SEQ ID NO: 232856 - DNA, 16 bp, P. troglodytes
cgcactttgggaggcc

SEQ ID NO: 232857 - DNA, 23 bp, P. troglodytes
cgcactttgggaggctgaggtgg

SEQ ID NO: 232858 - DNA, 16 bp, P. troglodytes
cgcagaccctcgcggt

SEQ ID NO: 232859 - DNA, 16 bp, P. troglodytes
cgcaggctagagtgca

SEQ ID NO: 232860 - DNA, 16 bp, P. troglodytes
cgcagtggcgccatct

SEQ ID NO: 232861 - DNA, 16 bp, P. troglodytes
cgcagtggctcaaacc

SEQ ID NO: 232862 - DNA, 16 bp, P. troglodytes
cgcagtggtgcgatct

SEQ ID NO: 232863 - DNA, 16 bp, P. troglodytes
cgcagtggttcatgcc

SEQ ID NO: 232864 - DNA, 16 bp, P. troglodytes
cgcagtttcgctcttg

SEQ ID NO: 232865 - DNA, 21 bp, P. troglodytes
cgcataaatgtcttcttttga

SEQ ID NO: 232866 - DNA, 16 bp, P. troglodytes
cgcatacacacacaca

SEQ ID NO: 232867 - DNA, 16 bp, P. troglodytes
cgcatatatatatata

SEQ ID NO: 232868 - DNA, 17 bp, P. troglodytes
cgcatctgtagtcccag

SEQ ID NO: 232869 - DNA, 16 bp, P. troglodytes
cgcatgcacacacaca

SEQ ID NO: 232870 - DNA, 16 bp, P. troglodytes
cgcatgtgtgtatgtg

SEQ ID NO: 232871 - DNA, 16 bp, P. troglodytes
cgccaacatggtgaaa

SEQ ID NO: 232872 - DNA, 16 bp, P. troglodytes
cgccacacctggctaa

SEQ ID NO: 232873 - DNA, 17 bp, P. troglodytes
cgccaccacgcctgact

SEQ ID NO: 232874 - DNA, 16 bp, P. troglodytes
cgccaccacgcgcagc

SEQ ID NO: 232875 - DNA, 16 bp, P. troglodytes
cgccaccacgctcagc

SEQ ID NO: 232876 - DNA, 17 bp, P. troglodytes
cgccaccatgtctggct

SEQ ID NO: 232877 - DNA, 16 bp, P. troglodytes
cgccacctcccgggtt

SEQ ID NO: 232878 - DNA, 16 bp, P. troglodytes
cgccactgcacccagc

SEQ ID NO: 232879 - DNA, 16 bp, P. troglodytes
cgccactgcacctggc

SEQ ID NO: 232880 - DNA, 16 bp, P. troglodytes
cgccactgcactccac

SEQ ID NO: 232881 - DNA, 16 bp, P. troglodytes
cgccactgtgcccggc

SEQ ID NO: 232882 - DNA, 16 bp, P. troglodytes
cgccagcctcggcctc

SEQ ID NO: 232883 - DNA, 16 bp, P. troglodytes
cgccagcctggagtgc

SEQ ID NO: 232884 - DNA, 19 bp, P. troglodytes
cgccaggcgcggtggctca

SEQ ID NO: 232885 - DNA, 16 bp, P. troglodytes
cgccaggctggactgc

SEQ ID NO: 232886 - DNA, 16 bp, P. troglodytes
cgccatgtcacccagg

SEQ ID NO: 232887 - DNA, 16 bp, P. troglodytes
cgccatgttggccatg

SEQ ID NO: 232888 - DNA, 16 bp, P. troglodytes
cgccattctaactggc

SEQ ID NO: 232889 - DNA, 16 bp, P. troglodytes
cgccattctcatgcct

SEQ ID NO: 232890 - DNA, 16 bp, P. troglodytes
cgcccacaaccatgcc

SEQ ID NO: 232891 - DNA, 16 bp, P. troglodytes
cgcccaccacacctgg

SEQ ID NO: 232892 - DNA, 16 bp, P. troglodytes
cgcccaccttggcctt

SEQ ID NO: 232893 - DNA, 16 bp, P. troglodytes
cgcccacgtcggcctc

SEQ ID NO: 232894 - DNA, 16 bp, P. troglodytes
cgcccagcctcttctt

SEQ ID NO: 232895 - DNA, 16 bp, P. troglodytes
cgcccagcctctttct

SEQ ID NO: 232896 - DNA, 16 bp, P. troglodytes
cgcccagcctgatttt

SEQ ID NO: 232897 - DNA, 16 bp, P. troglodytes
cgcccagccttttttt

SEQ ID NO: 232898 - DNA, 16 bp, P. troglodytes
cgcccccataatccaa

SEQ ID NO: 232899 - DNA, 16 bp, P. troglodytes
cgcccgcctcggactc

SEQ ID NO: 232900 - DNA, 16 bp, P. troglodytes
cgcccggcctaaattt

SEQ ID NO: 232901 - DNA, 16 bp, P. troglodytes
cgccctgcactccagc

SEQ ID NO: 232902 - DNA, 16 bp, P. troglodytes
cgccgctgcactccag

SEQ ID NO: 232903 - DNA, 16 bp, P. troglodytes
cgccgggtcccccagc

SEQ ID NO: 232904 - DNA, 17 bp, P. troglodytes
cgcctcagcctcccaag

SEQ ID NO: 232905 - DNA, 16 bp, P. troglodytes
cgcctcagcctcctga

SEQ ID NO: 232906 - DNA, 19 bp, P. troglodytes
cgcctcagcctctcaaagt

SEQ ID NO: 232907 - DNA, 16 bp, P. troglodytes
cgcctcaggaccctgt

SEQ ID NO: 232908 - DNA, 16 bp, P. troglodytes
cgcctcagtctcccga

SEQ ID NO: 232909 - DNA, 16 bp, P. troglodytes
cgcctcccaggttgac

SEQ ID NO: 232910 - DNA, 16 bp, P. troglodytes
cgcctccccaagtgct

SEQ ID NO: 232911 - DNA, 16 bp, P. troglodytes
cgcctcctgggctcaa

SEQ ID NO: 232912 - DNA, 16 bp, P. troglodytes
cgcctcggcgtcccaa

SEQ ID NO: 232913 - DNA, 16 bp, P. troglodytes
cgcctgcactcctcag

SEQ ID NO: 232914 - DNA, 16 bp, P. troglodytes
cgcctgcagtctcagc

SEQ ID NO: 232915 - DNA, 17 bp, P. troglodytes
cgcctgcctcagcctcc

SEQ ID NO: 232916 - DNA, 16 bp, P. troglodytes
cgcctgcctctgcctc

SEQ ID NO: 232917 - DNA, 16 bp, P. troglodytes
cgcctgcctgcctgcc

SEQ ID NO: 232918 - DNA, 16 bp, P. troglodytes
cgcctgctgctcacct

SEQ ID NO: 232919 - DNA, 16 bp, P. troglodytes
cgcctggccaattttt

SEQ ID NO: 232920 - DNA, 16 bp, P. troglodytes
cgcctggctcagaggg

SEQ ID NO: 232921 - DNA, 17 bp, P. troglodytes
cgcctgtaatcccagtg

SEQ ID NO: 232922 - DNA, 17 bp, P. troglodytes
cgcctgtaatcgcagct

SEQ ID NO: 232923 - DNA, 16 bp, P. troglodytes
cgcctgtaattgcagc

SEQ ID NO: 232924 - DNA, 16 bp, P. troglodytes
cgcctgtagttgcagc

SEQ ID NO: 232925 - DNA, 16 bp, P. troglodytes
cgcctgtcccctcagt

SEQ ID NO: 232926 - DNA, 16 bp, P. troglodytes
cgcctgtgatcccaga

SEQ ID NO: 232927 - DNA, 17 bp, P. troglodytes
cgcctgtgatctcagca

SEQ ID NO: 232928 - DNA, 16 bp, P. troglodytes
cgccttccaggttcac

SEQ ID NO: 232929 - DNA, 24 bp, P. troglodytes
cgccttggcctcccaaagtgctga

SEQ ID NO: 232930 - DNA, 16 bp, P. troglodytes
cgccttggcctcccag

SEQ ID NO: 232931 - DNA, 17 bp, P. troglodytes
cgccttggcctctcaaa

SEQ ID NO: 232932 - DNA, 16 bp, P. troglodytes
cgcgagactccatctc

SEQ ID NO: 232933 - DNA, 16 bp, P. troglodytes
cgcgaggcggagcttg

SEQ ID NO: 232934 - DNA, 16 bp, P. troglodytes
cgcgagttccgggtgg

SEQ ID NO: 232935 - DNA, 16 bp, P. troglodytes
cgcgcccggcccagag

SEQ ID NO: 232936 - DNA, 16 bp, P. troglodytes
cgcgcccggcccattt

SEQ ID NO: 232937 - DNA, 16 bp, P. troglodytes
cgcgcctggcctgcct

SEQ ID NO: 232938 - DNA, 16 bp, P. troglodytes
cgcgcctggctaattt

SEQ ID NO: 232939 - DNA, 16 bp, P. troglodytes
cgcgcgcacgcacaca

SEQ ID NO: 232940 - DNA, 17 bp, P. troglodytes
cgcgtgccaccatgccc

SEQ ID NO: 232941 - DNA, 16 bp, P. troglodytes
cgcgtggctcacgcct

SEQ ID NO: 232942 - DNA, 16 bp, P. troglodytes
cgcgtgtgtgtgtatg

SEQ ID NO: 232943 - DNA, 16 bp, P. troglodytes
cgctaccatgcccggc

SEQ ID NO: 232944 - DNA, 16 bp, P. troglodytes
cgctagcaagactaat

SEQ ID NO: 232945 - DNA, 16 bp, P. troglodytes
cgctaggattacaggt

SEQ ID NO: 232946 - DNA, 16 bp, P. troglodytes
cgctcaccacaacctc

SEQ ID NO: 232947 - DNA, 18 bp, P. troglodytes
cgctcactgcaagctcca

SEQ ID NO: 232948 - DNA, 16 bp, P. troglodytes
cgctcattgcaacctc

SEQ ID NO: 232949 - DNA, 16 bp, P. troglodytes
cgctcctgtcacccag

SEQ ID NO: 232950 - DNA, 16 bp, P. troglodytes
cgctctgtctccaggc

SEQ ID NO: 232951 - DNA, 16 bp, P. troglodytes
cgctctgtggcccagg

SEQ ID NO: 232952 - DNA, 16 bp, P. troglodytes
cgctcttgtctcccag

SEQ ID NO: 232953 - DNA, 16 bp, P. troglodytes
cgctgacaggccccag

SEQ ID NO: 232954 - DNA, 16 bp, P. troglodytes
cgctgaggctggagtg

SEQ ID NO: 232955 - DNA, 16 bp, P. troglodytes
cgctgcagtccagcct

SEQ ID NO: 232956 - DNA, 16 bp, P. troglodytes
cgctgccctccagcct

SEQ ID NO: 232957 - DNA, 16 bp, P. troglodytes
cgctggagtgcagtgg

SEQ ID NO: 232958 - DNA, 16 bp, P. troglodytes
cgctggctcacgcctg

SEQ ID NO: 232959 - DNA, 16 bp, P. troglodytes
cgctggcttcaggagt

SEQ ID NO: 232960 - DNA, 16 bp, P. troglodytes
cgctgggcatggtggc

SEQ ID NO: 232961 - DNA, 16 bp, P. troglodytes
cgctggtctccaactc

SEQ ID NO: 232962 - DNA, 17 bp, P. troglodytes
cgctggtctcgaactcc

SEQ ID NO: 232963 - DNA, 16 bp, P. troglodytes
cgctgttatttattgg

SEQ ID NO: 232964 - DNA, 16 bp, P. troglodytes
cgcttgaaaccaggag

SEQ ID NO: 232965 - DNA, 16 bp, P. troglodytes
cgcttgaacacaggag

SEQ ID NO: 232966 - DNA, 18 bp, P. troglodytes
cgcttgaaccctggaggt

SEQ ID NO: 232967 - DNA, 16 bp, P. troglodytes
cgcttgaactcaggag

SEQ ID NO: 232968 - DNA, 16 bp, P. troglodytes
cgcttgaatccaggag

SEQ ID NO: 232969 - DNA, 16 bp, P. troglodytes
cgcttgagcctggggg

SEQ ID NO: 232970 - DNA, 16 bp, P. troglodytes
cgcttgagcttaggag

SEQ ID NO: 232971 - DNA, 16 bp, P. troglodytes
cgcttgcacccaggag

SEQ ID NO: 232972 - DNA, 16 bp, P. troglodytes
cgcttgtaatcccagc

SEQ ID NO: 232973 - DNA, 16 bp, P. troglodytes
cgctttctgccatgat

SEQ ID NO: 232974 - DNA, 16 bp, P. troglodytes
cggaacaaagctggac

SEQ ID NO: 232975 - DNA, 16 bp, P. troglodytes
cggaaggctgaggaag

SEQ ID NO: 232976 - DNA, 16 bp, P. troglodytes
cggaaggtggagattg

SEQ ID NO: 232977 - DNA, 16 bp, P. troglodytes
cggacggacggacgga

SEQ ID NO: 232978 - DNA, 16 bp, P. troglodytes
cggacgtggtggtggg

SEQ ID NO: 232979 - DNA, 16 bp, P. troglodytes
cggacttcccagcctc

SEQ ID NO: 232980 - DNA, 16 bp, P. troglodytes
cggagaagtttgatcg

SEQ ID NO: 232981 - DNA, 16 bp, P. troglodytes
cggagcagccagccag

SEQ ID NO: 232982 - DNA, 16 bp, P. troglodytes
cggagcctcactctgt

SEQ ID NO: 232983 - DNA, 16 bp, P. troglodytes
cggaggatgcagtgag

SEQ ID NO: 232984 - DNA, 16 bp, P. troglodytes
cggaggcaggagaatt

SEQ ID NO: 232985 - DNA, 16 bp, P. troglodytes
cggaggctcacgcctg

SEQ ID NO: 232986 - DNA, 16 bp, P. troglodytes
cggaggctgaggcggg

SEQ ID NO: 232987 - DNA, 16 bp, P. troglodytes
cggaggctgcagagag

SEQ ID NO: 232988 - DNA, 16 bp, P. troglodytes
cggaggctgcagcgag

SEQ ID NO: 232989 - DNA, 23 bp, P. troglodytes
cggaggttgtggtgagctgagat

SEQ ID NO: 232990 - DNA, 16 bp, P. troglodytes
cggagtctcattttgt

SEQ ID NO: 232991 - DNA, 21 bp, P. troglodytes
cggagtctcgctctgtcgcca

SEQ ID NO: 232992 - DNA, 16 bp, P. troglodytes
cggagtcttgctctat

SEQ ID NO: 232993 - DNA, 16 bp, P. troglodytes
cggagtttcgctctgt

SEQ ID NO: 232994 - DNA, 17 bp, P. troglodytes
cggagtttctctcttgt

SEQ ID NO: 232995 - DNA, 21 bp, P. troglodytes
cggagtttcttccttctggtg

SEQ ID NO: 232996 - DNA, 17 bp, P. troglodytes
cggatcacttgagatca

SEQ ID NO: 232997 - DNA, 16 bp, P. troglodytes
cggattacaggcatgt

SEQ ID NO: 232998 - DNA, 16 bp, P. troglodytes
cggattctcactctgt

SEQ ID NO: 232999 - DNA, 16 bp, P. troglodytes
cggatttcccccttgc

SEQ ID NO: 233000 - DNA, 19 bp, P. troglodytes
cggcactttgggaggctga

SEQ ID NO: 233001 - DNA, 16 bp, P. troglodytes
cggcagcgaggctggg

SEQ ID NO: 233002 - DNA, 16 bp, P. troglodytes
cggcagctcacgcctg

SEQ ID NO: 233003 - DNA, 17 bp, P. troglodytes
cggccaacatggtaaaa

SEQ ID NO: 233004 - DNA, 16 bp, P. troglodytes
cggccagatgcagtgg

SEQ ID NO: 233005 - DNA, 16 bp, P. troglodytes
cggccagatgcggtgg

SEQ ID NO: 233006 - DNA, 16 bp, P. troglodytes
cggccagccctgctgg

SEQ ID NO: 233007 - DNA, 20 bp, P. troglodytes
cggccaggcacggtggctca

SEQ ID NO: 233008 - DNA, 16 bp, P. troglodytes
cggccctgccaacacc

SEQ ID NO: 233009 - DNA, 16 bp, P. troglodytes
cggcctcagcctcctg

SEQ ID NO: 233010 - DNA, 16 bp, P. troglodytes
cggcctcccagtgtgc

SEQ ID NO: 233011 - DNA, 16 bp, P. troglodytes
cggcctccccaggtgc

SEQ ID NO: 233012 - DNA, 16 bp, P. troglodytes
cggcctctgcctcctg

SEQ ID NO: 233013 - DNA, 16 bp, P. troglodytes
cggcggctcacacctg

SEQ ID NO: 233014 - DNA, 16 bp, P. troglodytes
cggcggctcacgcctg

SEQ ID NO: 233015 - DNA, 17 bp, P. troglodytes
cggcgtgatctcagctc

SEQ ID NO: 233016 - DNA, 16 bp, P. troglodytes
cggctcactgcagcct

SEQ ID NO: 233017 - DNA, 16 bp, P. troglodytes
cggctcactgtagcct

SEQ ID NO: 233018 - DNA, 16 bp, P. troglodytes
cggctcagtgcaacct

SEQ ID NO: 233019 - DNA, 16 bp, P. troglodytes
cggctccagctggtcc

SEQ ID NO: 233020 - DNA, 16 bp, P. troglodytes
cggctctctgcagcct

SEQ ID NO: 233021 - DNA, 16 bp, P. troglodytes
cggctggagtgcagtg

SEQ ID NO: 233022 - DNA, 16 bp, P. troglodytes
cggctggccaggtggg

SEQ ID NO: 233023 - DNA, 16 bp, P. troglodytes
cggctgggaggtggag

SEQ ID NO: 233024 - DNA, 20 bp, P. troglodytes
cggctgggcacggtggctca

SEQ ID NO: 233025 - DNA, 16 bp, P. troglodytes
cggctgggcgaggtgg

SEQ ID NO: 233026 - DNA, 16 bp, P. troglodytes
cgggaactggggctgc

SEQ ID NO: 233027 - DNA, 19 bp, P. troglodytes
cgggaagctgaggcaagag

SEQ ID NO: 233028 - DNA, 16 bp, P. troglodytes
cgggacactgaggcag

SEQ ID NO: 233029 - DNA, 19 bp, P. troglodytes
cgggacccggggatcccac

SEQ ID NO: 233030 - DNA, 16 bp, P. troglodytes
cgggagacagaggcag

SEQ ID NO: 233031 - DNA, 16 bp, P. troglodytes
cgggagacagaggctg

SEQ ID NO: 233032 - DNA, 16 bp, P. troglodytes
cgggagactgaggcag

SEQ ID NO: 233033 - DNA, 16 bp, P. troglodytes
cgggaggatctcttga

SEQ ID NO: 233034 - DNA, 18 bp, P. troglodytes
cgggaggattgcttgagg

SEQ ID NO: 233035 - DNA, 16 bp, P. troglodytes
cgggaggattgcttgg

SEQ ID NO: 233036 - DNA, 16 bp, P. troglodytes
cgggaggcagagctgg

SEQ ID NO: 233037 - DNA, 20 bp, P. troglodytes
cgggaggcagaggttgcact

SEQ ID NO: 233038 - DNA, 16 bp, P. troglodytes
cgggaggccgaggctg

SEQ ID NO: 233039 - DNA, 16 bp, P. troglodytes
cgggaggcggagctgg

SEQ ID NO: 233040 - DNA, 21 bp, P. troglodytes
cgggaggcggaggctgcagtg

SEQ ID NO: 233041 - DNA, 16 bp, P. troglodytes
cgggaggctgaaatgg

SEQ ID NO: 233042 - DNA, 16 bp, P. troglodytes
cgggaggctgagatga

SEQ ID NO: 233043 - DNA, 16 bp, P. troglodytes
cgggaggctgagctgg

SEQ ID NO: 233044 - DNA, 16 bp, P. troglodytes
cgggaggctgaggcac

SEQ ID NO: 233045 - DNA, 16 bp, P. troglodytes
cgggaggctgaggcca

SEQ ID NO: 233046 - DNA, 16 bp, P. troglodytes
cgggaggctgaggcct

SEQ ID NO: 233047 - DNA, 16 bp, P. troglodytes
cgggaggctgagtcag

SEQ ID NO: 233048 - DNA, 16 bp, P. troglodytes
cgggagtggtggcgca

SEQ ID NO: 233049 - DNA, 16 bp, P. troglodytes
cgggagttcgacacca

SEQ ID NO: 233050 - DNA, 20 bp, P. troglodytes
cgggattacaggcatgcacc

SEQ ID NO: 233051 - DNA, 16 bp, P. troglodytes
cgggattacaggcgcc

SEQ ID NO: 233052 - DNA, 16 bp, P. troglodytes
cgggcaaaaagagcca

SEQ ID NO: 233053 - DNA, 16 bp, P. troglodytes
cgggcacagcagctca

SEQ ID NO: 233054 - DNA, 16 bp, P. troglodytes
cgggcaccaccacacc

SEQ ID NO: 233055 - DNA, 17 bp, P. troglodytes
cgggcagataacctgag

SEQ ID NO: 233056 - DNA, 16 bp, P. troglodytes
cgggcagcccccagaa

SEQ ID NO: 233057 - DNA, 16 bp, P. troglodytes
cgggcatggtggctca

SEQ ID NO: 233058 - DNA, 17 bp, P. troglodytes
cgggcatggtggctcat

SEQ ID NO: 233059 - DNA, 18 bp, P. troglodytes
cgggcatggtggtgggca

SEQ ID NO: 233060 - DNA, 17 bp, P. troglodytes
cgggcatggtggtgtgt

SEQ ID NO: 233061 - DNA, 16 bp, P. troglodytes
cgggccaggcacagtg

SEQ ID NO: 233062 - DNA, 17 bp, P. troglodytes
cgggcgcagtggcttac

SEQ ID NO: 233063 - DNA, 16 bp, P. troglodytes
cgggcgcgggggctca

SEQ ID NO: 233064 - DNA, 16 bp, P. troglodytes
cgggcgtgctggcagg

SEQ ID NO: 233065 - DNA, 17 bp, P. troglodytes
cgggcgtggtggcgcac

SEQ ID NO: 233066 - DNA, 16 bp, P. troglodytes
cggggaggagccaaga

SEQ ID NO: 233067 - DNA, 16 bp, P. troglodytes
cggggaggcctcagga

SEQ ID NO: 233068 - DNA, 16 bp, P. troglodytes
cggggaggctccggcc

SEQ ID NO: 233069 - DNA, 16 bp, P. troglodytes
cggggctgaggtggga

SEQ ID NO: 233070 - DNA, 16 bp, P. troglodytes
cggggctgcaggtgga

SEQ ID NO: 233071 - DNA, 16 bp, P. troglodytes
cgggggctcacgcctg

SEQ ID NO: 233072 - DNA, 17 bp, P. troglodytes
cgggggctcatgcctgt

SEQ ID NO: 233073 - DNA, 16 bp, P. troglodytes
cgggggctgaggcagg

SEQ ID NO: 233074 - DNA, 16 bp, P. troglodytes
cgggggtctccctatg

SEQ ID NO: 233075 - DNA, 16 bp, P. troglodytes
cgggggtttcactatg

SEQ ID NO: 233076 - DNA, 16 bp, P. troglodytes
cggggtggcggccagg

SEQ ID NO: 233077 - DNA, 26 bp, P. troglodytes
cggggtttcaccatgttagccaggct

SEQ ID NO: 233078 - DNA, 23 bp, P. troglodytes
cggggtttcaccatgttggccaa

SEQ ID NO: 233079 - DNA, 17 bp, P. troglodytes
cggggtttcttcatgtt

SEQ ID NO: 233080 - DNA, 16 bp, P. troglodytes
cgggtgatgggtgcac

SEQ ID NO: 233081 - DNA, 18 bp, P. troglodytes
cgggtgcacagaagtcaa

SEQ ID NO: 233082 - DNA, 16 bp, P. troglodytes
cgggtgcagtggctca

SEQ ID NO: 233083 - DNA, 16 bp, P. troglodytes
cgggtgccatggctca

SEQ ID NO: 233084 - DNA, 16 bp, P. troglodytes
cgggtgccttcccagg

SEQ ID NO: 233085 - DNA, 16 bp, P. troglodytes
cgggtgcggcggctca

SEQ ID NO: 233086 - DNA, 17 bp, P. troglodytes
cgggtggatcacttgag

SEQ ID NO: 233087 - DNA, 18 bp, P. troglodytes
cgggtggatcacttgaga

SEQ ID NO: 233088 - DNA, 17 bp, P. troglodytes
cgggtgtggtggtgcac

SEQ ID NO: 233089 - DNA, 18 bp, P. troglodytes
cgggttttcaccatgttg

SEQ ID NO: 233090 - DNA, 16 bp, P. troglodytes
cgggttttgccatgtt

SEQ ID NO: 233091 - DNA, 16 bp, P. troglodytes
cggtagctcatgcctg

SEQ ID NO: 233092 - DNA, 16 bp, P. troglodytes
cggtagttcacgcctg

SEQ ID NO: 233093 - DNA, 16 bp, P. troglodytes
cggtcaccttcccagc

SEQ ID NO: 233094 - DNA, 16 bp, P. troglodytes
cggtcgctcatgcctg

SEQ ID NO: 233095 - DNA, 16 bp, P. troglodytes
cggtctcctgaccttg

SEQ ID NO: 233096 - DNA, 27 bp, P. troglodytes
cggtgaaaccccatctctactaaaaaa

SEQ ID NO: 233097 - DNA, 21 bp, P. troglodytes
cggtgaaaccccgtctctagt

SEQ ID NO: 233098 - DNA, 16 bp, P. troglodytes
cggtgactcacacctg

SEQ ID NO: 233099 - DNA, 16 bp, P. troglodytes
cggtgactcacgcctg

SEQ ID NO: 233100 - DNA, 16 bp, P. troglodytes
cggtgactcatgcctg

SEQ ID NO: 233101 - DNA, 16 bp, P. troglodytes
cggtgagtgttacagt

SEQ ID NO: 233102 - DNA, 16 bp, P. troglodytes
cggtgcaagctgttgg

SEQ ID NO: 233103 - DNA, 16 bp, P. troglodytes
cggtgcatgcagcccc

SEQ ID NO: 233104 - DNA, 16 bp, P. troglodytes
cggtgcctcacgcctg

SEQ ID NO: 233105 - DNA, 16 bp, P. troglodytes
cggtggcacacgcctg

SEQ ID NO: 233106 - DNA, 19 bp, P. troglodytes
cggtggctcaagcctgtaa

SEQ ID NO: 233107 - DNA, 16 bp, P. troglodytes
cggtggctcacacctg

SEQ ID NO: 233108 - DNA, 16 bp, P. troglodytes
cggtggctcacacttg

SEQ ID NO: 233109 - DNA, 18 bp, P. troglodytes
cggtggctcacatctgta

SEQ ID NO: 233110 - DNA, 16 bp, P. troglodytes
cggtggctcacccctg

SEQ ID NO: 233111 - DNA, 16 bp, P. troglodytes
cggtggctcacgccag

SEQ ID NO: 233112 - DNA, 16 bp, P. troglodytes
cggtggctcacgccgg

SEQ ID NO: 233113 - DNA, 16 bp, P. troglodytes
cggtggctcacgcctg

SEQ ID NO: 233114 - DNA, 16 bp, P. troglodytes
cggtggctcacgcttg

SEQ ID NO: 233115 - DNA, 16 bp, P. troglodytes
cggtggctcacgtctg

SEQ ID NO: 233116 - DNA, 16 bp, P. troglodytes
cggtggctcactcctg

SEQ ID NO: 233117 - DNA, 16 bp, P. troglodytes
cggtggctcacttctg

SEQ ID NO: 233118 - DNA, 16 bp, P. troglodytes
cggtggctcaggcctg

SEQ ID NO: 233119 - DNA, 16 bp, P. troglodytes
cggtggctcatgccta

SEQ ID NO: 233120 - DNA, 16 bp, P. troglodytes
cggtggctcatgcctg

SEQ ID NO: 233121 - DNA, 16 bp, P. troglodytes
cggtggctcatgcttg

SEQ ID NO: 233122 - DNA, 16 bp, P. troglodytes
cggtggctcccgcctg

SEQ ID NO: 233123 - DNA, 16 bp, P. troglodytes
cggtggctcgcgcctg

SEQ ID NO: 233124 - DNA, 16 bp, P. troglodytes
cggtggctgacgcctg

SEQ ID NO: 233125 - DNA, 16 bp, P. troglodytes
cggtggcttacacctg

SEQ ID NO: 233126 - DNA, 16 bp, P. troglodytes
cggtggcttatgcctg

SEQ ID NO: 233127 - DNA, 16 bp, P. troglodytes
cggtgggtcatgcctg

SEQ ID NO: 233128 - DNA, 16 bp, P. troglodytes
cggtgggttcgtggtc

SEQ ID NO: 233129 - DNA, 17 bp, P. troglodytes
cggtgggttcgtggtct

SEQ ID NO: 233130 - DNA, 16 bp, P. troglodytes
cggtggttcacacctg

SEQ ID NO: 233131 - DNA, 20 bp, P. troglodytes
cggtggttcacgcctgtaat

SEQ ID NO: 233132 - DNA, 16 bp, P. troglodytes
cggtggttcatgcctg

SEQ ID NO: 233133 - DNA, 16 bp, P. troglodytes
cggtggttgcagtgag

SEQ ID NO: 233134 - DNA, 19 bp, P. troglodytes
cggttgcagtgagccaaga

SEQ ID NO: 233135 - DNA, 16 bp, P. troglodytes
cggttgctcacgcctg

SEQ ID NO: 233136 - DNA, 16 bp, P. troglodytes
cgtaaagtgctgggat

SEQ ID NO: 233137 - DNA, 16 bp, P. troglodytes
cgtaatcccagctact

SEQ ID NO: 233138 - DNA, 16 bp, P. troglodytes
cgtactccagcctggg

SEQ ID NO: 233139 - DNA, 16 bp, P. troglodytes
cgtactctagcctggg

SEQ ID NO: 233140 - DNA, 16 bp, P. troglodytes
cgtagctactcaggag

SEQ ID NO: 233141 - DNA, 16 bp, P. troglodytes
cgtagctgggactaca

SEQ ID NO: 233142 - DNA, 16 bp, P. troglodytes
cgtagtcccagctact

SEQ ID NO: 233143 - DNA, 16 bp, P. troglodytes
cgtcaccatgcccagc

SEQ ID NO: 233144 - DNA, 16 bp, P. troglodytes
cgtcactgcactccag

SEQ ID NO: 233145 - DNA, 16 bp, P. troglodytes
cgtcaggaagttaccc

SEQ ID NO: 233146 - DNA, 16 bp, P. troglodytes
cgtcaggagttcaaga

SEQ ID NO: 233147 - DNA, 16 bp, P. troglodytes
cgtcagggataagaac

SEQ ID NO: 233148 - DNA, 17 bp, P. troglodytes
cgtccacctcggcctcc

SEQ ID NO: 233149 - DNA, 16 bp, P. troglodytes
cgtcccccagcctgac

SEQ ID NO: 233150 - DNA, 16 bp, P. troglodytes
cgtcccccaggctgga

SEQ ID NO: 233151 - DNA, 16 bp, P. troglodytes
cgtcctgggctgcatg

SEQ ID NO: 233152 - DNA, 16 bp, P. troglodytes
cgtcctgggttcaagc

SEQ ID NO: 233153 - DNA, 16 bp, P. troglodytes
cgtctataatcccagc

SEQ ID NO: 233154 - DNA, 16 bp, P. troglodytes
cgtctcaaaaaaaaaa

SEQ ID NO: 233155 - DNA, 16 bp, P. troglodytes
cgtctctgcctggctg

SEQ ID NO: 233156 - DNA, 16 bp, P. troglodytes
cgtctgcctcccaggt

SEQ ID NO: 233157 - DNA, 16 bp, P. troglodytes
cgtgaaccaccatgcc

SEQ ID NO: 233158 - DNA, 16 bp, P. troglodytes
cgtgagactccatctc

SEQ ID NO: 233159 - DNA, 16 bp, P. troglodytes
cgtgagccaagatcac

SEQ ID NO: 233160 - DNA, 16 bp, P. troglodytes
cgtgagccacaacgcc

SEQ ID NO: 233161 - DNA, 16 bp, P. troglodytes
cgtgagccacaatgcc

SEQ ID NO: 233162 - DNA, 22 bp, P. troglodytes
cgtgagccactgcacccggcca

SEQ ID NO: 233163 - DNA, 16 bp, P. troglodytes
cgtgagccatcgcacc

SEQ ID NO: 233164 - DNA, 16 bp, P. troglodytes
cgtgagccatcgcgcc

SEQ ID NO: 233165 - DNA, 16 bp, P. troglodytes
cgtgagtgacacagaa

SEQ ID NO: 233166 - DNA, 16 bp, P. troglodytes
cgtgatccgcctgctt

SEQ ID NO: 233167 - DNA, 16 bp, P. troglodytes
cgtgatcctcctgcct

SEQ ID NO: 233168 - DNA, 16 bp, P. troglodytes
cgtgatctcagttcac

SEQ ID NO: 233169 - DNA, 16 bp, P. troglodytes
cgtgatgttggctcac

SEQ ID NO: 233170 - DNA, 18 bp, P. troglodytes
cgtgcaccaccatgccca

SEQ ID NO: 233171 - DNA, 16 bp, P. troglodytes
cgtgcaccagcatgcc

SEQ ID NO: 233172 - DNA, 16 bp, P. troglodytes
cgtgccaccacacctg

SEQ ID NO: 233173 - DNA, 17 bp, P. troglodytes
cgtgccactgcacccca

SEQ ID NO: 233174 - DNA, 16 bp, P. troglodytes
cgtgcccagccttgtt

SEQ ID NO: 233175 - DNA, 16 bp, P. troglodytes
cgtgccccagcctccc

SEQ ID NO: 233176 - DNA, 16 bp, P. troglodytes
cgtgcctatagtccca

SEQ ID NO: 233177 - DNA, 16 bp, P. troglodytes
cgtgcctcggcctccc

SEQ ID NO: 233178 - DNA, 16 bp, P. troglodytes
cgtgcctggcctggat

SEQ ID NO: 233179 - DNA, 16 bp, P. troglodytes
cgtgcctggctaattt

SEQ ID NO: 233180 - DNA, 16 bp, P. troglodytes
cgtgcctgtaatctca

SEQ ID NO: 233181 - DNA, 16 bp, P. troglodytes
cgtgcgtgtgcgtgtg

SEQ ID NO: 233182 - DNA, 16 bp, P. troglodytes
cgtgctggcagtcctc

SEQ ID NO: 233183 - DNA, 16 bp, P. troglodytes
cgtgctggcgggcacc

SEQ ID NO: 233184 - DNA, 16 bp, P. troglodytes
cgtgctgggattatag

SEQ ID NO: 233185 - DNA, 16 bp, P. troglodytes
cgtggaggctcacgcc

SEQ ID NO: 233186 - DNA, 16 bp, P. troglodytes
cgtggcaaaactccat

SEQ ID NO: 233187 - DNA, 16 bp, P. troglodytes
cgtggcagtgggcacc

SEQ ID NO: 233188 - DNA, 19 bp, P. troglodytes
cgtggctcacacctgtaat

SEQ ID NO: 233189 - DNA, 16 bp, P. troglodytes
cgtggctggagaggcc

SEQ ID NO: 233190 - DNA, 16 bp, P. troglodytes
cgtggctggggaggcc

SEQ ID NO: 233191 - DNA, 16 bp, P. troglodytes
cgtgggcaacatggtg

SEQ ID NO: 233192 - DNA, 16 bp, P. troglodytes
cgtgggccactgtgcc

SEQ ID NO: 233193 - DNA, 16 bp, P. troglodytes
cgtgggctcctgtgcg

SEQ ID NO: 233194 - DNA, 16 bp, P. troglodytes
cgtgggcttggtgggc

SEQ ID NO: 233195 - DNA, 16 bp, P. troglodytes
cgtggtctcgctgact

SEQ ID NO: 233196 - DNA, 16 bp, P. troglodytes
cgtggtcttgctgact

SEQ ID NO: 233197 - DNA, 16 bp, P. troglodytes
cgtggtgaaaccctgt

SEQ ID NO: 233198 - DNA, 16 bp, P. troglodytes
cgtggtgctgggcgcc

SEQ ID NO: 233199 - DNA, 16 bp, P. troglodytes
cgtggtggatcacgcc

SEQ ID NO: 233200 - DNA, 16 bp, P. troglodytes
cgtggtggcgctcgcc

SEQ ID NO: 233201 - DNA, 16 bp, P. troglodytes
cgtggtggctggtgcc

SEQ ID NO: 233202 - DNA, 16 bp, P. troglodytes
cgtggtggtgcctgcc

SEQ ID NO: 233203 - DNA, 16 bp, P. troglodytes
cgtggtggtgtgggcc

SEQ ID NO: 233204 - DNA, 16 bp, P. troglodytes
cgtgtctctaccaaaa

SEQ ID NO: 233205 - DNA, 16 bp, P. troglodytes
cgtgtgccaccacact

SEQ ID NO: 233206 - DNA, 16 bp, P. troglodytes
cgtgtgcctgtgtgtg

SEQ ID NO: 233207 - DNA, 16 bp, P. troglodytes
cgtgtgcgtgtgcgtg

SEQ ID NO: 233208 - DNA, 16 bp, P. troglodytes
cgtgtgcgtgtgtgcg

SEQ ID NO: 233209 - DNA, 16 bp, P. troglodytes
cgtgtgtgcatgtgtg

SEQ ID NO: 233210 - DNA, 16 bp, P. troglodytes
cgtgtgtgcgtgtgtg

SEQ ID NO: 233211 - DNA, 16 bp, P. troglodytes
cgtgtgtgtgagtgtg

SEQ ID NO: 233212 - DNA, 16 bp, P. troglodytes
cgtgtgtgtgcgcgtg

SEQ ID NO: 233213 - DNA, 16 bp, P. troglodytes
cgtgtgtgtgtgtatt

SEQ ID NO: 233214 - DNA, 17 bp, P. troglodytes
cgtgtgtgtgtgtgcgc

SEQ ID NO: 233215 - DNA, 16 bp, P. troglodytes
cgtgtgtgtgtgtgta

SEQ ID NO: 233216 - DNA, 16 bp, P. troglodytes
cgtgttcatagcagca

SEQ ID NO: 233217 - DNA, 16 bp, P. troglodytes
cgtgttctcactcata

SEQ ID NO: 233218 - DNA, 16 bp, P. troglodytes
cgtgtttgtggtgatg

SEQ ID NO: 233219 - DNA, 16 bp, P. troglodytes
cgttcaaaccatagca

SEQ ID NO: 233220 - DNA, 17 bp, P. troglodytes
cgttgcactccagcctg

SEQ ID NO: 233221 - DNA, 16 bp, P. troglodytes
cgttggctcatgcctg

SEQ ID NO: 233222 - DNA, 16 bp, P. troglodytes
cgttgtggaagacagt

SEQ ID NO: 233223 - DNA, 16 bp, P. troglodytes
cgtttgagctcaggag

SEQ ID NO: 233224 - DNA, 16 bp, P. troglodytes
cgtttgttttttgaga

SEQ ID NO: 233225 - DNA, 16 bp, P. troglodytes
ctaaaaaaagagagag

SEQ ID NO: 233226 - DNA, 16 bp, P. troglodytes
ctaaaaaatgtacata

SEQ ID NO: 233227 - DNA, 16 bp, P. troglodytes
ctaaaaaccctagaag

SEQ ID NO: 233228 - DNA, 16 bp, P. troglodytes
ctaaaaagaaacccca

SEQ ID NO: 233229 - DNA, 16 bp, P. troglodytes
ctaaaaagaaattatt

SEQ ID NO: 233230 - DNA, 16 bp, P. troglodytes
ctaaaaaggggaggaa

SEQ ID NO: 233231 - DNA, 16 bp, P. troglodytes
ctaaaaatacaaagag

SEQ ID NO: 233232 - DNA, 16 bp, P. troglodytes
ctaaaaatagagaaat

SEQ ID NO: 233233 - DNA, 16 bp, P. troglodytes
ctaaaaatagcaaaat

SEQ ID NO: 233234 - DNA, 16 bp, P. troglodytes
ctaaaaatgcaaaact

SEQ ID NO: 233235 - DNA, 16 bp, P. troglodytes
ctaaaaatgtgaaagt

SEQ ID NO: 233236 - DNA, 16 bp, P. troglodytes
ctaaaactatttttaa

SEQ ID NO: 233237 - DNA, 16 bp, P. troglodytes
ctaaaactttcctaaa

SEQ ID NO: 233238 - DNA, 16 bp, P. troglodytes
ctaaaagagaggattt

SEQ ID NO: 233239 - DNA, 16 bp, P. troglodytes
ctaaaaggaaaattca

SEQ ID NO: 233240 - DNA, 16 bp, P. troglodytes
ctaaaaggggccaatg

SEQ ID NO: 233241 - DNA, 16 bp, P. troglodytes
ctaaaagtagaaaaat

SEQ ID NO: 233242 - DNA, 16 bp, P. troglodytes
ctaaaagtattcctta

SEQ ID NO: 233243 - DNA, 16 bp, P. troglodytes
ctaaaagtggaattgc

SEQ ID NO: 233244 - DNA, 16 bp, P. troglodytes
ctaaaagtttgaaaaa

SEQ ID NO: 233245 - DNA, 16 bp, P. troglodytes
ctaaaataaaagttta

SEQ ID NO: 233246 - DNA, 16 bp, P. troglodytes
ctaaaataaaagtttt

SEQ ID NO: 233247 - DNA, 16 bp, P. troglodytes
ctaaaataaatgtttt

SEQ ID NO: 233248 - DNA, 16 bp, P. troglodytes
ctaaaataactttttt

SEQ ID NO: 233249 - DNA, 16 bp, P. troglodytes
ctaaaatacaagaaat

SEQ ID NO: 233250 - DNA, 16 bp, P. troglodytes
ctaaaatataagctcc

SEQ ID NO: 233251 - DNA, 16 bp, P. troglodytes
ctaaaatatttacttt

SEQ ID NO: 233252 - DNA, 16 bp, P. troglodytes
ctaaaatatttgctat

SEQ ID NO: 233253 - DNA, 16 bp, P. troglodytes
ctaaaatgtataaaat

SEQ ID NO: 233254 - DNA, 16 bp, P. troglodytes
ctaaaatgttttttaa

SEQ ID NO: 233255 - DNA, 16 bp, P. troglodytes
ctaaaattagaaaaat

SEQ ID NO: 233256 - DNA, 16 bp, P. troglodytes
ctaaaattcttatgga

SEQ ID NO: 233257 - DNA, 16 bp, P. troglodytes
ctaaacaacagatttt

SEQ ID NO: 233258 - DNA, 16 bp, P. troglodytes
ctaaacactgctttaa

SEQ ID NO: 233259 - DNA, 17 bp, P. troglodytes
ctaaacatggaaaggaa

SEQ ID NO: 233260 - DNA, 16 bp, P. troglodytes
ctaaaccattaatgag

SEQ ID NO: 233261 - DNA, 16 bp, P. troglodytes
ctaaaccattcatgag

SEQ ID NO: 233262 - DNA, 16 bp, P. troglodytes
ctaaactgtcttccaa

SEQ ID NO: 233263 - DNA, 16 bp, P. troglodytes
ctaaagaaaattattt

SEQ ID NO: 233264 - DNA, 16 bp, P. troglodytes
ctaaagaaatacctga

SEQ ID NO: 233265 - DNA, 16 bp, P. troglodytes
ctaaagaagataaaca

SEQ ID NO: 233266 - DNA, 16 bp, P. troglodytes
ctaaagacataagtga

SEQ ID NO: 233267 - DNA, 16 bp, P. troglodytes
ctaaagactcctccaa

SEQ ID NO: 233268 - DNA, 16 bp, P. troglodytes
ctaaagagcttttgta

SEQ ID NO: 233269 - DNA, 16 bp, P. troglodytes
ctaaagatacaaaatt

SEQ ID NO: 233270 - DNA, 16 bp, P. troglodytes
ctaaagatttttttta

SEQ ID NO: 233271 - DNA, 16 bp, P. troglodytes
ctaaagcagtgtgtag

SEQ ID NO: 233272 - DNA, 16 bp, P. troglodytes
ctaaaggctgggaagt

SEQ ID NO: 233273 - DNA, 16 bp, P. troglodytes
ctaaagggaaaagtca

SEQ ID NO: 233274 - DNA, 16 bp, P. troglodytes
ctaaaggtttgttgat

SEQ ID NO: 233275 - DNA, 16 bp, P. troglodytes
ctaaagtctattttgt

SEQ ID NO: 233276 - DNA, 16 bp, P. troglodytes
ctaaagtttgaaaacc

SEQ ID NO: 233277 - DNA, 16 bp, P. troglodytes
ctaaataaatgtttta

SEQ ID NO: 233278 - DNA, 16 bp, P. troglodytes
ctaaataatacagtat

SEQ ID NO: 233279 - DNA, 16 bp, P. troglodytes
ctaaatacttcagtgt

SEQ ID NO: 233280 - DNA, 16 bp, P. troglodytes
ctaaatatatgtatat

SEQ ID NO: 233281 - DNA, 16 bp, P. troglodytes
ctaaatatcccaatta

SEQ ID NO: 233282 - DNA, 16 bp, P. troglodytes
ctaaatatgtacaatt

SEQ ID NO: 233283 - DNA, 16 bp, P. troglodytes
ctaaatattttaaatg

SEQ ID NO: 233284 - DNA, 16 bp, P. troglodytes
ctaaatattttaagcc

SEQ ID NO: 233285 - DNA, 16 bp, P. troglodytes
ctaaatccaatgacta

SEQ ID NO: 233286 - DNA, 16 bp, P. troglodytes
ctaaatcttaaaacaa

SEQ ID NO: 233287 - DNA, 16 bp, P. troglodytes
ctaaatgaaaattaaa

SEQ ID NO: 233288 - DNA, 16 bp, P. troglodytes
ctaaatgatgggaaca

SEQ ID NO: 233289 - DNA, 16 bp, P. troglodytes
ctaaatgcccaaaaga

SEQ ID NO: 233290 - DNA, 16 bp, P. troglodytes
ctaaatgcccatcatt

SEQ ID NO: 233291 - DNA, 16 bp, P. troglodytes
ctaaatgcctacatta

SEQ ID NO: 233292 - DNA, 16 bp, P. troglodytes
ctaaatgtaatagtct

SEQ ID NO: 233293 - DNA, 16 bp, P. troglodytes
ctaaattcagtctttt

SEQ ID NO: 233294 - DNA, 16 bp, P. troglodytes
ctaaattttgcatttt

SEQ ID NO: 233295 - DNA, 16 bp, P. troglodytes
ctaaatttttttccaa

SEQ ID NO: 233296 - DNA, 16 bp, P. troglodytes
ctaacaagttagcctg

SEQ ID NO: 233297 - DNA, 16 bp, P. troglodytes
ctaacagaacaaaaag

SEQ ID NO: 233298 - DNA, 16 bp, P. troglodytes
ctaacagacatttata

SEQ ID NO: 233299 - DNA, 16 bp, P. troglodytes
ctaacatccagaatct

SEQ ID NO: 233300 - DNA, 16 bp, P. troglodytes
ctaacatgaagaaacc

SEQ ID NO: 233301 - DNA, 16 bp, P. troglodytes
ctaacattgaagtctt

SEQ ID NO: 233302 - DNA, 16 bp, P. troglodytes
ctaacatttattgaat

SEQ ID NO: 233303 - DNA, 16 bp, P. troglodytes
ctaacatttattgagt

SEQ ID NO: 233304 - DNA, 16 bp, P. troglodytes
ctaaccataaaagaaa

SEQ ID NO: 233305 - DNA, 16 bp, P. troglodytes
ctaacccaaagcaagg

SEQ ID NO: 233306 - DNA, 16 bp, P. troglodytes
ctaacccaatgcaaag

SEQ ID NO: 233307 - DNA, 16 bp, P. troglodytes
ctaacccaatgcaagg

SEQ ID NO: 233308 - DNA, 16 bp, P. troglodytes
ctaactagaataacca

SEQ ID NO: 233309 - DNA, 16 bp, P. troglodytes
ctaactcataggcagt

SEQ ID NO: 233310 - DNA, 16 bp, P. troglodytes
ctaactgtgtgacctt

SEQ ID NO: 233311 - DNA, 16 bp, P. troglodytes
ctaacttgctgtgtga

SEQ ID NO: 233312 - DNA, 16 bp, P. troglodytes
ctaactttgggagaaa

SEQ ID NO: 233313 - DNA, 16 bp, P. troglodytes
ctaacttttgaatttt

SEQ ID NO: 233314 - DNA, 16 bp, P. troglodytes
ctaagaaagaaagaga

SEQ ID NO: 233315 - DNA, 16 bp, P. troglodytes
ctaagaaatctttgcc

SEQ ID NO: 233316 - DNA, 16 bp, P. troglodytes
ctaagaagaaagttca

SEQ ID NO: 233317 - DNA, 16 bp, P. troglodytes
ctaagaataattggca

SEQ ID NO: 233318 - DNA, 19 bp, P. troglodytes
ctaagacacataattgtca

SEQ ID NO: 233319 - DNA, 16 bp, P. troglodytes
ctaagagaatgaaaag

SEQ ID NO: 233320 - DNA, 16 bp, P. troglodytes
ctaagagaggtgagga

SEQ ID NO: 233321 - DNA, 16 bp, P. troglodytes
ctaagagatatctgca

SEQ ID NO: 233322 - DNA, 16 bp, P. troglodytes
ctaagaggaaaaaatg

SEQ ID NO: 233323 - DNA, 16 bp, P. troglodytes
ctaagatttttgactc

SEQ ID NO: 233324 - DNA, 16 bp, P. troglodytes
ctaagcaaaaagaaca

SEQ ID NO: 233325 - DNA, 16 bp, P. troglodytes
ctaagcaaattaacag

SEQ ID NO: 233326 - DNA, 16 bp, P. troglodytes
ctaagcactttacata

SEQ ID NO: 233327 - DNA, 16 bp, P. troglodytes
ctaagcctagtaccca

SEQ ID NO: 233328 - DNA, 16 bp, P. troglodytes
ctaagctatgagaaca

SEQ ID NO: 233329 - DNA, 16 bp, P. troglodytes
ctaagcttgtgggagt

SEQ ID NO: 233330 - DNA, 16 bp, P. troglodytes
ctaaggaggctgaagc

SEQ ID NO: 233331 - DNA, 16 bp, P. troglodytes
ctaaggcaggaggatc

SEQ ID NO: 233332 - DNA, 16 bp, P. troglodytes
ctaaggcagtgtggaa

SEQ ID NO: 233333 - DNA, 16 bp, P. troglodytes
ctaaggctcagagagg

SEQ ID NO: 233334 - DNA, 16 bp, P. troglodytes
ctaaggctgggcacag

SEQ ID NO: 233335 - DNA, 17 bp, P. troglodytes
ctaagggtgaaggagaa

SEQ ID NO: 233336 - DNA, 16 bp, P. troglodytes
ctaaggtgggaggatc

SEQ ID NO: 233337 - DNA, 16 bp, P. troglodytes
ctaaggttcagagagg

SEQ ID NO: 233338 - DNA, 16 bp, P. troglodytes
ctaagtaaatggaaag

SEQ ID NO: 233339 - DNA, 16 bp, P. troglodytes
ctaagtaatttctttt

SEQ ID NO: 233340 - DNA, 16 bp, P. troglodytes
ctaagtacagctaaaa

SEQ ID NO: 233341 - DNA, 17 bp, P. troglodytes
ctaagtcagagtctcct

SEQ ID NO: 233342 - DNA, 16 bp, P. troglodytes
ctaagtgaaaaaagcc

SEQ ID NO: 233343 - DNA, 16 bp, P. troglodytes
ctaagtgaagtcactc

SEQ ID NO: 233344 - DNA, 16 bp, P. troglodytes
ctaagtgagaaaagcc

SEQ ID NO: 233345 - DNA, 16 bp, P. troglodytes
ctaagtgcagtggctc

SEQ ID NO: 233346 - DNA, 16 bp, P. troglodytes
ctaagtgctgggatta

SEQ ID NO: 233347 - DNA, 16 bp, P. troglodytes
ctaagtgctttatgtg

SEQ ID NO: 233348 - DNA, 16 bp, P. troglodytes
ctaagtgttcaaatga

SEQ ID NO: 233349 - DNA, 16 bp, P. troglodytes
ctaagtgttgggatta

SEQ ID NO: 233350 - DNA, 16 bp, P. troglodytes
ctaagtttatttattt

SEQ ID NO: 233351 - DNA, 16 bp, P. troglodytes
ctaataaagaagaaga

SEQ ID NO: 233352 - DNA, 16 bp, P. troglodytes
ctaataatatttgttt

SEQ ID NO: 233353 - DNA, 16 bp, P. troglodytes
ctaatacaatgtaaat

SEQ ID NO: 233354 - DNA, 16 bp, P. troglodytes
ctaatacagtaaatat

SEQ ID NO: 233355 - DNA, 16 bp, P. troglodytes
ctaatactgtattttt

SEQ ID NO: 233356 - DNA, 16 bp, P. troglodytes
ctaatagagaagaaaa

SEQ ID NO: 233357 - DNA, 16 bp, P. troglodytes
ctaatagcctactatt

SEQ ID NO: 233358 - DNA, 16 bp, P. troglodytes
ctaatataaatgatga

SEQ ID NO: 233359 - DNA, 16 bp, P. troglodytes
ctaatatatactatat

SEQ ID NO: 233360 - DNA, 16 bp, P. troglodytes
ctaatatccagaagct

SEQ ID NO: 233361 - DNA, 16 bp, P. troglodytes
ctaatattcaacattc

SEQ ID NO: 233362 - DNA, 16 bp, P. troglodytes
ctaatattttattgag

SEQ ID NO: 233363 - DNA, 16 bp, P. troglodytes
ctaatcagagactcaa

SEQ ID NO: 233364 - DNA, 16 bp, P. troglodytes
ctaatcagctgacttt

SEQ ID NO: 233365 - DNA, 16 bp, P. troglodytes
ctaatcagtagttcac

SEQ ID NO: 233366 - DNA, 16 bp, P. troglodytes
ctaatcatgagaaaaa

SEQ ID NO: 233367 - DNA, 16 bp, P. troglodytes
ctaatcccattcatga

SEQ ID NO: 233368 - DNA, 16 bp, P. troglodytes
ctaatcccatttatga

SEQ ID NO: 233369 - DNA, 16 bp, P. troglodytes
ctaatctgaaaattca

SEQ ID NO: 233370 - DNA, 16 bp, P. troglodytes
ctaatctgcacattgt

SEQ ID NO: 233371 - DNA, 16 bp, P. troglodytes
ctaatcttgtagctaa

SEQ ID NO: 233372 - DNA, 16 bp, P. troglodytes
ctaatcttgtattttt

SEQ ID NO: 233373 - DNA, 16 bp, P. troglodytes
ctaatgatcatctgaa

SEQ ID NO: 233374 - DNA, 16 bp, P. troglodytes
ctaatgcaagataagg

SEQ ID NO: 233375 - DNA, 16 bp, P. troglodytes
ctaatgcagctggtga

SEQ ID NO: 233376 - DNA, 16 bp, P. troglodytes
ctaatgcagtaaattg

SEQ ID NO: 233377 - DNA, 16 bp, P. troglodytes
ctaatgcataacaaaa

SEQ ID NO: 233378 - DNA, 16 bp, P. troglodytes
ctaatgcctgatgatc

SEQ ID NO: 233379 - DNA, 16 bp, P. troglodytes
ctaatgctagccctcc

SEQ ID NO: 233380 - DNA, 16 bp, P. troglodytes
ctaatgttaagaaaac

SEQ ID NO: 233381 - DNA, 16 bp, P. troglodytes
ctaatgttttgtgttt

SEQ ID NO: 233382 - DNA, 16 bp, P. troglodytes
ctaattaaataccctt

SEQ ID NO: 233383 - DNA, 16 bp, P. troglodytes
ctaattacctcccaga

SEQ ID NO: 233384 - DNA, 16 bp, P. troglodytes
ctaattcattctatga

SEQ ID NO: 233385 - DNA, 16 bp, P. troglodytes
ctaattgtgtgaagaa

SEQ ID NO: 233386 - DNA, 16 bp, P. troglodytes
ctaatttacagatgag

SEQ ID NO: 233387 - DNA, 16 bp, P. troglodytes
ctaatttcaatattgt

SEQ ID NO: 233388 - DNA, 16 bp, P. troglodytes
ctaatttcagataaaa

SEQ ID NO: 233389 - DNA, 16 bp, P. troglodytes
ctaatttgaatttata

SEQ ID NO: 233390 - DNA, 16 bp, P. troglodytes
ctaatttgcattctca

SEQ ID NO: 233391 - DNA, 16 bp, P. troglodytes
ctaattttaaaatgtt

SEQ ID NO: 233392 - DNA, 16 bp, P. troglodytes
ctaattttggattttt

SEQ ID NO: 233393 - DNA, 16 bp, P. troglodytes
ctaattttgtactttt

SEQ ID NO: 233394 - DNA, 16 bp, P. troglodytes
ctaattttgttgttgt

SEQ ID NO: 233395 - DNA, 16 bp, P. troglodytes
ctaatttttaaaacat

SEQ ID NO: 233396 - DNA, 16 bp, P. troglodytes
ctaatttttatatgtt

SEQ ID NO: 233397 - DNA, 16 bp, P. troglodytes
ctaatttttgcatttt

SEQ ID NO: 233398 - DNA, 16 bp, P. troglodytes
ctaatttttgtgcttt

SEQ ID NO: 233399 - DNA, 16 bp, P. troglodytes
ctaattttttaaaaca

SEQ ID NO: 233400 - DNA, 16 bp, P. troglodytes
ctaattttttaaatgt

SEQ ID NO: 233401 - DNA, 16 bp, P. troglodytes
ctaattttttaatttg

SEQ ID NO: 233402 - DNA, 16 bp, P. troglodytes
ctaatttttttcaaag

SEQ ID NO: 233403 - DNA, 16 bp, P. troglodytes
ctaattttttttaatg

SEQ ID NO: 233404 - DNA, 16 bp, P. troglodytes
ctacaaaaaaagttta

SEQ ID NO: 233405 - DNA, 16 bp, P. troglodytes
ctacaaaaaagttttt

SEQ ID NO: 233406 - DNA, 16 bp, P. troglodytes
ctacaaaaacaaattt

SEQ ID NO: 233407 - DNA, 16 bp, P. troglodytes
ctacaaaaactgaaaa

SEQ ID NO: 233408 - DNA, 16 bp, P. troglodytes
ctacaaaaactttaaa

SEQ ID NO: 233409 - DNA, 16 bp, P. troglodytes
ctacaaaaagtgaaaa

SEQ ID NO: 233410 - DNA, 16 bp, P. troglodytes
ctacaaaaagtttttt

SEQ ID NO: 233411 - DNA, 16 bp, P. troglodytes
ctacaaaaatgaaaat

SEQ ID NO: 233412 - DNA, 16 bp, P. troglodytes
ctacaaaaatttcaaa

SEQ ID NO: 233413 - DNA, 16 bp, P. troglodytes
ctacaaaacactgctt

SEQ ID NO: 233414 - DNA, 16 bp, P. troglodytes
ctacaaaagattttaa

SEQ ID NO: 233415 - DNA, 16 bp, P. troglodytes
ctacaaacctgtatgg

SEQ ID NO: 233416 - DNA, 16 bp, P. troglodytes
ctacaaagaaaactac

SEQ ID NO: 233417 - DNA, 16 bp, P. troglodytes
ctacaaagaaactgca

SEQ ID NO: 233418 - DNA, 16 bp, P. troglodytes
ctacaaagaaattaaa

SEQ ID NO: 233419 - DNA, 16 bp, P. troglodytes
ctacaaagaacccaaa

SEQ ID NO: 233420 - DNA, 16 bp, P. troglodytes
ctacaaatcaataaca

SEQ ID NO: 233421 - DNA, 16 bp, P. troglodytes
ctacaacaaagaatta

SEQ ID NO: 233422 - DNA, 16 bp, P. troglodytes
ctacaacatggatgaa

SEQ ID NO: 233423 - DNA, 16 bp, P. troglodytes
ctacaaccatgtgatc

SEQ ID NO: 233424 - DNA, 16 bp, P. troglodytes
ctacaactttgctgaa

SEQ ID NO: 233425 - DNA, 16 bp, P. troglodytes
ctacaagaaaattaaa

SEQ ID NO: 233426 - DNA, 16 bp, P. troglodytes
ctacaagaaatgctga

SEQ ID NO: 233427 - DNA, 16 bp, P. troglodytes
ctacaagagaaagcag

SEQ ID NO: 233428 - DNA, 16 bp, P. troglodytes
ctacaagcatctgatc

SEQ ID NO: 233429 - DNA, 45 bp, P. troglodytes
ctacaagccagaagagagtgggggccaatattcaacattcttaaa

SEQ ID NO: 233430 - DNA, 16 bp, P. troglodytes
ctacaaggaacttaaa

SEQ ID NO: 233431 - DNA, 16 bp, P. troglodytes
ctacaatgaacatatg

SEQ ID NO: 233432 - DNA, 16 bp, P. troglodytes
ctacaatggcagaatt

SEQ ID NO: 233433 - DNA, 16 bp, P. troglodytes
ctacacacacacacat

SEQ ID NO: 233434 - DNA, 16 bp, P. troglodytes
ctacacaccaataata

SEQ ID NO: 233435 - DNA, 16 bp, P. troglodytes
ctacacagaaggctga

SEQ ID NO: 233436 - DNA, 16 bp, P. troglodytes
ctacacagcaaaataa

SEQ ID NO: 233437 - DNA, 16 bp, P. troglodytes
ctacactccatcctgg

SEQ ID NO: 233438 - DNA, 16 bp, P. troglodytes
ctacactctcaccagc

SEQ ID NO: 233439 - DNA, 16 bp, P. troglodytes
ctacactgagatgttt

SEQ ID NO: 233440 - DNA, 16 bp, P. troglodytes
ctacacttcagcctgg

SEQ ID NO: 233441 - DNA, 16 bp, P. troglodytes
ctacagaaaaccatca

SEQ ID NO: 233442 - DNA, 16 bp, P. troglodytes
ctacagaaaccctaca

SEQ ID NO: 233443 - DNA, 16 bp, P. troglodytes
ctacagaacagcaaat

SEQ ID NO: 233444 - DNA, 16 bp, P. troglodytes
ctacagaatgggaaaa

SEQ ID NO: 233445 - DNA, 16 bp, P. troglodytes
ctacagaatgggataa

SEQ ID NO: 233446 - DNA, 16 bp, P. troglodytes
ctacagacactcaatg

SEQ ID NO: 233447 - DNA, 16 bp, P. troglodytes
ctacagacatgcgcca

SEQ ID NO: 233448 - DNA, 16 bp, P. troglodytes
ctacagacctgtacag

SEQ ID NO: 233449 - DNA, 16 bp, P. troglodytes
ctacagagaaacagaa

SEQ ID NO: 233450 - DNA, 16 bp, P. troglodytes
ctacagatgtgtgtca

SEQ ID NO: 233451 - DNA, 16 bp, P. troglodytes
ctacagattcaacata

SEQ ID NO: 233452 - DNA, 16 bp, P. troglodytes
ctacagcaaacatcat

SEQ ID NO: 233453 - DNA, 16 bp, P. troglodytes
ctacagcactctgtgt

SEQ ID NO: 233454 - DNA, 16 bp, P. troglodytes
ctacagcctgggcagc

SEQ ID NO: 233455 - DNA, 16 bp, P. troglodytes
ctacagctaacatcat

SEQ ID NO: 233456 - DNA, 16 bp, P. troglodytes
ctacagctcccagcat

SEQ ID NO: 233457 - DNA, 16 bp, P. troglodytes
ctacagctttctgaat

SEQ ID NO: 233458 - DNA, 16 bp, P. troglodytes
ctacaggaaaaaaatc

SEQ ID NO: 233459 - DNA, 16 bp, P. troglodytes
ctacaggcacccatca

SEQ ID NO: 233460 - DNA, 16 bp, P. troglodytes
ctacaggcatacacta

SEQ ID NO: 233461 - DNA, 16 bp, P. troglodytes
ctacaggcattcacca

SEQ ID NO: 233462 - DNA, 16 bp, P. troglodytes
ctacaggcgcctgctg

SEQ ID NO: 233463 - DNA, 16 bp, P. troglodytes
ctacaggctgtacaag

SEQ ID NO: 233464 - DNA, 21 bp, P. troglodytes
ctacaggtgcatgccaccatg

SEQ ID NO: 233465 - DNA, 16 bp, P. troglodytes
ctacaggtgcccaaca

SEQ ID NO: 233466 - DNA, 16 bp, P. troglodytes
ctacaggtgcctgcaa

SEQ ID NO: 233467 - DNA, 16 bp, P. troglodytes
ctacaggtgctggaga

SEQ ID NO: 233468 - DNA, 16 bp, P. troglodytes
ctacaggtgtttgcca

SEQ ID NO: 233469 - DNA, 16 bp, P. troglodytes
ctacagtaacaaaaca

SEQ ID NO: 233470 - DNA, 16 bp, P. troglodytes
ctacagtaagccaaga

SEQ ID NO: 233471 - DNA, 16 bp, P. troglodytes
ctacagtgaacttatt

SEQ ID NO: 233472 - DNA, 16 bp, P. troglodytes
ctacagtgagctgtga

SEQ ID NO: 233473 - DNA, 16 bp, P. troglodytes
ctacagttccagctac

SEQ ID NO: 233474 - DNA, 16 bp, P. troglodytes
ctacatcaagggaaca

SEQ ID NO: 233475 - DNA, 16 bp, P. troglodytes
ctacatcagcctcctg

SEQ ID NO: 233476 - DNA, 16 bp, P. troglodytes
ctacatccttaccaac

SEQ ID NO: 233477 - DNA, 16 bp, P. troglodytes
ctacatggtgaaaccc

SEQ ID NO: 233478 - DNA, 16 bp, P. troglodytes
ctacattgaaaatctg

SEQ ID NO: 233479 - DNA, 16 bp, P. troglodytes
ctaccaaaaagcagcc

SEQ ID NO: 233480 - DNA, 16 bp, P. troglodytes
ctaccaacaatttatg

SEQ ID NO: 233481 - DNA, 16 bp, P. troglodytes
ctaccacctctgcctc

SEQ ID NO: 233482 - DNA, 16 bp, P. troglodytes
ctaccacgcctggcca

SEQ ID NO: 233483 - DNA, 16 bp, P. troglodytes
ctaccacttattagct

SEQ ID NO: 233484 - DNA, 16 bp, P. troglodytes
ctaccagaaatacaaa

SEQ ID NO: 233485 - DNA, 16 bp, P. troglodytes
ctaccagacctgcctt

SEQ ID NO: 233486 - DNA, 16 bp, P. troglodytes
ctaccagaggtagaag

SEQ ID NO: 233487 - DNA, 16 bp, P. troglodytes
ctaccaggaggctgag

SEQ ID NO: 233488 - DNA, 16 bp, P. troglodytes
ctaccaggttcctccc

SEQ ID NO: 233489 - DNA, 16 bp, P. troglodytes
ctaccatatgatccag

SEQ ID NO: 233490 - DNA, 20 bp, P. troglodytes
ctaccatcagagaatactac

SEQ ID NO: 233491 - DNA, 16 bp, P. troglodytes
ctaccatcagagagaa

SEQ ID NO: 233492 - DNA, 16 bp, P. troglodytes
ctaccatcagagtcaa

SEQ ID NO: 233493 - DNA, 16 bp, P. troglodytes
ctaccatgcctggctg

SEQ ID NO: 233494 - DNA, 16 bp, P. troglodytes
ctaccattctggaatc

SEQ ID NO: 233495 - DNA, 16 bp, P. troglodytes
ctaccattctggggcc

SEQ ID NO: 233496 - DNA, 16 bp, P. troglodytes
ctaccattgtggaaga

SEQ ID NO: 233497 - DNA, 16 bp, P. troglodytes
ctacccaagaccatgg

SEQ ID NO: 233498 - DNA, 16 bp, P. troglodytes
ctacccacatcctgct

SEQ ID NO: 233499 - DNA, 16 bp, P. troglodytes
ctacccaggaactgac

SEQ ID NO: 233500 - DNA, 16 bp, P. troglodytes
ctacccaggatgctga

SEQ ID NO: 233501 - DNA, 16 bp, P. troglodytes
ctacccagtttgtggt

SEQ ID NO: 233502 - DNA, 18 bp, P. troglodytes
ctacccatctgacaaagg

SEQ ID NO: 233503 - DNA, 25 bp, P. troglodytes
ctaccgggaagtgaggagcccctct

SEQ ID NO: 233504 - DNA, 16 bp, P. troglodytes
ctaccgggttcaagtg

SEQ ID NO: 233505 - DNA, 16 bp, P. troglodytes
ctacctcaggaggctg

SEQ ID NO: 233506 - DNA, 16 bp, P. troglodytes
ctacctcatcctcctg

SEQ ID NO: 233507 - DNA, 16 bp, P. troglodytes
ctacctccatgagatc

SEQ ID NO: 233508 - DNA, 16 bp, P. troglodytes
ctacctcctggattca

SEQ ID NO: 233509 - DNA, 16 bp, P. troglodytes
ctacctgcctacctac

SEQ ID NO: 233510 - DNA, 16 bp, P. troglodytes
ctacctgcttcagcct

SEQ ID NO: 233511 - DNA, 16 bp, P. troglodytes
ctacctggagatagtg

SEQ ID NO: 233512 - DNA, 16 bp, P. troglodytes
ctacctgggaggccaa

SEQ ID NO: 233513 - DNA, 16 bp, P. troglodytes
ctacctgggtgatgag

SEQ ID NO: 233514 - DNA, 16 bp, P. troglodytes
ctacctgtcaggtact

SEQ ID NO: 233515 - DNA, 16 bp, P. troglodytes
ctacgaagaaactgca

SEQ ID NO: 233516 - DNA, 16 bp, P. troglodytes
ctacgaggaacttaaa

SEQ ID NO: 233517 - DNA, 16 bp, P. troglodytes
ctactaataatacaaa

SEQ ID NO: 233518 - DNA, 16 bp, P. troglodytes
ctactactactactgc

SEQ ID NO: 233519 - DNA, 16 bp, P. troglodytes
ctactcaactctgctg

SEQ ID NO: 233520 - DNA, 16 bp, P. troglodytes
ctactcaaggaaataa

SEQ ID NO: 233521 - DNA, 16 bp, P. troglodytes
ctactcagaagactga

SEQ ID NO: 233522 - DNA, 16 bp, P. troglodytes
ctactcagaatggcat

SEQ ID NO: 233523 - DNA, 16 bp, P. troglodytes
ctactcaggagcctga

SEQ ID NO: 233524 - DNA, 16 bp, P. troglodytes
ctactcaggatactga

SEQ ID NO: 233525 - DNA, 16 bp, P. troglodytes
ctactcgggagctgag

SEQ ID NO: 233526 - DNA, 16 bp, P. troglodytes
ctactcgggaggctaa

SEQ ID NO: 233527 - DNA, 16 bp, P. troglodytes
ctactctagaggctga

SEQ ID NO: 233528 - DNA, 16 bp, P. troglodytes
ctactctctatgtcca

SEQ ID NO: 233529 - DNA, 16 bp, P. troglodytes
ctactctctatttcca

SEQ ID NO: 233530 - DNA, 16 bp, P. troglodytes
ctactctgccttactc

SEQ ID NO: 233531 - DNA, 16 bp, P. troglodytes
ctactctggaaactga

SEQ ID NO: 233532 - DNA, 16 bp, P. troglodytes
ctactctggccatgtg

SEQ ID NO: 233533 - DNA, 16 bp, P. troglodytes
ctactctggctcagga

SEQ ID NO: 233534 - DNA, 16 bp, P. troglodytes
ctactgaaaaaaaaat

SEQ ID NO: 233535 - DNA, 16 bp, P. troglodytes
ctactgaaaatattcc

SEQ ID NO: 233536 - DNA, 16 bp, P. troglodytes
ctactgaaatacaaaa

SEQ ID NO: 233537 - DNA, 16 bp, P. troglodytes
ctactgagggggctga

SEQ ID NO: 233538 - DNA, 16 bp, P. troglodytes
ctactgatttgtatac

SEQ ID NO: 233539 - DNA, 16 bp, P. troglodytes
ctactgcagctgatgc

SEQ ID NO: 233540 - DNA, 16 bp, P. troglodytes
ctactgcatgccagcc

SEQ ID NO: 233541 - DNA, 16 bp, P. troglodytes
ctactgctgctgctac

SEQ ID NO: 233542 - DNA, 16 bp, P. troglodytes
ctactgctgctgctgc

SEQ ID NO: 233543 - DNA, 16 bp, P. troglodytes
ctactgctgctgctgt

SEQ ID NO: 233544 - DNA, 16 bp, P. troglodytes
ctactggcctggatcc

SEQ ID NO: 233545 - DNA, 16 bp, P. troglodytes
ctactgggctgtattc

SEQ ID NO: 233546 - DNA, 16 bp, P. troglodytes
ctactggggatgggga

SEQ ID NO: 233547 - DNA, 16 bp, P. troglodytes
ctactgtactatcaaa

SEQ ID NO: 233548 - DNA, 16 bp, P. troglodytes
ctactgtcttttcttt

SEQ ID NO: 233549 - DNA, 16 bp, P. troglodytes
ctactgtgagtaaaat

SEQ ID NO: 233550 - DNA, 16 bp, P. troglodytes
ctactgtgcccagcta

SEQ ID NO: 233551 - DNA, 16 bp, P. troglodytes
ctactgtgtgccaagc

SEQ ID NO: 233552 - DNA, 16 bp, P. troglodytes
ctactgttaacatttt

SEQ ID NO: 233553 - DNA, 16 bp, P. troglodytes
ctacttcacagggttg

SEQ ID NO: 233554 - DNA, 16 bp, P. troglodytes
ctacttcctgtctctg

SEQ ID NO: 233555 - DNA, 16 bp, P. troglodytes
ctacttctattcaaca

SEQ ID NO: 233556 - DNA, 16 bp, P. troglodytes
ctacttgaaggtggag

SEQ ID NO: 233557 - DNA, 16 bp, P. troglodytes
ctacttgaggatggag

SEQ ID NO: 233558 - DNA, 17 bp, P. troglodytes
ctacttgggaggctgac

SEQ ID NO: 233559 - DNA, 16 bp, P. troglodytes
ctacttgggtgatggg

SEQ ID NO: 233560 - DNA, 16 bp, P. troglodytes
ctacttgtatgtcttc

SEQ ID NO: 233561 - DNA, 16 bp, P. troglodytes
ctactttcaattcttt

SEQ ID NO: 233562 - DNA, 16 bp, P. troglodytes
ctactttcagtttttt

SEQ ID NO: 233563 - DNA, 16 bp, P. troglodytes
ctactttctgtctgtg

SEQ ID NO: 233564 - DNA, 16 bp, P. troglodytes
ctactttttaaaaata

SEQ ID NO: 233565 - DNA, 16 bp, P. troglodytes
ctagaaaaaatgaata

SEQ ID NO: 233566 - DNA, 16 bp, P. troglodytes
ctagaaaacaaataac

SEQ ID NO: 233567 - DNA, 16 bp, P. troglodytes
ctagaaaaccccatcg

SEQ ID NO: 233568 - DNA, 16 bp, P. troglodytes
ctagaaaacctaaaag

SEQ ID NO: 233569 - DNA, 16 bp, P. troglodytes
ctagaaaagcaagaaa

SEQ ID NO: 233570 - DNA, 16 bp, P. troglodytes
ctagaaaatctggaag

SEQ ID NO: 233571 - DNA, 16 bp, P. troglodytes
ctagaaacaggaggca

SEQ ID NO: 233572 - DNA, 16 bp, P. troglodytes
ctagaaagaagctttt

SEQ ID NO: 233573 - DNA, 16 bp, P. troglodytes
ctagaaatatgaaaat

SEQ ID NO: 233574 - DNA, 16 bp, P. troglodytes
ctagaaatcaataata

SEQ ID NO: 233575 - DNA, 16 bp, P. troglodytes
ctagaaattatttaaa

SEQ ID NO: 233576 - DNA, 16 bp, P. troglodytes
ctagaacagttcctgg

SEQ ID NO: 233577 - DNA, 16 bp, P. troglodytes
ctagaacttcaagtat

SEQ ID NO: 233578 - DNA, 16 bp, P. troglodytes
ctagaagaaaacaaag

SEQ ID NO: 233579 - DNA, 16 bp, P. troglodytes
ctagaagaaaagattt

SEQ ID NO: 233580 - DNA, 16 bp, P. troglodytes
ctagaagagaggactt

SEQ ID NO: 233581 - DNA, 16 bp, P. troglodytes
ctagaagcaaacaggg

SEQ ID NO: 233582 - DNA, 16 bp, P. troglodytes
ctagaagcaatggata

SEQ ID NO: 233583 - DNA, 16 bp, P. troglodytes
ctagaagcagatgctg

SEQ ID NO: 233584 - DNA, 16 bp, P. troglodytes
ctagaagccaagcaga

SEQ ID NO: 233585 - DNA, 16 bp, P. troglodytes
ctagaagctggaaagg

SEQ ID NO: 233586 - DNA, 16 bp, P. troglodytes
ctagaaggaagaaact

SEQ ID NO: 233587 - DNA, 16 bp, P. troglodytes
ctagaaggactaagga

SEQ ID NO: 233588 - DNA, 16 bp, P. troglodytes
ctagaaggcagaggtt

SEQ ID NO: 233589 - DNA, 16 bp, P. troglodytes
ctagaagtggaattgc

SEQ ID NO: 233590 - DNA, 16 bp, P. troglodytes
ctagaataaaatgact

SEQ ID NO: 233591 - DNA, 16 bp, P. troglodytes
ctagaatatacaaaga

SEQ ID NO: 233592 - DNA, 16 bp, P. troglodytes
ctagaatatatatata

SEQ ID NO: 233593 - DNA, 16 bp, P. troglodytes
ctagaatatatttttt

SEQ ID NO: 233594 - DNA, 16 bp, P. troglodytes
ctagaatctttgtgct

SEQ ID NO: 233595 - DNA, 16 bp, P. troglodytes
ctagaatgcagtggca

SEQ ID NO: 233596 - DNA, 16 bp, P. troglodytes
ctagaattcagctgtg

SEQ ID NO: 233597 - DNA, 16 bp, P. troglodytes
ctagaatttatttatt

SEQ ID NO: 233598 - DNA, 16 bp, P. troglodytes
ctagacagacaggcct

SEQ ID NO: 233599 - DNA, 16 bp, P. troglodytes
ctagacatggtggtgc

SEQ ID NO: 233600 - DNA, 17 bp, P. troglodytes
ctagaccaaggagccct

SEQ ID NO: 233601 - DNA, 16 bp, P. troglodytes
ctagactggaatgcag

SEQ ID NO: 233602 - DNA, 16 bp, P. troglodytes
ctagactgtaaactcc

SEQ ID NO: 233603 - DNA, 16 bp, P. troglodytes
ctagactgtgagctcc

SEQ ID NO: 233604 - DNA, 16 bp, P. troglodytes
ctagactgtgagcttc

SEQ ID NO: 233605 - DNA, 16 bp, P. troglodytes
ctagagacccaggaga

SEQ ID NO: 233606 - DNA, 16 bp, P. troglodytes
ctagagagaaaggtca

SEQ ID NO: 233607 - DNA, 16 bp, P. troglodytes
ctagagagcagtggtg

SEQ ID NO: 233608 - DNA, 16 bp, P. troglodytes
ctagagattatttaaa

SEQ ID NO: 233609 - DNA, 16 bp, P. troglodytes
ctagagattctgattt

SEQ ID NO: 233610 - DNA, 16 bp, P. troglodytes
ctagagcccaggagtt

SEQ ID NO: 233611 - DNA, 16 bp, P. troglodytes
ctagagctgtgagaaa

SEQ ID NO: 233612 - DNA, 16 bp, P. troglodytes
ctagaggaaatggatg

SEQ ID NO: 233613 - DNA, 16 bp, P. troglodytes
ctagaggaatataaat

SEQ ID NO: 233614 - DNA, 16 bp, P. troglodytes
ctagaggcctctgctg

SEQ ID NO: 233615 - DNA, 16 bp, P. troglodytes
ctagaggctgggaaag

SEQ ID NO: 233616 - DNA, 16 bp, P. troglodytes
ctagagttttattttt

SEQ ID NO: 233617 - DNA, 16 bp, P. troglodytes
ctagatccagaagaga

SEQ ID NO: 233618 - DNA, 16 bp, P. troglodytes
ctagatcccctgagga

SEQ ID NO: 233619 - DNA, 16 bp, P. troglodytes
ctagatctttttcttc

SEQ ID NO: 233620 - DNA, 25 bp, P. troglodytes
ctagatgacgagttagtgggtgcag

SEQ ID NO: 233621 - DNA, 16 bp, P. troglodytes
ctagatgtggtggtgc

SEQ ID NO: 233622 - DNA, 16 bp, P. troglodytes
ctagattaagaaaatg

SEQ ID NO: 233623 - DNA, 16 bp, P. troglodytes
ctagattagtgtttga

SEQ ID NO: 233624 - DNA, 16 bp, P. troglodytes
ctagattcctcacatg

SEQ ID NO: 233625 - DNA, 16 bp, P. troglodytes
ctagattgtaagctcc

SEQ ID NO: 233626 - DNA, 16 bp, P. troglodytes
ctagatttcagaagat

SEQ ID NO: 233627 - DNA, 16 bp, P. troglodytes
ctagatttcagaggat

SEQ ID NO: 233628 - DNA, 16 bp, P. troglodytes
ctagatttgataaata

SEQ ID NO: 233629 - DNA, 16 bp, P. troglodytes
ctagattttcttccag

SEQ ID NO: 233630 - DNA, 24 bp, P. troglodytes
ctagcaaaagcaggggccattata

SEQ ID NO: 233631 - DNA, 16 bp, P. troglodytes
ctagcaacagagtgag

SEQ ID NO: 233632 - DNA, 20 bp, P. troglodytes
ctagcaagactaataaagaa

SEQ ID NO: 233633 - DNA, 16 bp, P. troglodytes
ctagcaagcctggggg

SEQ ID NO: 233634 - DNA, 17 bp, P. troglodytes
ctagcaaggcaggccaa

SEQ ID NO: 233635 - DNA, 16 bp, P. troglodytes
ctagcacagtgccttg

SEQ ID NO: 233636 - DNA, 16 bp, P. troglodytes
ctagcacttagggagg

SEQ ID NO: 233637 - DNA, 16 bp, P. troglodytes
ctagcagaagacaaga

SEQ ID NO: 233638 - DNA, 16 bp, P. troglodytes
ctagccacatgtgact

SEQ ID NO: 233639 - DNA, 16 bp, P. troglodytes
ctagccaggcatggtg

SEQ ID NO: 233640 - DNA, 16 bp, P. troglodytes
ctagccatatgcagaa

SEQ ID NO: 233641 - DNA, 16 bp, P. troglodytes
ctagcctctggtaacc

SEQ ID NO: 233642 - DNA, 16 bp, P. troglodytes
ctagcctggcaacaga

SEQ ID NO: 233643 - DNA, 16 bp, P. troglodytes
ctagcctgggcaacac

SEQ ID NO: 233644 - DNA, 16 bp, P. troglodytes
ctagcctgggcaatat

SEQ ID NO: 233645 - DNA, 25 bp, P. troglodytes
ctagcctgggtgacagagtgagacc

SEQ ID NO: 233646 - DNA, 16 bp, P. troglodytes
ctagcctgggtgatag

SEQ ID NO: 233647 - DNA, 16 bp, P. troglodytes
ctagctaagggattgt

SEQ ID NO: 233648 - DNA, 16 bp, P. troglodytes
ctagctacgcaggagg

SEQ ID NO: 233649 - DNA, 16 bp, P. troglodytes
ctagctatgctggaaa

SEQ ID NO: 233650 - DNA, 16 bp, P. troglodytes
ctagctcagcctccca

SEQ ID NO: 233651 - DNA, 17 bp, P. troglodytes
ctagctctgtcgccagg

SEQ ID NO: 233652 - DNA, 16 bp, P. troglodytes
ctagctgctctggagg

SEQ ID NO: 233653 - DNA, 16 bp, P. troglodytes
ctagctgggactacag

SEQ ID NO: 233654 - DNA, 16 bp, P. troglodytes
ctagctgggaggctga

SEQ ID NO: 233655 - DNA, 16 bp, P. troglodytes
ctagctgggattacag

SEQ ID NO: 233656 - DNA, 16 bp, P. troglodytes
ctagctgggcatggtg

SEQ ID NO: 233657 - DNA, 16 bp, P. troglodytes
ctagctgggcgtggtg

SEQ ID NO: 233658 - DNA, 16 bp, P. troglodytes
ctagctttgctctttt

SEQ ID NO: 233659 - DNA, 16 bp, P. troglodytes
ctaggaaactaataca

SEQ ID NO: 233660 - DNA, 16 bp, P. troglodytes
ctaggaaatctagaag

SEQ ID NO: 233661 - DNA, 16 bp, P. troglodytes
ctaggaacttggtgcc

SEQ ID NO: 233662 - DNA, 17 bp, P. troglodytes
ctaggaagaaactgcat

SEQ ID NO: 233663 - DNA, 16 bp, P. troglodytes
ctaggaaggaaggaag

SEQ ID NO: 233664 - DNA, 16 bp, P. troglodytes
ctaggaattaaccaaa

SEQ ID NO: 233665 - DNA, 16 bp, P. troglodytes
ctaggaggaaaaaatg

SEQ ID NO: 233666 - DNA, 16 bp, P. troglodytes
ctaggaggctgaggct

SEQ ID NO: 233667 - DNA, 16 bp, P. troglodytes
ctaggaggttgaggct

SEQ ID NO: 233668 - DNA, 16 bp, P. troglodytes
ctaggagtggaactgc

SEQ ID NO: 233669 - DNA, 16 bp, P. troglodytes
ctaggagttcaagacc

SEQ ID NO: 233670 - DNA, 16 bp, P. troglodytes
ctaggatggctacaat

SEQ ID NO: 233671 - DNA, 16 bp, P. troglodytes
ctaggattacaaatgt

SEQ ID NO: 233672 - DNA, 16 bp, P. troglodytes
ctaggcaacataatga

SEQ ID NO: 233673 - DNA, 16 bp, P. troglodytes
ctaggcagggtggctc

SEQ ID NO: 233674 - DNA, 16 bp, P. troglodytes
ctaggcattttatttt

SEQ ID NO: 233675 - DNA, 16 bp, P. troglodytes
ctaggccacaaggact

SEQ ID NO: 233676 - DNA, 16 bp, P. troglodytes
ctaggccacagagtga

SEQ ID NO: 233677 - DNA, 16 bp, P. troglodytes
ctaggccaggcatggt

SEQ ID NO: 233678 - DNA, 16 bp, P. troglodytes
ctaggcctcagtttcc

SEQ ID NO: 233679 - DNA, 16 bp, P. troglodytes
ctaggcctcttgcacc

SEQ ID NO: 233680 - DNA, 16 bp, P. troglodytes
ctaggcctgtctctcc

SEQ ID NO: 233681 - DNA, 16 bp, P. troglodytes
ctaggctgcagtgagc

SEQ ID NO: 233682 - DNA, 20 bp, P. troglodytes
ctaggctggtcttgaactct

SEQ ID NO: 233683 - DNA, 16 bp, P. troglodytes
ctagggagatattact

SEQ ID NO: 233684 - DNA, 16 bp, P. troglodytes
ctagggcagtgcagaa

SEQ ID NO: 233685 - DNA, 16 bp, P. troglodytes
ctaggggaaggaggag

SEQ ID NO: 233686 - DNA, 16 bp, P. troglodytes
ctaggggaagggggag

SEQ ID NO: 233687 - DNA, 16 bp, P. troglodytes
ctaggggttaggactt

SEQ ID NO: 233688 - DNA, 16 bp, P. troglodytes
ctagggtttttcaagg

SEQ ID NO: 233689 - DNA, 16 bp, P. troglodytes
ctaggtactggggata

SEQ ID NO: 233690 - DNA, 16 bp, P. troglodytes
ctaggtatttttattt

SEQ ID NO: 233691 - DNA, 16 bp, P. troglodytes
ctaggtctctgggcct

SEQ ID NO: 233692 - DNA, 16 bp, P. troglodytes
ctaggtctgggctccc

SEQ ID NO: 233693 - DNA, 16 bp, P. troglodytes
ctaggtgccaggcact

SEQ ID NO: 233694 - DNA, 16 bp, P. troglodytes
ctaggtgtggtggcac

SEQ ID NO: 233695 - DNA, 16 bp, P. troglodytes
ctagtaattttatagt

SEQ ID NO: 233696 - DNA, 16 bp, P. troglodytes
ctagtacagtgcctgg

SEQ ID NO: 233697 - DNA, 16 bp, P. troglodytes
ctagtacataattaaa

SEQ ID NO: 233698 - DNA, 16 bp, P. troglodytes
ctagtcagagcaatta

SEQ ID NO: 233699 - DNA, 16 bp, P. troglodytes
ctagtcatatttcaag

SEQ ID NO: 233700 - DNA, 16 bp, P. troglodytes
ctagtctcaaactctt

SEQ ID NO: 233701 - DNA, 16 bp, P. troglodytes
ctagtgaagatgctgt

SEQ ID NO: 233702 - DNA, 16 bp, P. troglodytes
ctagtgcagtgcctgg

SEQ ID NO: 233703 - DNA, 16 bp, P. troglodytes
ctagttctctgaagaa

SEQ ID NO: 233704 - DNA, 16 bp, P. troglodytes
ctagttgtttaaaagt

SEQ ID NO: 233705 - DNA, 16 bp, P. troglodytes
ctagtttcatttcatt

SEQ ID NO: 233706 - DNA, 16 bp, P. troglodytes
ctagttttacagatga

SEQ ID NO: 233707 - DNA, 16 bp, P. troglodytes
ctagttttattatatt

SEQ ID NO: 233708 - DNA, 16 bp, P. troglodytes
ctagttttgatctttg

SEQ ID NO: 233709 - DNA, 16 bp, P. troglodytes
ctagtttttaaatttt

SEQ ID NO: 233710 - DNA, 16 bp, P. troglodytes
ctataaaaatggcaat

SEQ ID NO: 233711 - DNA, 16 bp, P. troglodytes
ctataaaacagaaata

SEQ ID NO: 233712 - DNA, 16 bp, P. troglodytes
ctataaaacagaatga

SEQ ID NO: 233713 - DNA, 16 bp, P. troglodytes
ctataaaacattttta

SEQ ID NO: 233714 - DNA, 16 bp, P. troglodytes
ctataaaatgcaaata

SEQ ID NO: 233715 - DNA, 16 bp, P. troglodytes
ctataaaatgggggtg

SEQ ID NO: 233716 - DNA, 16 bp, P. troglodytes
ctataaacattcttgt

SEQ ID NO: 233717 - DNA, 16 bp, P. troglodytes
ctataaactataaact

SEQ ID NO: 233718 - DNA, 16 bp, P. troglodytes
ctataaactcacagat

SEQ ID NO: 233719 - DNA, 16 bp, P. troglodytes
ctataaagaaatatct

SEQ ID NO: 233720 - DNA, 16 bp, P. troglodytes
ctataaagaaatgtct

SEQ ID NO: 233721 - DNA, 16 bp, P. troglodytes
ctataaataaatatct

SEQ ID NO: 233722 - DNA, 16 bp, P. troglodytes
ctataaatatttgtgt

SEQ ID NO: 233723 - DNA, 16 bp, P. troglodytes
ctataacaaagtacta

SEQ ID NO: 233724 - DNA, 16 bp, P. troglodytes
ctataacagaatatca

SEQ ID NO: 233725 - DNA, 16 bp, P. troglodytes
ctataagaaaatacct

SEQ ID NO: 233726 - DNA, 16 bp, P. troglodytes
ctataatcacaccatt

SEQ ID NO: 233727 - DNA, 17 bp, P. troglodytes
ctataatcccagctact

SEQ ID NO: 233728 - DNA, 17 bp, P. troglodytes
ctataattccagctact

SEQ ID NO: 233729 - DNA, 16 bp, P. troglodytes
ctataattttgccttt

SEQ ID NO: 233730 - DNA, 16 bp, P. troglodytes
ctatacaccaacaaat

SEQ ID NO: 233731 - DNA, 16 bp, P. troglodytes
ctatacagaagctttt

SEQ ID NO: 233732 - DNA, 16 bp, P. troglodytes
ctatagaaaaaaatct

SEQ ID NO: 233733 - DNA, 16 bp, P. troglodytes
ctatagccttgacctc

SEQ ID NO: 233734 - DNA, 16 bp, P. troglodytes
ctatagcttttacttc

SEQ ID NO: 233735 - DNA, 16 bp, P. troglodytes
ctataggtgtgcacca

SEQ ID NO: 233736 - DNA, 16 bp, P. troglodytes
ctatagtcaataataa

SEQ ID NO: 233737 - DNA, 16 bp, P. troglodytes
ctatagtcccagctat

SEQ ID NO: 233738 - DNA, 16 bp, P. troglodytes
ctatataatgataaaa

SEQ ID NO: 233739 - DNA, 16 bp, P. troglodytes
ctatatatacatacat

SEQ ID NO: 233740 - DNA, 16 bp, P. troglodytes
ctatatatatctatat

SEQ ID NO: 233741 - DNA, 16 bp, P. troglodytes
ctatatatctatatag

SEQ ID NO: 233742 - DNA, 16 bp, P. troglodytes
ctatatatgtattata

SEQ ID NO: 233743 - DNA, 16 bp, P. troglodytes
ctatatatgtgtatat

SEQ ID NO: 233744 - DNA, 16 bp, P. troglodytes
ctatatctatctctat

SEQ ID NO: 233745 - DNA, 16 bp, P. troglodytes
ctatatgaactttaaa

SEQ ID NO: 233746 - DNA, 16 bp, P. troglodytes
ctatatgaagaaaatt

SEQ ID NO: 233747 - DNA, 16 bp, P. troglodytes
ctatatgccaaaaaat

SEQ ID NO: 233748 - DNA, 16 bp, P. troglodytes
ctatatgccaggtgct

SEQ ID NO: 233749 - DNA, 16 bp, P. troglodytes
ctatatggtctaaaaa

SEQ ID NO: 233750 - DNA, 16 bp, P. troglodytes
ctatattccaataaaa

SEQ ID NO: 233751 - DNA, 16 bp, P. troglodytes
ctatattgcccaagct

SEQ ID NO: 233752 - DNA, 16 bp, P. troglodytes
ctatattgtccaggct

SEQ ID NO: 233753 - DNA, 16 bp, P. troglodytes
ctatattgttatattt

SEQ ID NO: 233754 - DNA, 16 bp, P. troglodytes
ctatatttggttttct

SEQ ID NO: 233755 - DNA, 16 bp, P. troglodytes
ctatcaaaatacaaat

SEQ ID NO: 233756 - DNA, 16 bp, P. troglodytes
ctatcaaaattccagt

SEQ ID NO: 233757 - DNA, 16 bp, P. troglodytes
ctatcaaactaccaat

SEQ ID NO: 233758 - DNA, 16 bp, P. troglodytes
ctatcaaatatttaag

SEQ ID NO: 233759 - DNA, 16 bp, P. troglodytes
ctatcaacccatcatc

SEQ ID NO: 233760 - DNA, 16 bp, P. troglodytes
ctatcacagtgcctgg

SEQ ID NO: 233761 - DNA, 16 bp, P. troglodytes
ctatcagcattttggc

SEQ ID NO: 233762 - DNA, 16 bp, P. troglodytes
ctatcagcattttggg

SEQ ID NO: 233763 - DNA, 16 bp, P. troglodytes
ctatcataatttgttt

SEQ ID NO: 233764 - DNA, 16 bp, P. troglodytes
ctatcatgacaacagc

SEQ ID NO: 233765 - DNA, 16 bp, P. troglodytes
ctatcattcccatttt

SEQ ID NO: 233766 - DNA, 16 bp, P. troglodytes
ctatccatatgacaaa

SEQ ID NO: 233767 - DNA, 16 bp, P. troglodytes
ctatccatctatctat

SEQ ID NO: 233768 - DNA, 16 bp, P. troglodytes
ctatccctcccccagt

SEQ ID NO: 233769 - DNA, 16 bp, P. troglodytes
ctatccctcccgcctc

SEQ ID NO: 233770 - DNA, 16 bp, P. troglodytes
ctatcctgacttctaa

SEQ ID NO: 233771 - DNA, 16 bp, P. troglodytes
ctatctatctatctga

SEQ ID NO: 233772 - DNA, 16 bp, P. troglodytes
ctatctatctatctta

SEQ ID NO: 233773 - DNA, 16 bp, P. troglodytes
ctatctcaaaaaatta

SEQ ID NO: 233774 - DNA, 16 bp, P. troglodytes
ctatctctaataaaaa

SEQ ID NO: 233775 - DNA, 16 bp, P. troglodytes
ctatctcttaaaaaaa

SEQ ID NO: 233776 - DNA, 16 bp, P. troglodytes
ctatctgactccaaag

SEQ ID NO: 233777 - DNA, 16 bp, P. troglodytes
ctatctgttttgttaa

SEQ ID NO: 233778 - DNA, 16 bp, P. troglodytes
ctatcttcagcctcct

SEQ ID NO: 233779 - DNA, 16 bp, P. troglodytes
ctatcttgctgaaata

SEQ ID NO: 233780 - DNA, 16 bp, P. troglodytes
ctatcttggagaatgt

SEQ ID NO: 233781 - DNA, 16 bp, P. troglodytes
ctatgaaaaacagttt

SEQ ID NO: 233782 - DNA, 16 bp, P. troglodytes
ctatgaaaatctaatg

SEQ ID NO: 233783 - DNA, 16 bp, P. troglodytes
ctatgaacatttgcat

SEQ ID NO: 233784 - DNA, 16 bp, P. troglodytes
ctatgaacttttctct

SEQ ID NO: 233785 - DNA, 16 bp, P. troglodytes
ctatgaactttttgaa

SEQ ID NO: 233786 - DNA, 16 bp, P. troglodytes
ctatgaagaaactgta

SEQ ID NO: 233787 - DNA, 16 bp, P. troglodytes
ctatgaataaagctgc

SEQ ID NO: 233788 - DNA, 16 bp, P. troglodytes
ctatgaatgagaacat

SEQ ID NO: 233789 - DNA, 17 bp, P. troglodytes
ctatgaccacgtgacca

SEQ ID NO: 233790 - DNA, 16 bp, P. troglodytes
ctatgacctggaaacc

SEQ ID NO: 233791 - DNA, 16 bp, P. troglodytes
ctatgactggacgtgc

SEQ ID NO: 233792 - DNA, 16 bp, P. troglodytes
ctatgaggaaaactac

SEQ ID NO: 233793 - DNA, 16 bp, P. troglodytes
ctatgaggatgcaaaa

SEQ ID NO: 233794 - DNA, 16 bp, P. troglodytes
ctatgagttcaacttt

SEQ ID NO: 233795 - DNA, 16 bp, P. troglodytes
ctatgatccaaacacc

SEQ ID NO: 233796 - DNA, 16 bp, P. troglodytes
ctatgatctcagctac

SEQ ID NO: 233797 - DNA, 16 bp, P. troglodytes
ctatgattgcaacact

SEQ ID NO: 233798 - DNA, 16 bp, P. troglodytes
ctatgcacctgcaggc

SEQ ID NO: 233799 - DNA, 16 bp, P. troglodytes
ctatgcagccatgaaa

SEQ ID NO: 233800 - DNA, 16 bp, P. troglodytes
ctatgcatgtaacaaa

SEQ ID NO: 233801 - DNA, 16 bp, P. troglodytes
ctatgcattgtaggat

SEQ ID NO: 233802 - DNA, 16 bp, P. troglodytes
ctatgccaaagggaaa

SEQ ID NO: 233803 - DNA, 16 bp, P. troglodytes
ctatgccattttatat

SEQ ID NO: 233804 - DNA, 31 bp, P. troglodytes
ctatgctgaatctccttaggcactctctaat

SEQ ID NO: 233805 - DNA, 16 bp, P. troglodytes
ctatgctgcctaggct

SEQ ID NO: 233806 - DNA, 16 bp, P. troglodytes
ctatggaaataatttt

SEQ ID NO: 233807 - DNA, 16 bp, P. troglodytes
ctatggagaaaaacaa

SEQ ID NO: 233808 - DNA, 16 bp, P. troglodytes
ctatggagaaaaatga

SEQ ID NO: 233809 - DNA, 16 bp, P. troglodytes
ctatggcagtgcagaa

SEQ ID NO: 233810 - DNA, 16 bp, P. troglodytes
ctatggctgcttttgt

SEQ ID NO: 233811 - DNA, 16 bp, P. troglodytes
ctatgggaggccaagg

SEQ ID NO: 233812 - DNA, 16 bp, P. troglodytes
ctatggtctgaatgct

SEQ ID NO: 233813 - DNA, 16 bp, P. troglodytes
ctatgtaacaacctgc

SEQ ID NO: 233814 - DNA, 16 bp, P. troglodytes
ctatgtaaccaacctg

SEQ ID NO: 233815 - DNA, 16 bp, P. troglodytes
ctatgtaataaatggt

SEQ ID NO: 233816 - DNA, 16 bp, P. troglodytes
ctatgtatgtacatat

SEQ ID NO: 233817 - DNA, 16 bp, P. troglodytes
ctatgtatgtatgtgt

SEQ ID NO: 233818 - DNA, 16 bp, P. troglodytes
ctatgtatttatattt

SEQ ID NO: 233819 - DNA, 16 bp, P. troglodytes
ctatgtatttatttat

SEQ ID NO: 233820 - DNA, 16 bp, P. troglodytes
ctatgtatttttttaa

SEQ ID NO: 233821 - DNA, 16 bp, P. troglodytes
ctatgtctattgagat

SEQ ID NO: 233822 - DNA, 16 bp, P. troglodytes
ctatgtctggcttatt

SEQ ID NO: 233823 - DNA, 16 bp, P. troglodytes
ctatgtcttgaaaagt

SEQ ID NO: 233824 - DNA, 16 bp, P. troglodytes
ctatgtgaaaaataat

SEQ ID NO: 233825 - DNA, 16 bp, P. troglodytes
ctatgtgaagaaggac

SEQ ID NO: 233826 - DNA, 16 bp, P. troglodytes
ctatgtgatcttggac

SEQ ID NO: 233827 - DNA, 16 bp, P. troglodytes
ctatgtgccaagcatg

SEQ ID NO: 233828 - DNA, 16 bp, P. troglodytes
ctatgtgccaggtact

SEQ ID NO: 233829 - DNA, 16 bp, P. troglodytes
ctatgtgcccagcact

SEQ ID NO: 233830 - DNA, 16 bp, P. troglodytes
ctatgtgcctagcact

SEQ ID NO: 233831 - DNA, 16 bp, P. troglodytes
ctatgtgtatatgtat

SEQ ID NO: 233832 - DNA, 16 bp, P. troglodytes
ctatgtgtatgtatat

SEQ ID NO: 233833 - DNA, 16 bp, P. troglodytes
ctatgtgtcagacatt

SEQ ID NO: 233834 - DNA, 16 bp, P. troglodytes
ctatgtgtgacaaatg

SEQ ID NO: 233835 - DNA, 16 bp, P. troglodytes
ctatgtgtgtctctgt

SEQ ID NO: 233836 - DNA, 16 bp, P. troglodytes
ctatgtgtgtgtctgc

SEQ ID NO: 233837 - DNA, 16 bp, P. troglodytes
ctatgtgtgtttctgc

SEQ ID NO: 233838 - DNA, 16 bp, P. troglodytes
ctatgttaaaaaagaa

SEQ ID NO: 233839 - DNA, 16 bp, P. troglodytes
ctatgttaatagagat

SEQ ID NO: 233840 - DNA, 16 bp, P. troglodytes
ctatgttccaggaact

SEQ ID NO: 233841 - DNA, 16 bp, P. troglodytes
ctatgttcccagctac

SEQ ID NO: 233842 - DNA, 16 bp, P. troglodytes
ctatgttgccaggctg

SEQ ID NO: 233843 - DNA, 16 bp, P. troglodytes
ctatgttgcccaggcc

SEQ ID NO: 233844 - DNA, 16 bp, P. troglodytes
ctatgttgcccagtct

SEQ ID NO: 233845 - DNA, 16 bp, P. troglodytes
ctatgttgtctggggt

SEQ ID NO: 233846 - DNA, 16 bp, P. troglodytes
ctatgtttaaccattt

SEQ ID NO: 233847 - DNA, 16 bp, P. troglodytes
ctatgttttaaatttt

SEQ ID NO: 233848 - DNA, 16 bp, P. troglodytes
ctatgtttttttaaaa

SEQ ID NO: 233849 - DNA, 16 bp, P. troglodytes
ctattaagaaaatgaa

SEQ ID NO: 233850 - DNA, 16 bp, P. troglodytes
ctattaagaatacaaa

SEQ ID NO: 233851 - DNA, 16 bp, P. troglodytes
ctattaatgaacattt

SEQ ID NO: 233852 - DNA, 16 bp, P. troglodytes
ctattaattatttcct

SEQ ID NO: 233853 - DNA, 16 bp, P. troglodytes
ctattagaactaataa

SEQ ID NO: 233854 - DNA, 16 bp, P. troglodytes
ctattagaagaaaaca

SEQ ID NO: 233855 - DNA, 16 bp, P. troglodytes
ctattagtaattgttt

SEQ ID NO: 233856 - DNA, 16 bp, P. troglodytes
ctattatctcacagtt

SEQ ID NO: 233857 - DNA, 16 bp, P. troglodytes
ctattattagccccat

SEQ ID NO: 233858 - DNA, 16 bp, P. troglodytes
ctattattgttattat

SEQ ID NO: 233859 - DNA, 16 bp, P. troglodytes
ctattatttaaaaatg

SEQ ID NO: 233860 - DNA, 16 bp, P. troglodytes
ctattcaaatgttttg

SEQ ID NO: 233861 - DNA, 16 bp, P. troglodytes
ctattcaagatggagt

SEQ ID NO: 233862 - DNA, 16 bp, P. troglodytes
ctattcacaggcacca

SEQ ID NO: 233863 - DNA, 16 bp, P. troglodytes
ctattcagatcatttg

SEQ ID NO: 233864 - DNA, 16 bp, P. troglodytes
ctattcatctattgat

SEQ ID NO: 233865 - DNA, 16 bp, P. troglodytes
ctattccaaacaacag

SEQ ID NO: 233866 - DNA, 16 bp, P. troglodytes
ctattcctccacatcc

SEQ ID NO: 233867 - DNA, 16 bp, P. troglodytes
ctattctcacattgct

SEQ ID NO: 233868 - DNA, 16 bp, P. troglodytes
ctattctctctaaagc

SEQ ID NO: 233869 - DNA, 16 bp, P. troglodytes
ctattctgtgggttgc

SEQ ID NO: 233870 - DNA, 16 bp, P. troglodytes
ctattgaaataataaa

SEQ ID NO: 233871 - DNA, 16 bp, P. troglodytes
ctattgatatgatgta

SEQ ID NO: 233872 - DNA, 16 bp, P. troglodytes
ctattgatgggaatgt

SEQ ID NO: 233873 - DNA, 16 bp, P. troglodytes
ctattgcacttcagcc

SEQ ID NO: 233874 - DNA, 16 bp, P. troglodytes
ctattgctgcataaca

SEQ ID NO: 233875 - DNA, 16 bp, P. troglodytes
ctattgtaattgcttt

SEQ ID NO: 233876 - DNA, 16 bp, P. troglodytes
ctattgtgaatagtac

SEQ ID NO: 233877 - DNA, 16 bp, P. troglodytes
ctattgtgaattgtgc

SEQ ID NO: 233878 - DNA, 16 bp, P. troglodytes
ctattgtgggaccctg

SEQ ID NO: 233879 - DNA, 16 bp, P. troglodytes
ctattgtttagggaat

SEQ ID NO: 233880 - DNA, 16 bp, P. troglodytes
ctattgtttttcaata

SEQ ID NO: 233881 - DNA, 18 bp, P. troglodytes
ctatttaggtgagactat

SEQ ID NO: 233882 - DNA, 16 bp, P. troglodytes
ctatttatataacatt

SEQ ID NO: 233883 - DNA, 16 bp, P. troglodytes
ctatttcatttcttag

SEQ ID NO: 233884 - DNA, 16 bp, P. troglodytes
ctatttccaaataaag

SEQ ID NO: 233885 - DNA, 16 bp, P. troglodytes
ctatttctgtaaagaa

SEQ ID NO: 233886 - DNA, 16 bp, P. troglodytes
ctatttgacagatgag

SEQ ID NO: 233887 - DNA, 16 bp, P. troglodytes
ctatttgcagatgaca

SEQ ID NO: 233888 - DNA, 16 bp, P. troglodytes
ctatttggatgccctt

SEQ ID NO: 233889 - DNA, 16 bp, P. troglodytes
ctatttgggagactga

SEQ ID NO: 233890 - DNA, 16 bp, P. troglodytes
ctattttaaaattcat

SEQ ID NO: 233891 - DNA, 16 bp, P. troglodytes
ctattttaaagataag

SEQ ID NO: 233892 - DNA, 16 bp, P. troglodytes
ctattttaaagtaaaa

SEQ ID NO: 233893 - DNA, 16 bp, P. troglodytes
ctattttaaatggaat

SEQ ID NO: 233894 - DNA, 16 bp, P. troglodytes
ctattttctggaagag

SEQ ID NO: 233895 - DNA, 16 bp, P. troglodytes
ctattttgagacagag

SEQ ID NO: 233896 - DNA, 16 bp, P. troglodytes
ctattttgcaggctag

SEQ ID NO: 233897 - DNA, 16 bp, P. troglodytes
ctattttggtctctca

SEQ ID NO: 233898 - DNA, 16 bp, P. troglodytes
ctattttgtctcatat

SEQ ID NO: 233899 - DNA, 16 bp, P. troglodytes
ctattttgtgtgtgtg

SEQ ID NO: 233900 - DNA, 16 bp, P. troglodytes
ctatttttaaaaagta

SEQ ID NO: 233901 - DNA, 16 bp, P. troglodytes
ctatttttaaaacatt

SEQ ID NO: 233902 - DNA, 16 bp, P. troglodytes
ctatttttaaaagcat

SEQ ID NO: 233903 - DNA, 16 bp, P. troglodytes
ctatttttagtagaga

SEQ ID NO: 233904 - DNA, 16 bp, P. troglodytes
ctatttttatgccaat

SEQ ID NO: 233905 - DNA, 16 bp, P. troglodytes
ctatttttattttaga

SEQ ID NO: 233906 - DNA, 16 bp, P. troglodytes
ctattttttaaatgtc

SEQ ID NO: 233907 - DNA, 16 bp, P. troglodytes
ctattttttaagaaaa

SEQ ID NO: 233908 - DNA, 16 bp, P. troglodytes
ctattttttagagcag

SEQ ID NO: 233909 - DNA, 16 bp, P. troglodytes
ctcaaaaaaaaaagtt

SEQ ID NO: 233910 - DNA, 16 bp, P. troglodytes
ctcaaaaaaagaagag

SEQ ID NO: 233911 - DNA, 16 bp, P. troglodytes
ctcaaaaaagaagaag

SEQ ID NO: 233912 - DNA, 16 bp, P. troglodytes
ctcaaaaaagaaggaa

SEQ ID NO: 233913 - DNA, 16 bp, P. troglodytes
ctcaaaaaatgaaaat

SEQ ID NO: 233914 - DNA, 16 bp, P. troglodytes
ctcaaaaaatgtatat

SEQ ID NO: 233915 - DNA, 16 bp, P. troglodytes
ctcaaaaaattaaaag

SEQ ID NO: 233916 - DNA, 16 bp, P. troglodytes
ctcaaaaacatgctga

SEQ ID NO: 233917 - DNA, 16 bp, P. troglodytes
ctcaaaaagagaaaga

SEQ ID NO: 233918 - DNA, 16 bp, P. troglodytes
ctcaaaaagataaaat

SEQ ID NO: 233919 - DNA, 16 bp, P. troglodytes
ctcaaaaagcaaacaa

SEQ ID NO: 233920 - DNA, 16 bp, P. troglodytes
ctcaaaaagttaaaca

SEQ ID NO: 233921 - DNA, 16 bp, P. troglodytes
ctcaaaaagttaaatg

SEQ ID NO: 233922 - DNA, 16 bp, P. troglodytes
ctcaaaaatacataca

SEQ ID NO: 233923 - DNA, 16 bp, P. troglodytes
ctcaaaaatagggaag

SEQ ID NO: 233924 - DNA, 16 bp, P. troglodytes
ctcaaaagaagtcatt

SEQ ID NO: 233925 - DNA, 16 bp, P. troglodytes
ctcaaaaggaaaaaag

SEQ ID NO: 233926 - DNA, 16 bp, P. troglodytes
ctcaaaagtccacagt

SEQ ID NO: 233927 - DNA, 16 bp, P. troglodytes
ctcaaaataaaagtaa

SEQ ID NO: 233928 - DNA, 16 bp, P. troglodytes
ctcaaaataatgagag

SEQ ID NO: 233929 - DNA, 16 bp, P. troglodytes
ctcaaaatacatcaaa

SEQ ID NO: 233930 - DNA, 16 bp, P. troglodytes
ctcaaaatatcttatt

SEQ ID NO: 233931 - DNA, 16 bp, P. troglodytes
ctcaaaatcactgatc

SEQ ID NO: 233932 - DNA, 16 bp, P. troglodytes
ctcaaacccctgacct

SEQ ID NO: 233933 - DNA, 16 bp, P. troglodytes
ctcaaacccctgagct

SEQ ID NO: 233934 - DNA, 16 bp, P. troglodytes
ctcaaacccgggaggc

SEQ ID NO: 233935 - DNA, 16 bp, P. troglodytes
ctcaaactccaaacct

SEQ ID NO: 233936 - DNA, 16 bp, P. troglodytes
ctcaaactctggcctc

SEQ ID NO: 233937 - DNA, 16 bp, P. troglodytes
ctcaaactcttaggct

SEQ ID NO: 233938 - DNA, 16 bp, P. troglodytes
ctcaaactctttggct

SEQ ID NO: 233939 - DNA, 16 bp, P. troglodytes
ctcaaactgaatgaaa

SEQ ID NO: 233940 - DNA, 16 bp, P. troglodytes
ctcaaacttctgggct

SEQ ID NO: 233941 - DNA, 16 bp, P. troglodytes
ctcaaagaaagaaaag

SEQ ID NO: 233942 - DNA, 16 bp, P. troglodytes
ctcaaagaactttaaa

SEQ ID NO: 233943 - DNA, 16 bp, P. troglodytes
ctcaaagaagtcagag

SEQ ID NO: 233944 - DNA, 16 bp, P. troglodytes
ctcaaagacctagaaa

SEQ ID NO: 233945 - DNA, 16 bp, P. troglodytes
ctcaaagatctagaaa

SEQ ID NO: 233946 - DNA, 16 bp, P. troglodytes
ctcaaagctgtcagac

SEQ ID NO: 233947 - DNA, 16 bp, P. troglodytes
ctcaaaggaaaaagaa

SEQ ID NO: 233948 - DNA, 16 bp, P. troglodytes
ctcaaaggaagaaaaa

SEQ ID NO: 233949 - DNA, 16 bp, P. troglodytes
ctcaaagggaagccca

SEQ ID NO: 233950 - DNA, 16 bp, P. troglodytes
ctcaaagtcctggact

SEQ ID NO: 233951 - DNA, 16 bp, P. troglodytes
ctcaaagtgtggcccc

SEQ ID NO: 233952 - DNA, 16 bp, P. troglodytes
ctcaaagtgtggtctg

SEQ ID NO: 233953 - DNA, 16 bp, P. troglodytes
ctcaaagtgttgagat

SEQ ID NO: 233954 - DNA, 16 bp, P. troglodytes
ctcaaatcatattaga

SEQ ID NO: 233955 - DNA, 16 bp, P. troglodytes
ctcaaatgtcacctca

SEQ ID NO: 233956 - DNA, 16 bp, P. troglodytes
ctcaaatgttaccact

SEQ ID NO: 233957 - DNA, 16 bp, P. troglodytes
ctcaaattatactaca

SEQ ID NO: 233958 - DNA, 16 bp, P. troglodytes
ctcaaattcctgagct

SEQ ID NO: 233959 - DNA, 16 bp, P. troglodytes
ctcaaattcctggact

SEQ ID NO: 233960 - DNA, 16 bp, P. troglodytes
ctcaaattcctgggcc

SEQ ID NO: 233961 - DNA, 16 bp, P. troglodytes
ctcaaatttatatgtt

SEQ ID NO: 233962 - DNA, 16 bp, P. troglodytes
ctcaacaaaacattag

SEQ ID NO: 233963 - DNA, 16 bp, P. troglodytes
ctcaacaaaatcctag

SEQ ID NO: 233964 - DNA, 16 bp, P. troglodytes
ctcaacaaaattcaag

SEQ ID NO: 233965 - DNA, 16 bp, P. troglodytes
ctcaacaaacatttat

SEQ ID NO: 233966 - DNA, 16 bp, P. troglodytes
ctcaacaaacttcaag

SEQ ID NO: 233967 - DNA, 16 bp, P. troglodytes
ctcaacaaatttaaga

SEQ ID NO: 233968 - DNA, 16 bp, P. troglodytes
ctcaacaagttcctca

SEQ ID NO: 233969 - DNA, 16 bp, P. troglodytes
ctcaacagcaacaaca

SEQ ID NO: 233970 - DNA, 16 bp, P. troglodytes
ctcaacatcacaaatc

SEQ ID NO: 233971 - DNA, 16 bp, P. troglodytes
ctcaacatcattaacc

SEQ ID NO: 233972 - DNA, 16 bp, P. troglodytes
ctcaacatcctgggct

SEQ ID NO: 233973 - DNA, 16 bp, P. troglodytes
ctcaacctaccaaagt

SEQ ID NO: 233974 - DNA, 16 bp, P. troglodytes
ctcaacctcactgatc

SEQ ID NO: 233975 - DNA, 16 bp, P. troglodytes
ctcaacctcctcagct

SEQ ID NO: 233976 - DNA, 16 bp, P. troglodytes
ctcaacctcctggact

SEQ ID NO: 233977 - DNA, 16 bp, P. troglodytes
ctcaacctcttgagta

SEQ ID NO: 233978 - DNA, 16 bp, P. troglodytes
ctcaacctgataaaga

SEQ ID NO: 233979 - DNA, 16 bp, P. troglodytes
ctcaacctgccaggct

SEQ ID NO: 233980 - DNA, 16 bp, P. troglodytes
ctcaaccttggctgca

SEQ ID NO: 233981 - DNA, 16 bp, P. troglodytes
ctcaacttcaaagttc

SEQ ID NO: 233982 - DNA, 16 bp, P. troglodytes
ctcaacttgataaagg

SEQ ID NO: 233983 - DNA, 16 bp, P. troglodytes
ctcaactttaattttt

SEQ ID NO: 233984 - DNA, 16 bp, P. troglodytes
ctcaactttctgactt

SEQ ID NO: 233985 - DNA, 16 bp, P. troglodytes
ctcaactttttaaaat

SEQ ID NO: 233986 - DNA, 16 bp, P. troglodytes
ctcaagaaaaaaagag

SEQ ID NO: 233987 - DNA, 16 bp, P. troglodytes
ctcaagaaaatcagag

SEQ ID NO: 233988 - DNA, 16 bp, P. troglodytes
ctcaagaaacaaaaac

SEQ ID NO: 233989 - DNA, 16 bp, P. troglodytes
ctcaagaagaaaagaa

SEQ ID NO: 233990 - DNA, 16 bp, P. troglodytes
ctcaagaagaaagaga

SEQ ID NO: 233991 - DNA, 16 bp, P. troglodytes
ctcaagagaactgaaa

SEQ ID NO: 233992 - DNA, 16 bp, P. troglodytes
ctcaagaggaatgctt

SEQ ID NO: 233993 - DNA, 16 bp, P. troglodytes
ctcaagcaacccttcc

SEQ ID NO: 233994 - DNA, 16 bp, P. troglodytes
ctcaagcaagcctcct

SEQ ID NO: 233995 - DNA, 16 bp, P. troglodytes
ctcaagcaatccgccc

SEQ ID NO: 233996 - DNA, 16 bp, P. troglodytes
ctcaagcaatctgccc

SEQ ID NO: 233997 - DNA, 16 bp, P. troglodytes
ctcaagcaattcttct

SEQ ID NO: 233998 - DNA, 16 bp, P. troglodytes
ctcaagcagtccccct

SEQ ID NO: 233999 - DNA, 16 bp, P. troglodytes
ctcaagcccaggagtt

SEQ ID NO: 234000 - DNA, 17 bp, P. troglodytes
ctcaagcctgtaatcct

SEQ ID NO: 234001 - DNA, 16 bp, P. troglodytes
ctcaagcctgtgatcc

SEQ ID NO: 234002 - DNA, 16 bp, P. troglodytes
ctcaagcgatccacct

SEQ ID NO: 234003 - DNA, 16 bp, P. troglodytes
ctcaagcgatctgccc

SEQ ID NO: 234004 - DNA, 16 bp, P. troglodytes
ctcaagctggagtaca

SEQ ID NO: 234005 - DNA, 16 bp, P. troglodytes
ctcaagctgtcctcct

SEQ ID NO: 234006 - DNA, 16 bp, P. troglodytes
ctcaagcttctggcct

SEQ ID NO: 234007 - DNA, 16 bp, P. troglodytes
ctcaaggaattctcct

SEQ ID NO: 234008 - DNA, 16 bp, P. troglodytes
ctcaaggagaactaca

SEQ ID NO: 234009 - DNA, 16 bp, P. troglodytes
ctcaaggagccagaga

SEQ ID NO: 234010 - DNA, 16 bp, P. troglodytes
ctcaaggcagaagaat

SEQ ID NO: 234011 - DNA, 16 bp, P. troglodytes
ctcaaggccacacagc

SEQ ID NO: 234012 - DNA, 16 bp, P. troglodytes
ctcaaggtcatacagc

SEQ ID NO: 234013 - DNA, 16 bp, P. troglodytes
ctcaaggtcatcgcca

SEQ ID NO: 234014 - DNA, 16 bp, P. troglodytes
ctcaaggttacacagc

SEQ ID NO: 234015 - DNA, 16 bp, P. troglodytes
ctcaagtacctgggac

SEQ ID NO: 234016 - DNA, 16 bp, P. troglodytes
ctcaagtcccacagtc

SEQ ID NO: 234017 - DNA, 16 bp, P. troglodytes
ctcaagtgatccaccc

SEQ ID NO: 234018 - DNA, 16 bp, P. troglodytes
ctcaagtgatccatct

SEQ ID NO: 234019 - DNA, 16 bp, P. troglodytes
ctcaagtgatcctcct

SEQ ID NO: 234020 - DNA, 16 bp, P. troglodytes
ctcaagtgatcctctt

SEQ ID NO: 234021 - DNA, 16 bp, P. troglodytes
ctcaagtgatctgccc

SEQ ID NO: 234022 - DNA, 17 bp, P. troglodytes
ctcaagtgatctgtccg

SEQ ID NO: 234023 - DNA, 18 bp, P. troglodytes
ctcaagtgattctcccat

SEQ ID NO: 234024 - DNA, 16 bp, P. troglodytes
ctcaagtgattttcct

SEQ ID NO: 234025 - DNA, 16 bp, P. troglodytes
ctcaagtggaaggaag

SEQ ID NO: 234026 - DNA, 16 bp, P. troglodytes
ctcaagttcctcatct

SEQ ID NO: 234027 - DNA, 16 bp, P. troglodytes
ctcaagtttttgtttt

SEQ ID NO: 234028 - DNA, 16 bp, P. troglodytes
ctcaataaactaggta

SEQ ID NO: 234029 - DNA, 16 bp, P. troglodytes
ctcaataaatgttgct

SEQ ID NO: 234030 - DNA, 16 bp, P. troglodytes
ctcaataaatgttttt

SEQ ID NO: 234031 - DNA, 16 bp, P. troglodytes
ctcaataagtatttgc

SEQ ID NO: 234032 - DNA, 16 bp, P. troglodytes
ctcaataattgataga

SEQ ID NO: 234033 - DNA, 16 bp, P. troglodytes
ctcaatacctgcctct

SEQ ID NO: 234034 - DNA, 16 bp, P. troglodytes
ctcaatagaccaataa

SEQ ID NO: 234035 - DNA, 16 bp, P. troglodytes
ctcaatattgtgaaaa

SEQ ID NO: 234036 - DNA, 16 bp, P. troglodytes
ctcaatcaaaagaaac

SEQ ID NO: 234037 - DNA, 16 bp, P. troglodytes
ctcaatcaaaagaaag

SEQ ID NO: 234038 - DNA, 16 bp, P. troglodytes
ctcaatcgatcctccc

SEQ ID NO: 234039 - DNA, 16 bp, P. troglodytes
ctcaatctcctgggct

SEQ ID NO: 234040 - DNA, 16 bp, P. troglodytes
ctcaatgaattttttt

SEQ ID NO: 234041 - DNA, 16 bp, P. troglodytes
ctcaatgtcacttcat

SEQ ID NO: 234042 - DNA, 16 bp, P. troglodytes
ctcaatgtgaagatga

SEQ ID NO: 234043 - DNA, 16 bp, P. troglodytes
ctcaatttcctcatct

SEQ ID NO: 234044 - DNA, 16 bp, P. troglodytes
ctcaatttcttcatct

SEQ ID NO: 234045 - DNA, 16 bp, P. troglodytes
ctcaatttggatttgt

SEQ ID NO: 234046 - DNA, 16 bp, P. troglodytes
ctcaatttgggtttgt

SEQ ID NO: 234047 - DNA, 16 bp, P. troglodytes
ctcacaaagggctaat

SEQ ID NO: 234048 - DNA, 16 bp, P. troglodytes
ctcacaaatttgataa

SEQ ID NO: 234049 - DNA, 16 bp, P. troglodytes
ctcacaaattttgata

SEQ ID NO: 234050 - DNA, 16 bp, P. troglodytes
ctcacaagagctcctg

SEQ ID NO: 234051 - DNA, 16 bp, P. troglodytes
ctcacaagttctgatg

SEQ ID NO: 234052 - DNA, 16 bp, P. troglodytes
ctcacacactctcaca

SEQ ID NO: 234053 - DNA, 16 bp, P. troglodytes
ctcacacccgtaatcc

SEQ ID NO: 234054 - DNA, 16 bp, P. troglodytes
ctcacacctttaatct

SEQ ID NO: 234055 - DNA, 16 bp, P. troglodytes
ctcacagaagcagaaa

SEQ ID NO: 234056 - DNA, 16 bp, P. troglodytes
ctcacagcagcctctg

SEQ ID NO: 234057 - DNA, 16 bp, P. troglodytes
ctcacagctctggaag

SEQ ID NO: 234058 - DNA, 16 bp, P. troglodytes
ctcacagctctggagg

SEQ ID NO: 234059 - DNA, 16 bp, P. troglodytes
ctcacaggaaacttgt

SEQ ID NO: 234060 - DNA, 16 bp, P. troglodytes
ctcacaggagcgtgaa

SEQ ID NO: 234061 - DNA, 16 bp, P. troglodytes
ctcacagggatgttgt

SEQ ID NO: 234062 - DNA, 16 bp, P. troglodytes
ctcacagtaacctcaa

SEQ ID NO: 234063 - DNA, 16 bp, P. troglodytes
ctcacagtagaacttc

SEQ ID NO: 234064 - DNA, 16 bp, P. troglodytes
ctcacagtgctggagg

SEQ ID NO: 234065 - DNA, 16 bp, P. troglodytes
ctcacagttcaacatg

SEQ ID NO: 234066 - DNA, 16 bp, P. troglodytes
ctcacagttccacatg

SEQ ID NO: 234067 - DNA, 16 bp, P. troglodytes
ctcacagttccatatg

SEQ ID NO: 234068 - DNA, 16 bp, P. troglodytes
ctcacagttttggaga

SEQ ID NO: 234069 - DNA, 16 bp, P. troglodytes
ctcacatggcagaaag

SEQ ID NO: 234070 - DNA, 16 bp, P. troglodytes
ctcacatgtaaattgt

SEQ ID NO: 234071 - DNA, 16 bp, P. troglodytes
ctcacatttatttcaa

SEQ ID NO: 234072 - DNA, 16 bp, P. troglodytes
ctcaccaacacttgtt

SEQ ID NO: 234073 - DNA, 16 bp, P. troglodytes
ctcaccaacagtgtaa

SEQ ID NO: 234074 - DNA, 16 bp, P. troglodytes
ctcaccagaagccaag

SEQ ID NO: 234075 - DNA, 16 bp, P. troglodytes
ctcaccagacactgaa

SEQ ID NO: 234076 - DNA, 16 bp, P. troglodytes
ctcaccagcatctgtt

SEQ ID NO: 234077 - DNA, 16 bp, P. troglodytes
ctcaccatgtgatgcc

SEQ ID NO: 234078 - DNA, 16 bp, P. troglodytes
ctcaccattgctccat

SEQ ID NO: 234079 - DNA, 16 bp, P. troglodytes
ctcaccatttctatta

SEQ ID NO: 234080 - DNA, 16 bp, P. troglodytes
ctcacccaaggtcaca

SEQ ID NO: 234081 - DNA, 16 bp, P. troglodytes
ctcacccattcattca

SEQ ID NO: 234082 - DNA, 16 bp, P. troglodytes
ctcaccccagcctcct

SEQ ID NO: 234083 - DNA, 16 bp, P. troglodytes
ctcaccctcctgggct

SEQ ID NO: 234084 - DNA, 16 bp, P. troglodytes
ctcaccctgcagatct

SEQ ID NO: 234085 - DNA, 16 bp, P. troglodytes
ctcaccctgtccccca

SEQ ID NO: 234086 - DNA, 16 bp, P. troglodytes
ctcaccgcaagctccg

SEQ ID NO: 234087 - DNA, 16 bp, P. troglodytes
ctcacctcctgctgtg

SEQ ID NO: 234088 - DNA, 16 bp, P. troglodytes
ctcacctcctgttgtg

SEQ ID NO: 234089 - DNA, 16 bp, P. troglodytes
ctcacctctgcctccc

SEQ ID NO: 234090 - DNA, 20 bp, P. troglodytes
ctcacctgaggtcaggagtt

SEQ ID NO: 234091 - DNA, 16 bp, P. troglodytes
ctcacctgtgaaatgg

SEQ ID NO: 234092 - DNA, 16 bp, P. troglodytes
ctcacgagagctgatg

SEQ ID NO: 234093 - DNA, 16 bp, P. troglodytes
ctcacgcctatactcc

SEQ ID NO: 234094 - DNA, 16 bp, P. troglodytes
ctcacgcctgtaaatc

SEQ ID NO: 234095 - DNA, 16 bp, P. troglodytes
ctcacgcctgtatccc

SEQ ID NO: 234096 - DNA, 16 bp, P. troglodytes
ctcacgtctcagcctc

SEQ ID NO: 234097 - DNA, 16 bp, P. troglodytes
ctcactaaagccttga

SEQ ID NO: 234098 - DNA, 16 bp, P. troglodytes
ctcactacctgtgtga

SEQ ID NO: 234099 - DNA, 16 bp, P. troglodytes
ctcactcaagaagaaa

SEQ ID NO: 234100 - DNA, 16 bp, P. troglodytes
ctcactcacacacaca

SEQ ID NO: 234101 - DNA, 16 bp, P. troglodytes
ctcactcacccactgc

SEQ ID NO: 234102 - DNA, 16 bp, P. troglodytes
ctcactcactcactct

SEQ ID NO: 234103 - DNA, 16 bp, P. troglodytes
ctcactcactctcaca

SEQ ID NO: 234104 - DNA, 16 bp, P. troglodytes
ctcactccagcctggg

SEQ ID NO: 234105 - DNA, 16 bp, P. troglodytes
ctcactccagttaaaa

SEQ ID NO: 234106 - DNA, 16 bp, P. troglodytes
ctcactctagcctggg

SEQ ID NO: 234107 - DNA, 16 bp, P. troglodytes
ctcactctatcaccca

SEQ ID NO: 234108 - DNA, 16 bp, P. troglodytes
ctcactctcttgctca

SEQ ID NO: 234109 - DNA, 16 bp, P. troglodytes
ctcactctgtcagcca

SEQ ID NO: 234110 - DNA, 16 bp, P. troglodytes
ctcactctgtcccagg

SEQ ID NO: 234111 - DNA, 16 bp, P. troglodytes
ctcactctgtctgcca

SEQ ID NO: 234112 - DNA, 16 bp, P. troglodytes
ctcactctgtgtgtgt

SEQ ID NO: 234113 - DNA, 16 bp, P. troglodytes
ctcactgaaaaccaca

SEQ ID NO: 234114 - DNA, 16 bp, P. troglodytes
ctcactgaagccttga

SEQ ID NO: 234115 - DNA, 16 bp, P. troglodytes
ctcactgcaaactcca

SEQ ID NO: 234116 - DNA, 17 bp, P. troglodytes
ctcactgcaacctccga

SEQ ID NO: 234117 - DNA, 16 bp, P. troglodytes
ctcactgcaagccctg

SEQ ID NO: 234118 - DNA, 29 bp, P. troglodytes
ctcactgcaagctccgcctcctgggttca

SEQ ID NO: 234119 - DNA, 16 bp, P. troglodytes
ctcactgcaatctcct

SEQ ID NO: 234120 - DNA, 16 bp, P. troglodytes
ctcactgcactccagc

SEQ ID NO: 234121 - DNA, 16 bp, P. troglodytes
ctcactgcagccaccg

SEQ ID NO: 234122 - DNA, 16 bp, P. troglodytes
ctcactgcagcccctg

SEQ ID NO: 234123 - DNA, 16 bp, P. troglodytes
ctcactgcagccctga

SEQ ID NO: 234124 - DNA, 18 bp, P. troglodytes
ctcactgcagcctccgct

SEQ ID NO: 234125 - DNA, 16 bp, P. troglodytes
ctcactgcagccttga

SEQ ID NO: 234126 - DNA, 22 bp, P. troglodytes
ctcactgcagccttgacctccc

SEQ ID NO: 234127 - DNA, 16 bp, P. troglodytes
ctcactgcagccttgg

SEQ ID NO: 234128 - DNA, 16 bp, P. troglodytes
ctcactgcagtgtcaa

SEQ ID NO: 234129 - DNA, 16 bp, P. troglodytes
ctcactgcagtttcaa

SEQ ID NO: 234130 - DNA, 16 bp, P. troglodytes
ctcactgccacctcct

SEQ ID NO: 234131 - DNA, 16 bp, P. troglodytes
ctcactggctgcctgg

SEQ ID NO: 234132 - DNA, 16 bp, P. troglodytes
ctcactggcttcagga

SEQ ID NO: 234133 - DNA, 16 bp, P. troglodytes
ctcactgtagcctccc

SEQ ID NO: 234134 - DNA, 16 bp, P. troglodytes
ctcactgtagccttga

SEQ ID NO: 234135 - DNA, 16 bp, P. troglodytes
ctcactgtctcaccca

SEQ ID NO: 234136 - DNA, 16 bp, P. troglodytes
ctcactgtcttccaca

SEQ ID NO: 234137 - DNA, 16 bp, P. troglodytes
ctcactgtgtcctcag

SEQ ID NO: 234138 - DNA, 16 bp, P. troglodytes
ctcactgtgttatcca

SEQ ID NO: 234139 - DNA, 16 bp, P. troglodytes
ctcacttcagcttccc

SEQ ID NO: 234140 - DNA, 16 bp, P. troglodytes
ctcacttcctgctgtg

SEQ ID NO: 234141 - DNA, 16 bp, P. troglodytes
ctcacttctgacacca

SEQ ID NO: 234142 - DNA, 16 bp, P. troglodytes
ctcactttatcaccca

SEQ ID NO: 234143 - DNA, 16 bp, P. troglodytes
ctcactttcctcatct

SEQ ID NO: 234144 - DNA, 16 bp, P. troglodytes
ctcactttgtcgccag

SEQ ID NO: 234145 - DNA, 16 bp, P. troglodytes
ctcagaaaaggaaaaa

SEQ ID NO: 234146 - DNA, 16 bp, P. troglodytes
ctcagaaaataataat

SEQ ID NO: 234147 - DNA, 16 bp, P. troglodytes
ctcagaaacttctttc

SEQ ID NO: 234148 - DNA, 16 bp, P. troglodytes
ctcagaaataatatca

SEQ ID NO: 234149 - DNA, 16 bp, P. troglodytes
ctcagaacaaacaaac

SEQ ID NO: 234150 - DNA, 16 bp, P. troglodytes
ctcagaagaaaaagaa

SEQ ID NO: 234151 - DNA, 16 bp, P. troglodytes
ctcagaagaagacaaa

SEQ ID NO: 234152 - DNA, 16 bp, P. troglodytes
ctcagaagaagacaag

SEQ ID NO: 234153 - DNA, 16 bp, P. troglodytes
ctcagaaggctgagat

SEQ ID NO: 234154 - DNA, 16 bp, P. troglodytes
ctcagaataagacagg

SEQ ID NO: 234155 - DNA, 16 bp, P. troglodytes
ctcagaatgctacagg

SEQ ID NO: 234156 - DNA, 16 bp, P. troglodytes
ctcagaatggaggaag

SEQ ID NO: 234157 - DNA, 16 bp, P. troglodytes
ctcagacaggagaatc

SEQ ID NO: 234158 - DNA, 16 bp, P. troglodytes
ctcagaccacagcaga

SEQ ID NO: 234159 - DNA, 16 bp, P. troglodytes
ctcagactacaggtgc

SEQ ID NO: 234160 - DNA, 16 bp, P. troglodytes
ctcagactccccagta

SEQ ID NO: 234161 - DNA, 17 bp, P. troglodytes
ctcagactcctgagtaa

SEQ ID NO: 234162 - DNA, 16 bp, P. troglodytes
ctcagactgctgtgct

SEQ ID NO: 234163 - DNA, 16 bp, P. troglodytes
ctcagagaaaaagatt

SEQ ID NO: 234164 - DNA, 16 bp, P. troglodytes
ctcagagaagccttcc

SEQ ID NO: 234165 - DNA, 16 bp, P. troglodytes
ctcagagaggcctttc

SEQ ID NO: 234166 - DNA, 16 bp, P. troglodytes
ctcagagaggctttcc

SEQ ID NO: 234167 - DNA, 16 bp, P. troglodytes
ctcagagatctagaac

SEQ ID NO: 234168 - DNA, 16 bp, P. troglodytes
ctcagagattctgatt

SEQ ID NO: 234169 - DNA, 16 bp, P. troglodytes
ctcagagccctcgctt

SEQ ID NO: 234170 - DNA, 16 bp, P. troglodytes
ctcagagcctcagttt

SEQ ID NO: 234171 - DNA, 16 bp, P. troglodytes
ctcagagcttgaagat

SEQ ID NO: 234172 - DNA, 16 bp, P. troglodytes
ctcagaggctcaccaa

SEQ ID NO: 234173 - DNA, 16 bp, P. troglodytes
ctcagagtaaaagcca

SEQ ID NO: 234174 - DNA, 16 bp, P. troglodytes
ctcagataatttttaa

SEQ ID NO: 234175 - DNA, 16 bp, P. troglodytes
ctcagatcactgcaac

SEQ ID NO: 234176 - DNA, 16 bp, P. troglodytes
ctcagatgatctgccc

SEQ ID NO: 234177 - DNA, 16 bp, P. troglodytes
ctcagatgattcaccc

SEQ ID NO: 234178 - DNA, 16 bp, P. troglodytes
ctcagatggagaagag

SEQ ID NO: 234179 - DNA, 16 bp, P. troglodytes
ctcagattcctgagta

SEQ ID NO: 234180 - DNA, 16 bp, P. troglodytes
ctcagattcttcatct

SEQ ID NO: 234181 - DNA, 16 bp, P. troglodytes
ctcagatttccagcct

SEQ ID NO: 234182 - DNA, 16 bp, P. troglodytes
ctcagcaaagccactg

SEQ ID NO: 234183 - DNA, 24 bp, P. troglodytes
ctcagcaaagtctcaggatacaaa

SEQ ID NO: 234184 - DNA, 16 bp, P. troglodytes
ctcagcaaatgtgaaa

SEQ ID NO: 234185 - DNA, 16 bp, P. troglodytes
ctcagcaaggctgctg

SEQ ID NO: 234186 - DNA, 16 bp, P. troglodytes
ctcagcaagtcagctc

SEQ ID NO: 234187 - DNA, 16 bp, P. troglodytes
ctcagcaatggcagat

SEQ ID NO: 234188 - DNA, 16 bp, P. troglodytes
ctcagcaattccattt

SEQ ID NO: 234189 - DNA, 16 bp, P. troglodytes
ctcagcacagtgtctg

SEQ ID NO: 234190 - DNA, 16 bp, P. troglodytes
ctcagcaccacaccgc

SEQ ID NO: 234191 - DNA, 16 bp, P. troglodytes
ctcagcaccacattgc

SEQ ID NO: 234192 - DNA, 16 bp, P. troglodytes
ctcagcagagaggagg

SEQ ID NO: 234193 - DNA, 16 bp, P. troglodytes
ctcagcagagcagcca

SEQ ID NO: 234194 - DNA, 16 bp, P. troglodytes
ctcagcagatcccacc

SEQ ID NO: 234195 - DNA, 16 bp, P. troglodytes
ctcagcaggctgaagt

SEQ ID NO: 234196 - DNA, 16 bp, P. troglodytes
ctcagcatcctgaata

SEQ ID NO: 234197 - DNA, 16 bp, P. troglodytes
ctcagcatttccttgt

SEQ ID NO: 234198 - DNA, 16 bp, P. troglodytes
ctcagcatttgttttt

SEQ ID NO: 234199 - DNA, 16 bp, P. troglodytes
ctcagcattttgagag

SEQ ID NO: 234200 - DNA, 16 bp, P. troglodytes
ctcagcattttgggaa

SEQ ID NO: 234201 - DNA, 16 bp, P. troglodytes
ctcagccacagcagga

SEQ ID NO: 234202 - DNA, 16 bp, P. troglodytes
ctcagccagagctgag

SEQ ID NO: 234203 - DNA, 16 bp, P. troglodytes
ctcagccaggcacggt

SEQ ID NO: 234204 - DNA, 16 bp, P. troglodytes
ctcagccaggctggag

SEQ ID NO: 234205 - DNA, 16 bp, P. troglodytes
ctcagcccacaatctc

SEQ ID NO: 234206 - DNA, 16 bp, P. troglodytes
ctcagcccacagctct

SEQ ID NO: 234207 - DNA, 16 bp, P. troglodytes
ctcagcccactgcaag

SEQ ID NO: 234208 - DNA, 16 bp, P. troglodytes
ctcagcccacttgcac

SEQ ID NO: 234209 - DNA, 16 bp, P. troglodytes
ctcagcccagcaggct

SEQ ID NO: 234210 - DNA, 16 bp, P. troglodytes
ctcagccccagcccca

SEQ ID NO: 234211 - DNA, 16 bp, P. troglodytes
ctcagccccctccaga

SEQ ID NO: 234212 - DNA, 16 bp, P. troglodytes
ctcagccccctctgga

SEQ ID NO: 234213 - DNA, 16 bp, P. troglodytes
ctcagccctcctgagt

SEQ ID NO: 234214 - DNA, 16 bp, P. troglodytes
ctcagccctgctcacc

SEQ ID NO: 234215 - DNA, 16 bp, P. troglodytes
ctcagccctgctcact

SEQ ID NO: 234216 - DNA, 16 bp, P. troglodytes
ctcagcctactgagca

SEQ ID NO: 234217 - DNA, 16 bp, P. troglodytes
ctcagcctcagcctcc

SEQ ID NO: 234218 - DNA, 16 bp, P. troglodytes
ctcagcctccaaagtg

SEQ ID NO: 234219 - DNA, 16 bp, P. troglodytes
ctcagcctccaagcag

SEQ ID NO: 234220 - DNA, 16 bp, P. troglodytes
ctcagcctccagaaca

SEQ ID NO: 234221 - DNA, 16 bp, P. troglodytes
ctcagcctccagagga

SEQ ID NO: 234222 - DNA, 16 bp, P. troglodytes
ctcagcctccaggact

SEQ ID NO: 234223 - DNA, 16 bp, P. troglodytes
ctcagcctcccaaagc

SEQ ID NO: 234224 - DNA, 16 bp, P. troglodytes
ctcagcctcccaagag

SEQ ID NO: 234225 - DNA, 16 bp, P. troglodytes
ctcagcctcccaatgt

SEQ ID NO: 234226 - DNA, 16 bp, P. troglodytes
ctcagcctcccacaat

SEQ ID NO: 234227 - DNA, 16 bp, P. troglodytes
ctcagcctccctagtt

SEQ ID NO: 234228 - DNA, 16 bp, P. troglodytes
ctcagcctcctctcct

SEQ ID NO: 234229 - DNA, 16 bp, P. troglodytes
ctcagcctcctgagga

SEQ ID NO: 234230 - DNA, 16 bp, P. troglodytes
ctcagcctcctgagtc

SEQ ID NO: 234231 - DNA, 16 bp, P. troglodytes
ctcagcctcctgagtg

SEQ ID NO: 234232 - DNA, 16 bp, P. troglodytes
ctcagcctcctgctgg

SEQ ID NO: 234233 - DNA, 16 bp, P. troglodytes
ctcagcctcctggagt

SEQ ID NO: 234234 - DNA, 16 bp, P. troglodytes
ctcagcctcctgtgta

SEQ ID NO: 234235 - DNA, 16 bp, P. troglodytes
ctcagcctcctgtgtt

SEQ ID NO: 234236 - DNA, 16 bp, P. troglodytes
ctcagcctctcaggct

SEQ ID NO: 234237 - DNA, 16 bp, P. troglodytes
ctcagcctctctgagc

SEQ ID NO: 234238 - DNA, 16 bp, P. troglodytes
ctcagcctctctgggc

SEQ ID NO: 234239 - DNA, 16 bp, P. troglodytes
ctcagcctctgagcag

SEQ ID NO: 234240 - DNA, 23 bp, P. troglodytes
ctcagcctctggagtagctggga

SEQ ID NO: 234241 - DNA, 16 bp, P. troglodytes
ctcagcctgcctgcac

SEQ ID NO: 234242 - DNA, 16 bp, P. troglodytes
ctcagcctgctgagtg

SEQ ID NO: 234243 - DNA, 16 bp, P. troglodytes
ctcagcctggccttca

SEQ ID NO: 234244 - DNA, 16 bp, P. troglodytes
ctcagcctgggggaca

SEQ ID NO: 234245 - DNA, 16 bp, P. troglodytes
ctcagccttcccagca

SEQ ID NO: 234246 - DNA, 16 bp, P. troglodytes
ctcagccttcctgagt

SEQ ID NO: 234247 - DNA, 16 bp, P. troglodytes
ctcagctaattttttt

SEQ ID NO: 234248 - DNA, 16 bp, P. troglodytes
ctcagctacttgggat

SEQ ID NO: 234249 - DNA, 16 bp, P. troglodytes
ctcagctcagcctccc

SEQ ID NO: 234250 - DNA, 16 bp, P. troglodytes
ctcagctcccctgcca

SEQ ID NO: 234251 - DNA, 16 bp, P. troglodytes
ctcagctccctgcagc

SEQ ID NO: 234252 - DNA, 16 bp, P. troglodytes
ctcagctcctcaggag

SEQ ID NO: 234253 - DNA, 16 bp, P. troglodytes
ctcagctctgcaacct

SEQ ID NO: 234254 - DNA, 16 bp, P. troglodytes
ctcagctctgcaccag

SEQ ID NO: 234255 - DNA, 16 bp, P. troglodytes
ctcagctgacacccac

SEQ ID NO: 234256 - DNA, 16 bp, P. troglodytes
ctcagctgaggcagga

SEQ ID NO: 234257 - DNA, 16 bp, P. troglodytes
ctcagctgtgaaatgg

SEQ ID NO: 234258 - DNA, 16 bp, P. troglodytes
ctcagctgtgtccagt

SEQ ID NO: 234259 - DNA, 16 bp, P. troglodytes
ctcagctgttccagcc

SEQ ID NO: 234260 - DNA, 16 bp, P. troglodytes
ctcagcttcccaagaa

SEQ ID NO: 234261 - DNA, 16 bp, P. troglodytes
ctcagcttcccagagt

SEQ ID NO: 234262 - DNA, 16 bp, P. troglodytes
ctcagcttcctcacct

SEQ ID NO: 234263 - DNA, 16 bp, P. troglodytes
ctcagcttcctcatct

SEQ ID NO: 234264 - DNA, 16 bp, P. troglodytes
ctcagcttcctgagta

SEQ ID NO: 234265 - DNA, 16 bp, P. troglodytes
ctcagcttctcaaagt

SEQ ID NO: 234266 - DNA, 16 bp, P. troglodytes
ctcagcttctgagtag

SEQ ID NO: 234267 - DNA, 16 bp, P. troglodytes
ctcagcttctgggagg

SEQ ID NO: 234268 - DNA, 16 bp, P. troglodytes
ctcagcttctggggaa

SEQ ID NO: 234269 - DNA, 16 bp, P. troglodytes
ctcagcttcttcatct

SEQ ID NO: 234270 - DNA, 16 bp, P. troglodytes
ctcagcttcttgggag

SEQ ID NO: 234271 - DNA, 16 bp, P. troglodytes
ctcagctttcttatct

SEQ ID NO: 234272 - DNA, 16 bp, P. troglodytes
ctcaggaaaaaaacaa

SEQ ID NO: 234273 - DNA, 16 bp, P. troglodytes
ctcaggaagctgaggc

SEQ ID NO: 234274 - DNA, 16 bp, P. troglodytes
ctcaggaagtcctgag

SEQ ID NO: 234275 - DNA, 16 bp, P. troglodytes
ctcaggaatttgaggc

SEQ ID NO: 234276 - DNA, 16 bp, P. troglodytes
ctcaggaccagacaga

SEQ ID NO: 234277 - DNA, 16 bp, P. troglodytes
ctcaggacctcctggg

SEQ ID NO: 234278 - DNA, 16 bp, P. troglodytes
ctcaggactttttttt

SEQ ID NO: 234279 - DNA, 16 bp, P. troglodytes
ctcaggagaaaaaaaa

SEQ ID NO: 234280 - DNA, 16 bp, P. troglodytes
ctcaggagaaaccaaa

SEQ ID NO: 234281 - DNA, 16 bp, P. troglodytes
ctcaggagaactcact

SEQ ID NO: 234282 - DNA, 16 bp, P. troglodytes
ctcaggagaccagcct

SEQ ID NO: 234283 - DNA, 16 bp, P. troglodytes
ctcaggagactggggc

SEQ ID NO: 234284 - DNA, 22 bp, P. troglodytes
ctcaggagccgatgcgatcaac

SEQ ID NO: 234285 - DNA, 16 bp, P. troglodytes
ctcaggagcctgaggt

SEQ ID NO: 234286 - DNA, 16 bp, P. troglodytes
ctcaggagcttgaggc

SEQ ID NO: 234287 - DNA, 16 bp, P. troglodytes
ctcaggaggaggaggc

SEQ ID NO: 234288 - DNA, 16 bp, P. troglodytes
ctcaggaggctaaggt

SEQ ID NO: 234289 - DNA, 16 bp, P. troglodytes
ctcaggaggctgagtt

SEQ ID NO: 234290 - DNA, 16 bp, P. troglodytes
ctcaggaggctgtggt

SEQ ID NO: 234291 - DNA, 16 bp, P. troglodytes
ctcaggaggtggaggt

SEQ ID NO: 234292 - DNA, 16 bp, P. troglodytes
ctcaggagtttgagac

SEQ ID NO: 234293 - DNA, 16 bp, P. troglodytes
ctcaggcaatccgcct

SEQ ID NO: 234294 - DNA, 16 bp, P. troglodytes
ctcaggcaggagaatc

SEQ ID NO: 234295 - DNA, 16 bp, P. troglodytes
ctcaggcaggtctttc

SEQ ID NO: 234296 - DNA, 16 bp, P. troglodytes
ctcaggccaggtgcgg

SEQ ID NO: 234297 - DNA, 16 bp, P. troglodytes
ctcaggccccacccta

SEQ ID NO: 234298 - DNA, 16 bp, P. troglodytes
ctcaggccccacctca

SEQ ID NO: 234299 - DNA, 16 bp, P. troglodytes
ctcaggccctgcccca

SEQ ID NO: 234300 - DNA, 16 bp, P. troglodytes
ctcaggcctcagcctc

SEQ ID NO: 234301 - DNA, 16 bp, P. troglodytes
ctcaggcctcctgagt

SEQ ID NO: 234302 - DNA, 16 bp, P. troglodytes
ctcaggcgatccacct

SEQ ID NO: 234303 - DNA, 16 bp, P. troglodytes
ctcaggctcccaaagg

SEQ ID NO: 234304 - DNA, 16 bp, P. troglodytes
ctcaggctgcagctaa

SEQ ID NO: 234305 - DNA, 16 bp, P. troglodytes
ctcaggctgctgcttc

SEQ ID NO: 234306 - DNA, 16 bp, P. troglodytes
ctcaggctggaataca

SEQ ID NO: 234307 - DNA, 16 bp, P. troglodytes
ctcaggctggagtgca

SEQ ID NO: 234308 - DNA, 16 bp, P. troglodytes
ctcaggctggatggag

SEQ ID NO: 234309 - DNA, 16 bp, P. troglodytes
ctcaggctggctggag

SEQ ID NO: 234310 - DNA, 16 bp, P. troglodytes
ctcaggctggtctcca

SEQ ID NO: 234311 - DNA, 16 bp, P. troglodytes
ctcagggagctcctag

SEQ ID NO: 234312 - DNA, 16 bp, P. troglodytes
ctcagggatccaggct

SEQ ID NO: 234313 - DNA, 16 bp, P. troglodytes
ctcagggatgaacaag

SEQ ID NO: 234314 - DNA, 16 bp, P. troglodytes
ctcagggctgctctgt

SEQ ID NO: 234315 - DNA, 16 bp, P. troglodytes
ctcagggctggagtgc

SEQ ID NO: 234316 - DNA, 16 bp, P. troglodytes
ctcaggggttggggac

SEQ ID NO: 234317 - DNA, 16 bp, P. troglodytes
ctcagggtcacacagc

SEQ ID NO: 234318 - DNA, 16 bp, P. troglodytes
ctcagggtggagtgca

SEQ ID NO: 234319 - DNA, 16 bp, P. troglodytes
ctcaggtatttcttta

SEQ ID NO: 234320 - DNA, 16 bp, P. troglodytes
ctcaggtcacaggcag

SEQ ID NO: 234321 - DNA, 16 bp, P. troglodytes
ctcaggtcaggaattc

SEQ ID NO: 234322 - DNA, 16 bp, P. troglodytes
ctcaggtctttggact

SEQ ID NO: 234323 - DNA, 16 bp, P. troglodytes
ctcaggtgacccaccc

SEQ ID NO: 234324 - DNA, 18 bp, P. troglodytes
ctcaggtgatccaccccg

SEQ ID NO: 234325 - DNA, 16 bp, P. troglodytes
ctcaggtgatctacct

SEQ ID NO: 234326 - DNA, 16 bp, P. troglodytes
ctcaggtgatcttccc

SEQ ID NO: 234327 - DNA, 16 bp, P. troglodytes
ctcaggtgctcctccc

SEQ ID NO: 234328 - DNA, 16 bp, P. troglodytes
ctcaggtggctgaggc

SEQ ID NO: 234329 - DNA, 16 bp, P. troglodytes
ctcaggtggtccaccc

SEQ ID NO: 234330 - DNA, 16 bp, P. troglodytes
ctcagtaaatattaac

SEQ ID NO: 234331 - DNA, 16 bp, P. troglodytes
ctcagtacctgagtga

SEQ ID NO: 234332 - DNA, 16 bp, P. troglodytes
ctcagtagacacagaa

SEQ ID NO: 234333 - DNA, 16 bp, P. troglodytes
ctcagtagctgggatt

SEQ ID NO: 234334 - DNA, 16 bp, P. troglodytes
ctcagtatccatgggg

SEQ ID NO: 234335 - DNA, 16 bp, P. troglodytes
ctcagtcaaattcttt

SEQ ID NO: 234336 - DNA, 16 bp, P. troglodytes
ctcagtcctgggcaaa

SEQ ID NO: 234337 - DNA, 16 bp, P. troglodytes
ctcagtctctccatct

SEQ ID NO: 234338 - DNA, 16 bp, P. troglodytes
ctcagtctctgtctct

SEQ ID NO: 234339 - DNA, 16 bp, P. troglodytes
ctcagtctctttttct

SEQ ID NO: 234340 - DNA, 16 bp, P. troglodytes
ctcagtcttcccatct

SEQ ID NO: 234341 - DNA, 16 bp, P. troglodytes
ctcagtgcctggcaca

SEQ ID NO: 234342 - DNA, 16 bp, P. troglodytes
ctcagtggcccaggct

SEQ ID NO: 234343 - DNA, 16 bp, P. troglodytes
ctcagtgggaggtaat

SEQ ID NO: 234344 - DNA, 16 bp, P. troglodytes
ctcagtgtcctgagta

SEQ ID NO: 234345 - DNA, 16 bp, P. troglodytes
ctcagtgtctgcatct

SEQ ID NO: 234346 - DNA, 16 bp, P. troglodytes
ctcagtgtgggtgggc

SEQ ID NO: 234347 - DNA, 16 bp, P. troglodytes
ctcagttcactgcaaa

SEQ ID NO: 234348 - DNA, 16 bp, P. troglodytes
ctcagttccctcatct

SEQ ID NO: 234349 - DNA, 16 bp, P. troglodytes
ctcagttctgcatggc

SEQ ID NO: 234350 - DNA, 16 bp, P. troglodytes
ctcagttgaaaatgca

SEQ ID NO: 234351 - DNA, 16 bp, P. troglodytes
ctcagtttccccgtct

SEQ ID NO: 234352 - DNA, 16 bp, P. troglodytes
ctcagtttccctatct

SEQ ID NO: 234353 - DNA, 16 bp, P. troglodytes
ctcagtttcctcaact

SEQ ID NO: 234354 - DNA, 16 bp, P. troglodytes
ctcagtttcctcagct

SEQ ID NO: 234355 - DNA, 16 bp, P. troglodytes
ctcagtttcctcatcc

SEQ ID NO: 234356 - DNA, 16 bp, P. troglodytes
ctcagtttcctcatct

SEQ ID NO: 234357 - DNA, 16 bp, P. troglodytes
ctcagtttcctcattt

SEQ ID NO: 234358 - DNA, 16 bp, P. troglodytes
ctcagtttcctcctct

SEQ ID NO: 234359 - DNA, 16 bp, P. troglodytes
ctcagtttctccattt

SEQ ID NO: 234360 - DNA, 16 bp, P. troglodytes
ctcagtttctctgtct

SEQ ID NO: 234361 - DNA, 16 bp, P. troglodytes
ctcagtttcttcatct

SEQ ID NO: 234362 - DNA, 16 bp, P. troglodytes
ctcagttttcccatct

SEQ ID NO: 234363 - DNA, 16 bp, P. troglodytes
ctcagttttctaatct

SEQ ID NO: 234364 - DNA, 16 bp, P. troglodytes
ctcagttttctcagct

SEQ ID NO: 234365 - DNA, 16 bp, P. troglodytes
ctcagttttctcatct

SEQ ID NO: 234366 - DNA, 16 bp, P. troglodytes
ctcagttttctcattt

SEQ ID NO: 234367 - DNA, 16 bp, P. troglodytes
ctcagttttcttcttt

SEQ ID NO: 234368 - DNA, 16 bp, P. troglodytes
ctcagtttttaaattt

SEQ ID NO: 234369 - DNA, 16 bp, P. troglodytes
ctcataaaagtaaaaa

SEQ ID NO: 234370 - DNA, 16 bp, P. troglodytes
ctcataaaatgagttt

SEQ ID NO: 234371 - DNA, 16 bp, P. troglodytes
ctcatacacacataca

SEQ ID NO: 234372 - DNA, 16 bp, P. troglodytes
ctcatacagaagagct

SEQ ID NO: 234373 - DNA, 16 bp, P. troglodytes
ctcataccacagtgca

SEQ ID NO: 234374 - DNA, 16 bp, P. troglodytes
ctcataccacatacaa

SEQ ID NO: 234375 - DNA, 16 bp, P. troglodytes
ctcataggaacatgaa

SEQ ID NO: 234376 - DNA, 16 bp, P. troglodytes
ctcataggagcacgaa

SEQ ID NO: 234377 - DNA, 16 bp, P. troglodytes
ctcatagtgtaaacaa

SEQ ID NO: 234378 - DNA, 16 bp, P. troglodytes
ctcatatgtggaagct

SEQ ID NO: 234379 - DNA, 16 bp, P. troglodytes
ctcatcaacacttggt

SEQ ID NO: 234380 - DNA, 16 bp, P. troglodytes
ctcatcacaggcccag

SEQ ID NO: 234381 - DNA, 16 bp, P. troglodytes
ctcatcaccatgcctg

SEQ ID NO: 234382 - DNA, 16 bp, P. troglodytes
ctcatcagcaaaatgg

SEQ ID NO: 234383 - DNA, 16 bp, P. troglodytes
ctcatcatgttggcca

SEQ ID NO: 234384 - DNA, 16 bp, P. troglodytes
ctcatccaggtcattg

SEQ ID NO: 234385 - DNA, 16 bp, P. troglodytes
ctcatcctcatcctca

SEQ ID NO: 234386 - DNA, 17 bp, P. troglodytes
ctcatcctggctcaaaa

SEQ ID NO: 234387 - DNA, 16 bp, P. troglodytes
ctcatccttcaaggcc

SEQ ID NO: 234388 - DNA, 16 bp, P. troglodytes
ctcatctaatcctcat

SEQ ID NO: 234389 - DNA, 16 bp, P. troglodytes
ctcatctataaaatgg

SEQ ID NO: 234390 - DNA, 16 bp, P. troglodytes
ctcatctatgaaatga

SEQ ID NO: 234391 - DNA, 16 bp, P. troglodytes
ctcatctccaaatacc

SEQ ID NO: 234392 - DNA, 16 bp, P. troglodytes
ctcatctccatcaagt

SEQ ID NO: 234393 - DNA, 16 bp, P. troglodytes
ctcatctccatctcag

SEQ ID NO: 234394 - DNA, 17 bp, P. troglodytes
ctcatctccctgggaca

SEQ ID NO: 234395 - DNA, 16 bp, P. troglodytes
ctcatctctaaaaaga

SEQ ID NO: 234396 - DNA, 16 bp, P. troglodytes
ctcatctctacaaaaa

SEQ ID NO: 234397 - DNA, 16 bp, P. troglodytes
ctcatctctaccaaaa

SEQ ID NO: 234398 - DNA, 16 bp, P. troglodytes
ctcatctctactaaaa

SEQ ID NO: 234399 - DNA, 16 bp, P. troglodytes
ctcatctctataaaaa

SEQ ID NO: 234400 - DNA, 16 bp, P. troglodytes
ctcatctctgcatgtg

SEQ ID NO: 234401 - DNA, 16 bp, P. troglodytes
ctcatctgcaagatgg

SEQ ID NO: 234402 - DNA, 16 bp, P. troglodytes
ctcatctgtaaggtgg

SEQ ID NO: 234403 - DNA, 16 bp, P. troglodytes
ctcatctgtacaatgg

SEQ ID NO: 234404 - DNA, 16 bp, P. troglodytes
ctcatctgtgaaactg

SEQ ID NO: 234405 - DNA, 16 bp, P. troglodytes
ctcatctgtgaaatgg

SEQ ID NO: 234406 - DNA, 16 bp, P. troglodytes
ctcatcttaaaaaaaa

SEQ ID NO: 234407 - DNA, 16 bp, P. troglodytes
ctcatcttaaaaatga

SEQ ID NO: 234408 - DNA, 16 bp, P. troglodytes
ctcatcttcatctgag

SEQ ID NO: 234409 - DNA, 16 bp, P. troglodytes
ctcatcttcctcatct

SEQ ID NO: 234410 - DNA, 16 bp, P. troglodytes
ctcatctttaaaatgg

SEQ ID NO: 234411 - DNA, 16 bp, P. troglodytes
ctcatctttacaaaaa

SEQ ID NO: 234412 - DNA, 16 bp, P. troglodytes
ctcatgaacacaaaga

SEQ ID NO: 234413 - DNA, 16 bp, P. troglodytes
ctcatgaactaatcac

SEQ ID NO: 234414 - DNA, 16 bp, P. troglodytes
ctcatgaagatagaga

SEQ ID NO: 234415 - DNA, 16 bp, P. troglodytes
ctcatgacctaatcat

SEQ ID NO: 234416 - DNA, 16 bp, P. troglodytes
ctcatgagacttacta

SEQ ID NO: 234417 - DNA, 16 bp, P. troglodytes
ctcatgaggtcaggag

SEQ ID NO: 234418 - DNA, 16 bp, P. troglodytes
ctcatgataacctcaa

SEQ ID NO: 234419 - DNA, 16 bp, P. troglodytes
ctcatgattctgcagg

SEQ ID NO: 234420 - DNA, 16 bp, P. troglodytes
ctcatgatttgtctct

SEQ ID NO: 234421 - DNA, 16 bp, P. troglodytes
ctcatgcaaaaaaaaa

SEQ ID NO: 234422 - DNA, 16 bp, P. troglodytes
ctcatgcactaggccc

SEQ ID NO: 234423 - DNA, 16 bp, P. troglodytes
ctcatgcctcagccct

SEQ ID NO: 234424 - DNA, 16 bp, P. troglodytes
ctcatgcctcggcctc

SEQ ID NO: 234425 - DNA, 19 bp, P. troglodytes
ctcatgctattgtttgtgg

SEQ ID NO: 234426 - DNA, 16 bp, P. troglodytes
ctcatgcttttttatg

SEQ ID NO: 234427 - DNA, 16 bp, P. troglodytes
ctcatggaaacagaga

SEQ ID NO: 234428 - DNA, 16 bp, P. troglodytes
ctcatggacaggaaga

SEQ ID NO: 234429 - DNA, 16 bp, P. troglodytes
ctcatggagaaactct

SEQ ID NO: 234430 - DNA, 16 bp, P. troglodytes
ctcatggagaacctct

SEQ ID NO: 234431 - DNA, 16 bp, P. troglodytes
ctcatggagaggaaga

SEQ ID NO: 234432 - DNA, 16 bp, P. troglodytes
ctcatggatatagaga

SEQ ID NO: 234433 - DNA, 16 bp, P. troglodytes
ctcatggattagaaga

SEQ ID NO: 234434 - DNA, 16 bp, P. troglodytes
ctcatggcagtgaata

SEQ ID NO: 234435 - DNA, 16 bp, P. troglodytes
ctcatggccaacagca

SEQ ID NO: 234436 - DNA, 16 bp, P. troglodytes
ctcatggctctggagg

SEQ ID NO: 234437 - DNA, 16 bp, P. troglodytes
ctcatgggaggtgttt

SEQ ID NO: 234438 - DNA, 16 bp, P. troglodytes
ctcatggttctggagg

SEQ ID NO: 234439 - DNA, 16 bp, P. troglodytes
ctcatggttttaaata

SEQ ID NO: 234440 - DNA, 16 bp, P. troglodytes
ctcattaaatatttgt

SEQ ID NO: 234441 - DNA, 16 bp, P. troglodytes
ctcattaatgttcttt

SEQ ID NO: 234442 - DNA, 16 bp, P. troglodytes
ctcattactgtgagga

SEQ ID NO: 234443 - DNA, 16 bp, P. troglodytes
ctcattatacagatga

SEQ ID NO: 234444 - DNA, 16 bp, P. troglodytes
ctcattcacacacaca

SEQ ID NO: 234445 - DNA, 16 bp, P. troglodytes
ctcattcattatcatg

SEQ ID NO: 234446 - DNA, 16 bp, P. troglodytes
ctcattcattcattta

SEQ ID NO: 234447 - DNA, 16 bp, P. troglodytes
ctcattcattccttca

SEQ ID NO: 234448 - DNA, 16 bp, P. troglodytes
ctcattcattttcatg

SEQ ID NO: 234449 - DNA, 16 bp, P. troglodytes
ctcattcctgcctcag

SEQ ID NO: 234450 - DNA, 16 bp, P. troglodytes
ctcattctaaaattta

SEQ ID NO: 234451 - DNA, 16 bp, P. troglodytes
ctcattctctgtccag

SEQ ID NO: 234452 - DNA, 16 bp, P. troglodytes
ctcattctctttcctg

SEQ ID NO: 234453 - DNA, 16 bp, P. troglodytes
ctcattgaatcctcat

SEQ ID NO: 234454 - DNA, 16 bp, P. troglodytes
ctcattgagactggtt

SEQ ID NO: 234455 - DNA, 16 bp, P. troglodytes
ctcattgattcattca

SEQ ID NO: 234456 - DNA, 16 bp, P. troglodytes
ctcattgcaacctcca

SEQ ID NO: 234457 - DNA, 16 bp, P. troglodytes
ctcattgcagcctcaa

SEQ ID NO: 234458 - DNA, 16 bp, P. troglodytes
ctcattgcagcctcga

SEQ ID NO: 234459 - DNA, 16 bp, P. troglodytes
ctcattgccaagtcaa

SEQ ID NO: 234460 - DNA, 16 bp, P. troglodytes
ctcattgccacctcca

SEQ ID NO: 234461 - DNA, 16 bp, P. troglodytes
ctcattggctagaact

SEQ ID NO: 234462 - DNA, 16 bp, P. troglodytes
ctcattgtgcttttga

SEQ ID NO: 234463 - DNA, 16 bp, P. troglodytes
ctcatttaaaaattta

SEQ ID NO: 234464 - DNA, 16 bp, P. troglodytes
ctcatttaaacctcac

SEQ ID NO: 234465 - DNA, 16 bp, P. troglodytes
ctcatttaacagatga

SEQ ID NO: 234466 - DNA, 16 bp, P. troglodytes
ctcatttaataaatat

SEQ ID NO: 234467 - DNA, 16 bp, P. troglodytes
ctcatttaattcttaa

SEQ ID NO: 234468 - DNA, 16 bp, P. troglodytes
ctcatttataaaatga

SEQ ID NO: 234469 - DNA, 16 bp, P. troglodytes
ctcatttataatagct

SEQ ID NO: 234470 - DNA, 16 bp, P. troglodytes
ctcatttgtaaaatgg

SEQ ID NO: 234471 - DNA, 16 bp, P. troglodytes
ctcatttgtttacata

SEQ ID NO: 234472 - DNA, 16 bp, P. troglodytes
ctcattttaaaatgag

SEQ ID NO: 234473 - DNA, 16 bp, P. troglodytes
ctcattttaaaattgg

SEQ ID NO: 234474 - DNA, 16 bp, P. troglodytes
ctcattttccccatct

SEQ ID NO: 234475 - DNA, 16 bp, P. troglodytes
ctcattttcttttgca

SEQ ID NO: 234476 - DNA, 16 bp, P. troglodytes
ctcattttgcagaaga

SEQ ID NO: 234477 - DNA, 16 bp, P. troglodytes
ctcattttgcagatga

SEQ ID NO: 234478 - DNA, 16 bp, P. troglodytes
ctcattttgttgccca

SEQ ID NO: 234479 - DNA, 16 bp, P. troglodytes
ctcatttttgtaattt

SEQ ID NO: 234480 - DNA, 16 bp, P. troglodytes
ctcattttttaaaaaa

SEQ ID NO: 234481 - DNA, 16 bp, P. troglodytes
ctccaaaaaaaatttt

SEQ ID NO: 234482 - DNA, 16 bp, P. troglodytes
ctccaaaaattaaatt

SEQ ID NO: 234483 - DNA, 16 bp, P. troglodytes
ctccaaaactatgaga

SEQ ID NO: 234484 - DNA, 16 bp, P. troglodytes
ctccaaaactgtgaga

SEQ ID NO: 234485 - DNA, 16 bp, P. troglodytes
ctccaaaagactccta

SEQ ID NO: 234486 - DNA, 16 bp, P. troglodytes
ctccaaactcttccaa

SEQ ID NO: 234487 - DNA, 16 bp, P. troglodytes
ctccaaactgtccttg

SEQ ID NO: 234488 - DNA, 16 bp, P. troglodytes
ctccaaagaaaataaa

SEQ ID NO: 234489 - DNA, 16 bp, P. troglodytes
ctccaaagaaaatgaa

SEQ ID NO: 234490 - DNA, 16 bp, P. troglodytes
ctccaaagaagaaaaa

SEQ ID NO: 234491 - DNA, 16 bp, P. troglodytes
ctccaaagaagatgta

SEQ ID NO: 234492 - DNA, 16 bp, P. troglodytes
ctccaaagcccaaagg

SEQ ID NO: 234493 - DNA, 16 bp, P. troglodytes
ctccaaaggctgaggt

SEQ ID NO: 234494 - DNA, 16 bp, P. troglodytes
ctccaaatctcatgtt

SEQ ID NO: 234495 - DNA, 16 bp, P. troglodytes
ctccaacactgaggat

SEQ ID NO: 234496 - DNA, 16 bp, P. troglodytes
ctccaaccctgtggct

SEQ ID NO: 234497 - DNA, 16 bp, P. troglodytes
ctccaacctcaacctc

SEQ ID NO: 234498 - DNA, 16 bp, P. troglodytes
ctccaacctgggagac

SEQ ID NO: 234499 - DNA, 16 bp, P. troglodytes
ctccaacctgggctac

SEQ ID NO: 234500 - DNA, 16 bp, P. troglodytes
ctccaactcctggact

SEQ ID NO: 234501 - DNA, 16 bp, P. troglodytes
ctccaactcctgggat

SEQ ID NO: 234502 - DNA, 16 bp, P. troglodytes
ctccaactcctggtct

SEQ ID NO: 234503 - DNA, 16 bp, P. troglodytes
ctccaacttcagcctc

SEQ ID NO: 234504 - DNA, 16 bp, P. troglodytes
ctccaagagggcaggg

SEQ ID NO: 234505 - DNA, 16 bp, P. troglodytes
ctccaagcaatcctcc

SEQ ID NO: 234506 - DNA, 16 bp, P. troglodytes
ctccaagcctgggcga

SEQ ID NO: 234507 - DNA, 16 bp, P. troglodytes
ctccaagcctgtgatg

SEQ ID NO: 234508 - DNA, 16 bp, P. troglodytes
ctccaagctaaaggag

SEQ ID NO: 234509 - DNA, 18 bp, P. troglodytes
ctccaatgataggtaagg

SEQ ID NO: 234510 - DNA, 16 bp, P. troglodytes
ctccaattcctgggtt

SEQ ID NO: 234511 - DNA, 16 bp, P. troglodytes
ctccacaaagaaaaca

SEQ ID NO: 234512 - DNA, 16 bp, P. troglodytes
ctccacaactgtgaga

SEQ ID NO: 234513 - DNA, 16 bp, P. troglodytes
ctccacaagaagatca

SEQ ID NO: 234514 - DNA, 16 bp, P. troglodytes
ctccacacagaaacat

SEQ ID NO: 234515 - DNA, 16 bp, P. troglodytes
ctccacaccctcatca

SEQ ID NO: 234516 - DNA, 16 bp, P. troglodytes
ctccacagcctctcca

SEQ ID NO: 234517 - DNA, 16 bp, P. troglodytes
ctccacagcttcacca

SEQ ID NO: 234518 - DNA, 16 bp, P. troglodytes
ctccacatcctcttca

SEQ ID NO: 234519 - DNA, 16 bp, P. troglodytes
ctccacatccttacca

SEQ ID NO: 234520 - DNA, 16 bp, P. troglodytes
ctccacatccttgaca

SEQ ID NO: 234521 - DNA, 16 bp, P. troglodytes
ctccacatcttgtccc

SEQ ID NO: 234522 - DNA, 16 bp, P. troglodytes
ctccacatctttgcca

SEQ ID NO: 234523 - DNA, 16 bp, P. troglodytes
ctccacattttcattt

SEQ ID NO: 234524 - DNA, 16 bp, P. troglodytes
ctccaccatcccccag

SEQ ID NO: 234525 - DNA, 16 bp, P. troglodytes
ctccaccccatttgct

SEQ ID NO: 234526 - DNA, 16 bp, P. troglodytes
ctccaccctcaagtag

SEQ ID NO: 234527 - DNA, 16 bp, P. troglodytes
ctccaccctcagctcc

SEQ ID NO: 234528 - DNA, 16 bp, P. troglodytes
ctccaccctcaggtag

SEQ ID NO: 234529 - DNA, 16 bp, P. troglodytes
ctccaccctctgggtt

SEQ ID NO: 234530 - DNA, 17 bp, P. troglodytes
ctccaccctgactcatt

SEQ ID NO: 234531 - DNA, 16 bp, P. troglodytes
ctccaccctgggggac

SEQ ID NO: 234532 - DNA, 18 bp, P. troglodytes
ctccacctaccgggttca

SEQ ID NO: 234533 - DNA, 16 bp, P. troglodytes
ctccacctactgggtt

SEQ ID NO: 234534 - DNA, 16 bp, P. troglodytes
ctccacctattcatct

SEQ ID NO: 234535 - DNA, 16 bp, P. troglodytes
ctccacctcccagctt

SEQ ID NO: 234536 - DNA, 16 bp, P. troglodytes
ctccacctcccaggtg

SEQ ID NO: 234537 - DNA, 16 bp, P. troglodytes
ctccacctcctccagg

SEQ ID NO: 234538 - DNA, 16 bp, P. troglodytes
ctccacctcctgccag

SEQ ID NO: 234539 - DNA, 16 bp, P. troglodytes
ctccacctcctggtct

SEQ ID NO: 234540 - DNA, 16 bp, P. troglodytes
ctccacctcctgtcag

SEQ ID NO: 234541 - DNA, 16 bp, P. troglodytes
ctccacctcttggatt

SEQ ID NO: 234542 - DNA, 16 bp, P. troglodytes
ctccacctgcagcctc

SEQ ID NO: 234543 - DNA, 16 bp, P. troglodytes
ctccacctggacccac

SEQ ID NO: 234544 - DNA, 16 bp, P. troglodytes
ctccacctggtccctc

SEQ ID NO: 234545 - DNA, 16 bp, P. troglodytes
ctccaccttccaggct

SEQ ID NO: 234546 - DNA, 18 bp, P. troglodytes
ctccaccttccaggttca

SEQ ID NO: 234547 - DNA, 18 bp, P. troglodytes
ctccaccttccgggttca

SEQ ID NO: 234548 - DNA, 16 bp, P. troglodytes
ctccacgagggcaggg

SEQ ID NO: 234549 - DNA, 16 bp, P. troglodytes
ctccactaaaaacaca

SEQ ID NO: 234550 - DNA, 16 bp, P. troglodytes
ctccactaaaattaca

SEQ ID NO: 234551 - DNA, 16 bp, P. troglodytes
ctccactccagcctgg

SEQ ID NO: 234552 - DNA, 16 bp, P. troglodytes
ctccactccagtctgg

SEQ ID NO: 234553 - DNA, 16 bp, P. troglodytes
ctccacttcctcacca

SEQ ID NO: 234554 - DNA, 16 bp, P. troglodytes
ctccactttgggaggc

SEQ ID NO: 234555 - DNA, 16 bp, P. troglodytes
ctccagaaaaaaaaga

SEQ ID NO: 234556 - DNA, 16 bp, P. troglodytes
ctccagaacagtaaga

SEQ ID NO: 234557 - DNA, 16 bp, P. troglodytes
ctccagaacctgttgt

SEQ ID NO: 234558 - DNA, 16 bp, P. troglodytes
ctccagaactatgaga

SEQ ID NO: 234559 - DNA, 16 bp, P. troglodytes
ctccagaactttctca

SEQ ID NO: 234560 - DNA, 16 bp, P. troglodytes
ctccagaactttgaga

SEQ ID NO: 234561 - DNA, 16 bp, P. troglodytes
ctccagaagaaatgca

SEQ ID NO: 234562 - DNA, 16 bp, P. troglodytes
ctccagaagtgctggg

SEQ ID NO: 234563 - DNA, 16 bp, P. troglodytes
ctccagaattgtgaga

SEQ ID NO: 234564 - DNA, 16 bp, P. troglodytes
ctccagaattgtgagg

SEQ ID NO: 234565 - DNA, 16 bp, P. troglodytes
ctccagaatttggaaa

SEQ ID NO: 234566 - DNA, 16 bp, P. troglodytes
ctccagacagagcagc

SEQ ID NO: 234567 - DNA, 16 bp, P. troglodytes
ctccagaccccagaat

SEQ ID NO: 234568 - DNA, 17 bp, P. troglodytes
ctccagacgcgccacct

SEQ ID NO: 234569 - DNA, 16 bp, P. troglodytes
ctccagactgggtgat

SEQ ID NO: 234570 - DNA, 16 bp, P. troglodytes
ctccagagagacagaa

SEQ ID NO: 234571 - DNA, 16 bp, P. troglodytes
ctccagagcccagaat

SEQ ID NO: 234572 - DNA, 16 bp, P. troglodytes
ctccagagcctccaga

SEQ ID NO: 234573 - DNA, 16 bp, P. troglodytes
ctccagagcctgggcg

SEQ ID NO: 234574 - DNA, 16 bp, P. troglodytes
ctccagaggcagaggc

SEQ ID NO: 234575 - DNA, 16 bp, P. troglodytes
ctccagatctgtcact

SEQ ID NO: 234576 - DNA, 16 bp, P. troglodytes
ctccagcaaggacaca

SEQ ID NO: 234577 - DNA, 16 bp, P. troglodytes
ctccagcagcccagag

SEQ ID NO: 234578 - DNA, 16 bp, P. troglodytes
ctccagcagcctgggc

SEQ ID NO: 234579 - DNA, 16 bp, P. troglodytes
ctccagcagctgggac

SEQ ID NO: 234580 - DNA, 16 bp, P. troglodytes
ctccagcagctgttgt

SEQ ID NO: 234581 - DNA, 16 bp, P. troglodytes
ctccagcaggggcaca

SEQ ID NO: 234582 - DNA, 16 bp, P. troglodytes
ctccagcatctattgt

SEQ ID NO: 234583 - DNA, 16 bp, P. troglodytes
ctccagcatctgtttc

SEQ ID NO: 234584 - DNA, 16 bp, P. troglodytes
ctccagccaatggaga

SEQ ID NO: 234585 - DNA, 16 bp, P. troglodytes
ctccagccacagcctc

SEQ ID NO: 234586 - DNA, 16 bp, P. troglodytes
ctccagccacatgggc

SEQ ID NO: 234587 - DNA, 16 bp, P. troglodytes
ctccagccagcctggg

SEQ ID NO: 234588 - DNA, 16 bp, P. troglodytes
ctccagccagggcagc

SEQ ID NO: 234589 - DNA, 16 bp, P. troglodytes
ctccagccagggggac

SEQ ID NO: 234590 - DNA, 16 bp, P. troglodytes
ctccagccatcctccc

SEQ ID NO: 234591 - DNA, 16 bp, P. troglodytes
ctccagcccagacctc

SEQ ID NO: 234592 - DNA, 16 bp, P. troglodytes
ctccagcccagcccag

SEQ ID NO: 234593 - DNA, 16 bp, P. troglodytes
ctccagcccaggcctc

SEQ ID NO: 234594 - DNA, 16 bp, P. troglodytes
ctccagcccaggcgac

SEQ ID NO: 234595 - DNA, 16 bp, P. troglodytes
ctccagccccagcctc

SEQ ID NO: 234596 - DNA, 16 bp, P. troglodytes
ctccagccccaggcaa

SEQ ID NO: 234597 - DNA, 16 bp, P. troglodytes
ctccagccccatctct

SEQ ID NO: 234598 - DNA, 16 bp, P. troglodytes
ctccagcccctggcag

SEQ ID NO: 234599 - DNA, 16 bp, P. troglodytes
ctccagcccggacaac

SEQ ID NO: 234600 - DNA, 16 bp, P. troglodytes
ctccagcccgggcgac

SEQ ID NO: 234601 - DNA, 16 bp, P. troglodytes
ctccagccctggcctc

SEQ ID NO: 234602 - DNA, 16 bp, P. troglodytes
ctccagccgggtgaca

SEQ ID NO: 234603 - DNA, 16 bp, P. troglodytes
ctccagcctagaggac

SEQ ID NO: 234604 - DNA, 16 bp, P. troglodytes
ctccagcctaggcagc

SEQ ID NO: 234605 - DNA, 16 bp, P. troglodytes
ctccagcctcacctcc

SEQ ID NO: 234606 - DNA, 16 bp, P. troglodytes
ctccagcctcagcccc

SEQ ID NO: 234607 - DNA, 16 bp, P. troglodytes
ctccagcctcagcctc

SEQ ID NO: 234608 - DNA, 16 bp, P. troglodytes
ctccagcctcagcctt

SEQ ID NO: 234609 - DNA, 16 bp, P. troglodytes
ctccagcctcagcgac

SEQ ID NO: 234610 - DNA, 16 bp, P. troglodytes
ctccagcctccaggac

SEQ ID NO: 234611 - DNA, 16 bp, P. troglodytes
ctccagcctccgcctc

SEQ ID NO: 234612 - DNA, 16 bp, P. troglodytes
ctccagcctcctccct

SEQ ID NO: 234613 - DNA, 16 bp, P. troglodytes
ctccagcctcctctcc

SEQ ID NO: 234614 - DNA, 16 bp, P. troglodytes
ctccagcctgacaaca

SEQ ID NO: 234615 - DNA, 16 bp, P. troglodytes
ctccagcctgaccaac

SEQ ID NO: 234616 - DNA, 16 bp, P. troglodytes
ctccagcctgactgac

SEQ ID NO: 234617 - DNA, 16 bp, P. troglodytes
ctccagcctgagaaac

SEQ ID NO: 234618 - DNA, 16 bp, P. troglodytes
ctccagcctgagtggc

SEQ ID NO: 234619 - DNA, 16 bp, P. troglodytes
ctccagcctgcactcc

SEQ ID NO: 234620 - DNA, 16 bp, P. troglodytes
ctccagcctgcctggg

SEQ ID NO: 234621 - DNA, 16 bp, P. troglodytes
ctccagcctgcttttc

SEQ ID NO: 234622 - DNA, 16 bp, P. troglodytes
ctccagcctggaagat

SEQ ID NO: 234623 - DNA, 16 bp, P. troglodytes
ctccagcctggacagc

SEQ ID NO: 234624 - DNA, 16 bp, P. troglodytes
ctccagcctggaccac

SEQ ID NO: 234625 - DNA, 16 bp, P. troglodytes
ctccagcctggcctac

SEQ ID NO: 234626 - DNA, 17 bp, P. troglodytes
ctccagcctggcggaca

SEQ ID NO: 234627 - DNA, 16 bp, P. troglodytes
ctccagcctggctgag

SEQ ID NO: 234628 - DNA, 16 bp, P. troglodytes
ctccagcctgggaaaa

SEQ ID NO: 234629 - DNA, 16 bp, P. troglodytes
ctccagcctgggaggg

SEQ ID NO: 234630 - DNA, 16 bp, P. troglodytes
ctccagcctgggcacc

SEQ ID NO: 234631 - DNA, 16 bp, P. troglodytes
ctccagcctgggcgcc

SEQ ID NO: 234632 - DNA, 16 bp, P. troglodytes
ctccagcctgggcggt

SEQ ID NO: 234633 - DNA, 16 bp, P. troglodytes
ctccagcctgggctcc

SEQ ID NO: 234634 - DNA, 16 bp, P. troglodytes
ctccagcctgggctgc

SEQ ID NO: 234635 - DNA, 16 bp, P. troglodytes
ctccagcctgggggag

SEQ ID NO: 234636 - DNA, 16 bp, P. troglodytes
ctccagcctgggtaaa

SEQ ID NO: 234637 - DNA, 16 bp, P. troglodytes
ctccagcctgggtgag

SEQ ID NO: 234638 - DNA, 16 bp, P. troglodytes
ctccagcctgtgcaga

SEQ ID NO: 234639 - DNA, 16 bp, P. troglodytes
ctccagcctgtgtgat

SEQ ID NO: 234640 - DNA, 16 bp, P. troglodytes
ctccagccttggcaaa

SEQ ID NO: 234641 - DNA, 16 bp, P. troglodytes
ctccagccttggcaac

SEQ ID NO: 234642 - DNA, 16 bp, P. troglodytes
ctccagccttggcagc

SEQ ID NO: 234643 - DNA, 16 bp, P. troglodytes
ctccagctccagcccc

SEQ ID NO: 234644 - DNA, 16 bp, P. troglodytes
ctccagctccagcctc

SEQ ID NO: 234645 - DNA, 16 bp, P. troglodytes
ctccagctccagcctg

SEQ ID NO: 234646 - DNA, 16 bp, P. troglodytes
ctccagctccagctcc

SEQ ID NO: 234647 - DNA, 16 bp, P. troglodytes
ctccagctccatccct

SEQ ID NO: 234648 - DNA, 16 bp, P. troglodytes
ctccagctcccaggct

SEQ ID NO: 234649 - DNA, 16 bp, P. troglodytes
ctccagctcctggact

SEQ ID NO: 234650 - DNA, 16 bp, P. troglodytes
ctccagctcctgggct

SEQ ID NO: 234651 - DNA, 16 bp, P. troglodytes
ctccagctcctgggtt

SEQ ID NO: 234652 - DNA, 16 bp, P. troglodytes
ctccagctgcagctca

SEQ ID NO: 234653 - DNA, 16 bp, P. troglodytes
ctccagctgcctttaa

SEQ ID NO: 234654 - DNA, 16 bp, P. troglodytes
ctccagctgtgagcct

SEQ ID NO: 234655 - DNA, 16 bp, P. troglodytes
ctccagcttcattcat

SEQ ID NO: 234656 - DNA, 16 bp, P. troglodytes
ctccagcttgggcaat

SEQ ID NO: 234657 - DNA, 16 bp, P. troglodytes
ctccagcttgggtggc

SEQ ID NO: 234658 - DNA, 16 bp, P. troglodytes
ctccagcttgggtgtc

SEQ ID NO: 234659 - DNA, 16 bp, P. troglodytes
ctccagctttgatctt

SEQ ID NO: 234660 - DNA, 16 bp, P. troglodytes
ctccagctttggtctt

SEQ ID NO: 234661 - DNA, 16 bp, P. troglodytes
ctccagctttgttctt

SEQ ID NO: 234662 - DNA, 16 bp, P. troglodytes
ctccaggaagacttcc

SEQ ID NO: 234663 - DNA, 16 bp, P. troglodytes
ctccaggagagcaggg

SEQ ID NO: 234664 - DNA, 16 bp, P. troglodytes
ctccaggaggtggagg

SEQ ID NO: 234665 - DNA, 16 bp, P. troglodytes
ctccaggcagcacagc

SEQ ID NO: 234666 - DNA, 16 bp, P. troglodytes
ctccaggcatccctgg

SEQ ID NO: 234667 - DNA, 16 bp, P. troglodytes
ctccaggccccagaat

SEQ ID NO: 234668 - DNA, 16 bp, P. troglodytes
ctccaggccctggctc

SEQ ID NO: 234669 - DNA, 16 bp, P. troglodytes
ctccaggcctctctcc

SEQ ID NO: 234670 - DNA, 16 bp, P. troglodytes
ctccaggctccaggct

SEQ ID NO: 234671 - DNA, 16 bp, P. troglodytes
ctccaggctgcagtgc

SEQ ID NO: 234672 - DNA, 16 bp, P. troglodytes
ctccaggctggacaac

SEQ ID NO: 234673 - DNA, 16 bp, P. troglodytes
ctccaggctgggcaca

SEQ ID NO: 234674 - DNA, 16 bp, P. troglodytes
ctccaggctgggcgat

SEQ ID NO: 234675 - DNA, 16 bp, P. troglodytes
ctccagggaaacagaa

SEQ ID NO: 234676 - DNA, 16 bp, P. troglodytes
ctccagggagaggctg

SEQ ID NO: 234677 - DNA, 16 bp, P. troglodytes
ctccagggcatttcag

SEQ ID NO: 234678 - DNA, 16 bp, P. troglodytes
ctccagggcctggctc

SEQ ID NO: 234679 - DNA, 18 bp, P. troglodytes
ctccaggttcaagcgatt

SEQ ID NO: 234680 - DNA, 16 bp, P. troglodytes
ctccaggttcatctgt

SEQ ID NO: 234681 - DNA, 16 bp, P. troglodytes
ctccaggttctctggc

SEQ ID NO: 234682 - DNA, 16 bp, P. troglodytes
ctccagtgcctggcac

SEQ ID NO: 234683 - DNA, 16 bp, P. troglodytes
ctccagttttcttctt

SEQ ID NO: 234684 - DNA, 16 bp, P. troglodytes
ctccataaaaatccct

SEQ ID NO: 234685 - DNA, 16 bp, P. troglodytes
ctccatcacccaggtt

SEQ ID NO: 234686 - DNA, 16 bp, P. troglodytes
ctccatccagcctggc

SEQ ID NO: 234687 - DNA, 16 bp, P. troglodytes
ctccatccatgttgct

SEQ ID NO: 234688 - DNA, 16 bp, P. troglodytes
ctccatccccagctcc

SEQ ID NO: 234689 - DNA, 16 bp, P. troglodytes
ctccatcccccaggct

SEQ ID NO: 234690 - DNA, 16 bp, P. troglodytes
ctccatccctgtggct

SEQ ID NO: 234691 - DNA, 16 bp, P. troglodytes
ctccatcctaaaaaaa

SEQ ID NO: 234692 - DNA, 16 bp, P. troglodytes
ctccatcctgaaggaa

SEQ ID NO: 234693 - DNA, 16 bp, P. troglodytes
ctccatcctgggcaaa

SEQ ID NO: 234694 - DNA, 16 bp, P. troglodytes
ctccatcctgggtaac

SEQ ID NO: 234695 - DNA, 16 bp, P. troglodytes
ctccatcctgggtggc

SEQ ID NO: 234696 - DNA, 16 bp, P. troglodytes
ctccatctagctttgt

SEQ ID NO: 234697 - DNA, 16 bp, P. troglodytes
ctccatctcaaaaaca

SEQ ID NO: 234698 - DNA, 16 bp, P. troglodytes
ctccatctcaaaatga

SEQ ID NO: 234699 - DNA, 16 bp, P. troglodytes
ctccatctcacacaca

SEQ ID NO: 234700 - DNA, 16 bp, P. troglodytes
ctccatctccaaaaca

SEQ ID NO: 234701 - DNA, 16 bp, P. troglodytes
ctccatctccatctct

SEQ ID NO: 234702 - DNA, 16 bp, P. troglodytes
ctccatctcccaggtt

SEQ ID NO: 234703 - DNA, 16 bp, P. troglodytes
ctccatctcctgggct

SEQ ID NO: 234704 - DNA, 16 bp, P. troglodytes
ctccatctctaataaa

SEQ ID NO: 234705 - DNA, 16 bp, P. troglodytes
ctccatctctataaaa

SEQ ID NO: 234706 - DNA, 16 bp, P. troglodytes
ctccatctctctgtct

SEQ ID NO: 234707 - DNA, 16 bp, P. troglodytes
ctccatctctgggggc

SEQ ID NO: 234708 - DNA, 16 bp, P. troglodytes
ctccatctgtaagggc

SEQ ID NO: 234709 - DNA, 16 bp, P. troglodytes
ctccatcttaaaaaaa

SEQ ID NO: 234710 - DNA, 16 bp, P. troglodytes
ctccatcttcaaaaaa

SEQ ID NO: 234711 - DNA, 16 bp, P. troglodytes
ctccatcttcaaagtc

SEQ ID NO: 234712 - DNA, 16 bp, P. troglodytes
ctccatgcctcagcct

SEQ ID NO: 234713 - DNA, 16 bp, P. troglodytes
ctccatgcctggcttg

SEQ ID NO: 234714 - DNA, 16 bp, P. troglodytes
ctccatgtctttgcta

SEQ ID NO: 234715 - DNA, 16 bp, P. troglodytes
ctccatgtggcctctc

SEQ ID NO: 234716 - DNA, 16 bp, P. troglodytes
ctccatttaaaaaaaa

SEQ ID NO: 234717 - DNA, 16 bp, P. troglodytes
ctccatttaacccaaa

SEQ ID NO: 234718 - DNA, 16 bp, P. troglodytes
ctccatttctgtctct

SEQ ID NO: 234719 - DNA, 16 bp, P. troglodytes
ctccatttgagtggaa

SEQ ID NO: 234720 - DNA, 16 bp, P. troglodytes
ctccattttatagaag

SEQ ID NO: 234721 - DNA, 16 bp, P. troglodytes
ctcccaaaaagatatg

SEQ ID NO: 234722 - DNA, 16 bp, P. troglodytes
ctcccaaaatgctgga

SEQ ID NO: 234723 - DNA, 16 bp, P. troglodytes
ctcccaaaatgtgggg

SEQ ID NO: 234724 - DNA, 16 bp, P. troglodytes
ctcccaaaattcacat

SEQ ID NO: 234725 - DNA, 16 bp, P. troglodytes
ctcccaaagaactggg

SEQ ID NO: 234726 - DNA, 16 bp, P. troglodytes
ctcccaaagagctgga

SEQ ID NO: 234727 - DNA, 16 bp, P. troglodytes
ctcccaaagcactgga

SEQ ID NO: 234728 - DNA, 16 bp, P. troglodytes
ctcccaaagtgctgga

SEQ ID NO: 234729 - DNA, 16 bp, P. troglodytes
ctcccaaagtgctggc

SEQ ID NO: 234730 - DNA, 16 bp, P. troglodytes
ctcccaaagtgctggt

SEQ ID NO: 234731 - DNA, 16 bp, P. troglodytes
ctcccaaagtgcttgg

SEQ ID NO: 234732 - DNA, 16 bp, P. troglodytes
ctcccaaagtgtggga

SEQ ID NO: 234733 - DNA, 16 bp, P. troglodytes
ctcccaaataaaccac

SEQ ID NO: 234734 - DNA, 17 bp, P. troglodytes
ctcccaactactcagga

SEQ ID NO: 234735 - DNA, 16 bp, P. troglodytes
ctcccaagaagctgag

SEQ ID NO: 234736 - DNA, 16 bp, P. troglodytes
ctcccaaggtgctgga

SEQ ID NO: 234737 - DNA, 16 bp, P. troglodytes
ctcccaagtaactgaa

SEQ ID NO: 234738 - DNA, 16 bp, P. troglodytes
ctcccaagtagctggc

SEQ ID NO: 234739 - DNA, 16 bp, P. troglodytes
ctcccaagtatctggg

SEQ ID NO: 234740 - DNA, 16 bp, P. troglodytes
ctcccaagtgctggca

SEQ ID NO: 234741 - DNA, 16 bp, P. troglodytes
ctcccaagttcaagcg

SEQ ID NO: 234742 - DNA, 16 bp, P. troglodytes
ctcccaagttcaagtg

SEQ ID NO: 234743 - DNA, 16 bp, P. troglodytes
ctcccaatatcacaga

SEQ ID NO: 234744 - DNA, 16 bp, P. troglodytes
ctcccacaaaatgtgg

SEQ ID NO: 234745 - DNA, 16 bp, P. troglodytes
ctcccacacaataaaa

SEQ ID NO: 234746 - DNA, 16 bp, P. troglodytes
ctcccacacagccggc

SEQ ID NO: 234747 - DNA, 16 bp, P. troglodytes
ctcccacagcctccca

SEQ ID NO: 234748 - DNA, 16 bp, P. troglodytes
ctcccacatatgagtg

SEQ ID NO: 234749 - DNA, 16 bp, P. troglodytes
ctcccacatcagcctc

SEQ ID NO: 234750 - DNA, 16 bp, P. troglodytes
ctcccaccaacagcca

SEQ ID NO: 234751 - DNA, 16 bp, P. troglodytes
ctcccaccagcaatgc

SEQ ID NO: 234752 - DNA, 16 bp, P. troglodytes
ctcccaccagcagtgc

SEQ ID NO: 234753 - DNA, 16 bp, P. troglodytes
ctcccaccaggtccct

SEQ ID NO: 234754 - DNA, 16 bp, P. troglodytes
ctcccaccaggtctct

SEQ ID NO: 234755 - DNA, 16 bp, P. troglodytes
ctcccaccatctgcca

SEQ ID NO: 234756 - DNA, 16 bp, P. troglodytes
ctcccaccatgcccca

SEQ ID NO: 234757 - DNA, 16 bp, P. troglodytes
ctcccaccccagcatc

SEQ ID NO: 234758 - DNA, 16 bp, P. troglodytes
ctcccaccctgtggag

SEQ ID NO: 234759 - DNA, 16 bp, P. troglodytes
ctcccaccgcagcctc

SEQ ID NO: 234760 - DNA, 16 bp, P. troglodytes
ctcccaccgtggcctc

SEQ ID NO: 234761 - DNA, 16 bp, P. troglodytes
ctcccacctcaacctt

SEQ ID NO: 234762 - DNA, 16 bp, P. troglodytes
ctcccacctcagcagc

SEQ ID NO: 234763 - DNA, 16 bp, P. troglodytes
ctcccacctcagcctc

SEQ ID NO: 234764 - DNA, 16 bp, P. troglodytes
ctcccacctcaggccc

SEQ ID NO: 234765 - DNA, 16 bp, P. troglodytes
ctcccacctcagtctc

SEQ ID NO: 234766 - DNA, 16 bp, P. troglodytes
ctcccacctccagcct

SEQ ID NO: 234767 - DNA, 16 bp, P. troglodytes
ctcccacctcccagct

SEQ ID NO: 234768 - DNA, 16 bp, P. troglodytes
ctcccacctcggcttc

SEQ ID NO: 234769 - DNA, 16 bp, P. troglodytes
ctcccacctcgggctc

SEQ ID NO: 234770 - DNA, 16 bp, P. troglodytes
ctcccacctctgcctt

SEQ ID NO: 234771 - DNA, 16 bp, P. troglodytes
ctcccacctgctccct

SEQ ID NO: 234772 - DNA, 16 bp, P. troglodytes
ctcccacctggtccct

SEQ ID NO: 234773 - DNA, 16 bp, P. troglodytes
ctcccaccttagcctc

SEQ ID NO: 234774 - DNA, 16 bp, P. troglodytes
ctcccaccttgacctc

SEQ ID NO: 234775 - DNA, 16 bp, P. troglodytes
ctcccaccttggcctc

SEQ ID NO: 234776 - DNA, 17 bp, P. troglodytes
ctcccacgctcaagtga

SEQ ID NO: 234777 - DNA, 16 bp, P. troglodytes
ctcccacggagcccag

SEQ ID NO: 234778 - DNA, 16 bp, P. troglodytes
ctcccactctgtggct

SEQ ID NO: 234779 - DNA, 16 bp, P. troglodytes
ctcccactgcagcctc

SEQ ID NO: 234780 - DNA, 16 bp, P. troglodytes
ctcccactggccaaag

SEQ ID NO: 234781 - DNA, 16 bp, P. troglodytes
ctcccactggctccct

SEQ ID NO: 234782 - DNA, 16 bp, P. troglodytes
ctcccactggtccctc

SEQ ID NO: 234783 - DNA, 16 bp, P. troglodytes
ctcccacttcaacctc

SEQ ID NO: 234784 - DNA, 16 bp, P. troglodytes
ctcccacttcagcctc

SEQ ID NO: 234785 - DNA, 16 bp, P. troglodytes
ctcccacttcagtttc

SEQ ID NO: 234786 - DNA, 16 bp, P. troglodytes
ctcccagaagtgctgg

SEQ ID NO: 234787 - DNA, 16 bp, P. troglodytes
ctcccagaatgctggg

SEQ ID NO: 234788 - DNA, 16 bp, P. troglodytes
ctcccagagcgctggg

SEQ ID NO: 234789 - DNA, 16 bp, P. troglodytes
ctcccagaggtggagc

SEQ ID NO: 234790 - DNA, 16 bp, P. troglodytes
ctcccagataagcaca

SEQ ID NO: 234791 - DNA, 16 bp, P. troglodytes
ctcccagattcaggtg

SEQ ID NO: 234792 - DNA, 16 bp, P. troglodytes
ctcccagattccttag

SEQ ID NO: 234793 - DNA, 16 bp, P. troglodytes
ctcccagcacagcatt

SEQ ID NO: 234794 - DNA, 16 bp, P. troglodytes
ctcccagcacctgctc

SEQ ID NO: 234795 - DNA, 17 bp, P. troglodytes
ctcccagcactttggga

SEQ ID NO: 234796 - DNA, 16 bp, P. troglodytes
ctcccagccaggccct

SEQ ID NO: 234797 - DNA, 16 bp, P. troglodytes
ctcccagcccagcctc

SEQ ID NO: 234798 - DNA, 16 bp, P. troglodytes
ctcccagccccacctg

SEQ ID NO: 234799 - DNA, 16 bp, P. troglodytes
ctcccagcccctgaca

SEQ ID NO: 234800 - DNA, 16 bp, P. troglodytes
ctcccagccctgcctg

SEQ ID NO: 234801 - DNA, 16 bp, P. troglodytes
ctcccagcctcaggtg

SEQ ID NO: 234802 - DNA, 16 bp, P. troglodytes
ctcccagcctcctcct

SEQ ID NO: 234803 - DNA, 16 bp, P. troglodytes
ctcccagccttttttt

SEQ ID NO: 234804 - DNA, 16 bp, P. troglodytes
ctcccagctcccagcc

SEQ ID NO: 234805 - DNA, 16 bp, P. troglodytes
ctcccagctgtgaaag

SEQ ID NO: 234806 - DNA, 16 bp, P. troglodytes
ctcccagcttagcctc

SEQ ID NO: 234807 - DNA, 16 bp, P. troglodytes
ctcccaggatcaagag

SEQ ID NO: 234808 - DNA, 16 bp, P. troglodytes
ctcccaggctacatct

SEQ ID NO: 234809 - DNA, 16 bp, P. troglodytes
ctcccaggctggaggg

SEQ ID NO: 234810 - DNA, 16 bp, P. troglodytes
ctcccaggctggtgtg

SEQ ID NO: 234811 - DNA, 16 bp, P. troglodytes
ctcccaggtcctcttc

SEQ ID NO: 234812 - DNA, 16 bp, P. troglodytes
ctcccaggttaaagtg

SEQ ID NO: 234813 - DNA, 16 bp, P. troglodytes
ctcccaggttgaagag

SEQ ID NO: 234814 - DNA, 16 bp, P. troglodytes
ctcccaggtttaggtg

SEQ ID NO: 234815 - DNA, 16 bp, P. troglodytes
ctcccagtactatgtt

SEQ ID NO: 234816 - DNA, 16 bp, P. troglodytes
ctcccagtaggggctg

SEQ ID NO: 234817 - DNA, 16 bp, P. troglodytes
ctcccagtagttggga

SEQ ID NO: 234818 - DNA, 16 bp, P. troglodytes
ctcccagtccagtgct

SEQ ID NO: 234819 - DNA, 16 bp, P. troglodytes
ctcccagtctgtggtt

SEQ ID NO: 234820 - DNA, 16 bp, P. troglodytes
ctcccataattcccac

SEQ ID NO: 234821 - DNA, 16 bp, P. troglodytes
ctcccataattttgtt

SEQ ID NO: 234822 - DNA, 16 bp, P. troglodytes
ctcccatacaaaggga

SEQ ID NO: 234823 - DNA, 16 bp, P. troglodytes
ctcccatacaataata

SEQ ID NO: 234824 - DNA, 16 bp, P. troglodytes
ctcccatctcaacctc

SEQ ID NO: 234825 - DNA, 16 bp, P. troglodytes
ctcccatctccctgga

SEQ ID NO: 234826 - DNA, 16 bp, P. troglodytes
ctcccatgataactaa

SEQ ID NO: 234827 - DNA, 16 bp, P. troglodytes
ctcccatgtcagcctc

SEQ ID NO: 234828 - DNA, 16 bp, P. troglodytes
ctcccattaaaaaaaa

SEQ ID NO: 234829 - DNA, 16 bp, P. troglodytes
ctcccatttcagcctc

SEQ ID NO: 234830 - DNA, 16 bp, P. troglodytes
ctcccatttggaatag

SEQ ID NO: 234831 - DNA, 16 bp, P. troglodytes
ctcccattttacagat

SEQ ID NO: 234832 - DNA, 16 bp, P. troglodytes
ctccccacaacaaaga

SEQ ID NO: 234833 - DNA, 16 bp, P. troglodytes
ctccccacaccaagct

SEQ ID NO: 234834 - DNA, 16 bp, P. troglodytes
ctccccacagcccctg

SEQ ID NO: 234835 - DNA, 16 bp, P. troglodytes
ctccccacagcctctg

SEQ ID NO: 234836 - DNA, 16 bp, P. troglodytes
ctccccacatctcaga

SEQ ID NO: 234837 - DNA, 16 bp, P. troglodytes
ctccccaccccagggc

SEQ ID NO: 234838 - DNA, 17 bp, P. troglodytes
ctccccacccttgagaa

SEQ ID NO: 234839 - DNA, 16 bp, P. troglodytes
ctccccacctcagcct

SEQ ID NO: 234840 - DNA, 16 bp, P. troglodytes
ctccccacttcccaga

SEQ ID NO: 234841 - DNA, 16 bp, P. troglodytes
ctccccagccatgcag

SEQ ID NO: 234842 - DNA, 20 bp, P. troglodytes
ctccccagccatgtggaact

SEQ ID NO: 234843 - DNA, 16 bp, P. troglodytes
ctccccagctcctggc

SEQ ID NO: 234844 - DNA, 16 bp, P. troglodytes
ctccccagggcctctg

SEQ ID NO: 234845 - DNA, 16 bp, P. troglodytes
ctccccagggcctggc

SEQ ID NO: 234846 - DNA, 16 bp, P. troglodytes
ctccccaggtgctggg

SEQ ID NO: 234847 - DNA, 16 bp, P. troglodytes
ctccccatcagtttca

SEQ ID NO: 234848 - DNA, 16 bp, P. troglodytes
ctccccatcccactga

SEQ ID NO: 234849 - DNA, 16 bp, P. troglodytes
ctccccatctgtaaaa

SEQ ID NO: 234850 - DNA, 16 bp, P. troglodytes
ctcccccagcctctgg

SEQ ID NO: 234851 - DNA, 16 bp, P. troglodytes
ctcccccaggccctgg

SEQ ID NO: 234852 - DNA, 16 bp, P. troglodytes
ctcccccaggctggag

SEQ ID NO: 234853 - DNA, 16 bp, P. troglodytes
ctcccccatattttgc

SEQ ID NO: 234854 - DNA, 16 bp, P. troglodytes
ctccccccaccaagct

SEQ ID NO: 234855 - DNA, 16 bp, P. troglodytes
ctccccctcccaaagt

SEQ ID NO: 234856 - DNA, 16 bp, P. troglodytes
ctccccgctcagcctc

SEQ ID NO: 234857 - DNA, 16 bp, P. troglodytes
ctccccgggttcaagc

SEQ ID NO: 234858 - DNA, 16 bp, P. troglodytes
ctcccctagctcccca

SEQ ID NO: 234859 - DNA, 16 bp, P. troglodytes
ctcccctattctgagc

SEQ ID NO: 234860 - DNA, 16 bp, P. troglodytes
ctcccctcagcccctg

SEQ ID NO: 234861 - DNA, 16 bp, P. troglodytes
ctcccctctccactga

SEQ ID NO: 234862 - DNA, 16 bp, P. troglodytes
ctcccctgaactccag

SEQ ID NO: 234863 - DNA, 16 bp, P. troglodytes
ctcccctggagcctcc

SEQ ID NO: 234864 - DNA, 16 bp, P. troglodytes
ctccccttcccccagg

SEQ ID NO: 234865 - DNA, 16 bp, P. troglodytes
ctccccttccctgggg

SEQ ID NO: 234866 - DNA, 16 bp, P. troglodytes
ctccccttcctgctga

SEQ ID NO: 234867 - DNA, 16 bp, P. troglodytes
ctccccttcctgtgtc

SEQ ID NO: 234868 - DNA, 16 bp, P. troglodytes
ctcccctttacaaaac

SEQ ID NO: 234869 - DNA, 16 bp, P. troglodytes
ctcccgaatagctgga

SEQ ID NO: 234870 - DNA, 16 bp, P. troglodytes
ctcccgaattcaagca

SEQ ID NO: 234871 - DNA, 16 bp, P. troglodytes
ctcccgagaagctggg

SEQ ID NO: 234872 - DNA, 17 bp, P. troglodytes
ctcccgagtacctgaga

SEQ ID NO: 234873 - DNA, 18 bp, P. troglodytes
ctcccgagtagttgggac

SEQ ID NO: 234874 - DNA, 16 bp, P. troglodytes
ctcccgagtggctgga

SEQ ID NO: 234875 - DNA, 16 bp, P. troglodytes
ctcccgagttccagtg

SEQ ID NO: 234876 - DNA, 16 bp, P. troglodytes
ctcccgcctcagccct

SEQ ID NO: 234877 - DNA, 16 bp, P. troglodytes
ctcccgcctcccgggt

SEQ ID NO: 234878 - DNA, 16 bp, P. troglodytes
ctcccgcctcctgggt

SEQ ID NO: 234879 - DNA, 16 bp, P. troglodytes
ctcccgcctgagcctc

SEQ ID NO: 234880 - DNA, 16 bp, P. troglodytes
ctcccgcctgggcgac

SEQ ID NO: 234881 - DNA, 16 bp, P. troglodytes
ctcccggattcaagcg

SEQ ID NO: 234882 - DNA, 16 bp, P. troglodytes
ctcccgggctcaagtg

SEQ ID NO: 234883 - DNA, 16 bp, P. troglodytes
ctcccgggttcaggcg

SEQ ID NO: 234884 - DNA, 16 bp, P. troglodytes
ctcccgggttctagca

SEQ ID NO: 234885 - DNA, 16 bp, P. troglodytes
ctccctaagtgctagg

SEQ ID NO: 234886 - DNA, 32 bp, P. troglodytes
ctccctaatctcaagtacccagggacacaaaa

SEQ ID NO: 234887 - DNA, 16 bp, P. troglodytes
ctccctagaaaatggg

SEQ ID NO: 234888 - DNA, 16 bp, P. troglodytes
ctccctagcagctgag

SEQ ID NO: 234889 - DNA, 16 bp, P. troglodytes
ctccctcagcccctgg

SEQ ID NO: 234890 - DNA, 16 bp, P. troglodytes
ctccctcagcctctca

SEQ ID NO: 234891 - DNA, 16 bp, P. troglodytes
ctccctcagcctctgg

SEQ ID NO: 234892 - DNA, 16 bp, P. troglodytes
ctccctcagcttcctg

SEQ ID NO: 234893 - DNA, 16 bp, P. troglodytes
ctccctcagcttgcag

SEQ ID NO: 234894 - DNA, 28 bp, P. troglodytes
ctccctcagcttgcagggaggtgtggag

SEQ ID NO: 234895 - DNA, 16 bp, P. troglodytes
ctccctcagtgctggg

SEQ ID NO: 234896 - DNA, 16 bp, P. troglodytes
ctccctcatttctgaa

SEQ ID NO: 234897 - DNA, 16 bp, P. troglodytes
ctccctccactcccag

SEQ ID NO: 234898 - DNA, 16 bp, P. troglodytes
ctccctccagcctctg

SEQ ID NO: 234899 - DNA, 16 bp, P. troglodytes
ctccctccccttttga

SEQ ID NO: 234900 - DNA, 16 bp, P. troglodytes
ctccctccctccctga

SEQ ID NO: 234901 - DNA, 16 bp, P. troglodytes
ctccctccctcctgca

SEQ ID NO: 234902 - DNA, 16 bp, P. troglodytes
ctccctccctgcagcc

SEQ ID NO: 234903 - DNA, 16 bp, P. troglodytes
ctccctcctcagcctc

SEQ ID NO: 234904 - DNA, 16 bp, P. troglodytes
ctccctcctcagctcc

SEQ ID NO: 234905 - DNA, 16 bp, P. troglodytes
ctccctcctgcctcag

SEQ ID NO: 234906 - DNA, 16 bp, P. troglodytes
ctccctcctgctctgg

SEQ ID NO: 234907 - DNA, 16 bp, P. troglodytes
ctccctccttccccag

SEQ ID NO: 234908 - DNA, 16 bp, P. troglodytes
ctccctctcaaataaa

SEQ ID NO: 234909 - DNA, 16 bp, P. troglodytes
ctccctctcctcagcc

SEQ ID NO: 234910 - DNA, 16 bp, P. troglodytes
ctccctctctgggcct

SEQ ID NO: 234911 - DNA, 16 bp, P. troglodytes
ctccctctgaaggctc

SEQ ID NO: 234912 - DNA, 16 bp, P. troglodytes
ctccctctgcccccag

SEQ ID NO: 234913 - DNA, 16 bp, P. troglodytes
ctccctctgctccagc

SEQ ID NO: 234914 - DNA, 16 bp, P. troglodytes
ctccctctgtctctgc

SEQ ID NO: 234915 - DNA, 16 bp, P. troglodytes
ctccctctgtctctgt

SEQ ID NO: 234916 - DNA, 16 bp, P. troglodytes
ctccctctgtgtctct

SEQ ID NO: 234917 - DNA, 16 bp, P. troglodytes
ctccctctgtgtgtgt

SEQ ID NO: 234918 - DNA, 16 bp, P. troglodytes
ctccctctgtttccca

SEQ ID NO: 234919 - DNA, 16 bp, P. troglodytes
ctccctcttcagcttc

SEQ ID NO: 234920 - DNA, 16 bp, P. troglodytes
ctccctgcaacctcag

SEQ ID NO: 234921 - DNA, 16 bp, P. troglodytes
ctccctgcacacacac

SEQ ID NO: 234922 - DNA, 16 bp, P. troglodytes
ctccctgcagcccctg

SEQ ID NO: 234923 - DNA, 16 bp, P. troglodytes
ctccctgcagcctcaa

SEQ ID NO: 234924 - DNA, 16 bp, P. troglodytes
ctccctgcagcctcag

SEQ ID NO: 234925 - DNA, 16 bp, P. troglodytes
ctccctgccacctcca

SEQ ID NO: 234926 - DNA, 16 bp, P. troglodytes
ctccctgcctcagtct

SEQ ID NO: 234927 - DNA, 16 bp, P. troglodytes
ctccctgctgcctggg

SEQ ID NO: 234928 - DNA, 16 bp, P. troglodytes
ctccctgcttccacct

SEQ ID NO: 234929 - DNA, 16 bp, P. troglodytes
ctccctggaggaggtg

SEQ ID NO: 234930 - DNA, 16 bp, P. troglodytes
ctccctggccatgtgg

SEQ ID NO: 234931 - DNA, 16 bp, P. troglodytes
ctccctggcctcagcc

SEQ ID NO: 234932 - DNA, 16 bp, P. troglodytes
ctccctggctcaggtg

SEQ ID NO: 234933 - DNA, 16 bp, P. troglodytes
ctccctggctggagtg

SEQ ID NO: 234934 - DNA, 16 bp, P. troglodytes
ctccctggcttcagcc

SEQ ID NO: 234935 - DNA, 16 bp, P. troglodytes
ctccctggcttgcaga

SEQ ID NO: 234936 - DNA, 16 bp, P. troglodytes
ctccctgggcctccca

SEQ ID NO: 234937 - DNA, 16 bp, P. troglodytes
ctccctgggcctccct

SEQ ID NO: 234938 - DNA, 16 bp, P. troglodytes
ctccctggggcctggg

SEQ ID NO: 234939 - DNA, 16 bp, P. troglodytes
ctccctggtctccctg

SEQ ID NO: 234940 - DNA, 16 bp, P. troglodytes
ctccctggtgcactgt

SEQ ID NO: 234941 - DNA, 16 bp, P. troglodytes
ctccctggttcaagtg

SEQ ID NO: 234942 - DNA, 16 bp, P. troglodytes
ctccctgtctccatgt

SEQ ID NO: 234943 - DNA, 16 bp, P. troglodytes
ctccctgtctctctgt

SEQ ID NO: 234944 - DNA, 16 bp, P. troglodytes
ctccctgtgcagcctg

SEQ ID NO: 234945 - DNA, 16 bp, P. troglodytes
ctccctgtgccaccca

SEQ ID NO: 234946 - DNA, 16 bp, P. troglodytes
ctccctgtggggcagg

SEQ ID NO: 234947 - DNA, 16 bp, P. troglodytes
ctccctgtgtgtgtgt

SEQ ID NO: 234948 - DNA, 16 bp, P. troglodytes
ctccctgtgttctcac

SEQ ID NO: 234949 - DNA, 16 bp, P. troglodytes
ctcccttcagcatttc

SEQ ID NO: 234950 - DNA, 16 bp, P. troglodytes
ctcccttcaggagctc

SEQ ID NO: 234951 - DNA, 16 bp, P. troglodytes
ctcccttcccagcctc

SEQ ID NO: 234952 - DNA, 16 bp, P. troglodytes
ctcccttctcagcctc

SEQ ID NO: 234953 - DNA, 16 bp, P. troglodytes
ctcccttctcagcttc

SEQ ID NO: 234954 - DNA, 16 bp, P. troglodytes
ctcccttctcaggccc

SEQ ID NO: 234955 - DNA, 16 bp, P. troglodytes
ctcccttctgagtctc

SEQ ID NO: 234956 - DNA, 16 bp, P. troglodytes
ctccgacctcagcctc

SEQ ID NO: 234957 - DNA, 16 bp, P. troglodytes
ctccgcctcccagctt

SEQ ID NO: 234958 - DNA, 16 bp, P. troglodytes
ctccgcctcccgggct

SEQ ID NO: 234959 - DNA, 18 bp, P. troglodytes
ctccgcctcccgggttcc

SEQ ID NO: 234960 - DNA, 17 bp, P. troglodytes
ctccgcctcccgggttt

SEQ ID NO: 234961 - DNA, 16 bp, P. troglodytes
ctccgcctccctggct

SEQ ID NO: 234962 - DNA, 16 bp, P. troglodytes
ctccgcctccgggatt

SEQ ID NO: 234963 - DNA, 16 bp, P. troglodytes
ctccgcctcctgcgtt

SEQ ID NO: 234964 - DNA, 18 bp, P. troglodytes
ctccgcctgccgggttca

SEQ ID NO: 234965 - DNA, 16 bp, P. troglodytes
ctccgcctgggcaaca

SEQ ID NO: 234966 - DNA, 16 bp, P. troglodytes
ctccgccttctgggtt

SEQ ID NO: 234967 - DNA, 16 bp, P. troglodytes
ctccgcttcctgggct

SEQ ID NO: 234968 - DNA, 16 bp, P. troglodytes
ctccggcctcagcctc

SEQ ID NO: 234969 - DNA, 16 bp, P. troglodytes
ctccggggctcaagcg

SEQ ID NO: 234970 - DNA, 16 bp, P. troglodytes
ctccggtctcagcctc

SEQ ID NO: 234971 - DNA, 16 bp, P. troglodytes
ctccgtcccccaggct

SEQ ID NO: 234972 - DNA, 16 bp, P. troglodytes
ctcctaaagcactggg

SEQ ID NO: 234973 - DNA, 16 bp, P. troglodytes
ctcctaaagtgctgag

SEQ ID NO: 234974 - DNA, 17 bp, P. troglodytes
ctcctaacctcgtgatc

SEQ ID NO: 234975 - DNA, 16 bp, P. troglodytes
ctcctaaccttgtgat

SEQ ID NO: 234976 - DNA, 16 bp, P. troglodytes
ctcctaagcctccagg

SEQ ID NO: 234977 - DNA, 16 bp, P. troglodytes
ctcctaataccatcac

SEQ ID NO: 234978 - DNA, 16 bp, P. troglodytes
ctcctaccagcaccat

SEQ ID NO: 234979 - DNA, 16 bp, P. troglodytes
ctcctaccccagcctc

SEQ ID NO: 234980 - DNA, 16 bp, P. troglodytes
ctcctacctcagcccc

SEQ ID NO: 234981 - DNA, 16 bp, P. troglodytes
ctcctacctcagcctc

SEQ ID NO: 234982 - DNA, 16 bp, P. troglodytes
ctcctacctcagcctg

SEQ ID NO: 234983 - DNA, 16 bp, P. troglodytes
ctcctacctcagtctc

SEQ ID NO: 234984 - DNA, 16 bp, P. troglodytes
ctcctacctcggcctc

SEQ ID NO: 234985 - DNA, 16 bp, P. troglodytes
ctcctacctgagcctc

SEQ ID NO: 234986 - DNA, 23 bp, P. troglodytes
ctcctactacattcctttttgct

SEQ ID NO: 234987 - DNA, 16 bp, P. troglodytes
ctcctactgggaggtg

SEQ ID NO: 234988 - DNA, 17 bp, P. troglodytes
ctcctagcactttggga

SEQ ID NO: 234989 - DNA, 16 bp, P. troglodytes
ctcctaggctcaggtg

SEQ ID NO: 234990 - DNA, 16 bp, P. troglodytes
ctcctaggctccagca

SEQ ID NO: 234991 - DNA, 16 bp, P. troglodytes
ctcctatcaaagaaaa

SEQ ID NO: 234992 - DNA, 16 bp, P. troglodytes
ctcctatctcagcctc

SEQ ID NO: 234993 - DNA, 16 bp, P. troglodytes
ctcctatctctgcctc

SEQ ID NO: 234994 - DNA, 16 bp, P. troglodytes
ctcctattctgtgggt

SEQ ID NO: 234995 - DNA, 16 bp, P. troglodytes
ctcctcaaacatttat

SEQ ID NO: 234996 - DNA, 16 bp, P. troglodytes
ctcctcacatcccaga

SEQ ID NO: 234997 - DNA, 16 bp, P. troglodytes
ctcctcacccctgcct

SEQ ID NO: 234998 - DNA, 16 bp, P. troglodytes
ctcctcacctcccgga

SEQ ID NO: 234999 - DNA, 16 bp, P. troglodytes
ctcctcactgtgtcct

SEQ ID NO: 235000 - DNA, 17 bp, P. troglodytes
ctcctcacttcccagac

SEQ ID NO: 235001 - DNA, 16 bp, P. troglodytes
ctcctcacttcccagg

SEQ ID NO: 235002 - DNA, 16 bp, P. troglodytes
ctcctcacttcctaga

SEQ ID NO: 235003 - DNA, 34 bp, P. troglodytes; identical to SEQ ID NO: 86659

SEQ ID NO: 235004 - DNA, 16 bp, P. troglodytes
ctcctcagaaaattgg

SEQ ID NO: 235005 - DNA, 16 bp, P. troglodytes
ctcctcagaagaaata

SEQ ID NO: 235006 - DNA, 29 bp, P. troglodytes
ctcctcagcaaatgtaaaagaacagaaat

SEQ ID NO: 235007 - DNA, 16 bp, P. troglodytes
ctcctcagcacagacc

SEQ ID NO: 235008 - DNA, 17 bp, P. troglodytes
ctcctcagcctcccaag

SEQ ID NO: 235009 - DNA, 16 bp, P. troglodytes
ctcctcagcctgcaga

SEQ ID NO: 235010 - DNA, 16 bp, P. troglodytes
ctcctcagctcttggg

SEQ ID NO: 235011 - DNA, 16 bp, P. troglodytes
ctcctcagcttgcaga

SEQ ID NO: 235012 - DNA, 16 bp, P. troglodytes
ctcctcagtaaatgta

SEQ ID NO: 235013 - DNA, 16 bp, P. troglodytes
ctcctcagtctcctga

SEQ ID NO: 235014 - DNA, 16 bp, P. troglodytes
ctcctcagttcaagca

SEQ ID NO: 235015 - DNA, 16 bp, P. troglodytes
ctcctcatctccatct

SEQ ID NO: 235016 - DNA, 28 bp, P. troglodytes
ctcctccacctcttgtggagggcctgac

SEQ ID NO: 235017 - DNA, 16 bp, P. troglodytes
ctcctccagaaagctc

SEQ ID NO: 235018 - DNA, 16 bp, P. troglodytes
ctcctccagcccttcc

SEQ ID NO: 235019 - DNA, 16 bp, P. troglodytes
ctcctccagcctcagc

SEQ ID NO: 235020 - DNA, 16 bp, P. troglodytes
ctcctccagcctctgc

SEQ ID NO: 235021 - DNA, 16 bp, P. troglodytes
ctcctccaggaaggct

SEQ ID NO: 235022 - DNA, 16 bp, P. troglodytes
ctcctccagggagcct

SEQ ID NO: 235023 - DNA, 16 bp, P. troglodytes
ctcctcccacctcagc

SEQ ID NO: 235024 - DNA, 16 bp, P. troglodytes
ctcctcccagccccag

SEQ ID NO: 235025 - DNA, 16 bp, P. troglodytes
ctcctcccagctcctg

SEQ ID NO: 235026 - DNA, 16 bp, P. troglodytes
ctcctcccagcttcca

SEQ ID NO: 235027 - DNA, 16 bp, P. troglodytes
ctcctcccaggttcaa

SEQ ID NO: 235028 - DNA, 16 bp, P. troglodytes
ctcctcccatgaatca

SEQ ID NO: 235029 - DNA, 16 bp, P. troglodytes
ctcctccctcagcctc

SEQ ID NO: 235030 - DNA, 16 bp, P. troglodytes
ctcctccctcagcctg

SEQ ID NO: 235031 - DNA, 16 bp, P. troglodytes
ctcctccctcagcctt

SEQ ID NO: 235032 - DNA, 16 bp, P. troglodytes
ctcctccctcagctcc

SEQ ID NO: 235033 - DNA, 16 bp, P. troglodytes
ctcctccctcatgaat

SEQ ID NO: 235034 - DNA, 16 bp, P. troglodytes
ctcctccctgtcctca

SEQ ID NO: 235035 - DNA, 16 bp, P. troglodytes
ctcctccctgtctcca

SEQ ID NO: 235036 - DNA, 16 bp, P. troglodytes
ctcctccctgtgtctt

SEQ ID NO: 235037 - DNA, 16 bp, P. troglodytes
ctcctcccttctcaga

SEQ ID NO: 235038 - DNA, 16 bp, P. troglodytes
ctcctcctacctcagc

SEQ ID NO: 235039 - DNA, 16 bp, P. troglodytes
ctcctcctccagagga

SEQ ID NO: 235040 - DNA, 16 bp, P. troglodytes
ctcctcctccagggct

SEQ ID NO: 235041 - DNA, 16 bp, P. troglodytes
ctcctcctcccactgc

SEQ ID NO: 235042 - DNA, 16 bp, P. troglodytes
ctcctcctccccaggg

SEQ ID NO: 235043 - DNA, 16 bp, P. troglodytes
ctcctcctcctcagct

SEQ ID NO: 235044 - DNA, 16 bp, P. troglodytes
ctcctcctctgcccac

SEQ ID NO: 235045 - DNA, 16 bp, P. troglodytes
ctcctcctcttcctgg

SEQ ID NO: 235046 - DNA, 16 bp, P. troglodytes
ctcctcctgcccccag

SEQ ID NO: 235047 - DNA, 16 bp, P. troglodytes
ctcctcctgccctcca

SEQ ID NO: 235048 - DNA, 16 bp, P. troglodytes
ctcctcctgcctccca

SEQ ID NO: 235049 - DNA, 16 bp, P. troglodytes
ctcctcctgggactct

SEQ ID NO: 235050 - DNA, 16 bp, P. troglodytes
ctcctccttcagcctc

SEQ ID NO: 235051 - DNA, 16 bp, P. troglodytes
ctcctccttccccagg

SEQ ID NO: 235052 - DNA, 16 bp, P. troglodytes
ctcctccttcctgctg

SEQ ID NO: 235053 - DNA, 16 bp, P. troglodytes
ctcctcgcttcccaga

SEQ ID NO: 235054 - DNA, 16 bp, P. troglodytes
ctcctcggcctcggcg

SEQ ID NO: 235055 - DNA, 16 bp, P. troglodytes
ctcctcggttcaagca

SEQ ID NO: 235056 - DNA, 16 bp, P. troglodytes
ctcctctcagcccctg

SEQ ID NO: 235057 - DNA, 16 bp, P. troglodytes
ctcctctcagcctccc

SEQ ID NO: 235058 - DNA, 16 bp, P. troglodytes
ctcctctccagcacct

SEQ ID NO: 235059 - DNA, 16 bp, P. troglodytes
ctcctctctcagcctc

SEQ ID NO: 235060 - DNA, 16 bp, P. troglodytes
ctcctctctgggcaag

SEQ ID NO: 235061 - DNA, 16 bp, P. troglodytes
ctcctctgagctccag

SEQ ID NO: 235062 - DNA, 16 bp, P. troglodytes
ctcctctgcactccag

SEQ ID NO: 235063 - DNA, 16 bp, P. troglodytes
ctcctctgccttccac

SEQ ID NO: 235064 - DNA, 16 bp, P. troglodytes
ctcctctgccttctgc

SEQ ID NO: 235065 - DNA, 16 bp, P. troglodytes
ctcctctgtaaaatgg

SEQ ID NO: 235066 - DNA, 16 bp, P. troglodytes
ctcctctgtctcaaaa

SEQ ID NO: 235067 - DNA, 16 bp, P. troglodytes
ctcctctgtgtgtgtc

SEQ ID NO: 235068 - DNA, 16 bp, P. troglodytes
ctcctcttcagcctcc

SEQ ID NO: 235069 - DNA, 16 bp, P. troglodytes
ctcctcttcttataaa

SEQ ID NO: 235070 - DNA, 16 bp, P. troglodytes
ctcctcttcttatgag

SEQ ID NO: 235071 - DNA, 16 bp, P. troglodytes
ctcctcttgttgaatt

SEQ ID NO: 235072 - DNA, 16 bp, P. troglodytes
ctcctctttctcctgg

SEQ ID NO: 235073 - DNA, 16 bp, P. troglodytes
ctcctgaagctgtgtc

SEQ ID NO: 235074 - DNA, 16 bp, P. troglodytes
ctcctgaaggaagcag

SEQ ID NO: 235075 - DNA, 16 bp, P. troglodytes
ctcctgaaggacctgc

SEQ ID NO: 235076 - DNA, 16 bp, P. troglodytes
ctcctgaagggcctgc

SEQ ID NO: 235077 - DNA, 16 bp, P. troglodytes
ctcctgaatacaggac

SEQ ID NO: 235078 - DNA, 16 bp, P. troglodytes
ctcctgacaggccctg

SEQ ID NO: 235079 - DNA, 16 bp, P. troglodytes
ctcctgacatcaagtg

SEQ ID NO: 235080 - DNA, 16 bp, P. troglodytes
ctcctgaccacatgat

SEQ ID NO: 235081 - DNA, 16 bp, P. troglodytes
ctcctgaccctgtgat

SEQ ID NO: 235082 - DNA, 16 bp, P. troglodytes
ctcctgaccgcaagtg

SEQ ID NO: 235083 - DNA, 16 bp, P. troglodytes
ctcctgacctagtgat

SEQ ID NO: 235084 - DNA, 16 bp, P. troglodytes
ctcctgacctcaaagt

SEQ ID NO: 235085 - DNA, 16 bp, P. troglodytes
ctcctgacctcagctg

SEQ ID NO: 235086 - DNA, 17 bp, P. troglodytes
ctcctgacctcatgatc

SEQ ID NO: 235087 - DNA, 17 bp, P. troglodytes
ctcctgacctcatgatt

SEQ ID NO: 235088 - DNA, 16 bp, P. troglodytes
ctcctgacctcatgct

SEQ ID NO: 235089 - DNA, 16 bp, P. troglodytes
ctcctgacctcattat

SEQ ID NO: 235090 - DNA, 17 bp, P. troglodytes
ctcctgacctcctgatc

SEQ ID NO: 235091 - DNA, 16 bp, P. troglodytes
ctcctgacctcgtaat

SEQ ID NO: 235092 - DNA, 16 bp, P. troglodytes
ctcctgacctcgtgaa

SEQ ID NO: 235093 - DNA, 17 bp, P. troglodytes
ctcctgacctcgtgatc

SEQ ID NO: 235094 - DNA, 17 bp, P. troglodytes
ctcctgacctcgtgatg

SEQ ID NO: 235095 - DNA, 17 bp, P. troglodytes
ctcctgacctcgtgatt

SEQ ID NO: 235096 - DNA, 16 bp, P. troglodytes
ctcctgacctcttgat

SEQ ID NO: 235097 - DNA, 17 bp, P. troglodytes
ctcctgacctggtgatc

SEQ ID NO: 235098 - DNA, 16 bp, P. troglodytes
ctcctgaccttgcgat

SEQ ID NO: 235099 - DNA, 17 bp, P. troglodytes
ctcctgaccttgtgatc

SEQ ID NO: 235100 - DNA, 17 bp, P. troglodytes
ctcctgaccttgtgatt

SEQ ID NO: 235101 - DNA, 17 bp, P. troglodytes
ctcctgaccttgtggtc

SEQ ID NO: 235102 - DNA, 16 bp, P. troglodytes
ctcctgactcagactc

SEQ ID NO: 235103 - DNA, 16 bp, P. troglodytes
ctcctgactcagcctc

SEQ ID NO: 235104 - DNA, 16 bp, P. troglodytes
ctcctgacttcaagag

SEQ ID NO: 235105 - DNA, 16 bp, P. troglodytes
ctcctgacttcaagca

SEQ ID NO: 235106 - DNA, 17 bp, P. troglodytes
ctcctgacttcgtgatc

SEQ ID NO: 235107 - DNA, 16 bp, P. troglodytes
ctcctgagagctgttc

SEQ ID NO: 235108 - DNA, 16 bp, P. troglodytes
ctcctgagaggctggg

SEQ ID NO: 235109 - DNA, 16 bp, P. troglodytes
ctcctgagcctcccaa

SEQ ID NO: 235110 - DNA, 16 bp, P. troglodytes
ctcctgagctcaaagg

SEQ ID NO: 235111 - DNA, 16 bp, P. troglodytes
ctcctgagctcaagaa

SEQ ID NO: 235112 - DNA, 16 bp, P. troglodytes
ctcctgaggctcaagc

SEQ ID NO: 235113 - DNA, 16 bp, P. troglodytes
ctcctgaggcttctgt

SEQ ID NO: 235114 - DNA, 16 bp, P. troglodytes
ctcctgagtagctgat

SEQ ID NO: 235115 - DNA, 16 bp, P. troglodytes
ctcctgagtagctgct

SEQ ID NO: 235116 - DNA, 16 bp, P. troglodytes
ctcctgagttcaagca

SEQ ID NO: 235117 - DNA, 16 bp, P. troglodytes
ctcctgagttcaagcc

SEQ ID NO: 235118 - DNA, 16 bp, P. troglodytes
ctcctgagttcaagtg

SEQ ID NO: 235119 - DNA, 18 bp, P. troglodytes
ctcctgatctcaggtgat

SEQ ID NO: 235120 - DNA, 16 bp, P. troglodytes
ctcctgcagcaccccc

SEQ ID NO: 235121 - DNA, 16 bp, P. troglodytes
ctcctgcagcgccccc

SEQ ID NO: 235122 - DNA, 16 bp, P. troglodytes
ctcctgcaggacccag

SEQ ID NO: 235123 - DNA, 16 bp, P. troglodytes
ctcctgcatcagcctc

SEQ ID NO: 235124 - DNA, 16 bp, P. troglodytes
ctcctgcatcagcttc

SEQ ID NO: 235125 - DNA, 16 bp, P. troglodytes
ctcctgcattcattga

SEQ ID NO: 235126 - DNA, 16 bp, P. troglodytes
ctcctgccaacagcca

SEQ ID NO: 235127 - DNA, 16 bp, P. troglodytes
ctcctgccaggcccca

SEQ ID NO: 235128 - DNA, 16 bp, P. troglodytes
ctcctgccattttatt

SEQ ID NO: 235129 - DNA, 16 bp, P. troglodytes
ctcctgccccagctcc

SEQ ID NO: 235130 - DNA, 16 bp, P. troglodytes
ctcctgccccagctgc

SEQ ID NO: 235131 - DNA, 16 bp, P. troglodytes
ctcctgccccagtctc

SEQ ID NO: 235132 - DNA, 16 bp, P. troglodytes
ctcctgcccccagcac

SEQ ID NO: 235133 - DNA, 16 bp, P. troglodytes
ctcctgccctgcagcc

SEQ ID NO: 235134 - DNA, 16 bp, P. troglodytes
ctcctgccgtagcctc

SEQ ID NO: 235135 - DNA, 16 bp, P. troglodytes
ctcctgcctcaacctc

SEQ ID NO: 235136 - DNA, 16 bp, P. troglodytes
ctcctgcctcaagcct

SEQ ID NO: 235137 - DNA, 16 bp, P. troglodytes
ctcctgcctcaatctc

SEQ ID NO: 235138 - DNA, 16 bp, P. troglodytes
ctcctgcctcaccatc

SEQ ID NO: 235139 - DNA, 16 bp, P. troglodytes
ctcctgcctcacctcc

SEQ ID NO: 235140 - DNA, 16 bp, P. troglodytes
ctcctgcctcactgcc

SEQ ID NO: 235141 - DNA, 16 bp, P. troglodytes
ctcctgcctcagaccc

SEQ ID NO: 235142 - DNA, 16 bp, P. troglodytes
ctcctgcctcagactc

SEQ ID NO: 235143 - DNA, 16 bp, P. troglodytes
ctcctgcctcagcatc

SEQ ID NO: 235144 - DNA, 16 bp, P. troglodytes
ctcctgcctcagccac

SEQ ID NO: 235145 - DNA, 16 bp, P. troglodytes
ctcctgcctcagcccc

SEQ ID NO: 235146 - DNA, 16 bp, P. troglodytes
ctcctgcctcagcctg

SEQ ID NO: 235147 - DNA, 16 bp, P. troglodytes
ctcctgcctcagcctt

SEQ ID NO: 235148 - DNA, 16 bp, P. troglodytes
ctcctgcctcagctac

SEQ ID NO: 235149 - DNA, 16 bp, P. troglodytes
ctcctgcctcagcttc

SEQ ID NO: 235150 - DNA, 16 bp, P. troglodytes
ctcctgcctcagtctc

SEQ ID NO: 235151 - DNA, 16 bp, P. troglodytes
ctcctgcctcagtctt

SEQ ID NO: 235152 - DNA, 16 bp, P. troglodytes
ctcctgcctcagtgtc

SEQ ID NO: 235153 - DNA, 16 bp, P. troglodytes
ctcctgcctcatcctc

SEQ ID NO: 235154 - DNA, 16 bp, P. troglodytes
ctcctgcctcccagcc

SEQ ID NO: 235155 - DNA, 16 bp, P. troglodytes
ctcctgcctcctcagc

SEQ ID NO: 235156 - DNA, 16 bp, P. troglodytes
ctcctgcctcggcctt

SEQ ID NO: 235157 - DNA, 16 bp, P. troglodytes
ctcctgcctgactgcc

SEQ ID NO: 235158 - DNA, 16 bp, P. troglodytes
ctcctgcctgagcctc

SEQ ID NO: 235159 - DNA, 16 bp, P. troglodytes
ctcctgcctgcctgcc

SEQ ID NO: 235160 - DNA, 16 bp, P. troglodytes
ctcctgcctgctcctg

SEQ ID NO: 235161 - DNA, 16 bp, P. troglodytes
ctcctgcctggacaac

SEQ ID NO: 235162 - DNA, 16 bp, P. troglodytes
ctcctgccttagcctc

SEQ ID NO: 235163 - DNA, 16 bp, P. troglodytes
ctcctgccttggcccc

SEQ ID NO: 235164 - DNA, 16 bp, P. troglodytes
ctcctgcctttggact

SEQ ID NO: 235165 - DNA, 16 bp, P. troglodytes
ctcctgctatgcagcc

SEQ ID NO: 235166 - DNA, 16 bp, P. troglodytes
ctcctgctcagcctcc

SEQ ID NO: 235167 - DNA, 16 bp, P. troglodytes
ctcctgctccaaccat

SEQ ID NO: 235168 - DNA, 16 bp, P. troglodytes
ctcctgctccaccatg

SEQ ID NO: 235169 - DNA, 16 bp, P. troglodytes
ctcctgctccagcctc

SEQ ID NO: 235170 - DNA, 16 bp, P. troglodytes
ctcctgctcgtccctg

SEQ ID NO: 235171 - DNA, 16 bp, P. troglodytes
ctcctgctctcagcct

SEQ ID NO: 235172 - DNA, 16 bp, P. troglodytes
ctcctgctctggccat

SEQ ID NO: 235173 - DNA, 16 bp, P. troglodytes
ctcctgctgccctgtg

SEQ ID NO: 235174 - DNA, 16 bp, P. troglodytes
ctcctgctgctgcctc

SEQ ID NO: 235175 - DNA, 16 bp, P. troglodytes
ctcctgctgtcctgtg

SEQ ID NO: 235176 - DNA, 16 bp, P. troglodytes
ctcctgcttcagactc

SEQ ID NO: 235177 - DNA, 16 bp, P. troglodytes
ctcctgcttcagcctc

SEQ ID NO: 235178 - DNA, 16 bp, P. troglodytes
ctcctgcttcagcctt

SEQ ID NO: 235179 - DNA, 16 bp, P. troglodytes
ctcctgcttcagtctc

SEQ ID NO: 235180 - DNA, 16 bp, P. troglodytes
ctcctgcttcatcttc

SEQ ID NO: 235181 - DNA, 16 bp, P. troglodytes
ctcctgcttccacctc

SEQ ID NO: 235182 - DNA, 16 bp, P. troglodytes
ctcctggaaaccacca

SEQ ID NO: 235183 - DNA, 16 bp, P. troglodytes
ctcctggaatcccagc

SEQ ID NO: 235184 - DNA, 16 bp, P. troglodytes
ctcctggactctagtg

SEQ ID NO: 235185 - DNA, 16 bp, P. troglodytes
ctcctggactctgccc

SEQ ID NO: 235186 - DNA, 16 bp, P. troglodytes
ctcctggacttgagca

SEQ ID NO: 235187 - DNA, 16 bp, P. troglodytes
ctcctggagcctccag

SEQ ID NO: 235188 - DNA, 16 bp, P. troglodytes
ctcctggataaataat

SEQ ID NO: 235189 - DNA, 16 bp, P. troglodytes
ctcctggataattttt

SEQ ID NO: 235190 - DNA, 16 bp, P. troglodytes
ctcctggattcactga

SEQ ID NO: 235191 - DNA, 16 bp, P. troglodytes
ctcctggattcaggtg

SEQ ID NO: 235192 - DNA, 16 bp, P. troglodytes
ctcctggattccttag

SEQ ID NO: 235193 - DNA, 16 bp, P. troglodytes
ctcctggcacccactc

SEQ ID NO: 235194 - DNA, 21 bp, P. troglodytes
ctcctggccaacatggtgaaa

SEQ ID NO: 235195 - DNA, 16 bp, P. troglodytes
ctcctggccaggtgtg

SEQ ID NO: 235196 - DNA, 16 bp, P. troglodytes
ctcctggccgaataaa

SEQ ID NO: 235197 - DNA, 16 bp, P. troglodytes
ctcctggcctcaagca

SEQ ID NO: 235198 - DNA, 16 bp, P. troglodytes
ctcctggcctcaggcc

SEQ ID NO: 235199 - DNA, 16 bp, P. troglodytes
ctcctggcctccagca

SEQ ID NO: 235200 - DNA, 16 bp, P. troglodytes
ctcctggcctccagcg

SEQ ID NO: 235201 - DNA, 16 bp, P. troglodytes
ctcctggcctcgtgat

SEQ ID NO: 235202 - DNA, 16 bp, P. troglodytes
ctcctggccttaaaca

SEQ ID NO: 235203 - DNA, 16 bp, P. troglodytes
ctcctggctcagcccc

SEQ ID NO: 235204 - DNA, 16 bp, P. troglodytes
ctcctggcttcaaatg

SEQ ID NO: 235205 - DNA, 16 bp, P. troglodytes
ctcctggcttcaagtg

SEQ ID NO: 235206 - DNA, 16 bp, P. troglodytes
ctcctgggatcaagca

SEQ ID NO: 235207 - DNA, 16 bp, P. troglodytes
ctcctgggcagctggg

SEQ ID NO: 235208 - DNA, 16 bp, P. troglodytes
ctcctgggcccaagtg

SEQ ID NO: 235209 - DNA, 16 bp, P. troglodytes
ctcctgggcccactgt

SEQ ID NO: 235210 - DNA, 16 bp, P. troglodytes
ctcctgggcccaggca

SEQ ID NO: 235211 - DNA, 16 bp, P. troglodytes
ctcctgggcccaggtg

SEQ ID NO: 235212 - DNA, 16 bp, P. troglodytes
ctcctgggctcaacca

SEQ ID NO: 235213 - DNA, 16 bp, P. troglodytes
ctcctgggctcaagct

SEQ ID NO: 235214 - DNA, 16 bp, P. troglodytes
ctcctgggctcagaca

SEQ ID NO: 235215 - DNA, 16 bp, P. troglodytes
ctcctgggctcaggcg

SEQ ID NO: 235216 - DNA, 16 bp, P. troglodytes
ctcctgggctccagag

SEQ ID NO: 235217 - DNA, 16 bp, P. troglodytes
ctcctgggctccagcc

SEQ ID NO: 235218 - DNA, 16 bp, P. troglodytes
ctcctgggctcgagca

SEQ ID NO: 235219 - DNA, 16 bp, P. troglodytes
ctcctgggcttcagtg

SEQ ID NO: 235220 - DNA, 16 bp, P. troglodytes
ctcctggggaaggggt

SEQ ID NO: 235221 - DNA, 16 bp, P. troglodytes
ctcctggggagctggg

SEQ ID NO: 235222 - DNA, 16 bp, P. troglodytes
ctcctggggaggctga

SEQ ID NO: 235223 - DNA, 16 bp, P. troglodytes
ctcctgggtagctgga

SEQ ID NO: 235224 - DNA, 16 bp, P. troglodytes
ctcctgggtccaagca

SEQ ID NO: 235225 - DNA, 16 bp, P. troglodytes
ctcctgggtgcagctg

SEQ ID NO: 235226 - DNA, 16 bp, P. troglodytes
ctcctgggttcacgcg

SEQ ID NO: 235227 - DNA, 16 bp, P. troglodytes
ctcctgggttccagag

SEQ ID NO: 235228 - DNA, 16 bp, P. troglodytes
ctcctgggttgaaggg

SEQ ID NO: 235229 - DNA, 16 bp, P. troglodytes
ctcctgggttgaagtg

SEQ ID NO: 235230 - DNA, 16 bp, P. troglodytes
ctcctgggttgacgcc

SEQ ID NO: 235231 - DNA, 16 bp, P. troglodytes
ctcctggtggctccag

SEQ ID NO: 235232 - DNA, 16 bp, P. troglodytes
ctcctggtgtgtgtgt

SEQ ID NO: 235233 - DNA, 16 bp, P. troglodytes
ctcctgtaaccccagc

SEQ ID NO: 235234 - DNA, 16 bp, P. troglodytes
ctcctgtaagaatcta

SEQ ID NO: 235235 - DNA, 16 bp, P. troglodytes
ctcctgtcagagcagc

SEQ ID NO: 235236 - DNA, 16 bp, P. troglodytes
ctcctgtcccagcctc

SEQ ID NO: 235237 - DNA, 16 bp, P. troglodytes
ctcctgtcctcatgat

SEQ ID NO: 235238 - DNA, 16 bp, P. troglodytes
ctcctgtcctgctcat

SEQ ID NO: 235239 - DNA, 16 bp, P. troglodytes
ctcctgtctcaccctc

SEQ ID NO: 235240 - DNA, 16 bp, P. troglodytes
ctcctgtctcagcctc

SEQ ID NO: 235241 - DNA, 16 bp, P. troglodytes
ctcctgtctctgcctc

SEQ ID NO: 235242 - DNA, 16 bp, P. troglodytes
ctcctgtcttagcctc

SEQ ID NO: 235243 - DNA, 16 bp, P. troglodytes
ctcctgtcttggcctc

SEQ ID NO: 235244 - DNA, 16 bp, P. troglodytes
ctcctgtgagatcagc

SEQ ID NO: 235245 - DNA, 16 bp, P. troglodytes
ctcctgtgatcccagc

SEQ ID NO: 235246 - DNA, 16 bp, P. troglodytes
ctcctgtgttcatgcc

SEQ ID NO: 235247 - DNA, 16 bp, P. troglodytes
ctccttaccctgcccc

SEQ ID NO: 235248 - DNA, 16 bp, P. troglodytes
ctccttacccttggga

SEQ ID NO: 235249 - DNA, 16 bp, P. troglodytes
ctccttcaagcactcc

SEQ ID NO: 235250 - DNA, 16 bp, P. troglodytes
ctccttcaccttctgt

SEQ ID NO: 235251 - DNA, 16 bp, P. troglodytes
ctccttcagctgataa

SEQ ID NO: 235252 - DNA, 16 bp, P. troglodytes
ctccttcaggagctct

SEQ ID NO: 235253 - DNA, 16 bp, P. troglodytes
ctccttcatcagcctc

SEQ ID NO: 235254 - DNA, 16 bp, P. troglodytes
ctccttccccttttga

SEQ ID NO: 235255 - DNA, 16 bp, P. troglodytes
ctccttcctcagcctc

SEQ ID NO: 235256 - DNA, 16 bp, P. troglodytes
ctccttcctcagtctc

SEQ ID NO: 235257 - DNA, 16 bp, P. troglodytes
ctccttcctgctgtct

SEQ ID NO: 235258 - DNA, 17 bp, P. troglodytes
ctccttcgcccaggctg

SEQ ID NO: 235259 - DNA, 16 bp, P. troglodytes
ctccttctcagcctcc

SEQ ID NO: 235260 - DNA, 16 bp, P. troglodytes
ctccttctcccaggtt

SEQ ID NO: 235261 - DNA, 16 bp, P. troglodytes
ctccttctgccttctg

SEQ ID NO: 235262 - DNA, 16 bp, P. troglodytes
ctccttctttggcctc

SEQ ID NO: 235263 - DNA, 16 bp, P. troglodytes
ctccttgagggcaagg

SEQ ID NO: 235264 - DNA, 16 bp, P. troglodytes
ctccttgcaacctcca

SEQ ID NO: 235265 - DNA, 16 bp, P. troglodytes
ctccttgcccctagtt

SEQ ID NO: 235266 - DNA, 16 bp, P. troglodytes
ctccttggctcaggtg

SEQ ID NO: 235267 - DNA, 16 bp, P. troglodytes
ctccttgggcctcagt

SEQ ID NO: 235268 - DNA, 16 bp, P. troglodytes
ctccttgggctcaagc

SEQ ID NO: 235269 - DNA, 16 bp, P. troglodytes
ctccttgtaccctctg

SEQ ID NO: 235270 - DNA, 16 bp, P. troglodytes
ctccttgtggcctggg

SEQ ID NO: 235271 - DNA, 16 bp, P. troglodytes
ctccttgttaagtttg

SEQ ID NO: 235272 - DNA, 16 bp, P. troglodytes
ctcctttattttttgg

SEQ ID NO: 235273 - DNA, 16 bp, P. troglodytes
ctcctttccacagcca

SEQ ID NO: 235274 - DNA, 16 bp, P. troglodytes
ctcctttgactccaca

SEQ ID NO: 235275 - DNA, 16 bp, P. troglodytes
ctcctttgccttccac

SEQ ID NO: 235276 - DNA, 16 bp, P. troglodytes
ctcctttgccttctgc

SEQ ID NO: 235277 - DNA, 16 bp, P. troglodytes
ctcctttgctttctgc

SEQ ID NO: 235278 - DNA, 16 bp, P. troglodytes
ctccttttctcaagca

SEQ ID NO: 235279 - DNA, 16 bp, P. troglodytes
ctcctttttataagga

SEQ ID NO: 235280 - DNA, 16 bp, P. troglodytes
ctcctttttttaaaaa

SEQ ID NO: 235281 - DNA, 17 bp, P. troglodytes
ctcgaacccgggaggca

SEQ ID NO: 235282 - DNA, 16 bp, P. troglodytes
ctcgaacctgggaggc

SEQ ID NO: 235283 - DNA, 16 bp, P. troglodytes
ctcgaactcctgaccc

SEQ ID NO: 235284 - DNA, 16 bp, P. troglodytes
ctcgaacttctggcct

SEQ ID NO: 235285 - DNA, 16 bp, P. troglodytes
ctcgacctcctgagta

SEQ ID NO: 235286 - DNA, 16 bp, P. troglodytes
ctcgagaagagcaatt

SEQ ID NO: 235287 - DNA, 16 bp, P. troglodytes
ctcgagcccaggagtt

SEQ ID NO: 235288 - DNA, 16 bp, P. troglodytes
ctcgaggccaggagtt

SEQ ID NO: 235289 - DNA, 16 bp, P. troglodytes
ctcgaggtcaggagtt

SEQ ID NO: 235290 - DNA, 16 bp, P. troglodytes
ctcgccaccgcactcc

SEQ ID NO: 235291 - DNA, 16 bp, P. troglodytes
ctcgcctcggccttcc

SEQ ID NO: 235292 - DNA, 16 bp, P. troglodytes
ctcgctcgctcgctct

SEQ ID NO: 235293 - DNA, 16 bp, P. troglodytes
ctcgctctgtcacctg

SEQ ID NO: 235294 - DNA, 16 bp, P. troglodytes
ctcgctctgttgtcca

SEQ ID NO: 235295 - DNA, 16 bp, P. troglodytes
ctcgctgagcctcagt

SEQ ID NO: 235296 - DNA, 16 bp, P. troglodytes
ctcgctgcaatctctg

SEQ ID NO: 235297 - DNA, 16 bp, P. troglodytes
ctcgctgtctcccagg

SEQ ID NO: 235298 - DNA, 17 bp, P. troglodytes
ctcggcctcacaaagtg

SEQ ID NO: 235299 - DNA, 16 bp, P. troglodytes
ctcggcctcccaaaag

SEQ ID NO: 235300 - DNA, 17 bp, P. troglodytes
ctcggcctcccacagtg

SEQ ID NO: 235301 - DNA, 26 bp, P. troglodytes
ctcggcctcccgaagtgctgggattg

SEQ ID NO: 235302 - DNA, 16 bp, P. troglodytes
ctcggcctcggcctcc

SEQ ID NO: 235303 - DNA, 16 bp, P. troglodytes
ctcggcctctcaaagt

SEQ ID NO: 235304 - DNA, 16 bp, P. troglodytes
ctcggcttcccaaagt

SEQ ID NO: 235305 - DNA, 16 bp, P. troglodytes
ctcggcttcccaatgt

SEQ ID NO: 235306 - DNA, 16 bp, P. troglodytes
ctcggcttctggggag

SEQ ID NO: 235307 - DNA, 16 bp, P. troglodytes
ctcgggaggctaagga

SEQ ID NO: 235308 - DNA, 17 bp, P. troglodytes
ctcgggctcccaaagtg

SEQ ID NO: 235309 - DNA, 16 bp, P. troglodytes
ctcgggtccccttcca

SEQ ID NO: 235310 - DNA, 16 bp, P. troglodytes
ctcggtgcgctgcacc

SEQ ID NO: 235311 - DNA, 16 bp, P. troglodytes
ctcggtttcctcatct

SEQ ID NO: 235312 - DNA, 16 bp, P. troglodytes
ctcgtccctgggcaat

SEQ ID NO: 235313 - DNA, 17 bp, P. troglodytes
ctcgtgacctcgtgatc

SEQ ID NO: 235314 - DNA, 16 bp, P. troglodytes
ctcgtggagaacctct

SEQ ID NO: 235315 - DNA, 16 bp, P. troglodytes
ctcgttctgttaccca

SEQ ID NO: 235316 - DNA, 16 bp, P. troglodytes
ctctaaaaaaatacct

SEQ ID NO: 235317 - DNA, 16 bp, P. troglodytes
ctctaaaaaatgaagt

SEQ ID NO: 235318 - DNA, 16 bp, P. troglodytes
ctctaagaatgttgaa

SEQ ID NO: 235319 - DNA, 16 bp, P. troglodytes
ctctaagcctcagtgt

SEQ ID NO: 235320 - DNA, 16 bp, P. troglodytes
ctctaatatgatttga

SEQ ID NO: 235321 - DNA, 16 bp, P. troglodytes
ctctaatgcctgatga

SEQ ID NO: 235322 - DNA, 16 bp, P. troglodytes
ctctacaaaaaaaagt

SEQ ID NO: 235323 - DNA, 16 bp, P. troglodytes
ctctacaaaaaaaatg

SEQ ID NO: 235324 - DNA, 16 bp, P. troglodytes
ctctacaaaaactttt

SEQ ID NO: 235325 - DNA, 16 bp, P. troglodytes
ctctacaaaaagaaaa

SEQ ID NO: 235326 - DNA, 16 bp, P. troglodytes
ctctacaaataattta

SEQ ID NO: 235327 - DNA, 16 bp, P. troglodytes
ctctacaaatatttat

SEQ ID NO: 235328 - DNA, 16 bp, P. troglodytes
ctctacatcttcacca

SEQ ID NO: 235329 - DNA, 16 bp, P. troglodytes
ctctaccaaaaagtac

SEQ ID NO: 235330 - DNA, 16 bp, P. troglodytes
ctctaccacatggcca

SEQ ID NO: 235331 - DNA, 16 bp, P. troglodytes
ctctaccctcaagtag

SEQ ID NO: 235332 - DNA, 16 bp, P. troglodytes
ctctacctccttcagt

SEQ ID NO: 235333 - DNA, 16 bp, P. troglodytes
ctctactaaaaaataa

SEQ ID NO: 235334 - DNA, 16 bp, P. troglodytes
ctctactcccagctac

SEQ ID NO: 235335 - DNA, 16 bp, P. troglodytes
ctctactggaaataca

SEQ ID NO: 235336 - DNA, 16 bp, P. troglodytes
ctctacttctaattct

SEQ ID NO: 235337 - DNA, 16 bp, P. troglodytes
ctctactttctgctca

SEQ ID NO: 235338 - DNA, 16 bp, P. troglodytes
ctctagaaagttccaa

SEQ ID NO: 235339 - DNA, 16 bp, P. troglodytes
ctctagaactgtaaga

SEQ ID NO: 235340 - DNA, 16 bp, P. troglodytes
ctctagaagctgaaaa

SEQ ID NO: 235341 - DNA, 16 bp, P. troglodytes
ctctagactccacctc

SEQ ID NO: 235342 - DNA, 16 bp, P. troglodytes
ctctagctcctgacct

SEQ ID NO: 235343 - DNA, 16 bp, P. troglodytes
ctctagggaagaatcc

SEQ ID NO: 235344 - DNA, 16 bp, P. troglodytes
ctctagggcaggggca

SEQ ID NO: 235345 - DNA, 16 bp, P. troglodytes
ctctagtacctcagaa

SEQ ID NO: 235346 - DNA, 16 bp, P. troglodytes
ctctataggaaaaaaa

SEQ ID NO: 235347 - DNA, 16 bp, P. troglodytes
ctctatagggaaaaaa

SEQ ID NO: 235348 - DNA, 16 bp, P. troglodytes
ctctatcaaaaagaag

SEQ ID NO: 235349 - DNA, 16 bp, P. troglodytes
ctctatcaaaaggaaa

SEQ ID NO: 235350 - DNA, 16 bp, P. troglodytes
ctctatcagcttttaa

SEQ ID NO: 235351 - DNA, 16 bp, P. troglodytes
ctctatcatgagaaca

SEQ ID NO: 235352 - DNA, 16 bp, P. troglodytes
ctctatctccatcagt

SEQ ID NO: 235353 - DNA, 16 bp, P. troglodytes
ctctatctctctctat

SEQ ID NO: 235354 - DNA, 16 bp, P. troglodytes
ctctatctctgtctct

SEQ ID NO: 235355 - DNA, 16 bp, P. troglodytes
ctctatctgggcagtg

SEQ ID NO: 235356 - DNA, 16 bp, P. troglodytes
ctctatcttcaaaata

SEQ ID NO: 235357 - DNA, 16 bp, P. troglodytes
ctctatgggaaaaaaa

SEQ ID NO: 235358 - DNA, 16 bp, P. troglodytes
ctctattccccaggct

SEQ ID NO: 235359 - DNA, 16 bp, P. troglodytes
ctctattgcaattccc

SEQ ID NO: 235360 - DNA, 16 bp, P. troglodytes
ctctattgccctggct

SEQ ID NO: 235361 - DNA, 16 bp, P. troglodytes
ctctatttcctgacct

SEQ ID NO: 235362 - DNA, 16 bp, P. troglodytes
ctctatttctgtctct

SEQ ID NO: 235363 - DNA, 16 bp, P. troglodytes
ctctatttctgtgaag

SEQ ID NO: 235364 - DNA, 16 bp, P. troglodytes
ctctattttaatgtta

SEQ ID NO: 235365 - DNA, 16 bp, P. troglodytes
ctctcaaaaaagaaaa

SEQ ID NO: 235366 - DNA, 16 bp, P. troglodytes
ctctcaaaatatttta

SEQ ID NO: 235367 - DNA, 16 bp, P. troglodytes
ctctcaaagtgccagg

SEQ ID NO: 235368 - DNA, 16 bp, P. troglodytes
ctctcaaagtgttgag

SEQ ID NO: 235369 - DNA, 16 bp, P. troglodytes
ctctcaacactttaaa

SEQ ID NO: 235370 - DNA, 16 bp, P. troglodytes
ctctcaagtttcccct

SEQ ID NO: 235371 - DNA, 16 bp, P. troglodytes
ctctcacacacaaaca

SEQ ID NO: 235372 - DNA, 16 bp, P. troglodytes
ctctcacagctccact

SEQ ID NO: 235373 - DNA, 16 bp, P. troglodytes
ctctcaccacttctct

SEQ ID NO: 235374 - DNA, 16 bp, P. troglodytes
ctctcacccagcctgg

SEQ ID NO: 235375 - DNA, 16 bp, P. troglodytes
ctctcaccccagcctc

SEQ ID NO: 235376 - DNA, 16 bp, P. troglodytes
ctctcacctcagcctc

SEQ ID NO: 235377 - DNA, 16 bp, P. troglodytes
ctctcacctcagcctg

SEQ ID NO: 235378 - DNA, 16 bp, P. troglodytes
ctctcacctcagtctc

SEQ ID NO: 235379 - DNA, 16 bp, P. troglodytes
ctctcaccttagcctc

SEQ ID NO: 235380 - DNA, 16 bp, P. troglodytes
ctctcaccttatacaa

SEQ ID NO: 235381 - DNA, 16 bp, P. troglodytes
ctctcactctcactct

SEQ ID NO: 235382 - DNA, 16 bp, P. troglodytes
ctctcactctgtctct

SEQ ID NO: 235383 - DNA, 16 bp, P. troglodytes
ctctcagaaataatgc

SEQ ID NO: 235384 - DNA, 16 bp, P. troglodytes
ctctcagaacacagtg

SEQ ID NO: 235385 - DNA, 16 bp, P. troglodytes
ctctcagaacctcagt

SEQ ID NO: 235386 - DNA, 16 bp, P. troglodytes
ctctcagattcaagtg

SEQ ID NO: 235387 - DNA, 16 bp, P. troglodytes
ctctcagcaggaaggg

SEQ ID NO: 235388 - DNA, 16 bp, P. troglodytes
ctctcagcctttgctt

SEQ ID NO: 235389 - DNA, 16 bp, P. troglodytes
ctctcagctcagcctc

SEQ ID NO: 235390 - DNA, 16 bp, P. troglodytes
ctctcaggtgatgctg

SEQ ID NO: 235391 - DNA, 16 bp, P. troglodytes
ctctcaggttcaagcg

SEQ ID NO: 235392 - DNA, 16 bp, P. troglodytes
ctctcaggttcaagtg

SEQ ID NO: 235393 - DNA, 16 bp, P. troglodytes
ctctcatggttctgga

SEQ ID NO: 235394 - DNA, 16 bp, P. troglodytes
ctctcattctctcatt

SEQ ID NO: 235395 - DNA, 16 bp, P. troglodytes
ctctcattctgtcacc

SEQ ID NO: 235396 - DNA, 16 bp, P. troglodytes
ctctcattttctcttg

SEQ ID NO: 235397 - DNA, 16 bp, P. troglodytes
ctctccaaaataaaaa

SEQ ID NO: 235398 - DNA, 16 bp, P. troglodytes
ctctccaaactgcttt

SEQ ID NO: 235399 - DNA, 16 bp, P. troglodytes
ctctccaacctcatct

SEQ ID NO: 235400 - DNA, 16 bp, P. troglodytes
ctctccaagtctcagt

SEQ ID NO: 235401 - DNA, 16 bp, P. troglodytes
ctctccagaaaaaaaa

SEQ ID NO: 235402 - DNA, 16 bp, P. troglodytes
ctctccagcccctgtt

SEQ ID NO: 235403 - DNA, 16 bp, P. troglodytes
ctctccagcctgggaa

SEQ ID NO: 235404 - DNA, 16 bp, P. troglodytes
ctctccagcctgggca

SEQ ID NO: 235405 - DNA, 16 bp, P. troglodytes
ctctccagcctgggct

SEQ ID NO: 235406 - DNA, 16 bp, P. troglodytes
ctctccagccttctct

SEQ ID NO: 235407 - DNA, 16 bp, P. troglodytes
ctctccaggacattgg

SEQ ID NO: 235408 - DNA, 16 bp, P. troglodytes
ctctccatcacccagg

SEQ ID NO: 235409 - DNA, 16 bp, P. troglodytes
ctctccatctgtctct

SEQ ID NO: 235410 - DNA, 16 bp, P. troglodytes
ctctccatttatttgg

SEQ ID NO: 235411 - DNA, 16 bp, P. troglodytes
ctctcccaagactgaa

SEQ ID NO: 235412 - DNA, 16 bp, P. troglodytes
ctctcccagcccctgg

SEQ ID NO: 235413 - DNA, 16 bp, P. troglodytes
ctctcccagtccattg

SEQ ID NO: 235414 - DNA, 16 bp, P. troglodytes
ctctccccatagccac

SEQ ID NO: 235415 - DNA, 16 bp, P. troglodytes
ctctcccctcagcctc

SEQ ID NO: 235416 - DNA, 16 bp, P. troglodytes
ctctccctccctggat

SEQ ID NO: 235417 - DNA, 16 bp, P. troglodytes
ctctccctctctgcca

SEQ ID NO: 235418 - DNA, 16 bp, P. troglodytes
ctctccctctgtgtgt

SEQ ID NO: 235419 - DNA, 16 bp, P. troglodytes
ctctccctgcctccca

SEQ ID NO: 235420 - DNA, 16 bp, P. troglodytes
ctctccctgctcctgg

SEQ ID NO: 235421 - DNA, 16 bp, P. troglodytes
ctctccctgggtccct

SEQ ID NO: 235422 - DNA, 16 bp, P. troglodytes
ctctccctgtctgtct

SEQ ID NO: 235423 - DNA, 16 bp, P. troglodytes
ctctccgggcctcagt

SEQ ID NO: 235424 - DNA, 16 bp, P. troglodytes
ctctcctagtccactg

SEQ ID NO: 235425 - DNA, 16 bp, P. troglodytes
ctctcctatcctcaat

SEQ ID NO: 235426 - DNA, 16 bp, P. troglodytes
ctctcctcaggcctcc

SEQ ID NO: 235427 - DNA, 16 bp, P. troglodytes
ctctcctcctccagcc

SEQ ID NO: 235428 - DNA, 16 bp, P. troglodytes
ctctcctcctgcccca

SEQ ID NO: 235429 - DNA, 16 bp, P. troglodytes
ctctcctcctgcctca

SEQ ID NO: 235430 - DNA, 16 bp, P. troglodytes
ctctcctctcccagcc

SEQ ID NO: 235431 - DNA, 16 bp, P. troglodytes
ctctcctgccaccctg

SEQ ID NO: 235432 - DNA, 16 bp, P. troglodytes
ctctcctgccatcatg

SEQ ID NO: 235433 - DNA, 16 bp, P. troglodytes
ctctcctgccctgttc

SEQ ID NO: 235434 - DNA, 16 bp, P. troglodytes
ctctcctgcctcagcc

SEQ ID NO: 235435 - DNA, 18 bp, P. troglodytes
ctctcctgcctcagcctc

SEQ ID NO: 235436 - DNA, 16 bp, P. troglodytes
ctctcctgcctcagct

SEQ ID NO: 235437 - DNA, 16 bp, P. troglodytes
ctctcctgcctccacc

SEQ ID NO: 235438 - DNA, 16 bp, P. troglodytes
ctctcctgctgccctg

SEQ ID NO: 235439 - DNA, 16 bp, P. troglodytes
ctctcctggagctggg

SEQ ID NO: 235440 - DNA, 16 bp, P. troglodytes
ctctcctggctttcct

SEQ ID NO: 235441 - DNA, 16 bp, P. troglodytes
ctctcctgggttcaag

SEQ ID NO: 235442 - DNA, 16 bp, P. troglodytes
ctctccttgcttctca

SEQ ID NO: 235443 - DNA, 16 bp, P. troglodytes
ctctcctttcttagca

SEQ ID NO: 235444 - DNA, 16 bp, P. troglodytes
ctctcgcctcagcttc

SEQ ID NO: 235445 - DNA, 16 bp, P. troglodytes
ctctcggaccacagtg

SEQ ID NO: 235446 - DNA, 16 bp, P. troglodytes
ctctcggcacctcctc

SEQ ID NO: 235447 - DNA, 19 bp, P. troglodytes
ctctcgggttcacgccatt

SEQ ID NO: 235448 - DNA, 16 bp, P. troglodytes
ctctctaacctcatct

SEQ ID NO: 235449 - DNA, 16 bp, P. troglodytes
ctctctacttttatga

SEQ ID NO: 235450 - DNA, 16 bp, P. troglodytes
ctctctagcccaggct

SEQ ID NO: 235451 - DNA, 16 bp, P. troglodytes
ctctctcaccaggctg

SEQ ID NO: 235452 - DNA, 16 bp, P. troglodytes
ctctctcaccatgtga

SEQ ID NO: 235453 - DNA, 16 bp, P. troglodytes
ctctctcactgctcct

SEQ ID NO: 235454 - DNA, 16 bp, P. troglodytes
ctctctcagtcttcat

SEQ ID NO: 235455 - DNA, 16 bp, P. troglodytes
ctctctccactaaaaa

SEQ ID NO: 235456 - DNA, 16 bp, P. troglodytes
ctctctccctcactgc

SEQ ID NO: 235457 - DNA, 16 bp, P. troglodytes
ctctctccctccagcc

SEQ ID NO: 235458 - DNA, 16 bp, P. troglodytes
ctctctcctcaggcct

SEQ ID NO: 235459 - DNA, 16 bp, P. troglodytes
ctctctcctgccaccc

SEQ ID NO: 235460 - DNA, 16 bp, P. troglodytes
ctctctcctgctgctc

SEQ ID NO: 235461 - DNA, 16 bp, P. troglodytes
ctctctcctgttgcca

SEQ ID NO: 235462 - DNA, 16 bp, P. troglodytes
ctctctccttggcttg

SEQ ID NO: 235463 - DNA, 16 bp, P. troglodytes
ctctctcctttgcttg

SEQ ID NO: 235464 - DNA, 16 bp, P. troglodytes
ctctctctaaaataaa

SEQ ID NO: 235465 - DNA, 16 bp, P. troglodytes
ctctctctcaaaataa

SEQ ID NO: 235466 - DNA, 16 bp, P. troglodytes
ctctctctcacaaaca

SEQ ID NO: 235467 - DNA, 16 bp, P. troglodytes
ctctctctcactgtct

SEQ ID NO: 235468 - DNA, 16 bp, P. troglodytes
ctctctctcctgccag

SEQ ID NO: 235469 - DNA, 16 bp, P. troglodytes
ctctctctctcaatat

SEQ ID NO: 235470 - DNA, 16 bp, P. troglodytes
ctctctctctccagca

SEQ ID NO: 235471 - DNA, 16 bp, P. troglodytes
ctctctctctcgctcg

SEQ ID NO: 235472 - DNA, 16 bp, P. troglodytes
ctctctctctctcaat

SEQ ID NO: 235473 - DNA, 16 bp, P. troglodytes
ctctctctctctgaat

SEQ ID NO: 235474 - DNA, 16 bp, P. troglodytes
ctctctctctctttgg

SEQ ID NO: 235475 - DNA, 16 bp, P. troglodytes
ctctctctctgtcctg

SEQ ID NO: 235476 - DNA, 16 bp, P. troglodytes
ctctctctctgtgtct

SEQ ID NO: 235477 - DNA, 16 bp, P. troglodytes
ctctctctgaccttct

SEQ ID NO: 235478 - DNA, 16 bp, P. troglodytes
ctctctctgactttct

SEQ ID NO: 235479 - DNA, 16 bp, P. troglodytes
ctctctctgccaccca

SEQ ID NO: 235480 - DNA, 16 bp, P. troglodytes
ctctctctgggcctca

SEQ ID NO: 235481 - DNA, 16 bp, P. troglodytes
ctctctctgtcacaca

SEQ ID NO: 235482 - DNA, 16 bp, P. troglodytes
ctctctctgtccctgt

SEQ ID NO: 235483 - DNA, 16 bp, P. troglodytes
ctctctcttgctgcct

SEQ ID NO: 235484 - DNA, 16 bp, P. troglodytes
ctctctgaagtctgct

SEQ ID NO: 235485 - DNA, 16 bp, P. troglodytes
ctctctgagcctctgt

SEQ ID NO: 235486 - DNA, 16 bp, P. troglodytes
ctctctgagcttcagt

SEQ ID NO: 235487 - DNA, 16 bp, P. troglodytes
ctctctgatgtctctt

SEQ ID NO: 235488 - DNA, 16 bp, P. troglodytes
ctctctgcagcctctg

SEQ ID NO: 235489 - DNA, 16 bp, P. troglodytes
ctctctgccacccagg

SEQ ID NO: 235490 - DNA, 16 bp, P. troglodytes
ctctctgcctcagtct

SEQ ID NO: 235491 - DNA, 16 bp, P. troglodytes
ctctctgcctgccctt

SEQ ID NO: 235492 - DNA, 16 bp, P. troglodytes
ctctctgccttctgcc

SEQ ID NO: 235493 - DNA, 16 bp, P. troglodytes
ctctctgctgcccagg

SEQ ID NO: 235494 - DNA, 16 bp, P. troglodytes
ctctctgcttatatta

SEQ ID NO: 235495 - DNA, 16 bp, P. troglodytes
ctctctgcttgtctgt

SEQ ID NO: 235496 - DNA, 16 bp, P. troglodytes
ctctctggagtctctt

SEQ ID NO: 235497 - DNA, 16 bp, P. troglodytes
ctctctggctgccgtt

SEQ ID NO: 235498 - DNA, 16 bp, P. troglodytes
ctctctggctgctcct

SEQ ID NO: 235499 - DNA, 16 bp, P. troglodytes
ctctctggcttcctct

SEQ ID NO: 235500 - DNA, 16 bp, P. troglodytes
ctctctgggacagagc

SEQ ID NO: 235501 - DNA, 16 bp, P. troglodytes
ctctctgggagctgca

SEQ ID NO: 235502 - DNA, 16 bp, P. troglodytes
ctctctgggcttcagc

SEQ ID NO: 235503 - DNA, 16 bp, P. troglodytes
ctctctgggcttctgt

SEQ ID NO: 235504 - DNA, 16 bp, P. troglodytes
ctctctgtccccaccc

SEQ ID NO: 235505 - DNA, 16 bp, P. troglodytes
ctctctgtctgttgtt

SEQ ID NO: 235506 - DNA, 16 bp, P. troglodytes
ctctctgtgcctcaat

SEQ ID NO: 235507 - DNA, 16 bp, P. troglodytes
ctctctgtgctgagcc

SEQ ID NO: 235508 - DNA, 16 bp, P. troglodytes
ctctctgtgtctctct

SEQ ID NO: 235509 - DNA, 16 bp, P. troglodytes
ctctctgtgtctgtgt

SEQ ID NO: 235510 - DNA, 16 bp, P. troglodytes
ctctctgtgtgtgtct

SEQ ID NO: 235511 - DNA, 16 bp, P. troglodytes
ctctctgttgcccaag

SEQ ID NO: 235512 - DNA, 16 bp, P. troglodytes
ctctctgttgcctcag

SEQ ID NO: 235513 - DNA, 16 bp, P. troglodytes
ctctctgtttctatga

SEQ ID NO: 235514 - DNA, 16 bp, P. troglodytes
ctctctgtttgcctgc

SEQ ID NO: 235515 - DNA, 16 bp, P. troglodytes
ctctctgtttgttatt

SEQ ID NO: 235516 - DNA, 16 bp, P. troglodytes
ctctcttctggcctgt

SEQ ID NO: 235517 - DNA, 16 bp, P. troglodytes
ctctcttcttggtttg

SEQ ID NO: 235518 - DNA, 16 bp, P. troglodytes
ctctctttcattcctg

SEQ ID NO: 235519 - DNA, 16 bp, P. troglodytes
ctctctttctctcagt

SEQ ID NO: 235520 - DNA, 16 bp, P. troglodytes
ctctctttgctcctca

SEQ ID NO: 235521 - DNA, 16 bp, P. troglodytes
ctctctttgtactgtc

SEQ ID NO: 235522 - DNA, 16 bp, P. troglodytes
ctctctttgttcccag

SEQ ID NO: 235523 - DNA, 16 bp, P. troglodytes
ctctcttttttgagat

SEQ ID NO: 235524 - DNA, 16 bp, P. troglodytes
ctctgaaaaaagaaaa

SEQ ID NO: 235525 - DNA, 16 bp, P. troglodytes
ctctgaaaaaataaat

SEQ ID NO: 235526 - DNA, 16 bp, P. troglodytes
ctctgaaaagaagaaa

SEQ ID NO: 235527 - DNA, 16 bp, P. troglodytes
ctctgaaacctgggtg

SEQ ID NO: 235528 - DNA, 16 bp, P. troglodytes
ctctgaaataaaatgt

SEQ ID NO: 235529 - DNA, 16 bp, P. troglodytes
ctctgaacctcagttt

SEQ ID NO: 235530 - DNA, 16 bp, P. troglodytes
ctctgaaccttagttt

SEQ ID NO: 235531 - DNA, 16 bp, P. troglodytes
ctctgaagagagcaat

SEQ ID NO: 235532 - DNA, 16 bp, P. troglodytes
ctctgaagatgatttt

SEQ ID NO: 235533 - DNA, 16 bp, P. troglodytes
ctctgaagcaacagct

SEQ ID NO: 235534 - DNA, 16 bp, P. troglodytes
ctctgaagccatagcc

SEQ ID NO: 235535 - DNA, 16 bp, P. troglodytes
ctctgaagtcacagcc

SEQ ID NO: 235536 - DNA, 16 bp, P. troglodytes
ctctgaatatattaaa

SEQ ID NO: 235537 - DNA, 16 bp, P. troglodytes
ctctgaatttgcctat

SEQ ID NO: 235538 - DNA, 16 bp, P. troglodytes
ctctgaattttatttt

SEQ ID NO: 235539 - DNA, 16 bp, P. troglodytes
ctctgaatttttaaaa

SEQ ID NO: 235540 - DNA, 16 bp, P. troglodytes
ctctgacctctgcctc

SEQ ID NO: 235541 - DNA, 16 bp, P. troglodytes
ctctgacctctgcttc

SEQ ID NO: 235542 - DNA, 16 bp, P. troglodytes
ctctgactcccaggct

SEQ ID NO: 235543 - DNA, 16 bp, P. troglodytes
ctctgactccctcttt

SEQ ID NO: 235544 - DNA, 16 bp, P. troglodytes
ctctgacttcagcctc

SEQ ID NO: 235545 - DNA, 16 bp, P. troglodytes
ctctgactttgttctt

SEQ ID NO: 235546 - DNA, 16 bp, P. troglodytes
ctctgagactcagttt

SEQ ID NO: 235547 - DNA, 16 bp, P. troglodytes
ctctgagatggagttt

SEQ ID NO: 235548 - DNA, 16 bp, P. troglodytes
ctctgagcagcctctg

SEQ ID NO: 235549 - DNA, 16 bp, P. troglodytes
ctctgagcccagcaca

SEQ ID NO: 235550 - DNA, 16 bp, P. troglodytes
ctctgagcctcagctg

SEQ ID NO: 235551 - DNA, 16 bp, P. troglodytes
ctctgagcctcagctt

SEQ ID NO: 235552 - DNA, 16 bp, P. troglodytes
ctctgagcctcaggtt

SEQ ID NO: 235553 - DNA, 16 bp, P. troglodytes
ctctgagcctcagtat

SEQ ID NO: 235554 - DNA, 16 bp, P. troglodytes
ctctgagcctcagttt

SEQ ID NO: 235555 - DNA, 16 bp, P. troglodytes
ctctgagcctcggttt

SEQ ID NO: 235556 - DNA, 16 bp, P. troglodytes
ctctgagccttacttt

SEQ ID NO: 235557 - DNA, 16 bp, P. troglodytes
ctctgagccttgattt

SEQ ID NO: 235558 - DNA, 16 bp, P. troglodytes
ctctgagccttgcttt

SEQ ID NO: 235559 - DNA, 16 bp, P. troglodytes
ctctgagccttggctt

SEQ ID NO: 235560 - DNA, 16 bp, P. troglodytes
ctctgagccttggtgt

SEQ ID NO: 235561 - DNA, 16 bp, P. troglodytes
ctctgagccttggttt

SEQ ID NO: 235562 - DNA, 16 bp, P. troglodytes
ctctgagctgttctgt

SEQ ID NO: 235563 - DNA, 16 bp, P. troglodytes
ctctgagcttcaggtt

SEQ ID NO: 235564 - DNA, 16 bp, P. troglodytes
ctctgagggaagccag

SEQ ID NO: 235565 - DNA, 16 bp, P. troglodytes
ctctgagtctcagctt

SEQ ID NO: 235566 - DNA, 16 bp, P. troglodytes
ctctgagtctctgctt

SEQ ID NO: 235567 - DNA, 16 bp, P. troglodytes
ctctgagtgtggggcc

SEQ ID NO: 235568 - DNA, 16 bp, P. troglodytes
ctctgagtgtgtgtgt

SEQ ID NO: 235569 - DNA, 17 bp, P. troglodytes
ctctgagttccctcagt

SEQ ID NO: 235570 - DNA, 16 bp, P. troglodytes
ctctgagttttaaaaa

SEQ ID NO: 235571 - DNA, 16 bp, P. troglodytes
ctctgatcttatttct

SEQ ID NO: 235572 - DNA, 17 bp, P. troglodytes
ctctgatggtcagtgat

SEQ ID NO: 235573 - DNA, 16 bp, P. troglodytes
ctctgattattattat

SEQ ID NO: 235574 - DNA, 16 bp, P. troglodytes
ctctgattccaaagcc

SEQ ID NO: 235575 - DNA, 16 bp, P. troglodytes
ctctgatttctttgaa

SEQ ID NO: 235576 - DNA, 16 bp, P. troglodytes
ctctgatttcttttct

SEQ ID NO: 235577 - DNA, 16 bp, P. troglodytes
ctctgatttggtgtct

SEQ ID NO: 235578 - DNA, 16 bp, P. troglodytes
ctctgattttggtttt

SEQ ID NO: 235579 - DNA, 16 bp, P. troglodytes
ctctgcaaggagaact

SEQ ID NO: 235580 - DNA, 16 bp, P. troglodytes
ctctgcacactgcttt

SEQ ID NO: 235581 - DNA, 19 bp, P. troglodytes
ctctgcacagcaaaagaaa

SEQ ID NO: 235582 - DNA, 16 bp, P. troglodytes
ctctgcagcccaggct

SEQ ID NO: 235583 - DNA, 16 bp, P. troglodytes
ctctgcagcctcacca

SEQ ID NO: 235584 - DNA, 16 bp, P. troglodytes
ctctgcaggatatcat

SEQ ID NO: 235585 - DNA, 16 bp, P. troglodytes
ctctgcaggatgttat

SEQ ID NO: 235586 - DNA, 16 bp, P. troglodytes
ctctgcagttcctggt

SEQ ID NO: 235587 - DNA, 16 bp, P. troglodytes
ctctgcatcccagcca

SEQ ID NO: 235588 - DNA, 16 bp, P. troglodytes
ctctgcatcctcacca

SEQ ID NO: 235589 - DNA, 16 bp, P. troglodytes
ctctgcatctttgcca

SEQ ID NO: 235590 - DNA, 16 bp, P. troglodytes
ctctgccaaaaatata

SEQ ID NO: 235591 - DNA, 16 bp, P. troglodytes
ctctgccacagctcca

SEQ ID NO: 235592 - DNA, 16 bp, P. troglodytes
ctctgccacccaggca

SEQ ID NO: 235593 - DNA, 16 bp, P. troglodytes
ctctgccacccaggct

SEQ ID NO: 235594 - DNA, 16 bp, P. troglodytes
ctctgccacccatgct

SEQ ID NO: 235595 - DNA, 16 bp, P. troglodytes
ctctgccacctcccag

SEQ ID NO: 235596 - DNA, 16 bp, P. troglodytes
ctctgccacttcccag

SEQ ID NO: 235597 - DNA, 16 bp, P. troglodytes
ctctgccagtttttgg

SEQ ID NO: 235598 - DNA, 16 bp, P. troglodytes
ctctgcccacctcagc

SEQ ID NO: 235599 - DNA, 16 bp, P. troglodytes
ctctgcccagccacca

SEQ ID NO: 235600 - DNA, 16 bp, P. troglodytes
ctctgcccagctgccc

SEQ ID NO: 235601 - DNA, 16 bp, P. troglodytes
ctctgccccagcccca

SEQ ID NO: 235602 - DNA, 16 bp, P. troglodytes
ctctgccccagccctg

SEQ ID NO: 235603 - DNA, 16 bp, P. troglodytes
ctctgcccccaggctg

SEQ ID NO: 235604 - DNA, 16 bp, P. troglodytes
ctctgcccggccgcca

SEQ ID NO: 235605 - DNA, 16 bp, P. troglodytes
ctctgccctcagggag

SEQ ID NO: 235606 - DNA, 16 bp, P. troglodytes
ctctgccctccccaca

SEQ ID NO: 235607 - DNA, 16 bp, P. troglodytes
ctctgccgcccaggct

SEQ ID NO: 235608 - DNA, 22 bp, P. troglodytes
ctctgcctaggaaaaccagaga

SEQ ID NO: 235609 - DNA, 16 bp, P. troglodytes
ctctgcctcagcctcc

SEQ ID NO: 235610 - DNA, 16 bp, P. troglodytes
ctctgcctcagccttc

SEQ ID NO: 235611 - DNA, 16 bp, P. troglodytes
ctctgcctcagcttct

SEQ ID NO: 235612 - DNA, 16 bp, P. troglodytes
ctctgcctcagtttcc

SEQ ID NO: 235613 - DNA, 16 bp, P. troglodytes
ctctgcctccaaggct

SEQ ID NO: 235614 - DNA, 16 bp, P. troglodytes
ctctgcctccatcatc

SEQ ID NO: 235615 - DNA, 16 bp, P. troglodytes
ctctgcctccatcttc

SEQ ID NO: 235616 - DNA, 16 bp, P. troglodytes
ctctgcctcccagatt

SEQ ID NO: 235617 - DNA, 16 bp, P. troglodytes
ctctgcctcccaggta

SEQ ID NO: 235618 - DNA, 16 bp, P. troglodytes
ctctgcctccccagtt

SEQ ID NO: 235619 - DNA, 16 bp, P. troglodytes
ctctgcctccctaagt

SEQ ID NO: 235620 - DNA, 16 bp, P. troglodytes
ctctgcctccctgaga

SEQ ID NO: 235621 - DNA, 16 bp, P. troglodytes
ctctgcctccctgcaa

SEQ ID NO: 235622 - DNA, 16 bp, P. troglodytes
ctctgcctccctggcc

SEQ ID NO: 235623 - DNA, 16 bp, P. troglodytes
ctctgcctccctggct

SEQ ID NO: 235624 - DNA, 16 bp, P. troglodytes
ctctgcctcctcctgg

SEQ ID NO: 235625 - DNA, 16 bp, P. troglodytes
ctctgcctcctgccag

SEQ ID NO: 235626 - DNA, 16 bp, P. troglodytes
ctctgcctcctgcctg

SEQ ID NO: 235627 - DNA, 16 bp, P. troglodytes
ctctgcctcctggcct

SEQ ID NO: 235628 - DNA, 16 bp, P. troglodytes
ctctgcctcctggttt

SEQ ID NO: 235629 - DNA, 16 bp, P. troglodytes
ctctgcctcctgtgtt

SEQ ID NO: 235630 - DNA, 16 bp, P. troglodytes
ctctgcctctgcctct

SEQ ID NO: 235631 - DNA, 16 bp, P. troglodytes
ctctgcctctgtcctc

SEQ ID NO: 235632 - DNA, 16 bp, P. troglodytes
ctctgcctcttcctgg

SEQ ID NO: 235633 - DNA, 16 bp, P. troglodytes
ctctgcctcttgggtt

SEQ ID NO: 235634 - DNA, 16 bp, P. troglodytes
ctctgcctcttgtcag

SEQ ID NO: 235635 - DNA, 16 bp, P. troglodytes
ctctgcctgccaaagt

SEQ ID NO: 235636 - DNA, 16 bp, P. troglodytes
ctctgcctggaaaact

SEQ ID NO: 235637 - DNA, 16 bp, P. troglodytes
ctctgcctgtctgtct

SEQ ID NO: 235638 - DNA, 16 bp, P. troglodytes
ctctgcctgttcatcc

SEQ ID NO: 235639 - DNA, 16 bp, P. troglodytes
ctctgccttcccaggt

SEQ ID NO: 235640 - DNA, 16 bp, P. troglodytes
ctctgccttctaggtt

SEQ ID NO: 235641 - DNA, 16 bp, P. troglodytes
ctctgcctttcgggtt

SEQ ID NO: 235642 - DNA, 16 bp, P. troglodytes
ctctgcctttctgcaa

SEQ ID NO: 235643 - DNA, 16 bp, P. troglodytes
ctctgctaggacagtg

SEQ ID NO: 235644 - DNA, 16 bp, P. troglodytes
ctctgctagggcagta

SEQ ID NO: 235645 - DNA, 16 bp, P. troglodytes
ctctgctcaaaaccct

SEQ ID NO: 235646 - DNA, 16 bp, P. troglodytes
ctctgctcactgagat

SEQ ID NO: 235647 - DNA, 16 bp, P. troglodytes
ctctgctcactgcagc

SEQ ID NO: 235648 - DNA, 16 bp, P. troglodytes
ctctgctcagggtctc

SEQ ID NO: 235649 - DNA, 16 bp, P. troglodytes
ctctgctccccaggct

SEQ ID NO: 235650 - DNA, 16 bp, P. troglodytes
ctctgctccctgcatt

SEQ ID NO: 235651 - DNA, 16 bp, P. troglodytes
ctctgctcctctgcca

SEQ ID NO: 235652 - DNA, 16 bp, P. troglodytes
ctctgctcctctgcct

SEQ ID NO: 235653 - DNA, 16 bp, P. troglodytes
ctctgctctgctctgc

SEQ ID NO: 235654 - DNA, 16 bp, P. troglodytes
ctctgctgacaccttg

SEQ ID NO: 235655 - DNA, 16 bp, P. troglodytes
ctctgctgaggtcatc

SEQ ID NO: 235656 - DNA, 16 bp, P. troglodytes
ctctgctgcagccaca

SEQ ID NO: 235657 - DNA, 16 bp, P. troglodytes
ctctgctgcctcagcc

SEQ ID NO: 235658 - DNA, 16 bp, P. troglodytes
ctctgctggtagtttc

SEQ ID NO: 235659 - DNA, 16 bp, P. troglodytes
ctctgctgtgctgcct

SEQ ID NO: 235660 - DNA, 16 bp, P. troglodytes
ctctgctgttgtagtg

SEQ ID NO: 235661 - DNA, 16 bp, P. troglodytes
ctctgcttccaagatg

SEQ ID NO: 235662 - DNA, 16 bp, P. troglodytes
ctctgcttccaggttc

SEQ ID NO: 235663 - DNA, 16 bp, P. troglodytes
ctctgcttccattgtc

SEQ ID NO: 235664 - DNA, 16 bp, P. troglodytes
ctctgcttctctctgt

SEQ ID NO: 235665 - DNA, 16 bp, P. troglodytes
ctctgcttctctgtgt

SEQ ID NO: 235666 - DNA, 16 bp, P. troglodytes
ctctgcttcttgggag

SEQ ID NO: 235667 - DNA, 16 bp, P. troglodytes
ctctgctttccaggtt

SEQ ID NO: 235668 - DNA, 16 bp, P. troglodytes
ctctgctttccgggtt

SEQ ID NO: 235669 - DNA, 16 bp, P. troglodytes
ctctggaaaactccac

SEQ ID NO: 235670 - DNA, 16 bp, P. troglodytes
ctctggaaaattccac

SEQ ID NO: 235671 - DNA, 16 bp, P. troglodytes
ctctggaacataaccc

SEQ ID NO: 235672 - DNA, 16 bp, P. troglodytes
ctctggacccacctgg

SEQ ID NO: 235673 - DNA, 16 bp, P. troglodytes
ctctggacctcagttt

SEQ ID NO: 235674 - DNA, 16 bp, P. troglodytes
ctctggagagccctga

SEQ ID NO: 235675 - DNA, 16 bp, P. troglodytes
ctctggagccagaatg

SEQ ID NO: 235676 - DNA, 16 bp, P. troglodytes
ctctggagccagacca

SEQ ID NO: 235677 - DNA, 16 bp, P. troglodytes
ctctggagccagactg

SEQ ID NO: 235678 - DNA, 16 bp, P. troglodytes
ctctggagccagcctg

SEQ ID NO: 235679 - DNA, 16 bp, P. troglodytes
ctctggagcccaggct

SEQ ID NO: 235680 - DNA, 16 bp, P. troglodytes
ctctggaggagaagag

SEQ ID NO: 235681 - DNA, 16 bp, P. troglodytes
ctctggaggctccagg

SEQ ID NO: 235682 - DNA, 16 bp, P. troglodytes
ctctggaggctgagaa

SEQ ID NO: 235683 - DNA, 16 bp, P. troglodytes
ctctggaggctgagat

SEQ ID NO: 235684 - DNA, 16 bp, P. troglodytes
ctctggaggctgagtc

SEQ ID NO: 235685 - DNA, 16 bp, P. troglodytes
ctctggaggctgagtt

SEQ ID NO: 235686 - DNA, 16 bp, P. troglodytes
ctctggaggctgggaa

SEQ ID NO: 235687 - DNA, 16 bp, P. troglodytes
ctctggagtcagactg

SEQ ID NO: 235688 - DNA, 16 bp, P. troglodytes
ctctggagtctgaggt

SEQ ID NO: 235689 - DNA, 16 bp, P. troglodytes
ctctggagtttgagac

SEQ ID NO: 235690 - DNA, 16 bp, P. troglodytes
ctctggatttcctgaa

SEQ ID NO: 235691 - DNA, 16 bp, P. troglodytes
ctctggcataaatggg

SEQ ID NO: 235692 - DNA, 16 bp, P. troglodytes
ctctggccaccctccc

SEQ ID NO: 235693 - DNA, 16 bp, P. troglodytes
ctctggccaggacttc

SEQ ID NO: 235694 - DNA, 16 bp, P. troglodytes
ctctggcccagggcag

SEQ ID NO: 235695 - DNA, 16 bp, P. troglodytes
ctctggcctctaccca

SEQ ID NO: 235696 - DNA, 16 bp, P. troglodytes
ctctggcctctgccca

SEQ ID NO: 235697 - DNA, 16 bp, P. troglodytes
ctctggcctggatgac

SEQ ID NO: 235698 - DNA, 16 bp, P. troglodytes
ctctggccttggcctc

SEQ ID NO: 235699 - DNA, 16 bp, P. troglodytes
ctctggctcctgggct

SEQ ID NO: 235700 - DNA, 16 bp, P. troglodytes
ctctggctcctgggtt

SEQ ID NO: 235701 - DNA, 16 bp, P. troglodytes
ctctggctctctctct

SEQ ID NO: 235702 - DNA, 16 bp, P. troglodytes
ctctggctctgccact

SEQ ID NO: 235703 - DNA, 16 bp, P. troglodytes
ctctggctggggctgg

SEQ ID NO: 235704 - DNA, 16 bp, P. troglodytes
ctctggcttttccagg

SEQ ID NO: 235705 - DNA, 16 bp, P. troglodytes
ctctgggacacattaa

SEQ ID NO: 235706 - DNA, 16 bp, P. troglodytes
ctctgggagaccgagg

SEQ ID NO: 235707 - DNA, 16 bp, P. troglodytes
ctctgggagctctgtc

SEQ ID NO: 235708 - DNA, 16 bp, P. troglodytes
ctctgggaggcagaag

SEQ ID NO: 235709 - DNA, 16 bp, P. troglodytes
ctctgggaggccaaga

SEQ ID NO: 235710 - DNA, 16 bp, P. troglodytes
ctctgggaggctgggg

SEQ ID NO: 235711 - DNA, 16 bp, P. troglodytes
ctctgggaggtggagg

SEQ ID NO: 235712 - DNA, 17 bp, P. troglodytes
ctctgggagtgtctgtc

SEQ ID NO: 235713 - DNA, 16 bp, P. troglodytes
ctctgggcatcagttt

SEQ ID NO: 235714 - DNA, 16 bp, P. troglodytes
ctctgggccacagttt

SEQ ID NO: 235715 - DNA, 16 bp, P. troglodytes
ctctgggcccagccca

SEQ ID NO: 235716 - DNA, 16 bp, P. troglodytes
ctctgggcctatgatg

SEQ ID NO: 235717 - DNA, 16 bp, P. troglodytes
ctctgggcctgtttcc

SEQ ID NO: 235718 - DNA, 16 bp, P. troglodytes
ctctgggctcaaggga

SEQ ID NO: 235719 - DNA, 16 bp, P. troglodytes
ctctgggcttcagttt

SEQ ID NO: 235720 - DNA, 16 bp, P. troglodytes
ctctgggcttcatttt

SEQ ID NO: 235721 - DNA, 16 bp, P. troglodytes
ctctgggctttagttt

SEQ ID NO: 235722 - DNA, 16 bp, P. troglodytes
ctctggggactgtggt

SEQ ID NO: 235723 - DNA, 16 bp, P. troglodytes
ctctggggggctgagg

SEQ ID NO: 235724 - DNA, 16 bp, P. troglodytes
ctctgggtctgtttct

SEQ ID NO: 235725 - DNA, 16 bp, P. troglodytes
ctctggtccccttcca

SEQ ID NO: 235726 - DNA, 16 bp, P. troglodytes
ctctggtgggcaggag

SEQ ID NO: 235727 - DNA, 16 bp, P. troglodytes
ctctggttctctctct

SEQ ID NO: 235728 - DNA, 16 bp, P. troglodytes
ctctggttgatgaaat

SEQ ID NO: 235729 - DNA, 16 bp, P. troglodytes
ctctgtaaaatggaga

SEQ ID NO: 235730 - DNA, 16 bp, P. troglodytes
ctctgtacctcagttt

SEQ ID NO: 235731 - DNA, 16 bp, P. troglodytes
ctctgtacctgttaaa

SEQ ID NO: 235732 - DNA, 16 bp, P. troglodytes
ctctgtacttctatat

SEQ ID NO: 235733 - DNA, 16 bp, P. troglodytes
ctctgtatgcctttgc

SEQ ID NO: 235734 - DNA, 16 bp, P. troglodytes
ctctgtcaaaaaaaaa

SEQ ID NO: 235735 - DNA, 16 bp, P. troglodytes
ctctgtcaaaacaaaa

SEQ ID NO: 235736 - DNA, 16 bp, P. troglodytes
ctctgtcaagttcaaa

SEQ ID NO: 235737 - DNA, 16 bp, P. troglodytes
ctctgtcacccagctt

SEQ ID NO: 235738 - DNA, 16 bp, P. troglodytes
ctctgtcacccaggat

SEQ ID NO: 235739 - DNA, 16 bp, P. troglodytes
ctctgtcaccctagct

SEQ ID NO: 235740 - DNA, 16 bp, P. troglodytes
ctctgtcactcacgct

SEQ ID NO: 235741 - DNA, 16 bp, P. troglodytes
ctctgtcactctgtca

SEQ ID NO: 235742 - DNA, 16 bp, P. troglodytes
ctctgtcagagctctt

SEQ ID NO: 235743 - DNA, 16 bp, P. troglodytes
ctctgtcatccaagct

SEQ ID NO: 235744 - DNA, 16 bp, P. troglodytes
ctctgtcatccaggcc

SEQ ID NO: 235745 - DNA, 16 bp, P. troglodytes
ctctgtcccaaaaaca

SEQ ID NO: 235746 - DNA, 16 bp, P. troglodytes
ctctgtcccagaaaaa

SEQ ID NO: 235747 - DNA, 16 bp, P. troglodytes
ctctgtcccagagaga

SEQ ID NO: 235748 - DNA, 16 bp, P. troglodytes
ctctgtcccagggaaa

SEQ ID NO: 235749 - DNA, 16 bp, P. troglodytes
ctctgtccccagggct

SEQ ID NO: 235750 - DNA, 16 bp, P. troglodytes
ctctgtcccccaggtt

SEQ ID NO: 235751 - DNA, 16 bp, P. troglodytes
ctctgtcccctcccca

SEQ ID NO: 235752 - DNA, 16 bp, P. troglodytes
ctctgtcccctgggct

SEQ ID NO: 235753 - DNA, 16 bp, P. troglodytes
ctctgtccctgcagca

SEQ ID NO: 235754 - DNA, 16 bp, P. troglodytes
ctctgtcctcaggctg

SEQ ID NO: 235755 - DNA, 16 bp, P. troglodytes
ctctgtcctgcctggc

SEQ ID NO: 235756 - DNA, 16 bp, P. troglodytes
ctctgtcgcccaaggc

SEQ ID NO: 235757 - DNA, 16 bp, P. troglodytes
ctctgtcgcccaggat

SEQ ID NO: 235758 - DNA, 16 bp, P. troglodytes
ctctgtctaaaaagaa

SEQ ID NO: 235759 - DNA, 16 bp, P. troglodytes
ctctgtctcagaaaat

SEQ ID NO: 235760 - DNA, 16 bp, P. troglodytes
ctctgtctcagggaga

SEQ ID NO: 235761 - DNA, 16 bp, P. troglodytes
ctctgtctccaaggct

SEQ ID NO: 235762 - DNA, 16 bp, P. troglodytes
ctctgtctccaggctg

SEQ ID NO: 235763 - DNA, 16 bp, P. troglodytes
ctctgtctccatctct

SEQ ID NO: 235764 - DNA, 16 bp, P. troglodytes
ctctgtctcccagact

SEQ ID NO: 235765 - DNA, 16 bp, P. troglodytes
ctctgtctcctgccac

SEQ ID NO: 235766 - DNA, 16 bp, P. troglodytes
ctctgtctctaaacaa

SEQ ID NO: 235767 - DNA, 16 bp, P. troglodytes
ctctgtctctacaaaa

SEQ ID NO: 235768 - DNA, 16 bp, P. troglodytes
ctctgtctctcccagg

SEQ ID NO: 235769 - DNA, 16 bp, P. troglodytes
ctctgtctctttattt

SEQ ID NO: 235770 - DNA, 16 bp, P. troglodytes
ctctgtctgggaaaaa

SEQ ID NO: 235771 - DNA, 16 bp, P. troglodytes
ctctgtctgtctctcc

SEQ ID NO: 235772 - DNA, 16 bp, P. troglodytes
ctctgtctgtgtctct

SEQ ID NO: 235773 - DNA, 16 bp, P. troglodytes
ctctgtcttcatcttc

SEQ ID NO: 235774 - DNA, 16 bp, P. troglodytes
ctctgtcttcatgtgg

SEQ ID NO: 235775 - DNA, 16 bp, P. troglodytes
ctctgtcttcctgtct

SEQ ID NO: 235776 - DNA, 16 bp, P. troglodytes
ctctgtctttaaaaat

SEQ ID NO: 235777 - DNA, 16 bp, P. troglodytes
ctctgtgaatttgcct

SEQ ID NO: 235778 - DNA, 16 bp, P. troglodytes
ctctgtgactcaggct

SEQ ID NO: 235779 - DNA, 16 bp, P. troglodytes
ctctgtgagcagaggg

SEQ ID NO: 235780 - DNA, 16 bp, P. troglodytes
ctctgtgaggtaggta

SEQ ID NO: 235781 - DNA, 16 bp, P. troglodytes
ctctgtgccaagccct

SEQ ID NO: 235782 - DNA, 16 bp, P. troglodytes
ctctgtgcccagcact

SEQ ID NO: 235783 - DNA, 16 bp, P. troglodytes
ctctgtgcctcagttt

SEQ ID NO: 235784 - DNA, 16 bp, P. troglodytes
ctctgtgcctggcact

SEQ ID NO: 235785 - DNA, 16 bp, P. troglodytes
ctctgtgccttagttt

SEQ ID NO: 235786 - DNA, 16 bp, P. troglodytes
ctctgtgccttggttt

SEQ ID NO: 235787 - DNA, 16 bp, P. troglodytes
ctctgtgcttcagttt

SEQ ID NO: 235788 - DNA, 16 bp, P. troglodytes
ctctgtgcttctgttt

SEQ ID NO: 235789 - DNA, 16 bp, P. troglodytes
ctctgtggccaccacc

SEQ ID NO: 235790 - DNA, 16 bp, P. troglodytes
ctctgtggcccaggcc

SEQ ID NO: 235791 - DNA, 16 bp, P. troglodytes
ctctgtggcccaggtt

SEQ ID NO: 235792 - DNA, 16 bp, P. troglodytes
ctctgtggccctggga

SEQ ID NO: 235793 - DNA, 16 bp, P. troglodytes
ctctgtggctcacacc

SEQ ID NO: 235794 - DNA, 16 bp, P. troglodytes
ctctgtggctcagttt

SEQ ID NO: 235795 - DNA, 16 bp, P. troglodytes
ctctgtgggctgtacc

SEQ ID NO: 235796 - DNA, 16 bp, P. troglodytes
ctctgtgggggctctg

SEQ ID NO: 235797 - DNA, 16 bp, P. troglodytes
ctctgtgtcaaaaaaa

SEQ ID NO: 235798 - DNA, 16 bp, P. troglodytes
ctctgtgtctagctaa

SEQ ID NO: 235799 - DNA, 16 bp, P. troglodytes
ctctgtgtctctctct

SEQ ID NO: 235800 - DNA, 16 bp, P. troglodytes
ctctgtgtgaccttgg

SEQ ID NO: 235801 - DNA, 16 bp, P. troglodytes
ctctgtgtgtatatat

SEQ ID NO: 235802 - DNA, 16 bp, P. troglodytes
ctctgtgtgtctgtgt

SEQ ID NO: 235803 - DNA, 16 bp, P. troglodytes
ctctgtgtgtgtctct

SEQ ID NO: 235804 - DNA, 16 bp, P. troglodytes
ctctgtgtgtgtgtgc

SEQ ID NO: 235805 - DNA, 16 bp, P. troglodytes
ctctgttcatagtttc

SEQ ID NO: 235806 - DNA, 16 bp, P. troglodytes
ctctgttcattttttc

SEQ ID NO: 235807 - DNA, 16 bp, P. troglodytes
ctctgttcctcctgct

SEQ ID NO: 235808 - DNA, 18 bp, P. troglodytes
ctctgttctgttccattg

SEQ ID NO: 235809 - DNA, 16 bp, P. troglodytes
ctctgttgcccagctt

SEQ ID NO: 235810 - DNA, 16 bp, P. troglodytes
ctctgttggccaggct

SEQ ID NO: 235811 - DNA, 16 bp, P. troglodytes
ctctgtttcccaaagt

SEQ ID NO: 235812 - DNA, 16 bp, P. troglodytes
ctctgtttctccatct

SEQ ID NO: 235813 - DNA, 16 bp, P. troglodytes
ctctgtttttcagaat

SEQ ID NO: 235814 - DNA, 16 bp, P. troglodytes
ctcttaaaaaagaaaa

SEQ ID NO: 235815 - DNA, 16 bp, P. troglodytes
ctcttaaaaatagaaa

SEQ ID NO: 235816 - DNA, 16 bp, P. troglodytes
ctcttaacagattttt

SEQ ID NO: 235817 - DNA, 16 bp, P. troglodytes
ctcttaatactgcttt

SEQ ID NO: 235818 - DNA, 16 bp, P. troglodytes
ctcttactagctgtgt

SEQ ID NO: 235819 - DNA, 16 bp, P. troglodytes
ctcttactgcccaggc

SEQ ID NO: 235820 - DNA, 16 bp, P. troglodytes
ctcttactgctttcaa

SEQ ID NO: 235821 - DNA, 16 bp, P. troglodytes
ctcttagaagaaaatg

SEQ ID NO: 235822 - DNA, 16 bp, P. troglodytes
ctcttagttattttta

SEQ ID NO: 235823 - DNA, 16 bp, P. troglodytes
ctcttagtttcattga

SEQ ID NO: 235824 - DNA, 16 bp, P. troglodytes
ctcttataagggcact

SEQ ID NO: 235825 - DNA, 16 bp, P. troglodytes
ctcttatcagatatat

SEQ ID NO: 235826 - DNA, 16 bp, P. troglodytes
ctcttcaaggaggact

SEQ ID NO: 235827 - DNA, 16 bp, P. troglodytes
ctcttcaattttttaa

SEQ ID NO: 235828 - DNA, 16 bp, P. troglodytes
ctcttcaccaggcagg

SEQ ID NO: 235829 - DNA, 16 bp, P. troglodytes
ctcttcactgggcagg

SEQ ID NO: 235830 - DNA, 16 bp, P. troglodytes
ctcttcacttcccaga

SEQ ID NO: 235831 - DNA, 16 bp, P. troglodytes
ctcttcagaagaaaga

SEQ ID NO: 235832 - DNA, 16 bp, P. troglodytes
ctcttcagcatctgtt

SEQ ID NO: 235833 - DNA, 16 bp, P. troglodytes
ctcttcagcccaggag

SEQ ID NO: 235834 - DNA, 16 bp, P. troglodytes
ctcttcagcttgcaga

SEQ ID NO: 235835 - DNA, 16 bp, P. troglodytes
ctcttcagtgtctctt

SEQ ID NO: 235836 - DNA, 16 bp, P. troglodytes
ctcttcatcaaaccta

SEQ ID NO: 235837 - DNA, 16 bp, P. troglodytes
ctcttcatctggctgt

SEQ ID NO: 235838 - DNA, 16 bp, P. troglodytes
ctcttcatctgtaaaa

SEQ ID NO: 235839 - DNA, 16 bp, P. troglodytes
ctcttcatcttgcaaa

SEQ ID NO: 235840 - DNA, 16 bp, P. troglodytes
ctcttccacactgtgg

SEQ ID NO: 235841 - DNA, 16 bp, P. troglodytes
ctcttccagaaaacag

SEQ ID NO: 235842 - DNA, 16 bp, P. troglodytes
ctcttccagctcctgg

SEQ ID NO: 235843 - DNA, 16 bp, P. troglodytes
ctcttccagcttctag

SEQ ID NO: 235844 - DNA, 16 bp, P. troglodytes
ctcttcccctgtggct

SEQ ID NO: 235845 - DNA, 16 bp, P. troglodytes
ctcttccctctgcctg

SEQ ID NO: 235846 - DNA, 16 bp, P. troglodytes
ctcttcctccagctcc

SEQ ID NO: 235847 - DNA, 16 bp, P. troglodytes
ctcttcctcctcagcc

SEQ ID NO: 235848 - DNA, 16 bp, P. troglodytes
ctcttcctcctggaag

SEQ ID NO: 235849 - DNA, 16 bp, P. troglodytes
ctcttcctcctggctg

SEQ ID NO: 235850 - DNA, 16 bp, P. troglodytes
ctcttcctcctgggct

SEQ ID NO: 235851 - DNA, 16 bp, P. troglodytes
ctcttctccatctcca

SEQ ID NO: 235852 - DNA, 16 bp, P. troglodytes
ctcttctctgcagctg

SEQ ID NO: 235853 - DNA, 16 bp, P. troglodytes
ctcttctgagtctcca

SEQ ID NO: 235854 - DNA, 16 bp, P. troglodytes
ctcttctgccctgctc

SEQ ID NO: 235855 - DNA, 16 bp, P. troglodytes
ctcttctgcctcccaa

SEQ ID NO: 235856 - DNA, 16 bp, P. troglodytes
ctcttctgcctctgcc

SEQ ID NO: 235857 - DNA, 16 bp, P. troglodytes
ctcttctgctcctctg

SEQ ID NO: 235858 - DNA, 16 bp, P. troglodytes
ctcttctgggcattta

SEQ ID NO: 235859 - DNA, 16 bp, P. troglodytes
ctcttcttataaggac

SEQ ID NO: 235860 - DNA, 16 bp, P. troglodytes
ctcttcttcagcctct

SEQ ID NO: 235861 - DNA, 16 bp, P. troglodytes
ctcttcttcctctgtg

SEQ ID NO: 235862 - DNA, 16 bp, P. troglodytes
ctcttcttgagctggg

SEQ ID NO: 235863 - DNA, 16 bp, P. troglodytes
ctcttgaaagcaccac

SEQ ID NO: 235864 - DNA, 17 bp, P. troglodytes
ctcttgacctcatgatc

SEQ ID NO: 235865 - DNA, 17 bp, P. troglodytes
ctcttgacctcgtgatc

SEQ ID NO: 235866 - DNA, 17 bp, P. troglodytes
ctcttgaccttgtgatc

SEQ ID NO: 235867 - DNA, 16 bp, P. troglodytes
ctcttgccatgtgata

SEQ ID NO: 235868 - DNA, 16 bp, P. troglodytes
ctcttgcctcagcctc

SEQ ID NO: 235869 - DNA, 16 bp, P. troglodytes
ctcttgcctggattat

SEQ ID NO: 235870 - DNA, 16 bp, P. troglodytes
ctcttgccttagcctc

SEQ ID NO: 235871 - DNA, 16 bp, P. troglodytes
ctcttgccttagcttc

SEQ ID NO: 235872 - DNA, 16 bp, P. troglodytes
ctcttgccttctgtgc

SEQ ID NO: 235873 - DNA, 16 bp, P. troglodytes
ctcttgctctctgtct

SEQ ID NO: 235874 - DNA, 16 bp, P. troglodytes
ctcttgcttcagcctc

SEQ ID NO: 235875 - DNA, 16 bp, P. troglodytes
ctcttgcttttccagt

SEQ ID NO: 235876 - DNA, 18 bp, P. troglodytes
ctcttgcttttccccaca

SEQ ID NO: 235877 - DNA, 16 bp, P. troglodytes
ctcttggcctcaagcc

SEQ ID NO: 235878 - DNA, 16 bp, P. troglodytes
ctcttggcctcatgtg

SEQ ID NO: 235879 - DNA, 16 bp, P. troglodytes
ctcttggctgttgtga

SEQ ID NO: 235880 - DNA, 16 bp, P. troglodytes
ctcttggctttggagc

SEQ ID NO: 235881 - DNA, 16 bp, P. troglodytes
ctcttgggccttcagc

SEQ ID NO: 235882 - DNA, 16 bp, P. troglodytes
ctcttgggctcaagca

SEQ ID NO: 235883 - DNA, 16 bp, P. troglodytes
ctcttgggctcatgca

SEQ ID NO: 235884 - DNA, 16 bp, P. troglodytes
ctcttggggtccccag

SEQ ID NO: 235885 - DNA, 16 bp, P. troglodytes
ctcttgtctgatttct

SEQ ID NO: 235886 - DNA, 16 bp, P. troglodytes
ctcttgtcttaaaaaa

SEQ ID NO: 235887 - DNA, 16 bp, P. troglodytes
ctcttgtgccccaggc

SEQ ID NO: 235888 - DNA, 16 bp, P. troglodytes
ctctttaaaaaatgtt

SEQ ID NO: 235889 - DNA, 16 bp, P. troglodytes
ctctttaaataaataa

SEQ ID NO: 235890 - DNA, 16 bp, P. troglodytes
ctctttaataaaaact

SEQ ID NO: 235891 - DNA, 16 bp, P. troglodytes
ctctttagtttaacta

SEQ ID NO: 235892 - DNA, 16 bp, P. troglodytes
ctctttcagtcttttt

SEQ ID NO: 235893 - DNA, 16 bp, P. troglodytes
ctctttcctcagcctc

SEQ ID NO: 235894 - DNA, 16 bp, P. troglodytes
ctctttcctgccacca

SEQ ID NO: 235895 - DNA, 16 bp, P. troglodytes
ctctttcctgcctcag

SEQ ID NO: 235896 - DNA, 16 bp, P. troglodytes
ctctttcctttatgaa

SEQ ID NO: 235897 - DNA, 16 bp, P. troglodytes
ctctttctcaatctct

SEQ ID NO: 235898 - DNA, 16 bp, P. troglodytes
ctctttctcagggacg

SEQ ID NO: 235899 - DNA, 16 bp, P. troglodytes
ctctttctccactgca

SEQ ID NO: 235900 - DNA, 16 bp, P. troglodytes
ctctttctcctgctgc

SEQ ID NO: 235901 - DNA, 16 bp, P. troglodytes
ctctttctctctgctg

SEQ ID NO: 235902 - DNA, 16 bp, P. troglodytes
ctctttgaagaaattg

SEQ ID NO: 235903 - DNA, 16 bp, P. troglodytes
ctctttgaagcaattt

SEQ ID NO: 235904 - DNA, 16 bp, P. troglodytes
ctctttgaaggtctct

SEQ ID NO: 235905 - DNA, 16 bp, P. troglodytes
ctctttgagcatattt

SEQ ID NO: 235906 - DNA, 16 bp, P. troglodytes
ctctttgcctgctgct

SEQ ID NO: 235907 - DNA, 16 bp, P. troglodytes
ctctttgctttcactt

SEQ ID NO: 235908 - DNA, 16 bp, P. troglodytes
ctctttgggaagccaa

SEQ ID NO: 235909 - DNA, 16 bp, P. troglodytes
ctctttgggaggccga

SEQ ID NO: 235910 - DNA, 16 bp, P. troglodytes
ctctttgtactgcttt

SEQ ID NO: 235911 - DNA, 16 bp, P. troglodytes
ctctttgtgtccatga

SEQ ID NO: 235912 - DNA, 16 bp, P. troglodytes
ctcttttacactgttg

SEQ ID NO: 235913 - DNA, 16 bp, P. troglodytes
ctcttttatttaaaaa

SEQ ID NO: 235914 - DNA, 16 bp, P. troglodytes
ctcttttcctaattgg

SEQ ID NO: 235915 - DNA, 18 bp, P. troglodytes
ctcttttcggactcagcc

SEQ ID NO: 235916 - DNA, 16 bp, P. troglodytes
ctcttttctctaggct

SEQ ID NO: 235917 - DNA, 16 bp, P. troglodytes
ctcttttctctgaaaa

SEQ ID NO: 235918 - DNA, 16 bp, P. troglodytes
ctcttttcttttaaaa

SEQ ID NO: 235919 - DNA, 16 bp, P. troglodytes
ctcttttgccctcact

SEQ ID NO: 235920 - DNA, 16 bp, P. troglodytes
ctcttttgtttataaa

SEQ ID NO: 235921 - DNA, 16 bp, P. troglodytes
ctctttttaaaaacat

SEQ ID NO: 235922 - DNA, 16 bp, P. troglodytes
ctctttttattttgag

SEQ ID NO: 235923 - DNA, 16 bp, P. troglodytes
ctctttttcatatgtt

SEQ ID NO: 235924 - DNA, 16 bp, P. troglodytes
ctctttttccaaataa

SEQ ID NO: 235925 - DNA, 16 bp, P. troglodytes
ctctttttggccaggc

SEQ ID NO: 235926 - DNA, 16 bp, P. troglodytes
ctcttttttaaaaaaa

SEQ ID NO: 235927 - DNA, 16 bp, P. troglodytes
ctcttttttaaaaaat

SEQ ID NO: 235928 - DNA, 16 bp, P. troglodytes
ctcttttttagttcca

SEQ ID NO: 235929 - DNA, 16 bp, P. troglodytes
ctctttttttaaaaaa

SEQ ID NO: 235930 - DNA, 16 bp, P. troglodytes
ctctttttttgtaaat

SEQ ID NO: 235931 - DNA, 16 bp, P. troglodytes
ctgaaaaaaaaaatcc

SEQ ID NO: 235932 - DNA, 16 bp, P. troglodytes
ctgaaaaaaattttaa

SEQ ID NO: 235933 - DNA, 16 bp, P. troglodytes
ctgaaaaaattcaaaa

SEQ ID NO: 235934 - DNA, 16 bp, P. troglodytes
ctgaaaaacacaacat

SEQ ID NO: 235935 - DNA, 16 bp, P. troglodytes
ctgaaaaagaaacaga

SEQ ID NO: 235936 - DNA, 16 bp, P. troglodytes
ctgaaaaagaaattaa

SEQ ID NO: 235937 - DNA, 16 bp, P. troglodytes
ctgaaaaagcatttaa

SEQ ID NO: 235938 - DNA, 16 bp, P. troglodytes
ctgaaaaaggaaagaa

SEQ ID NO: 235939 - DNA, 16 bp, P. troglodytes
ctgaaaaaggcaagga

SEQ ID NO: 235940 - DNA, 16 bp, P. troglodytes
ctgaaaaataagaaca

SEQ ID NO: 235941 - DNA, 16 bp, P. troglodytes
ctgaaaaatacaaaac

SEQ ID NO: 235942 - DNA, 16 bp, P. troglodytes
ctgaaaaatacaatga

SEQ ID NO: 235943 - DNA, 16 bp, P. troglodytes
ctgaaaaatataataa

SEQ ID NO: 235944 - DNA, 16 bp, P. troglodytes
ctgaaaaatattccat

SEQ ID NO: 235945 - DNA, 16 bp, P. troglodytes
ctgaaaaatcaagaaa

SEQ ID NO: 235946 - DNA, 16 bp, P. troglodytes
ctgaaaaatcactgac

SEQ ID NO: 235947 - DNA, 16 bp, P. troglodytes
ctgaaaaatggagaaa

SEQ ID NO: 235948 - DNA, 16 bp, P. troglodytes
ctgaaaaatgggaaaa

SEQ ID NO: 235949 - DNA, 16 bp, P. troglodytes
ctgaaaaattattttt

SEQ ID NO: 235950 - DNA, 16 bp, P. troglodytes
ctgaaaacaaaaccaa

SEQ ID NO: 235951 - DNA, 16 bp, P. troglodytes
ctgaaaacaggagatt

SEQ ID NO: 235952 - DNA, 16 bp, P. troglodytes
ctgaaaacagggacaa

SEQ ID NO: 235953 - DNA, 16 bp, P. troglodytes
ctgaaaacattaaaaa

SEQ ID NO: 235954 - DNA, 16 bp, P. troglodytes
ctgaaaacattcaaaa

SEQ ID NO: 235955 - DNA, 16 bp, P. troglodytes
ctgaaaaccatgacac

SEQ ID NO: 235956 - DNA, 16 bp, P. troglodytes
ctgaaaagaaaattaa

SEQ ID NO: 235957 - DNA, 16 bp, P. troglodytes
ctgaaaaggacatgaa

SEQ ID NO: 235958 - DNA, 16 bp, P. troglodytes
ctgaaaagtctcagca

SEQ ID NO: 235959 - DNA, 16 bp, P. troglodytes
ctgaaaataaaaattt

SEQ ID NO: 235960 - DNA, 16 bp, P. troglodytes
ctgaaaataaaagata

SEQ ID NO: 235961 - DNA, 16 bp, P. troglodytes
ctgaaaataaaatgac

SEQ ID NO: 235962 - DNA, 16 bp, P. troglodytes
ctgaaaataaagaaat

SEQ ID NO: 235963 - DNA, 16 bp, P. troglodytes
ctgaaaataaatgttt

SEQ ID NO: 235964 - DNA, 16 bp, P. troglodytes
ctgaaaataatttttt

SEQ ID NO: 235965 - DNA, 16 bp, P. troglodytes
ctgaaaatataattct

SEQ ID NO: 235966 - DNA, 16 bp, P. troglodytes
ctgaaaatatattaat

SEQ ID NO: 235967 - DNA, 16 bp, P. troglodytes
ctgaaaatatgccatt

SEQ ID NO: 235968 - DNA, 16 bp, P. troglodytes
ctgaaaatcaacaact

SEQ ID NO: 235969 - DNA, 16 bp, P. troglodytes
ctgaaaatccaaaatg

SEQ ID NO: 235970 - DNA, 16 bp, P. troglodytes
ctgaaaatgaaattaa

SEQ ID NO: 235971 - DNA, 16 bp, P. troglodytes
ctgaaaatgcaaaaat

SEQ ID NO: 235972 - DNA, 16 bp, P. troglodytes
ctgaaaatgtggaagc

SEQ ID NO: 235973 - DNA, 16 bp, P. troglodytes
ctgaaaatgtggaagg

SEQ ID NO: 235974 - DNA, 16 bp, P. troglodytes
ctgaaaatgttaaaaa

SEQ ID NO: 235975 - DNA, 16 bp, P. troglodytes
ctgaaaatgtttttct

SEQ ID NO: 235976 - DNA, 16 bp, P. troglodytes
ctgaaaattccaaaaa

SEQ ID NO: 235977 - DNA, 16 bp, P. troglodytes
ctgaaaattccaaaat

SEQ ID NO: 235978 - DNA, 16 bp, P. troglodytes
ctgaaaatttaacagt

SEQ ID NO: 235979 - DNA, 16 bp, P. troglodytes
ctgaaaatttgagaca

SEQ ID NO: 235980 - DNA, 16 bp, P. troglodytes
ctgaaacaacagaaat

SEQ ID NO: 235981 - DNA, 16 bp, P. troglodytes
ctgaaacattttattt

SEQ ID NO: 235982 - DNA, 16 bp, P. troglodytes
ctgaaaccatggatag

SEQ ID NO: 235983 - DNA, 16 bp, P. troglodytes
ctgaaacctccatctc

SEQ ID NO: 235984 - DNA, 16 bp, P. troglodytes
ctgaaactacagaaag

SEQ ID NO: 235985 - DNA, 16 bp, P. troglodytes
ctgaaactattccaaa

SEQ ID NO: 235986 - DNA, 16 bp, P. troglodytes
ctgaaactattgcaat

SEQ ID NO: 235987 - DNA, 16 bp, P. troglodytes
ctgaaactcctgacct

SEQ ID NO: 235988 - DNA, 16 bp, P. troglodytes
ctgaaactgcagaaag

SEQ ID NO: 235989 - DNA, 16 bp, P. troglodytes
ctgaaactgggaagaa

SEQ ID NO: 235990 - DNA, 16 bp, P. troglodytes
ctgaaactttactaaa

SEQ ID NO: 235991 - DNA, 16 bp, P. troglodytes
ctgaaactttttgagc

SEQ ID NO: 235992 - DNA, 16 bp, P. troglodytes
ctgaaagaagaaataa

SEQ ID NO: 235993 - DNA, 16 bp, P. troglodytes
ctgaaagagaaaaaga

SEQ ID NO: 235994 - DNA, 16 bp, P. troglodytes
ctgaaagagaaatcaa

SEQ ID NO: 235995 - DNA, 16 bp, P. troglodytes
ctgaaagagagggaga

SEQ ID NO: 235996 - DNA, 16 bp, P. troglodytes
ctgaaagagctgtaac

SEQ ID NO: 235997 - DNA, 16 bp, P. troglodytes
ctgaaagataaaatag

SEQ ID NO: 235998 - DNA, 16 bp, P. troglodytes
ctgaaagatgaaatag

SEQ ID NO: 235999 - DNA, 16 bp, P. troglodytes
ctgaaagctctgcctc

SEQ ID NO: 236000 - DNA, 16 bp, P. troglodytes
ctgaaagctttgaaga

SEQ ID NO: 236001 - DNA, 16 bp, P. troglodytes
ctgaaaggatcaacaa

SEQ ID NO: 236002 - DNA, 16 bp, P. troglodytes
ctgaaaggtggaggtt

SEQ ID NO: 236003 - DNA, 16 bp, P. troglodytes
ctgaaagtaaaaaaca

SEQ ID NO: 236004 - DNA, 16 bp, P. troglodytes
ctgaaagtcacacagc

SEQ ID NO: 236005 - DNA, 16 bp, P. troglodytes
ctgaaagtgacagaga

SEQ ID NO: 236006 - DNA, 16 bp, P. troglodytes
ctgaaagtgactggga

SEQ ID NO: 236007 - DNA, 16 bp, P. troglodytes
ctgaaataaaatattt

SEQ ID NO: 236008 - DNA, 16 bp, P. troglodytes
ctgaaataatattttt

SEQ ID NO: 236009 - DNA, 16 bp, P. troglodytes
ctgaaataattttact

SEQ ID NO: 236010 - DNA, 16 bp, P. troglodytes
ctgaaatatatttctt

SEQ ID NO: 236011 - DNA, 16 bp, P. troglodytes
ctgaaatcatgccact

SEQ ID NO: 236012 - DNA, 16 bp, P. troglodytes
ctgaaatctattttgt

SEQ ID NO: 236013 - DNA, 16 bp, P. troglodytes
ctgaaatctggagaga

SEQ ID NO: 236014 - DNA, 16 bp, P. troglodytes
ctgaaatgaaaaagaa

SEQ ID NO: 236015 - DNA, 16 bp, P. troglodytes
ctgaaatgcagtggtg

SEQ ID NO: 236016 - DNA, 16 bp, P. troglodytes
ctgaaatgtaaaaccc

SEQ ID NO: 236017 - DNA, 16 bp, P. troglodytes
ctgaaatgtttatttt

SEQ ID NO: 236018 - DNA, 16 bp, P. troglodytes
ctgaaattaaaattta

SEQ ID NO: 236019 - DNA, 16 bp, P. troglodytes
ctgaaattacaggcat

SEQ ID NO: 236020 - DNA, 16 bp, P. troglodytes
ctgaaattataacaaa

SEQ ID NO: 236021 - DNA, 16 bp, P. troglodytes
ctgaaattatgtcaaa

SEQ ID NO: 236022 - DNA, 16 bp, P. troglodytes
ctgaaattcaaatttg

SEQ ID NO: 236023 - DNA, 16 bp, P. troglodytes
ctgaaattcttgaagt

SEQ ID NO: 236024 - DNA, 16 bp, P. troglodytes
ctgaaattgaaaaaaa

SEQ ID NO: 236025 - DNA, 25 bp, P. troglodytes
ctgaaattgtggcaataatcaatag

SEQ ID NO: 236026 - DNA, 16 bp, P. troglodytes
ctgaaatttattttct

SEQ ID NO: 236027 - DNA, 16 bp, P. troglodytes
ctgaaattttaaaaaa

SEQ ID NO: 236028 - DNA, 16 bp, P. troglodytes
ctgaaattttgtattt

SEQ ID NO: 236029 - DNA, 16 bp, P. troglodytes
ctgaacaaacaggcct

SEQ ID NO: 236030 - DNA, 16 bp, P. troglodytes
ctgaacaaactgaaaa

SEQ ID NO: 236031 - DNA, 16 bp, P. troglodytes
ctgaacactttttttt

SEQ ID NO: 236032 - DNA, 16 bp, P. troglodytes
ctgaacagaccaataa

SEQ ID NO: 236033 - DNA, 16 bp, P. troglodytes
ctgaaccacaaacaat

SEQ ID NO: 236034 - DNA, 16 bp, P. troglodytes
ctgaaccatttgagaa

SEQ ID NO: 236035 - DNA, 16 bp, P. troglodytes
ctgaaccctggaggca

SEQ ID NO: 236036 - DNA, 16 bp, P. troglodytes
ctgaaccttctcctag

SEQ ID NO: 236037 - DNA, 16 bp, P. troglodytes
ctgaaccttggttttc

SEQ ID NO: 236038 - DNA, 16 bp, P. troglodytes
ctgaactcaggagttc

SEQ ID NO: 236039 - DNA, 16 bp, P. troglodytes
ctgaactcctggcctc

SEQ ID NO: 236040 - DNA, 16 bp, P. troglodytes
ctgaacttaaaattaa

SEQ ID NO: 236041 - DNA, 16 bp, P. troglodytes
ctgaagaaaatgaaat

SEQ ID NO: 236042 - DNA, 16 bp, P. troglodytes
ctgaagaaagattttg

SEQ ID NO: 236043 - DNA, 16 bp, P. troglodytes
ctgaagaaattaaaat

SEQ ID NO: 236044 - DNA, 16 bp, P. troglodytes
ctgaagaaattccttt

SEQ ID NO: 236045 - DNA, 16 bp, P. troglodytes
ctgaagaaattttaaa

SEQ ID NO: 236046 - DNA, 16 bp, P. troglodytes
ctgaagaaccctgact

SEQ ID NO: 236047 - DNA, 16 bp, P. troglodytes
ctgaagaacttgaagt

SEQ ID NO: 236048 - DNA, 16 bp, P. troglodytes
ctgaagaacttggagc

SEQ ID NO: 236049 - DNA, 16 bp, P. troglodytes
ctgaagaacttggagt

SEQ ID NO: 236050 - DNA, 16 bp, P. troglodytes
ctgaagaacttggatt

SEQ ID NO: 236051 - DNA, 16 bp, P. troglodytes
ctgaagaactttcttt

SEQ ID NO: 236052 - DNA, 16 bp, P. troglodytes
ctgaagaagaaaacaa

SEQ ID NO: 236053 - DNA, 16 bp, P. troglodytes
ctgaagaagaaaataa

SEQ ID NO: 236054 - DNA, 16 bp, P. troglodytes
ctgaagaagaagaaaa

SEQ ID NO: 236055 - DNA, 16 bp, P. troglodytes
ctgaagaaggagaatc

SEQ ID NO: 236056 - DNA, 16 bp, P. troglodytes
ctgaagaatttggagt

SEQ ID NO: 236057 - DNA, 16 bp, P. troglodytes
ctgaagacaggctatt

SEQ ID NO: 236058 - DNA, 16 bp, P. troglodytes
ctgaagacccaggaga

SEQ ID NO: 236059 - DNA, 16 bp, P. troglodytes
ctgaagacctgggatc

SEQ ID NO: 236060 - DNA, 16 bp, P. troglodytes
ctgaagagaaggaaaa

SEQ ID NO: 236061 - DNA, 16 bp, P. troglodytes
ctgaagagcagtggca

SEQ ID NO: 236062 - DNA, 16 bp, P. troglodytes
ctgaagagcagtggtg

SEQ ID NO: 236063 - DNA, 16 bp, P. troglodytes
ctgaagagcctttggg

SEQ ID NO: 236064 - DNA, 16 bp, P. troglodytes
ctgaagagcttctgca

SEQ ID NO: 236065 - DNA, 16 bp, P. troglodytes
ctgaagaggaaactga

SEQ ID NO: 236066 - DNA, 16 bp, P. troglodytes
ctgaagagggaggaag

SEQ ID NO: 236067 - DNA, 16 bp, P. troglodytes
ctgaagatatttcctt

SEQ ID NO: 236068 - DNA, 16 bp, P. troglodytes
ctgaagatgaatggct

SEQ ID NO: 236069 - DNA, 16 bp, P. troglodytes
ctgaagatggaggaag

SEQ ID NO: 236070 - DNA, 16 bp, P. troglodytes
ctgaagatgtgattga

SEQ ID NO: 236071 - DNA, 16 bp, P. troglodytes
ctgaagatgtggctga

SEQ ID NO: 236072 - DNA, 16 bp, P. troglodytes
ctgaagcaacagccca

SEQ ID NO: 236073 - DNA, 16 bp, P. troglodytes
ctgaagcacagcacca

SEQ ID NO: 236074 - DNA, 24 bp, P. troglodytes
ctgaagcacagcatcacagggaga

SEQ ID NO: 236075 - DNA, 16 bp, P. troglodytes
ctgaagcagaagaatt

SEQ ID NO: 236076 - DNA, 16 bp, P. troglodytes
ctgaagcagcagccca

SEQ ID NO: 236077 - DNA, 16 bp, P. troglodytes
ctgaagcagctggatt

SEQ ID NO: 236078 - DNA, 16 bp, P. troglodytes
ctgaagcaggtcataa

SEQ ID NO: 236079 - DNA, 16 bp, P. troglodytes
ctgaagcaggtggatt

SEQ ID NO: 236080 - DNA, 16 bp, P. troglodytes
ctgaagcatttcccca

SEQ ID NO: 236081 - DNA, 16 bp, P. troglodytes
ctgaagcatttcttca

SEQ ID NO: 236082 - DNA, 16 bp, P. troglodytes
ctgaagccagagaatc

SEQ ID NO: 236083 - DNA, 16 bp, P. troglodytes
ctgaagccccagaggg

SEQ ID NO: 236084 - DNA, 16 bp, P. troglodytes
ctgaagccccagtggg

SEQ ID NO: 236085 - DNA, 16 bp, P. troglodytes
ctgaagccctcaccag

SEQ ID NO: 236086 - DNA, 16 bp, P. troglodytes
ctgaagccttcttctg

SEQ ID NO: 236087 - DNA, 16 bp, P. troglodytes
ctgaagctcagagaag

SEQ ID NO: 236088 - DNA, 16 bp, P. troglodytes
ctgaagctcagagagc

SEQ ID NO: 236089 - DNA, 16 bp, P. troglodytes
ctgaagctgaaaaatg

SEQ ID NO: 236090 - DNA, 16 bp, P. troglodytes
ctgaaggaagcagatt

SEQ ID NO: 236091 - DNA, 16 bp, P. troglodytes
ctgaaggaatggtcca

SEQ ID NO: 236092 - DNA, 16 bp, P. troglodytes
ctgaaggagatgggga

SEQ ID NO: 236093 - DNA, 16 bp, P. troglodytes
ctgaaggagctagaga

SEQ ID NO: 236094 - DNA, 16 bp, P. troglodytes
ctgaaggatattttca

SEQ ID NO: 236095 - DNA, 16 bp, P. troglodytes
ctgaaggatttttttt

SEQ ID NO: 236096 - DNA, 16 bp, P. troglodytes
ctgaaggcaaattgct

SEQ ID NO: 236097 - DNA, 16 bp, P. troglodytes
ctgaaggcccgagagc

SEQ ID NO: 236098 - DNA, 16 bp, P. troglodytes
ctgaaggcctgagaac

SEQ ID NO: 236099 - DNA, 16 bp, P. troglodytes
ctgaaggcttcctctg

SEQ ID NO: 236100 - DNA, 16 bp, P. troglodytes
ctgaaggtaattttat

SEQ ID NO: 236101 - DNA, 16 bp, P. troglodytes
ctgaaggtcacacagc

SEQ ID NO: 236102 - DNA, 16 bp, P. troglodytes
ctgaaggtgaatgagg

SEQ ID NO: 236103 - DNA, 16 bp, P. troglodytes
ctgaagtcagaagttc

SEQ ID NO: 236104 - DNA, 16 bp, P. troglodytes
ctgaagtgcaatggca

SEQ ID NO: 236105 - DNA, 16 bp, P. troglodytes
ctgaagtgcagtggga

SEQ ID NO: 236106 - DNA, 16 bp, P. troglodytes
ctgaagtggaccccca

SEQ ID NO: 236107 - DNA, 16 bp, P. troglodytes
ctgaagtgggagaata

SEQ ID NO: 236108 - DNA, 16 bp, P. troglodytes
ctgaagtgggaggaca

SEQ ID NO: 236109 - DNA, 16 bp, P. troglodytes
ctgaagtgtttttttt

SEQ ID NO: 236110 - DNA, 16 bp, P. troglodytes
ctgaagttatttatca

SEQ ID NO: 236111 - DNA, 16 bp, P. troglodytes
ctgaagttcaagacca

SEQ ID NO: 236112 - DNA, 16 bp, P. troglodytes
ctgaagttcagagaag

SEQ ID NO: 236113 - DNA, 16 bp, P. troglodytes
ctgaagttgctgcaga

SEQ ID NO: 236114 - DNA, 16 bp, P. troglodytes
ctgaagttttcttttt

SEQ ID NO: 236115 - DNA, 16 bp, P. troglodytes
ctgaagtttttctttt

SEQ ID NO: 236116 - DNA, 16 bp, P. troglodytes
ctgaataaagtcttcc

SEQ ID NO: 236117 - DNA, 16 bp, P. troglodytes
ctgaataataaaataa

SEQ ID NO: 236118 - DNA, 16 bp, P. troglodytes
ctgaatactgtaggca

SEQ ID NO: 236119 - DNA, 18 bp, P. troglodytes
ctgaatagaccaataaca

SEQ ID NO: 236120 - DNA, 19 bp, P. troglodytes
ctgaatatccttgttaatt

SEQ ID NO: 236121 - DNA, 16 bp, P. troglodytes
ctgaatattttaagcc

SEQ ID NO: 236122 - DNA, 16 bp, P. troglodytes
ctgaatcagaaactct

SEQ ID NO: 236123 - DNA, 16 bp, P. troglodytes
ctgaatccaggagttt

SEQ ID NO: 236124 - DNA, 16 bp, P. troglodytes
ctgaatctaaaaaaaa

SEQ ID NO: 236125 - DNA, 16 bp, P. troglodytes
ctgaatctaaagaaag

SEQ ID NO: 236126 - DNA, 16 bp, P. troglodytes
ctgaatctaatcatga

SEQ ID NO: 236127 - DNA, 16 bp, P. troglodytes
ctgaatgaataaataa

SEQ ID NO: 236128 - DNA, 16 bp, P. troglodytes
ctgaatgacaatagtg

SEQ ID NO: 236129 - DNA, 16 bp, P. troglodytes
ctgaatgagagaaaat

SEQ ID NO: 236130 - DNA, 16 bp, P. troglodytes
ctgaatgatgaaaaca

SEQ ID NO: 236131 - DNA, 16 bp, P. troglodytes
ctgaatgggaaaaaaa

SEQ ID NO: 236132 - DNA, 16 bp, P. troglodytes
ctgaatgggcagaaac

SEQ ID NO: 236133 - DNA, 16 bp, P. troglodytes
ctgaatgggcagaagc

SEQ ID NO: 236134 - DNA, 16 bp, P. troglodytes
ctgaatgtctgtgtct

SEQ ID NO: 236135 - DNA, 16 bp, P. troglodytes
ctgaatgtggagttgg

SEQ ID NO: 236136 - DNA, 16 bp, P. troglodytes
ctgaatgtgtccccca

SEQ ID NO: 236137 - DNA, 16 bp, P. troglodytes
ctgaatgtttatgtcc

SEQ ID NO: 236138 - DNA, 16 bp, P. troglodytes
ctgaatgtttgtgtcc

SEQ ID NO: 236139 - DNA, 16 bp, P. troglodytes
ctgaatgtttgtgttc

SEQ ID NO: 236140 - DNA, 16 bp, P. troglodytes
ctgaattagaaactct

SEQ ID NO: 236141 - DNA, 16 bp, P. troglodytes
ctgaattatgaagaaa

SEQ ID NO: 236142 - DNA, 16 bp, P. troglodytes
ctgaattattttaaaa

SEQ ID NO: 236143 - DNA, 16 bp, P. troglodytes
ctgaattccaaaggaa

SEQ ID NO: 236144 - DNA, 16 bp, P. troglodytes
ctgaattcctgggctc

SEQ ID NO: 236145 - DNA, 16 bp, P. troglodytes
ctgaattctgccaaac

SEQ ID NO: 236146 - DNA, 16 bp, P. troglodytes
ctgaattctttcccca

SEQ ID NO: 236147 - DNA, 16 bp, P. troglodytes
ctgaattgctacaatc

SEQ ID NO: 236148 - DNA, 16 bp, P. troglodytes
ctgaattgtttttctg

SEQ ID NO: 236149 - DNA, 16 bp, P. troglodytes
ctgaatttgattgttg

SEQ ID NO: 236150 - DNA, 16 bp, P. troglodytes
ctgaatttggaaaact

SEQ ID NO: 236151 - DNA, 16 bp, P. troglodytes
ctgaatttgttcatta

SEQ ID NO: 236152 - DNA, 16 bp, P. troglodytes
ctgaattttatcaaat

SEQ ID NO: 236153 - DNA, 16 bp, P. troglodytes
ctgaatttttcacttt

SEQ ID NO: 236154 - DNA, 16 bp, P. troglodytes
ctgaattttttcttct

SEQ ID NO: 236155 - DNA, 16 bp, P. troglodytes
ctgacaaaagattaat

SEQ ID NO: 236156 - DNA, 16 bp, P. troglodytes
ctgacaaccactaatc

SEQ ID NO: 236157 - DNA, 16 bp, P. troglodytes
ctgacaactttcacac

SEQ ID NO: 236158 - DNA, 16 bp, P. troglodytes
ctgacaagggattaat

SEQ ID NO: 236159 - DNA, 16 bp, P. troglodytes
ctgacaatatcaaatg

SEQ ID NO: 236160 - DNA, 16 bp, P. troglodytes
ctgacaatgatgtcac

SEQ ID NO: 236161 - DNA, 16 bp, P. troglodytes
ctgacaatgcagtaga

SEQ ID NO: 236162 - DNA, 16 bp, P. troglodytes
ctgacacaccagcccc

SEQ ID NO: 236163 - DNA, 16 bp, P. troglodytes
ctgacacccaagctgg

SEQ ID NO: 236164 - DNA, 16 bp, P. troglodytes
ctgacacctttgaaac

SEQ ID NO: 236165 - DNA, 16 bp, P. troglodytes
ctgacactttgatttt

SEQ ID NO: 236166 - DNA, 16 bp, P. troglodytes
ctgacagaaacaagca

SEQ ID NO: 236167 - DNA, 16 bp, P. troglodytes
ctgacagaagggaaga

SEQ ID NO: 236168 - DNA, 16 bp, P. troglodytes
ctgacagatttgaaga

SEQ ID NO: 236169 - DNA, 16 bp, P. troglodytes
ctgacagccagcaagg

SEQ ID NO: 236170 - DNA, 16 bp, P. troglodytes
ctgacagcctccagct

SEQ ID NO: 236171 - DNA, 16 bp, P. troglodytes
ctgacagctctgaaga

SEQ ID NO: 236172 - DNA, 16 bp, P. troglodytes
ctgacagttttataaa

SEQ ID NO: 236173 - DNA, 16 bp, P. troglodytes
ctgacatggtgaaatc

SEQ ID NO: 236174 - DNA, 16 bp, P. troglodytes
ctgacattcctggtgt

SEQ ID NO: 236175 - DNA, 16 bp, P. troglodytes
ctgaccaaaacaggat

SEQ ID NO: 236176 - DNA, 16 bp, P. troglodytes
ctgaccaacaaggaga

SEQ ID NO: 236177 - DNA, 20 bp, P. troglodytes
ctgaccaacatggtgaaact

SEQ ID NO: 236178 - DNA, 18 bp, P. troglodytes
ctgaccaacatgtagaaa

SEQ ID NO: 236179 - DNA, 18 bp, P. troglodytes
ctgaccaatacggtgaaa

SEQ ID NO: 236180 - DNA, 16 bp, P. troglodytes
ctgaccccaaagcctg

SEQ ID NO: 236181 - DNA, 16 bp, P. troglodytes
ctgaccccacagaaac

SEQ ID NO: 236182 - DNA, 16 bp, P. troglodytes
ctgaccccagagccca

SEQ ID NO: 236183 - DNA, 16 bp, P. troglodytes
ctgacccctctgcctg

SEQ ID NO: 236184 - DNA, 16 bp, P. troglodytes
ctgacccctgacccca

SEQ ID NO: 236185 - DNA, 16 bp, P. troglodytes
ctgacccctgaccccc

SEQ ID NO: 236186 - DNA, 16 bp, P. troglodytes
ctgaccccttcttcca

SEQ ID NO: 236187 - DNA, 16 bp, P. troglodytes
ctgaccctgaccctga

SEQ ID NO: 236188 - DNA, 16 bp, P. troglodytes
ctgaccctttgctcat

SEQ ID NO: 236189 - DNA, 16 bp, P. troglodytes
ctgacctaactgactc

SEQ ID NO: 236190 - DNA, 16 bp, P. troglodytes
ctgacctcaagggatc

SEQ ID NO: 236191 - DNA, 16 bp, P. troglodytes
ctgacctcaaggtgat

SEQ ID NO: 236192 - DNA, 16 bp, P. troglodytes
ctgacctcagaagatc

SEQ ID NO: 236193 - DNA, 16 bp, P. troglodytes
ctgacctcaggtgatt

SEQ ID NO: 236194 - DNA, 16 bp, P. troglodytes
ctgacctcatgaacca

SEQ ID NO: 236195 - DNA, 16 bp, P. troglodytes
ctgacctcatgatcaa

SEQ ID NO: 236196 - DNA, 16 bp, P. troglodytes
ctgacctccacaatgg

SEQ ID NO: 236197 - DNA, 16 bp, P. troglodytes
ctgacctccagcctgg

SEQ ID NO: 236198 - DNA, 16 bp, P. troglodytes
ctgacctcccaggctc

SEQ ID NO: 236199 - DNA, 16 bp, P. troglodytes
ctgacctcgagatccg

SEQ ID NO: 236200 - DNA, 16 bp, P. troglodytes
ctgacctctgacctct

SEQ ID NO: 236201 - DNA, 16 bp, P. troglodytes
ctgacctctggtgatc

SEQ ID NO: 236202 - DNA, 16 bp, P. troglodytes
ctgacctcttgatctg

SEQ ID NO: 236203 - DNA, 16 bp, P. troglodytes
ctgacctgaagtgatc

SEQ ID NO: 236204 - DNA, 16 bp, P. troglodytes
ctgaccttcccctgaa

SEQ ID NO: 236205 - DNA, 16 bp, P. troglodytes
ctgaccttctccccac

SEQ ID NO: 236206 - DNA, 16 bp, P. troglodytes
ctgacctttctttctg

SEQ ID NO: 236207 - DNA, 16 bp, P. troglodytes
ctgactcaaatgttag

SEQ ID NO: 236208 - DNA, 16 bp, P. troglodytes
ctgactcagcctcccg

SEQ ID NO: 236209 - DNA, 16 bp, P. troglodytes
ctgactcagcctctgg

SEQ ID NO: 236210 - DNA, 16 bp, P. troglodytes
ctgactcagccttcca

SEQ ID NO: 236211 - DNA, 16 bp, P. troglodytes
ctgactccaaagcctg

SEQ ID NO: 236212 - DNA, 16 bp, P. troglodytes
ctgactccacatttcc

SEQ ID NO: 236213 - DNA, 16 bp, P. troglodytes
ctgactccagagctca

SEQ ID NO: 236214 - DNA, 16 bp, P. troglodytes
ctgactccaggccctg

SEQ ID NO: 236215 - DNA, 16 bp, P. troglodytes
ctgactcccagccctg

SEQ ID NO: 236216 - DNA, 16 bp, P. troglodytes
ctgactcccaggccag

SEQ ID NO: 236217 - DNA, 16 bp, P. troglodytes
ctgactcccccacctc

SEQ ID NO: 236218 - DNA, 24 bp, P. troglodytes
ctgactctcttttcggactcagcc

SEQ ID NO: 236219 - DNA, 23 bp, P. troglodytes
ctgactctctttttggactcagc

SEQ ID NO: 236220 - DNA, 16 bp, P. troglodytes
ctgactctgcctccca

SEQ ID NO: 236221 - DNA, 16 bp, P. troglodytes
ctgactctttccagca

SEQ ID NO: 236222 - DNA, 16 bp, P. troglodytes
ctgactgactgaatga

SEQ ID NO: 236223 - DNA, 16 bp, P. troglodytes
ctgactgcaaagccca

SEQ ID NO: 236224 - DNA, 16 bp, P. troglodytes
ctgactgggcacggtg

SEQ ID NO: 236225 - DNA, 16 bp, P. troglodytes
ctgactggtgtgagac

SEQ ID NO: 236226 - DNA, 16 bp, P. troglodytes
ctgacttcaaaacata

SEQ ID NO: 236227 - DNA, 19 bp, P. troglodytes
ctgacttcaagaatgaagc

SEQ ID NO: 236228 - DNA, 16 bp, P. troglodytes
ctgacttcaagcaatt

SEQ ID NO: 236229 - DNA, 16 bp, P. troglodytes
ctgacttcaggtgtga

SEQ ID NO: 236230 - DNA, 16 bp, P. troglodytes
ctgacttcttcctttc

SEQ ID NO: 236231 - DNA, 16 bp, P. troglodytes
ctgacttgatcactac

SEQ ID NO: 236232 - DNA, 16 bp, P. troglodytes
ctgactttttttaaaa

SEQ ID NO: 236233 - DNA, 16 bp, P. troglodytes
ctgagaaaaaaagaga

SEQ ID NO: 236234 - DNA, 17 bp, P. troglodytes
ctgagaaaaagaattca

SEQ ID NO: 236235 - DNA, 16 bp, P. troglodytes
ctgagaaaagaaataa

SEQ ID NO: 236236 - DNA, 16 bp, P. troglodytes
ctgagaaacatctttg

SEQ ID NO: 236237 - DNA, 16 bp, P. troglodytes
ctgagaaactggattt

SEQ ID NO: 236238 - DNA, 16 bp, P. troglodytes
ctgagaaactgtcaca

SEQ ID NO: 236239 - DNA, 16 bp, P. troglodytes
ctgagaaagaagagaa

SEQ ID NO: 236240 - DNA, 16 bp, P. troglodytes
ctgagaaagcatttga

SEQ ID NO: 236241 - DNA, 16 bp, P. troglodytes
ctgagaaataaaaaga

SEQ ID NO: 236242 - DNA, 16 bp, P. troglodytes
ctgagaaatggaacaa

SEQ ID NO: 236243 - DNA, 16 bp, P. troglodytes
ctgagaaatttataaa

SEQ ID NO: 236244 - DNA, 16 bp, P. troglodytes
ctgagaaccacacccc

SEQ ID NO: 236245 - DNA, 16 bp, P. troglodytes
ctgagaacgggcagac

SEQ ID NO: 236246 - DNA, 16 bp, P. troglodytes
ctgagaactggaaaaa

SEQ ID NO: 236247 - DNA, 16 bp, P. troglodytes
ctgagaagaatgaaaa

SEQ ID NO: 236248 - DNA, 16 bp, P. troglodytes
ctgagaagtccaagat

SEQ ID NO: 236249 - DNA, 16 bp, P. troglodytes
ctgagaagtcctgcag

SEQ ID NO: 236250 - DNA, 16 bp, P. troglodytes
ctgagaatctgcattt

SEQ ID NO: 236251 - DNA, 16 bp, P. troglodytes
ctgagaatgatgtttt

SEQ ID NO: 236252 - DNA, 16 bp, P. troglodytes
ctgagaattatggttt

SEQ ID NO: 236253 - DNA, 16 bp, P. troglodytes
ctgagaattttccaaa

SEQ ID NO: 236254 - DNA, 16 bp, P. troglodytes
ctgagacaagagaatg

SEQ ID NO: 236255 - DNA, 16 bp, P. troglodytes
ctgagacacagctaag

SEQ ID NO: 236256 - DNA, 16 bp, P. troglodytes
ctgagacacatccagc

SEQ ID NO: 236257 - DNA, 16 bp, P. troglodytes
ctgagacagaaaaatt

SEQ ID NO: 236258 - DNA, 16 bp, P. troglodytes
ctgagacaggaggatc

SEQ ID NO: 236259 - DNA, 16 bp, P. troglodytes
ctgagacagggtctgg

SEQ ID NO: 236260 - DNA, 16 bp, P. troglodytes
ctgagacattttgtca

SEQ ID NO: 236261 - DNA, 16 bp, P. troglodytes
ctgagaccacttcagc

SEQ ID NO: 236262 - DNA, 16 bp, P. troglodytes
ctgagacccaggagag

SEQ ID NO: 236263 - DNA, 16 bp, P. troglodytes
ctgagacctactgggt

SEQ ID NO: 236264 - DNA, 16 bp, P. troglodytes
ctgagacggagtctca

SEQ ID NO: 236265 - DNA, 16 bp, P. troglodytes
ctgagacgggaggatt

SEQ ID NO: 236266 - DNA, 16 bp, P. troglodytes
ctgagactttgcagaa

SEQ ID NO: 236267 - DNA, 16 bp, P. troglodytes
ctgagactttgcttaa

SEQ ID NO: 236268 - DNA, 16 bp, P. troglodytes
ctgagagacagtttgc

SEQ ID NO: 236269 - DNA, 16 bp, P. troglodytes
ctgagagacccataga

SEQ ID NO: 236270 - DNA, 16 bp, P. troglodytes
ctgagagagaaggaga

SEQ ID NO: 236271 - DNA, 16 bp, P. troglodytes
ctgagagatgtgatcc

SEQ ID NO: 236272 - DNA, 16 bp, P. troglodytes
ctgagagatgttgtca

SEQ ID NO: 236273 - DNA, 16 bp, P. troglodytes
ctgagagatttcatca

SEQ ID NO: 236274 - DNA, 16 bp, P. troglodytes
ctgagagcacagtggg

SEQ ID NO: 236275 - DNA, 16 bp, P. troglodytes
ctgagagccacctcca

SEQ ID NO: 236276 - DNA, 16 bp, P. troglodytes
ctgagagccactttca

SEQ ID NO: 236277 - DNA, 16 bp, P. troglodytes
ctgagagcttcagaga

SEQ ID NO: 236278 - DNA, 16 bp, P. troglodytes
ctgagagctttccttt

SEQ ID NO: 236279 - DNA, 16 bp, P. troglodytes
ctgagagctttctttt

SEQ ID NO: 236280 - DNA, 16 bp, P. troglodytes
ctgagaggaatgtata

SEQ ID NO: 236281 - DNA, 16 bp, P. troglodytes
ctgagaggcagagatt

SEQ ID NO: 236282 - DNA, 16 bp, P. troglodytes
ctgagagtccagaaat

SEQ ID NO: 236283 - DNA, 17 bp, P. troglodytes
ctgagagtgatggtttc

SEQ ID NO: 236284 - DNA, 16 bp, P. troglodytes
ctgagataggagaaaa

SEQ ID NO: 236285 - DNA, 16 bp, P. troglodytes
ctgagatatatatata

SEQ ID NO: 236286 - DNA, 16 bp, P. troglodytes
ctgagatcacacagct

SEQ ID NO: 236287 - DNA, 17 bp, P. troglodytes
ctgagatcaggagttcg

SEQ ID NO: 236288 - DNA, 16 bp, P. troglodytes
ctgagatcataccact

SEQ ID NO: 236289 - DNA, 16 bp, P. troglodytes
ctgagatcatcccact

SEQ ID NO: 236290 - DNA, 16 bp, P. troglodytes
ctgagatcgggagttc

SEQ ID NO: 236291 - DNA, 16 bp, P. troglodytes
ctgagatctcgccact

SEQ ID NO: 236292 - DNA, 16 bp, P. troglodytes
ctgagatctgaggaca

SEQ ID NO: 236293 - DNA, 16 bp, P. troglodytes
ctgagatgaaacttcc

SEQ ID NO: 236294 - DNA, 16 bp, P. troglodytes
ctgagatgacaggcat

SEQ ID NO: 236295 - DNA, 16 bp, P. troglodytes
ctgagatgatgccact

SEQ ID NO: 236296 - DNA, 16 bp, P. troglodytes
ctgagatgcagggcac

SEQ ID NO: 236297 - DNA, 16 bp, P. troglodytes
ctgagatgggtggatt

SEQ ID NO: 236298 - DNA, 23 bp, P. troglodytes
ctgagatgtttgggtggagagaa

SEQ ID NO: 236299 - DNA, 16 bp, P. troglodytes
ctgagattaaaaaaaa

SEQ ID NO: 236300 - DNA, 16 bp, P. troglodytes
ctgagattacaggcac

SEQ ID NO: 236301 - DNA, 19 bp, P. troglodytes
ctgagattacaggcgccca

SEQ ID NO: 236302 - DNA, 17 bp, P. troglodytes
ctgagattacaggtgca

SEQ ID NO: 236303 - DNA, 16 bp, P. troglodytes
ctgagattcagagagg

SEQ ID NO: 236304 - DNA, 16 bp, P. troglodytes
ctgagattgagccatt

SEQ ID NO: 236305 - DNA, 16 bp, P. troglodytes
ctgagattttgctgaa

SEQ ID NO: 236306 - DNA, 16 bp, P. troglodytes
ctgagatttttatttt

SEQ ID NO: 236307 - DNA, 16 bp, P. troglodytes
ctgagcaacatggaga

SEQ ID NO: 236308 - DNA, 16 bp, P. troglodytes
ctgagcaacatggcag

SEQ ID NO: 236309 - DNA, 16 bp, P. troglodytes
ctgagcaatatggcaa

SEQ ID NO: 236310 - DNA, 19 bp, P. troglodytes
ctgagcaccttgtgacccc

SEQ ID NO: 236311 - DNA, 16 bp, P. troglodytes
ctgagcagcagcaaga

SEQ ID NO: 236312 - DNA, 16 bp, P. troglodytes
ctgagcagcatggtga

SEQ ID NO: 236313 - DNA, 16 bp, P. troglodytes
ctgagcagcctctgac

SEQ ID NO: 236314 - DNA, 16 bp, P. troglodytes
ctgagcatgatggcat

SEQ ID NO: 236315 - DNA, 16 bp, P. troglodytes
ctgagcatgctagctc

SEQ ID NO: 236316 - DNA, 16 bp, P. troglodytes
ctgagccaagatcgtg

SEQ ID NO: 236317 - DNA, 16 bp, P. troglodytes
ctgagccactgcgccc

SEQ ID NO: 236318 - DNA, 16 bp, P. troglodytes
ctgagccaggtgcagg

SEQ ID NO: 236319 - DNA, 16 bp, P. troglodytes
ctgagcccaaggaggt

SEQ ID NO: 236320 - DNA, 16 bp, P. troglodytes
ctgagcccagcacagc

SEQ ID NO: 236321 - DNA, 16 bp, P. troglodytes
ctgagcccagcccagc

SEQ ID NO: 236322 - DNA, 16 bp, P. troglodytes
ctgagcccaggaattc

SEQ ID NO: 236323 - DNA, 16 bp, P. troglodytes
ctgagcccaggaggtc

SEQ ID NO: 236324 - DNA, 16 bp, P. troglodytes
ctgagcccaggaggtt

SEQ ID NO: 236325 - DNA, 16 bp, P. troglodytes
ctgagcccagggaggt

SEQ ID NO: 236326 - DNA, 16 bp, P. troglodytes
ctgagcccattgaggc

SEQ ID NO: 236327 - DNA, 16 bp, P. troglodytes
ctgagccccaccccca

SEQ ID NO: 236328 - DNA, 16 bp, P. troglodytes
ctgagcccgggaggcg

SEQ ID NO: 236329 - DNA, 16 bp, P. troglodytes
ctgagcccgggaggtt

SEQ ID NO: 236330 - DNA, 16 bp, P. troglodytes
ctgagccctgccccac

SEQ ID NO: 236331 - DNA, 16 bp, P. troglodytes
ctgagccctgccctgc

SEQ ID NO: 236332 - DNA, 16 bp, P. troglodytes
ctgagccctgcttctg

SEQ ID NO: 236333 - DNA, 16 bp, P. troglodytes
ctgagcctcagattcc

SEQ ID NO: 236334 - DNA, 16 bp, P. troglodytes
ctgagcctcagtatcc

SEQ ID NO: 236335 - DNA, 16 bp, P. troglodytes
ctgagcctcagtctcc

SEQ ID NO: 236336 - DNA, 16 bp, P. troglodytes
ctgagcctcagtttcc

SEQ ID NO: 236337 - DNA, 17 bp, P. troglodytes
ctgagcctcagtttctc

SEQ ID NO: 236338 - DNA, 16 bp, P. troglodytes
ctgagcctcccccacc

SEQ ID NO: 236339 - DNA, 16 bp, P. troglodytes
ctgagcctcggtttcc

SEQ ID NO: 236340 - DNA, 16 bp, P. troglodytes
ctgagcctctgtgtcc

SEQ ID NO: 236341 - DNA, 16 bp, P. troglodytes
ctgagcctgcagtgag

SEQ ID NO: 236342 - DNA, 18 bp, P. troglodytes
ctgagcctgggaggtcaa

SEQ ID NO: 236343 - DNA, 16 bp, P. troglodytes
ctgagccttggtgtcc

SEQ ID NO: 236344 - DNA, 16 bp, P. troglodytes
ctgagctaaaggagga

SEQ ID NO: 236345 - DNA, 16 bp, P. troglodytes
ctgagctcaagcgatc

SEQ ID NO: 236346 - DNA, 16 bp, P. troglodytes
ctgagctcaagctatt

SEQ ID NO: 236347 - DNA, 16 bp, P. troglodytes
ctgagctcaggcaatc

SEQ ID NO: 236348 - DNA, 16 bp, P. troglodytes
ctgagctcatgatcca

SEQ ID NO: 236349 - DNA, 16 bp, P. troglodytes
ctgagctccaggagct

SEQ ID NO: 236350 - DNA, 16 bp, P. troglodytes
ctgagctctgcctctt

SEQ ID NO: 236351 - DNA, 16 bp, P. troglodytes
ctgagctgagccaggc

SEQ ID NO: 236352 - DNA, 16 bp, P. troglodytes
ctgagctgcagtttcc

SEQ ID NO: 236353 - DNA, 16 bp, P. troglodytes
ctgagctgctactctg

SEQ ID NO: 236354 - DNA, 16 bp, P. troglodytes
ctgagctgggaggatt

SEQ ID NO: 236355 - DNA, 16 bp, P. troglodytes
ctgagctgggctgggc

SEQ ID NO: 236356 - DNA, 16 bp, P. troglodytes
ctgagctgtacgttgg

SEQ ID NO: 236357 - DNA, 16 bp, P. troglodytes
ctgagcttcccaaagt

SEQ ID NO: 236358 - DNA, 16 bp, P. troglodytes
ctgagcttgttttcct

SEQ ID NO: 236359 - DNA, 16 bp, P. troglodytes
ctgagcttttgctcac

SEQ ID NO: 236360 - DNA, 16 bp, P. troglodytes
ctgaggaaaaaaatct

SEQ ID NO: 236361 - DNA, 16 bp, P. troglodytes
ctgaggaaaaagagaa

SEQ ID NO: 236362 - DNA, 16 bp, P. troglodytes
ctgaggaacaaggaag

SEQ ID NO: 236363 - DNA, 16 bp, P. troglodytes
ctgaggaacaaggaga

SEQ ID NO: 236364 - DNA, 16 bp, P. troglodytes
ctgaggaagaagaatg

SEQ ID NO: 236365 - DNA, 16 bp, P. troglodytes
ctgaggaagaagaatt

SEQ ID NO: 236366 - DNA, 16 bp, P. troglodytes
ctgaggaagaagataa

SEQ ID NO: 236367 - DNA, 16 bp, P. troglodytes
ctgaggaagaggagaa

SEQ ID NO: 236368 - DNA, 16 bp, P. troglodytes
ctgaggaagaggagga

SEQ ID NO: 236369 - DNA, 16 bp, P. troglodytes
ctgaggaaggaagatt

SEQ ID NO: 236370 - DNA, 16 bp, P. troglodytes
ctgaggaaggaggatg

SEQ ID NO: 236371 - DNA, 16 bp, P. troglodytes
ctgaggaaggaggatt

SEQ ID NO: 236372 - DNA, 16 bp, P. troglodytes
ctgaggaatttcatca

SEQ ID NO: 236373 - DNA, 16 bp, P. troglodytes
ctgaggagagagagag

SEQ ID NO: 236374 - DNA, 16 bp, P. troglodytes
ctgaggagatgggaga

SEQ ID NO: 236375 - DNA, 16 bp, P. troglodytes
ctgaggagatttctaa

SEQ ID NO: 236376 - DNA, 16 bp, P. troglodytes
ctgaggagcaaggaaa

SEQ ID NO: 236377 - DNA, 16 bp, P. troglodytes
ctgaggagcagaaaga

SEQ ID NO: 236378 - DNA, 16 bp, P. troglodytes
ctgaggagcagggaag

SEQ ID NO: 236379 - DNA, 16 bp, P. troglodytes
ctgaggaggaaactga

SEQ ID NO: 236380 - DNA, 16 bp, P. troglodytes
ctgaggaggaccccaa

SEQ ID NO: 236381 - DNA, 16 bp, P. troglodytes
ctgaggaggagaatgg

SEQ ID NO: 236382 - DNA, 16 bp, P. troglodytes
ctgaggaggagggact

SEQ ID NO: 236383 - DNA, 16 bp, P. troglodytes
ctgaggaggctgagga

SEQ ID NO: 236384 - DNA, 16 bp, P. troglodytes
ctgaggatgatgactt

SEQ ID NO: 236385 - DNA, 16 bp, P. troglodytes
ctgaggatggcagagc

SEQ ID NO: 236386 - DNA, 16 bp, P. troglodytes
ctgaggattacaattc

SEQ ID NO: 236387 - DNA, 16 bp, P. troglodytes
ctgaggcaagaaaatg

SEQ ID NO: 236388 - DNA, 16 bp, P. troglodytes
ctgaggcacagaaagt

SEQ ID NO: 236389 - DNA, 16 bp, P. troglodytes
ctgaggcacagagcgg

SEQ ID NO: 236390 - DNA, 16 bp, P. troglodytes
ctgaggcagaaaattg

SEQ ID NO: 236391 - DNA, 16 bp, P. troglodytes
ctgaggcagaaggatc

SEQ ID NO: 236392 - DNA, 16 bp, P. troglodytes
ctgaggcagagagaag

SEQ ID NO: 236393 - DNA, 16 bp, P. troglodytes
ctgaggcagagagttg

SEQ ID NO: 236394 - DNA, 16 bp, P. troglodytes
ctgaggcagatggatt

SEQ ID NO: 236395 - DNA, 16 bp, P. troglodytes
ctgaggcagcagaatc

SEQ ID NO: 236396 - DNA, 16 bp, P. troglodytes
ctgaggcagcagtgag

SEQ ID NO: 236397 - DNA, 16 bp, P. troglodytes
ctgaggcaggagaaga

SEQ ID NO: 236398 - DNA, 16 bp, P. troglodytes
ctgaggcaggagaata

SEQ ID NO: 236399 - DNA, 16 bp, P. troglodytes
ctgaggcaggagcatt

SEQ ID NO: 236400 - DNA, 16 bp, P. troglodytes
ctgaggcaggaggaga

SEQ ID NO: 236401 - DNA, 16 bp, P. troglodytes
ctgaggcaggagggtc

SEQ ID NO: 236402 - DNA, 16 bp, P. troglodytes
ctgaggcaggaggttg

SEQ ID NO: 236403 - DNA, 16 bp, P. troglodytes
ctgaggcaggcagatt

SEQ ID NO: 236404 - DNA, 16 bp, P. troglodytes
ctgaggcaggctgagg

SEQ ID NO: 236405 - DNA, 16 bp, P. troglodytes
ctgaggcagggaaatg

SEQ ID NO: 236406 - DNA, 16 bp, P. troglodytes
ctgaggcaggtgaatt

SEQ ID NO: 236407 - DNA, 19 bp, P. troglodytes
ctgaggcaggtggatcaca

SEQ ID NO: 236408 - DNA, 16 bp, P. troglodytes
ctgaggcaggtggatt

SEQ ID NO: 236409 - DNA, 16 bp, P. troglodytes
ctgaggcagtaggatc

SEQ ID NO: 236410 - DNA, 16 bp, P. troglodytes
ctgaggccacacagcc

SEQ ID NO: 236411 - DNA, 16 bp, P. troglodytes
ctgaggccagcagatc

SEQ ID NO: 236412 - DNA, 16 bp, P. troglodytes
ctgaggccaggagttc

SEQ ID NO: 236413 - DNA, 16 bp, P. troglodytes
ctgaggccaggtgtgg

SEQ ID NO: 236414 - DNA, 16 bp, P. troglodytes
ctgaggcccagagagg

SEQ ID NO: 236415 - DNA, 16 bp, P. troglodytes
ctgaggcccagccagg

SEQ ID NO: 236416 - DNA, 16 bp, P. troglodytes
ctgaggccccaagagg

SEQ ID NO: 236417 - DNA, 16 bp, P. troglodytes
ctgaggccgggcgtgg

SEQ ID NO: 236418 - DNA, 16 bp, P. troglodytes
ctgaggccgggtgtgg

SEQ ID NO: 236419 - DNA, 16 bp, P. troglodytes
ctgaggcctctccaac

SEQ ID NO: 236420 - DNA, 16 bp, P. troglodytes
ctgaggcctctgttgt

SEQ ID NO: 236421 - DNA, 16 bp, P. troglodytes
ctgaggcctcttctct

SEQ ID NO: 236422 - DNA, 16 bp, P. troglodytes
ctgaggcgggaggatc

SEQ ID NO: 236423 - DNA, 25 bp, P. troglodytes
ctgaggcgggcagatcacttgaggt

SEQ ID NO: 236424 - DNA, 17 bp, P. troglodytes
ctgaggcgggcggatcg

SEQ ID NO: 236425 - DNA, 16 bp, P. troglodytes
ctgaggcgggtggatt

SEQ ID NO: 236426 - DNA, 16 bp, P. troglodytes
ctgaggctacaggcac

SEQ ID NO: 236427 - DNA, 16 bp, P. troglodytes
ctgaggctcacagaag

SEQ ID NO: 236428 - DNA, 16 bp, P. troglodytes
ctgaggctcagacagg

SEQ ID NO: 236429 - DNA, 16 bp, P. troglodytes
ctgaggctcagagggg

SEQ ID NO: 236430 - DNA, 16 bp, P. troglodytes
ctgaggctcagagtgg

SEQ ID NO: 236431 - DNA, 16 bp, P. troglodytes
ctgaggctcagggaaa

SEQ ID NO: 236432 - DNA, 16 bp, P. troglodytes
ctgaggctcagggagg

SEQ ID NO: 236433 - DNA, 16 bp, P. troglodytes
ctgaggctccagagga

SEQ ID NO: 236434 - DNA, 16 bp, P. troglodytes
ctgaggctgaaggcct

SEQ ID NO: 236435 - DNA, 16 bp, P. troglodytes
ctgaggctgagacagg

SEQ ID NO: 236436 - DNA, 16 bp, P. troglodytes
ctgaggctgagatgga

SEQ ID NO: 236437 - DNA, 16 bp, P. troglodytes
ctgaggctgaggcagg

SEQ ID NO: 236438 - DNA, 16 bp, P. troglodytes
ctgaggctggaggagg

SEQ ID NO: 236439 - DNA, 16 bp, P. troglodytes
ctgaggctgggcacag

SEQ ID NO: 236440 - DNA, 16 bp, P. troglodytes
ctgaggctggggctgg

SEQ ID NO: 236441 - DNA, 16 bp, P. troglodytes
ctgaggctgggggagg

SEQ ID NO: 236442 - DNA, 16 bp, P. troglodytes
ctgaggctttcagact

SEQ ID NO: 236443 - DNA, 16 bp, P. troglodytes
ctgaggcttttggact

SEQ ID NO: 236444 - DNA, 16 bp, P. troglodytes
ctgagggatttttttt

SEQ ID NO: 236445 - DNA, 16 bp, P. troglodytes
ctgagggcaggagctg

SEQ ID NO: 236446 - DNA, 16 bp, P. troglodytes
ctgagggcagtggctc

SEQ ID NO: 236447 - DNA, 16 bp, P. troglodytes
ctgagggtggaggctg

SEQ ID NO: 236448 - DNA, 16 bp, P. troglodytes
ctgagggttttataaa

SEQ ID NO: 236449 - DNA, 16 bp, P. troglodytes
ctgaggtacagagaag

SEQ ID NO: 236450 - DNA, 16 bp, P. troglodytes
ctgaggtaggaggatt

SEQ ID NO: 236451 - DNA, 16 bp, P. troglodytes
ctgaggtcacacagct

SEQ ID NO: 236452 - DNA, 17 bp, P. troglodytes
ctgaggtcaggagttca

SEQ ID NO: 236453 - DNA, 16 bp, P. troglodytes
ctgaggtcataggtgg

SEQ ID NO: 236454 - DNA, 16 bp, P. troglodytes
ctgaggtccagagagg

SEQ ID NO: 236455 - DNA, 17 bp, P. troglodytes
ctgaggtcgtgccactg

SEQ ID NO: 236456 - DNA, 16 bp, P. troglodytes
ctgaggtgaaaagatc

SEQ ID NO: 236457 - DNA, 16 bp, P. troglodytes
ctgaggtgcaaggatt

SEQ ID NO: 236458 - DNA, 16 bp, P. troglodytes
ctgaggtgcagtggtg

SEQ ID NO: 236459 - DNA, 16 bp, P. troglodytes
ctgaggtggaaagatt

SEQ ID NO: 236460 - DNA, 16 bp, P. troglodytes
ctgaggtgggagcatc

SEQ ID NO: 236461 - DNA, 16 bp, P. troglodytes
ctgaggtgggaggacc

SEQ ID NO: 236462 - DNA, 16 bp, P. troglodytes
ctgaggtggggagatt

SEQ ID NO: 236463 - DNA, 16 bp, P. troglodytes
ctgaggtgggtagatt

SEQ ID NO: 236464 - DNA, 16 bp, P. troglodytes
ctgaggttcagagagg

SEQ ID NO: 236465 - DNA, 16 bp, P. troglodytes
ctgaggttgagaaact

SEQ ID NO: 236466 - DNA, 18 bp, P. troglodytes
ctgaggttgcagtgagct

SEQ ID NO: 236467 - DNA, 16 bp, P. troglodytes
ctgaggtttagagaga

SEQ ID NO: 236468 - DNA, 16 bp, P. troglodytes
ctgaggttttattttg

SEQ ID NO: 236469 - DNA, 16 bp, P. troglodytes
ctgagtaatttataaa

SEQ ID NO: 236470 - DNA, 16 bp, P. troglodytes
ctgagtacagtggctc

SEQ ID NO: 236471 - DNA, 16 bp, P. troglodytes
ctgagtactgtaggca

SEQ ID NO: 236472 - DNA, 16 bp, P. troglodytes
ctgagtagaccaataa

SEQ ID NO: 236473 - DNA, 17 bp, P. troglodytes
ctgagtagctgagatta

SEQ ID NO: 236474 - DNA, 16 bp, P. troglodytes
ctgagtagctgggagc

SEQ ID NO: 236475 - DNA, 16 bp, P. troglodytes
ctgagtagctgggttt

SEQ ID NO: 236476 - DNA, 16 bp, P. troglodytes
ctgagtagtagctggg

SEQ ID NO: 236477 - DNA, 16 bp, P. troglodytes
ctgagtagtattccac

SEQ ID NO: 236478 - DNA, 16 bp, P. troglodytes
ctgagtagtattccat

SEQ ID NO: 236479 - DNA, 16 bp, P. troglodytes
ctgagtagtttataaa

SEQ ID NO: 236480 - DNA, 16 bp, P. troglodytes
ctgagtcaggagaatc

SEQ ID NO: 236481 - DNA, 16 bp, P. troglodytes
ctgagtcaggaggatg

SEQ ID NO: 236482 - DNA, 16 bp, P. troglodytes
ctgagtcaggagttcg

SEQ ID NO: 236483 - DNA, 16 bp, P. troglodytes
ctgagtcctccccagc

SEQ ID NO: 236484 - DNA, 16 bp, P. troglodytes
ctgagtctcgctctgt

SEQ ID NO: 236485 - DNA, 16 bp, P. troglodytes
ctgagtctgcttctgg

SEQ ID NO: 236486 - DNA, 16 bp, P. troglodytes
ctgagtctggggtctt

SEQ ID NO: 236487 - DNA, 16 bp, P. troglodytes
ctgagtgaaaaagcca

SEQ ID NO: 236488 - DNA, 16 bp, P. troglodytes
ctgagtgacaagagca

SEQ ID NO: 236489 - DNA, 16 bp, P. troglodytes
ctgagtgacagactga

SEQ ID NO: 236490 - DNA, 16 bp, P. troglodytes
ctgagtgacagagaaa

SEQ ID NO: 236491 - DNA, 16 bp, P. troglodytes
ctgagtgagagaagcc

SEQ ID NO: 236492 - DNA, 16 bp, P. troglodytes
ctgagtgaggtgggag

SEQ ID NO: 236493 - DNA, 16 bp, P. troglodytes
ctgagtgcagtggcac

SEQ ID NO: 236494 - DNA, 16 bp, P. troglodytes
ctgagtggggaggatg

SEQ ID NO: 236495 - DNA, 16 bp, P. troglodytes
ctgagtgtgtgtgtgt

SEQ ID NO: 236496 - DNA, 16 bp, P. troglodytes
ctgagttatttcactt

SEQ ID NO: 236497 - DNA, 16 bp, P. troglodytes
ctgagttcaaatcctg

SEQ ID NO: 236498 - DNA, 16 bp, P. troglodytes
ctgagttcaactcctg

SEQ ID NO: 236499 - DNA, 16 bp, P. troglodytes
ctgagttcaagcgatc

SEQ ID NO: 236500 - DNA, 16 bp, P. troglodytes
ctgagttccacctcct

SEQ ID NO: 236501 - DNA, 16 bp, P. troglodytes
ctgagttccagtcctg

SEQ ID NO: 236502 - DNA, 16 bp, P. troglodytes
ctgagttccagtttga

SEQ ID NO: 236503 - DNA, 16 bp, P. troglodytes
ctgagtttatgctaat

SEQ ID NO: 236504 - DNA, 16 bp, P. troglodytes
ctgagttttctatttt

SEQ ID NO: 236505 - DNA, 16 bp, P. troglodytes
ctgagtttttaaaaat

SEQ ID NO: 236506 - DNA, 16 bp, P. troglodytes
ctgagtttttaaaatg

SEQ ID NO: 236507 - DNA, 16 bp, P. troglodytes
ctgataaaactgaaaa

SEQ ID NO: 236508 - DNA, 16 bp, P. troglodytes
ctgataaacaacttca

SEQ ID NO: 236509 - DNA, 16 bp, P. troglodytes
ctgataaacagacttt

SEQ ID NO: 236510 - DNA, 16 bp, P. troglodytes
ctgataaacccattgt

SEQ ID NO: 236511 - DNA, 16 bp, P. troglodytes
ctgataaagaacatct

SEQ ID NO: 236512 - DNA, 16 bp, P. troglodytes
ctgataaagacatatc

SEQ ID NO: 236513 - DNA, 16 bp, P. troglodytes
ctgataaatattgatg

SEQ ID NO: 236514 - DNA, 16 bp, P. troglodytes
ctgataaatgacttca

SEQ ID NO: 236515 - DNA, 16 bp, P. troglodytes
ctgataaccaagatgg

SEQ ID NO: 236516 - DNA, 16 bp, P. troglodytes
ctgataagaagcattt

SEQ ID NO: 236517 - DNA, 16 bp, P. troglodytes
ctgataatttaaaagg

SEQ ID NO: 236518 - DNA, 16 bp, P. troglodytes
ctgataatttcaaaat

SEQ ID NO: 236519 - DNA, 16 bp, P. troglodytes
ctgatacaatgtaaat

SEQ ID NO: 236520 - DNA, 16 bp, P. troglodytes
ctgatacatgctacaa

SEQ ID NO: 236521 - DNA, 16 bp, P. troglodytes
ctgataccaaaaccag

SEQ ID NO: 236522 - DNA, 16 bp, P. troglodytes
ctgataccaaagccag

SEQ ID NO: 236523 - DNA, 29 bp, P. troglodytes
ctgataccaaagccgggcagagacacaac

SEQ ID NO: 236524 - DNA, 18 bp, P. troglodytes
ctgataccaaagctgggc

SEQ ID NO: 236525 - DNA, 18 bp, P. troglodytes
ctgataccctttcttcca

SEQ ID NO: 236526 - DNA, 16 bp, P. troglodytes
ctgatagaaatataga

SEQ ID NO: 236527 - DNA, 16 bp, P. troglodytes
ctgatagaattcaact

SEQ ID NO: 236528 - DNA, 16 bp, P. troglodytes
ctgatagaattctaaa

SEQ ID NO: 236529 - DNA, 16 bp, P. troglodytes
ctgatagctttgaaga

SEQ ID NO: 236530 - DNA, 16 bp, P. troglodytes
ctgatagtgagtgagt

SEQ ID NO: 236531 - DNA, 16 bp, P. troglodytes
ctgatatcctttcttc

SEQ ID NO: 236532 - DNA, 16 bp, P. troglodytes
ctgatatccttttttt

SEQ ID NO: 236533 - DNA, 16 bp, P. troglodytes
ctgatattagttattt

SEQ ID NO: 236534 - DNA, 16 bp, P. troglodytes
ctgatattcaacaaag

SEQ ID NO: 236535 - DNA, 16 bp, P. troglodytes
ctgatattttaaaatt

SEQ ID NO: 236536 - DNA, 16 bp, P. troglodytes
ctgatattttgtattt

SEQ ID NO: 236537 - DNA, 16 bp, P. troglodytes
ctgatatttttactgt

SEQ ID NO: 236538 - DNA, 16 bp, P. troglodytes
ctgatcattcctctgg

SEQ ID NO: 236539 - DNA, 17 bp, P. troglodytes
ctgatccaccactggct

SEQ ID NO: 236540 - DNA, 17 bp, P. troglodytes
ctgatccacccacctcg

SEQ ID NO: 236541 - DNA, 16 bp, P. troglodytes
ctgatccacccgcctc

SEQ ID NO: 236542 - DNA, 16 bp, P. troglodytes
ctgatcctcccacctt

SEQ ID NO: 236543 - DNA, 16 bp, P. troglodytes
ctgatcctcctgcctt

SEQ ID NO: 236544 - DNA, 16 bp, P. troglodytes
ctgatcctgggctttt

SEQ ID NO: 236545 - DNA, 21 bp, P. troglodytes
ctgatctcggctcactgcaag

SEQ ID NO: 236546 - DNA, 16 bp, P. troglodytes
ctgatctgacagcagg

SEQ ID NO: 236547 - DNA, 16 bp, P. troglodytes
ctgatctgcccacctc

SEQ ID NO: 236548 - DNA, 16 bp, P. troglodytes
ctgatcttagctcact

SEQ ID NO: 236549 - DNA, 16 bp, P. troglodytes
ctgatcttcaataaag

SEQ ID NO: 236550 - DNA, 16 bp, P. troglodytes
ctgatcttccacaaag

SEQ ID NO: 236551 - DNA, 16 bp, P. troglodytes
ctgatcttgagctcct

SEQ ID NO: 236552 - DNA, 16 bp, P. troglodytes
ctgatcttgattattt

SEQ ID NO: 236553 - DNA, 16 bp, P. troglodytes
ctgatcttgcttttcc

SEQ ID NO: 236554 - DNA, 16 bp, P. troglodytes
ctgatctttgacaacc

SEQ ID NO: 236555 - DNA, 16 bp, P. troglodytes
ctgatgaaaaaaatca

SEQ ID NO: 236556 - DNA, 16 bp, P. troglodytes
ctgatgaaagaaattg

SEQ ID NO: 236557 - DNA, 16 bp, P. troglodytes
ctgatgaaagaggtgg

SEQ ID NO: 236558 - DNA, 16 bp, P. troglodytes
ctgatgaacaccaatg

SEQ ID NO: 236559 - DNA, 16 bp, P. troglodytes
ctgatgaagatgctgt

SEQ ID NO: 236560 - DNA, 16 bp, P. troglodytes
ctgatgactaatgatg

SEQ ID NO: 236561 - DNA, 16 bp, P. troglodytes
ctgatgagaaatctgt

SEQ ID NO: 236562 - DNA, 16 bp, P. troglodytes
ctgatgagaatgtgga

SEQ ID NO: 236563 - DNA, 16 bp, P. troglodytes
ctgatgagggcttcag

SEQ ID NO: 236564 - DNA, 16 bp, P. troglodytes
ctgatgatgaggagga

SEQ ID NO: 236565 - DNA, 16 bp, P. troglodytes
ctgatgatggacattt

SEQ ID NO: 236566 - DNA, 16 bp, P. troglodytes
ctgatgattagtgatg

SEQ ID NO: 236567 - DNA, 16 bp, P. troglodytes
ctgatgcaaaaattct

SEQ ID NO: 236568 - DNA, 16 bp, P. troglodytes
ctgatgcagcagcaga

SEQ ID NO: 236569 - DNA, 16 bp, P. troglodytes
ctgatgcagtggctca

SEQ ID NO: 236570 - DNA, 16 bp, P. troglodytes
ctgatgcatgctaaag

SEQ ID NO: 236571 - DNA, 16 bp, P. troglodytes
ctgatgcccaggctgg

SEQ ID NO: 236572 - DNA, 16 bp, P. troglodytes
ctgatgcggtggctca

SEQ ID NO: 236573 - DNA, 16 bp, P. troglodytes
ctgatgctctctctcc

SEQ ID NO: 236574 - DNA, 16 bp, P. troglodytes
ctgatgctgaggagga

SEQ ID NO: 236575 - DNA, 16 bp, P. troglodytes
ctgatgcttttataag

SEQ ID NO: 236576 - DNA, 16 bp, P. troglodytes
ctgatggaaatgtaca

SEQ ID NO: 236577 - DNA, 16 bp, P. troglodytes
ctgatggagctgaaaa

SEQ ID NO: 236578 - DNA, 16 bp, P. troglodytes
ctgatggagctgcaaa

SEQ ID NO: 236579 - DNA, 16 bp, P. troglodytes
ctgatgggaatgaaaa

SEQ ID NO: 236580 - DNA, 16 bp, P. troglodytes
ctgatgggatttcctt

SEQ ID NO: 236581 - DNA, 16 bp, P. troglodytes
ctgatggggatgtgga

SEQ ID NO: 236582 - DNA, 16 bp, P. troglodytes
ctgatggttgtttgta

SEQ ID NO: 236583 - DNA, 16 bp, P. troglodytes
ctgatggtttttaaag

SEQ ID NO: 236584 - DNA, 16 bp, P. troglodytes
ctgatgtctcttctta

SEQ ID NO: 236585 - DNA, 16 bp, P. troglodytes
ctgattaaaaagtggg

SEQ ID NO: 236586 - DNA, 16 bp, P. troglodytes
ctgattattagagaaa

SEQ ID NO: 236587 - DNA, 16 bp, P. troglodytes
ctgattattgtaaata

SEQ ID NO: 236588 - DNA, 16 bp, P. troglodytes
ctgattcagtgggtct

SEQ ID NO: 236589 - DNA, 16 bp, P. troglodytes
ctgattctgccactta

SEQ ID NO: 236590 - DNA, 16 bp, P. troglodytes
ctgattctttgaaaaa

SEQ ID NO: 236591 - DNA, 16 bp, P. troglodytes
ctgattctttgaaaag

SEQ ID NO: 236592 - DNA, 16 bp, P. troglodytes
ctgattgagaaccact

SEQ ID NO: 236593 - DNA, 16 bp, P. troglodytes
ctgattggtccatttt

SEQ ID NO: 236594 - DNA, 16 bp, P. troglodytes
ctgattgtaaaacatg

SEQ ID NO: 236595 - DNA, 16 bp, P. troglodytes
ctgattgtttcctcat

SEQ ID NO: 236596 - DNA, 16 bp, P. troglodytes
ctgattgttttctttg

SEQ ID NO: 236597 - DNA, 16 bp, P. troglodytes
ctgatttatcaagaca

SEQ ID NO: 236598 - DNA, 16 bp, P. troglodytes
ctgatttcaaaatata

SEQ ID NO: 236599 - DNA, 16 bp, P. troglodytes
ctgatttcaaagccca

SEQ ID NO: 236600 - DNA, 16 bp, P. troglodytes
ctgatttctccctttt

SEQ ID NO: 236601 - DNA, 16 bp, P. troglodytes
ctgatttctttgtatt

SEQ ID NO: 236602 - DNA, 16 bp, P. troglodytes
ctgatttgacaggagg

SEQ ID NO: 236603 - DNA, 16 bp, P. troglodytes
ctgatttgagtaataa

SEQ ID NO: 236604 - DNA, 16 bp, P. troglodytes
ctgatttgctttctgt

SEQ ID NO: 236605 - DNA, 16 bp, P. troglodytes
ctgattttaaaactta

SEQ ID NO: 236606 - DNA, 16 bp, P. troglodytes
ctgattttattaattt

SEQ ID NO: 236607 - DNA, 16 bp, P. troglodytes
ctgattttctgtctgg

SEQ ID NO: 236608 - DNA, 16 bp, P. troglodytes
ctgatttttaaatgtt

SEQ ID NO: 236609 - DNA, 16 bp, P. troglodytes
ctgatttttgtatgtt

SEQ ID NO: 236610 - DNA, 16 bp, P. troglodytes
ctgattttttgaaaaa

SEQ ID NO: 236611 - DNA, 16 bp, P. troglodytes
ctgatttttttaaaga

SEQ ID NO: 236612 - DNA, 16 bp, P. troglodytes
ctgatttttttgagca

SEQ ID NO: 236613 - DNA, 16 bp, P. troglodytes
ctgcaaaaataaaaat

SEQ ID NO: 236614 - DNA, 16 bp, P. troglodytes
ctgcaaaagacatcat

SEQ ID NO: 236615 - DNA, 31 bp, P. troglodytes; identical to SEQ ID NO: 89316

SEQ ID NO: 236616 - DNA, 16 bp, P. troglodytes
ctgcaaacagagacag

SEQ ID NO: 236617 - DNA, 16 bp, P. troglodytes
ctgcaaagaaaaagaa

SEQ ID NO: 236618 - DNA, 16 bp, P. troglodytes
ctgcaaagaaaaataa

SEQ ID NO: 236619 - DNA, 16 bp, P. troglodytes
ctgcaaagagacaaag

SEQ ID NO: 236620 - DNA, 16 bp, P. troglodytes
ctgcaaagctgaaaat

SEQ ID NO: 236621 - DNA, 16 bp, P. troglodytes
ctgcaaattttccaaa

SEQ ID NO: 236622 - DNA, 16 bp, P. troglodytes
ctgcaacaacaacaac

SEQ ID NO: 236623 - DNA, 16 bp, P. troglodytes
ctgcaacatccacctc

SEQ ID NO: 236624 - DNA, 16 bp, P. troglodytes
ctgcaacattttacat

SEQ ID NO: 236625 - DNA, 16 bp, P. troglodytes
ctgcaaccaccacctc

SEQ ID NO: 236626 - DNA, 16 bp, P. troglodytes
ctgcaaccactgcctc

SEQ ID NO: 236627 - DNA, 16 bp, P. troglodytes
ctgcaaccccacctcc

SEQ ID NO: 236628 - DNA, 16 bp, P. troglodytes
ctgcaacccccgcttc

SEQ ID NO: 236629 - DNA, 16 bp, P. troglodytes
ctgcaacccctgcccc

SEQ ID NO: 236630 - DNA, 16 bp, P. troglodytes
ctgcaaccctctgcct

SEQ ID NO: 236631 - DNA, 16 bp, P. troglodytes
ctgcaacctcagcccc

SEQ ID NO: 236632 - DNA, 16 bp, P. troglodytes
ctgcaacctccactac

SEQ ID NO: 236633 - DNA, 18 bp, P. troglodytes
ctgcaacctctgcttcct

SEQ ID NO: 236634 - DNA, 16 bp, P. troglodytes
ctgcaaccttcacctt

SEQ ID NO: 236635 - DNA, 16 bp, P. troglodytes
ctgcaacgtctgcctt

SEQ ID NO: 236636 - DNA, 16 bp, P. troglodytes
ctgcaactcctgggct

SEQ ID NO: 236637 - DNA, 16 bp, P. troglodytes
ctgcaacttgcctttt

SEQ ID NO: 236638 - DNA, 16 bp, P. troglodytes
ctgcaacttggaatgg

SEQ ID NO: 236639 - DNA, 16 bp, P. troglodytes
ctgcaagacagagaag

SEQ ID NO: 236640 - DNA, 16 bp, P. troglodytes
ctgcaagctcccctcc

SEQ ID NO: 236641 - DNA, 16 bp, P. troglodytes
ctgcaagctctgcctg

SEQ ID NO: 236642 - DNA, 16 bp, P. troglodytes
ctgcaagctgagggag

SEQ ID NO: 236643 - DNA, 16 bp, P. troglodytes
ctgcaagcttgaggag

SEQ ID NO: 236644 - DNA, 16 bp, P. troglodytes
ctgcaaggccacaggg

SEQ ID NO: 236645 - DNA, 16 bp, P. troglodytes
ctgcaagggagactgg

SEQ ID NO: 236646 - DNA, 16 bp, P. troglodytes
ctgcaagggagcctgg

SEQ ID NO: 236647 - DNA, 16 bp, P. troglodytes
ctgcaagtctgctgga

SEQ ID NO: 236648 - DNA, 16 bp, P. troglodytes
ctgcaataaacataaa

SEQ ID NO: 236649 - DNA, 16 bp, P. troglodytes
ctgcaataaccaaaac

SEQ ID NO: 236650 - DNA, 16 bp, P. troglodytes
ctgcaatatctctgag

SEQ ID NO: 236651 - DNA, 16 bp, P. troglodytes
ctgcaatcccagtact

SEQ ID NO: 236652 - DNA, 16 bp, P. troglodytes
ctgcaatgaacatttg

SEQ ID NO: 236653 - DNA, 16 bp, P. troglodytes
ctgcaatgagccaaga

SEQ ID NO: 236654 - DNA, 16 bp, P. troglodytes
ctgcaatgatagaaat

SEQ ID NO: 236655 - DNA, 16 bp, P. troglodytes
ctgcaatgcagcctgg

SEQ ID NO: 236656 - DNA, 16 bp, P. troglodytes
ctgcaatggcagagtt

SEQ ID NO: 236657 - DNA, 16 bp, P. troglodytes
ctgcaatgtggatgaa

SEQ ID NO: 236658 - DNA, 16 bp, P. troglodytes
ctgcacaagcaggaag

SEQ ID NO: 236659 - DNA, 16 bp, P. troglodytes
ctgcacacagcacggg

SEQ ID NO: 236660 - DNA, 16 bp, P. troglodytes
ctgcacacagcatggg

SEQ ID NO: 236661 - DNA, 16 bp, P. troglodytes
ctgcacacagccaggc

SEQ ID NO: 236662 - DNA, 16 bp, P. troglodytes
ctgcacacaggagggg

SEQ ID NO: 236663 - DNA, 17 bp, P. troglodytes
ctgcacacctcggcctc

SEQ ID NO: 236664 - DNA, 16 bp, P. troglodytes
ctgcacactggaatca

SEQ ID NO: 236665 - DNA, 16 bp, P. troglodytes
ctgcacagagcagctg

SEQ ID NO: 236666 - DNA, 16 bp, P. troglodytes
ctgcacagagcaggag

SEQ ID NO: 236667 - DNA, 16 bp, P. troglodytes
ctgcacagatcatctc

SEQ ID NO: 236668 - DNA, 17 bp, P. troglodytes
ctgcacagcaaaagaaa

SEQ ID NO: 236669 - DNA, 16 bp, P. troglodytes
ctgcacagcaaagaaa

SEQ ID NO: 236670 - DNA, 16 bp, P. troglodytes
ctgcacagcaaaggaa

SEQ ID NO: 236671 - DNA, 16 bp, P. troglodytes
ctgcacagcacaggaa

SEQ ID NO: 236672 - DNA, 16 bp, P. troglodytes
ctgcacagccagctct

SEQ ID NO: 236673 - DNA, 16 bp, P. troglodytes
ctgcacaggaaaagaa

SEQ ID NO: 236674 - DNA, 16 bp, P. troglodytes
ctgcacaggaacccac

SEQ ID NO: 236675 - DNA, 16 bp, P. troglodytes
ctgcacatccttgcca

SEQ ID NO: 236676 - DNA, 16 bp, P. troglodytes
ctgcacatgaatccca

SEQ ID NO: 236677 - DNA, 16 bp, P. troglodytes
ctgcacatggaacatt

SEQ ID NO: 236678 - DNA, 16 bp, P. troglodytes
ctgcacattgtgcgca

SEQ ID NO: 236679 - DNA, 16 bp, P. troglodytes
ctgcaccaaaaaaaaa

SEQ ID NO: 236680 - DNA, 16 bp, P. troglodytes
ctgcaccacactgctc

SEQ ID NO: 236681 - DNA, 16 bp, P. troglodytes
ctgcaccacagcactc

SEQ ID NO: 236682 - DNA, 25 bp, P. troglodytes
ctgcacccactaactcgtcatctag

SEQ ID NO: 236683 - DNA, 16 bp, P. troglodytes
ctgcacccagccaaac

SEQ ID NO: 236684 - DNA, 16 bp, P. troglodytes
ctgcacccagccaaga

SEQ ID NO: 236685 - DNA, 16 bp, P. troglodytes
ctgcacccagccagcc

SEQ ID NO: 236686 - DNA, 16 bp, P. troglodytes
ctgcacccagccaggt

SEQ ID NO: 236687 - DNA, 16 bp, P. troglodytes
ctgcacccagccctgc

SEQ ID NO: 236688 - DNA, 16 bp, P. troglodytes
ctgcacccagcctcct

SEQ ID NO: 236689 - DNA, 16 bp, P. troglodytes
ctgcacccagcctgac

SEQ ID NO: 236690 - DNA, 16 bp, P. troglodytes
ctgcacccagcctgcc

SEQ ID NO: 236691 - DNA, 16 bp, P. troglodytes
ctgcacccagcctgga

SEQ ID NO: 236692 - DNA, 16 bp, P. troglodytes
ctgcacccagcctggc

SEQ ID NO: 236693 - DNA, 16 bp, P. troglodytes
ctgcacccagcctggg

SEQ ID NO: 236694 - DNA, 16 bp, P. troglodytes
ctgcacccagccttgc

SEQ ID NO: 236695 - DNA, 16 bp, P. troglodytes
ctgcacccagctggca

SEQ ID NO: 236696 - DNA, 16 bp, P. troglodytes
ctgcaccccaaatcaa

SEQ ID NO: 236697 - DNA, 16 bp, P. troglodytes
ctgcaccccagccagg

SEQ ID NO: 236698 - DNA, 16 bp, P. troglodytes
ctgcaccccagcccag

SEQ ID NO: 236699 - DNA, 16 bp, P. troglodytes
ctgcaccccagcctgg

SEQ ID NO: 236700 - DNA, 16 bp, P. troglodytes
ctgcaccccaggctgg

SEQ ID NO: 236701 - DNA, 16 bp, P. troglodytes
ctgcacccccagcctg

SEQ ID NO: 236702 - DNA, 16 bp, P. troglodytes
ctgcaccctcctcctc

SEQ ID NO: 236703 - DNA, 16 bp, P. troglodytes
ctgcaccctgaccacc

SEQ ID NO: 236704 - DNA, 16 bp, P. troglodytes
ctgcacctccacctcc

SEQ ID NO: 236705 - DNA, 16 bp, P. troglodytes
ctgcacctggccaagt

SEQ ID NO: 236706 - DNA, 16 bp, P. troglodytes
ctgcacctggccacca

SEQ ID NO: 236707 - DNA, 16 bp, P. troglodytes
ctgcacctggccacct

SEQ ID NO: 236708 - DNA, 16 bp, P. troglodytes
ctgcacctggcccaga

SEQ ID NO: 236709 - DNA, 16 bp, P. troglodytes
ctgcacctggcccagc

SEQ ID NO: 236710 - DNA, 16 bp, P. troglodytes
ctgcacctggcccagg

SEQ ID NO: 236711 - DNA, 16 bp, P. troglodytes
ctgcacctggcccagt

SEQ ID NO: 236712 - DNA, 16 bp, P. troglodytes
ctgcacctggcccatt

SEQ ID NO: 236713 - DNA, 16 bp, P. troglodytes
ctgcacctggccccct

SEQ ID NO: 236714 - DNA, 16 bp, P. troglodytes
ctgcacctggcccctt

SEQ ID NO: 236715 - DNA, 16 bp, P. troglodytes
ctgcacctggccctga

SEQ ID NO: 236716 - DNA, 16 bp, P. troglodytes
ctgcacctggcccttt

SEQ ID NO: 236717 - DNA, 16 bp, P. troglodytes
ctgcacctggcctggc

SEQ ID NO: 236718 - DNA, 16 bp, P. troglodytes
ctgcacctggcctggg

SEQ ID NO: 236719 - DNA, 16 bp, P. troglodytes
ctgcacctggccttca

SEQ ID NO: 236720 - DNA, 16 bp, P. troglodytes
ctgcacctggccttcc

SEQ ID NO: 236721 - DNA, 16 bp, P. troglodytes
ctgcaccttcttaggg

SEQ ID NO: 236722 - DNA, 16 bp, P. troglodytes
ctgcactatttttttt

SEQ ID NO: 236723 - DNA, 16 bp, P. troglodytes
ctgcactccacccagg

SEQ ID NO: 236724 - DNA, 16 bp, P. troglodytes
ctgcactccagcctat

SEQ ID NO: 236725 - DNA, 18 bp, P. troglodytes
ctgcactccagcctgcgc

SEQ ID NO: 236726 - DNA, 17 bp, P. troglodytes
ctgcactccagtctggt

SEQ ID NO: 236727 - DNA, 16 bp, P. troglodytes
ctgcactccagtgtgg

SEQ ID NO: 236728 - DNA, 16 bp, P. troglodytes
ctgcactcctgggcga

SEQ ID NO: 236729 - DNA, 16 bp, P. troglodytes
ctgcactgatggcctc

SEQ ID NO: 236730 - DNA, 16 bp, P. troglodytes
ctgcactgcagccagg

SEQ ID NO: 236731 - DNA, 16 bp, P. troglodytes
ctgcactgcagcccag

SEQ ID NO: 236732 - DNA, 16 bp, P. troglodytes
ctgcactgcctgtggt

SEQ ID NO: 236733 - DNA, 19 bp, P. troglodytes
ctgcactgtgggagcccct

SEQ ID NO: 236734 - DNA, 16 bp, P. troglodytes
ctgcactgtgggaggc

SEQ ID NO: 236735 - DNA, 16 bp, P. troglodytes
ctgcactgttcttgtg

SEQ ID NO: 236736 - DNA, 16 bp, P. troglodytes
ctgcacttaaaaaaaa

SEQ ID NO: 236737 - DNA, 16 bp, P. troglodytes
ctgcacttctctctcc

SEQ ID NO: 236738 - DNA, 16 bp, P. troglodytes
ctgcagaaagttctac

SEQ ID NO: 236739 - DNA, 16 bp, P. troglodytes
ctgcagaaatacaaaa

SEQ ID NO: 236740 - DNA, 16 bp, P. troglodytes
ctgcagaacagcagat

SEQ ID NO: 236741 - DNA, 16 bp, P. troglodytes
ctgcagaaccaggagc

SEQ ID NO: 236742 - DNA, 16 bp, P. troglodytes
ctgcagaactgtaaga

SEQ ID NO: 236743 - DNA, 16 bp, P. troglodytes
ctgcagaagaaaaatt

SEQ ID NO: 236744 - DNA, 16 bp, P. troglodytes
ctgcagaagacattat

SEQ ID NO: 236745 - DNA, 17 bp, P. troglodytes
ctgcagaagtttctgct

SEQ ID NO: 236746 - DNA, 16 bp, P. troglodytes
ctgcagaccacagctg

SEQ ID NO: 236747 - DNA, 16 bp, P. troglodytes
ctgcagacccaggcat

SEQ ID NO: 236748 - DNA, 16 bp, P. troglodytes
ctgcagaccttcccag

SEQ ID NO: 236749 - DNA, 16 bp, P. troglodytes
ctgcagactccacctc

SEQ ID NO: 236750 - DNA, 16 bp, P. troglodytes
ctgcagagaaaaggaa

SEQ ID NO: 236751 - DNA, 16 bp, P. troglodytes
ctgcagagagagaggg

SEQ ID NO: 236752 - DNA, 16 bp, P. troglodytes
ctgcagagaggagcca

SEQ ID NO: 236753 - DNA, 16 bp, P. troglodytes
ctgcagagccacaggg

SEQ ID NO: 236754 - DNA, 16 bp, P. troglodytes
ctgcagaggacatgaa

SEQ ID NO: 236755 - DNA, 16 bp, P. troglodytes
ctgcagaggaggctgg

SEQ ID NO: 236756 - DNA, 16 bp, P. troglodytes
ctgcagaggcagtggc

SEQ ID NO: 236757 - DNA, 16 bp, P. troglodytes
ctgcagagtcccaagg

SEQ ID NO: 236758 - DNA, 16 bp, P. troglodytes
ctgcagcaagccctgc

SEQ ID NO: 236759 - DNA, 16 bp, P. troglodytes
ctgcagcagagaggcc

SEQ ID NO: 236760 - DNA, 16 bp, P. troglodytes
ctgcagcagagggtcc

SEQ ID NO: 236761 - DNA, 16 bp, P. troglodytes
ctgcagcagctgctgc

SEQ ID NO: 236762 - DNA, 16 bp, P. troglodytes
ctgcagcaggagcatg

SEQ ID NO: 236763 - DNA, 16 bp, P. troglodytes
ctgcagcaggggaggc

SEQ ID NO: 236764 - DNA, 16 bp, P. troglodytes
ctgcagcattgaactc

SEQ ID NO: 236765 - DNA, 16 bp, P. troglodytes
ctgcagccaacttgaa

SEQ ID NO: 236766 - DNA, 16 bp, P. troglodytes
ctgcagccaccacctc

SEQ ID NO: 236767 - DNA, 16 bp, P. troglodytes
ctgcagccacccctcc

SEQ ID NO: 236768 - DNA, 16 bp, P. troglodytes
ctgcagccactgctgc

SEQ ID NO: 236769 - DNA, 16 bp, P. troglodytes
ctgcagcccagagagg

SEQ ID NO: 236770 - DNA, 16 bp, P. troglodytes
ctgcagcccaggagtt

SEQ ID NO: 236771 - DNA, 16 bp, P. troglodytes
ctgcagccccagccaa

SEQ ID NO: 236772 - DNA, 16 bp, P. troglodytes
ctgcagccccgacctc

SEQ ID NO: 236773 - DNA, 16 bp, P. troglodytes
ctgcagcccctgcctc

SEQ ID NO: 236774 - DNA, 19 bp, P. troglodytes
ctgcagcccgagagtttgg

SEQ ID NO: 236775 - DNA, 16 bp, P. troglodytes
ctgcagccctgacctc

SEQ ID NO: 236776 - DNA, 16 bp, P. troglodytes
ctgcagccctgcagcc

SEQ ID NO: 236777 - DNA, 16 bp, P. troglodytes
ctgcagccctgcccag

SEQ ID NO: 236778 - DNA, 16 bp, P. troglodytes
ctgcagccctgccctg

SEQ ID NO: 236779 - DNA, 16 bp, P. troglodytes
ctgcagcctcaaactg

SEQ ID NO: 236780 - DNA, 16 bp, P. troglodytes
ctgcagcctcaacttc

SEQ ID NO: 236781 - DNA, 16 bp, P. troglodytes
ctgcagcctcaccagc

SEQ ID NO: 236782 - DNA, 16 bp, P. troglodytes
ctgcagcctcacctcc

SEQ ID NO: 236783 - DNA, 16 bp, P. troglodytes
ctgcagcctcagccac

SEQ ID NO: 236784 - DNA, 16 bp, P. troglodytes
ctgcagcctcagcctc

SEQ ID NO: 236785 - DNA, 16 bp, P. troglodytes
ctgcagcctccacttc

SEQ ID NO: 236786 - DNA, 16 bp, P. troglodytes
ctgcagcctcccaaag

SEQ ID NO: 236787 - DNA, 16 bp, P. troglodytes
ctgcagcctcccctcc

SEQ ID NO: 236788 - DNA, 16 bp, P. troglodytes
ctgcagcctcccctgg

SEQ ID NO: 236789 - DNA, 16 bp, P. troglodytes
ctgcagcctcccgagt

SEQ ID NO: 236790 - DNA, 16 bp, P. troglodytes
ctgcagcctccctctc

SEQ ID NO: 236791 - DNA, 16 bp, P. troglodytes
ctgcagcctcctcctc

SEQ ID NO: 236792 - DNA, 16 bp, P. troglodytes
ctgcagcctcctcctg

SEQ ID NO: 236793 - DNA, 16 bp, P. troglodytes
ctgcagcctcctgagt

SEQ ID NO: 236794 - DNA, 16 bp, P. troglodytes
ctgcagcctctgccca

SEQ ID NO: 236795 - DNA, 16 bp, P. troglodytes
ctgcagcctctgccct

SEQ ID NO: 236796 - DNA, 16 bp, P. troglodytes
ctgcagcctctgccgc

SEQ ID NO: 236797 - DNA, 16 bp, P. troglodytes
ctgcagcctctgctga

SEQ ID NO: 236798 - DNA, 17 bp, P. troglodytes
ctgcagcctctgctggt

SEQ ID NO: 236799 - DNA, 16 bp, P. troglodytes
ctgcagcctctgtccc

SEQ ID NO: 236800 - DNA, 16 bp, P. troglodytes
ctgcagcctctgtctc

SEQ ID NO: 236801 - DNA, 16 bp, P. troglodytes
ctgcagcctgagagtt

SEQ ID NO: 236802 - DNA, 16 bp, P. troglodytes
ctgcagcctgcagcct

SEQ ID NO: 236803 - DNA, 16 bp, P. troglodytes
ctgcagcctggaaccc

SEQ ID NO: 236804 - DNA, 16 bp, P. troglodytes
ctgcagcctggacaac

SEQ ID NO: 236805 - DNA, 16 bp, P. troglodytes
ctgcagcctggacctg

SEQ ID NO: 236806 - DNA, 16 bp, P. troglodytes
ctgcagcctggcaggg

SEQ ID NO: 236807 - DNA, 16 bp, P. troglodytes
ctgcagcctgggcaag

SEQ ID NO: 236808 - DNA, 16 bp, P. troglodytes
ctgcagcctgggcagc

SEQ ID NO: 236809 - DNA, 16 bp, P. troglodytes
ctgcagccttcacttc

SEQ ID NO: 236810 - DNA, 16 bp, P. troglodytes
ctgcagccttgaactc

SEQ ID NO: 236811 - DNA, 16 bp, P. troglodytes
ctgcagccttgactgc

SEQ ID NO: 236812 - DNA, 16 bp, P. troglodytes
ctgcagctcagagagg

SEQ ID NO: 236813 - DNA, 16 bp, P. troglodytes
ctgcagctccagcctg

SEQ ID NO: 236814 - DNA, 18 bp, P. troglodytes
ctgcagctcccagcgtga

SEQ ID NO: 236815 - DNA, 16 bp, P. troglodytes
ctgcagctgaggggcc

SEQ ID NO: 236816 - DNA, 16 bp, P. troglodytes
ctgcagctgcaggaag

SEQ ID NO: 236817 - DNA, 16 bp, P. troglodytes
ctgcagctgcaggcat

SEQ ID NO: 236818 - DNA, 16 bp, P. troglodytes
ctgcagctgcccaagc

SEQ ID NO: 236819 - DNA, 16 bp, P. troglodytes
ctgcagctgctgctgc

SEQ ID NO: 236820 - DNA, 16 bp, P. troglodytes
ctgcagctgctggccc

SEQ ID NO: 236821 - DNA, 16 bp, P. troglodytes
ctgcagctggaccaga

SEQ ID NO: 236822 - DNA, 16 bp, P. troglodytes
ctgcagctggtgctct

SEQ ID NO: 236823 - DNA, 16 bp, P. troglodytes
ctgcagctgtgcccag

SEQ ID NO: 236824 - DNA, 16 bp, P. troglodytes
ctgcagctgtgcctgg

SEQ ID NO: 236825 - DNA, 16 bp, P. troglodytes
ctgcagcttttcctgg

SEQ ID NO: 236826 - DNA, 16 bp, P. troglodytes
ctgcaggactggaagt

SEQ ID NO: 236827 - DNA, 16 bp, P. troglodytes
ctgcaggacttctcag

SEQ ID NO: 236828 - DNA, 16 bp, P. troglodytes
ctgcaggagttttttt

SEQ ID NO: 236829 - DNA, 16 bp, P. troglodytes
ctgcaggcacgcacca

SEQ ID NO: 236830 - DNA, 16 bp, P. troglodytes
ctgcaggcactcaatg

SEQ ID NO: 236831 - DNA, 16 bp, P. troglodytes
ctgcaggcatcacact

SEQ ID NO: 236832 - DNA, 16 bp, P. troglodytes
ctgcaggccaatatcc

SEQ ID NO: 236833 - DNA, 16 bp, P. troglodytes
ctgcaggccatctgga

SEQ ID NO: 236834 - DNA, 16 bp, P. troglodytes
ctgcaggcctccatct

SEQ ID NO: 236835 - DNA, 16 bp, P. troglodytes
ctgcaggctgtacagg

SEQ ID NO: 236836 - DNA, 16 bp, P. troglodytes
ctgcaggcttcatctt

SEQ ID NO: 236837 - DNA, 16 bp, P. troglodytes
ctgcagggaggcccca

SEQ ID NO: 236838 - DNA, 16 bp, P. troglodytes
ctgcagggcaggccag

SEQ ID NO: 236839 - DNA, 16 bp, P. troglodytes
ctgcagggcaggctgg

SEQ ID NO: 236840 - DNA, 16 bp, P. troglodytes
ctgcagggctgggaag

SEQ ID NO: 236841 - DNA, 16 bp, P. troglodytes
ctgcagggctgggagg

SEQ ID NO: 236842 - DNA, 16 bp, P. troglodytes
ctgcaggggcagagcc

SEQ ID NO: 236843 - DNA, 16 bp, P. troglodytes
ctgcaggggcggggcc

SEQ ID NO: 236844 - DNA, 16 bp, P. troglodytes
ctgcaggggcggggct

SEQ ID NO: 236845 - DNA, 16 bp, P. troglodytes
ctgcaggggctgctgg

SEQ ID NO: 236846 - DNA, 16 bp, P. troglodytes
ctgcaggggtggggct

SEQ ID NO: 236847 - DNA, 16 bp, P. troglodytes
ctgcaggtaactgaaa

SEQ ID NO: 236848 - DNA, 16 bp, P. troglodytes
ctgcaggtccccagcc

SEQ ID NO: 236849 - DNA, 16 bp, P. troglodytes
ctgcaggtctgctgca

SEQ ID NO: 236850 - DNA, 16 bp, P. troglodytes
ctgcaggtggagctgc

SEQ ID NO: 236851 - DNA, 16 bp, P. troglodytes
ctgcaggttgtacagg

SEQ ID NO: 236852 - DNA, 18 bp, P. troglodytes
ctgcagtaagccaagatc

SEQ ID NO: 236853 - DNA, 16 bp, P. troglodytes
ctgcagtcacagctac

SEQ ID NO: 236854 - DNA, 16 bp, P. troglodytes
ctgcagtccagcctag

SEQ ID NO: 236855 - DNA, 16 bp, P. troglodytes
ctgcagtccaggctgg

SEQ ID NO: 236856 - DNA, 16 bp, P. troglodytes
ctgcagtcccagcttc

SEQ ID NO: 236857 - DNA, 16 bp, P. troglodytes
ctgcagtctcatctga

SEQ ID NO: 236858 - DNA, 16 bp, P. troglodytes
ctgcagtctggctctc

SEQ ID NO: 236859 - DNA, 16 bp, P. troglodytes
ctgcagtgaacacatg

SEQ ID NO: 236860 - DNA, 16 bp, P. troglodytes
ctgcagtgaaccatga

SEQ ID NO: 236861 - DNA, 21 bp, P. troglodytes
ctgcagtgagccaagatcgcg

SEQ ID NO: 236862 - DNA, 20 bp, P. troglodytes
ctgcagtgagccaagattgc

SEQ ID NO: 236863 - DNA, 21 bp, P. troglodytes
ctgcagtgagccaagattgtg

SEQ ID NO: 236864 - DNA, 16 bp, P. troglodytes
ctgcagtgagctgatt

SEQ ID NO: 236865 - DNA, 16 bp, P. troglodytes
ctgcagtgagtggaga

SEQ ID NO: 236866 - DNA, 16 bp, P. troglodytes
ctgcagtgcagtggca

SEQ ID NO: 236867 - DNA, 16 bp, P. troglodytes
ctgcagtgcagtggcc

SEQ ID NO: 236868 - DNA, 16 bp, P. troglodytes
ctgcagtgcccaggac

SEQ ID NO: 236869 - DNA, 16 bp, P. troglodytes
ctgcagtgcctggcac

SEQ ID NO: 236870 - DNA, 16 bp, P. troglodytes
ctgcagtggcacgatc

SEQ ID NO: 236871 - DNA, 16 bp, P. troglodytes
ctgcagtgggaggatt

SEQ ID NO: 236872 - DNA, 16 bp, P. troglodytes
ctgcagtgggctctgc

SEQ ID NO: 236873 - DNA, 16 bp, P. troglodytes
ctgcagtggtgtgatc

SEQ ID NO: 236874 - DNA, 16 bp, P. troglodytes
ctgcagtgtgccatga

SEQ ID NO: 236875 - DNA, 16 bp, P. troglodytes
ctgcagtgtgctgtga

SEQ ID NO: 236876 - DNA, 16 bp, P. troglodytes
ctgcagtgtgtgtgtg

SEQ ID NO: 236877 - DNA, 16 bp, P. troglodytes
ctgcagtgtttggttt

SEQ ID NO: 236878 - DNA, 16 bp, P. troglodytes
ctgcagttttgttttt

SEQ ID NO: 236879 - DNA, 16 bp, P. troglodytes
ctgcatagaaaaagaa

SEQ ID NO: 236880 - DNA, 16 bp, P. troglodytes
ctgcatattgctagcc

SEQ ID NO: 236881 - DNA, 16 bp, P. troglodytes
ctgcatcagcctcccg

SEQ ID NO: 236882 - DNA, 16 bp, P. troglodytes
ctgcatccagcctggg

SEQ ID NO: 236883 - DNA, 16 bp, P. troglodytes
ctgcatcccaggctca

SEQ ID NO: 236884 - DNA, 16 bp, P. troglodytes
ctgcatcctcaacttc

SEQ ID NO: 236885 - DNA, 16 bp, P. troglodytes
ctgcatcctccacctc

SEQ ID NO: 236886 - DNA, 16 bp, P. troglodytes
ctgcatcctcctcctc

SEQ ID NO: 236887 - DNA, 16 bp, P. troglodytes
ctgcatccttgccagc

SEQ ID NO: 236888 - DNA, 16 bp, P. troglodytes
ctgcatcgccaagtca

SEQ ID NO: 236889 - DNA, 16 bp, P. troglodytes
ctgcatctcaaaaaag

SEQ ID NO: 236890 - DNA, 16 bp, P. troglodytes
ctgcatctgtgaaatg

SEQ ID NO: 236891 - DNA, 16 bp, P. troglodytes
ctgcatcttctcactt

SEQ ID NO: 236892 - DNA, 16 bp, P. troglodytes
ctgcatgcacagtggc

SEQ ID NO: 236893 - DNA, 16 bp, P. troglodytes
ctgcatgccagcctgg

SEQ ID NO: 236894 - DNA, 16 bp, P. troglodytes
ctgcatggctggggag

SEQ ID NO: 236895 - DNA, 16 bp, P. troglodytes
ctgcatgtgtgtctgt

SEQ ID NO: 236896 - DNA, 16 bp, P. troglodytes
ctgcatgttctcattt

SEQ ID NO: 236897 - DNA, 16 bp, P. troglodytes
ctgcattaatttgctt

SEQ ID NO: 236898 - DNA, 16 bp, P. troglodytes
ctgcattccagccttg

SEQ ID NO: 236899 - DNA, 16 bp, P. troglodytes
ctgcattcctgcctgg

SEQ ID NO: 236900 - DNA, 16 bp, P. troglodytes
ctgcatttaaaagaaa

SEQ ID NO: 236901 - DNA, 16 bp, P. troglodytes
ctgcatttccaacaag

SEQ ID NO: 236902 - DNA, 16 bp, P. troglodytes
ctgcattttacagatg

SEQ ID NO: 236903 - DNA, 16 bp, P. troglodytes
ctgcattttagcaaga

SEQ ID NO: 236904 - DNA, 16 bp, P. troglodytes
ctgcattttcttacta

SEQ ID NO: 236905 - DNA, 16 bp, P. troglodytes
ctgcatttttaaacaa

SEQ ID NO: 236906 - DNA, 16 bp, P. troglodytes
ctgccaaaaacaatct

SEQ ID NO: 236907 - DNA, 16 bp, P. troglodytes
ctgccaaaaccaagat

SEQ ID NO: 236908 - DNA, 16 bp, P. troglodytes
ctgccaaagtgggagc

SEQ ID NO: 236909 - DNA, 16 bp, P. troglodytes
ctgccaaattggataa

SEQ ID NO: 236910 - DNA, 16 bp, P. troglodytes
ctgccaacaccctgat

SEQ ID NO: 236911 - DNA, 16 bp, P. troglodytes
ctgccaagcaaatgga

SEQ ID NO: 236912 - DNA, 16 bp, P. troglodytes
ctgccaagccttgggg

SEQ ID NO: 236913 - DNA, 16 bp, P. troglodytes
ctgccaaggcctgggg

SEQ ID NO: 236914 - DNA, 16 bp, P. troglodytes
ctgccaagtgaggaca

SEQ ID NO: 236915 - DNA, 16 bp, P. troglodytes
ctgccaataccttgat

SEQ ID NO: 236916 - DNA, 16 bp, P. troglodytes
ctgccacaagccaaga

SEQ ID NO: 236917 - DNA, 16 bp, P. troglodytes
ctgccacagccacccc

SEQ ID NO: 236918 - DNA, 16 bp, P. troglodytes
ctgccacagcctccag

SEQ ID NO: 236919 - DNA, 16 bp, P. troglodytes
ctgccacagctgctgt

SEQ ID NO: 236920 - DNA, 16 bp, P. troglodytes
ctgccacagcttccca

SEQ ID NO: 236921 - DNA, 16 bp, P. troglodytes
ctgccacaggcaatgc

SEQ ID NO: 236922 - DNA, 16 bp, P. troglodytes
ctgccaccacacccaa

SEQ ID NO: 236923 - DNA, 18 bp, P. troglodytes
ctgccaccacatccagct

SEQ ID NO: 236924 - DNA, 16 bp, P. troglodytes
ctgccaccaccacctc

SEQ ID NO: 236925 - DNA, 16 bp, P. troglodytes
ctgccaccaccactgc

SEQ ID NO: 236926 - DNA, 16 bp, P. troglodytes
ctgccaccacccccgg

SEQ ID NO: 236927 - DNA, 16 bp, P. troglodytes
ctgccaccacgactgg

SEQ ID NO: 236928 - DNA, 16 bp, P. troglodytes
ctgccaccacgcccgg

SEQ ID NO: 236929 - DNA, 19 bp, P. troglodytes
ctgccaccacgcctggctt

SEQ ID NO: 236930 - DNA, 16 bp, P. troglodytes
ctgccaccagatgcag

SEQ ID NO: 236931 - DNA, 16 bp, P. troglodytes
ctgccaccatgcccga

SEQ ID NO: 236932 - DNA, 16 bp, P. troglodytes
ctgccaccatgcctga

SEQ ID NO: 236933 - DNA, 16 bp, P. troglodytes
ctgccaccatgtaaga

SEQ ID NO: 236934 - DNA, 16 bp, P. troglodytes
ctgccacccagactgg

SEQ ID NO: 236935 - DNA, 16 bp, P. troglodytes
ctgccacccagcctgg

SEQ ID NO: 236936 - DNA, 16 bp, P. troglodytes
ctgccacccaggctga

SEQ ID NO: 236937 - DNA, 16 bp, P. troglodytes
ctgccacctcagcctc

SEQ ID NO: 236938 - DNA, 16 bp, P. troglodytes
ctgccacctcagtctc

SEQ ID NO: 236939 - DNA, 16 bp, P. troglodytes
ctgccacctccacctc

SEQ ID NO: 236940 - DNA, 16 bp, P. troglodytes
ctgccacctccacctt

SEQ ID NO: 236941 - DNA, 17 bp, P. troglodytes
ctgccacctccgcttcc

SEQ ID NO: 236942 - DNA, 16 bp, P. troglodytes
ctgccaccttggcccc

SEQ ID NO: 236943 - DNA, 16 bp, P. troglodytes
ctgccaccttgtgaag

SEQ ID NO: 236944 - DNA, 16 bp, P. troglodytes
ctgccacgcccccatc

SEQ ID NO: 236945 - DNA, 16 bp, P. troglodytes
ctgccactaccaccac

SEQ ID NO: 236946 - DNA, 16 bp, P. troglodytes
ctgccactgcactcca

SEQ ID NO: 236947 - DNA, 16 bp, P. troglodytes
ctgccactgccaccac

SEQ ID NO: 236948 - DNA, 16 bp, P. troglodytes
ctgccactgccacctc

SEQ ID NO: 236949 - DNA, 16 bp, P. troglodytes
ctgccactgccactgc

SEQ ID NO: 236950 - DNA, 16 bp, P. troglodytes
ctgccactgcccagca

SEQ ID NO: 236951 - DNA, 16 bp, P. troglodytes
ctgccactgcctctgc

SEQ ID NO: 236952 - DNA, 16 bp, P. troglodytes
ctgccacttactagct

SEQ ID NO: 236953 - DNA, 16 bp, P. troglodytes
ctgccagactactgcc

SEQ ID NO: 236954 - DNA, 16 bp, P. troglodytes
ctgccagagtgctggg

SEQ ID NO: 236955 - DNA, 16 bp, P. troglodytes
ctgccagcacagcagt

SEQ ID NO: 236956 - DNA, 24 bp, P. troglodytes
ctgccagcacgctgtcacctctca

SEQ ID NO: 236957 - DNA, 16 bp, P. troglodytes
ctgccagcccagcccc

SEQ ID NO: 236958 - DNA, 16 bp, P. troglodytes
ctgccagcctaccctg

SEQ ID NO: 236959 - DNA, 16 bp, P. troglodytes
ctgccagcctccagaa

SEQ ID NO: 236960 - DNA, 16 bp, P. troglodytes
ctgccagctccatgga

SEQ ID NO: 236961 - DNA, 16 bp, P. troglodytes
ctgccagctccgcctc

SEQ ID NO: 236962 - DNA, 16 bp, P. troglodytes
ctgccagctctgcctc

SEQ ID NO: 236963 - DNA, 16 bp, P. troglodytes
ctgccagctgtgtgac

SEQ ID NO: 236964 - DNA, 36 bp, P. troglodytes
ctgccaggcagggaagggccccctgtccagtggaca

SEQ ID NO: 236965 - DNA, 16 bp, P. troglodytes
ctgccaggcggagggg

SEQ ID NO: 236966 - DNA, 16 bp, P. troglodytes
ctgccaggctgttttc

SEQ ID NO: 236967 - DNA, 16 bp, P. troglodytes
ctgccagggggtgggg

SEQ ID NO: 236968 - DNA, 16 bp, P. troglodytes
ctgccaggtagctggg

SEQ ID NO: 236969 - DNA, 16 bp, P. troglodytes
ctgccaggttttggaa

SEQ ID NO: 236970 - DNA, 16 bp, P. troglodytes
ctgccagtctcagcct

SEQ ID NO: 236971 - DNA, 16 bp, P. troglodytes
ctgccagtgctcattt

SEQ ID NO: 236972 - DNA, 16 bp, P. troglodytes
ctgccagttgtataaa

SEQ ID NO: 236973 - DNA, 16 bp, P. troglodytes
ctgccatatgatccag

SEQ ID NO: 236974 - DNA, 16 bp, P. troglodytes
ctgccatatgtgacaa

SEQ ID NO: 236975 - DNA, 16 bp, P. troglodytes
ctgccatcaccaccac

SEQ ID NO: 236976 - DNA, 16 bp, P. troglodytes
ctgccatccaggctgg

SEQ ID NO: 236977 - DNA, 16 bp, P. troglodytes
ctgccatccaggcttt

SEQ ID NO: 236978 - DNA, 16 bp, P. troglodytes
ctgccatggcttctgt

SEQ ID NO: 236979 - DNA, 16 bp, P. troglodytes
ctgccatggttttcag

SEQ ID NO: 236980 - DNA, 16 bp, P. troglodytes
ctgccattttgcctct

SEQ ID NO: 236981 - DNA, 16 bp, P. troglodytes
ctgccattttgtctct

SEQ ID NO: 236982 - DNA, 16 bp, P. troglodytes
ctgccattttttgttt

SEQ ID NO: 236983 - DNA, 16 bp, P. troglodytes
ctgcccaacacggtga

SEQ ID NO: 236984 - DNA, 16 bp, P. troglodytes
ctgcccaacatggaga

SEQ ID NO: 236985 - DNA, 16 bp, P. troglodytes
ctgcccaagaaagcct

SEQ ID NO: 236986 - DNA, 16 bp, P. troglodytes
ctgcccacaccttgat

SEQ ID NO: 236987 - DNA, 16 bp, P. troglodytes
ctgcccacagcccctg

SEQ ID NO: 236988 - DNA, 16 bp, P. troglodytes
ctgcccaccacagcct

SEQ ID NO: 236989 - DNA, 16 bp, P. troglodytes
ctgcccaccagcctgg

SEQ ID NO: 236990 - DNA, 16 bp, P. troglodytes
ctgcccaccctgctgc

SEQ ID NO: 236991 - DNA, 16 bp, P. troglodytes
ctgcccacctcaccct

SEQ ID NO: 236992 - DNA, 16 bp, P. troglodytes
ctgcccacctcagctt

SEQ ID NO: 236993 - DNA, 16 bp, P. troglodytes
ctgcccacctctacct

SEQ ID NO: 236994 - DNA, 16 bp, P. troglodytes
ctgcccacctggcctc

SEQ ID NO: 236995 - DNA, 17 bp, P. troglodytes
ctgcccaccttggcctc

SEQ ID NO: 236996 - DNA, 16 bp, P. troglodytes
ctgcccactgggaaga

SEQ ID NO: 236997 - DNA, 16 bp, P. troglodytes
ctgcccacttcggcct

SEQ ID NO: 236998 - DNA, 16 bp, P. troglodytes
ctgcccagagctcaga

SEQ ID NO: 236999 - DNA, 16 bp, P. troglodytes
ctgcccagcccagccc

SEQ ID NO: 237000 - DNA, 16 bp, P. troglodytes
ctgcccagccctgcct

SEQ ID NO: 237001 - DNA, 17 bp, P. troglodytes
ctgcccagccgccaccc

SEQ ID NO: 237002 - DNA, 16 bp, P. troglodytes
ctgcccagctgccacc

SEQ ID NO: 237003 - DNA, 16 bp, P. troglodytes
ctgcccagctgcccac

SEQ ID NO: 237004 - DNA, 16 bp, P. troglodytes
ctgcccaggccctgcc

SEQ ID NO: 237005 - DNA, 16 bp, P. troglodytes
ctgcccaggccggagt

SEQ ID NO: 237006 - DNA, 16 bp, P. troglodytes
ctgcccaggctggtct

SEQ ID NO: 237007 - DNA, 16 bp, P. troglodytes
ctgcccagggaggagg

SEQ ID NO: 237008 - DNA, 16 bp, P. troglodytes
ctgcccagggcctggg

SEQ ID NO: 237009 - DNA, 16 bp, P. troglodytes
ctgcccagtccaaact

SEQ ID NO: 237010 - DNA, 16 bp, P. troglodytes
ctgcccagtgaagagg

SEQ ID NO: 237011 - DNA, 17 bp, P. troglodytes
ctgcccatctcagcctc

SEQ ID NO: 237012 - DNA, 16 bp, P. troglodytes
ctgcccatggagggag

SEQ ID NO: 237013 - DNA, 16 bp, P. troglodytes
ctgcccatggccaccc

SEQ ID NO: 237014 - DNA, 16 bp, P. troglodytes
ctgccccacacccaga

SEQ ID NO: 237015 - DNA, 19 bp, P. troglodytes
ctgccccaccctaactgat

SEQ ID NO: 237016 - DNA, 16 bp, P. troglodytes
ctgccccacctcagcc

SEQ ID NO: 237017 - DNA, 16 bp, P. troglodytes
ctgccccagacctgga

SEQ ID NO: 237018 - DNA, 16 bp, P. troglodytes
ctgccccagcccagcc

SEQ ID NO: 237019 - DNA, 16 bp, P. troglodytes
ctgccccagcctcccg

SEQ ID NO: 237020 - DNA, 16 bp, P. troglodytes
ctgccccagcctctgg

SEQ ID NO: 237021 - DNA, 16 bp, P. troglodytes
ctgccccatcaagatg

SEQ ID NO: 237022 - DNA, 16 bp, P. troglodytes
ctgcccccaaacacac

SEQ ID NO: 237023 - DNA, 16 bp, P. troglodytes
ctgcccccaccctggg

SEQ ID NO: 237024 - DNA, 16 bp, P. troglodytes
ctgcccccactgtctg

SEQ ID NO: 237025 - DNA, 16 bp, P. troglodytes
ctgcccccagcccagg

SEQ ID NO: 237026 - DNA, 16 bp, P. troglodytes
ctgcccccagcctctg

SEQ ID NO: 237027 - DNA, 16 bp, P. troglodytes
ctgcccccatgaccca

SEQ ID NO: 237028 - DNA, 16 bp, P. troglodytes
ctgcccccatgaccta

SEQ ID NO: 237029 - DNA, 16 bp, P. troglodytes
ctgcccccatgattca

SEQ ID NO: 237030 - DNA, 16 bp, P. troglodytes
ctgccccccagcctgg

SEQ ID NO: 237031 - DNA, 16 bp, P. troglodytes
ctgcccccccaaaaaa

SEQ ID NO: 237032 - DNA, 16 bp, P. troglodytes
ctgccccctgagttca

SEQ ID NO: 237033 - DNA, 16 bp, P. troglodytes
ctgccccctgccccag

SEQ ID NO: 237034 - DNA, 16 bp, P. troglodytes
ctgcccccttggcctc

SEQ ID NO: 237035 - DNA, 16 bp, P. troglodytes
ctgccccgcagggagg

SEQ ID NO: 237036 - DNA, 16 bp, P. troglodytes
ctgccccgtgggaagg

SEQ ID NO: 237037 - DNA, 16 bp, P. troglodytes
ctgcccctacctgatg

SEQ ID NO: 237038 - DNA, 16 bp, P. troglodytes
ctgcccctatgattca

SEQ ID NO: 237039 - DNA, 16 bp, P. troglodytes
ctgcccctcaccttcc

SEQ ID NO: 237040 - DNA, 16 bp, P. troglodytes
ctgcccctcagcctcc

SEQ ID NO: 237041 - DNA, 16 bp, P. troglodytes
ctgcccctgcagcagg

SEQ ID NO: 237042 - DNA, 16 bp, P. troglodytes
ctgcccctgccctgct

SEQ ID NO: 237043 - DNA, 16 bp, P. troglodytes
ctgcccctgcctcctg

SEQ ID NO: 237044 - DNA, 16 bp, P. troglodytes
ctgcccctggcctctc

SEQ ID NO: 237045 - DNA, 16 bp, P. troglodytes
ctgccccttcccccag

SEQ ID NO: 237046 - DNA, 16 bp, P. troglodytes
ctgcccctttcccaga

SEQ ID NO: 237047 - DNA, 16 bp, P. troglodytes
ctgcccctttgagatg

SEQ ID NO: 237048 - DNA, 16 bp, P. troglodytes
ctgcccgcagaggtgg

SEQ ID NO: 237049 - DNA, 16 bp, P. troglodytes
ctgcccgcctcaccct

SEQ ID NO: 237050 - DNA, 16 bp, P. troglodytes
ctgcccgcctgagcct

SEQ ID NO: 237051 - DNA, 16 bp, P. troglodytes
ctgcccggccagccac

SEQ ID NO: 237052 - DNA, 16 bp, P. troglodytes
ctgcccggctgcccag

SEQ ID NO: 237053 - DNA, 16 bp, P. troglodytes
ctgcccgtccctgggc

SEQ ID NO: 237054 - DNA, 16 bp, P. troglodytes
ctgccctagaagaggt

SEQ ID NO: 237055 - DNA, 16 bp, P. troglodytes
ctgccctcaaggagca

SEQ ID NO: 237056 - DNA, 16 bp, P. troglodytes
ctgccctcaaggagct

SEQ ID NO: 237057 - DNA, 16 bp, P. troglodytes
ctgccctcagagagct

SEQ ID NO: 237058 - DNA, 16 bp, P. troglodytes
ctgccctcagccccac

SEQ ID NO: 237059 - DNA, 16 bp, P. troglodytes
ctgccctcaggtgatc

SEQ ID NO: 237060 - DNA, 16 bp, P. troglodytes
ctgccctccatcctgg

SEQ ID NO: 237061 - DNA, 16 bp, P. troglodytes
ctgccctccctgcctg

SEQ ID NO: 237062 - DNA, 16 bp, P. troglodytes
ctgccctcctcaccct

SEQ ID NO: 237063 - DNA, 16 bp, P. troglodytes
ctgccctcctcggcct

SEQ ID NO: 237064 - DNA, 16 bp, P. troglodytes
ctgccctcctgggcct

SEQ ID NO: 237065 - DNA, 16 bp, P. troglodytes
ctgccctcctgggtgc

SEQ ID NO: 237066 - DNA, 16 bp, P. troglodytes
ctgccctctcctccca

SEQ ID NO: 237067 - DNA, 16 bp, P. troglodytes
ctgccctctgggttca

SEQ ID NO: 237068 - DNA, 16 bp, P. troglodytes
ctgccctctggtggcc

SEQ ID NO: 237069 - DNA, 16 bp, P. troglodytes
ctgccctgcagcctgg

SEQ ID NO: 237070 - DNA, 16 bp, P. troglodytes
ctgccctgcccaggcc

SEQ ID NO: 237071 - DNA, 16 bp, P. troglodytes
ctgccctgccctgcct

SEQ ID NO: 237072 - DNA, 16 bp, P. troglodytes
ctgccctgctggattt

SEQ ID NO: 237073 - DNA, 16 bp, P. troglodytes
ctgccctggagatttg

SEQ ID NO: 237074 - DNA, 16 bp, P. troglodytes
ctgccctggccaaact

SEQ ID NO: 237075 - DNA, 16 bp, P. troglodytes
ctgccctgggcctcag

SEQ ID NO: 237076 - DNA, 16 bp, P. troglodytes
ctgccctgtgtccatg

SEQ ID NO: 237077 - DNA, 16 bp, P. troglodytes
ctgcccttcacatttt

SEQ ID NO: 237078 - DNA, 16 bp, P. troglodytes
ctgcccttgaggagct

SEQ ID NO: 237079 - DNA, 16 bp, P. troglodytes
ctgccgcctcagcctc

SEQ ID NO: 237080 - DNA, 16 bp, P. troglodytes
ctgccgcctcctgggt

SEQ ID NO: 237081 - DNA, 16 bp, P. troglodytes
ctgccggctctgaaga

SEQ ID NO: 237082 - DNA, 16 bp, P. troglodytes
ctgcctacctgggcct

SEQ ID NO: 237083 - DNA, 16 bp, P. troglodytes
ctgcctactttggcct

SEQ ID NO: 237084 - DNA, 16 bp, P. troglodytes
ctgcctaggcatccag

SEQ ID NO: 237085 - DNA, 16 bp, P. troglodytes
ctgcctcaaaacaaca

SEQ ID NO: 237086 - DNA, 16 bp, P. troglodytes
ctgcctcaacctccca

SEQ ID NO: 237087 - DNA, 16 bp, P. troglodytes
ctgcctcaacctcccc

SEQ ID NO: 237088 - DNA, 16 bp, P. troglodytes
ctgcctcaagcctccc

SEQ ID NO: 237089 - DNA, 16 bp, P. troglodytes
ctgcctcacagggctg

SEQ ID NO: 237090 - DNA, 16 bp, P. troglodytes
ctgcctcactctcctg

SEQ ID NO: 237091 - DNA, 16 bp, P. troglodytes
ctgcctcagcattcca

SEQ ID NO: 237092 - DNA, 16 bp, P. troglodytes
ctgcctcagcccccag

SEQ ID NO: 237093 - DNA, 16 bp, P. troglodytes
ctgcctcagcccctgc

SEQ ID NO: 237094 - DNA, 16 bp, P. troglodytes
ctgcctcagccctcag

SEQ ID NO: 237095 - DNA, 16 bp, P. troglodytes
ctgcctcagccctccg

SEQ ID NO: 237096 - DNA, 16 bp, P. troglodytes
ctgcctcagcctacca

SEQ ID NO: 237097 - DNA, 16 bp, P. troglodytes
ctgcctcagcctcaga

SEQ ID NO: 237098 - DNA, 16 bp, P. troglodytes
ctgcctcagcctgcca

SEQ ID NO: 237099 - DNA, 16 bp, P. troglodytes
ctgcctcagccttctc

SEQ ID NO: 237100 - DNA, 16 bp, P. troglodytes
ctgcctcagccttctg

SEQ ID NO: 237101 - DNA, 16 bp, P. troglodytes
ctgcctcagctgggac

SEQ ID NO: 237102 - DNA, 16 bp, P. troglodytes
ctgcctcaggccccca

SEQ ID NO: 237103 - DNA, 16 bp, P. troglodytes
ctgcctcaggttccca

SEQ ID NO: 237104 - DNA, 16 bp, P. troglodytes
ctgcctcatcctcccc

SEQ ID NO: 237105 - DNA, 16 bp, P. troglodytes
ctgcctccagccccag

SEQ ID NO: 237106 - DNA, 16 bp, P. troglodytes
ctgcctccaggaagcc

SEQ ID NO: 237107 - DNA, 16 bp, P. troglodytes
ctgcctccaggccttt

SEQ ID NO: 237108 - DNA, 16 bp, P. troglodytes
ctgcctccatttcctt

SEQ ID NO: 237109 - DNA, 16 bp, P. troglodytes
ctgcctcccaaactgc

SEQ ID NO: 237110 - DNA, 16 bp, P. troglodytes
ctgcctcccacctgcc

SEQ ID NO: 237111 - DNA, 16 bp, P. troglodytes
ctgcctcccagcctca

SEQ ID NO: 237112 - DNA, 16 bp, P. troglodytes
ctgcctcccagcctcc

SEQ ID NO: 237113 - DNA, 16 bp, P. troglodytes
ctgcctcccaggctgg

SEQ ID NO: 237114 - DNA, 16 bp, P. troglodytes
ctgcctcccaggttct

SEQ ID NO: 237115 - DNA, 16 bp, P. troglodytes
ctgcctcccaggtttc

SEQ ID NO: 237116 - DNA, 16 bp, P. troglodytes
ctgcctcccatcaccc

SEQ ID NO: 237117 - DNA, 16 bp, P. troglodytes
ctgcctccctcttaca

SEQ ID NO: 237118 - DNA, 16 bp, P. troglodytes
ctgcctccctgcctgc

SEQ ID NO: 237119 - DNA, 16 bp, P. troglodytes
ctgcctccctggcctc

SEQ ID NO: 237120 - DNA, 16 bp, P. troglodytes
ctgcctccctgggttc

SEQ ID NO: 237121 - DNA, 16 bp, P. troglodytes
ctgcctcccttggcct

SEQ ID NO: 237122 - DNA, 16 bp, P. troglodytes
ctgcctccgcctcctg

SEQ ID NO: 237123 - DNA, 16 bp, P. troglodytes
ctgcctcctccagcct

SEQ ID NO: 237124 - DNA, 16 bp, P. troglodytes
ctgcctcctcctccca

SEQ ID NO: 237125 - DNA, 16 bp, P. troglodytes
ctgcctcctgccctgc

SEQ ID NO: 237126 - DNA, 16 bp, P. troglodytes
ctgcctcctggcctca

SEQ ID NO: 237127 - DNA, 16 bp, P. troglodytes
ctgcctcctgggctca

SEQ ID NO: 237128 - DNA, 16 bp, P. troglodytes
ctgcctcctgggctct

SEQ ID NO: 237129 - DNA, 16 bp, P. troglodytes
ctgcctcctgggctga

SEQ ID NO: 237130 - DNA, 16 bp, P. troglodytes
ctgcctcctgggttgg

SEQ ID NO: 237131 - DNA, 16 bp, P. troglodytes
ctgcctcggccaccca

SEQ ID NO: 237132 - DNA, 16 bp, P. troglodytes
ctgcctcggcctcctg

SEQ ID NO: 237133 - DNA, 16 bp, P. troglodytes
ctgcctcggcctctca

SEQ ID NO: 237134 - DNA, 16 bp, P. troglodytes
ctgcctcggcttccca

SEQ ID NO: 237135 - DNA, 17 bp, P. troglodytes
ctgcctcggcttcctaa

SEQ ID NO: 237136 - DNA, 16 bp, P. troglodytes
ctgcctcgggcctccc

SEQ ID NO: 237137 - DNA, 16 bp, P. troglodytes
ctgcctctccagcctc

SEQ ID NO: 237138 - DNA, 16 bp, P. troglodytes
ctgcctctcccagctc

SEQ ID NO: 237139 - DNA, 16 bp, P. troglodytes
ctgcctctctgagcct

SEQ ID NO: 237140 - DNA, 16 bp, P. troglodytes
ctgcctctctggcctc

SEQ ID NO: 237141 - DNA, 16 bp, P. troglodytes
ctgcctctgccaccca

SEQ ID NO: 237142 - DNA, 16 bp, P. troglodytes
ctgcctctgccacccc

SEQ ID NO: 237143 - DNA, 16 bp, P. troglodytes
ctgcctctgccatccc

SEQ ID NO: 237144 - DNA, 16 bp, P. troglodytes
ctgcctctgccccagg

SEQ ID NO: 237145 - DNA, 16 bp, P. troglodytes
ctgcctctgcccctgc

SEQ ID NO: 237146 - DNA, 16 bp, P. troglodytes
ctgcctctgcctctgc

SEQ ID NO: 237147 - DNA, 16 bp, P. troglodytes
ctgcctctgcctgcca

SEQ ID NO: 237148 - DNA, 16 bp, P. troglodytes
ctgcctctgccttcca

SEQ ID NO: 237149 - DNA, 16 bp, P. troglodytes
ctgcctctgccttcct

SEQ ID NO: 237150 - DNA, 16 bp, P. troglodytes
ctgcctctgctgcaca

SEQ ID NO: 237151 - DNA, 16 bp, P. troglodytes
ctgcctctgcttcctg

SEQ ID NO: 237152 - DNA, 16 bp, P. troglodytes
ctgcctctgggctcaa

SEQ ID NO: 237153 - DNA, 16 bp, P. troglodytes
ctgcctctggggctca

SEQ ID NO: 237154 - DNA, 16 bp, P. troglodytes
ctgcctctgggtgggg

SEQ ID NO: 237155 - DNA, 16 bp, P. troglodytes
ctgcctctgtcaccca

SEQ ID NO: 237156 - DNA, 16 bp, P. troglodytes
ctgcctctgtcctcac

SEQ ID NO: 237157 - DNA, 16 bp, P. troglodytes
ctgcctctgtcttcat

SEQ ID NO: 237158 - DNA, 16 bp, P. troglodytes
ctgcctctgtggctct

SEQ ID NO: 237159 - DNA, 16 bp, P. troglodytes
ctgcctctgttgccca

SEQ ID NO: 237160 - DNA, 16 bp, P. troglodytes
ctgcctctgtttcttc

SEQ ID NO: 237161 - DNA, 16 bp, P. troglodytes
ctgcctcttccatcac

SEQ ID NO: 237162 - DNA, 16 bp, P. troglodytes
ctgcctcttcccagcc

SEQ ID NO: 237163 - DNA, 16 bp, P. troglodytes
ctgcctgagagccagg

SEQ ID NO: 237164 - DNA, 16 bp, P. troglodytes
ctgcctgagcccagga

SEQ ID NO: 237165 - DNA, 16 bp, P. troglodytes
ctgcctgagcttcctg

SEQ ID NO: 237166 - DNA, 17 bp, P. troglodytes
ctgcctgattattcacc

SEQ ID NO: 237167 - DNA, 16 bp, P. troglodytes
ctgcctgattctcctg

SEQ ID NO: 237168 - DNA, 16 bp, P. troglodytes
ctgcctgcagagagga

SEQ ID NO: 237169 - DNA, 16 bp, P. troglodytes
ctgcctgcaggccgac

SEQ ID NO: 237170 - DNA, 16 bp, P. troglodytes
ctgcctgccacagcct

SEQ ID NO: 237171 - DNA, 16 bp, P. troglodytes
ctgcctgccacggcct

SEQ ID NO: 237172 - DNA, 17 bp, P. troglodytes
ctgcctgccaggttcac

SEQ ID NO: 237173 - DNA, 16 bp, P. troglodytes
ctgcctgccccactgc

SEQ ID NO: 237174 - DNA, 16 bp, P. troglodytes
ctgcctgccccagcct

SEQ ID NO: 237175 - DNA, 16 bp, P. troglodytes
ctgcctgcccccagcc

SEQ ID NO: 237176 - DNA, 16 bp, P. troglodytes
ctgcctgcccctgcct

SEQ ID NO: 237177 - DNA, 16 bp, P. troglodytes
ctgcctgcccctggga

SEQ ID NO: 237178 - DNA, 16 bp, P. troglodytes
ctgcctgccctcagcc

SEQ ID NO: 237179 - DNA, 16 bp, P. troglodytes
ctgcctgccctgctgc

SEQ ID NO: 237180 - DNA, 16 bp, P. troglodytes
ctgcctgccctggcct

SEQ ID NO: 237181 - DNA, 16 bp, P. troglodytes
ctgcctgcctcagact

SEQ ID NO: 237182 - DNA, 16 bp, P. troglodytes
ctgcctgcctcagccc

SEQ ID NO: 237183 - DNA, 16 bp, P. troglodytes
ctgcctgcctcagtct

SEQ ID NO: 237184 - DNA, 16 bp, P. troglodytes
ctgcctgcctcagttt

SEQ ID NO: 237185 - DNA, 16 bp, P. troglodytes
ctgcctgcctccctgc

SEQ ID NO: 237186 - DNA, 16 bp, P. troglodytes
ctgcctgcctcggccc

SEQ ID NO: 237187 - DNA, 16 bp, P. troglodytes
ctgcctgcctcggtct

SEQ ID NO: 237188 - DNA, 16 bp, P. troglodytes
ctgcctgcctctgcct

SEQ ID NO: 237189 - DNA, 16 bp, P. troglodytes
ctgcctgcctgctctg

SEQ ID NO: 237190 - DNA, 16 bp, P. troglodytes
ctgcctgccttcctgc

SEQ ID NO: 237191 - DNA, 16 bp, P. troglodytes
ctgcctgccttggact

SEQ ID NO: 237192 - DNA, 16 bp, P. troglodytes
ctgcctgccttggcct

SEQ ID NO: 237193 - DNA, 16 bp, P. troglodytes
ctgcctgccttggctc

SEQ ID NO: 237194 - DNA, 16 bp, P. troglodytes
ctgcctgcctttccct

SEQ ID NO: 237195 - DNA, 16 bp, P. troglodytes
ctgcctgcctttgcct

SEQ ID NO: 237196 - DNA, 16 bp, P. troglodytes
ctgcctgctccatgga

SEQ ID NO: 237197 - DNA, 16 bp, P. troglodytes
ctgcctgctcccagcc

SEQ ID NO: 237198 - DNA, 16 bp, P. troglodytes
ctgcctgctcctggcc

SEQ ID NO: 237199 - DNA, 16 bp, P. troglodytes
ctgcctgctccttcct

SEQ ID NO: 237200 - DNA, 16 bp, P. troglodytes
ctgcctgctctgtgga

SEQ ID NO: 237201 - DNA, 16 bp, P. troglodytes
ctgcctgctgcctccc

SEQ ID NO: 237202 - DNA, 16 bp, P. troglodytes
ctgcctgctgcctgct

SEQ ID NO: 237203 - DNA, 16 bp, P. troglodytes
ctgcctgctggctctg

SEQ ID NO: 237204 - DNA, 16 bp, P. troglodytes
ctgcctgctgggctca

SEQ ID NO: 237205 - DNA, 16 bp, P. troglodytes
ctgcctgcttcagctt

SEQ ID NO: 237206 - DNA, 16 bp, P. troglodytes
ctgcctggaatgccct

SEQ ID NO: 237207 - DNA, 16 bp, P. troglodytes
ctgcctggaatgtttt

SEQ ID NO: 237208 - DNA, 16 bp, P. troglodytes
ctgcctggacattcag

SEQ ID NO: 237209 - DNA, 17 bp, P. troglodytes
ctgcctggcagccgagg

SEQ ID NO: 237210 - DNA, 16 bp, P. troglodytes
ctgcctggccgcccag

SEQ ID NO: 237211 - DNA, 16 bp, P. troglodytes
ctgcctggctaatttt

SEQ ID NO: 237212 - DNA, 16 bp, P. troglodytes
ctgcctggctccctcc

SEQ ID NO: 237213 - DNA, 16 bp, P. troglodytes
ctgcctggctgcccca

SEQ ID NO: 237214 - DNA, 16 bp, P. troglodytes
ctgcctgggagccagg

SEQ ID NO: 237215 - DNA, 16 bp, P. troglodytes
ctgcctgggccctgcc

SEQ ID NO: 237216 - DNA, 16 bp, P. troglodytes
ctgcctgggcctccca

SEQ ID NO: 237217 - DNA, 21 bp, P. troglodytes
ctgcctgggctcccactttgg

SEQ ID NO: 237218 - DNA, 16 bp, P. troglodytes
ctgcctgggctggagt

SEQ ID NO: 237219 - DNA, 16 bp, P. troglodytes
ctgcctgggtggcaga

SEQ ID NO: 237220 - DNA, 16 bp, P. troglodytes
ctgcctggtgttgctt

SEQ ID NO: 237221 - DNA, 16 bp, P. troglodytes
ctgcctgtctgtctgc

SEQ ID NO: 237222 - DNA, 16 bp, P. troglodytes
ctgcctgtgccctgcc

SEQ ID NO: 237223 - DNA, 16 bp, P. troglodytes
ctgcctgtgctctaca

SEQ ID NO: 237224 - DNA, 16 bp, P. troglodytes
ctgcctgtgggctggg

SEQ ID NO: 237225 - DNA, 16 bp, P. troglodytes
ctgcctgtgtccatgt

SEQ ID NO: 237226 - DNA, 16 bp, P. troglodytes
ctgcctgttctcactt

SEQ ID NO: 237227 - DNA, 16 bp, P. troglodytes
ctgccttaaaaataaa

SEQ ID NO: 237228 - DNA, 16 bp, P. troglodytes
ctgccttacaaaagct

SEQ ID NO: 237229 - DNA, 16 bp, P. troglodytes
ctgccttagcctacca

SEQ ID NO: 237230 - DNA, 16 bp, P. troglodytes
ctgccttaggctccca

SEQ ID NO: 237231 - DNA, 16 bp, P. troglodytes
ctgccttagtctcctg

SEQ ID NO: 237232 - DNA, 16 bp, P. troglodytes
ctgccttattgcaagg

SEQ ID NO: 237233 - DNA, 16 bp, P. troglodytes
ctgccttcaaggagtt

SEQ ID NO: 237234 - DNA, 16 bp, P. troglodytes
ctgccttcagagagct

SEQ ID NO: 237235 - DNA, 16 bp, P. troglodytes
ctgccttcatggaact

SEQ ID NO: 237236 - DNA, 16 bp, P. troglodytes
ctgccttcatggagct

SEQ ID NO: 237237 - DNA, 16 bp, P. troglodytes
ctgccttccacctcca

SEQ ID NO: 237238 - DNA, 16 bp, P. troglodytes
ctgccttccaggttca

SEQ ID NO: 237239 - DNA, 16 bp, P. troglodytes
ctgccttccccagccc

SEQ ID NO: 237240 - DNA, 16 bp, P. troglodytes
ctgccttctcaagtgg

SEQ ID NO: 237241 - DNA, 16 bp, P. troglodytes
ctgccttctccagcct

SEQ ID NO: 237242 - DNA, 16 bp, P. troglodytes
ctgccttctctggttt

SEQ ID NO: 237243 - DNA, 16 bp, P. troglodytes
ctgccttggcccccaa

SEQ ID NO: 237244 - DNA, 16 bp, P. troglodytes
ctgccttggccccctc

SEQ ID NO: 237245 - DNA, 16 bp, P. troglodytes
ctgccttggcccctca

SEQ ID NO: 237246 - DNA, 16 bp, P. troglodytes
ctgccttggcctcccg

SEQ ID NO: 237247 - DNA, 16 bp, P. troglodytes
ctgccttggcctccga

SEQ ID NO: 237248 - DNA, 16 bp, P. troglodytes
ctgccttgggactctg

SEQ ID NO: 237249 - DNA, 16 bp, P. troglodytes
ctgccttgggcttcca

SEQ ID NO: 237250 - DNA, 16 bp, P. troglodytes
ctgccttggtctccca

SEQ ID NO: 237251 - DNA, 16 bp, P. troglodytes
ctgccttggtcttcca

SEQ ID NO: 237252 - DNA, 16 bp, P. troglodytes
ctgcctttaaaaaaaa

SEQ ID NO: 237253 - DNA, 16 bp, P. troglodytes
ctgcctttaatatttt

SEQ ID NO: 237254 - DNA, 16 bp, P. troglodytes
ctgcctttactaaaaa

SEQ ID NO: 237255 - DNA, 16 bp, P. troglodytes
ctgcctttcaaagtgc

SEQ ID NO: 237256 - DNA, 16 bp, P. troglodytes
ctgcctttcaagagct

SEQ ID NO: 237257 - DNA, 16 bp, P. troglodytes
ctgcctttccctggtg

SEQ ID NO: 237258 - DNA, 16 bp, P. troglodytes
ctgcctttgcaaaaat

SEQ ID NO: 237259 - DNA, 16 bp, P. troglodytes
ctgccttttgtttggc

SEQ ID NO: 237260 - DNA, 16 bp, P. troglodytes
ctgcgacctctgcctc

SEQ ID NO: 237261 - DNA, 17 bp, P. troglodytes
ctgcgagggctgccagc

SEQ ID NO: 237262 - DNA, 16 bp, P. troglodytes
ctgcgatactgggagt

SEQ ID NO: 237263 - DNA, 16 bp, P. troglodytes
ctgcgcaccttggcct

SEQ ID NO: 237264 - DNA, 16 bp, P. troglodytes
ctgcgcagcaaaagaa

SEQ ID NO: 237265 - DNA, 16 bp, P. troglodytes
ctgcgcatcctgcaca

SEQ ID NO: 237266 - DNA, 16 bp, P. troglodytes
ctgcgcccagccatgt

SEQ ID NO: 237267 - DNA, 16 bp, P. troglodytes
ctgcgcccagcccaag

SEQ ID NO: 237268 - DNA, 16 bp, P. troglodytes
ctgcgcccagccccag

SEQ ID NO: 237269 - DNA, 16 bp, P. troglodytes
ctgcgcccagcctccc

SEQ ID NO: 237270 - DNA, 16 bp, P. troglodytes
ctgcgcccagcctctc

SEQ ID NO: 237271 - DNA, 16 bp, P. troglodytes
ctgcgcccagcttttt

SEQ ID NO: 237272 - DNA, 16 bp, P. troglodytes
ctgcgcccggccatga

SEQ ID NO: 237273 - DNA, 16 bp, P. troglodytes
ctgcgcccggcccagc

SEQ ID NO: 237274 - DNA, 16 bp, P. troglodytes
ctgcgcccggccccac

SEQ ID NO: 237275 - DNA, 16 bp, P. troglodytes
ctgcgcctggccaaga

SEQ ID NO: 237276 - DNA, 16 bp, P. troglodytes
ctgcgcctggccacca

SEQ ID NO: 237277 - DNA, 16 bp, P. troglodytes
ctgcgcctggccatct

SEQ ID NO: 237278 - DNA, 16 bp, P. troglodytes
ctgcgcctggcccagc

SEQ ID NO: 237279 - DNA, 16 bp, P. troglodytes
ctgcgcctggccctgg

SEQ ID NO: 237280 - DNA, 16 bp, P. troglodytes
ctgcgcctggcctact

SEQ ID NO: 237281 - DNA, 16 bp, P. troglodytes
ctgcgcctggccttgg

SEQ ID NO: 237282 - DNA, 16 bp, P. troglodytes
ctgcggcaggagaatc

SEQ ID NO: 237283 - DNA, 16 bp, P. troglodytes
ctgcgtcagcctcccc

SEQ ID NO: 237284 - DNA, 16 bp, P. troglodytes
ctgcgtggctggggag

SEQ ID NO: 237285 - DNA, 16 bp, P. troglodytes
ctgctaataaagacac

SEQ ID NO: 237286 - DNA, 16 bp, P. troglodytes
ctgctaatattttatt

SEQ ID NO: 237287 - DNA, 16 bp, P. troglodytes
ctgctaatttaaaaaa

SEQ ID NO: 237288 - DNA, 16 bp, P. troglodytes
ctgctacaaatacaaa

SEQ ID NO: 237289 - DNA, 16 bp, P. troglodytes
ctgctaccatgcccag

SEQ ID NO: 237290 - DNA, 16 bp, P. troglodytes
ctgctacttggaggct

SEQ ID NO: 237291 - DNA, 16 bp, P. troglodytes
ctgctagagtttgctg

SEQ ID NO: 237292 - DNA, 16 bp, P. troglodytes
ctgctagggcaatgtg

SEQ ID NO: 237293 - DNA, 16 bp, P. troglodytes
ctgctaggggacccag

SEQ ID NO: 237294 - DNA, 16 bp, P. troglodytes
ctgctagtttcaaact

SEQ ID NO: 237295 - DNA, 16 bp, P. troglodytes
ctgctataaagatact

SEQ ID NO: 237296 - DNA, 16 bp, P. troglodytes
ctgctatacaccaaca

SEQ ID NO: 237297 - DNA, 16 bp, P. troglodytes
ctgctatagactgaat

SEQ ID NO: 237298 - DNA, 16 bp, P. troglodytes
ctgctatctctgcctc

SEQ ID NO: 237299 - DNA, 16 bp, P. troglodytes
ctgctattattgtatt

SEQ ID NO: 237300 - DNA, 16 bp, P. troglodytes
ctgctatttatttatt

SEQ ID NO: 237301 - DNA, 16 bp, P. troglodytes
ctgctcaaaatccttc

SEQ ID NO: 237302 - DNA, 16 bp, P. troglodytes
ctgctcaaagaaatca

SEQ ID NO: 237303 - DNA, 16 bp, P. troglodytes
ctgctcaaggtcattg

SEQ ID NO: 237304 - DNA, 16 bp, P. troglodytes
ctgctcaccacagcct

SEQ ID NO: 237305 - DNA, 16 bp, P. troglodytes
ctgctcacctgctgtg

SEQ ID NO: 237306 - DNA, 16 bp, P. troglodytes
ctgctcagcaaaataa

SEQ ID NO: 237307 - DNA, 16 bp, P. troglodytes
ctgctcagcaccctgc

SEQ ID NO: 237308 - DNA, 16 bp, P. troglodytes
ctgctcagccccctgg

SEQ ID NO: 237309 - DNA, 16 bp, P. troglodytes
ctgctcagctcctggg

SEQ ID NO: 237310 - DNA, 17 bp, P. troglodytes
ctgctcaggccactgaa

SEQ ID NO: 237311 - DNA, 16 bp, P. troglodytes
ctgctcatcaaaagac

SEQ ID NO: 237312 - DNA, 16 bp, P. troglodytes
ctgctcatgtctgact

SEQ ID NO: 237313 - DNA, 16 bp, P. troglodytes
ctgctcattggcaatg

SEQ ID NO: 237314 - DNA, 16 bp, P. troglodytes
ctgctccacagcgccc

SEQ ID NO: 237315 - DNA, 16 bp, P. troglodytes
ctgctccaccagcttc

SEQ ID NO: 237316 - DNA, 16 bp, P. troglodytes
ctgctccactgactgg

SEQ ID NO: 237317 - DNA, 16 bp, P. troglodytes
ctgctccagaggctga

SEQ ID NO: 237318 - DNA, 16 bp, P. troglodytes
ctgctccagcctcctg

SEQ ID NO: 237319 - DNA, 16 bp, P. troglodytes
ctgctccaggaagcct

SEQ ID NO: 237320 - DNA, 16 bp, P. troglodytes
ctgctcccagccccag

SEQ ID NO: 237321 - DNA, 16 bp, P. troglodytes
ctgctccccaaatgct

SEQ ID NO: 237322 - DNA, 16 bp, P. troglodytes
ctgctccctcagcctc

SEQ ID NO: 237323 - DNA, 16 bp, P. troglodytes
ctgctcctccacctcc

SEQ ID NO: 237324 - DNA, 16 bp, P. troglodytes
ctgctcctcccacctc

SEQ ID NO: 237325 - DNA, 16 bp, P. troglodytes
ctgctcctgaattcct

SEQ ID NO: 237326 - DNA, 16 bp, P. troglodytes
ctgctcctgcagagca

SEQ ID NO: 237327 - DNA, 16 bp, P. troglodytes
ctgctcctgctcctgc

SEQ ID NO: 237328 - DNA, 16 bp, P. troglodytes
ctgctcctgtggcccc

SEQ ID NO: 237329 - DNA, 16 bp, P. troglodytes
ctgctccttctgcctg

SEQ ID NO: 237330 - DNA, 16 bp, P. troglodytes
ctgctccttgtggagc

SEQ ID NO: 237331 - DNA, 16 bp, P. troglodytes
ctgctctcaaggagct

SEQ ID NO: 237332 - DNA, 16 bp, P. troglodytes
ctgctctccagcccag

SEQ ID NO: 237333 - DNA, 16 bp, P. troglodytes
ctgctctccagcttgg

SEQ ID NO: 237334 - DNA, 16 bp, P. troglodytes
ctgctctcctactaca

SEQ ID NO: 237335 - DNA, 16 bp, P. troglodytes
ctgctctcctgcctgg

SEQ ID NO: 237336 - DNA, 16 bp, P. troglodytes
ctgctctctatctcca

SEQ ID NO: 237337 - DNA, 16 bp, P. troglodytes
ctgctctcttcagagc

SEQ ID NO: 237338 - DNA, 16 bp, P. troglodytes
ctgctctgaagaaata

SEQ ID NO: 237339 - DNA, 16 bp, P. troglodytes
ctgctctgatttcagt

SEQ ID NO: 237340 - DNA, 16 bp, P. troglodytes
ctgctctgattttttt

SEQ ID NO: 237341 - DNA, 16 bp, P. troglodytes
ctgctctgcagcctcc

SEQ ID NO: 237342 - DNA, 16 bp, P. troglodytes
ctgctctgccacttgg

SEQ ID NO: 237343 - DNA, 16 bp, P. troglodytes
ctgctctgtgcctcag

SEQ ID NO: 237344 - DNA, 16 bp, P. troglodytes
ctgctctgtggcccag

SEQ ID NO: 237345 - DNA, 16 bp, P. troglodytes
ctgctctgtggcctgg

SEQ ID NO: 237346 - DNA, 16 bp, P. troglodytes
ctgctcttatctttgt

SEQ ID NO: 237347 - DNA, 16 bp, P. troglodytes
ctgctcttgaacccct

SEQ ID NO: 237348 - DNA, 16 bp, P. troglodytes
ctgctgaactgtgagt

SEQ ID NO: 237349 - DNA, 16 bp, P. troglodytes
ctgctgaagctgtgcc

SEQ ID NO: 237350 - DNA, 16 bp, P. troglodytes
ctgctgaagtttgctg

SEQ ID NO: 237351 - DNA, 16 bp, P. troglodytes
ctgctgaatcaaaaga

SEQ ID NO: 237352 - DNA, 16 bp, P. troglodytes
ctgctgaatgaataaa

SEQ ID NO: 237353 - DNA, 18 bp, P. troglodytes
ctgctgaccctctcccca

SEQ ID NO: 237354 - DNA, 19 bp, P. troglodytes
ctgctgaccctctccccac

SEQ ID NO: 237355 - DNA, 16 bp, P. troglodytes
ctgctgacctcaagtg

SEQ ID NO: 237356 - DNA, 17 bp, P. troglodytes
ctgctgacctcgtgatc

SEQ ID NO: 237357 - DNA, 16 bp, P. troglodytes
ctgctgactttgaaga

SEQ ID NO: 237358 - DNA, 16 bp, P. troglodytes
ctgctgagaaatttct

SEQ ID NO: 237359 - DNA, 16 bp, P. troglodytes
ctgctgataaagacgt

SEQ ID NO: 237360 - DNA, 16 bp, P. troglodytes
ctgctgatgctgctgg

SEQ ID NO: 237361 - DNA, 16 bp, P. troglodytes
ctgctgattggctggg

SEQ ID NO: 237362 - DNA, 16 bp, P. troglodytes
ctgctgcacagacaaa

SEQ ID NO: 237363 - DNA, 16 bp, P. troglodytes
ctgctgcagcctctgc

SEQ ID NO: 237364 - DNA, 16 bp, P. troglodytes
ctgctgcagctccagc

SEQ ID NO: 237365 - DNA, 16 bp, P. troglodytes
ctgctgcagctgctgc

SEQ ID NO: 237366 - DNA, 16 bp, P. troglodytes
ctgctgcaggggcaga

SEQ ID NO: 237367 - DNA, 16 bp, P. troglodytes
ctgctgcagtatgctg

SEQ ID NO: 237368 - DNA, 16 bp, P. troglodytes
ctgctgcattccagcc

SEQ ID NO: 237369 - DNA, 16 bp, P. troglodytes
ctgctgccaccaccac

SEQ ID NO: 237370 - DNA, 16 bp, P. troglodytes
ctgctgccacgtgaag

SEQ ID NO: 237371 - DNA, 16 bp, P. troglodytes
ctgctgccatccatgt

SEQ ID NO: 237372 - DNA, 16 bp, P. troglodytes
ctgctgccatgcccag

SEQ ID NO: 237373 - DNA, 16 bp, P. troglodytes
ctgctgccatgtaaga

SEQ ID NO: 237374 - DNA, 16 bp, P. troglodytes
ctgctgccatgtgaga

SEQ ID NO: 237375 - DNA, 16 bp, P. troglodytes
ctgctgcccaggctgc

SEQ ID NO: 237376 - DNA, 16 bp, P. troglodytes
ctgctgcccaggctgg

SEQ ID NO: 237377 - DNA, 16 bp, P. troglodytes
ctgctgcccagggtgg

SEQ ID NO: 237378 - DNA, 16 bp, P. troglodytes
ctgctgcccatgctgg

SEQ ID NO: 237379 - DNA, 16 bp, P. troglodytes
ctgctgccctccagcc

SEQ ID NO: 237380 - DNA, 16 bp, P. troglodytes
ctgctgccctctgctg

SEQ ID NO: 237381 - DNA, 16 bp, P. troglodytes
ctgctgccctggctgg

SEQ ID NO: 237382 - DNA, 16 bp, P. troglodytes
ctgctgcctcagcctc

SEQ ID NO: 237383 - DNA, 16 bp, P. troglodytes
ctgctgcctcagcttc

SEQ ID NO: 237384 - DNA, 16 bp, P. troglodytes
ctgctgcctctgcctc

SEQ ID NO: 237385 - DNA, 16 bp, P. troglodytes
ctgctgcctctgcctg

SEQ ID NO: 237386 - DNA, 16 bp, P. troglodytes
ctgctgcctctgctgc

SEQ ID NO: 237387 - DNA, 16 bp, P. troglodytes
ctgctgcctgcctgcc

SEQ ID NO: 237388 - DNA, 16 bp, P. troglodytes
ctgctgccttcaggag

SEQ ID NO: 237389 - DNA, 16 bp, P. troglodytes
ctgctgccttttgttt

SEQ ID NO: 237390 - DNA, 16 bp, P. troglodytes
ctgctgcggctccagc

SEQ ID NO: 237391 - DNA, 16 bp, P. troglodytes
ctgctgctactgctgc

SEQ ID NO: 237392 - DNA, 16 bp, P. troglodytes
ctgctgctcaaggtca

SEQ ID NO: 237393 - DNA, 16 bp, P. troglodytes
ctgctgctcagaagaa

SEQ ID NO: 237394 - DNA, 16 bp, P. troglodytes
ctgctgctccaggaac

SEQ ID NO: 237395 - DNA, 16 bp, P. troglodytes
ctgctgctctctgcct

SEQ ID NO: 237396 - DNA, 16 bp, P. troglodytes
ctgctgctgataaaga

SEQ ID NO: 237397 - DNA, 16 bp, P. troglodytes
ctgctgctgcaggagg

SEQ ID NO: 237398 - DNA, 16 bp, P. troglodytes
ctgctgctgccaccac

SEQ ID NO: 237399 - DNA, 16 bp, P. troglodytes
ctgctgctgccactgc

SEQ ID NO: 237400 - DNA, 16 bp, P. troglodytes
ctgctgctgcccagca

SEQ ID NO: 237401 - DNA, 16 bp, P. troglodytes
ctgctgctgcctctgc

SEQ ID NO: 237402 - DNA, 16 bp, P. troglodytes
ctgctgctgcctggct

SEQ ID NO: 237403 - DNA, 16 bp, P. troglodytes
ctgctgctgctattgc

SEQ ID NO: 237404 - DNA, 16 bp, P. troglodytes
ctgctgctgctcctcc

SEQ ID NO: 237405 - DNA, 16 bp, P. troglodytes
ctgctgctgctcctgg

SEQ ID NO: 237406 - DNA, 16 bp, P. troglodytes
ctgctgctgctgatgg

SEQ ID NO: 237407 - DNA, 16 bp, P. troglodytes
ctgctgctgctgcagg

SEQ ID NO: 237408 - DNA, 16 bp, P. troglodytes
ctgctgctgctgccac

SEQ ID NO: 237409 - DNA, 16 bp, P. troglodytes
ctgctgctgctgcccc

SEQ ID NO: 237410 - DNA, 16 bp, P. troglodytes
ctgctgctgctgccct

SEQ ID NO: 237411 - DNA, 16 bp, P. troglodytes
ctgctgctgctgctat

SEQ ID NO: 237412 - DNA, 16 bp, P. troglodytes
ctgctgctgctgctca

SEQ ID NO: 237413 - DNA, 16 bp, P. troglodytes
ctgctgctgctgctga

SEQ ID NO: 237414 - DNA, 16 bp, P. troglodytes
ctgctgctgctgctgt

SEQ ID NO: 237415 - DNA, 16 bp, P. troglodytes
ctgctgctgctgcttc

SEQ ID NO: 237416 - DNA, 16 bp, P. troglodytes
ctgctgctgctgtaca

SEQ ID NO: 237417 - DNA, 16 bp, P. troglodytes
ctgctgctgctgtcac

SEQ ID NO: 237418 - DNA, 16 bp, P. troglodytes
ctgctgctgcttctac

SEQ ID NO: 237419 - DNA, 16 bp, P. troglodytes
ctgctgctgcttctcc

SEQ ID NO: 237420 - DNA, 16 bp, P. troglodytes
ctgctgctgcttctgc

SEQ ID NO: 237421 - DNA, 16 bp, P. troglodytes
ctgctgctgctttatc

SEQ ID NO: 237422 - DNA, 16 bp, P. troglodytes
ctgctgctggcacatg

SEQ ID NO: 237423 - DNA, 16 bp, P. troglodytes
ctgctgctgggaatgt

SEQ ID NO: 237424 - DNA, 16 bp, P. troglodytes
ctgctgctgtgctggc

SEQ ID NO: 237425 - DNA, 16 bp, P. troglodytes
ctgctgcttcctcctc

SEQ ID NO: 237426 - DNA, 16 bp, P. troglodytes
ctgctgcttctacttt

SEQ ID NO: 237427 - DNA, 16 bp, P. troglodytes
ctgctgcttctcctcc

SEQ ID NO: 237428 - DNA, 16 bp, P. troglodytes
ctgctgcttctgcttc

SEQ ID NO: 237429 - DNA, 16 bp, P. troglodytes
ctgctgcttgctgcac

SEQ ID NO: 237430 - DNA, 16 bp, P. troglodytes
ctgctgcttttccagg

SEQ ID NO: 237431 - DNA, 16 bp, P. troglodytes
ctgctgctttttaaaa

SEQ ID NO: 237432 - DNA, 16 bp, P. troglodytes
ctgctggaatttgctg

SEQ ID NO: 237433 - DNA, 16 bp, P. troglodytes
ctgctggagaggatgt

SEQ ID NO: 237434 - DNA, 16 bp, P. troglodytes
ctgctggagctccagc

SEQ ID NO: 237435 - DNA, 16 bp, P. troglodytes
ctgctggagtgcagtg

SEQ ID NO: 237436 - DNA, 16 bp, P. troglodytes
ctgctggagtttgctg

SEQ ID NO: 237437 - DNA, 16 bp, P. troglodytes
ctgctggattttggat

SEQ ID NO: 237438 - DNA, 16 bp, P. troglodytes
ctgctggccccaggca

SEQ ID NO: 237439 - DNA, 16 bp, P. troglodytes
ctgctggccctgggca

SEQ ID NO: 237440 - DNA, 16 bp, P. troglodytes
ctgctggcctctgcct

SEQ ID NO: 237441 - DNA, 16 bp, P. troglodytes
ctgctggcctgggtgc

SEQ ID NO: 237442 - DNA, 16 bp, P. troglodytes
ctgctggctctggaga

SEQ ID NO: 237443 - DNA, 16 bp, P. troglodytes
ctgctggctttggaga

SEQ ID NO: 237444 - DNA, 17 bp, P. troglodytes
ctgctgggattacaagc

SEQ ID NO: 237445 - DNA, 16 bp, P. troglodytes
ctgctgggcacagtgg

SEQ ID NO: 237446 - DNA, 16 bp, P. troglodytes
ctgctgggctcaggca

SEQ ID NO: 237447 - DNA, 16 bp, P. troglodytes
ctgctggggaagctga

SEQ ID NO: 237448 - DNA, 16 bp, P. troglodytes
ctgctgggggtgcctc

SEQ ID NO: 237449 - DNA, 16 bp, P. troglodytes
ctgctgggtgccaggc

SEQ ID NO: 237450 - DNA, 16 bp, P. troglodytes
ctgctggtccagggac

SEQ ID NO: 237451 - DNA, 16 bp, P. troglodytes
ctgctggtgtgtgtgt

SEQ ID NO: 237452 - DNA, 16 bp, P. troglodytes
ctgctggttttgaaga

SEQ ID NO: 237453 - DNA, 16 bp, P. troglodytes
ctgctgtaaagatacc

SEQ ID NO: 237454 - DNA, 16 bp, P. troglodytes
ctgctgtaacaaaata

SEQ ID NO: 237455 - DNA, 16 bp, P. troglodytes
ctgctgtaacaaatca

SEQ ID NO: 237456 - DNA, 16 bp, P. troglodytes
ctgctgtatcctcagt

SEQ ID NO: 237457 - DNA, 16 bp, P. troglodytes
ctgctgtatctccagc

SEQ ID NO: 237458 - DNA, 16 bp, P. troglodytes
ctgctgtcactgtctt

SEQ ID NO: 237459 - DNA, 16 bp, P. troglodytes
ctgctgtcttcagagc

SEQ ID NO: 237460 - DNA, 16 bp, P. troglodytes
ctgctgtgaacattca

SEQ ID NO: 237461 - DNA, 16 bp, P. troglodytes
ctgctgtgcccagcct

SEQ ID NO: 237462 - DNA, 16 bp, P. troglodytes
ctgctgtgcggcctgg

SEQ ID NO: 237463 - DNA, 16 bp, P. troglodytes
ctgctgtgctccagcc

SEQ ID NO: 237464 - DNA, 16 bp, P. troglodytes
ctgctgtggctccagc

SEQ ID NO: 237465 - DNA, 16 bp, P. troglodytes
ctgctgtggctgctgt

SEQ ID NO: 237466 - DNA, 16 bp, P. troglodytes
ctgctgtggcttcagc

SEQ ID NO: 237467 - DNA, 16 bp, P. troglodytes
ctgctgtgtctttccc

SEQ ID NO: 237468 - DNA, 16 bp, P. troglodytes
ctgctgtgtgacctgg

SEQ ID NO: 237469 - DNA, 16 bp, P. troglodytes
ctgctgtgtgcagcct

SEQ ID NO: 237470 - DNA, 16 bp, P. troglodytes
ctgctgtgtgccagcc

SEQ ID NO: 237471 - DNA, 16 bp, P. troglodytes
ctgctgtgtgctgggc

SEQ ID NO: 237472 - DNA, 16 bp, P. troglodytes
ctgctgttaaaaaaaa

SEQ ID NO: 237473 - DNA, 16 bp, P. troglodytes
ctgctgttacttttct

SEQ ID NO: 237474 - DNA, 16 bp, P. troglodytes
ctgctgttccttctgc

SEQ ID NO: 237475 - DNA, 16 bp, P. troglodytes
ctgctgttgaagcttt

SEQ ID NO: 237476 - DNA, 16 bp, P. troglodytes
ctgctgttgccatctt

SEQ ID NO: 237477 - DNA, 16 bp, P. troglodytes
ctgctgttgctgtctt

SEQ ID NO: 237478 - DNA, 16 bp, P. troglodytes
ctgcttaaaacccttt

SEQ ID NO: 237479 - DNA, 16 bp, P. troglodytes
ctgcttaaagaaatca

SEQ ID NO: 237480 - DNA, 16 bp, P. troglodytes
ctgcttagcacccaat

SEQ ID NO: 237481 - DNA, 16 bp, P. troglodytes
ctgcttaggcctccca

SEQ ID NO: 237482 - DNA, 16 bp, P. troglodytes
ctgcttcaccttccac

SEQ ID NO: 237483 - DNA, 16 bp, P. troglodytes
ctgcttcagcctcctg

SEQ ID NO: 237484 - DNA, 16 bp, P. troglodytes
ctgcttcagcctctgg

SEQ ID NO: 237485 - DNA, 16 bp, P. troglodytes
ctgcttcagcttcccg

SEQ ID NO: 237486 - DNA, 16 bp, P. troglodytes
ctgcttcattttcttt

SEQ ID NO: 237487 - DNA, 16 bp, P. troglodytes
ctgcttcatttttctc

SEQ ID NO: 237488 - DNA, 16 bp, P. troglodytes
ctgcttccaagctcac

SEQ ID NO: 237489 - DNA, 16 bp, P. troglodytes
ctgcttccacattttt

SEQ ID NO: 237490 - DNA, 16 bp, P. troglodytes
ctgcttccattttaaa

SEQ ID NO: 237491 - DNA, 16 bp, P. troglodytes
ctgcttcccaagttca

SEQ ID NO: 237492 - DNA, 16 bp, P. troglodytes
ctgcttccccttcacc

SEQ ID NO: 237493 - DNA, 16 bp, P. troglodytes
ctgcttcccttgtaaa

SEQ ID NO: 237494 - DNA, 16 bp, P. troglodytes
ctgcttcctcttcacc

SEQ ID NO: 237495 - DNA, 16 bp, P. troglodytes
ctgcttcctggctcct

SEQ ID NO: 237496 - DNA, 16 bp, P. troglodytes
ctgcttcctggtttgc

SEQ ID NO: 237497 - DNA, 16 bp, P. troglodytes
ctgcttctcccctctg

SEQ ID NO: 237498 - DNA, 16 bp, P. troglodytes
ctgcttctcctcctgc

SEQ ID NO: 237499 - DNA, 16 bp, P. troglodytes
ctgcttctctctgcct

SEQ ID NO: 237500 - DNA, 16 bp, P. troglodytes
ctgcttctgtgagttt

SEQ ID NO: 237501 - DNA, 16 bp, P. troglodytes
ctgcttctgtggcttt

SEQ ID NO: 237502 - DNA, 16 bp, P. troglodytes
ctgcttctttgacttt

SEQ ID NO: 237503 - DNA, 16 bp, P. troglodytes
ctgcttgagttcagga

SEQ ID NO: 237504 - DNA, 16 bp, P. troglodytes
ctgcttgctttctcag

SEQ ID NO: 237505 - DNA, 16 bp, P. troglodytes
ctgcttggaatgccct

SEQ ID NO: 237506 - DNA, 16 bp, P. troglodytes
ctgcttgggtggctga

SEQ ID NO: 237507 - DNA, 16 bp, P. troglodytes
ctgcttgggttcaaat

SEQ ID NO: 237508 - DNA, 16 bp, P. troglodytes
ctgcttggtgttctac

SEQ ID NO: 237509 - DNA, 16 bp, P. troglodytes
ctgcttgtctgttgtt

SEQ ID NO: 237510 - DNA, 16 bp, P. troglodytes
ctgctttaaaaacaaa

SEQ ID NO: 237511 - DNA, 16 bp, P. troglodytes
ctgctttaaaaatttt

SEQ ID NO: 237512 - DNA, 16 bp, P. troglodytes
ctgctttaaagatttt

SEQ ID NO: 237513 - DNA, 16 bp, P. troglodytes
ctgctttacttaaagt

SEQ ID NO: 237514 - DNA, 16 bp, P. troglodytes
ctgctttatcaactaa

SEQ ID NO: 237515 - DNA, 16 bp, P. troglodytes
ctgctttattttcctc

SEQ ID NO: 237516 - DNA, 16 bp, P. troglodytes
ctgctttcaaaattct

SEQ ID NO: 237517 - DNA, 16 bp, P. troglodytes
ctgctttcagttcttt

SEQ ID NO: 237518 - DNA, 16 bp, P. troglodytes
ctgctttcatttttat

SEQ ID NO: 237519 - DNA, 16 bp, P. troglodytes
ctgctttcatttttct

SEQ ID NO: 237520 - DNA, 16 bp, P. troglodytes
ctgctttccactgtgg

SEQ ID NO: 237521 - DNA, 16 bp, P. troglodytes
ctgctttcccttctgc

SEQ ID NO: 237522 - DNA, 16 bp, P. troglodytes
ctgctttcctgctaca

SEQ ID NO: 237523 - DNA, 16 bp, P. troglodytes
ctgctttccttctgga

SEQ ID NO: 237524 - DNA, 16 bp, P. troglodytes
ctgctttctgtctctg

SEQ ID NO: 237525 - DNA, 16 bp, P. troglodytes
ctgctttggcctctca

SEQ ID NO: 237526 - DNA, 16 bp, P. troglodytes
ctgctttgtcacccag

SEQ ID NO: 237527 - DNA, 16 bp, P. troglodytes
ctgctttgtgaagaag

SEQ ID NO: 237528 - DNA, 16 bp, P. troglodytes
ctgctttgtgcagcct

SEQ ID NO: 237529 - DNA, 16 bp, P. troglodytes
ctgctttgttcactgc

SEQ ID NO: 237530 - DNA, 16 bp, P. troglodytes
ctgcttttaagctaat

SEQ ID NO: 237531 - DNA, 16 bp, P. troglodytes
ctgcttttaagttttt

SEQ ID NO: 237532 - DNA, 16 bp, P. troglodytes
ctgcttttataaataa

SEQ ID NO: 237533 - DNA, 16 bp, P. troglodytes
ctgcttttattattat

SEQ ID NO: 237534 - DNA, 16 bp, P. troglodytes
ctgcttttctcaagca

SEQ ID NO: 237535 - DNA, 16 bp, P. troglodytes
ctggaaaaaaaaatta

SEQ ID NO: 237536 - DNA, 16 bp, P. troglodytes
ctggaaaaagcaagaa

SEQ ID NO: 237537 - DNA, 16 bp, P. troglodytes
ctggaaaagatccctt

SEQ ID NO: 237538 - DNA, 16 bp, P. troglodytes
ctggaaaagcctcagg

SEQ ID NO: 237539 - DNA, 16 bp, P. troglodytes
ctggaaaagctgcagg

SEQ ID NO: 237540 - DNA, 16 bp, P. troglodytes
ctggaaaaggaaaaac

SEQ ID NO: 237541 - DNA, 16 bp, P. troglodytes
ctggaaaaggcaaact

SEQ ID NO: 237542 - DNA, 16 bp, P. troglodytes
ctggaaaatcaggaca

SEQ ID NO: 237543 - DNA, 16 bp, P. troglodytes
ctggaaaatgtagtct

SEQ ID NO: 237544 - DNA, 16 bp, P. troglodytes
ctggaaacaacacaaa

SEQ ID NO: 237545 - DNA, 16 bp, P. troglodytes
ctggaaacagactcag

SEQ ID NO: 237546 - DNA, 16 bp, P. troglodytes
ctggaaacctctgtgg

SEQ ID NO: 237547 - DNA, 16 bp, P. troglodytes
ctggaaagaaaaagaa

SEQ ID NO: 237548 - DNA, 16 bp, P. troglodytes
ctggaaagaaaatgaa

SEQ ID NO: 237549 - DNA, 16 bp, P. troglodytes
ctggaaagcagtggca

SEQ ID NO: 237550 - DNA, 16 bp, P. troglodytes
ctggaaaggcgggaca

SEQ ID NO: 237551 - DNA, 16 bp, P. troglodytes
ctggaaagggaaggag

SEQ ID NO: 237552 - DNA, 16 bp, P. troglodytes
ctggaaagtggaggtt

SEQ ID NO: 237553 - DNA, 16 bp, P. troglodytes
ctggaaataccctcac

SEQ ID NO: 237554 - DNA, 16 bp, P. troglodytes
ctggaaatatttttaa

SEQ ID NO: 237555 - DNA, 16 bp, P. troglodytes
ctggaaatgaaaaaaa

SEQ ID NO: 237556 - DNA, 16 bp, P. troglodytes
ctggaaatgattttat

SEQ ID NO: 237557 - DNA, 16 bp, P. troglodytes
ctggaacaagaaaagg

SEQ ID NO: 237558 - DNA, 16 bp, P. troglodytes
ctggaacagaaaagag

SEQ ID NO: 237559 - DNA, 16 bp, P. troglodytes
ctggaaccaatcctcc

SEQ ID NO: 237560 - DNA, 16 bp, P. troglodytes
ctggaacctccacctc

SEQ ID NO: 237561 - DNA, 16 bp, P. troglodytes
ctggaacctctgcctc

SEQ ID NO: 237562 - DNA, 16 bp, P. troglodytes
ctggaactacaagcat

SEQ ID NO: 237563 - DNA, 16 bp, P. troglodytes
ctggaactacaggaat

SEQ ID NO: 237564 - DNA, 16 bp, P. troglodytes
ctggaactacaggggt

SEQ ID NO: 237565 - DNA, 17 bp, P. troglodytes
ctggaactacaggtgcc

SEQ ID NO: 237566 - DNA, 16 bp, P. troglodytes
ctggaactcaggaggc

SEQ ID NO: 237567 - DNA, 16 bp, P. troglodytes
ctggaactcctggact

SEQ ID NO: 237568 - DNA, 16 bp, P. troglodytes
ctggaactcctgggct

SEQ ID NO: 237569 - DNA, 16 bp, P. troglodytes
ctggaacttctgggct

SEQ ID NO: 237570 - DNA, 16 bp, P. troglodytes
ctggaagaaaggatat

SEQ ID NO: 237571 - DNA, 16 bp, P. troglodytes
ctggaagaagaaaaca

SEQ ID NO: 237572 - DNA, 16 bp, P. troglodytes
ctggaagaagaaagaa

SEQ ID NO: 237573 - DNA, 16 bp, P. troglodytes
ctggaagaagatattt

SEQ ID NO: 237574 - DNA, 16 bp, P. troglodytes
ctggaagacagagcaa

SEQ ID NO: 237575 - DNA, 16 bp, P. troglodytes
ctggaagaggaaagaa

SEQ ID NO: 237576 - DNA, 16 bp, P. troglodytes
ctggaagaggcaaaga

SEQ ID NO: 237577 - DNA, 16 bp, P. troglodytes
ctggaagaggcaggaa

SEQ ID NO: 237578 - DNA, 16 bp, P. troglodytes
ctggaagagtctacaa

SEQ ID NO: 237579 - DNA, 16 bp, P. troglodytes
ctggaagcagagcctg

SEQ ID NO: 237580 - DNA, 16 bp, P. troglodytes
ctggaagcagaggttg

SEQ ID NO: 237581 - DNA, 16 bp, P. troglodytes
ctggaagcagatgctg

SEQ ID NO: 237582 - DNA, 16 bp, P. troglodytes
ctggaagcattcccat

SEQ ID NO: 237583 - DNA, 22 bp, P. troglodytes
ctggaagcattccctttgaaaa

SEQ ID NO: 237584 - DNA, 16 bp, P. troglodytes
ctggaagccataattc

SEQ ID NO: 237585 - DNA, 16 bp, P. troglodytes
ctggaagctatcatcc

SEQ ID NO: 237586 - DNA, 16 bp, P. troglodytes
ctggaagctccacctc

SEQ ID NO: 237587 - DNA, 16 bp, P. troglodytes
ctggaagctgagcaga

SEQ ID NO: 237588 - DNA, 16 bp, P. troglodytes
ctggaagctgggaagt

SEQ ID NO: 237589 - DNA, 16 bp, P. troglodytes
ctggaagcttcatcct

SEQ ID NO: 237590 - DNA, 16 bp, P. troglodytes
ctggaagcttcttccc

SEQ ID NO: 237591 - DNA, 16 bp, P. troglodytes
ctggaagctttgtccc

SEQ ID NO: 237592 - DNA, 16 bp, P. troglodytes
ctggaaggaaaagaaa

SEQ ID NO: 237593 - DNA, 16 bp, P. troglodytes
ctggaaggcagagctt

SEQ ID NO: 237594 - DNA, 16 bp, P. troglodytes
ctggaaggcagaggtt

SEQ ID NO: 237595 - DNA, 16 bp, P. troglodytes
ctggaaggcagtggcg

SEQ ID NO: 237596 - DNA, 16 bp, P. troglodytes
ctggaaggtggagctt

SEQ ID NO: 237597 - DNA, 16 bp, P. troglodytes
ctggaatagcaggcat

SEQ ID NO: 237598 - DNA, 16 bp, P. troglodytes
ctggaatcccagcacc

SEQ ID NO: 237599 - DNA, 16 bp, P. troglodytes
ctggaatcccagccct

SEQ ID NO: 237600 - DNA, 16 bp, P. troglodytes
ctggaatcctggcagc

SEQ ID NO: 237601 - DNA, 16 bp, P. troglodytes
ctggaatgaagtggtg

SEQ ID NO: 237602 - DNA, 16 bp, P. troglodytes
ctggaatgcaaggata

SEQ ID NO: 237603 - DNA, 16 bp, P. troglodytes
ctggaatgcagtgatg

SEQ ID NO: 237604 - DNA, 16 bp, P. troglodytes
ctggaatgtagtggca

SEQ ID NO: 237605 - DNA, 16 bp, P. troglodytes
ctggaattacagacac

SEQ ID NO: 237606 - DNA, 18 bp, P. troglodytes
ctggaattacaggcatgc

SEQ ID NO: 237607 - DNA, 18 bp, P. troglodytes
ctggaattacaggcgccc

SEQ ID NO: 237608 - DNA, 16 bp, P. troglodytes
ctggaattacaggtgt

SEQ ID NO: 237609 - DNA, 16 bp, P. troglodytes
ctggaattacagtcac

SEQ ID NO: 237610 - DNA, 16 bp, P. troglodytes
ctggaattagaggcat

SEQ ID NO: 237611 - DNA, 16 bp, P. troglodytes
ctggaattataggcat

SEQ ID NO: 237612 - DNA, 16 bp, P. troglodytes
ctggaatttcccttga

SEQ ID NO: 237613 - DNA, 16 bp, P. troglodytes
ctggaatttgaaccca

SEQ ID NO: 237614 - DNA, 16 bp, P. troglodytes
ctggaatttttcattt

SEQ ID NO: 237615 - DNA, 16 bp, P. troglodytes
ctggacaaaggaatga

SEQ ID NO: 237616 - DNA, 16 bp, P. troglodytes
ctggacaacaaaagca

SEQ ID NO: 237617 - DNA, 16 bp, P. troglodytes
ctggacaacaagagta

SEQ ID NO: 237618 - DNA, 21 bp, P. troglodytes
ctggacaacatggtgaaacct

SEQ ID NO: 237619 - DNA, 16 bp, P. troglodytes
ctggacaacatgttga

SEQ ID NO: 237620 - DNA, 16 bp, P. troglodytes
ctggacaagatggtga

SEQ ID NO: 237621 - DNA, 16 bp, P. troglodytes
ctggacaaggacctgg

SEQ ID NO: 237622 - DNA, 16 bp, P. troglodytes
ctggacacaggacaag

SEQ ID NO: 237623 - DNA, 16 bp, P. troglodytes
ctggacactggacaag

SEQ ID NO: 237624 - DNA, 16 bp, P. troglodytes
ctggacaggcacctgc

SEQ ID NO: 237625 - DNA, 16 bp, P. troglodytes
ctggacatgatggcac

SEQ ID NO: 237626 - DNA, 17 bp, P. troglodytes
ctggaccaagtggacct

SEQ ID NO: 237627 - DNA, 16 bp, P. troglodytes
ctggaccccatcctta

SEQ ID NO: 237628 - DNA, 16 bp, P. troglodytes
ctggacccccttcctt

SEQ ID NO: 237629 - DNA, 16 bp, P. troglodytes
ctggacccctgggtct

SEQ ID NO: 237630 - DNA, 16 bp, P. troglodytes
ctggacctgccctgga

SEQ ID NO: 237631 - DNA, 16 bp, P. troglodytes
ctggacctgccctggg

SEQ ID NO: 237632 - DNA, 16 bp, P. troglodytes
ctggacctgccttggg

SEQ ID NO: 237633 - DNA, 16 bp, P. troglodytes
ctggaccttcaggttc

SEQ ID NO: 237634 - DNA, 16 bp, P. troglodytes
ctggacgttgagagga

SEQ ID NO: 237635 - DNA, 16 bp, P. troglodytes
ctggactcaagtgacc

SEQ ID NO: 237636 - DNA, 16 bp, P. troglodytes
ctggactccatcctgg

SEQ ID NO: 237637 - DNA, 16 bp, P. troglodytes
ctggactgcagcctgg

SEQ ID NO: 237638 - DNA, 16 bp, P. troglodytes
ctggacttcctgggtt

SEQ ID NO: 237639 - DNA, 16 bp, P. troglodytes
ctggacttctcagcct

SEQ ID NO: 237640 - DNA, 16 bp, P. troglodytes
ctggactttattgtcc

SEQ ID NO: 237641 - DNA, 16 bp, P. troglodytes
ctggagaaaaaagaaa

SEQ ID NO: 237642 - DNA, 16 bp, P. troglodytes
ctggagaaacagaaat

SEQ ID NO: 237643 - DNA, 16 bp, P. troglodytes
ctggagaaagaggctg

SEQ ID NO: 237644 - DNA, 16 bp, P. troglodytes
ctggagaaagatgtag

SEQ ID NO: 237645 - DNA, 16 bp, P. troglodytes
ctggagaaataggaat

SEQ ID NO: 237646 - DNA, 16 bp, P. troglodytes
ctggagaaccctgacc

SEQ ID NO: 237647 - DNA, 16 bp, P. troglodytes
ctggagaaccctgact

SEQ ID NO: 237648 - DNA, 16 bp, P. troglodytes
ctggagaactttgccc

SEQ ID NO: 237649 - DNA, 16 bp, P. troglodytes
ctggagaagcagcagc

SEQ ID NO: 237650 - DNA, 16 bp, P. troglodytes
ctggagaaggaggaag

SEQ ID NO: 237651 - DNA, 16 bp, P. troglodytes
ctggagaatcaggaaa

SEQ ID NO: 237652 - DNA, 16 bp, P. troglodytes
ctggagaatcctgact

SEQ ID NO: 237653 - DNA, 16 bp, P. troglodytes
ctggagaatttcccca

SEQ ID NO: 237654 - DNA, 16 bp, P. troglodytes
ctggagacatcatact

SEQ ID NO: 237655 - DNA, 16 bp, P. troglodytes
ctggagacattttcct

SEQ ID NO: 237656 - DNA, 16 bp, P. troglodytes
ctggagaccagcccgg

SEQ ID NO: 237657 - DNA, 16 bp, P. troglodytes
ctggagacccaggaaa

SEQ ID NO: 237658 - DNA, 16 bp, P. troglodytes
ctggagactcagggaa

SEQ ID NO: 237659 - DNA, 16 bp, P. troglodytes
ctggagactggaagtc

SEQ ID NO: 237660 - DNA, 16 bp, P. troglodytes
ctggagagaagaaaga

SEQ ID NO: 237661 - DNA, 16 bp, P. troglodytes
ctggagagcagtggag

SEQ ID NO: 237662 - DNA, 16 bp, P. troglodytes
ctggagaggatatgga

SEQ ID NO: 237663 - DNA, 16 bp, P. troglodytes
ctggagaggatttgga

SEQ ID NO: 237664 - DNA, 16 bp, P. troglodytes
ctggagaggggctggg

SEQ ID NO: 237665 - DNA, 16 bp, P. troglodytes
ctggagaggtaggcag

SEQ ID NO: 237666 - DNA, 16 bp, P. troglodytes
ctggagagtgcagtgg

SEQ ID NO: 237667 - DNA, 16 bp, P. troglodytes
ctggagatccaggaaa

SEQ ID NO: 237668 - DNA, 16 bp, P. troglodytes
ctggagatgatgtgga

SEQ ID NO: 237669 - DNA, 16 bp, P. troglodytes
ctggagatggacagtg

SEQ ID NO: 237670 - DNA, 16 bp, P. troglodytes
ctggagatggatgatg

SEQ ID NO: 237671 - DNA, 16 bp, P. troglodytes
ctggagatttgtggaa

SEQ ID NO: 237672 - DNA, 16 bp, P. troglodytes
ctggagcaagacaagg

SEQ ID NO: 237673 - DNA, 16 bp, P. troglodytes
ctggagcacaatggca

SEQ ID NO: 237674 - DNA, 16 bp, P. troglodytes
ctggagcagctgctgc

SEQ ID NO: 237675 - DNA, 16 bp, P. troglodytes
ctggagcaggaggaag

SEQ ID NO: 237676 - DNA, 16 bp, P. troglodytes
ctggagcatttcagat

SEQ ID NO: 237677 - DNA, 16 bp, P. troglodytes
ctggagccaccaggag

SEQ ID NO: 237678 - DNA, 16 bp, P. troglodytes
ctggagccaggctgcc

SEQ ID NO: 237679 - DNA, 16 bp, P. troglodytes
ctggagcccaggaggt

SEQ ID NO: 237680 - DNA, 16 bp, P. troglodytes
ctggagcccaggagtt

SEQ ID NO: 237681 - DNA, 16 bp, P. troglodytes
ctggagccccctgagg

SEQ ID NO: 237682 - DNA, 16 bp, P. troglodytes
ctggagccgtggcaga

SEQ ID NO: 237683 - DNA, 16 bp, P. troglodytes
ctggagcctaggagtt

SEQ ID NO: 237684 - DNA, 16 bp, P. troglodytes
ctggagcctcagtaaa

SEQ ID NO: 237685 - DNA, 16 bp, P. troglodytes
ctggagcctgaggcag

SEQ ID NO: 237686 - DNA, 16 bp, P. troglodytes
ctggagcctgggaagt

SEQ ID NO: 237687 - DNA, 16 bp, P. troglodytes
ctggagcctggggctg

SEQ ID NO: 237688 - DNA, 16 bp, P. troglodytes
ctggagcctgggtgac

SEQ ID NO: 237689 - DNA, 16 bp, P. troglodytes
ctggagccttcagagg

SEQ ID NO: 237690 - DNA, 16 bp, P. troglodytes
ctggagcgcagtggtg

SEQ ID NO: 237691 - DNA, 16 bp, P. troglodytes
ctggagctcaggagag

SEQ ID NO: 237692 - DNA, 16 bp, P. troglodytes
ctggagctcaggagtt

SEQ ID NO: 237693 - DNA, 16 bp, P. troglodytes
ctggagctgcaggctg

SEQ ID NO: 237694 - DNA, 16 bp, P. troglodytes
ctggagctgcctgccc

SEQ ID NO: 237695 - DNA, 16 bp, P. troglodytes
ctggagctgctgcagc

SEQ ID NO: 237696 - DNA, 16 bp, P. troglodytes
ctggagctgctgcctt

SEQ ID NO: 237697 - DNA, 16 bp, P. troglodytes
ctggagctggagcagc

SEQ ID NO: 237698 - DNA, 16 bp, P. troglodytes
ctggagctggaggagg

SEQ ID NO: 237699 - DNA, 16 bp, P. troglodytes
ctggagctggagtggc

SEQ ID NO: 237700 - DNA, 16 bp, P. troglodytes
ctggagctgggagtgg

SEQ ID NO: 237701 - DNA, 16 bp, P. troglodytes
ctggagctgggatttg

SEQ ID NO: 237702 - DNA, 16 bp, P. troglodytes
ctggagctgggggtgg

SEQ ID NO: 237703 - DNA, 16 bp, P. troglodytes
ctggaggaaaaacaaa

SEQ ID NO: 237704 - DNA, 16 bp, P. troglodytes
ctggaggaagaaattt

SEQ ID NO: 237705 - DNA, 16 bp, P. troglodytes
ctggaggaagcagagg

SEQ ID NO: 237706 - DNA, 16 bp, P. troglodytes
ctggaggaaggtggcc

SEQ ID NO: 237707 - DNA, 16 bp, P. troglodytes
ctggaggaatcatatt

SEQ ID NO: 237708 - DNA, 16 bp, P. troglodytes
ctggaggaatgcctgg

SEQ ID NO: 237709 - DNA, 16 bp, P. troglodytes
ctggaggacagtggcc

SEQ ID NO: 237710 - DNA, 16 bp, P. troglodytes
ctggaggacatcatgt

SEQ ID NO: 237711 - DNA, 16 bp, P. troglodytes
ctggaggacattgtgt

SEQ ID NO: 237712 - DNA, 16 bp, P. troglodytes
ctggaggaggagcagg

SEQ ID NO: 237713 - DNA, 16 bp, P. troglodytes
ctggaggaggaggaag

SEQ ID NO: 237714 - DNA, 16 bp, P. troglodytes
ctggaggaggaggagg

SEQ ID NO: 237715 - DNA, 16 bp, P. troglodytes
ctggaggaggtggcag

SEQ ID NO: 237716 - DNA, 16 bp, P. troglodytes
ctggaggaggtggtgt

SEQ ID NO: 237717 - DNA, 16 bp, P. troglodytes
ctggaggatgaggcag

SEQ ID NO: 237718 - DNA, 16 bp, P. troglodytes
ctggaggatggtgacc

SEQ ID NO: 237719 - DNA, 16 bp, P. troglodytes
ctggaggatggtggct

SEQ ID NO: 237720 - DNA, 16 bp, P. troglodytes
ctggaggattgcttga

SEQ ID NO: 237721 - DNA, 16 bp, P. troglodytes
ctggaggcagagattg

SEQ ID NO: 237722 - DNA, 16 bp, P. troglodytes
ctggaggcagggcata

SEQ ID NO: 237723 - DNA, 16 bp, P. troglodytes
ctggaggcatcgcact

SEQ ID NO: 237724 - DNA, 16 bp, P. troglodytes
ctggaggccaggagtt

SEQ ID NO: 237725 - DNA, 16 bp, P. troglodytes
ctggaggcccagctgt

SEQ ID NO: 237726 - DNA, 16 bp, P. troglodytes
ctggaggcccaggagg

SEQ ID NO: 237727 - DNA, 16 bp, P. troglodytes
ctggaggcctcacact

SEQ ID NO: 237728 - DNA, 16 bp, P. troglodytes
ctggaggcctccccag

SEQ ID NO: 237729 - DNA, 16 bp, P. troglodytes
ctggaggcggagcttg

SEQ ID NO: 237730 - DNA, 16 bp, P. troglodytes
ctggaggctaaggtgg

SEQ ID NO: 237731 - DNA, 16 bp, P. troglodytes
ctggaggctcagagag

SEQ ID NO: 237732 - DNA, 16 bp, P. troglodytes
ctggaggctcaggcag

SEQ ID NO: 237733 - DNA, 16 bp, P. troglodytes
ctggaggctgacgcag

SEQ ID NO: 237734 - DNA, 16 bp, P. troglodytes
ctggaggctgagctgg

SEQ ID NO: 237735 - DNA, 16 bp, P. troglodytes
ctggaggctgaggagt

SEQ ID NO: 237736 - DNA, 16 bp, P. troglodytes
ctggaggctgaggcgg

SEQ ID NO: 237737 - DNA, 16 bp, P. troglodytes
ctggaggctgaggtgg

SEQ ID NO: 237738 - DNA, 16 bp, P. troglodytes
ctggaggctgagtgtg

SEQ ID NO: 237739 - DNA, 16 bp, P. troglodytes
ctggaggctgcagtga

SEQ ID NO: 237740 - DNA, 16 bp, P. troglodytes
ctggaggctggggcag

SEQ ID NO: 237741 - DNA, 16 bp, P. troglodytes
ctggagggcagcagtg

SEQ ID NO: 237742 - DNA, 16 bp, P. troglodytes
ctggagggcaggggca

SEQ ID NO: 237743 - DNA, 16 bp, P. troglodytes
ctggagggcagtggcc

SEQ ID NO: 237744 - DNA, 16 bp, P. troglodytes
ctggagggcagtggcg

SEQ ID NO: 237745 - DNA, 16 bp, P. troglodytes
ctggagggcagtggtg

SEQ ID NO: 237746 - DNA, 16 bp, P. troglodytes
ctggaggggatgtgga

SEQ ID NO: 237747 - DNA, 16 bp, P. troglodytes
ctggagggggaggttg

SEQ ID NO: 237748 - DNA, 16 bp, P. troglodytes
ctggagggggccaagg

SEQ ID NO: 237749 - DNA, 16 bp, P. troglodytes
ctggagggtggagggt

SEQ ID NO: 237750 - DNA, 16 bp, P. troglodytes
ctggagggtggtggcc

SEQ ID NO: 237751 - DNA, 16 bp, P. troglodytes
ctggagggtttttttt

SEQ ID NO: 237752 - DNA, 16 bp, P. troglodytes
ctggaggtcaggagtc

SEQ ID NO: 237753 - DNA, 16 bp, P. troglodytes
ctggaggtcaggagtt

SEQ ID NO: 237754 - DNA, 16 bp, P. troglodytes
ctggaggtgaggcctg

SEQ ID NO: 237755 - DNA, 16 bp, P. troglodytes
ctggaggtggagcttg

SEQ ID NO: 237756 - DNA, 16 bp, P. troglodytes
ctggaggtggtggtgg

SEQ ID NO: 237757 - DNA, 16 bp, P. troglodytes
ctggaggttggaagtc

SEQ ID NO: 237758 - DNA, 16 bp, P. troglodytes
ctggagtaaagtggca

SEQ ID NO: 237759 - DNA, 16 bp, P. troglodytes
ctggagtacaatggca

SEQ ID NO: 237760 - DNA, 19 bp, P. troglodytes
ctggagtacaatggcgtga

SEQ ID NO: 237761 - DNA, 16 bp, P. troglodytes
ctggagtacagtggct

SEQ ID NO: 237762 - DNA, 16 bp, P. troglodytes
ctggagtacagtggtg

SEQ ID NO: 237763 - DNA, 16 bp, P. troglodytes
ctggagtcaagtgatc

SEQ ID NO: 237764 - DNA, 16 bp, P. troglodytes
ctggagtcagagctgg

SEQ ID NO: 237765 - DNA, 16 bp, P. troglodytes
ctggagtccaggagtt

SEQ ID NO: 237766 - DNA, 20 bp, P. troglodytes
ctggagtccagtggcacgat

SEQ ID NO: 237767 - DNA, 16 bp, P. troglodytes
ctggagtccagtggct

SEQ ID NO: 237768 - DNA, 16 bp, P. troglodytes
ctggagtcccagctgc

SEQ ID NO: 237769 - DNA, 16 bp, P. troglodytes
ctggagtcctttaaaa

SEQ ID NO: 237770 - DNA, 16 bp, P. troglodytes
ctggagtctgggaagt

SEQ ID NO: 237771 - DNA, 16 bp, P. troglodytes
ctggagtgcaaggagt

SEQ ID NO: 237772 - DNA, 16 bp, P. troglodytes
ctggagtgcaatggcc

SEQ ID NO: 237773 - DNA, 17 bp, P. troglodytes
ctggagtgcaatggtgc

SEQ ID NO: 237774 - DNA, 16 bp, P. troglodytes
ctggagtgcagaggag

SEQ ID NO: 237775 - DNA, 16 bp, P. troglodytes
ctggagtgcagtagcg

SEQ ID NO: 237776 - DNA, 16 bp, P. troglodytes
ctggagtgcagtgctg

SEQ ID NO: 237777 - DNA, 16 bp, P. troglodytes
ctggagtgcagtggct

SEQ ID NO: 237778 - DNA, 16 bp, P. troglodytes
ctggagtgcagtggtc

SEQ ID NO: 237779 - DNA, 16 bp, P. troglodytes
ctggagtgcgctggtg

SEQ ID NO: 237780 - DNA, 16 bp, P. troglodytes
ctggagtggcagtggt

SEQ ID NO: 237781 - DNA, 16 bp, P. troglodytes
ctggagtggtgcagtg

SEQ ID NO: 237782 - DNA, 16 bp, P. troglodytes
ctggagtgtaggggtg

SEQ ID NO: 237783 - DNA, 16 bp, P. troglodytes
ctggagttcaggagtt

SEQ ID NO: 237784 - DNA, 16 bp, P. troglodytes
ctggagttcagtgatg

SEQ ID NO: 237785 - DNA, 16 bp, P. troglodytes
ctggagttcagtggcg

SEQ ID NO: 237786 - DNA, 16 bp, P. troglodytes
ctggagttggaggctg

SEQ ID NO: 237787 - DNA, 16 bp, P. troglodytes
ctggataaagagaatg

SEQ ID NO: 237788 - DNA, 16 bp, P. troglodytes
ctggataaagagccaa

SEQ ID NO: 237789 - DNA, 16 bp, P. troglodytes
ctggataacttactgc

SEQ ID NO: 237790 - DNA, 16 bp, P. troglodytes
ctggataatgttccat

SEQ ID NO: 237791 - DNA, 16 bp, P. troglodytes
ctggataatttaaaaa

SEQ ID NO: 237792 - DNA, 16 bp, P. troglodytes
ctggataatttcaaat

SEQ ID NO: 237793 - DNA, 16 bp, P. troglodytes
ctggatagacatttct

SEQ ID NO: 237794 - DNA, 16 bp, P. troglodytes
ctggatatatattcaa

SEQ ID NO: 237795 - DNA, 16 bp, P. troglodytes
ctggatatcaccagca

SEQ ID NO: 237796 - DNA, 16 bp, P. troglodytes
ctggatatccaggcat

SEQ ID NO: 237797 - DNA, 16 bp, P. troglodytes
ctggatatgaaatttt

SEQ ID NO: 237798 - DNA, 16 bp, P. troglodytes
ctggatattaaacttt

SEQ ID NO: 237799 - DNA, 16 bp, P. troglodytes
ctggatcaaagggtat

SEQ ID NO: 237800 - DNA, 16 bp, P. troglodytes
ctggatcaggaaaaga

SEQ ID NO: 237801 - DNA, 16 bp, P. troglodytes
ctggatcatccaggtg

SEQ ID NO: 237802 - DNA, 16 bp, P. troglodytes
ctggatccagacccct

SEQ ID NO: 237803 - DNA, 16 bp, P. troglodytes
ctggatccctatctct

SEQ ID NO: 237804 - DNA, 16 bp, P. troglodytes
ctggatcccttccttc

SEQ ID NO: 237805 - DNA, 16 bp, P. troglodytes
ctggatctcagtttcc

SEQ ID NO: 237806 - DNA, 16 bp, P. troglodytes
ctggatctcattcttt

SEQ ID NO: 237807 - DNA, 16 bp, P. troglodytes
ctggatgacacagtga

SEQ ID NO: 237808 - DNA, 16 bp, P. troglodytes
ctggatgacagagacc

SEQ ID NO: 237809 - DNA, 16 bp, P. troglodytes
ctggatgacagcaaga

SEQ ID NO: 237810 - DNA, 16 bp, P. troglodytes
ctggatgaggtggctc

SEQ ID NO: 237811 - DNA, 16 bp, P. troglodytes
ctggatgatagagtga

SEQ ID NO: 237812 - DNA, 16 bp, P. troglodytes
ctggatgcttcttgcc

SEQ ID NO: 237813 - DNA, 16 bp, P. troglodytes
ctggatggagctggag

SEQ ID NO: 237814 - DNA, 16 bp, P. troglodytes
ctggatggagtgcagt

SEQ ID NO: 237815 - DNA, 16 bp, P. troglodytes
ctggatggcaaggaag

SEQ ID NO: 237816 - DNA, 16 bp, P. troglodytes
ctggatgtgatggcac

SEQ ID NO: 237817 - DNA, 16 bp, P. troglodytes
ctggattacaagcatg

SEQ ID NO: 237818 - DNA, 17 bp, P. troglodytes
ctggattaccaggtaga

SEQ ID NO: 237819 - DNA, 16 bp, P. troglodytes
ctggattacctgggtg

SEQ ID NO: 237820 - DNA, 16 bp, P. troglodytes
ctggattatctgggtg

SEQ ID NO: 237821 - DNA, 16 bp, P. troglodytes
ctggattcaaatccca

SEQ ID NO: 237822 - DNA, 16 bp, P. troglodytes
ctggattcagtttgtc

SEQ ID NO: 237823 - DNA, 16 bp, P. troglodytes
ctggattcatggattt

SEQ ID NO: 237824 - DNA, 16 bp, P. troglodytes
ctggattcattggttt

SEQ ID NO: 237825 - DNA, 16 bp, P. troglodytes
ctggattcctgggtct

SEQ ID NO: 237826 - DNA, 16 bp, P. troglodytes
ctggatttcattaaaa

SEQ ID NO: 237827 - DNA, 16 bp, P. troglodytes
ctggatttgggtttgg

SEQ ID NO: 237828 - DNA, 16 bp, P. troglodytes
ctggattttattttta

SEQ ID NO: 237829 - DNA, 16 bp, P. troglodytes
ctggattttgtttgcc

SEQ ID NO: 237830 - DNA, 16 bp, P. troglodytes
ctggatttttatattt

SEQ ID NO: 237831 - DNA, 16 bp, P. troglodytes
ctggcaaaaacaagaa

SEQ ID NO: 237832 - DNA, 16 bp, P. troglodytes
ctggcaaactgaaccc

SEQ ID NO: 237833 - DNA, 16 bp, P. troglodytes
ctggcaaagatggtga

SEQ ID NO: 237834 - DNA, 16 bp, P. troglodytes
ctggcaaagctgcaga

SEQ ID NO: 237835 - DNA, 16 bp, P. troglodytes
ctggcaaattctacca

SEQ ID NO: 237836 - DNA, 16 bp, P. troglodytes
ctggcaaatttttttg

SEQ ID NO: 237837 - DNA, 16 bp, P. troglodytes
ctggcaaccaccattg

SEQ ID NO: 237838 - DNA, 16 bp, P. troglodytes
ctggcaagttggtgct

SEQ ID NO: 237839 - DNA, 16 bp, P. troglodytes
ctggcacaagacaggg

SEQ ID NO: 237840 - DNA, 16 bp, P. troglodytes
ctggcacacacctgta

SEQ ID NO: 237841 - DNA, 16 bp, P. troglodytes
ctggcacacagtaggt

SEQ ID NO: 237842 - DNA, 16 bp, P. troglodytes
ctggcacagagtagat

SEQ ID NO: 237843 - DNA, 16 bp, P. troglodytes
ctggcacagtgcctgg

SEQ ID NO: 237844 - DNA, 16 bp, P. troglodytes
ctggcacagtggctca

SEQ ID NO: 237845 - DNA, 16 bp, P. troglodytes
ctggcacatagtaagc

SEQ ID NO: 237846 - DNA, 16 bp, P. troglodytes
ctggcacgcaccacca

SEQ ID NO: 237847 - DNA, 16 bp, P. troglodytes
ctggcactgagtgcct

SEQ ID NO: 237848 - DNA, 16 bp, P. troglodytes
ctggcactgtgctggg

SEQ ID NO: 237849 - DNA, 16 bp, P. troglodytes
ctggcacttagtaggt

SEQ ID NO: 237850 - DNA, 16 bp, P. troglodytes
ctggcagaagacaggg

SEQ ID NO: 237851 - DNA, 16 bp, P. troglodytes
ctggcagagacacaac

SEQ ID NO: 237852 - DNA, 16 bp, P. troglodytes
ctggcagatctggtgt

SEQ ID NO: 237853 - DNA, 16 bp, P. troglodytes
ctggcagcagaccacc

SEQ ID NO: 237854 - DNA, 16 bp, P. troglodytes
ctggcagcagagcaag

SEQ ID NO: 237855 - DNA, 16 bp, P. troglodytes
ctggcagcagagtgag

SEQ ID NO: 237856 - DNA, 16 bp, P. troglodytes
ctggcagcattcatca

SEQ ID NO: 237857 - DNA, 16 bp, P. troglodytes
ctggcagcccagcccc

SEQ ID NO: 237858 - DNA, 16 bp, P. troglodytes
ctggcagctgatgaga

SEQ ID NO: 237859 - DNA, 16 bp, P. troglodytes
ctggcagctggtgttt

SEQ ID NO: 237860 - DNA, 16 bp, P. troglodytes
ctggcagcttccatgt

SEQ ID NO: 237861 - DNA, 16 bp, P. troglodytes
ctggcagctttgttta

SEQ ID NO: 237862 - DNA, 16 bp, P. troglodytes
ctggcagggatgtgga

SEQ ID NO: 237863 - DNA, 16 bp, P. troglodytes
ctggcaggtgcccctc

SEQ ID NO: 237864 - DNA, 16 bp, P. troglodytes
ctggcagtgagctgca

SEQ ID NO: 237865 - DNA, 16 bp, P. troglodytes
ctggcagtgctggggg

SEQ ID NO: 237866 - DNA, 16 bp, P. troglodytes
ctggcagttgtgccaa

SEQ ID NO: 237867 - DNA, 16 bp, P. troglodytes
ctggcatagagtaagt

SEQ ID NO: 237868 - DNA, 16 bp, P. troglodytes
ctggcatatttcaaaa

SEQ ID NO: 237869 - DNA, 16 bp, P. troglodytes
ctggcatctactgggt

SEQ ID NO: 237870 - DNA, 16 bp, P. troglodytes
ctggcatgagatggtg

SEQ ID NO: 237871 - DNA, 16 bp, P. troglodytes
ctggcatgccctggag

SEQ ID NO: 237872 - DNA, 16 bp, P. troglodytes
ctggcatggtgactca

SEQ ID NO: 237873 - DNA, 16 bp, P. troglodytes
ctggcatgtcagcacc

SEQ ID NO: 237874 - DNA, 16 bp, P. troglodytes
ctggcattccaggcac

SEQ ID NO: 237875 - DNA, 16 bp, P. troglodytes
ctggcattttcttttt

SEQ ID NO: 237876 - DNA, 16 bp, P. troglodytes
ctggcattttgggagg

SEQ ID NO: 237877 - DNA, 16 bp, P. troglodytes
ctggccaaaaaggtga

SEQ ID NO: 237878 - DNA, 16 bp, P. troglodytes
ctggccaacaccttga

SEQ ID NO: 237879 - DNA, 16 bp, P. troglodytes
ctggccaacactgtga

SEQ ID NO: 237880 - DNA, 16 bp, P. troglodytes
ctggccaacagaatga

SEQ ID NO: 237881 - DNA, 16 bp, P. troglodytes
ctggccaacatagaga

SEQ ID NO: 237882 - DNA, 16 bp, P. troglodytes
ctggccaacatagtga

SEQ ID NO: 237883 - DNA, 16 bp, P. troglodytes
ctggccaacatagtgg

SEQ ID NO: 237884 - DNA, 16 bp, P. troglodytes
ctggccaacatggcca

SEQ ID NO: 237885 - DNA, 16 bp, P. troglodytes
ctggccaaccatggtg

SEQ ID NO: 237886 - DNA, 16 bp, P. troglodytes
ctggccaaccccaggc

SEQ ID NO: 237887 - DNA, 16 bp, P. troglodytes
ctggccaagagggtga

SEQ ID NO: 237888 - DNA, 16 bp, P. troglodytes
ctggccaagctggtct

SEQ ID NO: 237889 - DNA, 16 bp, P. troglodytes
ctggccaaggtggtga

SEQ ID NO: 237890 - DNA, 16 bp, P. troglodytes
ctggccaatttttgta

SEQ ID NO: 237891 - DNA, 16 bp, P. troglodytes
ctggccacactggcag

SEQ ID NO: 237892 - DNA, 16 bp, P. troglodytes
ctggccacactggcct

SEQ ID NO: 237893 - DNA, 16 bp, P. troglodytes
ctggccacagcagcct

SEQ ID NO: 237894 - DNA, 16 bp, P. troglodytes
ctggccacagtggcct

SEQ ID NO: 237895 - DNA, 16 bp, P. troglodytes
ctggccaccacgccca

SEQ ID NO: 237896 - DNA, 16 bp, P. troglodytes
ctggccaccatggcaa

SEQ ID NO: 237897 - DNA, 16 bp, P. troglodytes
ctggccaccatggtga

SEQ ID NO: 237898 - DNA, 16 bp, P. troglodytes
ctggccacctcagcct

SEQ ID NO: 237899 - DNA, 16 bp, P. troglodytes
ctggccaccttggcct

SEQ ID NO: 237900 - DNA, 16 bp, P. troglodytes
ctggccagaactccca

SEQ ID NO: 237901 - DNA, 16 bp, P. troglodytes
ctggccagaatttcca

SEQ ID NO: 237902 - DNA, 16 bp, P. troglodytes
ctggccagcatggaga

SEQ ID NO: 237903 - DNA, 16 bp, P. troglodytes
ctggccaggatggtct

SEQ ID NO: 237904 - DNA, 16 bp, P. troglodytes
ctggccaggctggtct

SEQ ID NO: 237905 - DNA, 17 bp, P. troglodytes
ctggccagggaaatcag

SEQ ID NO: 237906 - DNA, 16 bp, P. troglodytes
ctggccaggtgccatg

SEQ ID NO: 237907 - DNA, 21 bp, P. troglodytes
ctggccaggtgcggtggctca

SEQ ID NO: 237908 - DNA, 16 bp, P. troglodytes
ctggccatggtggcag

SEQ ID NO: 237909 - DNA, 16 bp, P. troglodytes
ctggcccaaggctctc

SEQ ID NO: 237910 - DNA, 16 bp, P. troglodytes
ctggcccagccccagc

SEQ ID NO: 237911 - DNA, 16 bp, P. troglodytes
ctggcccagcctccca

SEQ ID NO: 237912 - DNA, 16 bp, P. troglodytes
ctggcccaggatgtgt

SEQ ID NO: 237913 - DNA, 16 bp, P. troglodytes
ctggcccagggcctgg

SEQ ID NO: 237914 - DNA, 16 bp, P. troglodytes
ctggcccccagccttc

SEQ ID NO: 237915 - DNA, 16 bp, P. troglodytes
ctggccccctggctcc

SEQ ID NO: 237916 - DNA, 16 bp, P. troglodytes
ctggcccctgcctgcc

SEQ ID NO: 237917 - DNA, 17 bp, P. troglodytes
ctggcccgggtgctaag

SEQ ID NO: 237918 - DNA, 16 bp, P. troglodytes
ctggccctattttttt

SEQ ID NO: 237919 - DNA, 16 bp, P. troglodytes
ctggccctgccctcct

SEQ ID NO: 237920 - DNA, 16 bp, P. troglodytes
ctggccctgcctgggg

SEQ ID NO: 237921 - DNA, 16 bp, P. troglodytes
ctggccctggccctga

SEQ ID NO: 237922 - DNA, 16 bp, P. troglodytes
ctggccggcatggtga

SEQ ID NO: 237923 - DNA, 21 bp, P. troglodytes
ctggccgggcacagtggctca

SEQ ID NO: 237924 - DNA, 16 bp, P. troglodytes
ctggccgtggtggcag

SEQ ID NO: 237925 - DNA, 16 bp, P. troglodytes
ctggcctatttcactt

SEQ ID NO: 237926 - DNA, 16 bp, P. troglodytes
ctggcctcacaaaatg

SEQ ID NO: 237927 - DNA, 16 bp, P. troglodytes
ctggcctcagcctccc

SEQ ID NO: 237928 - DNA, 16 bp, P. troglodytes
ctggcctcagtctccc

SEQ ID NO: 237929 - DNA, 16 bp, P. troglodytes
ctggcctcagtctcct

SEQ ID NO: 237930 - DNA, 16 bp, P. troglodytes
ctggcctcagtttccc

SEQ ID NO: 237931 - DNA, 16 bp, P. troglodytes
ctggcctcatgtgatt

SEQ ID NO: 237932 - DNA, 16 bp, P. troglodytes
ctggcctcccagagtg

SEQ ID NO: 237933 - DNA, 16 bp, P. troglodytes
ctggcctcctacctgg

SEQ ID NO: 237934 - DNA, 16 bp, P. troglodytes
ctggcctcctcatggc

SEQ ID NO: 237935 - DNA, 16 bp, P. troglodytes
ctggcctcctgcctgg

SEQ ID NO: 237936 - DNA, 16 bp, P. troglodytes
ctggcctcctgggttc

SEQ ID NO: 237937 - DNA, 16 bp, P. troglodytes
ctggcctcgaacccct

SEQ ID NO: 237938 - DNA, 16 bp, P. troglodytes
ctggcctcgaacttct

SEQ ID NO: 237939 - DNA, 16 bp, P. troglodytes
ctggcctctagtgatc

SEQ ID NO: 237940 - DNA, 16 bp, P. troglodytes
ctggcctctccctttc

SEQ ID NO: 237941 - DNA, 16 bp, P. troglodytes
ctggcctctcctgggg

SEQ ID NO: 237942 - DNA, 16 bp, P. troglodytes
ctggcctctgcccacc

SEQ ID NO: 237943 - DNA, 16 bp, P. troglodytes
ctggcctgaggtgatc

SEQ ID NO: 237944 - DNA, 16 bp, P. troglodytes
ctggcctgccacaccc

SEQ ID NO: 237945 - DNA, 16 bp, P. troglodytes
ctggcctgcccagggc

SEQ ID NO: 237946 - DNA, 16 bp, P. troglodytes
ctggcctgccttcagc

SEQ ID NO: 237947 - DNA, 16 bp, P. troglodytes
ctggcctgctgcctgt

SEQ ID NO: 237948 - DNA, 16 bp, P. troglodytes
ctggcctggagcctgg

SEQ ID NO: 237949 - DNA, 16 bp, P. troglodytes
ctggcctggatcccac

SEQ ID NO: 237950 - DNA, 16 bp, P. troglodytes
ctggcctggcacagtg

SEQ ID NO: 237951 - DNA, 16 bp, P. troglodytes
ctggcctggccaacac

SEQ ID NO: 237952 - DNA, 16 bp, P. troglodytes
ctggcctggccctgcc

SEQ ID NO: 237953 - DNA, 16 bp, P. troglodytes
ctggcctgggagtcag

SEQ ID NO: 237954 - DNA, 16 bp, P. troglodytes
ctggcctgggtgacag

SEQ ID NO: 237955 - DNA, 16 bp, P. troglodytes
ctggccttaaagagga

SEQ ID NO: 237956 - DNA, 16 bp, P. troglodytes
ctggccttcagagaaa

SEQ ID NO: 237957 - DNA, 16 bp, P. troglodytes
ctggccttggtctccc

SEQ ID NO: 237958 - DNA, 16 bp, P. troglodytes
ctggcgacagagcgag

SEQ ID NO: 237959 - DNA, 16 bp, P. troglodytes
ctggcgcagtggctca

SEQ ID NO: 237960 - DNA, 16 bp, P. troglodytes
ctggcggattgcctga

SEQ ID NO: 237961 - DNA, 16 bp, P. troglodytes
ctggcgtgagccactg

SEQ ID NO: 237962 - DNA, 16 bp, P. troglodytes
ctggcgtgcagtggcg

SEQ ID NO: 237963 - DNA, 16 bp, P. troglodytes
ctggctaaattttaaa

SEQ ID NO: 237964 - DNA, 16 bp, P. troglodytes
ctggctaacacaatga

SEQ ID NO: 237965 - DNA, 18 bp, P. troglodytes
ctggctaacatggcgaaa

SEQ ID NO: 237966 - DNA, 16 bp, P. troglodytes
ctggctaatattttaa

SEQ ID NO: 237967 - DNA, 16 bp, P. troglodytes
ctggctaatctttttg

SEQ ID NO: 237968 - DNA, 16 bp, P. troglodytes
ctggctaattttctta

SEQ ID NO: 237969 - DNA, 16 bp, P. troglodytes
ctggctaattttgggg

SEQ ID NO: 237970 - DNA, 16 bp, P. troglodytes
ctggctagagatttat

SEQ ID NO: 237971 - DNA, 16 bp, P. troglodytes
ctggctagcatggtga

SEQ ID NO: 237972 - DNA, 16 bp, P. troglodytes
ctggctagttttttct

SEQ ID NO: 237973 - DNA, 16 bp, P. troglodytes
ctggctcacacctgca

SEQ ID NO: 237974 - DNA, 18 bp, P. troglodytes
ctggctcacacctgtaat

SEQ ID NO: 237975 - DNA, 18 bp, P. troglodytes
ctggctcagaagctcccc

SEQ ID NO: 237976 - DNA, 16 bp, P. troglodytes
ctggctcagcaggtcc

SEQ ID NO: 237977 - DNA, 16 bp, P. troglodytes
ctggctccaagcccag

SEQ ID NO: 237978 - DNA, 16 bp, P. troglodytes
ctggctccagagcctg

SEQ ID NO: 237979 - DNA, 16 bp, P. troglodytes
ctggctccaggtctct

SEQ ID NO: 237980 - DNA, 16 bp, P. troglodytes
ctggctcctgcacctg

SEQ ID NO: 237981 - DNA, 16 bp, P. troglodytes
ctggctcctggacagc

SEQ ID NO: 237982 - DNA, 16 bp, P. troglodytes
ctggctcctggatggc

SEQ ID NO: 237983 - DNA, 16 bp, P. troglodytes
ctggctcctggctcct

SEQ ID NO: 237984 - DNA, 16 bp, P. troglodytes
ctggctccttcagctg

SEQ ID NO: 237985 - DNA, 16 bp, P. troglodytes
ctggctccttctcatc

SEQ ID NO: 237986 - DNA, 16 bp, P. troglodytes
ctggctctgccacctg

SEQ ID NO: 237987 - DNA, 16 bp, P. troglodytes
ctggctctgccactta

SEQ ID NO: 237988 - DNA, 16 bp, P. troglodytes
ctggctctgcctctcc

SEQ ID NO: 237989 - DNA, 16 bp, P. troglodytes
ctggctctgcgtgaat

SEQ ID NO: 237990 - DNA, 16 bp, P. troglodytes
ctggctctggccttgg

SEQ ID NO: 237991 - DNA, 16 bp, P. troglodytes
ctggctctgtcaccag

SEQ ID NO: 237992 - DNA, 16 bp, P. troglodytes
ctggctctgtggccca

SEQ ID NO: 237993 - DNA, 18 bp, P. troglodytes
ctggctgacatggtgaaa

SEQ ID NO: 237994 - DNA, 16 bp, P. troglodytes
ctggctgaggaggaag

SEQ ID NO: 237995 - DNA, 16 bp, P. troglodytes
ctggctgaggccggag

SEQ ID NO: 237996 - DNA, 16 bp, P. troglodytes
ctggctgagtccaggg

SEQ ID NO: 237997 - DNA, 16 bp, P. troglodytes
ctggctgcaaactcct

SEQ ID NO: 237998 - DNA, 16 bp, P. troglodytes
ctggctgccctgaaca

SEQ ID NO: 237999 - DNA, 16 bp, P. troglodytes
ctggctgccttccctg

SEQ ID NO: 238000 - DNA, 16 bp, P. troglodytes
ctggctgctctgagtg

SEQ ID NO: 238001 - DNA, 16 bp, P. troglodytes
ctggctgctgcttctc

SEQ ID NO: 238002 - DNA, 16 bp, P. troglodytes
ctggctgctgtgtgga

SEQ ID NO: 238003 - DNA, 16 bp, P. troglodytes
ctggctggacatggtg

SEQ ID NO: 238004 - DNA, 16 bp, P. troglodytes
ctggctggagccatgg

SEQ ID NO: 238005 - DNA, 16 bp, P. troglodytes
ctggctggagttgctg

SEQ ID NO: 238006 - DNA, 16 bp, P. troglodytes
ctggctggagttgttg

SEQ ID NO: 238007 - DNA, 16 bp, P. troglodytes
ctggctggcaggggtg

SEQ ID NO: 238008 - DNA, 16 bp, P. troglodytes
ctggctggcatctggc

SEQ ID NO: 238009 - DNA, 16 bp, P. troglodytes
ctggctggctttgcca

SEQ ID NO: 238010 - DNA, 16 bp, P. troglodytes
ctggctgggcaaggtg

SEQ ID NO: 238011 - DNA, 16 bp, P. troglodytes
ctggctgggcacagtg

SEQ ID NO: 238012 - DNA, 16 bp, P. troglodytes
ctggctgggtacggtg

SEQ ID NO: 238013 - DNA, 16 bp, P. troglodytes
ctggctgggtgcagtg

SEQ ID NO: 238014 - DNA, 16 bp, P. troglodytes
ctggctgtagaaattt

SEQ ID NO: 238015 - DNA, 16 bp, P. troglodytes
ctggctgtgcaggaga

SEQ ID NO: 238016 - DNA, 16 bp, P. troglodytes
ctggctgtggtggtgt

SEQ ID NO: 238017 - DNA, 16 bp, P. troglodytes
ctggctgtgtcgccca

SEQ ID NO: 238018 - DNA, 16 bp, P. troglodytes
ctggctgtgtggcctt

SEQ ID NO: 238019 - DNA, 16 bp, P. troglodytes
ctggctgttccctctg

SEQ ID NO: 238020 - DNA, 16 bp, P. troglodytes
ctggcttagcctccca

SEQ ID NO: 238021 - DNA, 16 bp, P. troglodytes
ctggcttcaaagtttc

SEQ ID NO: 238022 - DNA, 16 bp, P. troglodytes
ctggcttcaagcaatc

SEQ ID NO: 238023 - DNA, 16 bp, P. troglodytes
ctggcttcaagtgatc

SEQ ID NO: 238024 - DNA, 16 bp, P. troglodytes
ctggcttcagagtctg

SEQ ID NO: 238025 - DNA, 16 bp, P. troglodytes
ctggcttcagcctccc

SEQ ID NO: 238026 - DNA, 16 bp, P. troglodytes
ctggcttcatgccatt

SEQ ID NO: 238027 - DNA, 16 bp, P. troglodytes
ctggcttcccccagag

SEQ ID NO: 238028 - DNA, 16 bp, P. troglodytes
ctggcttcctccagag

SEQ ID NO: 238029 - DNA, 16 bp, P. troglodytes
ctggcttccttcactt

SEQ ID NO: 238030 - DNA, 16 bp, P. troglodytes
ctggcttctccccact

SEQ ID NO: 238031 - DNA, 16 bp, P. troglodytes
ctggcttctctcactg

SEQ ID NO: 238032 - DNA, 16 bp, P. troglodytes
ctggcttggggagccc

SEQ ID NO: 238033 - DNA, 16 bp, P. troglodytes
ctggctttatttttct

SEQ ID NO: 238034 - DNA, 16 bp, P. troglodytes
ctggctttgaagatgg

SEQ ID NO: 238035 - DNA, 16 bp, P. troglodytes
ctggctttggggaaaa

SEQ ID NO: 238036 - DNA, 16 bp, P. troglodytes
ctggctttgtttctgg

SEQ ID NO: 238037 - DNA, 16 bp, P. troglodytes
ctgggaaaaaaaaaat

SEQ ID NO: 238038 - DNA, 16 bp, P. troglodytes
ctgggaaaactggaca

SEQ ID NO: 238039 - DNA, 16 bp, P. troglodytes
ctgggaaaagaaaaga

SEQ ID NO: 238040 - DNA, 16 bp, P. troglodytes
ctgggaaaatctttat

SEQ ID NO: 238041 - DNA, 18 bp, P. troglodytes
ctgggaaacagagcgaga

SEQ ID NO: 238042 - DNA, 16 bp, P. troglodytes
ctgggaaacagagtaa

SEQ ID NO: 238043 - DNA, 16 bp, P. troglodytes
ctgggaaagggaattc

SEQ ID NO: 238044 - DNA, 16 bp, P. troglodytes
ctgggaaatgtagtcc

SEQ ID NO: 238045 - DNA, 16 bp, P. troglodytes
ctgggaaatgtagttt

SEQ ID NO: 238046 - DNA, 16 bp, P. troglodytes
ctgggaacaaagagag

SEQ ID NO: 238047 - DNA, 16 bp, P. troglodytes
ctgggaacacaggcac

SEQ ID NO: 238048 - DNA, 28 bp, P. troglodytes
ctgggaactgaatgtctcggtataaaac

SEQ ID NO: 238049 - DNA, 16 bp, P. troglodytes
ctgggaagacttcctg

SEQ ID NO: 238050 - DNA, 16 bp, P. troglodytes
ctgggaagccgaggcg

SEQ ID NO: 238051 - DNA, 16 bp, P. troglodytes
ctgggaagggaagggc

SEQ ID NO: 238052 - DNA, 16 bp, P. troglodytes
ctgggaaggggcatga

SEQ ID NO: 238053 - DNA, 16 bp, P. troglodytes
ctgggaaggtggaggt

SEQ ID NO: 238054 - DNA, 16 bp, P. troglodytes
ctgggaagtccaagag

SEQ ID NO: 238055 - DNA, 16 bp, P. troglodytes
ctgggaagtccaagat

SEQ ID NO: 238056 - DNA, 16 bp, P. troglodytes
ctgggaagtgaagagc

SEQ ID NO: 238057 - DNA, 16 bp, P. troglodytes
ctgggaagtgaggagc

SEQ ID NO: 238058 - DNA, 16 bp, P. troglodytes
ctgggaatacaggtgc

SEQ ID NO: 238059 - DNA, 16 bp, P. troglodytes
ctgggaatcaaatttc

SEQ ID NO: 238060 - DNA, 16 bp, P. troglodytes
ctgggaatgcagctca

SEQ ID NO: 238061 - DNA, 16 bp, P. troglodytes
ctgggaattcaagacc

SEQ ID NO: 238062 - DNA, 16 bp, P. troglodytes
ctgggaattgtgggag

SEQ ID NO: 238063 - DNA, 16 bp, P. troglodytes
ctgggaatttgcattt

SEQ ID NO: 238064 - DNA, 16 bp, P. troglodytes
ctgggacaacaggcac

SEQ ID NO: 238065 - DNA, 16 bp, P. troglodytes
ctgggacagagctcct

SEQ ID NO: 238066 - DNA, 16 bp, P. troglodytes
ctgggacaggagaatc

SEQ ID NO: 238067 - DNA, 16 bp, P. troglodytes
ctgggacatatttaaa

SEQ ID NO: 238068 - DNA, 16 bp, P. troglodytes
ctgggaccaaaggtgt

SEQ ID NO: 238069 - DNA, 16 bp, P. troglodytes
ctgggaccacagatgc

SEQ ID NO: 238070 - DNA, 16 bp, P. troglodytes
ctgggaccacaggagc

SEQ ID NO: 238071 - DNA, 16 bp, P. troglodytes
ctgggaccacaggcgc

SEQ ID NO: 238072 - DNA, 16 bp, P. troglodytes
ctgggaccacaggcgt

SEQ ID NO: 238073 - DNA, 16 bp, P. troglodytes
ctgggaccacaggtgt

SEQ ID NO: 238074 - DNA, 16 bp, P. troglodytes
ctgggacccaggaggc

SEQ ID NO: 238075 - DNA, 16 bp, P. troglodytes
ctgggactaaaggcac

SEQ ID NO: 238076 - DNA, 16 bp, P. troglodytes
ctgggactacaaggtg

SEQ ID NO: 238077 - DNA, 16 bp, P. troglodytes
ctgggactacaagtac

SEQ ID NO: 238078 - DNA, 16 bp, P. troglodytes
ctgggactacagcacc

SEQ ID NO: 238079 - DNA, 16 bp, P. troglodytes
ctgggactacagcgcc

SEQ ID NO: 238080 - DNA, 16 bp, P. troglodytes
ctgggactacaggcag

SEQ ID NO: 238081 - DNA, 16 bp, P. troglodytes
ctgggactaccagtgt

SEQ ID NO: 238082 - DNA, 16 bp, P. troglodytes
ctgggactataggcgt

SEQ ID NO: 238083 - DNA, 16 bp, P. troglodytes
ctgggactcagtttcc

SEQ ID NO: 238084 - DNA, 16 bp, P. troglodytes
ctgggactgcagatgc

SEQ ID NO: 238085 - DNA, 16 bp, P. troglodytes
ctgggactgcagtcac

SEQ ID NO: 238086 - DNA, 16 bp, P. troglodytes
ctgggactgggactac

SEQ ID NO: 238087 - DNA, 16 bp, P. troglodytes
ctgggacttcccagcc

SEQ ID NO: 238088 - DNA, 16 bp, P. troglodytes
ctgggagaaccactgt

SEQ ID NO: 238089 - DNA, 16 bp, P. troglodytes
ctgggagaagctgcag

SEQ ID NO: 238090 - DNA, 16 bp, P. troglodytes
ctgggagaaggggcag

SEQ ID NO: 238091 - DNA, 16 bp, P. troglodytes
ctgggagacaaagcaa

SEQ ID NO: 238092 - DNA, 16 bp, P. troglodytes
ctgggagacacagtga

SEQ ID NO: 238093 - DNA, 16 bp, P. troglodytes
ctgggagacagagcta

SEQ ID NO: 238094 - DNA, 16 bp, P. troglodytes
ctgggagacagggaga

SEQ ID NO: 238095 - DNA, 16 bp, P. troglodytes
ctgggagacagggtga

SEQ ID NO: 238096 - DNA, 16 bp, P. troglodytes
ctgggagaggcagagg

SEQ ID NO: 238097 - DNA, 16 bp, P. troglodytes
ctgggagaggccagca

SEQ ID NO: 238098 - DNA, 16 bp, P. troglodytes
ctgggagatgtctccc

SEQ ID NO: 238099 - DNA, 16 bp, P. troglodytes
ctgggagatttttttt

SEQ ID NO: 238100 - DNA, 16 bp, P. troglodytes
ctgggagcagaggttg

SEQ ID NO: 238101 - DNA, 16 bp, P. troglodytes
ctgggagccaggcagg

SEQ ID NO: 238102 - DNA, 16 bp, P. troglodytes
ctgggagcctgaggca

SEQ ID NO: 238103 - DNA, 16 bp, P. troglodytes
ctgggagctccctgag

SEQ ID NO: 238104 - DNA, 17 bp, P. troglodytes
ctgggagctgtagactg

SEQ ID NO: 238105 - DNA, 16 bp, P. troglodytes
ctgggaggaggaggga

SEQ ID NO: 238106 - DNA, 16 bp, P. troglodytes
ctgggaggaggagttt

SEQ ID NO: 238107 - DNA, 16 bp, P. troglodytes
ctgggaggaggcagag

SEQ ID NO: 238108 - DNA, 17 bp, P. troglodytes
ctgggaggccgaggcgg

SEQ ID NO: 238109 - DNA, 16 bp, P. troglodytes
ctgggaggcctcagaa

SEQ ID NO: 238110 - DNA, 16 bp, P. troglodytes
ctgggaggcggagatt

SEQ ID NO: 238111 - DNA, 16 bp, P. troglodytes
ctgggagggagggaag

SEQ ID NO: 238112 - DNA, 16 bp, P. troglodytes
ctgggaggtccaggct

SEQ ID NO: 238113 - DNA, 16 bp, P. troglodytes
ctgggaggtggagatt

SEQ ID NO: 238114 - DNA, 16 bp, P. troglodytes
ctgggaggtggaggtc

SEQ ID NO: 238115 - DNA, 16 bp, P. troglodytes
ctgggaggttgtggct

SEQ ID NO: 238116 - DNA, 16 bp, P. troglodytes
ctgggagtggtggtac

SEQ ID NO: 238117 - DNA, 16 bp, P. troglodytes
ctgggagttccaggct

SEQ ID NO: 238118 - DNA, 16 bp, P. troglodytes
ctgggatcagaggcat

SEQ ID NO: 238119 - DNA, 16 bp, P. troglodytes
ctgggatcagctggga

SEQ ID NO: 238120 - DNA, 16 bp, P. troglodytes
ctgggatctgaaccca

SEQ ID NO: 238121 - DNA, 16 bp, P. troglodytes
ctgggatgacagatgc

SEQ ID NO: 238122 - DNA, 16 bp, P. troglodytes
ctgggatgctgaggtg

SEQ ID NO: 238123 - DNA, 16 bp, P. troglodytes
ctgggattaaaggcat

SEQ ID NO: 238124 - DNA, 16 bp, P. troglodytes
ctgggattacaaagtg

SEQ ID NO: 238125 - DNA, 16 bp, P. troglodytes
ctgggattacagacac

SEQ ID NO: 238126 - DNA, 20 bp, P. troglodytes
ctgggattacaggcatgagg

SEQ ID NO: 238127 - DNA, 18 bp, P. troglodytes
ctgggattacaggcgcct

SEQ ID NO: 238128 - DNA, 16 bp, P. troglodytes
ctgggattacagggag

SEQ ID NO: 238129 - DNA, 16 bp, P. troglodytes
ctgggattacagggcc

SEQ ID NO: 238130 - DNA, 16 bp, P. troglodytes
ctgggattacaggggc

SEQ ID NO: 238131 - DNA, 16 bp, P. troglodytes
ctgggattacaggtat

SEQ ID NO: 238132 - DNA, 16 bp, P. troglodytes
ctgggattacatatgt

SEQ ID NO: 238133 - DNA, 17 bp, P. troglodytes
ctgggattaccggcgtg

SEQ ID NO: 238134 - DNA, 16 bp, P. troglodytes
ctgggattatgggcac

SEQ ID NO: 238135 - DNA, 16 bp, P. troglodytes
ctgggattcaaacctg

SEQ ID NO: 238136 - DNA, 16 bp, P. troglodytes
ctgggattctgcattt

SEQ ID NO: 238137 - DNA, 16 bp, P. troglodytes
ctgggattctttttct

SEQ ID NO: 238138 - DNA, 16 bp, P. troglodytes
ctgggattgcaggaat

SEQ ID NO: 238139 - DNA, 24 bp, P. troglodytes
ctgggattgcaggcgtgagccact

SEQ ID NO: 238140 - DNA, 18 bp, P. troglodytes
ctgggattgcaggtgcac

SEQ ID NO: 238141 - DNA, 16 bp, P. troglodytes
ctgggattgtaagcat

SEQ ID NO: 238142 - DNA, 16 bp, P. troglodytes
ctgggatttgaaccct

SEQ ID NO: 238143 - DNA, 16 bp, P. troglodytes
ctgggattttccattt

SEQ ID NO: 238144 - DNA, 16 bp, P. troglodytes
ctgggattttgactgg

SEQ ID NO: 238145 - DNA, 16 bp, P. troglodytes
ctgggattttgattgg

SEQ ID NO: 238146 - DNA, 16 bp, P. troglodytes
ctgggcaaaatggtga

SEQ ID NO: 238147 - DNA, 16 bp, P. troglodytes
ctgggcaaagtggtga

SEQ ID NO: 238148 - DNA, 16 bp, P. troglodytes
ctgggcaacagaagga

SEQ ID NO: 238149 - DNA, 16 bp, P. troglodytes
ctgggcaacagagcaa

SEQ ID NO: 238150 - DNA, 16 bp, P. troglodytes
ctgggcaacagagtga

SEQ ID NO: 238151 - DNA, 16 bp, P. troglodytes
ctgggcaacagcaaga

SEQ ID NO: 238152 - DNA, 16 bp, P. troglodytes
ctgggcaacagggtga

SEQ ID NO: 238153 - DNA, 16 bp, P. troglodytes
ctgggcaacatagcaa

SEQ ID NO: 238154 - DNA, 16 bp, P. troglodytes
ctgggcaacatagtaa

SEQ ID NO: 238155 - DNA, 16 bp, P. troglodytes
ctgggcaaccccaggc

SEQ ID NO: 238156 - DNA, 16 bp, P. troglodytes
ctgggcaacgtggtga

SEQ ID NO: 238157 - DNA, 16 bp, P. troglodytes
ctgggcaacttggtga

SEQ ID NO: 238158 - DNA, 16 bp, P. troglodytes
ctgggcaagatgacaa

SEQ ID NO: 238159 - DNA, 16 bp, P. troglodytes
ctgggcaaggtgactc

SEQ ID NO: 238160 - DNA, 16 bp, P. troglodytes
ctgggcaaggtggcat

SEQ ID NO: 238161 - DNA, 16 bp, P. troglodytes
ctgggcaaggtggtgc

SEQ ID NO: 238162 - DNA, 16 bp, P. troglodytes
ctgggcaataagagca

SEQ ID NO: 238163 - DNA, 16 bp, P. troglodytes
ctgggcaatgaagtga

SEQ ID NO: 238164 - DNA, 16 bp, P. troglodytes
ctgggcaatggagtga

SEQ ID NO: 238165 - DNA, 16 bp, P. troglodytes
ctgggcaatgtaatga

SEQ ID NO: 238166 - DNA, 16 bp, P. troglodytes
ctgggcaatttttgta

SEQ ID NO: 238167 - DNA, 16 bp, P. troglodytes
ctgggcacagagccag

SEQ ID NO: 238168 - DNA, 16 bp, P. troglodytes
ctgggcacagcagctc

SEQ ID NO: 238169 - DNA, 16 bp, P. troglodytes
ctgggcacagtggcat

SEQ ID NO: 238170 - DNA, 16 bp, P. troglodytes
ctgggcacagtggctc

SEQ ID NO: 238171 - DNA, 16 bp, P. troglodytes
ctgggcaccagagcaa

SEQ ID NO: 238172 - DNA, 16 bp, P. troglodytes
ctgggcaccatggccc

SEQ ID NO: 238173 - DNA, 16 bp, P. troglodytes
ctgggcaccatggctt

SEQ ID NO: 238174 - DNA, 16 bp, P. troglodytes
ctgggcaccgtggagc

SEQ ID NO: 238175 - DNA, 16 bp, P. troglodytes
ctgggcaccttaagaa

SEQ ID NO: 238176 - DNA, 16 bp, P. troglodytes
ctgggcactgcagggt

SEQ ID NO: 238177 - DNA, 16 bp, P. troglodytes
ctgggcactgggaatg

SEQ ID NO: 238178 - DNA, 16 bp, P. troglodytes
ctgggcactgtggccc

SEQ ID NO: 238179 - DNA, 16 bp, P. troglodytes
ctgggcactgtggctt

SEQ ID NO: 238180 - DNA, 16 bp, P. troglodytes
ctgggcagaagggggc

SEQ ID NO: 238181 - DNA, 16 bp, P. troglodytes
ctgggcagaggcgccc

SEQ ID NO: 238182 - DNA, 16 bp, P. troglodytes
ctgggcagaggctgca

SEQ ID NO: 238183 - DNA, 16 bp, P. troglodytes
ctgggcagggctgggc

SEQ ID NO: 238184 - DNA, 16 bp, P. troglodytes
ctgggcaggggaaggg

SEQ ID NO: 238185 - DNA, 16 bp, P. troglodytes
ctgggcagggtggcag

SEQ ID NO: 238186 - DNA, 16 bp, P. troglodytes
ctgggcagtagtggca

SEQ ID NO: 238187 - DNA, 16 bp, P. troglodytes
ctgggcagtatggctt

SEQ ID NO: 238188 - DNA, 16 bp, P. troglodytes
ctgggcatcaagagtg

SEQ ID NO: 238189 - DNA, 16 bp, P. troglodytes
ctgggcatcatggtga

SEQ ID NO: 238190 - DNA, 16 bp, P. troglodytes
ctgggcatgatggtgg

SEQ ID NO: 238191 - DNA, 16 bp, P. troglodytes
ctgggcatgctggcag

SEQ ID NO: 238192 - DNA, 16 bp, P. troglodytes
ctgggcatgggggcgg

SEQ ID NO: 238193 - DNA, 16 bp, P. troglodytes
ctgggcatggtagtgg

SEQ ID NO: 238194 - DNA, 19 bp, P. troglodytes
ctgggcatggtggcaggca

SEQ ID NO: 238195 - DNA, 16 bp, P. troglodytes
ctgggcatggtggcat

SEQ ID NO: 238196 - DNA, 18 bp, P. troglodytes
ctgggcatggtggcgggc

SEQ ID NO: 238197 - DNA, 16 bp, P. troglodytes
ctgggcatgtctgtga

SEQ ID NO: 238198 - DNA, 16 bp, P. troglodytes
ctgggcattgtggtgg

SEQ ID NO: 238199 - DNA, 16 bp, P. troglodytes
ctgggccacacagcaa

SEQ ID NO: 238200 - DNA, 16 bp, P. troglodytes
ctgggccacagaacaa

SEQ ID NO: 238201 - DNA, 16 bp, P. troglodytes
ctgggccacatgcagc

SEQ ID NO: 238202 - DNA, 16 bp, P. troglodytes
ctgggccacatggtaa

SEQ ID NO: 238203 - DNA, 16 bp, P. troglodytes
ctgggccaccaggggt

SEQ ID NO: 238204 - DNA, 16 bp, P. troglodytes
ctgggccagcagctgc

SEQ ID NO: 238205 - DNA, 16 bp, P. troglodytes
ctgggccaggcatggt

SEQ ID NO: 238206 - DNA, 16 bp, P. troglodytes
ctgggccaggctgggg

SEQ ID NO: 238207 - DNA, 16 bp, P. troglodytes
ctgggccagggctggg

SEQ ID NO: 238208 - DNA, 16 bp, P. troglodytes
ctgggcccaagtgatt

SEQ ID NO: 238209 - DNA, 16 bp, P. troglodytes
ctgggcccagagacag

SEQ ID NO: 238210 - DNA, 16 bp, P. troglodytes
ctgggcccaggaggtc

SEQ ID NO: 238211 - DNA, 16 bp, P. troglodytes
ctgggcccaggagttt

SEQ ID NO: 238212 - DNA, 16 bp, P. troglodytes
ctgggcccagggtctc

SEQ ID NO: 238213 - DNA, 16 bp, P. troglodytes
ctgggccccacctcca

SEQ ID NO: 238214 - DNA, 16 bp, P. troglodytes
ctgggccccactccca

SEQ ID NO: 238215 - DNA, 16 bp, P. troglodytes
ctgggccctgcccaca

SEQ ID NO: 238216 - DNA, 16 bp, P. troglodytes
ctgggcctcaattttc

SEQ ID NO: 238217 - DNA, 16 bp, P. troglodytes
ctgggcctcactttcc

SEQ ID NO: 238218 - DNA, 16 bp, P. troglodytes
ctgggcctcagcctcc

SEQ ID NO: 238219 - DNA, 16 bp, P. troglodytes
ctgggcctcagcttcc

SEQ ID NO: 238220 - DNA, 16 bp, P. troglodytes
ctgggcctcagtttcc

SEQ ID NO: 238221 - DNA, 16 bp, P. troglodytes
ctgggcctccaggcct

SEQ ID NO: 238222 - DNA, 16 bp, P. troglodytes
ctgggcctccgtttcc

SEQ ID NO: 238223 - DNA, 16 bp, P. troglodytes
ctgggcctctcaaagt

SEQ ID NO: 238224 - DNA, 16 bp, P. troglodytes
ctgggcctgagcccct

SEQ ID NO: 238225 - DNA, 16 bp, P. troglodytes
ctgggcctggcccaca

SEQ ID NO: 238226 - DNA, 16 bp, P. troglodytes
ctgggcctggcccagg

SEQ ID NO: 238227 - DNA, 16 bp, P. troglodytes
ctgggcctggccctgg

SEQ ID NO: 238228 - DNA, 16 bp, P. troglodytes
ctgggcctgggccagg

SEQ ID NO: 238229 - DNA, 16 bp, P. troglodytes
ctgggcctgggcctgg

SEQ ID NO: 238230 - DNA, 16 bp, P. troglodytes
ctgggcctggggctgg

SEQ ID NO: 238231 - DNA, 16 bp, P. troglodytes
ctgggcctggtggcac

SEQ ID NO: 238232 - DNA, 16 bp, P. troglodytes
ctgggcctggtggcag

SEQ ID NO: 238233 - DNA, 16 bp, P. troglodytes
ctgggcctggtggcat

SEQ ID NO: 238234 - DNA, 16 bp, P. troglodytes
ctgggcctggtggtgt

SEQ ID NO: 238235 - DNA, 16 bp, P. troglodytes
ctgggcctgtggtggg

SEQ ID NO: 238236 - DNA, 16 bp, P. troglodytes
ctgggcctgttttctc

SEQ ID NO: 238237 - DNA, 17 bp, P. troglodytes
ctgggcgacagagagac

SEQ ID NO: 238238 - DNA, 16 bp, P. troglodytes
ctgggcgcagtggctg

SEQ ID NO: 238239 - DNA, 16 bp, P. troglodytes
ctgggcgccatggagc

SEQ ID NO: 238240 - DNA, 17 bp, P. troglodytes
ctgggcgccgtggctca

SEQ ID NO: 238241 - DNA, 19 bp, P. troglodytes
ctgggcgcggtggctcaca

SEQ ID NO: 238242 - DNA, 16 bp, P. troglodytes
ctgggcgtgctggtgc

SEQ ID NO: 238243 - DNA, 16 bp, P. troglodytes
ctgggcgtgctggtgg

SEQ ID NO: 238244 - DNA, 16 bp, P. troglodytes
ctgggcgtggtgctgg

SEQ ID NO: 238245 - DNA, 16 bp, P. troglodytes
ctgggcgtggtgttgt

SEQ ID NO: 238246 - DNA, 16 bp, P. troglodytes
ctgggctaaagcaatc

SEQ ID NO: 238247 - DNA, 16 bp, P. troglodytes
ctgggctcaaatgacc

SEQ ID NO: 238248 - DNA, 16 bp, P. troglodytes
ctgggctcaagagacc

SEQ ID NO: 238249 - DNA, 16 bp, P. troglodytes
ctgggctcacacctgt

SEQ ID NO: 238250 - DNA, 16 bp, P. troglodytes
ctgggctcactgcagg

SEQ ID NO: 238251 - DNA, 16 bp, P. troglodytes
ctgggctcagagccag

SEQ ID NO: 238252 - DNA, 16 bp, P. troglodytes
ctgggctcaggcagtc

SEQ ID NO: 238253 - DNA, 16 bp, P. troglodytes
ctgggctccaccccca

SEQ ID NO: 238254 - DNA, 16 bp, P. troglodytes
ctgggctccagccatc

SEQ ID NO: 238255 - DNA, 16 bp, P. troglodytes
ctgggctccagcctgg

SEQ ID NO: 238256 - DNA, 16 bp, P. troglodytes
ctgggctccgtggctc

SEQ ID NO: 238257 - DNA, 16 bp, P. troglodytes
ctgggctcctgcctca

SEQ ID NO: 238258 - DNA, 16 bp, P. troglodytes
ctgggctcctgggtct

SEQ ID NO: 238259 - DNA, 16 bp, P. troglodytes
ctgggctctggagcca

SEQ ID NO: 238260 - DNA, 16 bp, P. troglodytes
ctgggctctggcctct

SEQ ID NO: 238261 - DNA, 16 bp, P. troglodytes
ctgggctctgggctgg

SEQ ID NO: 238262 - DNA, 16 bp, P. troglodytes
ctgggctctgtggctc

SEQ ID NO: 238263 - DNA, 16 bp, P. troglodytes
ctgggctgaagtgatc

SEQ ID NO: 238264 - DNA, 16 bp, P. troglodytes
ctgggctgaggctgag

SEQ ID NO: 238265 - DNA, 16 bp, P. troglodytes
ctgggctgcaatgtgg

SEQ ID NO: 238266 - DNA, 16 bp, P. troglodytes
ctgggctgcattccca

SEQ ID NO: 238267 - DNA, 16 bp, P. troglodytes
ctgggctgcattctca

SEQ ID NO: 238268 - DNA, 16 bp, P. troglodytes
ctgggctggaagctct

SEQ ID NO: 238269 - DNA, 16 bp, P. troglodytes
ctgggctggacatggt

SEQ ID NO: 238270 - DNA, 16 bp, P. troglodytes
ctgggctggagagcag

SEQ ID NO: 238271 - DNA, 16 bp, P. troglodytes
ctgggctggagtgcac

SEQ ID NO: 238272 - DNA, 16 bp, P. troglodytes
ctgggctggagttcag

SEQ ID NO: 238273 - DNA, 16 bp, P. troglodytes
ctgggctggctgaggc

SEQ ID NO: 238274 - DNA, 16 bp, P. troglodytes
ctgggctgggaggcag

SEQ ID NO: 238275 - DNA, 16 bp, P. troglodytes
ctgggctgggccaggc

SEQ ID NO: 238276 - DNA, 16 bp, P. troglodytes
ctgggctgggcccagg

SEQ ID NO: 238277 - DNA, 16 bp, P. troglodytes
ctgggctgggctggac

SEQ ID NO: 238278 - DNA, 16 bp, P. troglodytes
ctgggctgggctggag

SEQ ID NO: 238279 - DNA, 16 bp, P. troglodytes
ctgggctggggcaggg

SEQ ID NO: 238280 - DNA, 16 bp, P. troglodytes
ctgggctggggcctgg

SEQ ID NO: 238281 - DNA, 16 bp, P. troglodytes
ctgggctggtgctggg

SEQ ID NO: 238282 - DNA, 16 bp, P. troglodytes
ctgggctggtggctca

SEQ ID NO: 238283 - DNA, 16 bp, P. troglodytes
ctgggctggttttgaa

SEQ ID NO: 238284 - DNA, 16 bp, P. troglodytes
ctgggcttcagtttcc

SEQ ID NO: 238285 - DNA, 16 bp, P. troglodytes
ctgggcttcagttttt

SEQ ID NO: 238286 - DNA, 16 bp, P. troglodytes
ctgggcttgagcagtc

SEQ ID NO: 238287 - DNA, 16 bp, P. troglodytes
ctgggcttggagccag

SEQ ID NO: 238288 - DNA, 16 bp, P. troglodytes
ctgggcttggccatgt

SEQ ID NO: 238289 - DNA, 16 bp, P. troglodytes
ctgggctttgaaggat

SEQ ID NO: 238290 - DNA, 16 bp, P. troglodytes
ctgggctttggtggaa

SEQ ID NO: 238291 - DNA, 16 bp, P. troglodytes
ctgggcttttctttgt

SEQ ID NO: 238292 - DNA, 16 bp, P. troglodytes
ctggggaaagaggctg

SEQ ID NO: 238293 - DNA, 16 bp, P. troglodytes
ctggggaacttttaaa

SEQ ID NO: 238294 - DNA, 16 bp, P. troglodytes
ctggggaaggagggaa

SEQ ID NO: 238295 - DNA, 16 bp, P. troglodytes
ctggggacacagagcc

SEQ ID NO: 238296 - DNA, 16 bp, P. troglodytes
ctggggacagggcagg

SEQ ID NO: 238297 - DNA, 16 bp, P. troglodytes
ctggggaccccaagag

SEQ ID NO: 238298 - DNA, 16 bp, P. troglodytes
ctggggactaccagag

SEQ ID NO: 238299 - DNA, 16 bp, P. troglodytes
ctggggagaagggaga

SEQ ID NO: 238300 - DNA, 16 bp, P. troglodytes
ctggggagagaagcag

SEQ ID NO: 238301 - DNA, 16 bp, P. troglodytes
ctggggagagagggga

SEQ ID NO: 238302 - DNA, 16 bp, P. troglodytes
ctggggagcagggagg

SEQ ID NO: 238303 - DNA, 16 bp, P. troglodytes
ctggggaggaggagga

SEQ ID NO: 238304 - DNA, 16 bp, P. troglodytes
ctggggaggcagagct

SEQ ID NO: 238305 - DNA, 16 bp, P. troglodytes
ctggggaggcagaggc

SEQ ID NO: 238306 - DNA, 16 bp, P. troglodytes
ctggggaggccacagg

SEQ ID NO: 238307 - DNA, 16 bp, P. troglodytes
ctggggaggccccaca

SEQ ID NO: 238308 - DNA, 16 bp, P. troglodytes
ctggggaggccccagg

SEQ ID NO: 238309 - DNA, 16 bp, P. troglodytes
ctggggaggcctcaag

SEQ ID NO: 238310 - DNA, 16 bp, P. troglodytes
ctggggaggcctcagg

SEQ ID NO: 238311 - DNA, 16 bp, P. troglodytes
ctggggaggcctcggg

SEQ ID NO: 238312 - DNA, 16 bp, P. troglodytes
ctggggaggctgagac

SEQ ID NO: 238313 - DNA, 16 bp, P. troglodytes
ctggggaggctgcagg

SEQ ID NO: 238314 - DNA, 16 bp, P. troglodytes
ctggggagggaagagg

SEQ ID NO: 238315 - DNA, 16 bp, P. troglodytes
ctggggagggagagca

SEQ ID NO: 238316 - DNA, 16 bp, P. troglodytes
ctggggagggcagagg

SEQ ID NO: 238317 - DNA, 16 bp, P. troglodytes
ctggggaggggagaag

SEQ ID NO: 238318 - DNA, 16 bp, P. troglodytes
ctggggaggggccagg

SEQ ID NO: 238319 - DNA, 16 bp, P. troglodytes
ctggggaggtcaaggc

SEQ ID NO: 238320 - DNA, 16 bp, P. troglodytes
ctggggaggtgtcagg

SEQ ID NO: 238321 - DNA, 16 bp, P. troglodytes
ctggggagtcatgccc

SEQ ID NO: 238322 - DNA, 16 bp, P. troglodytes
ctggggatagaaggaa

SEQ ID NO: 238323 - DNA, 16 bp, P. troglodytes
ctggggatcttgttaa

SEQ ID NO: 238324 - DNA, 16 bp, P. troglodytes
ctggggatggggccca

SEQ ID NO: 238325 - DNA, 16 bp, P. troglodytes
ctggggatggtggcac

SEQ ID NO: 238326 - DNA, 16 bp, P. troglodytes
ctggggattttttttt

SEQ ID NO: 238327 - DNA, 16 bp, P. troglodytes
ctggggcaacagagtg

SEQ ID NO: 238328 - DNA, 16 bp, P. troglodytes
ctggggcaatgttaat

SEQ ID NO: 238329 - DNA, 16 bp, P. troglodytes
ctggggcacagagaag

SEQ ID NO: 238330 - DNA, 16 bp, P. troglodytes
ctggggcagaaggatc

SEQ ID NO: 238331 - DNA, 16 bp, P. troglodytes
ctggggcagaggcagg

SEQ ID NO: 238332 - DNA, 16 bp, P. troglodytes
ctggggcaggagcagc

SEQ ID NO: 238333 - DNA, 16 bp, P. troglodytes
ctggggcaggaggaga

SEQ ID NO: 238334 - DNA, 16 bp, P. troglodytes
ctggggcaggaggagg

SEQ ID NO: 238335 - DNA, 16 bp, P. troglodytes
ctggggcaggaggatc

SEQ ID NO: 238336 - DNA, 16 bp, P. troglodytes
ctggggcaggaggatg

SEQ ID NO: 238337 - DNA, 16 bp, P. troglodytes
ctggggcaggcagggc

SEQ ID NO: 238338 - DNA, 16 bp, P. troglodytes
ctggggcagggcctgg

SEQ ID NO: 238339 - DNA, 16 bp, P. troglodytes
ctggggcagtgcagaa

SEQ ID NO: 238340 - DNA, 16 bp, P. troglodytes
ctggggccacaggtgg

SEQ ID NO: 238341 - DNA, 16 bp, P. troglodytes
ctggggccagcagggc

SEQ ID NO: 238342 - DNA, 16 bp, P. troglodytes
ctggggccaggctgcc

SEQ ID NO: 238343 - DNA, 16 bp, P. troglodytes
ctggggccaggctggg

SEQ ID NO: 238344 - DNA, 16 bp, P. troglodytes
ctggggccagggctgg

SEQ ID NO: 238345 - DNA, 16 bp, P. troglodytes
ctggggccaggtgcag

SEQ ID NO: 238346 - DNA, 16 bp, P. troglodytes
ctggggccccagcctg

SEQ ID NO: 238347 - DNA, 16 bp, P. troglodytes
ctggggcccttccctg

SEQ ID NO: 238348 - DNA, 16 bp, P. troglodytes
ctggggccggcagggc

SEQ ID NO: 238349 - DNA, 16 bp, P. troglodytes
ctggggcctggactcc

SEQ ID NO: 238350 - DNA, 16 bp, P. troglodytes
ctggggcctggctggg

SEQ ID NO: 238351 - DNA, 16 bp, P. troglodytes
ctggggcctggggcct

SEQ ID NO: 238352 - DNA, 16 bp, P. troglodytes
ctggggcctgtgtggg

SEQ ID NO: 238353 - DNA, 16 bp, P. troglodytes
ctggggctacaggtgc

SEQ ID NO: 238354 - DNA, 17 bp, P. troglodytes
ctggggctacaggtgcg

SEQ ID NO: 238355 - DNA, 16 bp, P. troglodytes
ctggggctcaagcaat

SEQ ID NO: 238356 - DNA, 16 bp, P. troglodytes
ctggggctcatgcctg

SEQ ID NO: 238357 - DNA, 16 bp, P. troglodytes
ctggggctgcaggtgc

SEQ ID NO: 238358 - DNA, 16 bp, P. troglodytes
ctggggctgcaggtgg

SEQ ID NO: 238359 - DNA, 16 bp, P. troglodytes
ctggggctgggagcag

SEQ ID NO: 238360 - DNA, 16 bp, P. troglodytes
ctggggctgggcacag

SEQ ID NO: 238361 - DNA, 16 bp, P. troglodytes
ctggggctgggcctgg

SEQ ID NO: 238362 - DNA, 16 bp, P. troglodytes
ctggggctggggaagg

SEQ ID NO: 238363 - DNA, 16 bp, P. troglodytes
ctggggctggggccag

SEQ ID NO: 238364 - DNA, 16 bp, P. troglodytes
ctggggctggggctgc

SEQ ID NO: 238365 - DNA, 16 bp, P. troglodytes
ctggggctgggggaag

SEQ ID NO: 238366 - DNA, 16 bp, P. troglodytes
ctggggctgggggcag

SEQ ID NO: 238367 - DNA, 16 bp, P. troglodytes
ctggggcttggtttcc

SEQ ID NO: 238368 - DNA, 16 bp, P. troglodytes
ctgggggaaaaaaaag

SEQ ID NO: 238369 - DNA, 16 bp, P. troglodytes
ctgggggacagagaaa

SEQ ID NO: 238370 - DNA, 16 bp, P. troglodytes
ctgggggacagagaga

SEQ ID NO: 238371 - DNA, 16 bp, P. troglodytes
ctgggggaggagagag

SEQ ID NO: 238372 - DNA, 16 bp, P. troglodytes
ctgggggagggacttg

SEQ ID NO: 238373 - DNA, 16 bp, P. troglodytes
ctgggggaggggtgcc

SEQ ID NO: 238374 - DNA, 16 bp, P. troglodytes
ctgggggcagggcaga

SEQ ID NO: 238375 - DNA, 16 bp, P. troglodytes
ctgggggcgctgcagg

SEQ ID NO: 238376 - DNA, 16 bp, P. troglodytes
ctgggggctccacccc

SEQ ID NO: 238377 - DNA, 16 bp, P. troglodytes
ctgggggctgggctgc

SEQ ID NO: 238378 - DNA, 16 bp, P. troglodytes
ctgggggctgtggctc

SEQ ID NO: 238379 - DNA, 16 bp, P. troglodytes
ctgggggtccactcca

SEQ ID NO: 238380 - DNA, 16 bp, P. troglodytes
ctgggggtcctggaac

SEQ ID NO: 238381 - DNA, 16 bp, P. troglodytes
ctgggggtgggtctct

SEQ ID NO: 238382 - DNA, 16 bp, P. troglodytes
ctgggggtggtggcat

SEQ ID NO: 238383 - DNA, 16 bp, P. troglodytes
ctggggtatttatcca

SEQ ID NO: 238384 - DNA, 16 bp, P. troglodytes
ctggggtggctgaggt

SEQ ID NO: 238385 - DNA, 16 bp, P. troglodytes
ctggggtggggactgg

SEQ ID NO: 238386 - DNA, 16 bp, P. troglodytes
ctggggttggggagag

SEQ ID NO: 238387 - DNA, 16 bp, P. troglodytes
ctgggtaacagagcca

SEQ ID NO: 238388 - DNA, 16 bp, P. troglodytes
ctgggtaattcataaa

SEQ ID NO: 238389 - DNA, 16 bp, P. troglodytes
ctgggtaatttataaa

SEQ ID NO: 238390 - DNA, 16 bp, P. troglodytes
ctgggtaatttctaaa

SEQ ID NO: 238391 - DNA, 16 bp, P. troglodytes
ctgggtaatttgtaga

SEQ ID NO: 238392 - DNA, 16 bp, P. troglodytes
ctgggtaatttttata

SEQ ID NO: 238393 - DNA, 16 bp, P. troglodytes
ctgggtagcaggcaga

SEQ ID NO: 238394 - DNA, 16 bp, P. troglodytes
ctgggtagctgggact

SEQ ID NO: 238395 - DNA, 16 bp, P. troglodytes
ctgggtagtttataaa

SEQ ID NO: 238396 - DNA, 16 bp, P. troglodytes
ctgggtatagaaggaa

SEQ ID NO: 238397 - DNA, 16 bp, P. troglodytes
ctgggtatattttgaa

SEQ ID NO: 238398 - DNA, 16 bp, P. troglodytes
ctgggtatggggcagg

SEQ ID NO: 238399 - DNA, 16 bp, P. troglodytes
ctgggtatgtctgtga

SEQ ID NO: 238400 - DNA, 20 bp, P. troglodytes
ctgggtattgtccaaggttt

SEQ ID NO: 238401 - DNA, 16 bp, P. troglodytes
ctgggtcaaatggtag

SEQ ID NO: 238402 - DNA, 19 bp, P. troglodytes
ctgggtcaaatggtatttc

SEQ ID NO: 238403 - DNA, 16 bp, P. troglodytes
ctgggtcaaatggtgt

SEQ ID NO: 238404 - DNA, 16 bp, P. troglodytes
ctgggtcagagacaaa

SEQ ID NO: 238405 - DNA, 16 bp, P. troglodytes
ctgggtcagaggggag

SEQ ID NO: 238406 - DNA, 16 bp, P. troglodytes
ctgggtcaggtgggga

SEQ ID NO: 238407 - DNA, 16 bp, P. troglodytes
ctgggtccagggcccc

SEQ ID NO: 238408 - DNA, 16 bp, P. troglodytes
ctgggtccctgaatca

SEQ ID NO: 238409 - DNA, 16 bp, P. troglodytes
ctgggtccctgccaca

SEQ ID NO: 238410 - DNA, 16 bp, P. troglodytes
ctgggtctcaccatgt

SEQ ID NO: 238411 - DNA, 16 bp, P. troglodytes
ctgggtctcagcttcc

SEQ ID NO: 238412 - DNA, 16 bp, P. troglodytes
ctgggtctgcagctgc

SEQ ID NO: 238413 - DNA, 16 bp, P. troglodytes
ctgggtcttctgtggt

SEQ ID NO: 238414 - DNA, 16 bp, P. troglodytes
ctgggtgacaagaatg

SEQ ID NO: 238415 - DNA, 16 bp, P. troglodytes
ctgggtgacaagggtg

SEQ ID NO: 238416 - DNA, 16 bp, P. troglodytes
ctgggtgacagaataa

SEQ ID NO: 238417 - DNA, 16 bp, P. troglodytes
ctgggtgacagagaag

SEQ ID NO: 238418 - DNA, 16 bp, P. troglodytes
ctgggtgacagagagt

SEQ ID NO: 238419 - DNA, 16 bp, P. troglodytes
ctgggtgacagagata

SEQ ID NO: 238420 - DNA, 16 bp, P. troglodytes
ctgggtgacagagcag

SEQ ID NO: 238421 - DNA, 16 bp, P. troglodytes
ctgggtgacagcacaa

SEQ ID NO: 238422 - DNA, 16 bp, P. troglodytes
ctgggtgacaggatga

SEQ ID NO: 238423 - DNA, 16 bp, P. troglodytes
ctgggtgacagtgaga

SEQ ID NO: 238424 - DNA, 16 bp, P. troglodytes
ctgggtgaccttgggc

SEQ ID NO: 238425 - DNA, 16 bp, P. troglodytes
ctgggtgaggtggcag

SEQ ID NO: 238426 - DNA, 16 bp, P. troglodytes
ctgggtgaggtggctc

SEQ ID NO: 238427 - DNA, 16 bp, P. troglodytes
ctgggtgaggtggtgg

SEQ ID NO: 238428 - DNA, 16 bp, P. troglodytes
ctgggtgatgctgatg

SEQ ID NO: 238429 - DNA, 16 bp, P. troglodytes
ctgggtgattcttctg

SEQ ID NO: 238430 - DNA, 16 bp, P. troglodytes
ctgggtgcccttaaca

SEQ ID NO: 238431 - DNA, 16 bp, P. troglodytes
ctgggtgcctcccaca

SEQ ID NO: 238432 - DNA, 17 bp, P. troglodytes
ctgggtgcggtgcctca

SEQ ID NO: 238433 - DNA, 16 bp, P. troglodytes
ctgggtgctgggggag

SEQ ID NO: 238434 - DNA, 16 bp, P. troglodytes
ctgggtggagcccact

SEQ ID NO: 238435 - DNA, 16 bp, P. troglodytes
ctgggtggttgaggct

SEQ ID NO: 238436 - DNA, 16 bp, P. troglodytes
ctgggtgtgctggcat

SEQ ID NO: 238437 - DNA, 16 bp, P. troglodytes
ctgggtgtgctggtgc

SEQ ID NO: 238438 - DNA, 16 bp, P. troglodytes
ctgggtgtggtggagc

SEQ ID NO: 238439 - DNA, 16 bp, P. troglodytes
ctgggtgtggtggcca

SEQ ID NO: 238440 - DNA, 16 bp, P. troglodytes
ctgggtgtggtggctt

SEQ ID NO: 238441 - DNA, 16 bp, P. troglodytes
ctgggtgtggtggtcc

SEQ ID NO: 238442 - DNA, 16 bp, P. troglodytes
ctgggttagggtctcc

SEQ ID NO: 238443 - DNA, 16 bp, P. troglodytes
ctgggttcaaatcctg

SEQ ID NO: 238444 - DNA, 16 bp, P. troglodytes
ctgggttcaaatcttg

SEQ ID NO: 238445 - DNA, 16 bp, P. troglodytes
ctgggttcaaattctg

SEQ ID NO: 238446 - DNA, 16 bp, P. troglodytes
ctgggttcaagagatc

SEQ ID NO: 238447 - DNA, 16 bp, P. troglodytes
ctgggttcaagcaatc

SEQ ID NO: 238448 - DNA, 16 bp, P. troglodytes
ctgggttcagtggctc

SEQ ID NO: 238449 - DNA, 16 bp, P. troglodytes
ctgggttctagtccca

SEQ ID NO: 238450 - DNA, 16 bp, P. troglodytes
ctgggttcttgtctca

SEQ ID NO: 238451 - DNA, 16 bp, P. troglodytes
ctgggtttaaatccca

SEQ ID NO: 238452 - DNA, 16 bp, P. troglodytes
ctgggtttcaccattt

SEQ ID NO: 238453 - DNA, 16 bp, P. troglodytes
ctgggtttccagcaca

SEQ ID NO: 238454 - DNA, 16 bp, P. troglodytes
ctgggtttgaatcctg

SEQ ID NO: 238455 - DNA, 16 bp, P. troglodytes
ctgggtttgaattctg

SEQ ID NO: 238456 - DNA, 16 bp, P. troglodytes
ctggtaaaaatacaaa

SEQ ID NO: 238457 - DNA, 21 bp, P. troglodytes
ctggtaagcaacttcagcaaa

SEQ ID NO: 238458 - DNA, 16 bp, P. troglodytes
ctggtaataaagacat

SEQ ID NO: 238459 - DNA, 16 bp, P. troglodytes
ctggtaccagtaccat

SEQ ID NO: 238460 - DNA, 16 bp, P. troglodytes
ctggtactacaggcac

SEQ ID NO: 238461 - DNA, 16 bp, P. troglodytes
ctggtactacaggcat

SEQ ID NO: 238462 - DNA, 16 bp, P. troglodytes
ctggtatgttgtatct

SEQ ID NO: 238463 - DNA, 16 bp, P. troglodytes
ctggtcaacagggtga

SEQ ID NO: 238464 - DNA, 16 bp, P. troglodytes
ctggtcaacatggtga

SEQ ID NO: 238465 - DNA, 16 bp, P. troglodytes
ctggtcacattttcat

SEQ ID NO: 238466 - DNA, 16 bp, P. troglodytes
ctggtcactggaaaga

SEQ ID NO: 238467 - DNA, 16 bp, P. troglodytes
ctggtcaggctggtct

SEQ ID NO: 238468 - DNA, 16 bp, P. troglodytes
ctggtccaagccacca

SEQ ID NO: 238469 - DNA, 16 bp, P. troglodytes
ctggtcccaagcattt

SEQ ID NO: 238470 - DNA, 16 bp, P. troglodytes
ctggtcctgagctttt

SEQ ID NO: 238471 - DNA, 16 bp, P. troglodytes
ctggtcctgtggcccc

SEQ ID NO: 238472 - DNA, 16 bp, P. troglodytes
ctggtctacaactcct

SEQ ID NO: 238473 - DNA, 16 bp, P. troglodytes
ctggtctattcaggga

SEQ ID NO: 238474 - DNA, 16 bp, P. troglodytes
ctggtctcaaactcca

SEQ ID NO: 238475 - DNA, 16 bp, P. troglodytes
ctggtctcaaactccc

SEQ ID NO: 238476 - DNA, 16 bp, P. troglodytes
ctggtctccaagtcct

SEQ ID NO: 238477 - DNA, 16 bp, P. troglodytes
ctggtctcctgagctc

SEQ ID NO: 238478 - DNA, 16 bp, P. troglodytes
ctggtctccttgcttc

SEQ ID NO: 238479 - DNA, 16 bp, P. troglodytes
ctggtctctctgcctc

SEQ ID NO: 238480 - DNA, 16 bp, P. troglodytes
ctggtctgcagttccc

SEQ ID NO: 238481 - DNA, 16 bp, P. troglodytes
ctggtctgcgggttgc

SEQ ID NO: 238482 - DNA, 16 bp, P. troglodytes
ctggtcttaaagtcct

SEQ ID NO: 238483 - DNA, 16 bp, P. troglodytes
ctggtcttcaactctt

SEQ ID NO: 238484 - DNA, 16 bp, P. troglodytes
ctggtcttgaactccc

SEQ ID NO: 238485 - DNA, 16 bp, P. troglodytes
ctggtcttgaactttt

SEQ ID NO: 238486 - DNA, 19 bp, P. troglodytes
ctggtgaaaccccatctct

SEQ ID NO: 238487 - DNA, 19 bp, P. troglodytes
ctggtgaaaccctatctct

SEQ ID NO: 238488 - DNA, 20 bp, P. troglodytes
ctggtgacagagcgagactc

SEQ ID NO: 238489 - DNA, 16 bp, P. troglodytes
ctggtgagaatgcaga

SEQ ID NO: 238490 - DNA, 16 bp, P. troglodytes
ctggtgaggcctcagg

SEQ ID NO: 238491 - DNA, 16 bp, P. troglodytes
ctggtgagggttctct

SEQ ID NO: 238492 - DNA, 17 bp, P. troglodytes
ctggtgatacccaggca

SEQ ID NO: 238493 - DNA, 16 bp, P. troglodytes
ctggtgatttttgcac

SEQ ID NO: 238494 - DNA, 16 bp, P. troglodytes
ctggtgcacaccacca

SEQ ID NO: 238495 - DNA, 16 bp, P. troglodytes
ctggtgcagagctgag

SEQ ID NO: 238496 - DNA, 16 bp, P. troglodytes
ctggtgcccaggctgg

SEQ ID NO: 238497 - DNA, 16 bp, P. troglodytes
ctggtgccctgatctt

SEQ ID NO: 238498 - DNA, 16 bp, P. troglodytes
ctggtgcctcagcctc

SEQ ID NO: 238499 - DNA, 16 bp, P. troglodytes
ctggtgcctgccacca

SEQ ID NO: 238500 - DNA, 16 bp, P. troglodytes
ctggtgctgctgctgc

SEQ ID NO: 238501 - DNA, 16 bp, P. troglodytes
ctggtgctttctgttt

SEQ ID NO: 238502 - DNA, 16 bp, P. troglodytes
ctggtggaaatgaaaa

SEQ ID NO: 238503 - DNA, 16 bp, P. troglodytes
ctggtggcaggtgcct

SEQ ID NO: 238504 - DNA, 16 bp, P. troglodytes
ctggtggcattgtgcc

SEQ ID NO: 238505 - DNA, 16 bp, P. troglodytes
ctggtggctgctggca

SEQ ID NO: 238506 - DNA, 16 bp, P. troglodytes
ctggtggctggcagcc

SEQ ID NO: 238507 - DNA, 16 bp, P. troglodytes
ctggtgggaatataaa

SEQ ID NO: 238508 - DNA, 16 bp, P. troglodytes
ctggtgggaatgtaaa

SEQ ID NO: 238509 - DNA, 16 bp, P. troglodytes
ctggtgggaggtgatg

SEQ ID NO: 238510 - DNA, 16 bp, P. troglodytes
ctggtggggaatgttg

SEQ ID NO: 238511 - DNA, 16 bp, P. troglodytes
ctggtgggtggtgatt

SEQ ID NO: 238512 - DNA, 16 bp, P. troglodytes
ctggtggtgcatgcct

SEQ ID NO: 238513 - DNA, 16 bp, P. troglodytes
ctggtggtggcagtgg

SEQ ID NO: 238514 - DNA, 16 bp, P. troglodytes
ctggtggtgggcgcct

SEQ ID NO: 238515 - DNA, 16 bp, P. troglodytes
ctggtgtgctgtattc

SEQ ID NO: 238516 - DNA, 16 bp, P. troglodytes
ctggtgttgataaaat

SEQ ID NO: 238517 - DNA, 16 bp, P. troglodytes
ctggttaaaaaacaaa

SEQ ID NO: 238518 - DNA, 16 bp, P. troglodytes
ctggttagaaatttct

SEQ ID NO: 238519 - DNA, 16 bp, P. troglodytes
ctggttattatgcaga

SEQ ID NO: 238520 - DNA, 16 bp, P. troglodytes
ctggttatttatttat

SEQ ID NO: 238521 - DNA, 16 bp, P. troglodytes
ctggttattttttgta

SEQ ID NO: 238522 - DNA, 16 bp, P. troglodytes
ctggttcaggccatga

SEQ ID NO: 238523 - DNA, 16 bp, P. troglodytes
ctggttccaggacctc

SEQ ID NO: 238524 - DNA, 16 bp, P. troglodytes
ctggttccatattttt

SEQ ID NO: 238525 - DNA, 16 bp, P. troglodytes
ctggttctcaggactt

SEQ ID NO: 238526 - DNA, 16 bp, P. troglodytes
ctggttctcaggcctt

SEQ ID NO: 238527 - DNA, 16 bp, P. troglodytes
ctggttctgatgcttg

SEQ ID NO: 238528 - DNA, 16 bp, P. troglodytes
ctggttctgttgccca

SEQ ID NO: 238529 - DNA, 16 bp, P. troglodytes
ctggttgtttaaaaga

SEQ ID NO: 238530 - DNA, 16 bp, P. troglodytes
ctggtttaagaaaatg

SEQ ID NO: 238531 - DNA, 23 bp, P. troglodytes
ctggtttattgagactagagaat

SEQ ID NO: 238532 - DNA, 16 bp, P. troglodytes
ctggtttcaaactgct

SEQ ID NO: 238533 - DNA, 16 bp, P. troglodytes
ctggtttcaagcgatt

SEQ ID NO: 238534 - DNA, 16 bp, P. troglodytes
ctggtttcgaactccc

SEQ ID NO: 238535 - DNA, 16 bp, P. troglodytes
ctggtttcttctcatt

SEQ ID NO: 238536 - DNA, 16 bp, P. troglodytes
ctggttttcaaagaga

SEQ ID NO: 238537 - DNA, 16 bp, P. troglodytes
ctggttttcctcctac

SEQ ID NO: 238538 - DNA, 16 bp, P. troglodytes
ctggttttgaaatcct

SEQ ID NO: 238539 - DNA, 16 bp, P. troglodytes
ctggttttgatatcaa

SEQ ID NO: 238540 - DNA, 16 bp, P. troglodytes
ctggttttgatctcct

SEQ ID NO: 238541 - DNA, 16 bp, P. troglodytes
ctggtttttctgctct

SEQ ID NO: 238542 - DNA, 16 bp, P. troglodytes
ctgtaaaaacaaaaac

SEQ ID NO: 238543 - DNA, 16 bp, P. troglodytes
ctgtaaaactacaaat

SEQ ID NO: 238544 - DNA, 16 bp, P. troglodytes
ctgtaaaactcctaga

SEQ ID NO: 238545 - DNA, 16 bp, P. troglodytes
ctgtaaaatgagaatt

SEQ ID NO: 238546 - DNA, 19 bp, P. troglodytes
ctgtaaaatgcaccaatca

SEQ ID NO: 238547 - DNA, 16 bp, P. troglodytes
ctgtaaaatggacaca

SEQ ID NO: 238548 - DNA, 16 bp, P. troglodytes
ctgtaaaatgggacca

SEQ ID NO: 238549 - DNA, 16 bp, P. troglodytes
ctgtaaaatggggaaa

SEQ ID NO: 238550 - DNA, 16 bp, P. troglodytes
ctgtaaaatggggatg

SEQ ID NO: 238551 - DNA, 16 bp, P. troglodytes
ctgtaaaatggtgata

SEQ ID NO: 238552 - DNA, 16 bp, P. troglodytes
ctgtaaactacttcaa

SEQ ID NO: 238553 - DNA, 16 bp, P. troglodytes
ctgtaaagaaaaataa

SEQ ID NO: 238554 - DNA, 16 bp, P. troglodytes
ctgtaaagtggggatg

SEQ ID NO: 238555 - DNA, 16 bp, P. troglodytes
ctgtaaataaagtttt

SEQ ID NO: 238556 - DNA, 16 bp, P. troglodytes
ctgtaaataatgctgc

SEQ ID NO: 238557 - DNA, 16 bp, P. troglodytes
ctgtaaatatttttta

SEQ ID NO: 238558 - DNA, 16 bp, P. troglodytes
ctgtaacaaaatacca

SEQ ID NO: 238559 - DNA, 16 bp, P. troglodytes
ctgtaaccattaagca

SEQ ID NO: 238560 - DNA, 16 bp, P. troglodytes
ctgtaaccccagcact

SEQ ID NO: 238561 - DNA, 17 bp, P. troglodytes
ctgtaaccccagctact

SEQ ID NO: 238562 - DNA, 17 bp, P. troglodytes
ctgtaaccctagctact

SEQ ID NO: 238563 - DNA, 16 bp, P. troglodytes
ctgtaagaaataaatt

SEQ ID NO: 238564 - DNA, 16 bp, P. troglodytes
ctgtaagtccaatgaa

SEQ ID NO: 238565 - DNA, 16 bp, P. troglodytes
ctgtaatatttttatt

SEQ ID NO: 238566 - DNA, 16 bp, P. troglodytes
ctgtaatcacagcatt

SEQ ID NO: 238567 - DNA, 16 bp, P. troglodytes
ctgtaatcccaacaca

SEQ ID NO: 238568 - DNA, 16 bp, P. troglodytes
ctgtaatcccaacacg

SEQ ID NO: 238569 - DNA, 16 bp, P. troglodytes
ctgtaatcccaacact

SEQ ID NO: 238570 - DNA, 16 bp, P. troglodytes
ctgtaatcccaacatg

SEQ ID NO: 238571 - DNA, 17 bp, P. troglodytes
ctgtaatcccaactact

SEQ ID NO: 238572 - DNA, 17 bp, P. troglodytes
ctgtaatcccacctact

SEQ ID NO: 238573 - DNA, 17 bp, P. troglodytes
ctgtaatcccagatact

SEQ ID NO: 238574 - DNA, 18 bp, P. troglodytes
ctgtaatcccagcactag

SEQ ID NO: 238575 - DNA, 16 bp, P. troglodytes
ctgtaatcccagcatg

SEQ ID NO: 238576 - DNA, 16 bp, P. troglodytes
ctgtaatcccagctaa

SEQ ID NO: 238577 - DNA, 17 bp, P. troglodytes
ctgtaatcccagctacc

SEQ ID NO: 238578 - DNA, 17 bp, P. troglodytes
ctgtaatcccagctact

SEQ ID NO: 238579 - DNA, 16 bp, P. troglodytes
ctgtaatcccagctat

SEQ ID NO: 238580 - DNA, 17 bp, P. troglodytes
ctgtaatcccagctcct

SEQ ID NO: 238581 - DNA, 17 bp, P. troglodytes
ctgtaatcccagctgct

SEQ ID NO: 238582 - DNA, 17 bp, P. troglodytes
ctgtaatcccaggtact

SEQ ID NO: 238583 - DNA, 17 bp, P. troglodytes
ctgtaatcccggctact

SEQ ID NO: 238584 - DNA, 17 bp, P. troglodytes
ctgtaatcctagctact

SEQ ID NO: 238585 - DNA, 16 bp, P. troglodytes
ctgtaatcctagctat

SEQ ID NO: 238586 - DNA, 16 bp, P. troglodytes
ctgtaatcctggctac

SEQ ID NO: 238587 - DNA, 17 bp, P. troglodytes
ctgtaatctcagctgct

SEQ ID NO: 238588 - DNA, 16 bp, P. troglodytes
ctgtaatctcagcttc

SEQ ID NO: 238589 - DNA, 17 bp, P. troglodytes
ctgtaatgccagctact

SEQ ID NO: 238590 - DNA, 16 bp, P. troglodytes
ctgtaattccagctgc

SEQ ID NO: 238591 - DNA, 16 bp, P. troglodytes
ctgtaattctaccact

SEQ ID NO: 238592 - DNA, 16 bp, P. troglodytes
ctgtaatttctttcag

SEQ ID NO: 238593 - DNA, 16 bp, P. troglodytes
ctgtaatttttttaaa

SEQ ID NO: 238594 - DNA, 16 bp, P. troglodytes
ctgtacaacaaatccc

SEQ ID NO: 238595 - DNA, 16 bp, P. troglodytes
ctgtacagcatgtgac

SEQ ID NO: 238596 - DNA, 16 bp, P. troglodytes
ctgtacccagcctatt

SEQ ID NO: 238597 - DNA, 16 bp, P. troglodytes
ctgtacccaggctgga

SEQ ID NO: 238598 - DNA, 16 bp, P. troglodytes
ctgtacccattaaaca

SEQ ID NO: 238599 - DNA, 16 bp, P. troglodytes
ctgtacccattaagca

SEQ ID NO: 238600 - DNA, 16 bp, P. troglodytes
ctgtacctggcctttt

SEQ ID NO: 238601 - DNA, 16 bp, P. troglodytes
ctgtactacagcctgg

SEQ ID NO: 238602 - DNA, 16 bp, P. troglodytes
ctgtactccagcctga

SEQ ID NO: 238603 - DNA, 16 bp, P. troglodytes
ctgtactgaaaatgaa

SEQ ID NO: 238604 - DNA, 16 bp, P. troglodytes
ctgtagaaaaggaaga

SEQ ID NO: 238605 - DNA, 16 bp, P. troglodytes
ctgtagaacactagaa

SEQ ID NO: 238606 - DNA, 16 bp, P. troglodytes
ctgtagaatggatgtt

SEQ ID NO: 238607 - DNA, 16 bp, P. troglodytes
ctgtagaccaaatgga

SEQ ID NO: 238608 - DNA, 16 bp, P. troglodytes
ctgtagactttataaa

SEQ ID NO: 238609 - DNA, 16 bp, P. troglodytes
ctgtagatttctttgg

SEQ ID NO: 238610 - DNA, 35 bp, P. troglodytes
ctgtagccttgtagtatagtttgaagtcaggtagt

SEQ ID NO: 238611 - DNA, 16 bp, P. troglodytes
ctgtagctcagtagct

SEQ ID NO: 238612 - DNA, 16 bp, P. troglodytes
ctgtaggcatcacatt

SEQ ID NO: 238613 - DNA, 17 bp, P. troglodytes
ctgtagtcacagctact

SEQ ID NO: 238614 - DNA, 16 bp, P. troglodytes
ctgtagtccaagctac

SEQ ID NO: 238615 - DNA, 16 bp, P. troglodytes
ctgtagtcccagccac

SEQ ID NO: 238616 - DNA, 16 bp, P. troglodytes
ctgtagtcccagctaa

SEQ ID NO: 238617 - DNA, 17 bp, P. troglodytes
ctgtagtcccagctact

SEQ ID NO: 238618 - DNA, 16 bp, P. troglodytes
ctgtagtcccagctag

SEQ ID NO: 238619 - DNA, 16 bp, P. troglodytes
ctgtagtcccagctat

SEQ ID NO: 238620 - DNA, 16 bp, P. troglodytes
ctgtagtcccatctac

SEQ ID NO: 238621 - DNA, 16 bp, P. troglodytes
ctgtagtccccactac

SEQ ID NO: 238622 - DNA, 16 bp, P. troglodytes
ctgtagtccccgctac

SEQ ID NO: 238623 - DNA, 16 bp, P. troglodytes
ctgtagtcctagctag

SEQ ID NO: 238624 - DNA, 16 bp, P. troglodytes
ctgtagtcctagctat

SEQ ID NO: 238625 - DNA, 17 bp, P. troglodytes
ctgtagtcgcagctact

SEQ ID NO: 238626 - DNA, 16 bp, P. troglodytes
ctgtagttccagctat

SEQ ID NO: 238627 - DNA, 16 bp, P. troglodytes
ctgtagttttgccttt

SEQ ID NO: 238628 - DNA, 16 bp, P. troglodytes
ctgtatagggtgtctg

SEQ ID NO: 238629 - DNA, 16 bp, P. troglodytes
ctgtatatactgtata

SEQ ID NO: 238630 - DNA, 16 bp, P. troglodytes
ctgtatatttcaaaat

SEQ ID NO: 238631 - DNA, 16 bp, P. troglodytes
ctgtatcaaaaacaaa

SEQ ID NO: 238632 - DNA, 16 bp, P. troglodytes
ctgtatcaaaaataaa

SEQ ID NO: 238633 - DNA, 16 bp, P. troglodytes
ctgtatccccagtgcc

SEQ ID NO: 238634 - DNA, 16 bp, P. troglodytes
ctgtatcccccaggct

SEQ ID NO: 238635 - DNA, 16 bp, P. troglodytes
ctgtatcctgagctct

SEQ ID NO: 238636 - DNA, 41 bp, P. troglodytes
ctgtatctagctgctctggtggggccttggagaacctgtgt

SEQ ID NO: 238637 - DNA, 16 bp, P. troglodytes
ctgtatcttttaagtg

SEQ ID NO: 238638 - DNA, 16 bp, P. troglodytes
ctgtatgaccttgggc

SEQ ID NO: 238639 - DNA, 16 bp, P. troglodytes
ctgtatgccaggcact

SEQ ID NO: 238640 - DNA, 16 bp, P. troglodytes
ctgtatggcctgcaga

SEQ ID NO: 238641 - DNA, 16 bp, P. troglodytes
ctgtatgtctgtcttt

SEQ ID NO: 238642 - DNA, 16 bp, P. troglodytes
ctgtatgtgtatgtat

SEQ ID NO: 238643 - DNA, 16 bp, P. troglodytes
ctgtatgtgtgtgtgt

SEQ ID NO: 238644 - DNA, 16 bp, P. troglodytes
ctgtattaaaaaaaaa

SEQ ID NO: 238645 - DNA, 16 bp, P. troglodytes
ctgtattattttttaa

SEQ ID NO: 238646 - DNA, 16 bp, P. troglodytes
ctgtattccatcctgg

SEQ ID NO: 238647 - DNA, 16 bp, P. troglodytes
ctgtattcccagctat

SEQ ID NO: 238648 - DNA, 16 bp, P. troglodytes
ctgtattccctgaatt

SEQ ID NO: 238649 - DNA, 16 bp, P. troglodytes
ctgtattctctccctt

SEQ ID NO: 238650 - DNA, 16 bp, P. troglodytes
ctgtattcttacaata

SEQ ID NO: 238651 - DNA, 16 bp, P. troglodytes
ctgtatttaaaatttt

SEQ ID NO: 238652 - DNA, 16 bp, P. troglodytes
ctgtatttacccaatg

SEQ ID NO: 238653 - DNA, 16 bp, P. troglodytes
ctgtatttgaagataa

SEQ ID NO: 238654 - DNA, 16 bp, P. troglodytes
ctgtattttcaaataa

SEQ ID NO: 238655 - DNA, 16 bp, P. troglodytes
ctgtattttgtgctga

SEQ ID NO: 238656 - DNA, 16 bp, P. troglodytes
ctgtatttttaaaaat

SEQ ID NO: 238657 - DNA, 16 bp, P. troglodytes
ctgtatttttactgta

SEQ ID NO: 238658 - DNA, 18 bp, P. troglodytes
ctgtatttttagtagaga

SEQ ID NO: 238659 - DNA, 16 bp, P. troglodytes
ctgtcaaaaacaaaaa

SEQ ID NO: 238660 - DNA, 16 bp, P. troglodytes
ctgtcaaaaagaaaga

SEQ ID NO: 238661 - DNA, 16 bp, P. troglodytes
ctgtcaaatggggata

SEQ ID NO: 238662 - DNA, 16 bp, P. troglodytes
ctgtcaaggtcattaa

SEQ ID NO: 238663 - DNA, 16 bp, P. troglodytes
ctgtcaatggagtatt

SEQ ID NO: 238664 - DNA, 16 bp, P. troglodytes
ctgtcaccaagctgga

SEQ ID NO: 238665 - DNA, 17 bp, P. troglodytes
ctgtcacccaagctgga

SEQ ID NO: 238666 - DNA, 16 bp, P. troglodytes
ctgtcacccaggagtg

SEQ ID NO: 238667 - DNA, 16 bp, P. troglodytes
ctgtcacccaggctac

SEQ ID NO: 238668 - DNA, 17 bp, P. troglodytes
ctgtcacccagtctgga

SEQ ID NO: 238669 - DNA, 16 bp, P. troglodytes
ctgtcacctgactcta

SEQ ID NO: 238670 - DNA, 16 bp, P. troglodytes
ctgtcactcaggctaa

SEQ ID NO: 238671 - DNA, 18 bp, P. troglodytes
ctgtcactcaggctggag

SEQ ID NO: 238672 - DNA, 16 bp, P. troglodytes
ctgtcactggggctgg

SEQ ID NO: 238673 - DNA, 16 bp, P. troglodytes
ctgtcactgtcttgaa

SEQ ID NO: 238674 - DNA, 16 bp, P. troglodytes
ctgtcactttaaaaaa

SEQ ID NO: 238675 - DNA, 16 bp, P. troglodytes
ctgtcagagtgaacag

SEQ ID NO: 238676 - DNA, 16 bp, P. troglodytes
ctgtcagcaggaagca

SEQ ID NO: 238677 - DNA, 16 bp, P. troglodytes
ctgtcagccaagctgg

SEQ ID NO: 238678 - DNA, 16 bp, P. troglodytes
ctgtcagccaggctgg

SEQ ID NO: 238679 - DNA, 16 bp, P. troglodytes
ctgtcagctctgaagg

SEQ ID NO: 238680 - DNA, 16 bp, P. troglodytes
ctgtcagctttttccc

SEQ ID NO: 238681 - DNA, 16 bp, P. troglodytes
ctgtcagtcaattaaa

SEQ ID NO: 238682 - DNA, 16 bp, P. troglodytes
ctgtcagtcttatgat

SEQ ID NO: 238683 - DNA, 16 bp, P. troglodytes
ctgtcatccagactgg

SEQ ID NO: 238684 - DNA, 16 bp, P. troglodytes
ctgtcatctcagctac

SEQ ID NO: 238685 - DNA, 16 bp, P. troglodytes
ctgtcatctcctataa

SEQ ID NO: 238686 - DNA, 16 bp, P. troglodytes
ctgtcattatgatggt

SEQ ID NO: 238687 - DNA, 16 bp, P. troglodytes
ctgtcattctgtcatt

SEQ ID NO: 238688 - DNA, 16 bp, P. troglodytes
ctgtcattgtctccca

SEQ ID NO: 238689 - DNA, 16 bp, P. troglodytes
ctgtcattttattaat

SEQ ID NO: 238690 - DNA, 16 bp, P. troglodytes
ctgtcattttcatttt

SEQ ID NO: 238691 - DNA, 16 bp, P. troglodytes
ctgtccaaaaaaaaaa

SEQ ID NO: 238692 - DNA, 16 bp, P. troglodytes
ctgtccaacatggcaa

SEQ ID NO: 238693 - DNA, 16 bp, P. troglodytes
ctgtccaggtttgtag

SEQ ID NO: 238694 - DNA, 16 bp, P. troglodytes
ctgtccagtgctgaaa

SEQ ID NO: 238695 - DNA, 16 bp, P. troglodytes
ctgtccatccatccac

SEQ ID NO: 238696 - DNA, 16 bp, P. troglodytes
ctgtccatgagcatgg

SEQ ID NO: 238697 - DNA, 16 bp, P. troglodytes
ctgtccatgtgttctc

SEQ ID NO: 238698 - DNA, 16 bp, P. troglodytes
ctgtccatttttgctt

SEQ ID NO: 238699 - DNA, 16 bp, P. troglodytes
ctgtcccagcctccca

SEQ ID NO: 238700 - DNA, 16 bp, P. troglodytes
ctgtcccagctactca

SEQ ID NO: 238701 - DNA, 16 bp, P. troglodytes
ctgtcccattggtctg

SEQ ID NO: 238702 - DNA, 16 bp, P. troglodytes
ctgtccccagccctgc

SEQ ID NO: 238703 - DNA, 16 bp, P. troglodytes
ctgtccccagggctgg

SEQ ID NO: 238704 - DNA, 16 bp, P. troglodytes
ctgtccccattaaaca

SEQ ID NO: 238705 - DNA, 16 bp, P. troglodytes
ctgtccccccaggctg

SEQ ID NO: 238706 - DNA, 16 bp, P. troglodytes
ctgtccccctggctgg

SEQ ID NO: 238707 - DNA, 16 bp, P. troglodytes
ctgtcccctctgcctg

SEQ ID NO: 238708 - DNA, 16 bp, P. troglodytes
ctgtccctctggagaa

SEQ ID NO: 238709 - DNA, 16 bp, P. troglodytes
ctgtccctctgtccct

SEQ ID NO: 238710 - DNA, 16 bp, P. troglodytes
ctgtccctgaagacct

SEQ ID NO: 238711 - DNA, 16 bp, P. troglodytes
ctgtccctgagcctct

SEQ ID NO: 238712 - DNA, 16 bp, P. troglodytes
ctgtccctgaggctgg

SEQ ID NO: 238713 - DNA, 16 bp, P. troglodytes
ctgtccctgtctctct

SEQ ID NO: 238714 - DNA, 16 bp, P. troglodytes
ctgtccctgtttgcag

SEQ ID NO: 238715 - DNA, 16 bp, P. troglodytes
ctgtcctaaaagagct

SEQ ID NO: 238716 - DNA, 16 bp, P. troglodytes
ctgtcctcaaggagct

SEQ ID NO: 238717 - DNA, 16 bp, P. troglodytes
ctgtcctccaggttca

SEQ ID NO: 238718 - DNA, 17 bp, P. troglodytes
ctgtcctctagacccca

SEQ ID NO: 238719 - DNA, 16 bp, P. troglodytes
ctgtcctctctgaacc

SEQ ID NO: 238720 - DNA, 16 bp, P. troglodytes
ctgtcctgcctcagcc

SEQ ID NO: 238721 - DNA, 16 bp, P. troglodytes
ctgtcctgcctggctc

SEQ ID NO: 238722 - DNA, 16 bp, P. troglodytes
ctgtcctgggcactgt

SEQ ID NO: 238723 - DNA, 16 bp, P. troglodytes
ctgtcctgtacattgt

SEQ ID NO: 238724 - DNA, 16 bp, P. troglodytes
ctgtcctgtcctgctc

SEQ ID NO: 238725 - DNA, 16 bp, P. troglodytes
ctgtccttaaaaaaaa

SEQ ID NO: 238726 - DNA, 16 bp, P. troglodytes
ctgtccttcttgagaa

SEQ ID NO: 238727 - DNA, 16 bp, P. troglodytes
ctgtcctttgtccaca

SEQ ID NO: 238728 - DNA, 16 bp, P. troglodytes
ctgtcgcccaggcggg

SEQ ID NO: 238729 - DNA, 16 bp, P. troglodytes
ctgtcgcccaggttgg

SEQ ID NO: 238730 - DNA, 16 bp, P. troglodytes
ctgtcgccctggctgg

SEQ ID NO: 238731 - DNA, 16 bp, P. troglodytes
ctgtctatgtcttgaa

SEQ ID NO: 238732 - DNA, 16 bp, P. troglodytes
ctgtctcaaaaaatta

SEQ ID NO: 238733 - DNA, 16 bp, P. troglodytes
ctgtctcaaaaatgaa

SEQ ID NO: 238734 - DNA, 16 bp, P. troglodytes
ctgtctcaaacacaca

SEQ ID NO: 238735 - DNA, 16 bp, P. troglodytes
ctgtctcaaagaaaaa

SEQ ID NO: 238736 - DNA, 16 bp, P. troglodytes
ctgtctcagaaagaaa

SEQ ID NO: 238737 - DNA, 16 bp, P. troglodytes
ctgtctcagaagaaaa

SEQ ID NO: 238738 - DNA, 16 bp, P. troglodytes
ctgtctcaggctggag

SEQ ID NO: 238739 - DNA, 16 bp, P. troglodytes
ctgtctcataaaaaat

SEQ ID NO: 238740 - DNA, 16 bp, P. troglodytes
ctgtctcatcctcctg

SEQ ID NO: 238741 - DNA, 16 bp, P. troglodytes
ctgtctcattttaatg

SEQ ID NO: 238742 - DNA, 16 bp, P. troglodytes
ctgtctccaaaataaa

SEQ ID NO: 238743 - DNA, 16 bp, P. troglodytes
ctgtctccagaaaaaa

SEQ ID NO: 238744 - DNA, 16 bp, P. troglodytes
ctgtctccaggctctg

SEQ ID NO: 238745 - DNA, 16 bp, P. troglodytes
ctgtctccatgagttt

SEQ ID NO: 238746 - DNA, 16 bp, P. troglodytes
ctgtctccctgtctct

SEQ ID NO: 238747 - DNA, 16 bp, P. troglodytes
ctgtctcctgctcatc

SEQ ID NO: 238748 - DNA, 16 bp, P. troglodytes
ctgtctcctgggttta

SEQ ID NO: 238749 - DNA, 16 bp, P. troglodytes
ctgtctccttggttca

SEQ ID NO: 238750 - DNA, 16 bp, P. troglodytes
ctgtctcgtggatctg

SEQ ID NO: 238751 - DNA, 16 bp, P. troglodytes
ctgtctctaaaaaaca

SEQ ID NO: 238752 - DNA, 16 bp, P. troglodytes
ctgtctctaaaaagag

SEQ ID NO: 238753 - DNA, 16 bp, P. troglodytes
ctgtctctacataaaa

SEQ ID NO: 238754 - DNA, 16 bp, P. troglodytes
ctgtctctactaaaac

SEQ ID NO: 238755 - DNA, 16 bp, P. troglodytes
ctgtctctactggaaa

SEQ ID NO: 238756 - DNA, 16 bp, P. troglodytes
ctgtctctacttaaaa

SEQ ID NO: 238757 - DNA, 16 bp, P. troglodytes
ctgtctctatggattt

SEQ ID NO: 238758 - DNA, 16 bp, P. troglodytes
ctgtctctattaaaaa

SEQ ID NO: 238759 - DNA, 16 bp, P. troglodytes
ctgtctctctcctgct

SEQ ID NO: 238760 - DNA, 16 bp, P. troglodytes
ctgtctctctgtctct

SEQ ID NO: 238761 - DNA, 16 bp, P. troglodytes
ctgtctctgaaaacaa

SEQ ID NO: 238762 - DNA, 16 bp, P. troglodytes
ctgtctctggtaattt

SEQ ID NO: 238763 - DNA, 16 bp, P. troglodytes
ctgtctctggtgcttt

SEQ ID NO: 238764 - DNA, 16 bp, P. troglodytes
ctgtctcttagaaaaa

SEQ ID NO: 238765 - DNA, 16 bp, P. troglodytes
ctgtctcttttaaaaa

SEQ ID NO: 238766 - DNA, 16 bp, P. troglodytes
ctgtctgaaaaaaaaa

SEQ ID NO: 238767 - DNA, 16 bp, P. troglodytes
ctgtctgagtgggagc

SEQ ID NO: 238768 - DNA, 16 bp, P. troglodytes
ctgtctgatctttgac

SEQ ID NO: 238769 - DNA, 16 bp, P. troglodytes
ctgtctgggagggagg

SEQ ID NO: 238770 - DNA, 16 bp, P. troglodytes
ctgtctgtactaaaat

SEQ ID NO: 238771 - DNA, 16 bp, P. troglodytes
ctgtctgtatggattt

SEQ ID NO: 238772 - DNA, 16 bp, P. troglodytes
ctgtctgtctctgtct

SEQ ID NO: 238773 - DNA, 16 bp, P. troglodytes
ctgtctgtctgtctct

SEQ ID NO: 238774 - DNA, 16 bp, P. troglodytes
ctgtctgtctgtgtct

SEQ ID NO: 238775 - DNA, 16 bp, P. troglodytes
ctgtcttaaaaacaac

SEQ ID NO: 238776 - DNA, 16 bp, P. troglodytes
ctgtcttagtcagctc

SEQ ID NO: 238777 - DNA, 16 bp, P. troglodytes
ctgtcttcaagaagct

SEQ ID NO: 238778 - DNA, 16 bp, P. troglodytes
ctgtcttccacaaatg

SEQ ID NO: 238779 - DNA, 16 bp, P. troglodytes
ctgtcttccagcctgg

SEQ ID NO: 238780 - DNA, 16 bp, P. troglodytes
ctgtcttcctcctgct

SEQ ID NO: 238781 - DNA, 16 bp, P. troglodytes
ctgtcttcctgccttc

SEQ ID NO: 238782 - DNA, 16 bp, P. troglodytes
ctgtcttcttctgatc

SEQ ID NO: 238783 - DNA, 16 bp, P. troglodytes
ctgtcttcttgcactg

SEQ ID NO: 238784 - DNA, 16 bp, P. troglodytes
ctgtcttctttcactt

SEQ ID NO: 238785 - DNA, 16 bp, P. troglodytes
ctgtctttaaaaaaaa

SEQ ID NO: 238786 - DNA, 16 bp, P. troglodytes
ctgtctttcacagtgg

SEQ ID NO: 238787 - DNA, 16 bp, P. troglodytes
ctgtctttgtctctgt

SEQ ID NO: 238788 - DNA, 16 bp, P. troglodytes
ctgtcttttatattta

SEQ ID NO: 238789 - DNA, 16 bp, P. troglodytes
ctgtcttttccccatt

SEQ ID NO: 238790 - DNA, 16 bp, P. troglodytes
ctgtcttttctccatt

SEQ ID NO: 238791 - DNA, 16 bp, P. troglodytes
ctgtctttttaatgat

SEQ ID NO: 238792 - DNA, 16 bp, P. troglodytes
ctgtgaaaaataaatg

SEQ ID NO: 238793 - DNA, 16 bp, P. troglodytes
ctgtgaaaaatacaaa

SEQ ID NO: 238794 - DNA, 16 bp, P. troglodytes
ctgtgaaaacactttg

SEQ ID NO: 238795 - DNA, 16 bp, P. troglodytes
ctgtgaaaagaaaata

SEQ ID NO: 238796 - DNA, 16 bp, P. troglodytes
ctgtgaaacagctttg

SEQ ID NO: 238797 - DNA, 16 bp, P. troglodytes
ctgtgaaagcaggaac

SEQ ID NO: 238798 - DNA, 16 bp, P. troglodytes
ctgtgaaatgaatgaa

SEQ ID NO: 238799 - DNA, 16 bp, P. troglodytes
ctgtgaacagccactg

SEQ ID NO: 238800 - DNA, 16 bp, P. troglodytes
ctgtgaacatgggtgt

SEQ ID NO: 238801 - DNA, 16 bp, P. troglodytes
ctgtgaagaaaagtca

SEQ ID NO: 238802 - DNA, 16 bp, P. troglodytes
ctgtgaagaaaataaa

SEQ ID NO: 238803 - DNA, 16 bp, P. troglodytes
ctgtgaagaagctttt

SEQ ID NO: 238804 - DNA, 16 bp, P. troglodytes
ctgtgaagaataatgg

SEQ ID NO: 238805 - DNA, 16 bp, P. troglodytes
ctgtgaagaatgtaaa

SEQ ID NO: 238806 - DNA, 16 bp, P. troglodytes
ctgtgaagaatttcat

SEQ ID NO: 238807 - DNA, 16 bp, P. troglodytes
ctgtgaagactataat

SEQ ID NO: 238808 - DNA, 16 bp, P. troglodytes
ctgtgaaggtctctga

SEQ ID NO: 238809 - DNA, 16 bp, P. troglodytes
ctgtgaaggtgttttt

SEQ ID NO: 238810 - DNA, 16 bp, P. troglodytes
ctgtgaatagccactg

SEQ ID NO: 238811 - DNA, 16 bp, P. troglodytes
ctgtgaatatgttact

SEQ ID NO: 238812 - DNA, 16 bp, P. troglodytes
ctgtgaatatgttatg

SEQ ID NO: 238813 - DNA, 20 bp, P. troglodytes
ctgtgaatccgtctggtcct

SEQ ID NO: 238814 - DNA, 16 bp, P. troglodytes
ctgtgaattgtctttt

SEQ ID NO: 238815 - DNA, 16 bp, P. troglodytes
ctgtgaattttccaaa

SEQ ID NO: 238816 - DNA, 16 bp, P. troglodytes
ctgtgacaaaattcaa

SEQ ID NO: 238817 - DNA, 16 bp, P. troglodytes
ctgtgacatgtgttta

SEQ ID NO: 238818 - DNA, 16 bp, P. troglodytes
ctgtgaccccagctac

SEQ ID NO: 238819 - DNA, 16 bp, P. troglodytes
ctgtgacctgcaggta

SEQ ID NO: 238820 - DNA, 16 bp, P. troglodytes
ctgtgaccttgctgaa

SEQ ID NO: 238821 - DNA, 16 bp, P. troglodytes
ctgtgaccttgggtaa

SEQ ID NO: 238822 - DNA, 16 bp, P. troglodytes
ctgtgactcttgcaga

SEQ ID NO: 238823 - DNA, 16 bp, P. troglodytes
ctgtgacttgcttcta

SEQ ID NO: 238824 - DNA, 16 bp, P. troglodytes
ctgtgactttggacaa

SEQ ID NO: 238825 - DNA, 16 bp, P. troglodytes
ctgtgagaagatggcc

SEQ ID NO: 238826 - DNA, 16 bp, P. troglodytes
ctgtgagagaataaat

SEQ ID NO: 238827 - DNA, 16 bp, P. troglodytes
ctgtgagccaaataca

SEQ ID NO: 238828 - DNA, 16 bp, P. troglodytes
ctgtgagccaaggaat

SEQ ID NO: 238829 - DNA, 16 bp, P. troglodytes
ctgtgagccatgatca

SEQ ID NO: 238830 - DNA, 16 bp, P. troglodytes
ctgtgagcctcaattt

SEQ ID NO: 238831 - DNA, 16 bp, P. troglodytes
ctgtgagctccttgag

SEQ ID NO: 238832 - DNA, 16 bp, P. troglodytes
ctgtgagctgaactgc

SEQ ID NO: 238833 - DNA, 16 bp, P. troglodytes
ctgtgagctgcactgc

SEQ ID NO: 238834 - DNA, 16 bp, P. troglodytes
ctgtgagctgtgattg

SEQ ID NO: 238835 - DNA, 16 bp, P. troglodytes
ctgtgaggaaaaaaaa

SEQ ID NO: 238836 - DNA, 16 bp, P. troglodytes
ctgtgaggctgtggct

SEQ ID NO: 238837 - DNA, 16 bp, P. troglodytes
ctgtgaggtgaatcca

SEQ ID NO: 238838 - DNA, 16 bp, P. troglodytes
ctgtgaggttgaggct

SEQ ID NO: 238839 - DNA, 16 bp, P. troglodytes
ctgtgagtcccctgat

SEQ ID NO: 238840 - DNA, 16 bp, P. troglodytes
ctgtgagtgtaaaata

SEQ ID NO: 238841 - DNA, 16 bp, P. troglodytes
ctgtgagtgtgtgtgt

SEQ ID NO: 238842 - DNA, 16 bp, P. troglodytes
ctgtgatcagtgattt

SEQ ID NO: 238843 - DNA, 16 bp, P. troglodytes
ctgtgatccaggctgg

SEQ ID NO: 238844 - DNA, 16 bp, P. troglodytes
ctgtgatcccaccact

SEQ ID NO: 238845 - DNA, 16 bp, P. troglodytes
ctgtgatcccagtgct

SEQ ID NO: 238846 - DNA, 16 bp, P. troglodytes
ctgtgatcccagttac

SEQ ID NO: 238847 - DNA, 16 bp, P. troglodytes
ctgtgatcttaccact

SEQ ID NO: 238848 - DNA, 16 bp, P. troglodytes
ctgtgatgatagaaat

SEQ ID NO: 238849 - DNA, 16 bp, P. troglodytes
ctgtgatggccagtga

SEQ ID NO: 238850 - DNA, 16 bp, P. troglodytes
ctgtgattccagctac

SEQ ID NO: 238851 - DNA, 16 bp, P. troglodytes
ctgtgattgaaccact

SEQ ID NO: 238852 - DNA, 16 bp, P. troglodytes
ctgtgattttgactac

SEQ ID NO: 238853 - DNA, 16 bp, P. troglodytes
ctgtgcaaccttgggc

SEQ ID NO: 238854 - DNA, 16 bp, P. troglodytes
ctgtgcaagaagcatg

SEQ ID NO: 238855 - DNA, 16 bp, P. troglodytes
ctgtgcaccaggcact

SEQ ID NO: 238856 - DNA, 16 bp, P. troglodytes
ctgtgcactccttatg

SEQ ID NO: 238857 - DNA, 16 bp, P. troglodytes
ctgtgcactgtaggat

SEQ ID NO: 238858 - DNA, 16 bp, P. troglodytes
ctgtgcagaagatttt

SEQ ID NO: 238859 - DNA, 16 bp, P. troglodytes
ctgtgcagatgctctt

SEQ ID NO: 238860 - DNA, 16 bp, P. troglodytes
ctgtgcagattctcag

SEQ ID NO: 238861 - DNA, 16 bp, P. troglodytes
ctgtgcagcctcagga

SEQ ID NO: 238862 - DNA, 16 bp, P. troglodytes
ctgtgcagcctctgga

SEQ ID NO: 238863 - DNA, 16 bp, P. troglodytes
ctgtgcagctgcaagg

SEQ ID NO: 238864 - DNA, 16 bp, P. troglodytes
ctgtgcaggaccccac

SEQ ID NO: 238865 - DNA, 16 bp, P. troglodytes
ctgtgcagtagctttt

SEQ ID NO: 238866 - DNA, 16 bp, P. troglodytes
ctgtgcatggtggcac

SEQ ID NO: 238867 - DNA, 16 bp, P. troglodytes
ctgtgcattgcaggat

SEQ ID NO: 238868 - DNA, 16 bp, P. troglodytes
ctgtgcattgtaagat

SEQ ID NO: 238869 - DNA, 16 bp, P. troglodytes
ctgtgcattgtaggat

SEQ ID NO: 238870 - DNA, 16 bp, P. troglodytes
ctgtgccaggcactgt

SEQ ID NO: 238871 - DNA, 16 bp, P. troglodytes
ctgtgccaggccctgg

SEQ ID NO: 238872 - DNA, 16 bp, P. troglodytes
ctgtgcccagccaacc

SEQ ID NO: 238873 - DNA, 16 bp, P. troglodytes
ctgtgcccagccaagg

SEQ ID NO: 238874 - DNA, 16 bp, P. troglodytes
ctgtgcccagccacag

SEQ ID NO: 238875 - DNA, 16 bp, P. troglodytes
ctgtgcccagccacat

SEQ ID NO: 238876 - DNA, 16 bp, P. troglodytes
ctgtgcccagccactg

SEQ ID NO: 238877 - DNA, 16 bp, P. troglodytes
ctgtgcccagccagcc

SEQ ID NO: 238878 - DNA, 16 bp, P. troglodytes
ctgtgcccagccagga

SEQ ID NO: 238879 - DNA, 16 bp, P. troglodytes
ctgtgcccagcccaga

SEQ ID NO: 238880 - DNA, 16 bp, P. troglodytes
ctgtgcccagccccac

SEQ ID NO: 238881 - DNA, 16 bp, P. troglodytes
ctgtgcccagccccag

SEQ ID NO: 238882 - DNA, 16 bp, P. troglodytes
ctgtgcccagcccctg

SEQ ID NO: 238883 - DNA, 16 bp, P. troglodytes
ctgtgcccagccctaa

SEQ ID NO: 238884 - DNA, 16 bp, P. troglodytes
ctgtgcccagccctct

SEQ ID NO: 238885 - DNA, 16 bp, P. troglodytes
ctgtgcccagccctga

SEQ ID NO: 238886 - DNA, 16 bp, P. troglodytes
ctgtgcccagccctgc

SEQ ID NO: 238887 - DNA, 16 bp, P. troglodytes
ctgtgcccagcctaca

SEQ ID NO: 238888 - DNA, 16 bp, P. troglodytes
ctgtgcccagcctcct

SEQ ID NO: 238889 - DNA, 16 bp, P. troglodytes
ctgtgcccagcctctt

SEQ ID NO: 238890 - DNA, 16 bp, P. troglodytes
ctgtgcccagcctgat

SEQ ID NO: 238891 - DNA, 16 bp, P. troglodytes
ctgtgcccagcctgca

SEQ ID NO: 238892 - DNA, 16 bp, P. troglodytes
ctgtgcccagcctgga

SEQ ID NO: 238893 - DNA, 16 bp, P. troglodytes
ctgtgcccagcctgtg

SEQ ID NO: 238894 - DNA, 16 bp, P. troglodytes
ctgtgcccatggacct

SEQ ID NO: 238895 - DNA, 16 bp, P. troglodytes
ctgtgcccggccaaaa

SEQ ID NO: 238896 - DNA, 16 bp, P. troglodytes
ctgtgcccggcctcag

SEQ ID NO: 238897 - DNA, 16 bp, P. troglodytes
ctgtgcccggccttca

SEQ ID NO: 238898 - DNA, 16 bp, P. troglodytes
ctgtgccctctgcctg

SEQ ID NO: 238899 - DNA, 16 bp, P. troglodytes
ctgtgccctgtcccca

SEQ ID NO: 238900 - DNA, 16 bp, P. troglodytes
ctgtgcctcagcctcc

SEQ ID NO: 238901 - DNA, 16 bp, P. troglodytes
ctgtgcctcagttccc

SEQ ID NO: 238902 - DNA, 16 bp, P. troglodytes
ctgtgcctcagtttcc

SEQ ID NO: 238903 - DNA, 16 bp, P. troglodytes
ctgtgcctcctgggct

SEQ ID NO: 238904 - DNA, 16 bp, P. troglodytes
ctgtgcctcctgtccc

SEQ ID NO: 238905 - DNA, 16 bp, P. troglodytes
ctgtgcctggccaacc

SEQ ID NO: 238906 - DNA, 16 bp, P. troglodytes
ctgtgcctggccaggc

SEQ ID NO: 238907 - DNA, 16 bp, P. troglodytes
ctgtgcctggccagtg

SEQ ID NO: 238908 - DNA, 16 bp, P. troglodytes
ctgtgcctggccattg

SEQ ID NO: 238909 - DNA, 16 bp, P. troglodytes
ctgtgcctggccccag

SEQ ID NO: 238910 - DNA, 16 bp, P. troglodytes
ctgtgcctggccccca

SEQ ID NO: 238911 - DNA, 16 bp, P. troglodytes
ctgtgcctggcccctg

SEQ ID NO: 238912 - DNA, 16 bp, P. troglodytes
ctgtgcctggcccctt

SEQ ID NO: 238913 - DNA, 16 bp, P. troglodytes
ctgtgcctggccctgt

SEQ ID NO: 238914 - DNA, 16 bp, P. troglodytes
ctgtgcctggcctctt

SEQ ID NO: 238915 - DNA, 16 bp, P. troglodytes
ctgtgcctggcctgcc

SEQ ID NO: 238916 - DNA, 16 bp, P. troglodytes
ctgtgcctggctgttt

SEQ ID NO: 238917 - DNA, 16 bp, P. troglodytes
ctgtgccttggtttcc

SEQ ID NO: 238918 - DNA, 16 bp, P. troglodytes
ctgtgccttggtttct

SEQ ID NO: 238919 - DNA, 16 bp, P. troglodytes
ctgtgcgacagagtga

SEQ ID NO: 238920 - DNA, 16 bp, P. troglodytes
ctgtgctaggtgctga

SEQ ID NO: 238921 - DNA, 16 bp, P. troglodytes
ctgtgctctacaaatg

SEQ ID NO: 238922 - DNA, 16 bp, P. troglodytes
ctgtgctgcctgaggc

SEQ ID NO: 238923 - DNA, 16 bp, P. troglodytes
ctgtgctgctgccatc

SEQ ID NO: 238924 - DNA, 16 bp, P. troglodytes
ctgtgctggatgcttt

SEQ ID NO: 238925 - DNA, 16 bp, P. troglodytes
ctgtgctggccaggct

SEQ ID NO: 238926 - DNA, 16 bp, P. troglodytes
ctgtgctgggctctgg

SEQ ID NO: 238927 - DNA, 16 bp, P. troglodytes
ctgtgctgtgctgggg

SEQ ID NO: 238928 - DNA, 16 bp, P. troglodytes
ctgtgctgtgtgcagt

SEQ ID NO: 238929 - DNA, 16 bp, P. troglodytes
ctgtggaaaacacttt

SEQ ID NO: 238930 - DNA, 16 bp, P. troglodytes
ctgtggaaaatgacat

SEQ ID NO: 238931 - DNA, 17 bp, P. troglodytes
ctgtggaagacagtgtg

SEQ ID NO: 238932 - DNA, 16 bp, P. troglodytes
ctgtggaatgcagttt

SEQ ID NO: 238933 - DNA, 16 bp, P. troglodytes
ctgtggactcgccctg

SEQ ID NO: 238934 - DNA, 16 bp, P. troglodytes
ctgtggagaaaaggga

SEQ ID NO: 238935 - DNA, 16 bp, P. troglodytes
ctgtggagatatttaa

SEQ ID NO: 238936 - DNA, 16 bp, P. troglodytes
ctgtggaggagggatt

SEQ ID NO: 238937 - DNA, 16 bp, P. troglodytes
ctgtggaggaggtgga

SEQ ID NO: 238938 - DNA, 16 bp, P. troglodytes
ctgtggataaggggga

SEQ ID NO: 238939 - DNA, 16 bp, P. troglodytes
ctgtggatggacactt

SEQ ID NO: 238940 - DNA, 16 bp, P. troglodytes
ctgtggattgtctttt

SEQ ID NO: 238941 - DNA, 16 bp, P. troglodytes
ctgtggccaccactac

SEQ ID NO: 238942 - DNA, 16 bp, P. troglodytes
ctgtggccaccagcac

SEQ ID NO: 238943 - DNA, 16 bp, P. troglodytes
ctgtggcccagccaag

SEQ ID NO: 238944 - DNA, 16 bp, P. troglodytes
ctgtggcccaggcggg

SEQ ID NO: 238945 - DNA, 16 bp, P. troglodytes
ctgtggcccaggctga

SEQ ID NO: 238946 - DNA, 16 bp, P. troglodytes
ctgtggcccaggctgt

SEQ ID NO: 238947 - DNA, 16 bp, P. troglodytes
ctgtggcccccaccca

SEQ ID NO: 238948 - DNA, 16 bp, P. troglodytes
ctgtggccctggctgg

SEQ ID NO: 238949 - DNA, 16 bp, P. troglodytes
ctgtggcctccccaga

SEQ ID NO: 238950 - DNA, 16 bp, P. troglodytes
ctgtggcctctgcctc

SEQ ID NO: 238951 - DNA, 16 bp, P. troglodytes
ctgtggcctgggctgg

SEQ ID NO: 238952 - DNA, 16 bp, P. troglodytes
ctgtggctcacgcctg

SEQ ID NO: 238953 - DNA, 16 bp, P. troglodytes
ctgtggctcatgcctg

SEQ ID NO: 238954 - DNA, 16 bp, P. troglodytes
ctgtggctctgcagag

SEQ ID NO: 238955 - DNA, 16 bp, P. troglodytes
ctgtggctgctgtaac

SEQ ID NO: 238956 - DNA, 16 bp, P. troglodytes
ctgtggctgggtgcag

SEQ ID NO: 238957 - DNA, 16 bp, P. troglodytes
ctgtggctgtggctgt

SEQ ID NO: 238958 - DNA, 16 bp, P. troglodytes
ctgtggcttgtcttct

SEQ ID NO: 238959 - DNA, 16 bp, P. troglodytes
ctgtggctttgcaggt

SEQ ID NO: 238960 - DNA, 16 bp, P. troglodytes
ctgtggcttttccaga

SEQ ID NO: 238961 - DNA, 16 bp, P. troglodytes
ctgtgggaccctgggc

SEQ ID NO: 238962 - DNA, 16 bp, P. troglodytes
ctgtgggagaccaagg

SEQ ID NO: 238963 - DNA, 16 bp, P. troglodytes
ctgtgggagcccagag

SEQ ID NO: 238964 - DNA, 16 bp, P. troglodytes
ctgtgggaggccaggg

SEQ ID NO: 238965 - DNA, 16 bp, P. troglodytes
ctgtgggaggcctagg

SEQ ID NO: 238966 - DNA, 16 bp, P. troglodytes
ctgtgggatgtaaatt

SEQ ID NO: 238967 - DNA, 16 bp, P. troglodytes
ctgtgggcacagcttc

SEQ ID NO: 238968 - DNA, 16 bp, P. troglodytes
ctgtgggccatagttt

SEQ ID NO: 238969 - DNA, 16 bp, P. troglodytes
ctgtgggctgggcaca

SEQ ID NO: 238970 - DNA, 16 bp, P. troglodytes
ctgtgggctgtagttt

SEQ ID NO: 238971 - DNA, 16 bp, P. troglodytes
ctgtgggcttttcata

SEQ ID NO: 238972 - DNA, 16 bp, P. troglodytes
ctgtggggaaaaaaaa

SEQ ID NO: 238973 - DNA, 16 bp, P. troglodytes
ctgtggggagggcagg

SEQ ID NO: 238974 - DNA, 16 bp, P. troglodytes
ctgtggggctggtccc

SEQ ID NO: 238975 - DNA, 16 bp, P. troglodytes
ctgtgggtttctcata

SEQ ID NO: 238976 - DNA, 16 bp, P. troglodytes
ctgtggtaccagctac

SEQ ID NO: 238977 - DNA, 16 bp, P. troglodytes
ctgtggtcatgccact

SEQ ID NO: 238978 - DNA, 16 bp, P. troglodytes
ctgtggtcccagctac

SEQ ID NO: 238979 - DNA, 16 bp, P. troglodytes
ctgtggtcccagctat

SEQ ID NO: 238980 - DNA, 16 bp, P. troglodytes
ctgtggtgagctgtga

SEQ ID NO: 238981 - DNA, 16 bp, P. troglodytes
ctgtggtgcagtggca

SEQ ID NO: 238982 - DNA, 16 bp, P. troglodytes
ctgtggtggtgcacac

SEQ ID NO: 238983 - DNA, 16 bp, P. troglodytes
ctgtggtgtatatgta

SEQ ID NO: 238984 - DNA, 16 bp, P. troglodytes
ctgtggtgtgtgcctg

SEQ ID NO: 238985 - DNA, 16 bp, P. troglodytes
ctgtggttcacgcctg

SEQ ID NO: 238986 - DNA, 16 bp, P. troglodytes
ctgtggttctgcaggg

SEQ ID NO: 238987 - DNA, 16 bp, P. troglodytes
ctgtggtttctttcag

SEQ ID NO: 238988 - DNA, 16 bp, P. troglodytes
ctgtggttttaattta

SEQ ID NO: 238989 - DNA, 16 bp, P. troglodytes
ctgtggttttcagctc

SEQ ID NO: 238990 - DNA, 16 bp, P. troglodytes
ctgtgtaacaaattac

SEQ ID NO: 238991 - DNA, 16 bp, P. troglodytes
ctgtgtaatttacaaa

SEQ ID NO: 238992 - DNA, 16 bp, P. troglodytes
ctgtgtacacacacac

SEQ ID NO: 238993 - DNA, 16 bp, P. troglodytes
ctgtgtacctggaaaa

SEQ ID NO: 238994 - DNA, 16 bp, P. troglodytes
ctgtgtatctgtgtat

SEQ ID NO: 238995 - DNA, 16 bp, P. troglodytes
ctgtgtatgtgtatat

SEQ ID NO: 238996 - DNA, 16 bp, P. troglodytes
ctgtgtatgtgtatgt

SEQ ID NO: 238997 - DNA, 16 bp, P. troglodytes
ctgtgtattttcaaat

SEQ ID NO: 238998 - DNA, 16 bp, P. troglodytes
ctgtgtcacaggtgtg

SEQ ID NO: 238999 - DNA, 16 bp, P. troglodytes
ctgtgtcacgcaggct

SEQ ID NO: 239000 - DNA, 16 bp, P. troglodytes
ctgtgtcatgggtcat

SEQ ID NO: 239001 - DNA, 16 bp, P. troglodytes
ctgtgtccaaaaaaaa

SEQ ID NO: 239002 - DNA, 16 bp, P. troglodytes
ctgtgtccaaatttcc

SEQ ID NO: 239003 - DNA, 16 bp, P. troglodytes
ctgtgtccagatgttg

SEQ ID NO: 239004 - DNA, 16 bp, P. troglodytes
ctgtgtccagtctact

SEQ ID NO: 239005 - DNA, 16 bp, P. troglodytes
ctgtgtccatgtgatc

SEQ ID NO: 239006 - DNA, 16 bp, P. troglodytes
ctgtgtccatgtgttc

SEQ ID NO: 239007 - DNA, 16 bp, P. troglodytes
ctgtgtcccaggcact

SEQ ID NO: 239008 - DNA, 16 bp, P. troglodytes
ctgtgtcccctcaaaa

SEQ ID NO: 239009 - DNA, 16 bp, P. troglodytes
ctgtgtcctcacatgg

SEQ ID NO: 239010 - DNA, 16 bp, P. troglodytes
ctgtgtcctcaggtgg

SEQ ID NO: 239011 - DNA, 16 bp, P. troglodytes
ctgtgtcctgccccca

SEQ ID NO: 239012 - DNA, 16 bp, P. troglodytes
ctgtgtcgcccaggct

SEQ ID NO: 239013 - DNA, 16 bp, P. troglodytes
ctgtgtctactgaaaa

SEQ ID NO: 239014 - DNA, 16 bp, P. troglodytes
ctgtgtctagatttat

SEQ ID NO: 239015 - DNA, 16 bp, P. troglodytes
ctgtgtctcaggaatg

SEQ ID NO: 239016 - DNA, 16 bp, P. troglodytes
ctgtgtctctgtctgt

SEQ ID NO: 239017 - DNA, 16 bp, P. troglodytes
ctgtgtctgtgtctgt

SEQ ID NO: 239018 - DNA, 16 bp, P. troglodytes
ctgtgtctgtgtgtgt

SEQ ID NO: 239019 - DNA, 16 bp, P. troglodytes
ctgtgtcttttaatta

SEQ ID NO: 239020 - DNA, 16 bp, P. troglodytes
ctgtgtcttttcatgg

SEQ ID NO: 239021 - DNA, 16 bp, P. troglodytes
ctgtgtgacagaatga

SEQ ID NO: 239022 - DNA, 16 bp, P. troglodytes
ctgtgtgacctcaggc

SEQ ID NO: 239023 - DNA, 16 bp, P. troglodytes
ctgtgtgacctggagc

SEQ ID NO: 239024 - DNA, 16 bp, P. troglodytes
ctgtgtgacctggttc

SEQ ID NO: 239025 - DNA, 16 bp, P. troglodytes
ctgtgtgaccttgaac

SEQ ID NO: 239026 - DNA, 16 bp, P. troglodytes
ctgtgtgaccttgggc

SEQ ID NO: 239027 - DNA, 16 bp, P. troglodytes
ctgtgtgaccttgggg

SEQ ID NO: 239028 - DNA, 16 bp, P. troglodytes
ctgtgtgaccttgggt

SEQ ID NO: 239029 - DNA, 16 bp, P. troglodytes
ctgtgtgacttgggca

SEQ ID NO: 239030 - DNA, 16 bp, P. troglodytes
ctgtgtgactttggaa

SEQ ID NO: 239031 - DNA, 16 bp, P. troglodytes
ctgtgtgactttgggc

SEQ ID NO: 239032 - DNA, 16 bp, P. troglodytes
ctgtgtgaggtgtctg

SEQ ID NO: 239033 - DNA, 16 bp, P. troglodytes
ctgtgtgatctctgca

SEQ ID NO: 239034 - DNA, 16 bp, P. troglodytes
ctgtgtgatgctgagg

SEQ ID NO: 239035 - DNA, 16 bp, P. troglodytes
ctgtgtgcagagtccc

SEQ ID NO: 239036 - DNA, 16 bp, P. troglodytes
ctgtgtgccaagcact

SEQ ID NO: 239037 - DNA, 16 bp, P. troglodytes
ctgtgtgccagacatt

SEQ ID NO: 239038 - DNA, 16 bp, P. troglodytes
ctgtgtgccaggcaat

SEQ ID NO: 239039 - DNA, 16 bp, P. troglodytes
ctgtgtgccaggcaca

SEQ ID NO: 239040 - DNA, 16 bp, P. troglodytes
ctgtgtgccaggcact

SEQ ID NO: 239041 - DNA, 16 bp, P. troglodytes
ctgtgtgccaggcgct

SEQ ID NO: 239042 - DNA, 16 bp, P. troglodytes
ctgtgtgcccagcacc

SEQ ID NO: 239043 - DNA, 16 bp, P. troglodytes
ctgtgtgcccaggaag

SEQ ID NO: 239044 - DNA, 16 bp, P. troglodytes
ctgtgtgcctcagttt

SEQ ID NO: 239045 - DNA, 16 bp, P. troglodytes
ctgtgtgcctggcact

SEQ ID NO: 239046 - DNA, 16 bp, P. troglodytes
ctgtgtgctgaagagg

SEQ ID NO: 239047 - DNA, 16 bp, P. troglodytes
ctgtgtggaaagaagt

SEQ ID NO: 239048 - DNA, 16 bp, P. troglodytes
ctgtgtggaacctggg

SEQ ID NO: 239049 - DNA, 16 bp, P. troglodytes
ctgtgtggacatcctt

SEQ ID NO: 239050 - DNA, 16 bp, P. troglodytes
ctgtgtggaggctcca

SEQ ID NO: 239051 - DNA, 16 bp, P. troglodytes
ctgtgtggcccagttc

SEQ ID NO: 239052 - DNA, 16 bp, P. troglodytes
ctgtgtggccctgggc

SEQ ID NO: 239053 - DNA, 16 bp, P. troglodytes
ctgtgtggccctgttc

SEQ ID NO: 239054 - DNA, 16 bp, P. troglodytes
ctgtgtggtcctgggc

SEQ ID NO: 239055 - DNA, 16 bp, P. troglodytes
ctgtgtgtcagacact

SEQ ID NO: 239056 - DNA, 16 bp, P. troglodytes
ctgtgtgtcagactga

SEQ ID NO: 239057 - DNA, 16 bp, P. troglodytes
ctgtgtgtgactgtgt

SEQ ID NO: 239058 - DNA, 16 bp, P. troglodytes
ctgtgtgtgcctctgt

SEQ ID NO: 239059 - DNA, 16 bp, P. troglodytes
ctgtgtgtgcctgagc

SEQ ID NO: 239060 - DNA, 16 bp, P. troglodytes
ctgtgtgtgtctgtga

SEQ ID NO: 239061 - DNA, 16 bp, P. troglodytes
ctgtgtgtgtctgtgt

SEQ ID NO: 239062 - DNA, 16 bp, P. troglodytes
ctgtgtgtgtgcatgc

SEQ ID NO: 239063 - DNA, 16 bp, P. troglodytes
ctgtgtgtgtgcgtgt

SEQ ID NO: 239064 - DNA, 16 bp, P. troglodytes
ctgtgtgtgtgtatat

SEQ ID NO: 239065 - DNA, 16 bp, P. troglodytes
ctgtgtgtgtgtgcat

SEQ ID NO: 239066 - DNA, 16 bp, P. troglodytes
ctgtgtgtgtgtgtat

SEQ ID NO: 239067 - DNA, 16 bp, P. troglodytes
ctgtgtgttcttgggc

SEQ ID NO: 239068 - DNA, 16 bp, P. troglodytes
ctgtgttaagtcatgg

SEQ ID NO: 239069 - DNA, 16 bp, P. troglodytes
ctgtgttccaagaaaa

SEQ ID NO: 239070 - DNA, 16 bp, P. troglodytes
ctgtgttctcacatgg

SEQ ID NO: 239071 - DNA, 16 bp, P. troglodytes
ctgtgttctgagagac

SEQ ID NO: 239072 - DNA, 16 bp, P. troglodytes
ctgtgttgaatagaag

SEQ ID NO: 239073 - DNA, 16 bp, P. troglodytes
ctgtgttgcccaagct

SEQ ID NO: 239074 - DNA, 16 bp, P. troglodytes
ctgtgttggctgggct

SEQ ID NO: 239075 - DNA, 16 bp, P. troglodytes
ctgtgttgtccaggct

SEQ ID NO: 239076 - DNA, 16 bp, P. troglodytes
ctgtgtttcaataaaa

SEQ ID NO: 239077 - DNA, 16 bp, P. troglodytes
ctgtgttttaacaaac

SEQ ID NO: 239078 - DNA, 16 bp, P. troglodytes
ctgtgttttaacaagt

SEQ ID NO: 239079 - DNA, 16 bp, P. troglodytes
ctgtgttttcttctgg

SEQ ID NO: 239080 - DNA, 16 bp, P. troglodytes
ctgtgtttttaaattt

SEQ ID NO: 239081 - DNA, 16 bp, P. troglodytes
ctgtgttttttaaaaa

SEQ ID NO: 239082 - DNA, 16 bp, P. troglodytes
ctgtgttttttaattg

SEQ ID NO: 239083 - DNA, 16 bp, P. troglodytes
ctgttaaaatgaaaat

SEQ ID NO: 239084 - DNA, 16 bp, P. troglodytes
ctgttaacattttgat

SEQ ID NO: 239085 - DNA, 16 bp, P. troglodytes
ctgttaatatggtgta

SEQ ID NO: 239086 - DNA, 16 bp, P. troglodytes
ctgttaattactgcct

SEQ ID NO: 239087 - DNA, 16 bp, P. troglodytes
ctgttacaaaagaaaa

SEQ ID NO: 239088 - DNA, 16 bp, P. troglodytes
ctgttacaaatgaaaa

SEQ ID NO: 239089 - DNA, 16 bp, P. troglodytes
ctgttacccacgctgg

SEQ ID NO: 239090 - DNA, 16 bp, P. troglodytes
ctgttactggagaatt

SEQ ID NO: 239091 - DNA, 21 bp, P. troglodytes
ctgttagaaggaaaactaaca

SEQ ID NO: 239092 - DNA, 16 bp, P. troglodytes
ctgttagcaattttca

SEQ ID NO: 239093 - DNA, 16 bp, P. troglodytes
ctgttagtaggaatgt

SEQ ID NO: 239094 - DNA, 19 bp, P. troglodytes
ctgttagtctgatgggctt

SEQ ID NO: 239095 - DNA, 16 bp, P. troglodytes
ctgttatagcagcaaa

SEQ ID NO: 239096 - DNA, 16 bp, P. troglodytes
ctgttatcccagcaat

SEQ ID NO: 239097 - DNA, 16 bp, P. troglodytes
ctgttatcccaggact

SEQ ID NO: 239098 - DNA, 18 bp, P. troglodytes
ctgttatcctgttctttt

SEQ ID NO: 239099 - DNA, 16 bp, P. troglodytes
ctgttattaaaaaaaa

SEQ ID NO: 239100 - DNA, 16 bp, P. troglodytes
ctgttattaaaaagaa

SEQ ID NO: 239101 - DNA, 16 bp, P. troglodytes
ctgttattatctccat

SEQ ID NO: 239102 - DNA, 16 bp, P. troglodytes
ctgttattattattgt

SEQ ID NO: 239103 - DNA, 16 bp, P. troglodytes
ctgttatttaagatgt

SEQ ID NO: 239104 - DNA, 16 bp, P. troglodytes
ctgttatttttgactt

SEQ ID NO: 239105 - DNA, 16 bp, P. troglodytes
ctgttcaagttaaact

SEQ ID NO: 239106 - DNA, 16 bp, P. troglodytes
ctgttcacccaggctg

SEQ ID NO: 239107 - DNA, 16 bp, P. troglodytes
ctgttcagaaaaaaaa

SEQ ID NO: 239108 - DNA, 16 bp, P. troglodytes
ctgttcatatggataa

SEQ ID NO: 239109 - DNA, 16 bp, P. troglodytes
ctgttcatctcctttg

SEQ ID NO: 239110 - DNA, 16 bp, P. troglodytes
ctgttcatgtcctctg

SEQ ID NO: 239111 - DNA, 16 bp, P. troglodytes
ctgttcattcattcat

SEQ ID NO: 239112 - DNA, 16 bp, P. troglodytes
ctgttcatttttttcc

SEQ ID NO: 239113 - DNA, 16 bp, P. troglodytes
ctgttccagtctctgc

SEQ ID NO: 239114 - DNA, 16 bp, P. troglodytes
ctgttcccatttttat

SEQ ID NO: 239115 - DNA, 16 bp, P. troglodytes
ctgttccccctgcctg

SEQ ID NO: 239116 - DNA, 16 bp, P. troglodytes
ctgttcctctgcctgg

SEQ ID NO: 239117 - DNA, 16 bp, P. troglodytes
ctgttcctgcattcat

SEQ ID NO: 239118 - DNA, 16 bp, P. troglodytes
ctgttcctgtgatagt

SEQ ID NO: 239119 - DNA, 16 bp, P. troglodytes
ctgttccttctgcctg

SEQ ID NO: 239120 - DNA, 16 bp, P. troglodytes
ctgttctaagtgcctt

SEQ ID NO: 239121 - DNA, 16 bp, P. troglodytes
ctgttctaggtactgg

SEQ ID NO: 239122 - DNA, 16 bp, P. troglodytes
ctgttctaggtgctgg

SEQ ID NO: 239123 - DNA, 16 bp, P. troglodytes
ctgttctcatactgct

SEQ ID NO: 239124 - DNA, 16 bp, P. troglodytes
ctgttctcatgctgcc

SEQ ID NO: 239125 - DNA, 16 bp, P. troglodytes
ctgttctccaagctgg

SEQ ID NO: 239126 - DNA, 16 bp, P. troglodytes
ctgttctccatagtgg

SEQ ID NO: 239127 - DNA, 16 bp, P. troglodytes
ctgttctctctgaagc

SEQ ID NO: 239128 - DNA, 16 bp, P. troglodytes
ctgttctctctgcctg

SEQ ID NO: 239129 - DNA, 16 bp, P. troglodytes
ctgttctgcagcatcc

SEQ ID NO: 239130 - DNA, 16 bp, P. troglodytes
ctgttctttctgcctg

SEQ ID NO: 239131 - DNA, 16 bp, P. troglodytes
ctgttcttttgcattt

SEQ ID NO: 239132 - DNA, 16 bp, P. troglodytes
ctgttgaaggacatct

SEQ ID NO: 239133 - DNA, 16 bp, P. troglodytes
ctgttgaatgaatgaa

SEQ ID NO: 239134 - DNA, 16 bp, P. troglodytes
ctgttgagcacttgaa

SEQ ID NO: 239135 - DNA, 16 bp, P. troglodytes
ctgttgatgagcattt

SEQ ID NO: 239136 - DNA, 16 bp, P. troglodytes
ctgttgatggacattt

SEQ ID NO: 239137 - DNA, 16 bp, P. troglodytes
ctgttgatgggaatgc

SEQ ID NO: 239138 - DNA, 16 bp, P. troglodytes
ctgttgccatggaaac

SEQ ID NO: 239139 - DNA, 23 bp, P. troglodytes
ctgttgcccaagctggagtgcaa

SEQ ID NO: 239140 - DNA, 16 bp, P. troglodytes
ctgttgcccagcctgg

SEQ ID NO: 239141 - DNA, 16 bp, P. troglodytes
ctgttgcccaggcaac

SEQ ID NO: 239142 - DNA, 17 bp, P. troglodytes
ctgttgcccaggctggt

SEQ ID NO: 239143 - DNA, 16 bp, P. troglodytes
ctgttgcccaggctgt

SEQ ID NO: 239144 - DNA, 16 bp, P. troglodytes
ctgttgcctgggctgg

SEQ ID NO: 239145 - DNA, 16 bp, P. troglodytes
ctgttgctcaataaaa

SEQ ID NO: 239146 - DNA, 16 bp, P. troglodytes
ctgttgctcctaggct

SEQ ID NO: 239147 - DNA, 16 bp, P. troglodytes
ctgttgctttggggtg

SEQ ID NO: 239148 - DNA, 16 bp, P. troglodytes
ctgttggcccaggctg

SEQ ID NO: 239149 - DNA, 16 bp, P. troglodytes
ctgttggcctcaagca

SEQ ID NO: 239150 - DNA, 16 bp, P. troglodytes
ctgttggctcattctg

SEQ ID NO: 239151 - DNA, 16 bp, P. troglodytes
ctgttgggattacagg

SEQ ID NO: 239152 - DNA, 16 bp, P. troglodytes
ctgttggtggactctc

SEQ ID NO: 239153 - DNA, 16 bp, P. troglodytes
ctgttggtggcaatgt

SEQ ID NO: 239154 - DNA, 16 bp, P. troglodytes
ctgttggttagaagca

SEQ ID NO: 239155 - DNA, 16 bp, P. troglodytes
ctgttgtgaacagtgc

SEQ ID NO: 239156 - DNA, 16 bp, P. troglodytes
ctgttgtgaggtgggg

SEQ ID NO: 239157 - DNA, 16 bp, P. troglodytes
ctgttgttgctgctgt

SEQ ID NO: 239158 - DNA, 16 bp, P. troglodytes
ctgttgttggtgtata

SEQ ID NO: 239159 - DNA, 16 bp, P. troglodytes
ctgttgttgttttgag

SEQ ID NO: 239160 - DNA, 26 bp, P. troglodytes
ctgttgtttcctgactttttaatgat

SEQ ID NO: 239161 - DNA, 16 bp, P. troglodytes
ctgtttaaaagaaaaa

SEQ ID NO: 239162 - DNA, 16 bp, P. troglodytes
ctgtttaacaaagcac

SEQ ID NO: 239163 - DNA, 16 bp, P. troglodytes
ctgtttacattcaagg

SEQ ID NO: 239164 - DNA, 16 bp, P. troglodytes
ctgtttatatggtgta

SEQ ID NO: 239165 - DNA, 16 bp, P. troglodytes
ctgtttattctaatta

SEQ ID NO: 239166 - DNA, 16 bp, P. troglodytes
ctgtttatttttaaat

SEQ ID NO: 239167 - DNA, 16 bp, P. troglodytes
ctgtttcaaaaacaaa

SEQ ID NO: 239168 - DNA, 16 bp, P. troglodytes
ctgtttcagcctctgc

SEQ ID NO: 239169 - DNA, 16 bp, P. troglodytes
ctgtttccacactgct

SEQ ID NO: 239170 - DNA, 16 bp, P. troglodytes
ctgtttccatggaaac

SEQ ID NO: 239171 - DNA, 16 bp, P. troglodytes
ctgtttcccaggctgg

SEQ ID NO: 239172 - DNA, 16 bp, P. troglodytes
ctgtttcccatcaccc

SEQ ID NO: 239173 - DNA, 16 bp, P. troglodytes
ctgtttcctaggctgg

SEQ ID NO: 239174 - DNA, 16 bp, P. troglodytes
ctgtttcctcatcagt

SEQ ID NO: 239175 - DNA, 16 bp, P. troglodytes
ctgtttcctgggctgg

SEQ ID NO: 239176 - DNA, 16 bp, P. troglodytes
ctgtttctaaaaaaaa

SEQ ID NO: 239177 - DNA, 16 bp, P. troglodytes
ctgtttctacaaaata

SEQ ID NO: 239178 - DNA, 16 bp, P. troglodytes
ctgtttctccacatcc

SEQ ID NO: 239179 - DNA, 16 bp, P. troglodytes
ctgtttctctagaaaa

SEQ ID NO: 239180 - DNA, 16 bp, P. troglodytes
ctgtttcttcatttgt

SEQ ID NO: 239181 - DNA, 16 bp, P. troglodytes
ctgtttcttttcactt

SEQ ID NO: 239182 - DNA, 16 bp, P. troglodytes
ctgtttcttttgtaaa

SEQ ID NO: 239183 - DNA, 16 bp, P. troglodytes
ctgtttgaaatggctc

SEQ ID NO: 239184 - DNA, 16 bp, P. troglodytes
ctgtttgacagcattt

SEQ ID NO: 239185 - DNA, 16 bp, P. troglodytes
ctgtttgataacattt

SEQ ID NO: 239186 - DNA, 16 bp, P. troglodytes
ctgtttgatagcattt

SEQ ID NO: 239187 - DNA, 16 bp, P. troglodytes
ctgtttgcagaagaca

SEQ ID NO: 239188 - DNA, 16 bp, P. troglodytes
ctgtttgcaggagaag

SEQ ID NO: 239189 - DNA, 16 bp, P. troglodytes
ctgtttgccattttta

SEQ ID NO: 239190 - DNA, 18 bp, P. troglodytes
ctgtttgcctgggtatca

SEQ ID NO: 239191 - DNA, 16 bp, P. troglodytes
ctgtttgcttatttgt

SEQ ID NO: 239192 - DNA, 16 bp, P. troglodytes
ctgtttggagatgaca

SEQ ID NO: 239193 - DNA, 16 bp, P. troglodytes
ctgtttgggaagatga

SEQ ID NO: 239194 - DNA, 16 bp, P. troglodytes
ctgtttgtgggactgt

SEQ ID NO: 239195 - DNA, 16 bp, P. troglodytes
ctgtttgtgttacagc

SEQ ID NO: 239196 - DNA, 16 bp, P. troglodytes
ctgttttaaaaaaaaa

SEQ ID NO: 239197 - DNA, 16 bp, P. troglodytes
ctgttttaaaaaagaa

SEQ ID NO: 239198 - DNA, 16 bp, P. troglodytes
ctgttttaaaatttta

SEQ ID NO: 239199 - DNA, 16 bp, P. troglodytes
ctgttttatagataag

SEQ ID NO: 239200 - DNA, 16 bp, P. troglodytes
ctgttttcagaatttt

SEQ ID NO: 239201 - DNA, 16 bp, P. troglodytes
ctgttttcagctcttt

SEQ ID NO: 239202 - DNA, 16 bp, P. troglodytes
ctgttttcatgtattt

SEQ ID NO: 239203 - DNA, 16 bp, P. troglodytes
ctgttttcatttcatt

SEQ ID NO: 239204 - DNA, 16 bp, P. troglodytes
ctgttttcatttgtaa

SEQ ID NO: 239205 - DNA, 16 bp, P. troglodytes
ctgttttccaaaatga

SEQ ID NO: 239206 - DNA, 16 bp, P. troglodytes
ctgttttccaaagctg

SEQ ID NO: 239207 - DNA, 16 bp, P. troglodytes
ctgttttccaaagtga

SEQ ID NO: 239208 - DNA, 16 bp, P. troglodytes
ctgttttccacagcag

SEQ ID NO: 239209 - DNA, 16 bp, P. troglodytes
ctgttttccatagtgt

SEQ ID NO: 239210 - DNA, 16 bp, P. troglodytes
ctgttttccatattgg

SEQ ID NO: 239211 - DNA, 16 bp, P. troglodytes
ctgttttccatttgtt

SEQ ID NO: 239212 - DNA, 16 bp, P. troglodytes
ctgttttctattcatt

SEQ ID NO: 239213 - DNA, 16 bp, P. troglodytes
ctgttttctctgcctg

SEQ ID NO: 239214 - DNA, 16 bp, P. troglodytes
ctgttttctctttcta

SEQ ID NO: 239215 - DNA, 16 bp, P. troglodytes
ctgttttcttttgaaa

SEQ ID NO: 239216 - DNA, 16 bp, P. troglodytes
ctgttttcttttgcaa

SEQ ID NO: 239217 - DNA, 16 bp, P. troglodytes
ctgttttggaaccagt

SEQ ID NO: 239218 - DNA, 16 bp, P. troglodytes
ctgttttgtaaaatgt

SEQ ID NO: 239219 - DNA, 16 bp, P. troglodytes
ctgttttgttcactgt

SEQ ID NO: 239220 - DNA, 16 bp, P. troglodytes
ctgttttgtttattgc

SEQ ID NO: 239221 - DNA, 16 bp, P. troglodytes
ctgtttttaaaaaaaa

SEQ ID NO: 239222 - DNA, 16 bp, P. troglodytes
ctgtttttaaaaccat

SEQ ID NO: 239223 - DNA, 16 bp, P. troglodytes
ctgtttttaattctgt

SEQ ID NO: 239224 - DNA, 16 bp, P. troglodytes
ctgtttttattaaaaa

SEQ ID NO: 239225 - DNA, 16 bp, P. troglodytes
ctgtttttcataatga

SEQ ID NO: 239226 - DNA, 16 bp, P. troglodytes
ctgtttttcctttcca

SEQ ID NO: 239227 - DNA, 16 bp, P. troglodytes
ctgtttttctaaataa

SEQ ID NO: 239228 - DNA, 16 bp, P. troglodytes
ctgtttttctaccagt

SEQ ID NO: 239229 - DNA, 16 bp, P. troglodytes
ctgtttttctgtggct

SEQ ID NO: 239230 - DNA, 16 bp, P. troglodytes
ctgtttttttaaataa

SEQ ID NO: 239231 - DNA, 16 bp, P. troglodytes
cttaaaaaaaagtttt

SEQ ID NO: 239232 - DNA, 16 bp, P. troglodytes
cttaaaaacaacagaa

SEQ ID NO: 239233 - DNA, 16 bp, P. troglodytes
cttaaaaacatttttt

SEQ ID NO: 239234 - DNA, 16 bp, P. troglodytes
cttaaaaagttaaaaa

SEQ ID NO: 239235 - DNA, 16 bp, P. troglodytes
cttaaaaatgcagatt

SEQ ID NO: 239236 - DNA, 16 bp, P. troglodytes
cttaaaaattgttaaa

SEQ ID NO: 239237 - DNA, 16 bp, P. troglodytes
cttaaaaattgttaag

SEQ ID NO: 239238 - DNA, 16 bp, P. troglodytes
cttaaaaatttagaaa

SEQ ID NO: 239239 - DNA, 16 bp, P. troglodytes
cttaaaacaacagcaa

SEQ ID NO: 239240 - DNA, 16 bp, P. troglodytes
cttaaaacaacattta

SEQ ID NO: 239241 - DNA, 16 bp, P. troglodytes
cttaaaacaaccacca

SEQ ID NO: 239242 - DNA, 16 bp, P. troglodytes
cttaaaacaatagaaa

SEQ ID NO: 239243 - DNA, 16 bp, P. troglodytes
cttaaaactgcttttg

SEQ ID NO: 239244 - DNA, 16 bp, P. troglodytes
cttaaaagcaagaccc

SEQ ID NO: 239245 - DNA, 16 bp, P. troglodytes
cttaaaaggaaaagct

SEQ ID NO: 239246 - DNA, 16 bp, P. troglodytes
cttaaaagttaaagaa

SEQ ID NO: 239247 - DNA, 16 bp, P. troglodytes
cttaaaattcttaatt

SEQ ID NO: 239248 - DNA, 16 bp, P. troglodytes
cttaaacaaatttata

SEQ ID NO: 239249 - DNA, 16 bp, P. troglodytes
cttaaacaactaaaag

SEQ ID NO: 239250 - DNA, 16 bp, P. troglodytes
cttaaacccaggaggc

SEQ ID NO: 239251 - DNA, 16 bp, P. troglodytes
cttaaacccgggaggc

SEQ ID NO: 239252 - DNA, 16 bp, P. troglodytes
cttaaacctgagaggc

SEQ ID NO: 239253 - DNA, 16 bp, P. troglodytes
cttaaacctgggaggc

SEQ ID NO: 239254 - DNA, 16 bp, P. troglodytes
cttaaactatttcaaa

SEQ ID NO: 239255 - DNA, 16 bp, P. troglodytes
cttaaagaaatatttt

SEQ ID NO: 239256 - DNA, 16 bp, P. troglodytes
cttaaagaagtaaaag

SEQ ID NO: 239257 - DNA, 16 bp, P. troglodytes
cttaaagaataataaa

SEQ ID NO: 239258 - DNA, 16 bp, P. troglodytes
cttaaagagatatttg

SEQ ID NO: 239259 - DNA, 16 bp, P. troglodytes
cttaaagatgagaaaa

SEQ ID NO: 239260 - DNA, 16 bp, P. troglodytes
cttaaagatggcacag

SEQ ID NO: 239261 - DNA, 16 bp, P. troglodytes
cttaaagtaaaagaaa

SEQ ID NO: 239262 - DNA, 16 bp, P. troglodytes
cttaaagtataaaaaa

SEQ ID NO: 239263 - DNA, 16 bp, P. troglodytes
cttaaagtcatcagct

SEQ ID NO: 239264 - DNA, 16 bp, P. troglodytes
cttaaagttggaattt

SEQ ID NO: 239265 - DNA, 16 bp, P. troglodytes
cttaaagtttcaaaat

SEQ ID NO: 239266 - DNA, 16 bp, P. troglodytes
cttaaataaaagaaat

SEQ ID NO: 239267 - DNA, 16 bp, P. troglodytes
cttaaatattttgtca

SEQ ID NO: 239268 - DNA, 16 bp, P. troglodytes
cttaaatgttctcatc

SEQ ID NO: 239269 - DNA, 16 bp, P. troglodytes
cttaacagatatttac

SEQ ID NO: 239270 - DNA, 16 bp, P. troglodytes
cttaacagctgtgtga

SEQ ID NO: 239271 - DNA, 16 bp, P. troglodytes
cttaacctcccaagta

SEQ ID NO: 239272 - DNA, 16 bp, P. troglodytes
cttaacctccctgagc

SEQ ID NO: 239273 - DNA, 16 bp, P. troglodytes
cttaacctctctgtgc

SEQ ID NO: 239274 - DNA, 16 bp, P. troglodytes
cttaactcaagcattt

SEQ ID NO: 239275 - DNA, 16 bp, P. troglodytes
cttaactgatgatatt

SEQ ID NO: 239276 - DNA, 16 bp, P. troglodytes
cttaacttctctgtgt

SEQ ID NO: 239277 - DNA, 16 bp, P. troglodytes
cttaagaaaatggaaa

SEQ ID NO: 239278 - DNA, 16 bp, P. troglodytes
cttaagaaatacattt

SEQ ID NO: 239279 - DNA, 16 bp, P. troglodytes
cttaagaaatttcaaa

SEQ ID NO: 239280 - DNA, 16 bp, P. troglodytes
cttaagagatcctcct

SEQ ID NO: 239281 - DNA, 16 bp, P. troglodytes
cttaagcaaaaagaac

SEQ ID NO: 239282 - DNA, 16 bp, P. troglodytes
cttaagcaggtcatct

SEQ ID NO: 239283 - DNA, 16 bp, P. troglodytes
cttaagcagtcttcct

SEQ ID NO: 239284 - DNA, 16 bp, P. troglodytes
cttaagccatcctcct

SEQ ID NO: 239285 - DNA, 16 bp, P. troglodytes
cttaagcccaggaatt

SEQ ID NO: 239286 - DNA, 16 bp, P. troglodytes
cttaagcccaggagct

SEQ ID NO: 239287 - DNA, 16 bp, P. troglodytes
cttaagcccaggaggt

SEQ ID NO: 239288 - DNA, 16 bp, P. troglodytes
cttaagcccaggagtt

SEQ ID NO: 239289 - DNA, 16 bp, P. troglodytes
cttaagctcaggagtt

SEQ ID NO: 239290 - DNA, 16 bp, P. troglodytes
cttaaggaaataaaag

SEQ ID NO: 239291 - DNA, 16 bp, P. troglodytes
cttaaggaactagaga

SEQ ID NO: 239292 - DNA, 16 bp, P. troglodytes
cttaaggagaggagag

SEQ ID NO: 239293 - DNA, 16 bp, P. troglodytes
cttaaggccaggagtt

SEQ ID NO: 239294 - DNA, 16 bp, P. troglodytes
cttaagggaacattgg

SEQ ID NO: 239295 - DNA, 16 bp, P. troglodytes
cttaaggtcaggagtt

SEQ ID NO: 239296 - DNA, 16 bp, P. troglodytes
cttaagtgtgtttttg

SEQ ID NO: 239297 - DNA, 16 bp, P. troglodytes
cttaagtgttcatcaa

SEQ ID NO: 239298 - DNA, 16 bp, P. troglodytes
cttaataaatacttgt

SEQ ID NO: 239299 - DNA, 16 bp, P. troglodytes
cttaataaatgtttga

SEQ ID NO: 239300 - DNA, 16 bp, P. troglodytes
cttaataaatgttttt

SEQ ID NO: 239301 - DNA, 16 bp, P. troglodytes
cttaataaatttaaga

SEQ ID NO: 239302 - DNA, 16 bp, P. troglodytes
cttaataatttttaag

SEQ ID NO: 239303 - DNA, 16 bp, P. troglodytes
cttaatacctaggtga

SEQ ID NO: 239304 - DNA, 16 bp, P. troglodytes
cttaatatggacattt

SEQ ID NO: 239305 - DNA, 16 bp, P. troglodytes
cttaatcccatcatct

SEQ ID NO: 239306 - DNA, 16 bp, P. troglodytes
cttaatcctcagaaca

SEQ ID NO: 239307 - DNA, 16 bp, P. troglodytes
cttaatctataaaatg

SEQ ID NO: 239308 - DNA, 16 bp, P. troglodytes
cttaatctccaaataa

SEQ ID NO: 239309 - DNA, 16 bp, P. troglodytes
cttaatctcctcttct

SEQ ID NO: 239310 - DNA, 16 bp, P. troglodytes
cttaatctcttcattg

SEQ ID NO: 239311 - DNA, 16 bp, P. troglodytes
cttaatgacagagata

SEQ ID NO: 239312 - DNA, 16 bp, P. troglodytes
cttaatgccattgaac

SEQ ID NO: 239313 - DNA, 16 bp, P. troglodytes
cttaatggcatttaga

SEQ ID NO: 239314 - DNA, 16 bp, P. troglodytes
cttaattagatcccat

SEQ ID NO: 239315 - DNA, 16 bp, P. troglodytes
cttaatttaaaaatac

SEQ ID NO: 239316 - DNA, 16 bp, P. troglodytes
cttaatttaattacat

SEQ ID NO: 239317 - DNA, 16 bp, P. troglodytes
cttaatttcctttttg

SEQ ID NO: 239318 - DNA, 16 bp, P. troglodytes
cttaatttggttctca

SEQ ID NO: 239319 - DNA, 16 bp, P. troglodytes
cttaattttaatgtaa

SEQ ID NO: 239320 - DNA, 16 bp, P. troglodytes
cttaatttttaaaaca

SEQ ID NO: 239321 - DNA, 16 bp, P. troglodytes
cttacaaatggttaaa

SEQ ID NO: 239322 - DNA, 16 bp, P. troglodytes
cttacaacatggcagc

SEQ ID NO: 239323 - DNA, 16 bp, P. troglodytes
cttacaagctgtgtga

SEQ ID NO: 239324 - DNA, 22 bp, P. troglodytes
cttacaagggacgtgaaggacc

SEQ ID NO: 239325 - DNA, 16 bp, P. troglodytes
cttacacatggtgttg

SEQ ID NO: 239326 - DNA, 16 bp, P. troglodytes
cttacagtaaaataaa

SEQ ID NO: 239327 - DNA, 16 bp, P. troglodytes
cttacagttccacatg

SEQ ID NO: 239328 - DNA, 16 bp, P. troglodytes
cttacataaaatggtg

SEQ ID NO: 239329 - DNA, 16 bp, P. troglodytes
cttacataaccatggt

SEQ ID NO: 239330 - DNA, 16 bp, P. troglodytes
cttacatgaaaattgt

SEQ ID NO: 239331 - DNA, 16 bp, P. troglodytes
cttacatggcaggagc

SEQ ID NO: 239332 - DNA, 16 bp, P. troglodytes
cttacatgggatgtga

SEQ ID NO: 239333 - DNA, 16 bp, P. troglodytes
cttaccatagatctta

SEQ ID NO: 239334 - DNA, 16 bp, P. troglodytes
cttacccaaggtcaca

SEQ ID NO: 239335 - DNA, 16 bp, P. troglodytes
cttaccctccagaaaa

SEQ ID NO: 239336 - DNA, 16 bp, P. troglodytes
cttacctgtaaaatgg

SEQ ID NO: 239337 - DNA, 16 bp, P. troglodytes
cttacctttaaaaaaa

SEQ ID NO: 239338 - DNA, 16 bp, P. troglodytes
cttactaaacataaga

SEQ ID NO: 239339 - DNA, 16 bp, P. troglodytes
cttactacacataaga

SEQ ID NO: 239340 - DNA, 16 bp, P. troglodytes
cttactaggtgccagg

SEQ ID NO: 239341 - DNA, 16 bp, P. troglodytes
cttactctcttctcca

SEQ ID NO: 239342 - DNA, 16 bp, P. troglodytes
cttactgcaaactcca

SEQ ID NO: 239343 - DNA, 16 bp, P. troglodytes
cttactgcagcctcag

SEQ ID NO: 239344 - DNA, 16 bp, P. troglodytes
cttactggggaaagaa

SEQ ID NO: 239345 - DNA, 16 bp, P. troglodytes
cttactgtaatttttt

SEQ ID NO: 239346 - DNA, 16 bp, P. troglodytes
cttactgtcttccttt

SEQ ID NO: 239347 - DNA, 16 bp, P. troglodytes
cttactttgtgccagg

SEQ ID NO: 239348 - DNA, 16 bp, P. troglodytes
cttagaaattttttct

SEQ ID NO: 239349 - DNA, 16 bp, P. troglodytes
cttagaagaaaacaga

SEQ ID NO: 239350 - DNA, 16 bp, P. troglodytes
cttagaatagtgtctg

SEQ ID NO: 239351 - DNA, 16 bp, P. troglodytes
cttagaatatatatat

SEQ ID NO: 239352 - DNA, 16 bp, P. troglodytes
cttagaatattttcaa

SEQ ID NO: 239353 - DNA, 16 bp, P. troglodytes
cttagagaaagaaaaa

SEQ ID NO: 239354 - DNA, 16 bp, P. troglodytes
cttagaggaaatgctt

SEQ ID NO: 239355 - DNA, 16 bp, P. troglodytes
cttagatttcagagga

SEQ ID NO: 239356 - DNA, 16 bp, P. troglodytes
cttagcaacttttact

SEQ ID NO: 239357 - DNA, 16 bp, P. troglodytes
cttagcacaatgtttt

SEQ ID NO: 239358 - DNA, 17 bp, P. troglodytes
cttagcacccgggccag

SEQ ID NO: 239359 - DNA, 17 bp, P. troglodytes
cttagcacctgggccag

SEQ ID NO: 239360 - DNA, 16 bp, P. troglodytes
cttagcataatgtctg

SEQ ID NO: 239361 - DNA, 16 bp, P. troglodytes
cttagcatagtgttct

SEQ ID NO: 239362 - DNA, 16 bp, P. troglodytes
cttagcattttctttt

SEQ ID NO: 239363 - DNA, 19 bp, P. troglodytes
cttagccgggcatggtggc

SEQ ID NO: 239364 - DNA, 16 bp, P. troglodytes
cttagcctcagtttcc

SEQ ID NO: 239365 - DNA, 16 bp, P. troglodytes
cttagcctcccgagca

SEQ ID NO: 239366 - DNA, 16 bp, P. troglodytes
cttagctgccttcctg

SEQ ID NO: 239367 - DNA, 16 bp, P. troglodytes
cttaggatacttctga

SEQ ID NO: 239368 - DNA, 17 bp, P. troglodytes
cttaggattgacttggc

SEQ ID NO: 239369 - DNA, 16 bp, P. troglodytes
cttaggcaagtcattt

SEQ ID NO: 239370 - DNA, 16 bp, P. troglodytes
cttaggctggagtgca

SEQ ID NO: 239371 - DNA, 16 bp, P. troglodytes
cttaggtatttctcct

SEQ ID NO: 239372 - DNA, 16 bp, P. troglodytes
cttaggtgatccgccc

SEQ ID NO: 239373 - DNA, 16 bp, P. troglodytes
cttagtacctgggtga

SEQ ID NO: 239374 - DNA, 16 bp, P. troglodytes
cttagtactttgggag

SEQ ID NO: 239375 - DNA, 16 bp, P. troglodytes
cttagtctgtaagaga

SEQ ID NO: 239376 - DNA, 16 bp, P. troglodytes
cttagtgattttgggg

SEQ ID NO: 239377 - DNA, 16 bp, P. troglodytes
cttagttaaaaaaaaa

SEQ ID NO: 239378 - DNA, 16 bp, P. troglodytes
cttagttattttaaaa

SEQ ID NO: 239379 - DNA, 16 bp, P. troglodytes
cttagtttccccatct

SEQ ID NO: 239380 - DNA, 16 bp, P. troglodytes
cttagtttcctcaact

SEQ ID NO: 239381 - DNA, 16 bp, P. troglodytes
cttataaaaaggaaaa

SEQ ID NO: 239382 - DNA, 16 bp, P. troglodytes
cttataaaacagaaat

SEQ ID NO: 239383 - DNA, 16 bp, P. troglodytes
cttataaaagagatcc

SEQ ID NO: 239384 - DNA, 16 bp, P. troglodytes
cttataaattacccag

SEQ ID NO: 239385 - DNA, 16 bp, P. troglodytes
cttataaggacatttg

SEQ ID NO: 239386 - DNA, 16 bp, P. troglodytes
cttatactttttaaaa

SEQ ID NO: 239387 - DNA, 16 bp, P. troglodytes
cttatatctcattggc

SEQ ID NO: 239388 - DNA, 16 bp, P. troglodytes
cttatatcttatacaa

SEQ ID NO: 239389 - DNA, 16 bp, P. troglodytes
cttatattcattcatt

SEQ ID NO: 239390 - DNA, 16 bp, P. troglodytes
cttatcaacaacagaa

SEQ ID NO: 239391 - DNA, 16 bp, P. troglodytes
cttatcaccttaagga

SEQ ID NO: 239392 - DNA, 16 bp, P. troglodytes
cttatccaaagtcaca

SEQ ID NO: 239393 - DNA, 16 bp, P. troglodytes
cttatctaaacctaat

SEQ ID NO: 239394 - DNA, 16 bp, P. troglodytes
cttatctatgaaatgg

SEQ ID NO: 239395 - DNA, 16 bp, P. troglodytes
cttatctgtaaaatat

SEQ ID NO: 239396 - DNA, 16 bp, P. troglodytes
cttatctgtaaaatga

SEQ ID NO: 239397 - DNA, 16 bp, P. troglodytes
cttatctgtaaaatgg

SEQ ID NO: 239398 - DNA, 16 bp, P. troglodytes
cttatcttgtgctggt

SEQ ID NO: 239399 - DNA, 16 bp, P. troglodytes
cttatgaaaatctaac

SEQ ID NO: 239400 - DNA, 16 bp, P. troglodytes
cttatgatgtgccagg

SEQ ID NO: 239401 - DNA, 16 bp, P. troglodytes
cttatgatttttaaaa

SEQ ID NO: 239402 - DNA, 16 bp, P. troglodytes
cttatgcattgctggt

SEQ ID NO: 239403 - DNA, 16 bp, P. troglodytes
cttatgcctttacatc

SEQ ID NO: 239404 - DNA, 16 bp, P. troglodytes
cttatgggaccattgt

SEQ ID NO: 239405 - DNA, 16 bp, P. troglodytes
cttatgggctcaagtg

SEQ ID NO: 239406 - DNA, 16 bp, P. troglodytes
cttatgttagtttgct

SEQ ID NO: 239407 - DNA, 16 bp, P. troglodytes
cttattaatctgtctt

SEQ ID NO: 239408 - DNA, 16 bp, P. troglodytes
cttattcaaagaaata

SEQ ID NO: 239409 - DNA, 16 bp, P. troglodytes
cttattccagttctta

SEQ ID NO: 239410 - DNA, 16 bp, P. troglodytes
cttattcctttccaat

SEQ ID NO: 239411 - DNA, 16 bp, P. troglodytes
cttattctaaaattga

SEQ ID NO: 239412 - DNA, 16 bp, P. troglodytes
cttattctggatattt

SEQ ID NO: 239413 - DNA, 16 bp, P. troglodytes
cttattgaatggtttt

SEQ ID NO: 239414 - DNA, 16 bp, P. troglodytes
cttattgagcatctac

SEQ ID NO: 239415 - DNA, 16 bp, P. troglodytes
cttattgggaactgga

SEQ ID NO: 239416 - DNA, 16 bp, P. troglodytes
cttatttaataaatgg

SEQ ID NO: 239417 - DNA, 16 bp, P. troglodytes
cttatttaatcctcat

SEQ ID NO: 239418 - DNA, 16 bp, P. troglodytes
cttatttagttcattt

SEQ ID NO: 239419 - DNA, 16 bp, P. troglodytes
cttatttatcaaaaat

SEQ ID NO: 239420 - DNA, 16 bp, P. troglodytes
cttatttattttgaaa

SEQ ID NO: 239421 - DNA, 16 bp, P. troglodytes
cttatttcagataaaa

SEQ ID NO: 239422 - DNA, 16 bp, P. troglodytes
cttatttcagtaagtt

SEQ ID NO: 239423 - DNA, 16 bp, P. troglodytes
cttatttccaaataag

SEQ ID NO: 239424 - DNA, 16 bp, P. troglodytes
cttatttctgagatct

SEQ ID NO: 239425 - DNA, 16 bp, P. troglodytes
cttatttctgccttca

SEQ ID NO: 239426 - DNA, 16 bp, P. troglodytes
cttatttctgtgttct

SEQ ID NO: 239427 - DNA, 16 bp, P. troglodytes
cttatttgaacatggt

SEQ ID NO: 239428 - DNA, 16 bp, P. troglodytes
cttatttggaaaaaaa

SEQ ID NO: 239429 - DNA, 16 bp, P. troglodytes
cttattttaaaaagtt

SEQ ID NO: 239430 - DNA, 16 bp, P. troglodytes
cttattttacaaatga

SEQ ID NO: 239431 - DNA, 16 bp, P. troglodytes
cttattttagaaaatt

SEQ ID NO: 239432 - DNA, 16 bp, P. troglodytes
cttattttcctatttg

SEQ ID NO: 239433 - DNA, 16 bp, P. troglodytes
cttattttgaaaaatt

SEQ ID NO: 239434 - DNA, 16 bp, P. troglodytes
cttattttgtaaattt

SEQ ID NO: 239435 - DNA, 16 bp, P. troglodytes
cttattttgtcatatt

SEQ ID NO: 239436 - DNA, 16 bp, P. troglodytes
cttatttttaaaactg

SEQ ID NO: 239437 - DNA, 16 bp, P. troglodytes
cttattttttaatgaa

SEQ ID NO: 239438 - DNA, 16 bp, P. troglodytes
cttcaaaaaaccaact

SEQ ID NO: 239439 - DNA, 16 bp, P. troglodytes
cttcaaaaaagtaaaa

SEQ ID NO: 239440 - DNA, 18 bp, P. troglodytes
cttcaaaaaatcaatgaa

SEQ ID NO: 239441 - DNA, 16 bp, P. troglodytes
cttcaaaaatatattt

SEQ ID NO: 239442 - DNA, 16 bp, P. troglodytes
cttcaaaagtgtcaag

SEQ ID NO: 239443 - DNA, 16 bp, P. troglodytes
cttcaaaatgaaaaat

SEQ ID NO: 239444 - DNA, 16 bp, P. troglodytes
cttcaaaatggttaag

SEQ ID NO: 239445 - DNA, 16 bp, P. troglodytes
cttcaaacaaatgaaa

SEQ ID NO: 239446 - DNA, 16 bp, P. troglodytes
cttcaaacagaataaa

SEQ ID NO: 239447 - DNA, 16 bp, P. troglodytes
cttcaaactataatat

SEQ ID NO: 239448 - DNA, 16 bp, P. troglodytes
cttcaaactgttccaa

SEQ ID NO: 239449 - DNA, 16 bp, P. troglodytes
cttcaaagccacaggg

SEQ ID NO: 239450 - DNA, 16 bp, P. troglodytes
cttcaaatattctttt

SEQ ID NO: 239451 - DNA, 16 bp, P. troglodytes
cttcaaatatttgaaa

SEQ ID NO: 239452 - DNA, 16 bp, P. troglodytes
cttcaaatgatcctcc

SEQ ID NO: 239453 - DNA, 16 bp, P. troglodytes
cttcaacaaaatacaa

SEQ ID NO: 239454 - DNA, 16 bp, P. troglodytes
cttcaacacaggaatt

SEQ ID NO: 239455 - DNA, 16 bp, P. troglodytes
cttcaacacctcactg

SEQ ID NO: 239456 - DNA, 16 bp, P. troglodytes
cttcaacatatacatt

SEQ ID NO: 239457 - DNA, 16 bp, P. troglodytes
cttcaacccaggaagc

SEQ ID NO: 239458 - DNA, 16 bp, P. troglodytes
cttcaaccctgggatg

SEQ ID NO: 239459 - DNA, 16 bp, P. troglodytes
cttcaacttaaaatca

SEQ ID NO: 239460 - DNA, 16 bp, P. troglodytes
cttcaacttcctgggc

SEQ ID NO: 239461 - DNA, 16 bp, P. troglodytes
cttcaactttgttctt

SEQ ID NO: 239462 - DNA, 16 bp, P. troglodytes
cttcaagaaaaccttg

SEQ ID NO: 239463 - DNA, 16 bp, P. troglodytes
cttcaagaaactagaa

SEQ ID NO: 239464 - DNA, 16 bp, P. troglodytes
cttcaagaactttttc

SEQ ID NO: 239465 - DNA, 16 bp, P. troglodytes
cttcaagaataaagcc

SEQ ID NO: 239466 - DNA, 17 bp, P. troglodytes
cttcaagaatgaagcca

SEQ ID NO: 239467 - DNA, 16 bp, P. troglodytes
cttcaagaccagcctg

SEQ ID NO: 239468 - DNA, 16 bp, P. troglodytes
cttcaaggagaacaac

SEQ ID NO: 239469 - DNA, 17 bp, P. troglodytes
cttcaaggagaactaca

SEQ ID NO: 239470 - DNA, 16 bp, P. troglodytes
cttcaaggctctcatc

SEQ ID NO: 239471 - DNA, 16 bp, P. troglodytes
cttcaagtcaccagct

SEQ ID NO: 239472 - DNA, 16 bp, P. troglodytes
cttcaataaatggtat

SEQ ID NO: 239473 - DNA, 16 bp, P. troglodytes
cttcaattatgaagct

SEQ ID NO: 239474 - DNA, 16 bp, P. troglodytes
cttcaattcttgactt

SEQ ID NO: 239475 - DNA, 16 bp, P. troglodytes
cttcacaatccatgtt

SEQ ID NO: 239476 - DNA, 16 bp, P. troglodytes
cttcacagaatgggaa

SEQ ID NO: 239477 - DNA, 16 bp, P. troglodytes
cttcacagagaaaata

SEQ ID NO: 239478 - DNA, 16 bp, P. troglodytes
cttcacagaggaggtg

SEQ ID NO: 239479 - DNA, 16 bp, P. troglodytes
cttcacagatgaggaa

SEQ ID NO: 239480 - DNA, 16 bp, P. troglodytes
cttcacatcctctcca

SEQ ID NO: 239481 - DNA, 16 bp, P. troglodytes
cttcacatgatggcag

SEQ ID NO: 239482 - DNA, 16 bp, P. troglodytes
cttcacattgtgcaca

SEQ ID NO: 239483 - DNA, 16 bp, P. troglodytes
cttcaccaaagaggat

SEQ ID NO: 239484 - DNA, 16 bp, P. troglodytes
cttcaccactattttg

SEQ ID NO: 239485 - DNA, 16 bp, P. troglodytes
cttcaccagaagctga

SEQ ID NO: 239486 - DNA, 16 bp, P. troglodytes
cttcaccagggacctg

SEQ ID NO: 239487 - DNA, 16 bp, P. troglodytes
cttcaccatcatcatc

SEQ ID NO: 239488 - DNA, 16 bp, P. troglodytes
cttcaccatgctggcc

SEQ ID NO: 239489 - DNA, 17 bp, P. troglodytes
cttcaccatgttggcca

SEQ ID NO: 239490 - DNA, 16 bp, P. troglodytes
cttcacctcccaggct

SEQ ID NO: 239491 - DNA, 16 bp, P. troglodytes
cttcacctctctgagc

SEQ ID NO: 239492 - DNA, 16 bp, P. troglodytes
cttcaccttcaccttc

SEQ ID NO: 239493 - DNA, 16 bp, P. troglodytes
cttcactcccctgcta

SEQ ID NO: 239494 - DNA, 16 bp, P. troglodytes
cttcactggggaccca

SEQ ID NO: 239495 - DNA, 16 bp, P. troglodytes
cttcacttctgaagct

SEQ ID NO: 239496 - DNA, 16 bp, P. troglodytes
cttcagaaataatacc

SEQ ID NO: 239497 - DNA, 16 bp, P. troglodytes
cttcagaaatgaaaac

SEQ ID NO: 239498 - DNA, 16 bp, P. troglodytes
cttcagaaatgaagac

SEQ ID NO: 239499 - DNA, 16 bp, P. troglodytes
cttcagaactataaga

SEQ ID NO: 239500 - DNA, 16 bp, P. troglodytes
cttcagacattgccaa

SEQ ID NO: 239501 - DNA, 16 bp, P. troglodytes
cttcagagagaacaga

SEQ ID NO: 239502 - DNA, 16 bp, P. troglodytes
cttcagagagaagaaa

SEQ ID NO: 239503 - DNA, 16 bp, P. troglodytes
cttcagagcaagaaaa

SEQ ID NO: 239504 - DNA, 16 bp, P. troglodytes
cttcagatgactccag

SEQ ID NO: 239505 - DNA, 16 bp, P. troglodytes
cttcagcaactaccac

SEQ ID NO: 239506 - DNA, 16 bp, P. troglodytes
cttcagcagacttaaa

SEQ ID NO: 239507 - DNA, 16 bp, P. troglodytes
cttcagcagccaccac

SEQ ID NO: 239508 - DNA, 16 bp, P. troglodytes
cttcagcagtctcagg

SEQ ID NO: 239509 - DNA, 16 bp, P. troglodytes
cttcagccatgactgt

SEQ ID NO: 239510 - DNA, 16 bp, P. troglodytes
cttcagccccctgagt

SEQ ID NO: 239511 - DNA, 16 bp, P. troglodytes
cttcagccggtccctc

SEQ ID NO: 239512 - DNA, 16 bp, P. troglodytes
cttcagcctcagcttc

SEQ ID NO: 239513 - DNA, 16 bp, P. troglodytes
cttcagcctccacagt

SEQ ID NO: 239514 - DNA, 16 bp, P. troglodytes
cttcagcctcccagag

SEQ ID NO: 239515 - DNA, 16 bp, P. troglodytes
cttcagcctccccagc

SEQ ID NO: 239516 - DNA, 16 bp, P. troglodytes
cttcagcctcctttcc

SEQ ID NO: 239517 - DNA, 16 bp, P. troglodytes
cttcagcctgagcgac

SEQ ID NO: 239518 - DNA, 16 bp, P. troglodytes
cttcagcctggaagac

SEQ ID NO: 239519 - DNA, 16 bp, P. troglodytes
cttcagcctggacttc

SEQ ID NO: 239520 - DNA, 16 bp, P. troglodytes
cttcagcctgggcgag

SEQ ID NO: 239521 - DNA, 16 bp, P. troglodytes
cttcagccttgacctc

SEQ ID NO: 239522 - DNA, 16 bp, P. troglodytes
cttcagcgtcctgagt

SEQ ID NO: 239523 - DNA, 16 bp, P. troglodytes
cttcagctaccagggc

SEQ ID NO: 239524 - DNA, 16 bp, P. troglodytes
cttcagctccagctgt

SEQ ID NO: 239525 - DNA, 16 bp, P. troglodytes
cttcagctgtaaaatg

SEQ ID NO: 239526 - DNA, 16 bp, P. troglodytes
cttcagcttcttcatc

SEQ ID NO: 239527 - DNA, 16 bp, P. troglodytes
cttcagctttcttttg

SEQ ID NO: 239528 - DNA, 16 bp, P. troglodytes
cttcaggaactctttt

SEQ ID NO: 239529 - DNA, 16 bp, P. troglodytes
cttcaggaagccttcc

SEQ ID NO: 239530 - DNA, 16 bp, P. troglodytes
cttcaggaagctgagg

SEQ ID NO: 239531 - DNA, 16 bp, P. troglodytes
cttcaggacctgcttg

SEQ ID NO: 239532 - DNA, 16 bp, P. troglodytes
cttcaggactcagatc

SEQ ID NO: 239533 - DNA, 16 bp, P. troglodytes
cttcaggagctctttc

SEQ ID NO: 239534 - DNA, 16 bp, P. troglodytes
cttcaggaggaattcc

SEQ ID NO: 239535 - DNA, 16 bp, P. troglodytes
cttcaggaggcccagg

SEQ ID NO: 239536 - DNA, 16 bp, P. troglodytes
cttcaggagttctttt

SEQ ID NO: 239537 - DNA, 16 bp, P. troglodytes
cttcaggatgatggag

SEQ ID NO: 239538 - DNA, 16 bp, P. troglodytes
cttcaggccagggagg

SEQ ID NO: 239539 - DNA, 17 bp, P. troglodytes
cttcaggccatctggat

SEQ ID NO: 239540 - DNA, 16 bp, P. troglodytes
cttcaggccctccctg

SEQ ID NO: 239541 - DNA, 16 bp, P. troglodytes
cttcaggctgaaatga

SEQ ID NO: 239542 - DNA, 16 bp, P. troglodytes
cttcaggctgtctttg

SEQ ID NO: 239543 - DNA, 16 bp, P. troglodytes
cttcagggaaagatca

SEQ ID NO: 239544 - DNA, 16 bp, P. troglodytes
cttcaggggaaaaaaa

SEQ ID NO: 239545 - DNA, 16 bp, P. troglodytes
cttcaggtcaggagtt

SEQ ID NO: 239546 - DNA, 16 bp, P. troglodytes
cttcagtctcctgagt

SEQ ID NO: 239547 - DNA, 16 bp, P. troglodytes
cttcagtcttctgagt

SEQ ID NO: 239548 - DNA, 16 bp, P. troglodytes
cttcagtgaaccatga

SEQ ID NO: 239549 - DNA, 16 bp, P. troglodytes
cttcagtggcttccca

SEQ ID NO: 239550 - DNA, 16 bp, P. troglodytes
cttcagttctgctctg

SEQ ID NO: 239551 - DNA, 16 bp, P. troglodytes
cttcagtttcccaaag

SEQ ID NO: 239552 - DNA, 16 bp, P. troglodytes
cttcagtttctccagt

SEQ ID NO: 239553 - DNA, 16 bp, P. troglodytes
cttcagttttctgaaa

SEQ ID NO: 239554 - DNA, 16 bp, P. troglodytes
cttcataacagcatga

SEQ ID NO: 239555 - DNA, 16 bp, P. troglodytes
cttcatagaactgaag

SEQ ID NO: 239556 - DNA, 16 bp, P. troglodytes
cttcatataaatggaa

SEQ ID NO: 239557 - DNA, 16 bp, P. troglodytes
cttcatatatatatat

SEQ ID NO: 239558 - DNA, 16 bp, P. troglodytes
cttcatcacccaggct

SEQ ID NO: 239559 - DNA, 16 bp, P. troglodytes
cttcatcagggtcctc

SEQ ID NO: 239560 - DNA, 16 bp, P. troglodytes
cttcatcccagaaggg

SEQ ID NO: 239561 - DNA, 16 bp, P. troglodytes
cttcatcccctggggc

SEQ ID NO: 239562 - DNA, 16 bp, P. troglodytes
cttcatcctcatcatc

SEQ ID NO: 239563 - DNA, 16 bp, P. troglodytes
cttcatccttgtcatc

SEQ ID NO: 239564 - DNA, 16 bp, P. troglodytes
cttcatctctctgagc

SEQ ID NO: 239565 - DNA, 16 bp, P. troglodytes
cttcatctgtgaaatg

SEQ ID NO: 239566 - DNA, 16 bp, P. troglodytes
cttcatgaagcataca

SEQ ID NO: 239567 - DNA, 16 bp, P. troglodytes
cttcatgaatgggatt

SEQ ID NO: 239568 - DNA, 16 bp, P. troglodytes
cttcatgcccaggcag

SEQ ID NO: 239569 - DNA, 16 bp, P. troglodytes
cttcatggaattgaag

SEQ ID NO: 239570 - DNA, 16 bp, P. troglodytes
cttcatggagcttaca

SEQ ID NO: 239571 - DNA, 16 bp, P. troglodytes
cttcatggagcttata

SEQ ID NO: 239572 - DNA, 16 bp, P. troglodytes
cttcatggaggaagtg

SEQ ID NO: 239573 - DNA, 16 bp, P. troglodytes
cttcatggaggaggtg

SEQ ID NO: 239574 - DNA, 16 bp, P. troglodytes
cttcatgtattttgaa

SEQ ID NO: 239575 - DNA, 16 bp, P. troglodytes
cttcatgtatttttaa

SEQ ID NO: 239576 - DNA, 16 bp, P. troglodytes
cttcattcattcaaca

SEQ ID NO: 239577 - DNA, 16 bp, P. troglodytes
cttcattcctgaagtc

SEQ ID NO: 239578 - DNA, 16 bp, P. troglodytes
cttcattcctttgtgt

SEQ ID NO: 239579 - DNA, 16 bp, P. troglodytes
cttcattccttttatg

SEQ ID NO: 239580 - DNA, 16 bp, P. troglodytes
cttcattcttgaaaga

SEQ ID NO: 239581 - DNA, 16 bp, P. troglodytes
cttcattctttttatg

SEQ ID NO: 239582 - DNA, 16 bp, P. troglodytes
cttcattggtaaaatg

SEQ ID NO: 239583 - DNA, 16 bp, P. troglodytes
cttcatttataaagct

SEQ ID NO: 239584 - DNA, 16 bp, P. troglodytes
cttcatttattcattc

SEQ ID NO: 239585 - DNA, 16 bp, P. troglodytes
cttcattttaaagata

SEQ ID NO: 239586 - DNA, 16 bp, P. troglodytes
cttcattttaaccttg

SEQ ID NO: 239587 - DNA, 16 bp, P. troglodytes
cttcattttcttcaaa

SEQ ID NO: 239588 - DNA, 16 bp, P. troglodytes
cttcatttttgaagtc

SEQ ID NO: 239589 - DNA, 16 bp, P. troglodytes
cttccaaaatacaatg

SEQ ID NO: 239590 - DNA, 16 bp, P. troglodytes
cttccaaactcatttt

SEQ ID NO: 239591 - DNA, 16 bp, P. troglodytes
cttccaaactcctgct

SEQ ID NO: 239592 - DNA, 16 bp, P. troglodytes
cttccaaatctcatgt

SEQ ID NO: 239593 - DNA, 16 bp, P. troglodytes
cttccaagatacagtg

SEQ ID NO: 239594 - DNA, 16 bp, P. troglodytes
cttccaagatggcacc

SEQ ID NO: 239595 - DNA, 16 bp, P. troglodytes
cttccaagatggcggc

SEQ ID NO: 239596 - DNA, 16 bp, P. troglodytes
cttccaagttcattca

SEQ ID NO: 239597 - DNA, 16 bp, P. troglodytes
cttccacaaacctaga

SEQ ID NO: 239598 - DNA, 16 bp, P. troglodytes
cttccacaaccagcag

SEQ ID NO: 239599 - DNA, 16 bp, P. troglodytes
cttccacatcagcctc

SEQ ID NO: 239600 - DNA, 16 bp, P. troglodytes
cttccacattgtggaa

SEQ ID NO: 239601 - DNA, 16 bp, P. troglodytes
cttccacattttcagg

SEQ ID NO: 239602 - DNA, 16 bp, P. troglodytes
cttccaccacctccaa

SEQ ID NO: 239603 - DNA, 16 bp, P. troglodytes
cttccaccaggttcct

SEQ ID NO: 239604 - DNA, 16 bp, P. troglodytes
cttccaccatgattgt

SEQ ID NO: 239605 - DNA, 16 bp, P. troglodytes
cttccacccaggctgg

SEQ ID NO: 239606 - DNA, 16 bp, P. troglodytes
cttccacctcagcctc

SEQ ID NO: 239607 - DNA, 16 bp, P. troglodytes
cttccacctcagcttc

SEQ ID NO: 239608 - DNA, 16 bp, P. troglodytes
cttccacctcccggat

SEQ ID NO: 239609 - DNA, 16 bp, P. troglodytes
cttccacctcctggat

SEQ ID NO: 239610 - DNA, 16 bp, P. troglodytes
cttccacctccttggt

SEQ ID NO: 239611 - DNA, 16 bp, P. troglodytes
cttccacctgtgagcc

SEQ ID NO: 239612 - DNA, 16 bp, P. troglodytes
cttccaccttagcctc

SEQ ID NO: 239613 - DNA, 16 bp, P. troglodytes
cttccaccttctggct

SEQ ID NO: 239614 - DNA, 16 bp, P. troglodytes
cttccaccttctgggt

SEQ ID NO: 239615 - DNA, 16 bp, P. troglodytes
cttccactgaatacac

SEQ ID NO: 239616 - DNA, 16 bp, P. troglodytes
cttccacttccaccat

SEQ ID NO: 239617 - DNA, 16 bp, P. troglodytes
cttccagagaaaggat

SEQ ID NO: 239618 - DNA, 16 bp, P. troglodytes
cttccagatttttttt

SEQ ID NO: 239619 - DNA, 16 bp, P. troglodytes
cttccagcccccagaa

SEQ ID NO: 239620 - DNA, 16 bp, P. troglodytes
cttccagctcagcctc

SEQ ID NO: 239621 - DNA, 16 bp, P. troglodytes
cttccagctccaccca

SEQ ID NO: 239622 - DNA, 16 bp, P. troglodytes
cttccagcttccttat

SEQ ID NO: 239623 - DNA, 16 bp, P. troglodytes
cttccagcttctgctg

SEQ ID NO: 239624 - DNA, 16 bp, P. troglodytes
cttccagcttctggta

SEQ ID NO: 239625 - DNA, 16 bp, P. troglodytes
cttccaggaagccttc

SEQ ID NO: 239626 - DNA, 16 bp, P. troglodytes
cttccaggccctccca

SEQ ID NO: 239627 - DNA, 16 bp, P. troglodytes
cttccaggctcaagag

SEQ ID NO: 239628 - DNA, 16 bp, P. troglodytes
cttccaggctcaagca

SEQ ID NO: 239629 - DNA, 16 bp, P. troglodytes
cttccagggattttat

SEQ ID NO: 239630 - DNA, 16 bp, P. troglodytes
cttccaggtgattctg

SEQ ID NO: 239631 - DNA, 16 bp, P. troglodytes
cttccagtcttcctgc

SEQ ID NO: 239632 - DNA, 17 bp, P. troglodytes
cttccagttgatcacat

SEQ ID NO: 239633 - DNA, 16 bp, P. troglodytes
cttccagtttctgccc

SEQ ID NO: 239634 - DNA, 16 bp, P. troglodytes
cttccatattttaaaa

SEQ ID NO: 239635 - DNA, 16 bp, P. troglodytes
cttccatcaaagccaa

SEQ ID NO: 239636 - DNA, 16 bp, P. troglodytes
cttccatcatgatttt

SEQ ID NO: 239637 - DNA, 16 bp, P. troglodytes
cttccatctccacatc

SEQ ID NO: 239638 - DNA, 16 bp, P. troglodytes
cttccatgaaacctgt

SEQ ID NO: 239639 - DNA, 16 bp, P. troglodytes
cttccatgagtttgac

SEQ ID NO: 239640 - DNA, 16 bp, P. troglodytes
cttccatgccctctcc

SEQ ID NO: 239641 - DNA, 16 bp, P. troglodytes
cttccatgtcttggct

SEQ ID NO: 239642 - DNA, 16 bp, P. troglodytes
cttccattctgtaggt

SEQ ID NO: 239643 - DNA, 16 bp, P. troglodytes
cttccatttataaaac

SEQ ID NO: 239644 - DNA, 16 bp, P. troglodytes
cttccatttggccttt

SEQ ID NO: 239645 - DNA, 16 bp, P. troglodytes
cttcccaaaggccaca

SEQ ID NO: 239646 - DNA, 16 bp, P. troglodytes
cttcccaacagccccc

SEQ ID NO: 239647 - DNA, 16 bp, P. troglodytes
cttcccaagaaggaca

SEQ ID NO: 239648 - DNA, 16 bp, P. troglodytes
cttcccaaggagctgg

SEQ ID NO: 239649 - DNA, 16 bp, P. troglodytes
cttcccaagttcaagc

SEQ ID NO: 239650 - DNA, 16 bp, P. troglodytes
cttcccacctcagcca

SEQ ID NO: 239651 - DNA, 16 bp, P. troglodytes
cttcccacctcggcct

SEQ ID NO: 239652 - DNA, 16 bp, P. troglodytes
cttcccagagaaggtg

SEQ ID NO: 239653 - DNA, 16 bp, P. troglodytes
cttcccagattcaagc

SEQ ID NO: 239654 - DNA, 16 bp, P. troglodytes
cttcccagcactcctg

SEQ ID NO: 239655 - DNA, 16 bp, P. troglodytes
cttcccagcagctttg

SEQ ID NO: 239656 - DNA, 16 bp, P. troglodytes
cttcccagccatgctt

SEQ ID NO: 239657 - DNA, 16 bp, P. troglodytes
cttcccagcctccagg

SEQ ID NO: 239658 - DNA, 16 bp, P. troglodytes
cttcccagcctcctga

SEQ ID NO: 239659 - DNA, 16 bp, P. troglodytes
cttcccagcctgcaga

SEQ ID NO: 239660 - DNA, 16 bp, P. troglodytes
cttcccagcctgcagg

SEQ ID NO: 239661 - DNA, 16 bp, P. troglodytes
cttcccagcttccaaa

SEQ ID NO: 239662 - DNA, 16 bp, P. troglodytes
cttcccaggctccagt

SEQ ID NO: 239663 - DNA, 16 bp, P. troglodytes
cttcccaggtgattct

SEQ ID NO: 239664 - DNA, 16 bp, P. troglodytes
cttcccaggttcaagc

SEQ ID NO: 239665 - DNA, 21 bp, P. troglodytes
cttcccaggttcacgccattc

SEQ ID NO: 239666 - DNA, 16 bp, P. troglodytes
cttcccagtcatgctt

SEQ ID NO: 239667 - DNA, 16 bp, P. troglodytes
cttcccatctcagcct

SEQ ID NO: 239668 - DNA, 16 bp, P. troglodytes
cttcccattgctctta

SEQ ID NO: 239669 - DNA, 16 bp, P. troglodytes
cttcccattttacaga

SEQ ID NO: 239670 - DNA, 16 bp, P. troglodytes
cttccccaaagtcaca

SEQ ID NO: 239671 - DNA, 16 bp, P. troglodytes
cttccccaacccagca

SEQ ID NO: 239672 - DNA, 16 bp, P. troglodytes
cttccccagcccctgg

SEQ ID NO: 239673 - DNA, 16 bp, P. troglodytes
cttccccagcctccca

SEQ ID NO: 239674 - DNA, 16 bp, P. troglodytes
cttccccagcttgcag

SEQ ID NO: 239675 - DNA, 16 bp, P. troglodytes
cttccccagtcaagcc

SEQ ID NO: 239676 - DNA, 16 bp, P. troglodytes
cttcccccaacccctg

SEQ ID NO: 239677 - DNA, 16 bp, P. troglodytes
cttcccccagcccctg

SEQ ID NO: 239678 - DNA, 16 bp, P. troglodytes
cttcccccaggtgctc

SEQ ID NO: 239679 - DNA, 19 bp, P. troglodytes
cttccccctgcacagatct

SEQ ID NO: 239680 - DNA, 16 bp, P. troglodytes
cttcccctccaaagga

SEQ ID NO: 239681 - DNA, 16 bp, P. troglodytes
cttcccctctccccag

SEQ ID NO: 239682 - DNA, 16 bp, P. troglodytes
cttcccctgaagtctg

SEQ ID NO: 239683 - DNA, 16 bp, P. troglodytes
cttccccttcctgcca

SEQ ID NO: 239684 - DNA, 16 bp, P. troglodytes
cttcccgaggctccac

SEQ ID NO: 239685 - DNA, 16 bp, P. troglodytes
cttcccgggtagctgg

SEQ ID NO: 239686 - DNA, 16 bp, P. troglodytes
cttccctacttttgag

SEQ ID NO: 239687 - DNA, 16 bp, P. troglodytes
cttccctcagcctccc

SEQ ID NO: 239688 - DNA, 16 bp, P. troglodytes
cttccctcctccccag

SEQ ID NO: 239689 - DNA, 16 bp, P. troglodytes
cttccctctctgggcc

SEQ ID NO: 239690 - DNA, 16 bp, P. troglodytes
cttccctgaccaccca

SEQ ID NO: 239691 - DNA, 16 bp, P. troglodytes
cttccctgctgccatg

SEQ ID NO: 239692 - DNA, 16 bp, P. troglodytes
cttccctgggccacag

SEQ ID NO: 239693 - DNA, 16 bp, P. troglodytes
cttccctgggcctcag

SEQ ID NO: 239694 - DNA, 16 bp, P. troglodytes
cttccctgtgtgtgtg

SEQ ID NO: 239695 - DNA, 16 bp, P. troglodytes
cttcccttcagggcag

SEQ ID NO: 239696 - DNA, 16 bp, P. troglodytes
cttccctttccaccat

SEQ ID NO: 239697 - DNA, 16 bp, P. troglodytes
cttcctaaaagtaatc

SEQ ID NO: 239698 - DNA, 16 bp, P. troglodytes
cttcctaaagtgctgg

SEQ ID NO: 239699 - DNA, 16 bp, P. troglodytes
cttcctacacagcctg

SEQ ID NO: 239700 - DNA, 16 bp, P. troglodytes
cttcctatatagcctg

SEQ ID NO: 239701 - DNA, 16 bp, P. troglodytes
cttcctattcatgagc

SEQ ID NO: 239702 - DNA, 16 bp, P. troglodytes
cttcctatttatgagc

SEQ ID NO: 239703 - DNA, 16 bp, P. troglodytes
cttcctcaacctccca

SEQ ID NO: 239704 - DNA, 33 bp, P. troglodytes
cttcctcaaggacttaacttgtgcaagctgact

SEQ ID NO: 239705 - DNA, 16 bp, P. troglodytes
cttcctcacctctcag

SEQ ID NO: 239706 - DNA, 16 bp, P. troglodytes
cttcctcagcccccca

SEQ ID NO: 239707 - DNA, 16 bp, P. troglodytes
cttcctcagcctcccg

SEQ ID NO: 239708 - DNA, 16 bp, P. troglodytes
cttcctcagcctcctg

SEQ ID NO: 239709 - DNA, 16 bp, P. troglodytes
cttcctcaggaaatga

SEQ ID NO: 239710 - DNA, 16 bp, P. troglodytes
cttcctcaggaacacc

SEQ ID NO: 239711 - DNA, 16 bp, P. troglodytes
cttcctcatctccatc

SEQ ID NO: 239712 - DNA, 16 bp, P. troglodytes
cttcctcatctgaaaa

SEQ ID NO: 239713 - DNA, 16 bp, P. troglodytes
cttcctcatctgcaaa

SEQ ID NO: 239714 - DNA, 16 bp, P. troglodytes
cttcctcatttgtaaa

SEQ ID NO: 239715 - DNA, 16 bp, P. troglodytes
cttcctccaaaaaaaa

SEQ ID NO: 239716 - DNA, 16 bp, P. troglodytes
cttcctccagaaagcc

SEQ ID NO: 239717 - DNA, 16 bp, P. troglodytes
cttcctccaggaagcc

SEQ ID NO: 239718 - DNA, 16 bp, P. troglodytes
cttcctccaggcagcc

SEQ ID NO: 239719 - DNA, 16 bp, P. troglodytes
cttcctccaggtgctc

SEQ ID NO: 239720 - DNA, 16 bp, P. troglodytes
cttcctccccaaaaca

SEQ ID NO: 239721 - DNA, 16 bp, P. troglodytes
cttcctccccagcctc

SEQ ID NO: 239722 - DNA, 16 bp, P. troglodytes
cttcctccccagctcc

SEQ ID NO: 239723 - DNA, 16 bp, P. troglodytes
cttcctccccaggctg

SEQ ID NO: 239724 - DNA, 16 bp, P. troglodytes
cttcctccctcagccc

SEQ ID NO: 239725 - DNA, 16 bp, P. troglodytes
cttcctcctcagcctc

SEQ ID NO: 239726 - DNA, 16 bp, P. troglodytes
cttcctcctccccagc

SEQ ID NO: 239727 - DNA, 16 bp, P. troglodytes
cttcctcctcctcagc

SEQ ID NO: 239728 - DNA, 16 bp, P. troglodytes
cttcctccttctctgg

SEQ ID NO: 239729 - DNA, 16 bp, P. troglodytes
cttcctcggcctcctg

SEQ ID NO: 239730 - DNA, 16 bp, P. troglodytes
cttcctctattttttg

SEQ ID NO: 239731 - DNA, 16 bp, P. troglodytes
cttcctctccagcctc

SEQ ID NO: 239732 - DNA, 16 bp, P. troglodytes
cttcctctccccagcc

SEQ ID NO: 239733 - DNA, 16 bp, P. troglodytes
cttcctctgcctggaa

SEQ ID NO: 239734 - DNA, 16 bp, P. troglodytes
cttcctctgctgcctc

SEQ ID NO: 239735 - DNA, 16 bp, P. troglodytes
cttcctcttcagcctc

SEQ ID NO: 239736 - DNA, 16 bp, P. troglodytes
cttcctcttcctcagc

SEQ ID NO: 239737 - DNA, 16 bp, P. troglodytes
cttcctgaaggacctg

SEQ ID NO: 239738 - DNA, 16 bp, P. troglodytes
cttcctgaaggaggtg

SEQ ID NO: 239739 - DNA, 16 bp, P. troglodytes
cttcctgagcccagta

SEQ ID NO: 239740 - DNA, 16 bp, P. troglodytes
cttcctgaggcctcat

SEQ ID NO: 239741 - DNA, 16 bp, P. troglodytes
cttcctgaggctccac

SEQ ID NO: 239742 - DNA, 16 bp, P. troglodytes
cttcctgagtagttgg

SEQ ID NO: 239743 - DNA, 16 bp, P. troglodytes
cttcctgagttgctgg

SEQ ID NO: 239744 - DNA, 16 bp, P. troglodytes
cttcctgatccttcct

SEQ ID NO: 239745 - DNA, 16 bp, P. troglodytes
cttcctgcagctgcag

SEQ ID NO: 239746 - DNA, 16 bp, P. troglodytes
cttcctgccacagcct

SEQ ID NO: 239747 - DNA, 16 bp, P. troglodytes
cttcctgcccttgaac

SEQ ID NO: 239748 - DNA, 16 bp, P. troglodytes
cttcctgcctcagtct

SEQ ID NO: 239749 - DNA, 16 bp, P. troglodytes
cttcctgcctgccctg

SEQ ID NO: 239750 - DNA, 16 bp, P. troglodytes
cttcctgcctgctgca

SEQ ID NO: 239751 - DNA, 16 bp, P. troglodytes
cttcctgcctttgctt

SEQ ID NO: 239752 - DNA, 16 bp, P. troglodytes
cttcctgctccatccc

SEQ ID NO: 239753 - DNA, 16 bp, P. troglodytes
cttcctggagaaggtg

SEQ ID NO: 239754 - DNA, 16 bp, P. troglodytes
cttcctggaggaagag

SEQ ID NO: 239755 - DNA, 16 bp, P. troglodytes
cttcctggaggagctg

SEQ ID NO: 239756 - DNA, 16 bp, P. troglodytes
cttcctggaggaggag

SEQ ID NO: 239757 - DNA, 16 bp, P. troglodytes
cttcctggaggaggtg

SEQ ID NO: 239758 - DNA, 16 bp, P. troglodytes
cttcctggaggtggtg

SEQ ID NO: 239759 - DNA, 16 bp, P. troglodytes
cttcctggcagccaaa

SEQ ID NO: 239760 - DNA, 16 bp, P. troglodytes
cttcctggcagccaag

SEQ ID NO: 239761 - DNA, 16 bp, P. troglodytes
cttcctggcctctttg

SEQ ID NO: 239762 - DNA, 16 bp, P. troglodytes
cttcctggctgtgtgg

SEQ ID NO: 239763 - DNA, 16 bp, P. troglodytes
cttcctggcttgcaga

SEQ ID NO: 239764 - DNA, 16 bp, P. troglodytes
cttcctgggggaggtg

SEQ ID NO: 239765 - DNA, 16 bp, P. troglodytes
cttcctgggtggagtg

SEQ ID NO: 239766 - DNA, 16 bp, P. troglodytes
cttcctgggttcaagc

SEQ ID NO: 239767 - DNA, 16 bp, P. troglodytes
cttcctggttcataaa

SEQ ID NO: 239768 - DNA, 16 bp, P. troglodytes
cttcctgtcagatcag

SEQ ID NO: 239769 - DNA, 16 bp, P. troglodytes
cttcctgtctcagctt

SEQ ID NO: 239770 - DNA, 16 bp, P. troglodytes
cttcctgtctctctgt

SEQ ID NO: 239771 - DNA, 16 bp, P. troglodytes
cttcctgtgcctggct

SEQ ID NO: 239772 - DNA, 16 bp, P. troglodytes
cttcctgtgtccatat

SEQ ID NO: 239773 - DNA, 16 bp, P. troglodytes
cttcctgtgtctggct

SEQ ID NO: 239774 - DNA, 16 bp, P. troglodytes
cttccttagcctccca

SEQ ID NO: 239775 - DNA, 16 bp, P. troglodytes
cttccttatctgtaaa

SEQ ID NO: 239776 - DNA, 18 bp, P. troglodytes
cttccttcaggagctctt

SEQ ID NO: 239777 - DNA, 16 bp, P. troglodytes
cttccttccttccaga

SEQ ID NO: 239778 - DNA, 16 bp, P. troglodytes
cttccttcgggagctc

SEQ ID NO: 239779 - DNA, 16 bp, P. troglodytes
cttccttctttccaat

SEQ ID NO: 239780 - DNA, 16 bp, P. troglodytes
cttccttgagcagtgg

SEQ ID NO: 239781 - DNA, 16 bp, P. troglodytes
cttccttggcatctgg

SEQ ID NO: 239782 - DNA, 16 bp, P. troglodytes
cttcctttgctgtgca

SEQ ID NO: 239783 - DNA, 16 bp, P. troglodytes
cttcctttgggagctc

SEQ ID NO: 239784 - DNA, 16 bp, P. troglodytes
cttccttttaatgaag

SEQ ID NO: 239785 - DNA, 16 bp, P. troglodytes
cttccttttggtgggt

SEQ ID NO: 239786 - DNA, 16 bp, P. troglodytes
cttccttttgttccca

SEQ ID NO: 239787 - DNA, 16 bp, P. troglodytes
cttcgagaccagcctg

SEQ ID NO: 239788 - DNA, 16 bp, P. troglodytes
cttcgggaggtggagg

SEQ ID NO: 239789 - DNA, 16 bp, P. troglodytes
cttcggttctgctctg

SEQ ID NO: 239790 - DNA, 16 bp, P. troglodytes
cttcgtttttaacaaa

SEQ ID NO: 239791 - DNA, 16 bp, P. troglodytes
cttctaaacaaccaga

SEQ ID NO: 239792 - DNA, 16 bp, P. troglodytes
cttctaagaactggaa

SEQ ID NO: 239793 - DNA, 16 bp, P. troglodytes
cttctaaggcctctct

SEQ ID NO: 239794 - DNA, 16 bp, P. troglodytes
cttctaagttttctag

SEQ ID NO: 239795 - DNA, 16 bp, P. troglodytes
cttctacctcttggct

SEQ ID NO: 239796 - DNA, 16 bp, P. troglodytes
cttctagaagaaagca

SEQ ID NO: 239797 - DNA, 16 bp, P. troglodytes
cttctagaggccaccc

SEQ ID NO: 239798 - DNA, 16 bp, P. troglodytes
cttctagattgtctag

SEQ ID NO: 239799 - DNA, 16 bp, P. troglodytes
cttctaggagttttaa

SEQ ID NO: 239800 - DNA, 16 bp, P. troglodytes
cttctagggtttttgt

SEQ ID NO: 239801 - DNA, 16 bp, P. troglodytes
cttctagtcagccatc

SEQ ID NO: 239802 - DNA, 16 bp, P. troglodytes
cttctatccatgaaat

SEQ ID NO: 239803 - DNA, 16 bp, P. troglodytes
cttctatgtcttcttc

SEQ ID NO: 239804 - DNA, 16 bp, P. troglodytes
cttctatttcattgag

SEQ ID NO: 239805 - DNA, 16 bp, P. troglodytes
cttctcaaaagaagaa

SEQ ID NO: 239806 - DNA, 16 bp, P. troglodytes
cttctcaaaaggagac

SEQ ID NO: 239807 - DNA, 16 bp, P. troglodytes
cttctcaactggaaaa

SEQ ID NO: 239808 - DNA, 16 bp, P. troglodytes
cttctcacaagacttt

SEQ ID NO: 239809 - DNA, 16 bp, P. troglodytes
cttctcactgtgtcct

SEQ ID NO: 239810 - DNA, 16 bp, P. troglodytes
cttctcagcaaatgta

SEQ ID NO: 239811 - DNA, 16 bp, P. troglodytes
cttctcagcctctctg

SEQ ID NO: 239812 - DNA, 16 bp, P. troglodytes
cttctcagcctctgta

SEQ ID NO: 239813 - DNA, 16 bp, P. troglodytes
cttctcagcctgcaga

SEQ ID NO: 239814 - DNA, 16 bp, P. troglodytes
cttctcagggctagct

SEQ ID NO: 239815 - DNA, 16 bp, P. troglodytes
cttctcatctggaaaa

SEQ ID NO: 239816 - DNA, 16 bp, P. troglodytes
cttctcatggtggcag

SEQ ID NO: 239817 - DNA, 16 bp, P. troglodytes
cttctccaccatgatc

SEQ ID NO: 239818 - DNA, 16 bp, P. troglodytes
cttctccagcaagggc

SEQ ID NO: 239819 - DNA, 16 bp, P. troglodytes
cttctccatgttggtc

SEQ ID NO: 239820 - DNA, 16 bp, P. troglodytes
cttctcccaggctgga

SEQ ID NO: 239821 - DNA, 16 bp, P. troglodytes
cttctcccctccccag

SEQ ID NO: 239822 - DNA, 16 bp, P. troglodytes
cttctcctcccaggtt

SEQ ID NO: 239823 - DNA, 16 bp, P. troglodytes
cttctcctcctccaaa

SEQ ID NO: 239824 - DNA, 16 bp, P. troglodytes
cttctcctctctgctg

SEQ ID NO: 239825 - DNA, 16 bp, P. troglodytes
cttctcctgccctctg

SEQ ID NO: 239826 - DNA, 16 bp, P. troglodytes
cttctcctgcctaatt

SEQ ID NO: 239827 - DNA, 20 bp, P. troglodytes
cttctcctgcctcagcctcc

SEQ ID NO: 239828 - DNA, 16 bp, P. troglodytes
cttctcctgcctcatt

SEQ ID NO: 239829 - DNA, 16 bp, P. troglodytes
cttctccttcctgcag

SEQ ID NO: 239830 - DNA, 16 bp, P. troglodytes
cttctcgctttatttc

SEQ ID NO: 239831 - DNA, 16 bp, P. troglodytes
cttctctaccaaaaat

SEQ ID NO: 239832 - DNA, 16 bp, P. troglodytes
cttctctctgctgaga

SEQ ID NO: 239833 - DNA, 16 bp, P. troglodytes
cttctctgagcctgtt

SEQ ID NO: 239834 - DNA, 16 bp, P. troglodytes
cttctctgagctccag

SEQ ID NO: 239835 - DNA, 16 bp, P. troglodytes
cttctctgaggaagtg

SEQ ID NO: 239836 - DNA, 16 bp, P. troglodytes
cttctctgcacctcag

SEQ ID NO: 239837 - DNA, 16 bp, P. troglodytes
cttctctggctctcct

SEQ ID NO: 239838 - DNA, 16 bp, P. troglodytes
cttctctggttttggt

SEQ ID NO: 239839 - DNA, 16 bp, P. troglodytes
cttctctgtgaagcct

SEQ ID NO: 239840 - DNA, 16 bp, P. troglodytes
cttctctgtgcctcag

SEQ ID NO: 239841 - DNA, 16 bp, P. troglodytes
cttctctgtgtccatg

SEQ ID NO: 239842 - DNA, 16 bp, P. troglodytes
cttctctttggcatat

SEQ ID NO: 239843 - DNA, 16 bp, P. troglodytes
cttctcttttaaaatt

SEQ ID NO: 239844 - DNA, 16 bp, P. troglodytes
cttctgaaagaaaaaa

SEQ ID NO: 239845 - DNA, 16 bp, P. troglodytes
cttctgaagctgggag

SEQ ID NO: 239846 - DNA, 16 bp, P. troglodytes
cttctgaccaactggc

SEQ ID NO: 239847 - DNA, 16 bp, P. troglodytes
cttctgacccacagaa

SEQ ID NO: 239848 - DNA, 16 bp, P. troglodytes
cttctgacctccagga

SEQ ID NO: 239849 - DNA, 17 bp, P. troglodytes
cttctgacctcgtgatc

SEQ ID NO: 239850 - DNA, 16 bp, P. troglodytes
cttctgagctcaagca

SEQ ID NO: 239851 - DNA, 16 bp, P. troglodytes
cttctgagtctcagtt

SEQ ID NO: 239852 - DNA, 16 bp, P. troglodytes
cttctgagtttctgat

SEQ ID NO: 239853 - DNA, 16 bp, P. troglodytes
cttctgatttcttctt

SEQ ID NO: 239854 - DNA, 16 bp, P. troglodytes
cttctgcaaaaaaaaa

SEQ ID NO: 239855 - DNA, 16 bp, P. troglodytes
cttctgcacagcaaag

SEQ ID NO: 239856 - DNA, 16 bp, P. troglodytes
cttctgcacaggaaag

SEQ ID NO: 239857 - DNA, 16 bp, P. troglodytes
cttctgcagttttctt

SEQ ID NO: 239858 - DNA, 16 bp, P. troglodytes
cttctgccacagcctc

SEQ ID NO: 239859 - DNA, 16 bp, P. troglodytes
cttctgccagacaccc

SEQ ID NO: 239860 - DNA, 16 bp, P. troglodytes
cttctgccatgattgg

SEQ ID NO: 239861 - DNA, 16 bp, P. troglodytes
cttctgccatgattgt

SEQ ID NO: 239862 - DNA, 16 bp, P. troglodytes
cttctgcccagcaaag

SEQ ID NO: 239863 - DNA, 16 bp, P. troglodytes
cttctgccgtggcttc

SEQ ID NO: 239864 - DNA, 16 bp, P. troglodytes
cttctgcctaagcctc

SEQ ID NO: 239865 - DNA, 16 bp, P. troglodytes
cttctgcctcagcccc

SEQ ID NO: 239866 - DNA, 16 bp, P. troglodytes
cttctgcctcagccct

SEQ ID NO: 239867 - DNA, 16 bp, P. troglodytes
cttctgcctccacctc

SEQ ID NO: 239868 - DNA, 16 bp, P. troglodytes
cttctgcctctgccat

SEQ ID NO: 239869 - DNA, 16 bp, P. troglodytes
cttctgcctctgccct

SEQ ID NO: 239870 - DNA, 16 bp, P. troglodytes
cttctgcctgagtatt

SEQ ID NO: 239871 - DNA, 16 bp, P. troglodytes
cttctgcctggaacac

SEQ ID NO: 239872 - DNA, 16 bp, P. troglodytes
cttctgcctggacatg

SEQ ID NO: 239873 - DNA, 16 bp, P. troglodytes
cttctgccttagtctc

SEQ ID NO: 239874 - DNA, 16 bp, P. troglodytes
cttctgccttgtatcc

SEQ ID NO: 239875 - DNA, 16 bp, P. troglodytes
cttctgctatcttgct

SEQ ID NO: 239876 - DNA, 16 bp, P. troglodytes
cttctgctcacatttt

SEQ ID NO: 239877 - DNA, 16 bp, P. troglodytes
cttctgctctaaaact

SEQ ID NO: 239878 - DNA, 16 bp, P. troglodytes
cttctgctgagtttgg

SEQ ID NO: 239879 - DNA, 16 bp, P. troglodytes
cttctgctgctgctgc

SEQ ID NO: 239880 - DNA, 16 bp, P. troglodytes
cttctgctgctgcttt

SEQ ID NO: 239881 - DNA, 16 bp, P. troglodytes
cttctgcttacctttt

SEQ ID NO: 239882 - DNA, 16 bp, P. troglodytes
cttctgcttcagtctc

SEQ ID NO: 239883 - DNA, 16 bp, P. troglodytes
cttctgcttctgagga

SEQ ID NO: 239884 - DNA, 16 bp, P. troglodytes
cttctgcttctgggag

SEQ ID NO: 239885 - DNA, 16 bp, P. troglodytes
cttctgcttctgggga

SEQ ID NO: 239886 - DNA, 16 bp, P. troglodytes
cttctgcttttctgcc

SEQ ID NO: 239887 - DNA, 16 bp, P. troglodytes
cttctggaagctgcag

SEQ ID NO: 239888 - DNA, 16 bp, P. troglodytes
cttctggagcctgggg

SEQ ID NO: 239889 - DNA, 16 bp, P. troglodytes
cttctggaggctctga

SEQ ID NO: 239890 - DNA, 16 bp, P. troglodytes
cttctggcctccatgg

SEQ ID NO: 239891 - DNA, 16 bp, P. troglodytes
cttctggcctctggaa

SEQ ID NO: 239892 - DNA, 16 bp, P. troglodytes
cttctggctttcatct

SEQ ID NO: 239893 - DNA, 16 bp, P. troglodytes
cttctgggagttttat

SEQ ID NO: 239894 - DNA, 16 bp, P. troglodytes
cttctgggcctcagtt

SEQ ID NO: 239895 - DNA, 16 bp, P. troglodytes
cttctgggtagctggg

SEQ ID NO: 239896 - DNA, 16 bp, P. troglodytes
cttctgggtgtgtctg

SEQ ID NO: 239897 - DNA, 16 bp, P. troglodytes
cttctgggttcaaatg

SEQ ID NO: 239898 - DNA, 16 bp, P. troglodytes
cttctggtatgagaaa

SEQ ID NO: 239899 - DNA, 16 bp, P. troglodytes
cttctggtcttaaagc

SEQ ID NO: 239900 - DNA, 16 bp, P. troglodytes
cttctggtggttgcca

SEQ ID NO: 239901 - DNA, 16 bp, P. troglodytes
cttctgtagttctttt

SEQ ID NO: 239902 - DNA, 16 bp, P. troglodytes
cttctgtattcccctg

SEQ ID NO: 239903 - DNA, 16 bp, P. troglodytes
cttctgtcttagcctc

SEQ ID NO: 239904 - DNA, 16 bp, P. troglodytes
cttctgtgaaatgggg

SEQ ID NO: 239905 - DNA, 16 bp, P. troglodytes
cttctgtgtcctcaca

SEQ ID NO: 239906 - DNA, 16 bp, P. troglodytes
cttctgtgtctggttt

SEQ ID NO: 239907 - DNA, 16 bp, P. troglodytes
cttctgttcctagttt

SEQ ID NO: 239908 - DNA, 16 bp, P. troglodytes
cttctgttggaagaag

SEQ ID NO: 239909 - DNA, 16 bp, P. troglodytes
cttctgttttctcaaa

SEQ ID NO: 239910 - DNA, 16 bp, P. troglodytes
cttctgttttctcagt

SEQ ID NO: 239911 - DNA, 16 bp, P. troglodytes
cttctgtttttcaaaa

SEQ ID NO: 239912 - DNA, 16 bp, P. troglodytes
cttcttaactttctgt

SEQ ID NO: 239913 - DNA, 16 bp, P. troglodytes
cttcttaagctgataa

SEQ ID NO: 239914 - DNA, 16 bp, P. troglodytes
cttcttataagagcac

SEQ ID NO: 239915 - DNA, 16 bp, P. troglodytes
cttcttatgagaatct

SEQ ID NO: 239916 - DNA, 16 bp, P. troglodytes
cttcttcacatggctg

SEQ ID NO: 239917 - DNA, 16 bp, P. troglodytes
cttcttcagagaaatg

SEQ ID NO: 239918 - DNA, 16 bp, P. troglodytes
cttcttcagctccaag

SEQ ID NO: 239919 - DNA, 16 bp, P. troglodytes
cttcttcagctgataa

SEQ ID NO: 239920 - DNA, 16 bp, P. troglodytes
cttcttccaaaagaag

SEQ ID NO: 239921 - DNA, 16 bp, P. troglodytes
cttcttcctcaggaat

SEQ ID NO: 239922 - DNA, 16 bp, P. troglodytes
cttcttcctgctgaca

SEQ ID NO: 239923 - DNA, 16 bp, P. troglodytes
cttcttcctttcaaat

SEQ ID NO: 239924 - DNA, 16 bp, P. troglodytes
cttcttctatgtcttc

SEQ ID NO: 239925 - DNA, 16 bp, P. troglodytes
cttcttctgtcaccca

SEQ ID NO: 239926 - DNA, 16 bp, P. troglodytes
cttcttctgtctgtgt

SEQ ID NO: 239927 - DNA, 16 bp, P. troglodytes
cttcttgcctggggac

SEQ ID NO: 239928 - DNA, 16 bp, P. troglodytes
cttcttgctggtggag

SEQ ID NO: 239929 - DNA, 16 bp, P. troglodytes
cttcttgctgtgtcct

SEQ ID NO: 239930 - DNA, 16 bp, P. troglodytes
cttcttgcttcatttc

SEQ ID NO: 239931 - DNA, 16 bp, P. troglodytes
cttcttggatctgtgg

SEQ ID NO: 239932 - DNA, 16 bp, P. troglodytes
cttcttggcttctctg

SEQ ID NO: 239933 - DNA, 16 bp, P. troglodytes
cttcttgtatttgaat

SEQ ID NO: 239934 - DNA, 16 bp, P. troglodytes
cttcttgttgaaatga

SEQ ID NO: 239935 - DNA, 16 bp, P. troglodytes
cttctttaaaaaagaa

SEQ ID NO: 239936 - DNA, 16 bp, P. troglodytes
cttctttcaaaattag

SEQ ID NO: 239937 - DNA, 16 bp, P. troglodytes
cttctttcacttagga

SEQ ID NO: 239938 - DNA, 16 bp, P. troglodytes
cttctttccagttttt

SEQ ID NO: 239939 - DNA, 16 bp, P. troglodytes
cttctttgtctcattt

SEQ ID NO: 239940 - DNA, 16 bp, P. troglodytes
cttcttttaagatttt

SEQ ID NO: 239941 - DNA, 16 bp, P. troglodytes
cttcttttactcaaca

SEQ ID NO: 239942 - DNA, 16 bp, P. troglodytes
cttcttttacttagca

SEQ ID NO: 239943 - DNA, 16 bp, P. troglodytes
cttcttttcagaagtg

SEQ ID NO: 239944 - DNA, 16 bp, P. troglodytes
cttcttttcctaattg

SEQ ID NO: 239945 - DNA, 16 bp, P. troglodytes
cttcttttcctctggg

SEQ ID NO: 239946 - DNA, 16 bp, P. troglodytes
cttcttttgaaaatta

SEQ ID NO: 239947 - DNA, 16 bp, P. troglodytes
cttcttttggattatt

SEQ ID NO: 239948 - DNA, 16 bp, P. troglodytes
cttcttttgtgaagta

SEQ ID NO: 239949 - DNA, 16 bp, P. troglodytes
cttctttttcaaaact

SEQ ID NO: 239950 - DNA, 16 bp, P. troglodytes
cttcttttttaaaaaa

SEQ ID NO: 239951 - DNA, 16 bp, P. troglodytes
cttgaaaaaaatcaaa

SEQ ID NO: 239952 - DNA, 16 bp, P. troglodytes
cttgaaaaagaaaagc

SEQ ID NO: 239953 - DNA, 16 bp, P. troglodytes
cttgaaaactggaaca

SEQ ID NO: 239954 - DNA, 16 bp, P. troglodytes
cttgaaaatattttct

SEQ ID NO: 239955 - DNA, 16 bp, P. troglodytes
cttgaaaatcactaag

SEQ ID NO: 239956 - DNA, 16 bp, P. troglodytes
cttgaaaattattttt

SEQ ID NO: 239957 - DNA, 16 bp, P. troglodytes
cttgaaaattgcttag

SEQ ID NO: 239958 - DNA, 16 bp, P. troglodytes
cttgaaaccagaaggc

SEQ ID NO: 239959 - DNA, 16 bp, P. troglodytes
cttgaaaccaggaggc

SEQ ID NO: 239960 - DNA, 16 bp, P. troglodytes
cttgaaactcagggcc

SEQ ID NO: 239961 - DNA, 16 bp, P. troglodytes
cttgaaacttaaaaaa

SEQ ID NO: 239962 - DNA, 16 bp, P. troglodytes
cttgaaagaagacatt

SEQ ID NO: 239963 - DNA, 16 bp, P. troglodytes
cttgaaagagaaaaaa

SEQ ID NO: 239964 - DNA, 16 bp, P. troglodytes
cttgaaagtcagaatt

SEQ ID NO: 239965 - DNA, 16 bp, P. troglodytes
cttgaaatcaggagtt

SEQ ID NO: 239966 - DNA, 16 bp, P. troglodytes
cttgaaattaaaaaca

SEQ ID NO: 239967 - DNA, 16 bp, P. troglodytes
cttgaaattcactttt

SEQ ID NO: 239968 - DNA, 16 bp, P. troglodytes
cttgaaatttgctgag

SEQ ID NO: 239969 - DNA, 16 bp, P. troglodytes
cttgaacaagtcattt

SEQ ID NO: 239970 - DNA, 16 bp, P. troglodytes
cttgaacaatgtggga

SEQ ID NO: 239971 - DNA, 16 bp, P. troglodytes
cttgaacacctggcct

SEQ ID NO: 239972 - DNA, 16 bp, P. troglodytes
cttgaacacgggaggc

SEQ ID NO: 239973 - DNA, 16 bp, P. troglodytes
cttgaaccaggaaggc

SEQ ID NO: 239974 - DNA, 16 bp, P. troglodytes
cttgaaccagggaggc

SEQ ID NO: 239975 - DNA, 16 bp, P. troglodytes
cttgaaccagggagtc

SEQ ID NO: 239976 - DNA, 16 bp, P. troglodytes
cttgaaccagggagtt

SEQ ID NO: 239977 - DNA, 18 bp, P. troglodytes
cttgaaccagggagttgg

SEQ ID NO: 239978 - DNA, 16 bp, P. troglodytes
cttgaacccaagaggc

SEQ ID NO: 239979 - DNA, 16 bp, P. troglodytes
cttgaacccagaaggc

SEQ ID NO: 239980 - DNA, 16 bp, P. troglodytes
cttgaacccagaaggt

SEQ ID NO: 239981 - DNA, 16 bp, P. troglodytes
cttgaacccagcaggc

SEQ ID NO: 239982 - DNA, 16 bp, P. troglodytes
cttgaacccaggaagc

SEQ ID NO: 239983 - DNA, 16 bp, P. troglodytes
cttgaacccaggagcc

SEQ ID NO: 239984 - DNA, 16 bp, P. troglodytes
cttgaacccaggagga

SEQ ID NO: 239985 - DNA, 16 bp, P. troglodytes
cttgaacccaggaggc

SEQ ID NO: 239986 - DNA, 16 bp, P. troglodytes
cttgaacccaggaggt

SEQ ID NO: 239987 - DNA, 16 bp, P. troglodytes
cttgaacccaggagtt

SEQ ID NO: 239988 - DNA, 16 bp, P. troglodytes
cttgaacccaggtggc

SEQ ID NO: 239989 - DNA, 16 bp, P. troglodytes
cttgaacccatgaggc

SEQ ID NO: 239990 - DNA, 16 bp, P. troglodytes
cttgaacccgaaaggc

SEQ ID NO: 239991 - DNA, 16 bp, P. troglodytes
cttgaacccgagagga

SEQ ID NO: 239992 - DNA, 16 bp, P. troglodytes
cttgaacccgagaggc

SEQ ID NO: 239993 - DNA, 16 bp, P. troglodytes
cttgaacccggaaggc

SEQ ID NO: 239994 - DNA, 16 bp, P. troglodytes
cttgaacccggcaggc

SEQ ID NO: 239995 - DNA, 16 bp, P. troglodytes
cttgaacccgggaagc

SEQ ID NO: 239996 - DNA, 16 bp, P. troglodytes
cttgaacccgggaggc

SEQ ID NO: 239997 - DNA, 16 bp, P. troglodytes
cttgaacccgggaggg

SEQ ID NO: 239998 - DNA, 16 bp, P. troglodytes
cttgaacccgggaggt

SEQ ID NO: 239999 - DNA, 16 bp, P. troglodytes
cttgaacccgggtggc

SEQ ID NO: 240000 - DNA, 16 bp, P. troglodytes
cttgaaccctagaggc

SEQ ID NO: 240001 - DNA, 16 bp, P. troglodytes
cttgaaccctggaggc

SEQ ID NO: 240002 - DNA, 17 bp, P. troglodytes
cttgaaccctggaggta

SEQ ID NO: 240003 - DNA, 16 bp, P. troglodytes
cttgaaccggggaggc

SEQ ID NO: 240004 - DNA, 16 bp, P. troglodytes
cttgaaccggggaggt

SEQ ID NO: 240005 - DNA, 16 bp, P. troglodytes
cttgaacctaggaggc

SEQ ID NO: 240006 - DNA, 16 bp, P. troglodytes
cttgaacctaggaggt

SEQ ID NO: 240007 - DNA, 16 bp, P. troglodytes
cttgaacctcagaggc

SEQ ID NO: 240008 - DNA, 16 bp, P. troglodytes
cttgaacctgcgaggc

SEQ ID NO: 240009 - DNA, 16 bp, P. troglodytes
cttgaacctggaaggc

SEQ ID NO: 240010 - DNA, 16 bp, P. troglodytes
cttgaacctgggaaac

SEQ ID NO: 240011 - DNA, 16 bp, P. troglodytes
cttgaacctgggacac

SEQ ID NO: 240012 - DNA, 16 bp, P. troglodytes
cttgaacctgggaggc

SEQ ID NO: 240013 - DNA, 16 bp, P. troglodytes
cttgaacctgggaggg

SEQ ID NO: 240014 - DNA, 16 bp, P. troglodytes
cttgaacctgggaggt

SEQ ID NO: 240015 - DNA, 16 bp, P. troglodytes
cttgaacctgggagtt

SEQ ID NO: 240016 - DNA, 16 bp, P. troglodytes
cttgaacctgggatgt

SEQ ID NO: 240017 - DNA, 16 bp, P. troglodytes
cttgaacctggggggc

SEQ ID NO: 240018 - DNA, 16 bp, P. troglodytes
cttgaacctgtgaggc

SEQ ID NO: 240019 - DNA, 16 bp, P. troglodytes
cttgaacgcgggaggc

SEQ ID NO: 240020 - DNA, 16 bp, P. troglodytes
cttgaactcagaaggc

SEQ ID NO: 240021 - DNA, 16 bp, P. troglodytes
cttgaactcagctctg

SEQ ID NO: 240022 - DNA, 16 bp, P. troglodytes
cttgaactcagctgtg

SEQ ID NO: 240023 - DNA, 16 bp, P. troglodytes
cttgaactcaggagac

SEQ ID NO: 240024 - DNA, 16 bp, P. troglodytes
cttgaactcaggagat

SEQ ID NO: 240025 - DNA, 16 bp, P. troglodytes
cttgaactcaggaggc

SEQ ID NO: 240026 - DNA, 16 bp, P. troglodytes
cttgaactccagagct

SEQ ID NO: 240027 - DNA, 16 bp, P. troglodytes
cttgaactcctggact

SEQ ID NO: 240028 - DNA, 16 bp, P. troglodytes
cttgaactcctggatg

SEQ ID NO: 240029 - DNA, 16 bp, P. troglodytes
cttgaactcctggctt

SEQ ID NO: 240030 - DNA, 16 bp, P. troglodytes
cttgaactcctgggtt

SEQ ID NO: 240031 - DNA, 16 bp, P. troglodytes
cttgaactccttgcct

SEQ ID NO: 240032 - DNA, 16 bp, P. troglodytes
cttgaactcgggaggc

SEQ ID NO: 240033 - DNA, 16 bp, P. troglodytes
cttgaactcgggaggt

SEQ ID NO: 240034 - DNA, 16 bp, P. troglodytes
cttgaactctggacct

SEQ ID NO: 240035 - DNA, 16 bp, P. troglodytes
cttgaactctggggct

SEQ ID NO: 240036 - DNA, 16 bp, P. troglodytes
cttgaactgaggaggt

SEQ ID NO: 240037 - DNA, 16 bp, P. troglodytes
cttgaactggggaagc

SEQ ID NO: 240038 - DNA, 16 bp, P. troglodytes
cttgaactggggaggc

SEQ ID NO: 240039 - DNA, 16 bp, P. troglodytes
cttgaactggggaggt

SEQ ID NO: 240040 - DNA, 16 bp, P. troglodytes
cttgaacttctggcct

SEQ ID NO: 240041 - DNA, 16 bp, P. troglodytes
cttgaacttgggaggc

SEQ ID NO: 240042 - DNA, 16 bp, P. troglodytes
cttgaacttgggaggg

SEQ ID NO: 240043 - DNA, 16 bp, P. troglodytes
cttgaactttggaggc

SEQ ID NO: 240044 - DNA, 16 bp, P. troglodytes
cttgaagaatctgatg

SEQ ID NO: 240045 - DNA, 16 bp, P. troglodytes
cttgaagacagcagaa

SEQ ID NO: 240046 - DNA, 16 bp, P. troglodytes
cttgaagacattatgc

SEQ ID NO: 240047 - DNA, 16 bp, P. troglodytes
cttgaagaccttccag

SEQ ID NO: 240048 - DNA, 17 bp, P. troglodytes
cttgaagaggtccttca

SEQ ID NO: 240049 - DNA, 16 bp, P. troglodytes
cttgaagatgaggagt

SEQ ID NO: 240050 - DNA, 16 bp, P. troglodytes
cttgaagcaaatgaaa

SEQ ID NO: 240051 - DNA, 16 bp, P. troglodytes
cttgaagccagcacag

SEQ ID NO: 240052 - DNA, 16 bp, P. troglodytes
cttgaagccaggagtt

SEQ ID NO: 240053 - DNA, 16 bp, P. troglodytes
cttgaagccgggaggc

SEQ ID NO: 240054 - DNA, 16 bp, P. troglodytes
cttgaagccgggagtt

SEQ ID NO: 240055 - DNA, 16 bp, P. troglodytes
cttgaaggatgaatgc

SEQ ID NO: 240056 - DNA, 16 bp, P. troglodytes
cttgaagtcaggagtt

SEQ ID NO: 240057 - DNA, 16 bp, P. troglodytes
cttgaataaacatcag

SEQ ID NO: 240058 - DNA, 16 bp, P. troglodytes
cttgaatatgggaggc

SEQ ID NO: 240059 - DNA, 16 bp, P. troglodytes
cttgaatccagcaggc

SEQ ID NO: 240060 - DNA, 16 bp, P. troglodytes
cttgaatccaggaggc

SEQ ID NO: 240061 - DNA, 16 bp, P. troglodytes
cttgaatccgggaggc

SEQ ID NO: 240062 - DNA, 16 bp, P. troglodytes
cttgaatccgggaggt

SEQ ID NO: 240063 - DNA, 16 bp, P. troglodytes
cttgaatcctggaggc

SEQ ID NO: 240064 - DNA, 16 bp, P. troglodytes
cttgaatctaaaataa

SEQ ID NO: 240065 - DNA, 16 bp, P. troglodytes
cttgaatctaggaggc

SEQ ID NO: 240066 - DNA, 16 bp, P. troglodytes
cttgaatctgggaggc

SEQ ID NO: 240067 - DNA, 16 bp, P. troglodytes
cttgaatgtgggaggc

SEQ ID NO: 240068 - DNA, 16 bp, P. troglodytes
cttgaattcctcctca

SEQ ID NO: 240069 - DNA, 16 bp, P. troglodytes
cttgaattcctgtcct

SEQ ID NO: 240070 - DNA, 16 bp, P. troglodytes
cttgacattttttcct

SEQ ID NO: 240071 - DNA, 16 bp, P. troglodytes
cttgacccaggagttc

SEQ ID NO: 240072 - DNA, 16 bp, P. troglodytes
cttgaccccaggaggt

SEQ ID NO: 240073 - DNA, 16 bp, P. troglodytes
cttgaccctaggagtt

SEQ ID NO: 240074 - DNA, 16 bp, P. troglodytes
cttgaccctgggaagt

SEQ ID NO: 240075 - DNA, 16 bp, P. troglodytes
cttgacctccccaagt

SEQ ID NO: 240076 - DNA, 16 bp, P. troglodytes
cttgacctcctaggct

SEQ ID NO: 240077 - DNA, 16 bp, P. troglodytes
cttgaccttccaggtt

SEQ ID NO: 240078 - DNA, 16 bp, P. troglodytes
cttgaccttgatggag

SEQ ID NO: 240079 - DNA, 16 bp, P. troglodytes
cttgactccaggagtt

SEQ ID NO: 240080 - DNA, 16 bp, P. troglodytes
cttgactgaaacttta

SEQ ID NO: 240081 - DNA, 16 bp, P. troglodytes
cttgacttcagaggga

SEQ ID NO: 240082 - DNA, 16 bp, P. troglodytes
cttgacttctctgagc

SEQ ID NO: 240083 - DNA, 16 bp, P. troglodytes
cttgactttagcccag

SEQ ID NO: 240084 - DNA, 16 bp, P. troglodytes
cttgacttttcccttt

SEQ ID NO: 240085 - DNA, 16 bp, P. troglodytes
cttgacttttctttct

SEQ ID NO: 240086 - DNA, 16 bp, P. troglodytes
cttgactttttaaaaa

SEQ ID NO: 240087 - DNA, 16 bp, P. troglodytes
cttgagaagctgggac

SEQ ID NO: 240088 - DNA, 16 bp, P. troglodytes
cttgagacagggtctc

SEQ ID NO: 240089 - DNA, 16 bp, P. troglodytes
cttgagaccaagagtt

SEQ ID NO: 240090 - DNA, 16 bp, P. troglodytes
cttgagaccaggagtt

SEQ ID NO: 240091 - DNA, 16 bp, P. troglodytes
cttgagacccaggaag

SEQ ID NO: 240092 - DNA, 16 bp, P. troglodytes
cttgagatcaggagtt

SEQ ID NO: 240093 - DNA, 16 bp, P. troglodytes
cttgagcaaattaaca

SEQ ID NO: 240094 - DNA, 16 bp, P. troglodytes
cttgagcaagtcactt

SEQ ID NO: 240095 - DNA, 16 bp, P. troglodytes
cttgagcaagtcattt

SEQ ID NO: 240096 - DNA, 16 bp, P. troglodytes
cttgagcacaggagtt

SEQ ID NO: 240097 - DNA, 16 bp, P. troglodytes
cttgagcatccacaga

SEQ ID NO: 240098 - DNA, 16 bp, P. troglodytes
cttgagccaccacgcc

SEQ ID NO: 240099 - DNA, 16 bp, P. troglodytes
cttgagcccaagaggt

SEQ ID NO: 240100 - DNA, 16 bp, P. troglodytes
cttgagcccaagagtt

SEQ ID NO: 240101 - DNA, 16 bp, P. troglodytes
cttgagcccacgaatt

SEQ ID NO: 240102 - DNA, 16 bp, P. troglodytes
cttgagcccacgagtt

SEQ ID NO: 240103 - DNA, 16 bp, P. troglodytes
cttgagcccagaagat

SEQ ID NO: 240104 - DNA, 16 bp, P. troglodytes
cttgagcccagaagct

SEQ ID NO: 240105 - DNA, 16 bp, P. troglodytes
cttgagcccagaaggt

SEQ ID NO: 240106 - DNA, 16 bp, P. troglodytes
cttgagcccagaagtt

SEQ ID NO: 240107 - DNA, 16 bp, P. troglodytes
cttgagcccagcagct

SEQ ID NO: 240108 - DNA, 16 bp, P. troglodytes
cttgagcccaggaagt

SEQ ID NO: 240109 - DNA, 16 bp, P. troglodytes
cttgagcccaggaatt

SEQ ID NO: 240110 - DNA, 16 bp, P. troglodytes
cttgagcccaggagac

SEQ ID NO: 240111 - DNA, 16 bp, P. troglodytes
cttgagcccaggagat

SEQ ID NO: 240112 - DNA, 16 bp, P. troglodytes
cttgagcccaggagct

SEQ ID NO: 240113 - DNA, 16 bp, P. troglodytes
cttgagcccaggagga

SEQ ID NO: 240114 - DNA, 16 bp, P. troglodytes
cttgagcccaggaggc

SEQ ID NO: 240115 - DNA, 16 bp, P. troglodytes
cttgagcccaggaggt

SEQ ID NO: 240116 - DNA, 16 bp, P. troglodytes
cttgagcccaggagtc

SEQ ID NO: 240117 - DNA, 16 bp, P. troglodytes
cttgagcccaggagtt

SEQ ID NO: 240118 - DNA, 16 bp, P. troglodytes
cttgagcccaggattt

SEQ ID NO: 240119 - DNA, 16 bp, P. troglodytes
cttgagcccaggcggt

SEQ ID NO: 240120 - DNA, 16 bp, P. troglodytes
cttgagcccaggggtt

SEQ ID NO: 240121 - DNA, 16 bp, P. troglodytes
cttgagccccggaggt

SEQ ID NO: 240122 - DNA, 16 bp, P. troglodytes
cttgagcccgagaggt

SEQ ID NO: 240123 - DNA, 16 bp, P. troglodytes
cttgagccctggaggt

SEQ ID NO: 240124 - DNA, 16 bp, P. troglodytes
cttgagccgaggagtt

SEQ ID NO: 240125 - DNA, 16 bp, P. troglodytes
cttgagcctagaagtt

SEQ ID NO: 240126 - DNA, 16 bp, P. troglodytes
cttgagcctaggaggt

SEQ ID NO: 240127 - DNA, 16 bp, P. troglodytes
cttgagcctaggcgtt

SEQ ID NO: 240128 - DNA, 16 bp, P. troglodytes
cttgagcctgggaggc

SEQ ID NO: 240129 - DNA, 16 bp, P. troglodytes
cttgagcctgggaggt

SEQ ID NO: 240130 - DNA, 16 bp, P. troglodytes
cttgagcctgtgaggt

SEQ ID NO: 240131 - DNA, 16 bp, P. troglodytes
cttgagccttggaggt

SEQ ID NO: 240132 - DNA, 16 bp, P. troglodytes
cttgagccttggtttt

SEQ ID NO: 240133 - DNA, 16 bp, P. troglodytes
cttgagctcaggaggt

SEQ ID NO: 240134 - DNA, 16 bp, P. troglodytes
cttgagctcaggagtt

SEQ ID NO: 240135 - DNA, 16 bp, P. troglodytes
cttgagctcaggtgtt

SEQ ID NO: 240136 - DNA, 16 bp, P. troglodytes
cttgagctctgctaag

SEQ ID NO: 240137 - DNA, 16 bp, P. troglodytes
cttgagcttagaagtt

SEQ ID NO: 240138 - DNA, 16 bp, P. troglodytes
cttgagcttaggagtt

SEQ ID NO: 240139 - DNA, 16 bp, P. troglodytes
cttgagcttgggagat

SEQ ID NO: 240140 - DNA, 16 bp, P. troglodytes
cttgaggaagcagtct

SEQ ID NO: 240141 - DNA, 16 bp, P. troglodytes
cttgaggacagggact

SEQ ID NO: 240142 - DNA, 16 bp, P. troglodytes
cttgaggcattcatcc

SEQ ID NO: 240143 - DNA, 16 bp, P. troglodytes
cttgaggccaaaagtt

SEQ ID NO: 240144 - DNA, 16 bp, P. troglodytes
cttgaggccaagagtt

SEQ ID NO: 240145 - DNA, 16 bp, P. troglodytes
cttgaggccaagggtt

SEQ ID NO: 240146 - DNA, 16 bp, P. troglodytes
cttgaggccacaagtt

SEQ ID NO: 240147 - DNA, 16 bp, P. troglodytes
cttgaggccagaagtt

SEQ ID NO: 240148 - DNA, 16 bp, P. troglodytes
cttgaggccagcagtt

SEQ ID NO: 240149 - DNA, 16 bp, P. troglodytes
cttgaggccaggaatt

SEQ ID NO: 240150 - DNA, 16 bp, P. troglodytes
cttgaggccaggagct

SEQ ID NO: 240151 - DNA, 16 bp, P. troglodytes
cttgaggccaggagtt

SEQ ID NO: 240152 - DNA, 16 bp, P. troglodytes
cttgaggccgggagtt

SEQ ID NO: 240153 - DNA, 16 bp, P. troglodytes
cttgaggcctggaatt

SEQ ID NO: 240154 - DNA, 16 bp, P. troglodytes
cttgaggcctggagtt

SEQ ID NO: 240155 - DNA, 16 bp, P. troglodytes
cttgaggctgaggcag

SEQ ID NO: 240156 - DNA, 16 bp, P. troglodytes
cttgaggctgggagtt

SEQ ID NO: 240157 - DNA, 16 bp, P. troglodytes
cttgagggcagagact

SEQ ID NO: 240158 - DNA, 16 bp, P. troglodytes
cttgagggcaggaatt

SEQ ID NO: 240159 - DNA, 16 bp, P. troglodytes
cttgagggcagggacc

SEQ ID NO: 240160 - DNA, 16 bp, P. troglodytes
cttgagggtcaattga

SEQ ID NO: 240161 - DNA, 16 bp, P. troglodytes
cttgaggtcaagagtt

SEQ ID NO: 240162 - DNA, 16 bp, P. troglodytes
cttgaggtcacacagc

SEQ ID NO: 240163 - DNA, 16 bp, P. troglodytes
cttgaggtcagaagtt

SEQ ID NO: 240164 - DNA, 16 bp, P. troglodytes
cttgaggtcagaggtc

SEQ ID NO: 240165 - DNA, 16 bp, P. troglodytes
cttgaggtcagcagtt

SEQ ID NO: 240166 - DNA, 16 bp, P. troglodytes
cttgaggtcagcctgg

SEQ ID NO: 240167 - DNA, 16 bp, P. troglodytes
cttgaggtcaggaatt

SEQ ID NO: 240168 - DNA, 16 bp, P. troglodytes
cttgaggtcaggagtc

SEQ ID NO: 240169 - DNA, 16 bp, P. troglodytes
cttgaggtcaggagtt

SEQ ID NO: 240170 - DNA, 16 bp, P. troglodytes
cttgaggttaggagtt

SEQ ID NO: 240171 - DNA, 16 bp, P. troglodytes
cttgagtccaagagtt

SEQ ID NO: 240172 - DNA, 16 bp, P. troglodytes
cttgagtccagcaggt

SEQ ID NO: 240173 - DNA, 16 bp, P. troglodytes
cttgagtccaggaatt

SEQ ID NO: 240174 - DNA, 16 bp, P. troglodytes
cttgagtccaggaggt

SEQ ID NO: 240175 - DNA, 16 bp, P. troglodytes
cttgagtccaggagtt

SEQ ID NO: 240176 - DNA, 16 bp, P. troglodytes
cttgagtctaggagtt

SEQ ID NO: 240177 - DNA, 16 bp, P. troglodytes
cttgagtgcaggagtt

SEQ ID NO: 240178 - DNA, 16 bp, P. troglodytes
cttgagtgcagtggcg

SEQ ID NO: 240179 - DNA, 16 bp, P. troglodytes
cttgagttcaggagtt

SEQ ID NO: 240180 - DNA, 17 bp, P. troglodytes
cttgagtttatctgtct

SEQ ID NO: 240181 - DNA, 16 bp, P. troglodytes
cttgataccaaaacct

SEQ ID NO: 240182 - DNA, 16 bp, P. troglodytes
cttgataccaaaagca

SEQ ID NO: 240183 - DNA, 16 bp, P. troglodytes
cttgatataattttga

SEQ ID NO: 240184 - DNA, 16 bp, P. troglodytes
cttgatatgatttcag

SEQ ID NO: 240185 - DNA, 16 bp, P. troglodytes
cttgatcccaggagtt

SEQ ID NO: 240186 - DNA, 16 bp, P. troglodytes
cttgatcctaggagtt

SEQ ID NO: 240187 - DNA, 16 bp, P. troglodytes
cttgatcttgaatttc

SEQ ID NO: 240188 - DNA, 16 bp, P. troglodytes
cttgatcttggacttc

SEQ ID NO: 240189 - DNA, 16 bp, P. troglodytes
cttgatgctgaggttt

SEQ ID NO: 240190 - DNA, 16 bp, P. troglodytes
cttgatggatcagctg

SEQ ID NO: 240191 - DNA, 16 bp, P. troglodytes
cttgattgaatcagct

SEQ ID NO: 240192 - DNA, 16 bp, P. troglodytes
cttgattgatagtttg

SEQ ID NO: 240193 - DNA, 16 bp, P. troglodytes
cttgattgattgattg

SEQ ID NO: 240194 - DNA, 16 bp, P. troglodytes
cttgatttaacccacc

SEQ ID NO: 240195 - DNA, 16 bp, P. troglodytes
cttgatttccttttct

SEQ ID NO: 240196 - DNA, 16 bp, P. troglodytes
cttgattttggacttc

SEQ ID NO: 240197 - DNA, 16 bp, P. troglodytes
cttgatttttaaaaaa

SEQ ID NO: 240198 - DNA, 16 bp, P. troglodytes
cttgatttttctcctt

SEQ ID NO: 240199 - DNA, 16 bp, P. troglodytes
cttgattttttaaaaa

SEQ ID NO: 240200 - DNA, 16 bp, P. troglodytes
cttgcaaaattcctga

SEQ ID NO: 240201 - DNA, 16 bp, P. troglodytes
cttgcaaactgtctga

SEQ ID NO: 240202 - DNA, 16 bp, P. troglodytes
cttgcaactgcacact

SEQ ID NO: 240203 - DNA, 16 bp, P. troglodytes
cttgcacacagtaggc

SEQ ID NO: 240204 - DNA, 16 bp, P. troglodytes
cttgcacccaggaggc

SEQ ID NO: 240205 - DNA, 16 bp, P. troglodytes
cttgcacttcctgagt

SEQ ID NO: 240206 - DNA, 16 bp, P. troglodytes
cttgcagcgagccaag

SEQ ID NO: 240207 - DNA, 16 bp, P. troglodytes
cttgcaggactgaaag

SEQ ID NO: 240208 - DNA, 16 bp, P. troglodytes
cttgcaggagggagca

SEQ ID NO: 240209 - DNA, 16 bp, P. troglodytes
cttgcaggtggctgcc

SEQ ID NO: 240210 - DNA, 16 bp, P. troglodytes
cttgcagtgagacgag

SEQ ID NO: 240211 - DNA, 16 bp, P. troglodytes
cttgcagttttctttt

SEQ ID NO: 240212 - DNA, 16 bp, P. troglodytes
cttgcatatgcatgtt

SEQ ID NO: 240213 - DNA, 16 bp, P. troglodytes
cttgccacatacaaaa

SEQ ID NO: 240214 - DNA, 16 bp, P. troglodytes
cttgccagacaccaaa

SEQ ID NO: 240215 - DNA, 16 bp, P. troglodytes
cttgcccaacatcaca

SEQ ID NO: 240216 - DNA, 16 bp, P. troglodytes
cttgcccaagatcaca

SEQ ID NO: 240217 - DNA, 16 bp, P. troglodytes
cttgcccaaggtcaca

SEQ ID NO: 240218 - DNA, 16 bp, P. troglodytes
cttgcccagactggag

SEQ ID NO: 240219 - DNA, 16 bp, P. troglodytes
cttgcccagtgtcaca

SEQ ID NO: 240220 - DNA, 16 bp, P. troglodytes
cttgcccatggtcaca

SEQ ID NO: 240221 - DNA, 16 bp, P. troglodytes
cttgccccaaatcaca

SEQ ID NO: 240222 - DNA, 16 bp, P. troglodytes
cttgccccaagtcaca

SEQ ID NO: 240223 - DNA, 16 bp, P. troglodytes
cttgcccctcccccag

SEQ ID NO: 240224 - DNA, 16 bp, P. troglodytes
cttgcccggctaattt

SEQ ID NO: 240225 - DNA, 21 bp, P. troglodytes
cttgccctcattccggtaaac

SEQ ID NO: 240226 - DNA, 16 bp, P. troglodytes
cttgccctcattctgg

SEQ ID NO: 240227 - DNA, 16 bp, P. troglodytes
cttgccctggccagaa

SEQ ID NO: 240228 - DNA, 16 bp, P. troglodytes
cttgcctaaggccaca

SEQ ID NO: 240229 - DNA, 16 bp, P. troglodytes
cttgcctaatttttct

SEQ ID NO: 240230 - DNA, 16 bp, P. troglodytes
cttgcctatagtccca

SEQ ID NO: 240231 - DNA, 16 bp, P. troglodytes
cttgcctcaagtgatc

SEQ ID NO: 240232 - DNA, 16 bp, P. troglodytes
cttgcctcagtctcct

SEQ ID NO: 240233 - DNA, 16 bp, P. troglodytes
cttgcctcctcagagg

SEQ ID NO: 240234 - DNA, 16 bp, P. troglodytes
cttgcctcctccagct

SEQ ID NO: 240235 - DNA, 16 bp, P. troglodytes
cttgcctgccctgcat

SEQ ID NO: 240236 - DNA, 16 bp, P. troglodytes
cttgcctgctgccata

SEQ ID NO: 240237 - DNA, 16 bp, P. troglodytes
cttgcctgtagtccca

SEQ ID NO: 240238 - DNA, 16 bp, P. troglodytes
cttgcctgtcaccatg

SEQ ID NO: 240239 - DNA, 16 bp, P. troglodytes
cttgccttcatggagc

SEQ ID NO: 240240 - DNA, 16 bp, P. troglodytes
cttgcctttccagctt

SEQ ID NO: 240241 - DNA, 16 bp, P. troglodytes
cttgccttttcatttt

SEQ ID NO: 240242 - DNA, 16 bp, P. troglodytes
cttgccttttccaact

SEQ ID NO: 240243 - DNA, 16 bp, P. troglodytes
cttgcgatagtttgct

SEQ ID NO: 240244 - DNA, 16 bp, P. troglodytes
cttgctaatggcctat

SEQ ID NO: 240245 - DNA, 16 bp, P. troglodytes
cttgctacaacctcca

SEQ ID NO: 240246 - DNA, 16 bp, P. troglodytes
cttgctactcaaagtg

SEQ ID NO: 240247 - DNA, 16 bp, P. troglodytes
cttgctagagacctag

SEQ ID NO: 240248 - DNA, 16 bp, P. troglodytes
cttgctagctgtgtgg

SEQ ID NO: 240249 - DNA, 16 bp, P. troglodytes
cttgctattgaattgt

SEQ ID NO: 240250 - DNA, 16 bp, P. troglodytes
cttgctcaaggtcaca

SEQ ID NO: 240251 - DNA, 16 bp, P. troglodytes
cttgctcaagttcaca

SEQ ID NO: 240252 - DNA, 16 bp, P. troglodytes
cttgctcacacacccc

SEQ ID NO: 240253 - DNA, 16 bp, P. troglodytes
cttgctcagagtcaca

SEQ ID NO: 240254 - DNA, 16 bp, P. troglodytes
cttgctcctgctccag

SEQ ID NO: 240255 - DNA, 16 bp, P. troglodytes
cttgctctgtcaccat

SEQ ID NO: 240256 - DNA, 16 bp, P. troglodytes
cttgctcttcagcttg

SEQ ID NO: 240257 - DNA, 16 bp, P. troglodytes
cttgctcttccttctg

SEQ ID NO: 240258 - DNA, 16 bp, P. troglodytes
cttgctcttgtcacct

SEQ ID NO: 240259 - DNA, 16 bp, P. troglodytes
cttgctgaacttgttt

SEQ ID NO: 240260 - DNA, 16 bp, P. troglodytes
cttgctgccatcttgg

SEQ ID NO: 240261 - DNA, 16 bp, P. troglodytes
cttgctgctgatgact

SEQ ID NO: 240262 - DNA, 16 bp, P. troglodytes
cttgctgcttttaaaa

SEQ ID NO: 240263 - DNA, 16 bp, P. troglodytes
cttgctggatcaggag

SEQ ID NO: 240264 - DNA, 16 bp, P. troglodytes
cttgctgtctcagagg

SEQ ID NO: 240265 - DNA, 16 bp, P. troglodytes
cttgctgtgtccccca

SEQ ID NO: 240266 - DNA, 16 bp, P. troglodytes
cttgctgtgtcttcat

SEQ ID NO: 240267 - DNA, 16 bp, P. troglodytes
cttgctgtgtgcccag

SEQ ID NO: 240268 - DNA, 16 bp, P. troglodytes
cttgctgttttcatga

SEQ ID NO: 240269 - DNA, 16 bp, P. troglodytes
cttgcttaaaatattt

SEQ ID NO: 240270 - DNA, 16 bp, P. troglodytes
cttgcttccccttcac

SEQ ID NO: 240271 - DNA, 16 bp, P. troglodytes
cttgcttcccctttgc

SEQ ID NO: 240272 - DNA, 16 bp, P. troglodytes
cttgcttctctagttt

SEQ ID NO: 240273 - DNA, 16 bp, P. troglodytes
cttgcttgcctgctgc

SEQ ID NO: 240274 - DNA, 16 bp, P. troglodytes
cttgcttgcttgcttt

SEQ ID NO: 240275 - DNA, 16 bp, P. troglodytes
cttgcttggtgccctg

SEQ ID NO: 240276 - DNA, 16 bp, P. troglodytes
cttgctttcctcatct

SEQ ID NO: 240277 - DNA, 16 bp, P. troglodytes
cttgctttggatttta

SEQ ID NO: 240278 - DNA, 16 bp, P. troglodytes
cttgcttttctcactt

SEQ ID NO: 240279 - DNA, 16 bp, P. troglodytes
cttggaaaaacagtgt

SEQ ID NO: 240280 - DNA, 16 bp, P. troglodytes
cttggaaaaataaact

SEQ ID NO: 240281 - DNA, 16 bp, P. troglodytes
cttggaaaagttattt

SEQ ID NO: 240282 - DNA, 16 bp, P. troglodytes
cttggaagcagacagc

SEQ ID NO: 240283 - DNA, 16 bp, P. troglodytes
cttggaagcagagaga

SEQ ID NO: 240284 - DNA, 16 bp, P. troglodytes
cttggaagcagatcct

SEQ ID NO: 240285 - DNA, 16 bp, P. troglodytes
cttggaataaaatcca

SEQ ID NO: 240286 - DNA, 16 bp, P. troglodytes
cttggaatttaaaaaa

SEQ ID NO: 240287 - DNA, 16 bp, P. troglodytes
cttggacaagtcattt

SEQ ID NO: 240288 - DNA, 16 bp, P. troglodytes
cttggacaatacccag

SEQ ID NO: 240289 - DNA, 16 bp, P. troglodytes
cttggacccgggaggt

SEQ ID NO: 240290 - DNA, 16 bp, P. troglodytes
cttggacctgggaggc

SEQ ID NO: 240291 - DNA, 16 bp, P. troglodytes
cttggactcccagcct

SEQ ID NO: 240292 - DNA, 16 bp, P. troglodytes
cttggactctccaaag

SEQ ID NO: 240293 - DNA, 16 bp, P. troglodytes
cttggacttctagctt

SEQ ID NO: 240294 - DNA, 16 bp, P. troglodytes
cttggagaaaatattt

SEQ ID NO: 240295 - DNA, 16 bp, P. troglodytes
cttggagatttctcaa

SEQ ID NO: 240296 - DNA, 16 bp, P. troglodytes
cttggagccaggagtt

SEQ ID NO: 240297 - DNA, 16 bp, P. troglodytes
cttggagctgaagaag

SEQ ID NO: 240298 - DNA, 16 bp, P. troglodytes
cttggaggctgcagtg

SEQ ID NO: 240299 - DNA, 16 bp, P. troglodytes
cttggataaaatgttc

SEQ ID NO: 240300 - DNA, 16 bp, P. troglodytes
cttggataactggcta

SEQ ID NO: 240301 - DNA, 16 bp, P. troglodytes
cttggatcttctctct

SEQ ID NO: 240302 - DNA, 16 bp, P. troglodytes
cttggatgacagagtg

SEQ ID NO: 240303 - DNA, 16 bp, P. troglodytes
cttggatttacaccag

SEQ ID NO: 240304 - DNA, 16 bp, P. troglodytes
cttggcaatgcaggct

SEQ ID NO: 240305 - DNA, 16 bp, P. troglodytes
cttggcagcctccacc

SEQ ID NO: 240306 - DNA, 16 bp, P. troglodytes
cttggcattccttggc

SEQ ID NO: 240307 - DNA, 16 bp, P. troglodytes
cttggccaaagtcaca

SEQ ID NO: 240308 - DNA, 16 bp, P. troglodytes
cttggccaacgtggca

SEQ ID NO: 240309 - DNA, 16 bp, P. troglodytes
cttggccaagtcactt

SEQ ID NO: 240310 - DNA, 20 bp, P. troglodytes
cttggccgggcacggtggct

SEQ ID NO: 240311 - DNA, 16 bp, P. troglodytes
cttggcctcccaaagg

SEQ ID NO: 240312 - DNA, 16 bp, P. troglodytes
cttggcctcccaagtg

SEQ ID NO: 240313 - DNA, 16 bp, P. troglodytes
cttggcctcctgaagt

SEQ ID NO: 240314 - DNA, 16 bp, P. troglodytes
cttggcctctccaagt

SEQ ID NO: 240315 - DNA, 16 bp, P. troglodytes
cttggcctctctgagc

SEQ ID NO: 240316 - DNA, 16 bp, P. troglodytes
cttggctattgtggat

SEQ ID NO: 240317 - DNA, 16 bp, P. troglodytes
cttggctcacggcaac

SEQ ID NO: 240318 - DNA, 16 bp, P. troglodytes
cttggctcagggcaac

SEQ ID NO: 240319 - DNA, 16 bp, P. troglodytes
cttggctccctgcagc

SEQ ID NO: 240320 - DNA, 16 bp, P. troglodytes
cttggctgaattcttt

SEQ ID NO: 240321 - DNA, 16 bp, P. troglodytes
cttggctgggcgtggt

SEQ ID NO: 240322 - DNA, 16 bp, P. troglodytes
cttggctgggtgtggt

SEQ ID NO: 240323 - DNA, 16 bp, P. troglodytes
cttggcttacagcaac

SEQ ID NO: 240324 - DNA, 16 bp, P. troglodytes
cttggcttctgggagg

SEQ ID NO: 240325 - DNA, 16 bp, P. troglodytes
cttgggaaagttactt

SEQ ID NO: 240326 - DNA, 16 bp, P. troglodytes
cttgggaagctaaggc

SEQ ID NO: 240327 - DNA, 16 bp, P. troglodytes
cttgggaagctctgcc

SEQ ID NO: 240328 - DNA, 16 bp, P. troglodytes
cttgggaggatcactt

SEQ ID NO: 240329 - DNA, 16 bp, P. troglodytes
cttgggaggcagaggg

SEQ ID NO: 240330 - DNA, 20 bp, P. troglodytes
cttgggaggccaaggcagga

SEQ ID NO: 240331 - DNA, 18 bp, P. troglodytes
cttgggaggccgaggcgg

SEQ ID NO: 240332 - DNA, 16 bp, P. troglodytes
cttgggaggcctcagg

SEQ ID NO: 240333 - DNA, 20 bp, P. troglodytes
cttgggaggctgaggcaggt

SEQ ID NO: 240334 - DNA, 19 bp, P. troglodytes
cttgggaggctgaggcgga

SEQ ID NO: 240335 - DNA, 16 bp, P. troglodytes
cttgggagggaggctg

SEQ ID NO: 240336 - DNA, 16 bp, P. troglodytes
cttgggagggtgtatg

SEQ ID NO: 240337 - DNA, 16 bp, P. troglodytes
cttgggagtgtgtatg

SEQ ID NO: 240338 - DNA, 16 bp, P. troglodytes
cttgggcaagtcattt

SEQ ID NO: 240339 - DNA, 16 bp, P. troglodytes
cttgggcagctccgcc

SEQ ID NO: 240340 - DNA, 16 bp, P. troglodytes
cttgggcagctcctcc

SEQ ID NO: 240341 - DNA, 16 bp, P. troglodytes
cttgggcagctctgcc

SEQ ID NO: 240342 - DNA, 16 bp, P. troglodytes
cttgggcctgggagat

SEQ ID NO: 240343 - DNA, 16 bp, P. troglodytes
cttgggctcaagcgat

SEQ ID NO: 240344 - DNA, 16 bp, P. troglodytes
cttgggctgccataac

SEQ ID NO: 240345 - DNA, 16 bp, P. troglodytes
cttggggaaaaaaaaa

SEQ ID NO: 240346 - DNA, 16 bp, P. troglodytes
cttggggaaaaaaata

SEQ ID NO: 240347 - DNA, 16 bp, P. troglodytes
cttggggaagctgagg

SEQ ID NO: 240348 - DNA, 16 bp, P. troglodytes
cttggggaagttactt

SEQ ID NO: 240349 - DNA, 16 bp, P. troglodytes
cttggggaggccgagg

SEQ ID NO: 240350 - DNA, 16 bp, P. troglodytes
cttgggggacagagca

SEQ ID NO: 240351 - DNA, 16 bp, P. troglodytes
cttggggggaaaaaaa

SEQ ID NO: 240352 - DNA, 16 bp, P. troglodytes
cttgggtgaccagatg

SEQ ID NO: 240353 - DNA, 16 bp, P. troglodytes
cttgggtgagcctctg

SEQ ID NO: 240354 - DNA, 16 bp, P. troglodytes
cttgggtggcagagtg

SEQ ID NO: 240355 - DNA, 16 bp, P. troglodytes
cttgggttcaaatcct

SEQ ID NO: 240356 - DNA, 16 bp, P. troglodytes
cttgggttcacaccat

SEQ ID NO: 240357 - DNA, 16 bp, P. troglodytes
cttggtaaatttttct

SEQ ID NO: 240358 - DNA, 16 bp, P. troglodytes
cttggtactgtccttg

SEQ ID NO: 240359 - DNA, 16 bp, P. troglodytes
cttggtatatatccaa

SEQ ID NO: 240360 - DNA, 16 bp, P. troglodytes
cttggtcatgataaat

SEQ ID NO: 240361 - DNA, 16 bp, P. troglodytes
cttggtctagcggtaa

SEQ ID NO: 240362 - DNA, 16 bp, P. troglodytes
cttggtctgctggcct

SEQ ID NO: 240363 - DNA, 21 bp, P. troglodytes
cttggtgcagagctgagttca

SEQ ID NO: 240364 - DNA, 16 bp, P. troglodytes
cttggtgcctcagttt

SEQ ID NO: 240365 - DNA, 16 bp, P. troglodytes
cttggtggagggaggg

SEQ ID NO: 240366 - DNA, 16 bp, P. troglodytes
cttggtggcgcatgcc

SEQ ID NO: 240367 - DNA, 16 bp, P. troglodytes
cttggtggctcatgcc

SEQ ID NO: 240368 - DNA, 16 bp, P. troglodytes
cttggtggctgaggca

SEQ ID NO: 240369 - DNA, 16 bp, P. troglodytes
cttggtggcttaaagc

SEQ ID NO: 240370 - DNA, 16 bp, P. troglodytes
cttggtgggagtgtaa

SEQ ID NO: 240371 - DNA, 16 bp, P. troglodytes
cttggtgttatacatt

SEQ ID NO: 240372 - DNA, 16 bp, P. troglodytes
cttggttaaatttgtt

SEQ ID NO: 240373 - DNA, 16 bp, P. troglodytes
cttggttagctgtatt

SEQ ID NO: 240374 - DNA, 16 bp, P. troglodytes
cttggttcactgcaac

SEQ ID NO: 240375 - DNA, 16 bp, P. troglodytes
cttggtttcctcacct

SEQ ID NO: 240376 - DNA, 16 bp, P. troglodytes
cttggttttccattcc

SEQ ID NO: 240377 - DNA, 16 bp, P. troglodytes
cttggttttctcattt

SEQ ID NO: 240378 - DNA, 16 bp, P. troglodytes
cttggttttggccaat

SEQ ID NO: 240379 - DNA, 16 bp, P. troglodytes
cttggttttttaaaaa

SEQ ID NO: 240380 - DNA, 16 bp, P. troglodytes
cttgtaaagatctttc

SEQ ID NO: 240381 - DNA, 16 bp, P. troglodytes
cttgtaaatgtgtttg

SEQ ID NO: 240382 - DNA, 16 bp, P. troglodytes
cttgtaaatttctttg

SEQ ID NO: 240383 - DNA, 16 bp, P. troglodytes
cttgtaaatttgtata

SEQ ID NO: 240384 - DNA, 16 bp, P. troglodytes
cttgtaagttgtattt

SEQ ID NO: 240385 - DNA, 16 bp, P. troglodytes
cttgtaatcccagctg

SEQ ID NO: 240386 - DNA, 16 bp, P. troglodytes
cttgtacacagatgtt

SEQ ID NO: 240387 - DNA, 16 bp, P. troglodytes
cttgtacccaggaggc

SEQ ID NO: 240388 - DNA, 16 bp, P. troglodytes
cttgtactcctgggct

SEQ ID NO: 240389 - DNA, 16 bp, P. troglodytes
cttgtagaattcagct

SEQ ID NO: 240390 - DNA, 16 bp, P. troglodytes
cttgtagagacctttc

SEQ ID NO: 240391 - DNA, 16 bp, P. troglodytes
cttgtatcctgtgacc

SEQ ID NO: 240392 - DNA, 17 bp, P. troglodytes
cttgtattttcagtaga

SEQ ID NO: 240393 - DNA, 16 bp, P. troglodytes
cttgtccaaagttaca

SEQ ID NO: 240394 - DNA, 16 bp, P. troglodytes
cttgtccaagatggca

SEQ ID NO: 240395 - DNA, 16 bp, P. troglodytes
cttgtccaaggccaca

SEQ ID NO: 240396 - DNA, 16 bp, P. troglodytes
cttgtccccacagccc

SEQ ID NO: 240397 - DNA, 16 bp, P. troglodytes
cttgtctcaaaagaaa

SEQ ID NO: 240398 - DNA, 16 bp, P. troglodytes
cttgtctcaagaaaaa

SEQ ID NO: 240399 - DNA, 16 bp, P. troglodytes
cttgtctcacaaaaaa

SEQ ID NO: 240400 - DNA, 16 bp, P. troglodytes
cttgtctctacaaaaa

SEQ ID NO: 240401 - DNA, 16 bp, P. troglodytes
cttgtctctagaaaaa

SEQ ID NO: 240402 - DNA, 16 bp, P. troglodytes
cttgtctctcctaaaa

SEQ ID NO: 240403 - DNA, 16 bp, P. troglodytes
cttgtctgtaaaatgg

SEQ ID NO: 240404 - DNA, 16 bp, P. troglodytes
cttgtcttctgctacc

SEQ ID NO: 240405 - DNA, 16 bp, P. troglodytes
cttgtcttctggtcac

SEQ ID NO: 240406 - DNA, 16 bp, P. troglodytes
cttgtctttataaatt

SEQ ID NO: 240407 - DNA, 22 bp, P. troglodytes
cttgtgaaattccttctcctgg

SEQ ID NO: 240408 - DNA, 16 bp, P. troglodytes
cttgtgaatatattaa

SEQ ID NO: 240409 - DNA, 16 bp, P. troglodytes
cttgtgacctctggct

SEQ ID NO: 240410 - DNA, 16 bp, P. troglodytes
cttgtgaggctgaggc

SEQ ID NO: 240411 - DNA, 16 bp, P. troglodytes
cttgtgatcttgctct

SEQ ID NO: 240412 - DNA, 16 bp, P. troglodytes
cttgtgattttgattt

SEQ ID NO: 240413 - DNA, 16 bp, P. troglodytes
cttgtgcaggagaact

SEQ ID NO: 240414 - DNA, 16 bp, P. troglodytes
cttgtgccagttttca

SEQ ID NO: 240415 - DNA, 16 bp, P. troglodytes
cttgtgccatcaagcc

SEQ ID NO: 240416 - DNA, 16 bp, P. troglodytes
cttgtgcccaggagtt

SEQ ID NO: 240417 - DNA, 16 bp, P. troglodytes
cttgtgccgacctcct

SEQ ID NO: 240418 - DNA, 16 bp, P. troglodytes
cttgtgcctcagcccc

SEQ ID NO: 240419 - DNA, 16 bp, P. troglodytes
cttgtgcctgggaggt

SEQ ID NO: 240420 - DNA, 16 bp, P. troglodytes
cttgtgccttagcctc

SEQ ID NO: 240421 - DNA, 16 bp, P. troglodytes
cttgtgcttcctgggt

SEQ ID NO: 240422 - DNA, 16 bp, P. troglodytes
cttgtggaaaggggag

SEQ ID NO: 240423 - DNA, 16 bp, P. troglodytes
cttgtggaagcaaaaa

SEQ ID NO: 240424 - DNA, 16 bp, P. troglodytes
cttgtggccaggagtt

SEQ ID NO: 240425 - DNA, 16 bp, P. troglodytes
cttgtggccccttcct

SEQ ID NO: 240426 - DNA, 16 bp, P. troglodytes
cttgtggttttgattt

SEQ ID NO: 240427 - DNA, 16 bp, P. troglodytes
cttgtgttagtttgct

SEQ ID NO: 240428 - DNA, 16 bp, P. troglodytes
cttgttaaaaattcag

SEQ ID NO: 240429 - DNA, 16 bp, P. troglodytes
cttgttaaatgaataa

SEQ ID NO: 240430 - DNA, 16 bp, P. troglodytes
cttgttacttatgcaa

SEQ ID NO: 240431 - DNA, 16 bp, P. troglodytes
cttgttcaaaagagaa

SEQ ID NO: 240432 - DNA, 16 bp, P. troglodytes
cttgttccagatttta

SEQ ID NO: 240433 - DNA, 16 bp, P. troglodytes
cttgttccccaaaaac

SEQ ID NO: 240434 - DNA, 16 bp, P. troglodytes
cttgttcctcagcctc

SEQ ID NO: 240435 - DNA, 16 bp, P. troglodytes
cttgttctgttgccag

SEQ ID NO: 240436 - DNA, 16 bp, P. troglodytes
cttgttgaattgcttt

SEQ ID NO: 240437 - DNA, 16 bp, P. troglodytes
cttgttgatattttat

SEQ ID NO: 240438 - DNA, 16 bp, P. troglodytes
cttgttgcacaggctg

SEQ ID NO: 240439 - DNA, 16 bp, P. troglodytes
cttgttgcccaggcta

SEQ ID NO: 240440 - DNA, 16 bp, P. troglodytes
cttgttggccattttt

SEQ ID NO: 240441 - DNA, 16 bp, P. troglodytes
cttgtttctttatcca

SEQ ID NO: 240442 - DNA, 16 bp, P. troglodytes
cttgtttggatcctga

SEQ ID NO: 240443 - DNA, 16 bp, P. troglodytes
cttgtttgtgtgattg

SEQ ID NO: 240444 - DNA, 16 bp, P. troglodytes
cttgttttatacataa

SEQ ID NO: 240445 - DNA, 16 bp, P. troglodytes
cttgttttatggccta

SEQ ID NO: 240446 - DNA, 16 bp, P. troglodytes
cttgttttatgtcctt

SEQ ID NO: 240447 - DNA, 16 bp, P. troglodytes
cttgttttattgtgct

SEQ ID NO: 240448 - DNA, 16 bp, P. troglodytes
cttgttttgctggaaa

SEQ ID NO: 240449 - DNA, 16 bp, P. troglodytes
cttgttttgtgactta

SEQ ID NO: 240450 - DNA, 16 bp, P. troglodytes
cttgtttttaaaagaa

SEQ ID NO: 240451 - DNA, 16 bp, P. troglodytes
cttgtttttgtaaata

SEQ ID NO: 240452 - DNA, 20 bp, P. troglodytes
cttgtttttgtcaggtttgt

SEQ ID NO: 240453 - DNA, 16 bp, P. troglodytes
cttgttttttaaataa

SEQ ID NO: 240454 - DNA, 16 bp, P. troglodytes
ctttaaaaaaaatctt

SEQ ID NO: 240455 - DNA, 16 bp, P. troglodytes
ctttaaaaaaatgttt

SEQ ID NO: 240456 - DNA, 16 bp, P. troglodytes
ctttaaaaaagaaaag

SEQ ID NO: 240457 - DNA, 16 bp, P. troglodytes
ctttaaaaaatatttg

SEQ ID NO: 240458 - DNA, 16 bp, P. troglodytes
ctttaaaaagaatgaa

SEQ ID NO: 240459 - DNA, 16 bp, P. troglodytes
ctttaaaaaggaagga

SEQ ID NO: 240460 - DNA, 16 bp, P. troglodytes
ctttaaaaataaagaa

SEQ ID NO: 240461 - DNA, 16 bp, P. troglodytes
ctttaaaaatatttct

SEQ ID NO: 240462 - DNA, 16 bp, P. troglodytes
ctttaaaaattattgt

SEQ ID NO: 240463 - DNA, 16 bp, P. troglodytes
ctttaaaaattccaaa

SEQ ID NO: 240464 - DNA, 16 bp, P. troglodytes
ctttaaaaggtcttat

SEQ ID NO: 240465 - DNA, 16 bp, P. troglodytes
ctttaaaagttaaaaa

SEQ ID NO: 240466 - DNA, 16 bp, P. troglodytes
ctttaaaagttaattt

SEQ ID NO: 240467 - DNA, 16 bp, P. troglodytes
ctttaaaataaaagca

SEQ ID NO: 240468 - DNA, 16 bp, P. troglodytes
ctttaaaatattttca

SEQ ID NO: 240469 - DNA, 16 bp, P. troglodytes
ctttaaaatgataaat

SEQ ID NO: 240470 - DNA, 16 bp, P. troglodytes
ctttaaaatgatgaat

SEQ ID NO: 240471 - DNA, 16 bp, P. troglodytes
ctttaaaatgtaattt

SEQ ID NO: 240472 - DNA, 16 bp, P. troglodytes
ctttaaaattatgtat

SEQ ID NO: 240473 - DNA, 16 bp, P. troglodytes
ctttaaaattattggt

SEQ ID NO: 240474 - DNA, 16 bp, P. troglodytes
ctttaaaatttttcaa

SEQ ID NO: 240475 - DNA, 16 bp, P. troglodytes
ctttaaacatttcttt

SEQ ID NO: 240476 - DNA, 16 bp, P. troglodytes
ctttaaagaagttttt

SEQ ID NO: 240477 - DNA, 16 bp, P. troglodytes
ctttaaagagaataaa

SEQ ID NO: 240478 - DNA, 16 bp, P. troglodytes
ctttaaagggagagaa

SEQ ID NO: 240479 - DNA, 16 bp, P. troglodytes
ctttaaagtagttttc

SEQ ID NO: 240480 - DNA, 16 bp, P. troglodytes
ctttaaagtttgagaa

SEQ ID NO: 240481 - DNA, 16 bp, P. troglodytes
ctttaaatatgtcata

SEQ ID NO: 240482 - DNA, 16 bp, P. troglodytes
ctttaaatatgtcatg

SEQ ID NO: 240483 - DNA, 16 bp, P. troglodytes
ctttaaatcaaaagct

SEQ ID NO: 240484 - DNA, 16 bp, P. troglodytes
ctttaaatgttatttt

SEQ ID NO: 240485 - DNA, 16 bp, P. troglodytes
ctttaaatttccctct

SEQ ID NO: 240486 - DNA, 16 bp, P. troglodytes
ctttaacccaggaggc

SEQ ID NO: 240487 - DNA, 16 bp, P. troglodytes
ctttaacctttacaag

SEQ ID NO: 240488 - DNA, 16 bp, P. troglodytes
ctttaactcaggaggc

SEQ ID NO: 240489 - DNA, 16 bp, P. troglodytes
ctttaagaaatgaaaa

SEQ ID NO: 240490 - DNA, 16 bp, P. troglodytes
ctttaagaatattttt

SEQ ID NO: 240491 - DNA, 16 bp, P. troglodytes
ctttaagaatgtggaa

SEQ ID NO: 240492 - DNA, 16 bp, P. troglodytes
ctttaagaattttgaa

SEQ ID NO: 240493 - DNA, 16 bp, P. troglodytes
ctttaagatttaatga

SEQ ID NO: 240494 - DNA, 16 bp, P. troglodytes
ctttaagatttgactg

SEQ ID NO: 240495 - DNA, 16 bp, P. troglodytes
ctttaagcagctgttt

SEQ ID NO: 240496 - DNA, 16 bp, P. troglodytes
ctttaaggacttctct

SEQ ID NO: 240497 - DNA, 16 bp, P. troglodytes
ctttaaggatgctgaa

SEQ ID NO: 240498 - DNA, 16 bp, P. troglodytes
ctttaagtcaggagtt

SEQ ID NO: 240499 - DNA, 16 bp, P. troglodytes
ctttaagtccattaaa

SEQ ID NO: 240500 - DNA, 16 bp, P. troglodytes
ctttaagttttaaggt

SEQ ID NO: 240501 - DNA, 16 bp, P. troglodytes
ctttaagttttaggct

SEQ ID NO: 240502 - DNA, 16 bp, P. troglodytes
ctttaatagtcataga

SEQ ID NO: 240503 - DNA, 16 bp, P. troglodytes
ctttaatccatctgga

SEQ ID NO: 240504 - DNA, 17 bp, P. troglodytes
ctttaatctcttaatcc

SEQ ID NO: 240505 - DNA, 16 bp, P. troglodytes
ctttaatgaaaagaat

SEQ ID NO: 240506 - DNA, 16 bp, P. troglodytes
ctttaattagatccca

SEQ ID NO: 240507 - DNA, 16 bp, P. troglodytes
ctttaattgctgtcag

SEQ ID NO: 240508 - DNA, 16 bp, P. troglodytes
ctttaatttcttgctt

SEQ ID NO: 240509 - DNA, 16 bp, P. troglodytes
ctttacaaaaagtaaa

SEQ ID NO: 240510 - DNA, 16 bp, P. troglodytes
ctttacaaacaagcaa

SEQ ID NO: 240511 - DNA, 16 bp, P. troglodytes
ctttacaatggagaaa

SEQ ID NO: 240512 - DNA, 16 bp, P. troglodytes
ctttacagaaaaaaat

SEQ ID NO: 240513 - DNA, 16 bp, P. troglodytes
ctttacagagaagcaa

SEQ ID NO: 240514 - DNA, 16 bp, P. troglodytes
ctttacagatggagaa

SEQ ID NO: 240515 - DNA, 16 bp, P. troglodytes
ctttacagatgggaaa

SEQ ID NO: 240516 - DNA, 16 bp, P. troglodytes
ctttacagcaatgccc

SEQ ID NO: 240517 - DNA, 16 bp, P. troglodytes
ctttacagcagcaccc

SEQ ID NO: 240518 - DNA, 16 bp, P. troglodytes
ctttacaggtgaagtg

SEQ ID NO: 240519 - DNA, 16 bp, P. troglodytes
ctttacagtttgcaaa

SEQ ID NO: 240520 - DNA, 16 bp, P. troglodytes
ctttaccaatatgtaa

SEQ ID NO: 240521 - DNA, 16 bp, P. troglodytes
ctttacctctctgggc

SEQ ID NO: 240522 - DNA, 16 bp, P. troglodytes
ctttacctttctctgg

SEQ ID NO: 240523 - DNA, 16 bp, P. troglodytes
ctttactaaaaacaca

SEQ ID NO: 240524 - DNA, 16 bp, P. troglodytes
ctttactattatgaat

SEQ ID NO: 240525 - DNA, 16 bp, P. troglodytes
ctttactgaattaatt

SEQ ID NO: 240526 - DNA, 16 bp, P. troglodytes
ctttacttcccagtat

SEQ ID NO: 240527 - DNA, 16 bp, P. troglodytes
ctttagaaaaaaatca

SEQ ID NO: 240528 - DNA, 16 bp, P. troglodytes
ctttagaaaaattaat

SEQ ID NO: 240529 - DNA, 16 bp, P. troglodytes
ctttagaaaatagttt

SEQ ID NO: 240530 - DNA, 16 bp, P. troglodytes
ctttagaaatgaagac

SEQ ID NO: 240531 - DNA, 16 bp, P. troglodytes
ctttagaaggaagtca

SEQ ID NO: 240532 - DNA, 16 bp, P. troglodytes
ctttagaaggctgagg

SEQ ID NO: 240533 - DNA, 16 bp, P. troglodytes
ctttagaccaaatgga

SEQ ID NO: 240534 - DNA, 16 bp, P. troglodytes
ctttagcattttttat

SEQ ID NO: 240535 - DNA, 16 bp, P. troglodytes
ctttagccaagacaaa

SEQ ID NO: 240536 - DNA, 16 bp, P. troglodytes
ctttagcccaggagtt

SEQ ID NO: 240537 - DNA, 16 bp, P. troglodytes
ctttagcctgggcaac

SEQ ID NO: 240538 - DNA, 16 bp, P. troglodytes
ctttaggcctcagaag

SEQ ID NO: 240539 - DNA, 16 bp, P. troglodytes
ctttaggtttagtttg

SEQ ID NO: 240540 - DNA, 16 bp, P. troglodytes
ctttagtagagatggg

SEQ ID NO: 240541 - DNA, 16 bp, P. troglodytes
ctttataaaaatggaa

SEQ ID NO: 240542 - DNA, 16 bp, P. troglodytes
ctttataaaaccatta

SEQ ID NO: 240543 - DNA, 16 bp, P. troglodytes
ctttataaaatgaatt

SEQ ID NO: 240544 - DNA, 16 bp, P. troglodytes
ctttataaacactgta

SEQ ID NO: 240545 - DNA, 16 bp, P. troglodytes
ctttataacagtgcaa

SEQ ID NO: 240546 - DNA, 16 bp, P. troglodytes
ctttataatttaccca

SEQ ID NO: 240547 - DNA, 16 bp, P. troglodytes
ctttatacaaaaatta

SEQ ID NO: 240548 - DNA, 16 bp, P. troglodytes
ctttatacttttctgt

SEQ ID NO: 240549 - DNA, 16 bp, P. troglodytes
ctttatagatgaagaa

SEQ ID NO: 240550 - DNA, 16 bp, P. troglodytes
ctttatagatgaggaa

SEQ ID NO: 240551 - DNA, 16 bp, P. troglodytes
ctttatagtaagtctt

SEQ ID NO: 240552 - DNA, 16 bp, P. troglodytes
ctttatagtgatgcaa

SEQ ID NO: 240553 - DNA, 16 bp, P. troglodytes
ctttatagttttatca

SEQ ID NO: 240554 - DNA, 16 bp, P. troglodytes
ctttatatatatgtgt

SEQ ID NO: 240555 - DNA, 16 bp, P. troglodytes
ctttatatattaaaga

SEQ ID NO: 240556 - DNA, 16 bp, P. troglodytes
ctttatccagcttgcc

SEQ ID NO: 240557 - DNA, 16 bp, P. troglodytes
ctttatctcatttaat

SEQ ID NO: 240558 - DNA, 16 bp, P. troglodytes
ctttatctgtgaaatg

SEQ ID NO: 240559 - DNA, 16 bp, P. troglodytes
ctttatgcctcagttt

SEQ ID NO: 240560 - DNA, 16 bp, P. troglodytes
ctttatgtctagctca

SEQ ID NO: 240561 - DNA, 16 bp, P. troglodytes
ctttatgtgtgtgtgt

SEQ ID NO: 240562 - DNA, 16 bp, P. troglodytes
ctttattgcaatattt

SEQ ID NO: 240563 - DNA, 16 bp, P. troglodytes
ctttatttctcaacat

SEQ ID NO: 240564 - DNA, 16 bp, P. troglodytes
ctttattttaccttca

SEQ ID NO: 240565 - DNA, 16 bp, P. troglodytes
ctttattttactgtgg

SEQ ID NO: 240566 - DNA, 16 bp, P. troglodytes
ctttattttctgaaaa

SEQ ID NO: 240567 - DNA, 16 bp, P. troglodytes
ctttattttcttctgc

SEQ ID NO: 240568 - DNA, 16 bp, P. troglodytes
ctttattttttagaac

SEQ ID NO: 240569 - DNA, 16 bp, P. troglodytes
ctttatttttttaaag

SEQ ID NO: 240570 - DNA, 16 bp, P. troglodytes
ctttatttttttagag

SEQ ID NO: 240571 - DNA, 16 bp, P. troglodytes
ctttcaaaatattatt

SEQ ID NO: 240572 - DNA, 16 bp, P. troglodytes
ctttcaaagagaataa

SEQ ID NO: 240573 - DNA, 16 bp, P. troglodytes
ctttcaaatataattt

SEQ ID NO: 240574 - DNA, 16 bp, P. troglodytes
ctttcaagacagcatc

SEQ ID NO: 240575 - DNA, 16 bp, P. troglodytes
ctttcaaggaattggt

SEQ ID NO: 240576 - DNA, 16 bp, P. troglodytes
ctttcaataaatactt

SEQ ID NO: 240577 - DNA, 16 bp, P. troglodytes
ctttcaatgacaaaaa

SEQ ID NO: 240578 - DNA, 16 bp, P. troglodytes
ctttcaattgtatttt

SEQ ID NO: 240579 - DNA, 16 bp, P. troglodytes
ctttcacagaattatt

SEQ ID NO: 240580 - DNA, 16 bp, P. troglodytes
ctttcacatttccccc

SEQ ID NO: 240581 - DNA, 16 bp, P. troglodytes
ctttcaccaatgtttt

SEQ ID NO: 240582 - DNA, 16 bp, P. troglodytes
ctttcaccatgtgagg

SEQ ID NO: 240583 - DNA, 16 bp, P. troglodytes
ctttcaccttccacca

SEQ ID NO: 240584 - DNA, 16 bp, P. troglodytes
ctttcactattaagta

SEQ ID NO: 240585 - DNA, 16 bp, P. troglodytes
ctttcactcctgctct

SEQ ID NO: 240586 - DNA, 16 bp, P. troglodytes
ctttcactgtaataaa

SEQ ID NO: 240587 - DNA, 16 bp, P. troglodytes
ctttcacttattaaac

SEQ ID NO: 240588 - DNA, 16 bp, P. troglodytes
ctttcagaactgtgag

SEQ ID NO: 240589 - DNA, 16 bp, P. troglodytes
ctttcagacttttttt

SEQ ID NO: 240590 - DNA, 16 bp, P. troglodytes
ctttcagatacaccaa

SEQ ID NO: 240591 - DNA, 16 bp, P. troglodytes
ctttcagatgactgca

SEQ ID NO: 240592 - DNA, 16 bp, P. troglodytes
ctttcagatttctctt

SEQ ID NO: 240593 - DNA, 16 bp, P. troglodytes
ctttcagcattagaca

SEQ ID NO: 240594 - DNA, 16 bp, P. troglodytes
ctttcagcattgaaca

SEQ ID NO: 240595 - DNA, 16 bp, P. troglodytes
ctttcagcctccaaaa

SEQ ID NO: 240596 - DNA, 16 bp, P. troglodytes
ctttcagtgcctggct

SEQ ID NO: 240597 - DNA, 16 bp, P. troglodytes
ctttcagttctgctct

SEQ ID NO: 240598 - DNA, 16 bp, P. troglodytes
ctttcagttctttgaa

SEQ ID NO: 240599 - DNA, 16 bp, P. troglodytes
ctttcagtttcctcat

SEQ ID NO: 240600 - DNA, 16 bp, P. troglodytes
ctttcataaaatattt

SEQ ID NO: 240601 - DNA, 16 bp, P. troglodytes
ctttcatagctagaga

SEQ ID NO: 240602 - DNA, 16 bp, P. troglodytes
ctttcatatttctgtg

SEQ ID NO: 240603 - DNA, 16 bp, P. troglodytes
ctttcatgaaaggaaa

SEQ ID NO: 240604 - DNA, 16 bp, P. troglodytes
ctttcatgtctggctt

SEQ ID NO: 240605 - DNA, 16 bp, P. troglodytes
ctttccaaagaaccag

SEQ ID NO: 240606 - DNA, 16 bp, P. troglodytes
ctttccaaaggcagag

SEQ ID NO: 240607 - DNA, 16 bp, P. troglodytes
ctttccaaagtgactg

SEQ ID NO: 240608 - DNA, 16 bp, P. troglodytes
ctttccaacctccaga

SEQ ID NO: 240609 - DNA, 16 bp, P. troglodytes
ctttccaccatgattg

SEQ ID NO: 240610 - DNA, 16 bp, P. troglodytes
ctttccacctcagcct

SEQ ID NO: 240611 - DNA, 16 bp, P. troglodytes
ctttccagatattcaa

SEQ ID NO: 240612 - DNA, 16 bp, P. troglodytes
ctttccagtttggagg

SEQ ID NO: 240613 - DNA, 16 bp, P. troglodytes
ctttccatgtaaattt

SEQ ID NO: 240614 - DNA, 16 bp, P. troglodytes
ctttccatttatttaa

SEQ ID NO: 240615 - DNA, 16 bp, P. troglodytes
ctttcccacttccaca

SEQ ID NO: 240616 - DNA, 16 bp, P. troglodytes
ctttccccagccacct

SEQ ID NO: 240617 - DNA, 16 bp, P. troglodytes
ctttccctctggctgc

SEQ ID NO: 240618 - DNA, 16 bp, P. troglodytes
ctttcccttctcagaa

SEQ ID NO: 240619 - DNA, 16 bp, P. troglodytes
ctttccctttttaaaa

SEQ ID NO: 240620 - DNA, 16 bp, P. troglodytes
ctttcctagcaaaggg

SEQ ID NO: 240621 - DNA, 16 bp, P. troglodytes
ctttcctcaagcagaa

SEQ ID NO: 240622 - DNA, 16 bp, P. troglodytes
ctttcctctggaagct

SEQ ID NO: 240623 - DNA, 16 bp, P. troglodytes
ctttcctcttccagct

SEQ ID NO: 240624 - DNA, 16 bp, P. troglodytes
ctttcctgctctaaag

SEQ ID NO: 240625 - DNA, 16 bp, P. troglodytes
ctttcctgcttaaaat

SEQ ID NO: 240626 - DNA, 16 bp, P. troglodytes
ctttcctgggcagagg

SEQ ID NO: 240627 - DNA, 16 bp, P. troglodytes
ctttcctttcctgatt

SEQ ID NO: 240628 - DNA, 16 bp, P. troglodytes
ctttcctttgtcttga

SEQ ID NO: 240629 - DNA, 16 bp, P. troglodytes
ctttcctttttcaaaa

SEQ ID NO: 240630 - DNA, 16 bp, P. troglodytes
ctttctaacaggccca

SEQ ID NO: 240631 - DNA, 16 bp, P. troglodytes
ctttctagttttatct

SEQ ID NO: 240632 - DNA, 16 bp, P. troglodytes
ctttctattcaataaa

SEQ ID NO: 240633 - DNA, 16 bp, P. troglodytes
ctttctcacattgcaa

SEQ ID NO: 240634 - DNA, 16 bp, P. troglodytes
ctttctcagaaaaaaa

SEQ ID NO: 240635 - DNA, 16 bp, P. troglodytes
ctttctcagacaaaca

SEQ ID NO: 240636 - DNA, 16 bp, P. troglodytes
ctttctcagcctcagt

SEQ ID NO: 240637 - DNA, 16 bp, P. troglodytes
ctttctcagcctcctg

SEQ ID NO: 240638 - DNA, 16 bp, P. troglodytes
ctttctcaggaatgcc

SEQ ID NO: 240639 - DNA, 16 bp, P. troglodytes
ctttctcatctgaaaa

SEQ ID NO: 240640 - DNA, 16 bp, P. troglodytes
ctttctcatctgtaaa

SEQ ID NO: 240641 - DNA, 16 bp, P. troglodytes
ctttctccacagcctt

SEQ ID NO: 240642 - DNA, 16 bp, P. troglodytes
ctttctccatcttcaa

SEQ ID NO: 240643 - DNA, 16 bp, P. troglodytes
ctttctcccctgctgg

SEQ ID NO: 240644 - DNA, 16 bp, P. troglodytes
ctttctcccgtgctgg

SEQ ID NO: 240645 - DNA, 16 bp, P. troglodytes
ctttctccctgagtcc

SEQ ID NO: 240646 - DNA, 16 bp, P. troglodytes
ctttctccctggctgc

SEQ ID NO: 240647 - DNA, 16 bp, P. troglodytes
ctttctcccttgctgg

SEQ ID NO: 240648 - DNA, 16 bp, P. troglodytes
ctttctccttcctgat

SEQ ID NO: 240649 - DNA, 16 bp, P. troglodytes
ctttctctacatcctc

SEQ ID NO: 240650 - DNA, 16 bp, P. troglodytes
ctttctctacccagca

SEQ ID NO: 240651 - DNA, 16 bp, P. troglodytes
ctttctctagttttct

SEQ ID NO: 240652 - DNA, 16 bp, P. troglodytes
ctttctctattgaatt

SEQ ID NO: 240653 - DNA, 16 bp, P. troglodytes
ctttctctctgtctca

SEQ ID NO: 240654 - DNA, 16 bp, P. troglodytes
ctttctctggcctccc

SEQ ID NO: 240655 - DNA, 16 bp, P. troglodytes
ctttctctgggcctca

SEQ ID NO: 240656 - DNA, 16 bp, P. troglodytes
ctttctctgtgcctca

SEQ ID NO: 240657 - DNA, 16 bp, P. troglodytes
ctttctctgtgccttc

SEQ ID NO: 240658 - DNA, 16 bp, P. troglodytes
ctttctcttgctcctg

SEQ ID NO: 240659 - DNA, 16 bp, P. troglodytes
ctttctgattggtgag

SEQ ID NO: 240660 - DNA, 16 bp, P. troglodytes
ctttctgctgacttca

SEQ ID NO: 240661 - DNA, 16 bp, P. troglodytes
ctttctggaaaagaaa

SEQ ID NO: 240662 - DNA, 16 bp, P. troglodytes
ctttctggaaaaggca

SEQ ID NO: 240663 - DNA, 16 bp, P. troglodytes
ctttctggaggaggtg

SEQ ID NO: 240664 - DNA, 16 bp, P. troglodytes
ctttctggctgcttgt

SEQ ID NO: 240665 - DNA, 16 bp, P. troglodytes
ctttctgggcctcagt

SEQ ID NO: 240666 - DNA, 16 bp, P. troglodytes
ctttctgggcctggct

SEQ ID NO: 240667 - DNA, 16 bp, P. troglodytes
ctttctgggctcaagt

SEQ ID NO: 240668 - DNA, 16 bp, P. troglodytes
ctttctgtcactatag

SEQ ID NO: 240669 - DNA, 16 bp, P. troglodytes
ctttctgtctctgtga

SEQ ID NO: 240670 - DNA, 16 bp, P. troglodytes
ctttctgtgccaggct

SEQ ID NO: 240671 - DNA, 16 bp, P. troglodytes
ctttctgtgcctcagt

SEQ ID NO: 240672 - DNA, 16 bp, P. troglodytes
ctttctgttctcatga

SEQ ID NO: 240673 - DNA, 16 bp, P. troglodytes
ctttcttatataaaat

SEQ ID NO: 240674 - DNA, 16 bp, P. troglodytes
ctttcttcacagaagt

SEQ ID NO: 240675 - DNA, 16 bp, P. troglodytes
ctttcttcagcctttt

SEQ ID NO: 240676 - DNA, 16 bp, P. troglodytes
ctttcttcagtgtttt

SEQ ID NO: 240677 - DNA, 16 bp, P. troglodytes
ctttcttctgccatct

SEQ ID NO: 240678 - DNA, 16 bp, P. troglodytes
ctttcttctttgtcac

SEQ ID NO: 240679 - DNA, 16 bp, P. troglodytes
ctttctttatccttgg

SEQ ID NO: 240680 - DNA, 16 bp, P. troglodytes
ctttctttctggctgc

SEQ ID NO: 240681 - DNA, 16 bp, P. troglodytes
ctttctttgacttgga

SEQ ID NO: 240682 - DNA, 16 bp, P. troglodytes
ctttctttggaggcag

SEQ ID NO: 240683 - DNA, 16 bp, P. troglodytes
ctttcttttctggagg

SEQ ID NO: 240684 - DNA, 16 bp, P. troglodytes
ctttcttttgtaaatg

SEQ ID NO: 240685 - DNA, 16 bp, P. troglodytes
ctttcttttgtaaatt

SEQ ID NO: 240686 - DNA, 16 bp, P. troglodytes
ctttcttttgtgaatt

SEQ ID NO: 240687 - DNA, 16 bp, P. troglodytes
ctttcttttttatggc

SEQ ID NO: 240688 - DNA, 16 bp, P. troglodytes
ctttgaaaaaatataa

SEQ ID NO: 240689 - DNA, 16 bp, P. troglodytes
ctttgaaaaatagttt

SEQ ID NO: 240690 - DNA, 16 bp, P. troglodytes
ctttgaaaaatgtaaa

SEQ ID NO: 240691 - DNA, 16 bp, P. troglodytes
ctttgaaaactggaac

SEQ ID NO: 240692 - DNA, 16 bp, P. troglodytes
ctttgaaaatgaaaaa

SEQ ID NO: 240693 - DNA, 16 bp, P. troglodytes
ctttgaaaatgtaaat

SEQ ID NO: 240694 - DNA, 16 bp, P. troglodytes
ctttgaaaatgtctgt

SEQ ID NO: 240695 - DNA, 16 bp, P. troglodytes
ctttgaaaatgttttt

SEQ ID NO: 240696 - DNA, 16 bp, P. troglodytes
ctttgaaacaaccaat

SEQ ID NO: 240697 - DNA, 16 bp, P. troglodytes
ctttgaaaggctgaag

SEQ ID NO: 240698 - DNA, 16 bp, P. troglodytes
ctttgaaatgtataaa

SEQ ID NO: 240699 - DNA, 16 bp, P. troglodytes
ctttgaaattttcttt

SEQ ID NO: 240700 - DNA, 16 bp, P. troglodytes
ctttgaacctcagttt

SEQ ID NO: 240701 - DNA, 16 bp, P. troglodytes
ctttgaagagagcagt

SEQ ID NO: 240702 - DNA, 16 bp, P. troglodytes
ctttgaagaggaactt

SEQ ID NO: 240703 - DNA, 16 bp, P. troglodytes
ctttgaagatgaaaga

SEQ ID NO: 240704 - DNA, 16 bp, P. troglodytes
ctttgaagatgaagaa

SEQ ID NO: 240705 - DNA, 16 bp, P. troglodytes
ctttgaagatgaagga

SEQ ID NO: 240706 - DNA, 16 bp, P. troglodytes
ctttgaagatggaagg

SEQ ID NO: 240707 - DNA, 16 bp, P. troglodytes
ctttgaagatgtgatt

SEQ ID NO: 240708 - DNA, 19 bp, P. troglodytes
ctttgaagcaactgtgaat

SEQ ID NO: 240709 - DNA, 16 bp, P. troglodytes
ctttgaagcagttgtg

SEQ ID NO: 240710 - DNA, 16 bp, P. troglodytes
ctttgaaggaagcaga

SEQ ID NO: 240711 - DNA, 16 bp, P. troglodytes
ctttgaaggctgaggc

SEQ ID NO: 240712 - DNA, 16 bp, P. troglodytes
ctttgaatagaccaat

SEQ ID NO: 240713 - DNA, 16 bp, P. troglodytes
ctttgaatgtggccca

SEQ ID NO: 240714 - DNA, 16 bp, P. troglodytes
ctttgaatgtgtttgc

SEQ ID NO: 240715 - DNA, 16 bp, P. troglodytes
ctttgaattaattttt

SEQ ID NO: 240716 - DNA, 16 bp, P. troglodytes
ctttgacaaaccagac

SEQ ID NO: 240717 - DNA, 16 bp, P. troglodytes
ctttgacaaacctgac

SEQ ID NO: 240718 - DNA, 16 bp, P. troglodytes
ctttgacaccatgtct

SEQ ID NO: 240719 - DNA, 16 bp, P. troglodytes
ctttgacagttgagtg

SEQ ID NO: 240720 - DNA, 16 bp, P. troglodytes
ctttgactatttgggg

SEQ ID NO: 240721 - DNA, 16 bp, P. troglodytes
ctttgactccacgtct

SEQ ID NO: 240722 - DNA, 16 bp, P. troglodytes
ctttgactggaatggt

SEQ ID NO: 240723 - DNA, 16 bp, P. troglodytes
ctttgacttggggttt

SEQ ID NO: 240724 - DNA, 16 bp, P. troglodytes
ctttgacttttaaaaa

SEQ ID NO: 240725 - DNA, 16 bp, P. troglodytes
ctttgagaaccactgc

SEQ ID NO: 240726 - DNA, 16 bp, P. troglodytes
ctttgagaagctgaga

SEQ ID NO: 240727 - DNA, 16 bp, P. troglodytes
ctttgagaggatgagg

SEQ ID NO: 240728 - DNA, 16 bp, P. troglodytes
ctttgagaggccaaga

SEQ ID NO: 240729 - DNA, 16 bp, P. troglodytes
ctttgagataaatgaa

SEQ ID NO: 240730 - DNA, 16 bp, P. troglodytes
ctttgagatggggtct

SEQ ID NO: 240731 - DNA, 16 bp, P. troglodytes
ctttgagccacagctg

SEQ ID NO: 240732 - DNA, 16 bp, P. troglodytes
ctttgagcctcagctt

SEQ ID NO: 240733 - DNA, 16 bp, P. troglodytes
ctttgagcctcagttt

SEQ ID NO: 240734 - DNA, 16 bp, P. troglodytes
ctttgagctctgaagt

SEQ ID NO: 240735 - DNA, 16 bp, P. troglodytes
ctttgagctgaggctg

SEQ ID NO: 240736 - DNA, 16 bp, P. troglodytes
ctttgaggaaaaaaaa

SEQ ID NO: 240737 - DNA, 16 bp, P. troglodytes
ctttgaggaattgcca

SEQ ID NO: 240738 - DNA, 16 bp, P. troglodytes
ctttgagtcttggttt

SEQ ID NO: 240739 - DNA, 16 bp, P. troglodytes
ctttgataaaattcaa

SEQ ID NO: 240740 - DNA, 16 bp, P. troglodytes
ctttgataatggtgac

SEQ ID NO: 240741 - DNA, 16 bp, P. troglodytes
ctttgatctcattatt

SEQ ID NO: 240742 - DNA, 16 bp, P. troglodytes
ctttgatcttggactt

SEQ ID NO: 240743 - DNA, 16 bp, P. troglodytes
ctttgatgaagtgtct

SEQ ID NO: 240744 - DNA, 16 bp, P. troglodytes
ctttgattactatagc

SEQ ID NO: 240745 - DNA, 16 bp, P. troglodytes
ctttgattttggactt

SEQ ID NO: 240746 - DNA, 16 bp, P. troglodytes
ctttgatttttttaaa

SEQ ID NO: 240747 - DNA, 16 bp, P. troglodytes
ctttgcaaaaattata

SEQ ID NO: 240748 - DNA, 16 bp, P. troglodytes
ctttgcaactgggtaa

SEQ ID NO: 240749 - DNA, 16 bp, P. troglodytes
ctttgcacatgctgtt

SEQ ID NO: 240750 - DNA, 16 bp, P. troglodytes
ctttgcacttgccatt

SEQ ID NO: 240751 - DNA, 16 bp, P. troglodytes
ctttgcagaaaaaaaa

SEQ ID NO: 240752 - DNA, 16 bp, P. troglodytes
ctttgcagatgatatg

SEQ ID NO: 240753 - DNA, 16 bp, P. troglodytes
ctttgcagatgtgatt

SEQ ID NO: 240754 - DNA, 16 bp, P. troglodytes
ctttgcagattctaca

SEQ ID NO: 240755 - DNA, 16 bp, P. troglodytes
ctttgcaggcacatgg

SEQ ID NO: 240756 - DNA, 16 bp, P. troglodytes
ctttgcagtaagtttt

SEQ ID NO: 240757 - DNA, 16 bp, P. troglodytes
ctttgcatttatttat

SEQ ID NO: 240758 - DNA, 16 bp, P. troglodytes
ctttgcatttcagttt

SEQ ID NO: 240759 - DNA, 16 bp, P. troglodytes
ctttgcatttgctgtt

SEQ ID NO: 240760 - DNA, 16 bp, P. troglodytes
ctttgcattttagttt

SEQ ID NO: 240761 - DNA, 16 bp, P. troglodytes
ctttgccattgtgaac

SEQ ID NO: 240762 - DNA, 16 bp, P. troglodytes
ctttgcccatttttct

SEQ ID NO: 240763 - DNA, 19 bp, P. troglodytes
ctttgccccagccactttg

SEQ ID NO: 240764 - DNA, 16 bp, P. troglodytes
ctttgccctccaccat

SEQ ID NO: 240765 - DNA, 16 bp, P. troglodytes
ctttgcccttctgcca

SEQ ID NO: 240766 - DNA, 16 bp, P. troglodytes
ctttgcctcttttgat

SEQ ID NO: 240767 - DNA, 16 bp, P. troglodytes
ctttgcctgagttctt

SEQ ID NO: 240768 - DNA, 16 bp, P. troglodytes
ctttgccttatttgaa

SEQ ID NO: 240769 - DNA, 16 bp, P. troglodytes
ctttgccttcctccat

SEQ ID NO: 240770 - DNA, 16 bp, P. troglodytes
ctttgcctttgatttt

SEQ ID NO: 240771 - DNA, 16 bp, P. troglodytes
ctttgctattgcaaat

SEQ ID NO: 240772 - DNA, 16 bp, P. troglodytes
ctttgctcaaggaaat

SEQ ID NO: 240773 - DNA, 16 bp, P. troglodytes
ctttgctcacatgttt

SEQ ID NO: 240774 - DNA, 16 bp, P. troglodytes
ctttgctcatttttct

SEQ ID NO: 240775 - DNA, 16 bp, P. troglodytes
ctttgctccagttccc

SEQ ID NO: 240776 - DNA, 16 bp, P. troglodytes
ctttgctcctgcatct

SEQ ID NO: 240777 - DNA, 16 bp, P. troglodytes
ctttgctcctttgtta

SEQ ID NO: 240778 - DNA, 16 bp, P. troglodytes
ctttgctgaagttgtc

SEQ ID NO: 240779 - DNA, 16 bp, P. troglodytes
ctttgctgaatttttt

SEQ ID NO: 240780 - DNA, 16 bp, P. troglodytes
ctttgctgatgttgct

SEQ ID NO: 240781 - DNA, 16 bp, P. troglodytes
ctttgctgctctgcag

SEQ ID NO: 240782 - DNA, 16 bp, P. troglodytes
ctttgctgctgctgct

SEQ ID NO: 240783 - DNA, 16 bp, P. troglodytes
ctttgctgctgtgaat

SEQ ID NO: 240784 - DNA, 16 bp, P. troglodytes
ctttgctgggcactca

SEQ ID NO: 240785 - DNA, 16 bp, P. troglodytes
ctttgctgggtatagt

SEQ ID NO: 240786 - DNA, 16 bp, P. troglodytes
ctttgctgtgtagaag

SEQ ID NO: 240787 - DNA, 16 bp, P. troglodytes
ctttgctgttctcatg

SEQ ID NO: 240788 - DNA, 16 bp, P. troglodytes
ctttgctttccatttg

SEQ ID NO: 240789 - DNA, 16 bp, P. troglodytes
ctttggaaaaattaaa

SEQ ID NO: 240790 - DNA, 16 bp, P. troglodytes
ctttggaaaacagttt

SEQ ID NO: 240791 - DNA, 16 bp, P. troglodytes
ctttggaaaataattt

SEQ ID NO: 240792 - DNA, 16 bp, P. troglodytes
ctttggaaaatcattt

SEQ ID NO: 240793 - DNA, 16 bp, P. troglodytes
ctttggaaagcagttt

SEQ ID NO: 240794 - DNA, 16 bp, P. troglodytes
ctttggaaataatttt

SEQ ID NO: 240795 - DNA, 16 bp, P. troglodytes
ctttggaactaggtaa

SEQ ID NO: 240796 - DNA, 16 bp, P. troglodytes
ctttggaaggtaatta

SEQ ID NO: 240797 - DNA, 16 bp, P. troglodytes
ctttggacctcagttt

SEQ ID NO: 240798 - DNA, 16 bp, P. troglodytes
ctttggagaaaagtct

SEQ ID NO: 240799 - DNA, 16 bp, P. troglodytes
ctttggagaaaggcat

SEQ ID NO: 240800 - DNA, 16 bp, P. troglodytes
ctttggagaaccctga

SEQ ID NO: 240801 - DNA, 16 bp, P. troglodytes
ctttggagaattgtct

SEQ ID NO: 240802 - DNA, 16 bp, P. troglodytes
ctttggagagcccaag

SEQ ID NO: 240803 - DNA, 16 bp, P. troglodytes
ctttggaggagaagaa

SEQ ID NO: 240804 - DNA, 16 bp, P. troglodytes
ctttggaggcagaagc

SEQ ID NO: 240805 - DNA, 16 bp, P. troglodytes
ctttggaggccgaggc

SEQ ID NO: 240806 - DNA, 16 bp, P. troglodytes
ctttggagggagcatg

SEQ ID NO: 240807 - DNA, 16 bp, P. troglodytes
ctttggattaaatctg

SEQ ID NO: 240808 - DNA, 16 bp, P. troglodytes
ctttggattttttaaa

SEQ ID NO: 240809 - DNA, 16 bp, P. troglodytes
ctttggcacagagctt

SEQ ID NO: 240810 - DNA, 16 bp, P. troglodytes
ctttggccaacagaat

SEQ ID NO: 240811 - DNA, 16 bp, P. troglodytes
ctttggcctcctgaag

SEQ ID NO: 240812 - DNA, 16 bp, P. troglodytes
ctttggccttccaaag

SEQ ID NO: 240813 - DNA, 16 bp, P. troglodytes
ctttggctcacactca

SEQ ID NO: 240814 - DNA, 16 bp, P. troglodytes
ctttggctctgtgggc

SEQ ID NO: 240815 - DNA, 16 bp, P. troglodytes
ctttggctgtgtgggc

SEQ ID NO: 240816 - DNA, 16 bp, P. troglodytes
ctttggcttgcagatg

SEQ ID NO: 240817 - DNA, 16 bp, P. troglodytes
ctttgggaacccaagg

SEQ ID NO: 240818 - DNA, 16 bp, P. troglodytes
ctttgggaagccaaga

SEQ ID NO: 240819 - DNA, 16 bp, P. troglodytes
ctttgggaagctcagg

SEQ ID NO: 240820 - DNA, 16 bp, P. troglodytes
ctttgggaagtaatta

SEQ ID NO: 240821 - DNA, 16 bp, P. troglodytes
ctttgggaagtgatta

SEQ ID NO: 240822 - DNA, 16 bp, P. troglodytes
ctttgggaagtggagg

SEQ ID NO: 240823 - DNA, 16 bp, P. troglodytes
ctttgggagaccaatg

SEQ ID NO: 240824 - DNA, 16 bp, P. troglodytes
ctttgggagaccgagg

SEQ ID NO: 240825 - DNA, 16 bp, P. troglodytes
ctttgggagactgggg

SEQ ID NO: 240826 - DNA, 16 bp, P. troglodytes
ctttgggagctgaggc

SEQ ID NO: 240827 - DNA, 16 bp, P. troglodytes
ctttgggaggacaagg

SEQ ID NO: 240828 - DNA, 16 bp, P. troglodytes
ctttgggaggcagagg

SEQ ID NO: 240829 - DNA, 16 bp, P. troglodytes
ctttgggaggccaaga

SEQ ID NO: 240830 - DNA, 16 bp, P. troglodytes
ctttgggaggccagga

SEQ ID NO: 240831 - DNA, 16 bp, P. troglodytes
ctttgggaggccatgg

SEQ ID NO: 240832 - DNA, 16 bp, P. troglodytes
ctttgggaggctgaca

SEQ ID NO: 240833 - DNA, 16 bp, P. troglodytes
ctttgggatgcctagg

SEQ ID NO: 240834 - DNA, 16 bp, P. troglodytes
ctttgggatgctgaag

SEQ ID NO: 240835 - DNA, 16 bp, P. troglodytes
ctttgggcaagtcact

SEQ ID NO: 240836 - DNA, 16 bp, P. troglodytes
ctttgggctgtatggc

SEQ ID NO: 240837 - DNA, 16 bp, P. troglodytes
ctttgggctgtatttg

SEQ ID NO: 240838 - DNA, 16 bp, P. troglodytes
ctttgggggacacatt

SEQ ID NO: 240839 - DNA, 16 bp, P. troglodytes
ctttgggggacagttg

SEQ ID NO: 240840 - DNA, 16 bp, P. troglodytes
ctttgggtactatgga

SEQ ID NO: 240841 - DNA, 16 bp, P. troglodytes
ctttgggtttattttg

SEQ ID NO: 240842 - DNA, 16 bp, P. troglodytes
ctttggtaggctgagg

SEQ ID NO: 240843 - DNA, 16 bp, P. troglodytes
ctttggtattttttaa

SEQ ID NO: 240844 - DNA, 16 bp, P. troglodytes
ctttggtgaggtatct

SEQ ID NO: 240845 - DNA, 16 bp, P. troglodytes
ctttggttgtctgtgc

SEQ ID NO: 240846 - DNA, 16 bp, P. troglodytes
ctttgtaaactgtgaa

SEQ ID NO: 240847 - DNA, 16 bp, P. troglodytes
ctttgtaaagctaatg

SEQ ID NO: 240848 - DNA, 16 bp, P. troglodytes
ctttgtaatatgtttt

SEQ ID NO: 240849 - DNA, 16 bp, P. troglodytes
ctttgtagattctgaa

SEQ ID NO: 240850 - DNA, 16 bp, P. troglodytes
ctttgtaggtgaagtg

SEQ ID NO: 240851 - DNA, 16 bp, P. troglodytes
ctttgtatattttgaa

SEQ ID NO: 240852 - DNA, 16 bp, P. troglodytes
ctttgtatttcagttt

SEQ ID NO: 240853 - DNA, 16 bp, P. troglodytes
ctttgtattttaaaat

SEQ ID NO: 240854 - DNA, 16 bp, P. troglodytes
ctttgtatttttaaaa

SEQ ID NO: 240855 - DNA, 16 bp, P. troglodytes
ctttgtatttttaata

SEQ ID NO: 240856 - DNA, 16 bp, P. troglodytes
ctttgtcaccaccagg

SEQ ID NO: 240857 - DNA, 16 bp, P. troglodytes
ctttgtcagatgagaa

SEQ ID NO: 240858 - DNA, 16 bp, P. troglodytes
ctttgtcagatgcatt

SEQ ID NO: 240859 - DNA, 16 bp, P. troglodytes
ctttgtcagtagaggg

SEQ ID NO: 240860 - DNA, 16 bp, P. troglodytes
ctttgtctcaaaataa

SEQ ID NO: 240861 - DNA, 16 bp, P. troglodytes
ctttgtctcagagggg

SEQ ID NO: 240862 - DNA, 16 bp, P. troglodytes
ctttgtctctcccaga

SEQ ID NO: 240863 - DNA, 16 bp, P. troglodytes
ctttgtcttggaaatg

SEQ ID NO: 240864 - DNA, 16 bp, P. troglodytes
ctttgtgacagcagcc

SEQ ID NO: 240865 - DNA, 16 bp, P. troglodytes
ctttgtgaccttgggc

SEQ ID NO: 240866 - DNA, 16 bp, P. troglodytes
ctttgtggaaggctga

SEQ ID NO: 240867 - DNA, 16 bp, P. troglodytes
ctttgtggaggaggca

SEQ ID NO: 240868 - DNA, 16 bp, P. troglodytes
ctttgtggaggaggtg

SEQ ID NO: 240869 - DNA, 16 bp, P. troglodytes
ctttgtggccttctct

SEQ ID NO: 240870 - DNA, 16 bp, P. troglodytes
ctttgtggggccgagg

SEQ ID NO: 240871 - DNA, 16 bp, P. troglodytes
ctttgtgtagtatgga

SEQ ID NO: 240872 - DNA, 16 bp, P. troglodytes
ctttgtgtctctctgt

SEQ ID NO: 240873 - DNA, 16 bp, P. troglodytes
ctttgtgtgtatgtgt

SEQ ID NO: 240874 - DNA, 16 bp, P. troglodytes
ctttgtgtgtgcgtgt

SEQ ID NO: 240875 - DNA, 16 bp, P. troglodytes
ctttgtgttcatgtgt

SEQ ID NO: 240876 - DNA, 48 bp, P. troglodytes
ctttgttaaacagatgcttgaaggcagcatgctccttaagagtcatca

SEQ ID NO: 240877 - DNA, 45 bp, P. troglodytes
ctttgttcacttgtttatctgctgaccttccctccactattgtcc

SEQ ID NO: 240878 - DNA, 16 bp, P. troglodytes
ctttgttcagggctca

SEQ ID NO: 240879 - DNA, 16 bp, P. troglodytes
ctttgttctcattaat

SEQ ID NO: 240880 - DNA, 16 bp, P. troglodytes
ctttgttctccatttt

SEQ ID NO: 240881 - DNA, 16 bp, P. troglodytes
ctttgttcttccttca

SEQ ID NO: 240882 - DNA, 16 bp, P. troglodytes
ctttgttctttggctc

SEQ ID NO: 240883 - DNA, 16 bp, P. troglodytes
ctttgttcttttaaaa

SEQ ID NO: 240884 - DNA, 21 bp, P. troglodytes
ctttgttgcccaggctggagt

SEQ ID NO: 240885 - DNA, 16 bp, P. troglodytes
ctttgttggatacata

SEQ ID NO: 240886 - DNA, 16 bp, P. troglodytes
ctttgttgtcatttca

SEQ ID NO: 240887 - DNA, 16 bp, P. troglodytes
ctttgttgttttaaag

SEQ ID NO: 240888 - DNA, 16 bp, P. troglodytes
ctttgtttaaaaaaaa

SEQ ID NO: 240889 - DNA, 16 bp, P. troglodytes
ctttgtttcctcatct

SEQ ID NO: 240890 - DNA, 16 bp, P. troglodytes
ctttgtttccttatct

SEQ ID NO: 240891 - DNA, 16 bp, P. troglodytes
ctttgtttgtttgaga

SEQ ID NO: 240892 - DNA, 16 bp, P. troglodytes
ctttgttttaaaaaaa

SEQ ID NO: 240893 - DNA, 16 bp, P. troglodytes
ctttgttttaaatata

SEQ ID NO: 240894 - DNA, 16 bp, P. troglodytes
ctttgttttaatataa

SEQ ID NO: 240895 - DNA, 16 bp, P. troglodytes
ctttgttttccaggct

SEQ ID NO: 240896 - DNA, 16 bp, P. troglodytes
ctttgttttcttctaa

SEQ ID NO: 240897 - DNA, 16 bp, P. troglodytes
ctttgtttttaaactt

SEQ ID NO: 240898 - DNA, 16 bp, P. troglodytes
ctttgtttttaatgta

SEQ ID NO: 240899 - DNA, 16 bp, P. troglodytes
cttttaaaaaactttt

SEQ ID NO: 240900 - DNA, 16 bp, P. troglodytes
cttttaaaaaatgttt

SEQ ID NO: 240901 - DNA, 16 bp, P. troglodytes
cttttaaaaagaaaaa

SEQ ID NO: 240902 - DNA, 16 bp, P. troglodytes
cttttaaaaatcagaa

SEQ ID NO: 240903 - DNA, 16 bp, P. troglodytes
cttttaaaaatgaatt

SEQ ID NO: 240904 - DNA, 16 bp, P. troglodytes
cttttaaaaatgattt

SEQ ID NO: 240905 - DNA, 16 bp, P. troglodytes
cttttaaaaatgcttt

SEQ ID NO: 240906 - DNA, 16 bp, P. troglodytes
cttttaaaaatgtaaa

SEQ ID NO: 240907 - DNA, 16 bp, P. troglodytes
cttttaaaaatgtttg

SEQ ID NO: 240908 - DNA, 16 bp, P. troglodytes
cttttaaaaattactg

SEQ ID NO: 240909 - DNA, 16 bp, P. troglodytes
cttttaaaaattgtgt

SEQ ID NO: 240910 - DNA, 16 bp, P. troglodytes
cttttaaaaattttgt

SEQ ID NO: 240911 - DNA, 16 bp, P. troglodytes
cttttaaaacattatt

SEQ ID NO: 240912 - DNA, 16 bp, P. troglodytes
cttttaaaagcaaatt

SEQ ID NO: 240913 - DNA, 16 bp, P. troglodytes
cttttaaaagttatta

SEQ ID NO: 240914 - DNA, 16 bp, P. troglodytes
cttttaaaatacattt

SEQ ID NO: 240915 - DNA, 16 bp, P. troglodytes
cttttaaaatcagaag

SEQ ID NO: 240916 - DNA, 16 bp, P. troglodytes
cttttaaaatcatcag

SEQ ID NO: 240917 - DNA, 16 bp, P. troglodytes
cttttaaaatgaaagt

SEQ ID NO: 240918 - DNA, 16 bp, P. troglodytes
cttttaaaatgctgaa

SEQ ID NO: 240919 - DNA, 16 bp, P. troglodytes
cttttaaaattgattt

SEQ ID NO: 240920 - DNA, 16 bp, P. troglodytes
cttttaaaattttgtt

SEQ ID NO: 240921 - DNA, 16 bp, P. troglodytes
cttttaaacacatttt

SEQ ID NO: 240922 - DNA, 16 bp, P. troglodytes
cttttaaagaaaaatt

SEQ ID NO: 240923 - DNA, 16 bp, P. troglodytes
cttttaaagaattaaa

SEQ ID NO: 240924 - DNA, 16 bp, P. troglodytes
cttttaaataaaatct

SEQ ID NO: 240925 - DNA, 16 bp, P. troglodytes
cttttaaatgaccaaa

SEQ ID NO: 240926 - DNA, 16 bp, P. troglodytes
cttttaaatttaaact

SEQ ID NO: 240927 - DNA, 16 bp, P. troglodytes
cttttaaatttactga

SEQ ID NO: 240928 - DNA, 16 bp, P. troglodytes
cttttaaatttgttga

SEQ ID NO: 240929 - DNA, 16 bp, P. troglodytes
cttttaacaaccagct

SEQ ID NO: 240930 - DNA, 16 bp, P. troglodytes
cttttaacttttaaaa

SEQ ID NO: 240931 - DNA, 16 bp, P. troglodytes
cttttaagaaatgtct

SEQ ID NO: 240932 - DNA, 16 bp, P. troglodytes
cttttaagttcaggga

SEQ ID NO: 240933 - DNA, 16 bp, P. troglodytes
cttttaataacaaaag

SEQ ID NO: 240934 - DNA, 16 bp, P. troglodytes
cttttaatattttgct

SEQ ID NO: 240935 - DNA, 16 bp, P. troglodytes
cttttaattctcttaa

SEQ ID NO: 240936 - DNA, 16 bp, P. troglodytes
cttttacactgttggg

SEQ ID NO: 240937 - DNA, 16 bp, P. troglodytes
cttttacagaaaaagt

SEQ ID NO: 240938 - DNA, 16 bp, P. troglodytes
cttttacattaaaaat

SEQ ID NO: 240939 - DNA, 16 bp, P. troglodytes
cttttagcattttttc

SEQ ID NO: 240940 - DNA, 16 bp, P. troglodytes
cttttagctattatga

SEQ ID NO: 240941 - DNA, 16 bp, P. troglodytes
cttttagcttccctgg

SEQ ID NO: 240942 - DNA, 21 bp, P. troglodytes
cttttagtagagacagggttt

SEQ ID NO: 240943 - DNA, 23 bp, P. troglodytes
cttttagtagagatagggtttca

SEQ ID NO: 240944 - DNA, 26 bp, P. troglodytes
cttttagtagagatggggtttcaccg

SEQ ID NO: 240945 - DNA, 16 bp, P. troglodytes
cttttataaataaagt

SEQ ID NO: 240946 - DNA, 16 bp, P. troglodytes
cttttataagggcatt

SEQ ID NO: 240947 - DNA, 16 bp, P. troglodytes
cttttataataaacca

SEQ ID NO: 240948 - DNA, 16 bp, P. troglodytes
cttttatacctgtttt

SEQ ID NO: 240949 - DNA, 16 bp, P. troglodytes
cttttatactttggtt

SEQ ID NO: 240950 - DNA, 16 bp, P. troglodytes
cttttatcattacata

SEQ ID NO: 240951 - DNA, 16 bp, P. troglodytes
cttttatgactggctt

SEQ ID NO: 240952 - DNA, 16 bp, P. troglodytes
cttttatgcagccaaa

SEQ ID NO: 240953 - DNA, 16 bp, P. troglodytes
cttttatgtgcactgg

SEQ ID NO: 240954 - DNA, 16 bp, P. troglodytes
cttttatgtttttaaa

SEQ ID NO: 240955 - DNA, 16 bp, P. troglodytes
cttttattaaagaaaa

SEQ ID NO: 240956 - DNA, 16 bp, P. troglodytes
cttttattagagaatg

SEQ ID NO: 240957 - DNA, 16 bp, P. troglodytes
cttttattatggaaaa

SEQ ID NO: 240958 - DNA, 16 bp, P. troglodytes
cttttattatgttgag

SEQ ID NO: 240959 - DNA, 16 bp, P. troglodytes
cttttattcctcactc

SEQ ID NO: 240960 - DNA, 16 bp, P. troglodytes
cttttattgcccaggc

SEQ ID NO: 240961 - DNA, 16 bp, P. troglodytes
cttttattgtgttgag

SEQ ID NO: 240962 - DNA, 16 bp, P. troglodytes
cttttattttaaaaca

SEQ ID NO: 240963 - DNA, 16 bp, P. troglodytes
cttttcaaaaaaacaa

SEQ ID NO: 240964 - DNA, 16 bp, P. troglodytes
cttttcaaaaaatcag

SEQ ID NO: 240965 - DNA, 16 bp, P. troglodytes
cttttcaaataaaata

SEQ ID NO: 240966 - DNA, 16 bp, P. troglodytes
cttttcaaataaccaa

SEQ ID NO: 240967 - DNA, 16 bp, P. troglodytes
cttttcacattggctt

SEQ ID NO: 240968 - DNA, 16 bp, P. troglodytes
cttttcacatttcaaa

SEQ ID NO: 240969 - DNA, 16 bp, P. troglodytes
cttttcactttcctga

SEQ ID NO: 240970 - DNA, 16 bp, P. troglodytes
cttttcagaaggtttt

SEQ ID NO: 240971 - DNA, 16 bp, P. troglodytes
cttttcagatatttga

SEQ ID NO: 240972 - DNA, 16 bp, P. troglodytes
cttttcagattggctt

SEQ ID NO: 240973 - DNA, 16 bp, P. troglodytes
cttttcagttttgaaa

SEQ ID NO: 240974 - DNA, 16 bp, P. troglodytes
cttttcatgtctctat

SEQ ID NO: 240975 - DNA, 16 bp, P. troglodytes
cttttcattctcttaa

SEQ ID NO: 240976 - DNA, 16 bp, P. troglodytes
cttttcattgctgaat

SEQ ID NO: 240977 - DNA, 16 bp, P. troglodytes
cttttcatttccttaa

SEQ ID NO: 240978 - DNA, 16 bp, P. troglodytes
cttttcatttctttgc

SEQ ID NO: 240979 - DNA, 16 bp, P. troglodytes
cttttccatttctgca

SEQ ID NO: 240980 - DNA, 16 bp, P. troglodytes
cttttcccagcaccat

SEQ ID NO: 240981 - DNA, 16 bp, P. troglodytes
cttttcccatggtctt

SEQ ID NO: 240982 - DNA, 16 bp, P. troglodytes
cttttcccccaggctg

SEQ ID NO: 240983 - DNA, 21 bp, P. troglodytes
cttttccgacgggcttaaaaa

SEQ ID NO: 240984 - DNA, 16 bp, P. troglodytes
cttttcctcattgtct

SEQ ID NO: 240985 - DNA, 16 bp, P. troglodytes
cttttcctgtttgaat

SEQ ID NO: 240986 - DNA, 16 bp, P. troglodytes
cttttcctttaaaaat

SEQ ID NO: 240987 - DNA, 16 bp, P. troglodytes
cttttctaacagaaag

SEQ ID NO: 240988 - DNA, 16 bp, P. troglodytes
cttttctaagtccttt

SEQ ID NO: 240989 - DNA, 16 bp, P. troglodytes
cttttctaataaactt

SEQ ID NO: 240990 - DNA, 16 bp, P. troglodytes
cttttctcaaaataaa

SEQ ID NO: 240991 - DNA, 16 bp, P. troglodytes
cttttctctacatcct

SEQ ID NO: 240992 - DNA, 16 bp, P. troglodytes
cttttctctactaaaa

SEQ ID NO: 240993 - DNA, 16 bp, P. troglodytes
cttttctctgcaccct

SEQ ID NO: 240994 - DNA, 16 bp, P. troglodytes
cttttctcttgcaaca

SEQ ID NO: 240995 - DNA, 16 bp, P. troglodytes
cttttctcttttaaaa

SEQ ID NO: 240996 - DNA, 16 bp, P. troglodytes
cttttctgatttggat

SEQ ID NO: 240997 - DNA, 16 bp, P. troglodytes
cttttctggaatgtca

SEQ ID NO: 240998 - DNA, 16 bp, P. troglodytes
cttttctgtaaagggc

SEQ ID NO: 240999 - DNA, 16 bp, P. troglodytes
cttttctgtgaatttt

SEQ ID NO: 241000 - DNA, 16 bp, P. troglodytes
cttttctgttactcag

SEQ ID NO: 241001 - DNA, 16 bp, P. troglodytes
cttttcttattaaaaa

SEQ ID NO: 241002 - DNA, 16 bp, P. troglodytes
cttttcttcatttatg

SEQ ID NO: 241003 - DNA, 16 bp, P. troglodytes
cttttcttctgcaatg

SEQ ID NO: 241004 - DNA, 16 bp, P. troglodytes
cttttcttgttccagt

SEQ ID NO: 241005 - DNA, 16 bp, P. troglodytes
cttttctttaaagatg

SEQ ID NO: 241006 - DNA, 16 bp, P. troglodytes
cttttctttactgaga

SEQ ID NO: 241007 - DNA, 16 bp, P. troglodytes
cttttctttactggaa

SEQ ID NO: 241008 - DNA, 16 bp, P. troglodytes
cttttctttctgactg

SEQ ID NO: 241009 - DNA, 16 bp, P. troglodytes
cttttctttgtcatct

SEQ ID NO: 241010 - DNA, 16 bp, P. troglodytes
cttttctttgtgggaa

SEQ ID NO: 241011 - DNA, 16 bp, P. troglodytes
cttttctttttgaaac

SEQ ID NO: 241012 - DNA, 16 bp, P. troglodytes
cttttcttttttaaga

SEQ ID NO: 241013 - DNA, 16 bp, P. troglodytes
cttttcttttttgaaa

SEQ ID NO: 241014 - DNA, 16 bp, P. troglodytes
cttttgaaaagggtct

SEQ ID NO: 241015 - DNA, 16 bp, P. troglodytes
cttttgaaaatagttt

SEQ ID NO: 241016 - DNA, 16 bp, P. troglodytes
cttttgaaaatattta

SEQ ID NO: 241017 - DNA, 16 bp, P. troglodytes
cttttgaaagtgtctg

SEQ ID NO: 241018 - DNA, 16 bp, P. troglodytes
cttttgaagcttagtt

SEQ ID NO: 241019 - DNA, 16 bp, P. troglodytes
cttttgaatgtatttt

SEQ ID NO: 241020 - DNA, 16 bp, P. troglodytes
cttttgaatgtttttg

SEQ ID NO: 241021 - DNA, 16 bp, P. troglodytes
cttttgaatttctttg

SEQ ID NO: 241022 - DNA, 16 bp, P. troglodytes
cttttgaattttgaat

SEQ ID NO: 241023 - DNA, 16 bp, P. troglodytes
cttttgactcctttgt

SEQ ID NO: 241024 - DNA, 16 bp, P. troglodytes
cttttgacttccccaa

SEQ ID NO: 241025 - DNA, 16 bp, P. troglodytes
cttttgactttgttta

SEQ ID NO: 241026 - DNA, 16 bp, P. troglodytes
cttttgagaattttct

SEQ ID NO: 241027 - DNA, 17 bp, P. troglodytes
cttttgagacagagtct

SEQ ID NO: 241028 - DNA, 16 bp, P. troglodytes
cttttgagatatcttt

SEQ ID NO: 241029 - DNA, 16 bp, P. troglodytes
cttttgaggtaatttt

SEQ ID NO: 241030 - DNA, 16 bp, P. troglodytes
cttttgagttaatgtt

SEQ ID NO: 241031 - DNA, 16 bp, P. troglodytes
cttttgatgaacagaa

SEQ ID NO: 241032 - DNA, 16 bp, P. troglodytes
cttttgatgtctgcag

SEQ ID NO: 241033 - DNA, 16 bp, P. troglodytes
cttttgatgtcttcat

SEQ ID NO: 241034 - DNA, 16 bp, P. troglodytes
cttttgattataaatt

SEQ ID NO: 241035 - DNA, 16 bp, P. troglodytes
cttttgcaaatatttt

SEQ ID NO: 241036 - DNA, 16 bp, P. troglodytes
cttttgcaacaacatg

SEQ ID NO: 241037 - DNA, 16 bp, P. troglodytes
cttttgcacagcaaaa

SEQ ID NO: 241038 - DNA, 16 bp, P. troglodytes
cttttgcacagcaaag

SEQ ID NO: 241039 - DNA, 16 bp, P. troglodytes
cttttgcatttttaat

SEQ ID NO: 241040 - DNA, 16 bp, P. troglodytes
cttttgccacttctat

SEQ ID NO: 241041 - DNA, 16 bp, P. troglodytes
cttttgcccaggatgg

SEQ ID NO: 241042 - DNA, 16 bp, P. troglodytes
cttttgcccattctgt

SEQ ID NO: 241043 - DNA, 16 bp, P. troglodytes
cttttgcccattttga

SEQ ID NO: 241044 - DNA, 16 bp, P. troglodytes
cttttgctatatccca

SEQ ID NO: 241045 - DNA, 16 bp, P. troglodytes
cttttgctatttctac

SEQ ID NO: 241046 - DNA, 16 bp, P. troglodytes
cttttgctgcctgtgc

SEQ ID NO: 241047 - DNA, 16 bp, P. troglodytes
cttttgctgtccagaa

SEQ ID NO: 241048 - DNA, 16 bp, P. troglodytes
cttttggactcttgga

SEQ ID NO: 241049 - DNA, 16 bp, P. troglodytes
cttttggaggaggaga

SEQ ID NO: 241050 - DNA, 16 bp, P. troglodytes
cttttggaggcagagg

SEQ ID NO: 241051 - DNA, 16 bp, P. troglodytes
cttttggaggccaaag

SEQ ID NO: 241052 - DNA, 16 bp, P. troglodytes
cttttggagtctccaa

SEQ ID NO: 241053 - DNA, 16 bp, P. troglodytes
cttttggcatttttgt

SEQ ID NO: 241054 - DNA, 16 bp, P. troglodytes
cttttggcctaggatt

SEQ ID NO: 241055 - DNA, 16 bp, P. troglodytes
cttttggctattggga

SEQ ID NO: 241056 - DNA, 16 bp, P. troglodytes
cttttggcttgtaggg

SEQ ID NO: 241057 - DNA, 16 bp, P. troglodytes
cttttggctttcctgg

SEQ ID NO: 241058 - DNA, 16 bp, P. troglodytes
cttttgggaggctgag

SEQ ID NO: 241059 - DNA, 16 bp, P. troglodytes
cttttggggaaaaaaa

SEQ ID NO: 241060 - DNA, 16 bp, P. troglodytes
cttttggggttttatg

SEQ ID NO: 241061 - DNA, 16 bp, P. troglodytes
cttttggtgcctggct

SEQ ID NO: 241062 - DNA, 16 bp, P. troglodytes
cttttggtttccctgg

SEQ ID NO: 241063 - DNA, 16 bp, P. troglodytes
cttttgtaaaataaaa

SEQ ID NO: 241064 - DNA, 18 bp, P. troglodytes
cttttgtaaataaagttt

SEQ ID NO: 241065 - DNA, 16 bp, P. troglodytes
cttttgtatttcagta

SEQ ID NO: 241066 - DNA, 16 bp, P. troglodytes
cttttgtccttcattc

SEQ ID NO: 241067 - DNA, 16 bp, P. troglodytes
cttttgtcttcagcta

SEQ ID NO: 241068 - DNA, 16 bp, P. troglodytes
cttttgtctttgatgt

SEQ ID NO: 241069 - DNA, 16 bp, P. troglodytes
cttttgtctttgtaaa

SEQ ID NO: 241070 - DNA, 16 bp, P. troglodytes
cttttgtgaaatgtct

SEQ ID NO: 241071 - DNA, 16 bp, P. troglodytes
cttttgtgaatggctt

SEQ ID NO: 241072 - DNA, 16 bp, P. troglodytes
cttttgtgactggctt

SEQ ID NO: 241073 - DNA, 16 bp, P. troglodytes
cttttgtgcctggctt

SEQ ID NO: 241074 - DNA, 16 bp, P. troglodytes
cttttgtggaaaaaaa

SEQ ID NO: 241075 - DNA, 16 bp, P. troglodytes
cttttgtggttttaat

SEQ ID NO: 241076 - DNA, 16 bp, P. troglodytes
cttttgtgtctagctt

SEQ ID NO: 241077 - DNA, 16 bp, P. troglodytes
cttttgttacttaggc

SEQ ID NO: 241078 - DNA, 16 bp, P. troglodytes
cttttgttcattcagt

SEQ ID NO: 241079 - DNA, 16 bp, P. troglodytes
cttttgttctaatgag

SEQ ID NO: 241080 - DNA, 16 bp, P. troglodytes
cttttgttcttttaaa

SEQ ID NO: 241081 - DNA, 16 bp, P. troglodytes
cttttgttgccatctt

SEQ ID NO: 241082 - DNA, 16 bp, P. troglodytes
cttttgttggtgtata

SEQ ID NO: 241083 - DNA, 16 bp, P. troglodytes
cttttgtttaaaattt

SEQ ID NO: 241084 - DNA, 16 bp, P. troglodytes
cttttgtttcaataaa

SEQ ID NO: 241085 - DNA, 16 bp, P. troglodytes
cttttgtttcctgtgc

SEQ ID NO: 241086 - DNA, 16 bp, P. troglodytes
cttttgttttgaaata

SEQ ID NO: 241087 - DNA, 16 bp, P. troglodytes
ctttttaaaaaagaaa

SEQ ID NO: 241088 - DNA, 16 bp, P. troglodytes
ctttttaaaaaagaca

SEQ ID NO: 241089 - DNA, 16 bp, P. troglodytes
ctttttaaaaaaggta

SEQ ID NO: 241090 - DNA, 16 bp, P. troglodytes
ctttttaaaaaatgat

SEQ ID NO: 241091 - DNA, 16 bp, P. troglodytes
ctttttaaaaaatgtc

SEQ ID NO: 241092 - DNA, 16 bp, P. troglodytes
ctttttaaaaaatttg

SEQ ID NO: 241093 - DNA, 16 bp, P. troglodytes
ctttttaaaaagatat

SEQ ID NO: 241094 - DNA, 16 bp, P. troglodytes
ctttttaaaaaggaat

SEQ ID NO: 241095 - DNA, 16 bp, P. troglodytes
ctttttaaaaatactt

SEQ ID NO: 241096 - DNA, 16 bp, P. troglodytes
ctttttaaaaatctgg

SEQ ID NO: 241097 - DNA, 16 bp, P. troglodytes
ctttttaaaaatgaat

SEQ ID NO: 241098 - DNA, 16 bp, P. troglodytes
ctttttaaaaatgtga

SEQ ID NO: 241099 - DNA, 16 bp, P. troglodytes
ctttttaaaaccatta

SEQ ID NO: 241100 - DNA, 16 bp, P. troglodytes
ctttttaaaagacatt

SEQ ID NO: 241101 - DNA, 16 bp, P. troglodytes
ctttttaaaagcattt

SEQ ID NO: 241102 - DNA, 16 bp, P. troglodytes
ctttttaaaagtaatt

SEQ ID NO: 241103 - DNA, 16 bp, P. troglodytes
ctttttaaaataaact

SEQ ID NO: 241104 - DNA, 16 bp, P. troglodytes
ctttttaaaataaagc

SEQ ID NO: 241105 - DNA, 16 bp, P. troglodytes
ctttttaaaatgtatt

SEQ ID NO: 241106 - DNA, 16 bp, P. troglodytes
ctttttaaaatgtctt

SEQ ID NO: 241107 - DNA, 16 bp, P. troglodytes
ctttttaaaatgtgat

SEQ ID NO: 241108 - DNA, 16 bp, P. troglodytes
ctttttaaaattcaaa

SEQ ID NO: 241109 - DNA, 16 bp, P. troglodytes
ctttttaaagcacttt

SEQ ID NO: 241110 - DNA, 16 bp, P. troglodytes
ctttttaaagtattta

SEQ ID NO: 241111 - DNA, 16 bp, P. troglodytes
ctttttaaagttaaaa

SEQ ID NO: 241112 - DNA, 16 bp, P. troglodytes
ctttttaaatttttag

SEQ ID NO: 241113 - DNA, 16 bp, P. troglodytes
ctttttaagaaactgt

SEQ ID NO: 241114 - DNA, 16 bp, P. troglodytes
ctttttaatggggttg

SEQ ID NO: 241115 - DNA, 16 bp, P. troglodytes
ctttttaatgtgttat

SEQ ID NO: 241116 - DNA, 16 bp, P. troglodytes
ctttttaatttgatgt

SEQ ID NO: 241117 - DNA, 16 bp, P. troglodytes
ctttttacttctgtga

SEQ ID NO: 241118 - DNA, 16 bp, P. troglodytes
ctttttagtagagatg

SEQ ID NO: 241119 - DNA, 16 bp, P. troglodytes
ctttttagtttaatga

SEQ ID NO: 241120 - DNA, 16 bp, P. troglodytes
ctttttatagccaaat

SEQ ID NO: 241121 - DNA, 16 bp, P. troglodytes
ctttttatatgcctgt

SEQ ID NO: 241122 - DNA, 16 bp, P. troglodytes
ctttttatatgcttat

SEQ ID NO: 241123 - DNA, 16 bp, P. troglodytes
ctttttatcttgaaat

SEQ ID NO: 241124 - DNA, 16 bp, P. troglodytes
ctttttatggctgaat

SEQ ID NO: 241125 - DNA, 16 bp, P. troglodytes
ctttttatggctgaga

SEQ ID NO: 241126 - DNA, 16 bp, P. troglodytes
ctttttattaccaaat

SEQ ID NO: 241127 - DNA, 16 bp, P. troglodytes
ctttttattttgcaat

SEQ ID NO: 241128 - DNA, 16 bp, P. troglodytes
ctttttattttgccaa

SEQ ID NO: 241129 - DNA, 16 bp, P. troglodytes
ctttttcaaaaaacaa

SEQ ID NO: 241130 - DNA, 16 bp, P. troglodytes
ctttttcaaataatga

SEQ ID NO: 241131 - DNA, 16 bp, P. troglodytes
ctttttcaaatgcttt

SEQ ID NO: 241132 - DNA, 16 bp, P. troglodytes
ctttttcaacaaatgg

SEQ ID NO: 241133 - DNA, 16 bp, P. troglodytes
ctttttcaacattgtt

SEQ ID NO: 241134 - DNA, 16 bp, P. troglodytes
ctttttcaagattgtt

SEQ ID NO: 241135 - DNA, 16 bp, P. troglodytes
ctttttcaaggttttt

SEQ ID NO: 241136 - DNA, 16 bp, P. troglodytes
ctttttcagaaaaaca

SEQ ID NO: 241137 - DNA, 16 bp, P. troglodytes
ctttttcagagacagg

SEQ ID NO: 241138 - DNA, 16 bp, P. troglodytes
ctttttcagattattt

SEQ ID NO: 241139 - DNA, 16 bp, P. troglodytes
ctttttcatatacctg

SEQ ID NO: 241140 - DNA, 16 bp, P. troglodytes
ctttttcatggggttg

SEQ ID NO: 241141 - DNA, 16 bp, P. troglodytes
ctttttcatttcaaaa

SEQ ID NO: 241142 - DNA, 16 bp, P. troglodytes
ctttttccaattctgt

SEQ ID NO: 241143 - DNA, 16 bp, P. troglodytes
ctttttctaaataaaa

SEQ ID NO: 241144 - DNA, 16 bp, P. troglodytes
ctttttctactgtttg

SEQ ID NO: 241145 - DNA, 16 bp, P. troglodytes
ctttttctggctgaat

SEQ ID NO: 241146 - DNA, 16 bp, P. troglodytes
ctttttctgtaaagga

SEQ ID NO: 241147 - DNA, 16 bp, P. troglodytes
ctttttctgtctgtaa

SEQ ID NO: 241148 - DNA, 16 bp, P. troglodytes
ctttttctgtgaaaaa

SEQ ID NO: 241149 - DNA, 16 bp, P. troglodytes
ctttttcttgtaatgt

SEQ ID NO: 241150 - DNA, 16 bp, P. troglodytes
ctttttctttatagat

SEQ ID NO: 241151 - DNA, 16 bp, P. troglodytes
ctttttgaaaaattaa

SEQ ID NO: 241152 - DNA, 16 bp, P. troglodytes
ctttttgaaaggatca

SEQ ID NO: 241153 - DNA, 16 bp, P. troglodytes
ctttttgaaataaaaa

SEQ ID NO: 241154 - DNA, 16 bp, P. troglodytes
ctttttgaatttttaa

SEQ ID NO: 241155 - DNA, 16 bp, P. troglodytes
ctttttgagacggagt

SEQ ID NO: 241156 - DNA, 16 bp, P. troglodytes
ctttttgagatggagt

SEQ ID NO: 241157 - DNA, 16 bp, P. troglodytes
ctttttgagcactgac

SEQ ID NO: 241158 - DNA, 16 bp, P. troglodytes
ctttttgaggagctgc

SEQ ID NO: 241159 - DNA, 16 bp, P. troglodytes
ctttttgatggaattg

SEQ ID NO: 241160 - DNA, 16 bp, P. troglodytes
ctttttgatgggactg

SEQ ID NO: 241161 - DNA, 16 bp, P. troglodytes
ctttttgatgggtttt

SEQ ID NO: 241162 - DNA, 16 bp, P. troglodytes
ctttttgcagggaaaa

SEQ ID NO: 241163 - DNA, 16 bp, P. troglodytes
ctttttgctattgtga

SEQ ID NO: 241164 - DNA, 16 bp, P. troglodytes
ctttttgcttacaatt

SEQ ID NO: 241165 - DNA, 16 bp, P. troglodytes
ctttttgcttatgatt

SEQ ID NO: 241166 - DNA, 16 bp, P. troglodytes
ctttttgctttaaaaa

SEQ ID NO: 241167 - DNA, 16 bp, P. troglodytes
ctttttggaagagttt

SEQ ID NO: 241168 - DNA, 16 bp, P. troglodytes
ctttttggatgagtct

SEQ ID NO: 241169 - DNA, 16 bp, P. troglodytes
ctttttggtggaatga

SEQ ID NO: 241170 - DNA, 16 bp, P. troglodytes
ctttttgtagaaactg

SEQ ID NO: 241171 - DNA, 16 bp, P. troglodytes
ctttttgttatttaaa

SEQ ID NO: 241172 - DNA, 16 bp, P. troglodytes
ctttttgttcctctga

SEQ ID NO: 241173 - DNA, 16 bp, P. troglodytes
ctttttgtttaggata

SEQ ID NO: 241174 - DNA, 16 bp, P. troglodytes
cttttttaaaaaaagg

SEQ ID NO: 241175 - DNA, 16 bp, P. troglodytes
cttttttaaaaaagca

SEQ ID NO: 241176 - DNA, 16 bp, P. troglodytes
cttttttaaaaaattg

SEQ ID NO: 241177 - DNA, 16 bp, P. troglodytes
cttttttaaaaacact

SEQ ID NO: 241178 - DNA, 16 bp, P. troglodytes
cttttttaaaaagaaa

SEQ ID NO: 241179 - DNA, 16 bp, P. troglodytes
cttttttaaaaataga

SEQ ID NO: 241180 - DNA, 16 bp, P. troglodytes
cttttttaaaagattt

SEQ ID NO: 241181 - DNA, 16 bp, P. troglodytes
cttttttaaagaaaaa

SEQ ID NO: 241182 - DNA, 16 bp, P. troglodytes
cttttttaaatgtttg

SEQ ID NO: 241183 - DNA, 16 bp, P. troglodytes
cttttttattatagcc

SEQ ID NO: 241184 - DNA, 16 bp, P. troglodytes
cttttttcaaaagaaa

SEQ ID NO: 241185 - DNA, 16 bp, P. troglodytes
cttttttccaaatatt

SEQ ID NO: 241186 - DNA, 16 bp, P. troglodytes
cttttttcccccaact

SEQ ID NO: 241187 - DNA, 16 bp, P. troglodytes
cttttttccccccaaa

SEQ ID NO: 241188 - DNA, 16 bp, P. troglodytes
cttttttcccccccaa

SEQ ID NO: 241189 - DNA, 16 bp, P. troglodytes
cttttttctaattctg

SEQ ID NO: 241190 - DNA, 16 bp, P. troglodytes
cttttttctcttcaaa

SEQ ID NO: 241191 - DNA, 16 bp, P. troglodytes
cttttttcttcaaata

SEQ ID NO: 241192 - DNA, 16 bp, P. troglodytes
cttttttgagacagaa

SEQ ID NO: 241193 - DNA, 16 bp, P. troglodytes
cttttttgagacatgg

SEQ ID NO: 241194 - DNA, 16 bp, P. troglodytes
cttttttgagatgcag

SEQ ID NO: 241195 - DNA, 16 bp, P. troglodytes
cttttttgatgtagat

SEQ ID NO: 241196 - DNA, 16 bp, P. troglodytes
cttttttgccagaaga

SEQ ID NO: 241197 - DNA, 16 bp, P. troglodytes
cttttttgcctttaaa

SEQ ID NO: 241198 - DNA, 16 bp, P. troglodytes
cttttttggggggatg

SEQ ID NO: 241199 - DNA, 16 bp, P. troglodytes
ctttttttaaaaaaag

SEQ ID NO: 241200 - DNA, 16 bp, P. troglodytes
ctttttttaaaaaagt

SEQ ID NO: 241201 - DNA, 16 bp, P. troglodytes
ctttttttaaaaaatc

SEQ ID NO: 241202 - DNA, 16 bp, P. troglodytes
ctttttttaaagaaca

SEQ ID NO: 241203 - DNA, 16 bp, P. troglodytes
ctttttttcccctaag

SEQ ID NO: 241204 - DNA, 16 bp, P. troglodytes
ctttttttctcagtct

SEQ ID NO: 241205 - DNA, 16 bp, P. troglodytes
ctttttttctttagaa

SEQ ID NO: 241206 - DNA, 17 bp, P. troglodytes
ctttttttgagacagaa

SEQ ID NO: 241207 - DNA, 20 bp, P. troglodytes
ctttttttgagatggagtct

SEQ ID NO: 241208 - DNA, 16 bp, P. troglodytes
ctttttttgagatggg

SEQ ID NO: 241209 - DNA, 16 bp, P. troglodytes
ctttttttggttggta

SEQ ID NO: 241210 - DNA, 16 bp, P. troglodytes
cttttttttaagagat

SEQ ID NO: 241211 - DNA, 16 bp, P. troglodytes
cttttttttccccaca

SEQ ID NO: 241212 - DNA, 16 bp, P. troglodytes
ctttttttttaaatag

SEQ ID NO: 241213 - DNA, 16 bp, P. troglodytes
ctttttttttgaaaca

SEQ ID NO: 241214 - DNA, 16 bp, P. troglodytes
ctttttttttgagatg

SEQ ID NO: 241215 - DNA, 16 bp, P. troglodytes
cttttttttttaaaga

SEQ ID NO: 241216 - DNA, 19 bp, P. troglodytes
cttttttttttgagacagg

SEQ ID NO: 241217 - DNA, 24 bp, P. troglodytes
cttttttttttgagacggagtctc

SEQ ID NO: 241218 - DNA, 16 bp, P. troglodytes
gaaaaaaaaagtgctt

SEQ ID NO: 241219 - DNA, 16 bp, P. troglodytes
gaaaaaaaaatctgct

SEQ ID NO: 241220 - DNA, 16 bp, P. troglodytes
gaaaaaaaatatttct

SEQ ID NO: 241221 - DNA, 16 bp, P. troglodytes
gaaaaaaaatctttta

SEQ ID NO: 241222 - DNA, 16 bp, P. troglodytes
gaaaaaaaattagcca

SEQ ID NO: 241223 - DNA, 16 bp, P. troglodytes
gaaaaaaaatttgcaa

SEQ ID NO: 241224 - DNA, 16 bp, P. troglodytes
gaaaaaaactcaacat

SEQ ID NO: 241225 - DNA, 16 bp, P. troglodytes
gaaaaaaagaaagctg

SEQ ID NO: 241226 - DNA, 16 bp, P. troglodytes
gaaaaaaaggctgggc

SEQ ID NO: 241227 - DNA, 16 bp, P. troglodytes
gaaaaaaaggtatttt

SEQ ID NO: 241228 - DNA, 16 bp, P. troglodytes
gaaaaaaatatatcat

SEQ ID NO: 241229 - DNA, 16 bp, P. troglodytes
gaaaaaaatcagaatt

SEQ ID NO: 241230 - DNA, 16 bp, P. troglodytes
gaaaaaaatctctgaa

SEQ ID NO: 241231 - DNA, 16 bp, P. troglodytes
gaaaaaaatctggaaa

SEQ ID NO: 241232 - DNA, 16 bp, P. troglodytes
gaaaaaaatcttaaga

SEQ ID NO: 241233 - DNA, 16 bp, P. troglodytes
gaaaaaaatgaaactt

SEQ ID NO: 241234 - DNA, 16 bp, P. troglodytes
gaaaaaaatgcttaaa

SEQ ID NO: 241235 - DNA, 16 bp, P. troglodytes
gaaaaaaattacatat

SEQ ID NO: 241236 - DNA, 16 bp, P. troglodytes
gaaaaaaattacttta

SEQ ID NO: 241237 - DNA, 16 bp, P. troglodytes
gaaaaaaattattctg

SEQ ID NO: 241238 - DNA, 16 bp, P. troglodytes
gaaaaaaattcacatt

SEQ ID NO: 241239 - DNA, 16 bp, P. troglodytes
gaaaaaaattgtcttc

SEQ ID NO: 241240 - DNA, 16 bp, P. troglodytes
gaaaaaacccttcaaa

SEQ ID NO: 241241 - DNA, 16 bp, P. troglodytes
gaaaaaactattttaa

SEQ ID NO: 241242 - DNA, 16 bp, P. troglodytes
gaaaaaactgaggcac

SEQ ID NO: 241243 - DNA, 16 bp, P. troglodytes
gaaaaaactgcatcaa

SEQ ID NO: 241244 - DNA, 16 bp, P. troglodytes
gaaaaaagaacaggat

SEQ ID NO: 241245 - DNA, 16 bp, P. troglodytes
gaaaaaagactggaag

SEQ ID NO: 241246 - DNA, 16 bp, P. troglodytes
gaaaaaagccagtcac

SEQ ID NO: 241247 - DNA, 16 bp, P. troglodytes
gaaaaaaggaaagttt

SEQ ID NO: 241248 - DNA, 16 bp, P. troglodytes
gaaaaaaggttttaaa

SEQ ID NO: 241249 - DNA, 16 bp, P. troglodytes
gaaaaaatacataatt

SEQ ID NO: 241250 - DNA, 16 bp, P. troglodytes
gaaaaaatatttgaca

SEQ ID NO: 241251 - DNA, 16 bp, P. troglodytes
gaaaaaatggtttcat

SEQ ID NO: 241252 - DNA, 16 bp, P. troglodytes
gaaaaacacttcaaaa

SEQ ID NO: 241253 - DNA, 16 bp, P. troglodytes
gaaaaacacttgaaaa

SEQ ID NO: 241254 - DNA, 16 bp, P. troglodytes
gaaaaacagaatattt

SEQ ID NO: 241255 - DNA, 16 bp, P. troglodytes
gaaaaacagatttaaa

SEQ ID NO: 241256 - DNA, 16 bp, P. troglodytes
gaaaaacaggcagtta

SEQ ID NO: 241257 - DNA, 16 bp, P. troglodytes
gaaaaacattctgtgc

SEQ ID NO: 241258 - DNA, 16 bp, P. troglodytes
gaaaaacattttttaa

SEQ ID NO: 241259 - DNA, 16 bp, P. troglodytes
gaaaaacatttttttt

SEQ ID NO: 241260 - DNA, 16 bp, P. troglodytes
gaaaaacctagaagaa

SEQ ID NO: 241261 - DNA, 16 bp, P. troglodytes
gaaaaactaaatggaa

SEQ ID NO: 241262 - DNA, 16 bp, P. troglodytes
gaaaaactactttaaa

SEQ ID NO: 241263 - DNA, 16 bp, P. troglodytes
gaaaaactatttaaaa

SEQ ID NO: 241264 - DNA, 16 bp, P. troglodytes
gaaaaactgaataata

SEQ ID NO: 241265 - DNA, 16 bp, P. troglodytes
gaaaaactgacatctt

SEQ ID NO: 241266 - DNA, 16 bp, P. troglodytes
gaaaaactttttaaaa

SEQ ID NO: 241267 - DNA, 16 bp, P. troglodytes
gaaaaactttttttaa

SEQ ID NO: 241268 - DNA, 16 bp, P. troglodytes
gaaaaagaaaaaggct

SEQ ID NO: 241269 - DNA, 16 bp, P. troglodytes
gaaaaagaaaacatct

SEQ ID NO: 241270 - DNA, 16 bp, P. troglodytes
gaaaaagaaaaccatt

SEQ ID NO: 241271 - DNA, 16 bp, P. troglodytes
gaaaaagaaaatctga

SEQ ID NO: 241272 - DNA, 16 bp, P. troglodytes
gaaaaagaaaatgtca

SEQ ID NO: 241273 - DNA, 16 bp, P. troglodytes
gaaaaagaaatgctta

SEQ ID NO: 241274 - DNA, 16 bp, P. troglodytes
gaaaaagaatattttg

SEQ ID NO: 241275 - DNA, 16 bp, P. troglodytes
gaaaaagaatgagttc

SEQ ID NO: 241276 - DNA, 16 bp, P. troglodytes
gaaaaagactttaaaa

SEQ ID NO: 241277 - DNA, 16 bp, P. troglodytes
gaaaaagagcaaatta

SEQ ID NO: 241278 - DNA, 16 bp, P. troglodytes
gaaaaagagtccagga

SEQ ID NO: 241279 - DNA, 16 bp, P. troglodytes
gaaaaagatttaattg

SEQ ID NO: 241280 - DNA, 16 bp, P. troglodytes
gaaaaagcactggaca

SEQ ID NO: 241281 - DNA, 16 bp, P. troglodytes
gaaaaagccagacaca

SEQ ID NO: 241282 - DNA, 16 bp, P. troglodytes
gaaaaagccatgaaag

SEQ ID NO: 241283 - DNA, 16 bp, P. troglodytes
gaaaaagcttatagaa

SEQ ID NO: 241284 - DNA, 16 bp, P. troglodytes
gaaaaataaagacatt

SEQ ID NO: 241285 - DNA, 16 bp, P. troglodytes
gaaaaataaagcagga

SEQ ID NO: 241286 - DNA, 16 bp, P. troglodytes
gaaaaataaatttctg

SEQ ID NO: 241287 - DNA, 16 bp, P. troglodytes
gaaaaataatcctaaa

SEQ ID NO: 241288 - DNA, 16 bp, P. troglodytes
gaaaaataattacata

SEQ ID NO: 241289 - DNA, 16 bp, P. troglodytes
gaaaaataattcagaa

SEQ ID NO: 241290 - DNA, 16 bp, P. troglodytes
gaaaaataatttttct

SEQ ID NO: 241291 - DNA, 16 bp, P. troglodytes
gaaaaatacaataact

SEQ ID NO: 241292 - DNA, 16 bp, P. troglodytes
gaaaaatacagtatct

SEQ ID NO: 241293 - DNA, 16 bp, P. troglodytes
gaaaaatacatttctg

SEQ ID NO: 241294 - DNA, 16 bp, P. troglodytes
gaaaaataggacagaa

SEQ ID NO: 241295 - DNA, 16 bp, P. troglodytes
gaaaaatatgttttct

SEQ ID NO: 241296 - DNA, 16 bp, P. troglodytes
gaaaaatattcaagaa

SEQ ID NO: 241297 - DNA, 16 bp, P. troglodytes
gaaaaatattctaaaa

SEQ ID NO: 241298 - DNA, 16 bp, P. troglodytes
gaaaaatatttctata

SEQ ID NO: 241299 - DNA, 16 bp, P. troglodytes
gaaaaatatttgcaac

SEQ ID NO: 241300 - DNA, 16 bp, P. troglodytes
gaaaaatcatcttcca

SEQ ID NO: 241301 - DNA, 16 bp, P. troglodytes
gaaaaatctccaaata

SEQ ID NO: 241302 - DNA, 16 bp, P. troglodytes
gaaaaatgaactgaaa

SEQ ID NO: 241303 - DNA, 16 bp, P. troglodytes
gaaaaatgacattgaa

SEQ ID NO: 241304 - DNA, 16 bp, P. troglodytes
gaaaaatgcaatagag

SEQ ID NO: 241305 - DNA, 16 bp, P. troglodytes
gaaaaatgcatttttt

SEQ ID NO: 241306 - DNA, 16 bp, P. troglodytes
gaaaaatgctaagaaa

SEQ ID NO: 241307 - DNA, 16 bp, P. troglodytes
gaaaaatgcttttttt

SEQ ID NO: 241308 - DNA, 16 bp, P. troglodytes
gaaaaatggaacagaa

SEQ ID NO: 241309 - DNA, 16 bp, P. troglodytes
gaaaaatgtctgttca

SEQ ID NO: 241310 - DNA, 16 bp, P. troglodytes
gaaaaatgtgggaaag

SEQ ID NO: 241311 - DNA, 29 bp, P. troglodytes
gaaaaatgttaagggcagccagagagaaa

SEQ ID NO: 241312 - DNA, 16 bp, P. troglodytes
gaaaaatgttttataa

SEQ ID NO: 241313 - DNA, 16 bp, P. troglodytes
gaaaaatgtttttaaa

SEQ ID NO: 241314 - DNA, 16 bp, P. troglodytes
gaaaaattaaagttga

SEQ ID NO: 241315 - DNA, 16 bp, P. troglodytes
gaaaaattagccgggc

SEQ ID NO: 241316 - DNA, 16 bp, P. troglodytes
gaaaaattcaagctgg

SEQ ID NO: 241317 - DNA, 16 bp, P. troglodytes
gaaaaattctcaacaa

SEQ ID NO: 241318 - DNA, 16 bp, P. troglodytes
gaaaaattggccaaaa

SEQ ID NO: 241319 - DNA, 16 bp, P. troglodytes
gaaaaattggtgacaa

SEQ ID NO: 241320 - DNA, 16 bp, P. troglodytes
gaaaaatttcaaataa

SEQ ID NO: 241321 - DNA, 16 bp, P. troglodytes
gaaaaatttcaagaaa

SEQ ID NO: 241322 - DNA, 16 bp, P. troglodytes
gaaaacaaagattttt

SEQ ID NO: 241323 - DNA, 16 bp, P. troglodytes
gaaaacaaatcattct

SEQ ID NO: 241324 - DNA, 16 bp, P. troglodytes
gaaaacaaatctttct

SEQ ID NO: 241325 - DNA, 16 bp, P. troglodytes
gaaaacaaatgttttt

SEQ ID NO: 241326 - DNA, 16 bp, P. troglodytes
gaaaacaacctaaatg

SEQ ID NO: 241327 - DNA, 16 bp, P. troglodytes
gaaaacaatatatttt

SEQ ID NO: 241328 - DNA, 16 bp, P. troglodytes
gaaaacaattcaattt

SEQ ID NO: 241329 - DNA, 16 bp, P. troglodytes
gaaaacacttcaggat

SEQ ID NO: 241330 - DNA, 16 bp, P. troglodytes
gaaaacactttgtaaa

SEQ ID NO: 241331 - DNA, 16 bp, P. troglodytes
gaaaacagaaatgcct

SEQ ID NO: 241332 - DNA, 16 bp, P. troglodytes
gaaaacaggaaaatgt

SEQ ID NO: 241333 - DNA, 16 bp, P. troglodytes
gaaaacagtatggcaa

SEQ ID NO: 241334 - DNA, 16 bp, P. troglodytes
gaaaacagtgcagaga

SEQ ID NO: 241335 - DNA, 16 bp, P. troglodytes
gaaaacagtgtggaga

SEQ ID NO: 241336 - DNA, 16 bp, P. troglodytes
gaaaacagtttgaaaa

SEQ ID NO: 241337 - DNA, 16 bp, P. troglodytes
gaaaacagtttggcaa

SEQ ID NO: 241338 - DNA, 16 bp, P. troglodytes
gaaaacagtttttcca

SEQ ID NO: 241339 - DNA, 16 bp, P. troglodytes
gaaaacagtttttttt

SEQ ID NO: 241340 - DNA, 16 bp, P. troglodytes
gaaaacataggagaaa

SEQ ID NO: 241341 - DNA, 16 bp, P. troglodytes
gaaaacatcagagaaa

SEQ ID NO: 241342 - DNA, 16 bp, P. troglodytes
gaaaacatggaagaaa

SEQ ID NO: 241343 - DNA, 16 bp, P. troglodytes
gaaaacatgtgagcaa

SEQ ID NO: 241344 - DNA, 16 bp, P. troglodytes
gaaaacattcttcagg

SEQ ID NO: 241345 - DNA, 16 bp, P. troglodytes
gaaaacatttgccaac

SEQ ID NO: 241346 - DNA, 16 bp, P. troglodytes
gaaaacatttggaaaa

SEQ ID NO: 241347 - DNA, 16 bp, P. troglodytes
gaaaacatttgggaaa

SEQ ID NO: 241348 - DNA, 16 bp, P. troglodytes
gaaaacattttattct

SEQ ID NO: 241349 - DNA, 16 bp, P. troglodytes
gaaaaccaaatacctc

SEQ ID NO: 241350 - DNA, 16 bp, P. troglodytes
gaaaaccaaattttac

SEQ ID NO: 241351 - DNA, 16 bp, P. troglodytes
gaaaacccaactcaaa

SEQ ID NO: 241352 - DNA, 16 bp, P. troglodytes
gaaaacccagggaact

SEQ ID NO: 241353 - DNA, 16 bp, P. troglodytes
gaaaacccatctctac

SEQ ID NO: 241354 - DNA, 16 bp, P. troglodytes
gaaaacctagaaaaca

SEQ ID NO: 241355 - DNA, 16 bp, P. troglodytes
gaaaacctagaagaaa

SEQ ID NO: 241356 - DNA, 16 bp, P. troglodytes
gaaaacctagaagaga

SEQ ID NO: 241357 - DNA, 16 bp, P. troglodytes
gaaaacctaggaaata

SEQ ID NO: 241358 - DNA, 16 bp, P. troglodytes
gaaaacctaggcaaaa

SEQ ID NO: 241359 - DNA, 28 bp, P. troglodytes
gaaaacctaggcaataccattcaggaca

SEQ ID NO: 241360 - DNA, 16 bp, P. troglodytes
gaaaacctcaacaaac

SEQ ID NO: 241361 - DNA, 16 bp, P. troglodytes
gaaaacctgaacaaac

SEQ ID NO: 241362 - DNA, 16 bp, P. troglodytes
gaaaacctgcacaaga

SEQ ID NO: 241363 - DNA, 16 bp, P. troglodytes
gaaaacctggaagaaa

SEQ ID NO: 241364 - DNA, 16 bp, P. troglodytes
gaaaaccttctggaaa

SEQ ID NO: 241365 - DNA, 16 bp, P. troglodytes
gaaaaccttttggaaa

SEQ ID NO: 241366 - DNA, 16 bp, P. troglodytes
gaaaactaaaattata

SEQ ID NO: 241367 - DNA, 16 bp, P. troglodytes
gaaaactacaaaacat

SEQ ID NO: 241368 - DNA, 16 bp, P. troglodytes
gaaaactccagaaata

SEQ ID NO: 241369 - DNA, 17 bp, P. troglodytes
gaaaactccatctcaaa

SEQ ID NO: 241370 - DNA, 16 bp, P. troglodytes
gaaaactgaggccaga

SEQ ID NO: 241371 - DNA, 16 bp, P. troglodytes
gaaaactgcagaagca

SEQ ID NO: 241372 - DNA, 16 bp, P. troglodytes
gaaaactgcttaaagg

SEQ ID NO: 241373 - DNA, 16 bp, P. troglodytes
gaaaactggatataca

SEQ ID NO: 241374 - DNA, 16 bp, P. troglodytes
gaaaactggctgggca

SEQ ID NO: 241375 - DNA, 16 bp, P. troglodytes
gaaaacttagaagaaa

SEQ ID NO: 241376 - DNA, 16 bp, P. troglodytes
gaaaacttagagaaaa

SEQ ID NO: 241377 - DNA, 16 bp, P. troglodytes
gaaaacttagatgaaa

SEQ ID NO: 241378 - DNA, 16 bp, P. troglodytes
gaaaacttcccctttg

SEQ ID NO: 241379 - DNA, 16 bp, P. troglodytes
gaaaacttggaaaaaa

SEQ ID NO: 241380 - DNA, 16 bp, P. troglodytes
gaaaacttgtatctgc

SEQ ID NO: 241381 - DNA, 16 bp, P. troglodytes
gaaaacttgtctctac

SEQ ID NO: 241382 - DNA, 16 bp, P. troglodytes
gaaaagaaaaaccagt

SEQ ID NO: 241383 - DNA, 16 bp, P. troglodytes
gaaaagaaaaagttct

SEQ ID NO: 241384 - DNA, 16 bp, P. troglodytes
gaaaagaaaactgagg

SEQ ID NO: 241385 - DNA, 16 bp, P. troglodytes
gaaaagaaaatctctt

SEQ ID NO: 241386 - DNA, 16 bp, P. troglodytes
gaaaagaaaatgttat

SEQ ID NO: 241387 - DNA, 16 bp, P. troglodytes
gaaaagaaaatgttta

SEQ ID NO: 241388 - DNA, 16 bp, P. troglodytes
gaaaagaaaattagca

SEQ ID NO: 241389 - DNA, 16 bp, P. troglodytes
gaaaagaaaattcaag

SEQ ID NO: 241390 - DNA, 16 bp, P. troglodytes
gaaaagaaaattcaat

SEQ ID NO: 241391 - DNA, 16 bp, P. troglodytes
gaaaagaaaattctat

SEQ ID NO: 241392 - DNA, 16 bp, P. troglodytes
gaaaagaaagcttgga

SEQ ID NO: 241393 - DNA, 16 bp, P. troglodytes
gaaaagaaaggcttta

SEQ ID NO: 241394 - DNA, 16 bp, P. troglodytes
gaaaagaaaggtttaa

SEQ ID NO: 241395 - DNA, 16 bp, P. troglodytes
gaaaagaaagtttgta

SEQ ID NO: 241396 - DNA, 16 bp, P. troglodytes
gaaaagaaatttctgt

SEQ ID NO: 241397 - DNA, 16 bp, P. troglodytes
gaaaagaactttcaac

SEQ ID NO: 241398 - DNA, 16 bp, P. troglodytes
gaaaagaagtcattat

SEQ ID NO: 241399 - DNA, 16 bp, P. troglodytes
gaaaagaatatttatt

SEQ ID NO: 241400 - DNA, 16 bp, P. troglodytes
gaaaagaatcagtgaa

SEQ ID NO: 241401 - DNA, 16 bp, P. troglodytes
gaaaagaatgaaatca

SEQ ID NO: 241402 - DNA, 16 bp, P. troglodytes
gaaaagaatgtacatt

SEQ ID NO: 241403 - DNA, 16 bp, P. troglodytes
gaaaagaatgtatttt

SEQ ID NO: 241404 - DNA, 16 bp, P. troglodytes
gaaaagaatgtgtgtt

SEQ ID NO: 241405 - DNA, 16 bp, P. troglodytes
gaaaagaattttcaat

SEQ ID NO: 241406 - DNA, 16 bp, P. troglodytes
gaaaagacagccatct

SEQ ID NO: 241407 - DNA, 16 bp, P. troglodytes
gaaaagacataaagga

SEQ ID NO: 241408 - DNA, 16 bp, P. troglodytes
gaaaagaccattcttt

SEQ ID NO: 241409 - DNA, 16 bp, P. troglodytes
gaaaagactaaatcta

SEQ ID NO: 241410 - DNA, 16 bp, P. troglodytes
gaaaagactgtatctt

SEQ ID NO: 241411 - DNA, 16 bp, P. troglodytes
gaaaagactgtctttt

SEQ ID NO: 241412 - DNA, 16 bp, P. troglodytes
gaaaagagaaaacatt

SEQ ID NO: 241413 - DNA, 16 bp, P. troglodytes
gaaaagagaagaatca

SEQ ID NO: 241414 - DNA, 16 bp, P. troglodytes
gaaaagagaattttta

SEQ ID NO: 241415 - DNA, 16 bp, P. troglodytes
gaaaagagattttaaa

SEQ ID NO: 241416 - DNA, 16 bp, P. troglodytes
gaaaagaggtataatt

SEQ ID NO: 241417 - DNA, 16 bp, P. troglodytes
gaaaagaggtttaatc

SEQ ID NO: 241418 - DNA, 16 bp, P. troglodytes
gaaaagaggttttatt

SEQ ID NO: 241419 - DNA, 16 bp, P. troglodytes
gaaaagagttttaaaa

SEQ ID NO: 241420 - DNA, 16 bp, P. troglodytes
gaaaagagttttattt

SEQ ID NO: 241421 - DNA, 16 bp, P. troglodytes
gaaaagatagtctttt

SEQ ID NO: 241422 - DNA, 16 bp, P. troglodytes
gaaaagatatttgcaa

SEQ ID NO: 241423 - DNA, 16 bp, P. troglodytes
gaaaagatgctgaaca

SEQ ID NO: 241424 - DNA, 16 bp, P. troglodytes
gaaaagatgcttagca

SEQ ID NO: 241425 - DNA, 16 bp, P. troglodytes
gaaaagatggccatct

SEQ ID NO: 241426 - DNA, 16 bp, P. troglodytes
gaaaagattcaccatt

SEQ ID NO: 241427 - DNA, 16 bp, P. troglodytes
gaaaagattcctttca

SEQ ID NO: 241428 - DNA, 16 bp, P. troglodytes
gaaaagcagaagaaat

SEQ ID NO: 241429 - DNA, 16 bp, P. troglodytes
gaaaagcattttataa

SEQ ID NO: 241430 - DNA, 16 bp, P. troglodytes
gaaaagccacagaaac

SEQ ID NO: 241431 - DNA, 16 bp, P. troglodytes
gaaaagcccagaacct

SEQ ID NO: 241432 - DNA, 16 bp, P. troglodytes
gaaaagctgaggcagg

SEQ ID NO: 241433 - DNA, 16 bp, P. troglodytes
gaaaagctgcaggcat

SEQ ID NO: 241434 - DNA, 16 bp, P. troglodytes
gaaaagctgttcaaca

SEQ ID NO: 241435 - DNA, 16 bp, P. troglodytes
gaaaagctttcagttt

SEQ ID NO: 241436 - DNA, 16 bp, P. troglodytes
gaaaaggaaatcagta

SEQ ID NO: 241437 - DNA, 16 bp, P. troglodytes
gaaaaggaaatgctta

SEQ ID NO: 241438 - DNA, 16 bp, P. troglodytes
gaaaaggaagaagtca

SEQ ID NO: 241439 - DNA, 16 bp, P. troglodytes
gaaaaggaagacataa

SEQ ID NO: 241440 - DNA, 16 bp, P. troglodytes
gaaaaggagcaggtag

SEQ ID NO: 241441 - DNA, 16 bp, P. troglodytes
gaaaaggcaacattca

SEQ ID NO: 241442 - DNA, 16 bp, P. troglodytes
gaaaaggcctttgaga

SEQ ID NO: 241443 - DNA, 16 bp, P. troglodytes
gaaaaggctgaagaaa

SEQ ID NO: 241444 - DNA, 16 bp, P. troglodytes
gaaaaggctttcaaca

SEQ ID NO: 241445 - DNA, 16 bp, P. troglodytes
gaaaagggaaacaaat

SEQ ID NO: 241446 - DNA, 16 bp, P. troglodytes
gaaaaggtctcactat

SEQ ID NO: 241447 - DNA, 16 bp, P. troglodytes
gaaaaggtttcaccat

SEQ ID NO: 241448 - DNA, 16 bp, P. troglodytes
gaaaagtacaaaaatt

SEQ ID NO: 241449 - DNA, 16 bp, P. troglodytes
gaaaagtacaaagaag

SEQ ID NO: 241450 - DNA, 16 bp, P. troglodytes
gaaaagtatttcattt

SEQ ID NO: 241451 - DNA, 16 bp, P. troglodytes
gaaaagtcaggaaaca

SEQ ID NO: 241452 - DNA, 16 bp, P. troglodytes
gaaaagtctttatttc

SEQ ID NO: 241453 - DNA, 16 bp, P. troglodytes
gaaaagtgatttttaa

SEQ ID NO: 241454 - DNA, 16 bp, P. troglodytes
gaaaagttaagcaaaa

SEQ ID NO: 241455 - DNA, 16 bp, P. troglodytes
gaaaagttccccaagt

SEQ ID NO: 241456 - DNA, 16 bp, P. troglodytes
gaaaagttctggaaat

SEQ ID NO: 241457 - DNA, 16 bp, P. troglodytes
gaaaagtttgctgatc

SEQ ID NO: 241458 - DNA, 16 bp, P. troglodytes
gaaaagtttggaggtt

SEQ ID NO: 241459 - DNA, 16 bp, P. troglodytes
gaaaagtttttgaaaa

SEQ ID NO: 241460 - DNA, 16 bp, P. troglodytes
gaaaataaaaatcatc

SEQ ID NO: 241461 - DNA, 16 bp, P. troglodytes
gaaaataaactttttt

SEQ ID NO: 241462 - DNA, 16 bp, P. troglodytes
gaaaataaatacattt

SEQ ID NO: 241463 - DNA, 16 bp, P. troglodytes
gaaaataaatcattaa

SEQ ID NO: 241464 - DNA, 16 bp, P. troglodytes
gaaaataaatcattat

SEQ ID NO: 241465 - DNA, 16 bp, P. troglodytes
gaaaataaatgatttt

SEQ ID NO: 241466 - DNA, 16 bp, P. troglodytes
gaaaataacagatgtt

SEQ ID NO: 241467 - DNA, 16 bp, P. troglodytes
gaaaataacctcaaaa

SEQ ID NO: 241468 - DNA, 16 bp, P. troglodytes
gaaaataactttaaaa

SEQ ID NO: 241469 - DNA, 16 bp, P. troglodytes
gaaaataacttttttt

SEQ ID NO: 241470 - DNA, 16 bp, P. troglodytes
gaaaataataaacatt

SEQ ID NO: 241471 - DNA, 16 bp, P. troglodytes
gaaaataatgtatatt

SEQ ID NO: 241472 - DNA, 16 bp, P. troglodytes
gaaaataattttcaaa

SEQ ID NO: 241473 - DNA, 16 bp, P. troglodytes
gaaaatacaaaatatt

SEQ ID NO: 241474 - DNA, 16 bp, P. troglodytes
gaaaatacaggagaaa

SEQ ID NO: 241475 - DNA, 16 bp, P. troglodytes
gaaaatactttgaaat

SEQ ID NO: 241476 - DNA, 16 bp, P. troglodytes
gaaaatagcctcaaag

SEQ ID NO: 241477 - DNA, 16 bp, P. troglodytes
gaaaataggattttct

SEQ ID NO: 241478 - DNA, 16 bp, P. troglodytes
gaaaatagggtctgga

SEQ ID NO: 241479 - DNA, 16 bp, P. troglodytes
gaaaatagtatggagg

SEQ ID NO: 241480 - DNA, 16 bp, P. troglodytes
gaaaatatacagtaaa

SEQ ID NO: 241481 - DNA, 16 bp, P. troglodytes
gaaaatatattcaaaa

SEQ ID NO: 241482 - DNA, 16 bp, P. troglodytes
gaaaatatctttcttt

SEQ ID NO: 241483 - DNA, 16 bp, P. troglodytes
gaaaatatggtaaata

SEQ ID NO: 241484 - DNA, 16 bp, P. troglodytes
gaaaatatggtataaa

SEQ ID NO: 241485 - DNA, 16 bp, P. troglodytes
gaaaatatgttgcaag

SEQ ID NO: 241486 - DNA, 16 bp, P. troglodytes
gaaaatattcacaaaa

SEQ ID NO: 241487 - DNA, 16 bp, P. troglodytes
gaaaatatttatgaag

SEQ ID NO: 241488 - DNA, 16 bp, P. troglodytes
gaaaatatttgccaaa

SEQ ID NO: 241489 - DNA, 16 bp, P. troglodytes
gaaaatatttgccaat

SEQ ID NO: 241490 - DNA, 16 bp, P. troglodytes
gaaaatatttgtaagc

SEQ ID NO: 241491 - DNA, 16 bp, P. troglodytes
gaaaatatttgtcaaa

SEQ ID NO: 241492 - DNA, 16 bp, P. troglodytes
gaaaatatttgtgaat

SEQ ID NO: 241493 - DNA, 16 bp, P. troglodytes
gaaaatattttcaaca

SEQ ID NO: 241494 - DNA, 16 bp, P. troglodytes
gaaaatattttcagaa

SEQ ID NO: 241495 - DNA, 16 bp, P. troglodytes
gaaaatattttccttt

SEQ ID NO: 241496 - DNA, 16 bp, P. troglodytes
gaaaatatttttgtat

SEQ ID NO: 241497 - DNA, 16 bp, P. troglodytes
gaaaatcaaatcaaga

SEQ ID NO: 241498 - DNA, 16 bp, P. troglodytes
gaaaatcaagagcaaa

SEQ ID NO: 241499 - DNA, 16 bp, P. troglodytes
gaaaatcaatatatca

SEQ ID NO: 241500 - DNA, 16 bp, P. troglodytes
gaaaatcagattttct

SEQ ID NO: 241501 - DNA, 16 bp, P. troglodytes
gaaaatcatgaaagag

SEQ ID NO: 241502 - DNA, 16 bp, P. troglodytes
gaaaatcatttcaaaa

SEQ ID NO: 241503 - DNA, 16 bp, P. troglodytes
gaaaatcattttttct

SEQ ID NO: 241504 - DNA, 16 bp, P. troglodytes
gaaaatccagaggaaa

SEQ ID NO: 241505 - DNA, 16 bp, P. troglodytes
gaaaatcctcaagaaa

SEQ ID NO: 241506 - DNA, 16 bp, P. troglodytes
gaaaatctagaggaaa

SEQ ID NO: 241507 - DNA, 16 bp, P. troglodytes
gaaaatctcaaggaat

SEQ ID NO: 241508 - DNA, 16 bp, P. troglodytes
gaaaatctcttgaacc

SEQ ID NO: 241509 - DNA, 16 bp, P. troglodytes
gaaaatctgagacagg

SEQ ID NO: 241510 - DNA, 16 bp, P. troglodytes
gaaaatcttttcattt

SEQ ID NO: 241511 - DNA, 16 bp, P. troglodytes
gaaaatgaaaaagttc

SEQ ID NO: 241512 - DNA, 16 bp, P. troglodytes
gaaaatgaaaactgaa

SEQ ID NO: 241513 - DNA, 16 bp, P. troglodytes
gaaaatgaaaatgtat

SEQ ID NO: 241514 - DNA, 16 bp, P. troglodytes
gaaaatgaaataccta

SEQ ID NO: 241515 - DNA, 16 bp, P. troglodytes
gaaaatgaactaagac

SEQ ID NO: 241516 - DNA, 16 bp, P. troglodytes
gaaaatgaagacagaa

SEQ ID NO: 241517 - DNA, 16 bp, P. troglodytes
gaaaatgaagagcaaa

SEQ ID NO: 241518 - DNA, 16 bp, P. troglodytes
gaaaatgaagcacaga

SEQ ID NO: 241519 - DNA, 16 bp, P. troglodytes
gaaaatgaatatattt

SEQ ID NO: 241520 - DNA, 16 bp, P. troglodytes
gaaaatgacagaattt

SEQ ID NO: 241521 - DNA, 16 bp, P. troglodytes
gaaaatgaggaaaaac

SEQ ID NO: 241522 - DNA, 16 bp, P. troglodytes
gaaaatgaggaagatg

SEQ ID NO: 241523 - DNA, 16 bp, P. troglodytes
gaaaatgaggcagaga

SEQ ID NO: 241524 - DNA, 16 bp, P. troglodytes
gaaaatgagtttactg

SEQ ID NO: 241525 - DNA, 16 bp, P. troglodytes
gaaaatgatgatgatg

SEQ ID NO: 241526 - DNA, 16 bp, P. troglodytes
gaaaatgattttctct

SEQ ID NO: 241527 - DNA, 16 bp, P. troglodytes
gaaaatgcaaataaat

SEQ ID NO: 241528 - DNA, 16 bp, P. troglodytes
gaaaatgcagagaacc

SEQ ID NO: 241529 - DNA, 16 bp, P. troglodytes
gaaaatgcagattaaa

SEQ ID NO: 241530 - DNA, 16 bp, P. troglodytes
gaaaatgcagattcct

SEQ ID NO: 241531 - DNA, 16 bp, P. troglodytes
gaaaatgcattttctt

SEQ ID NO: 241532 - DNA, 16 bp, P. troglodytes
gaaaatgctaataaaa

SEQ ID NO: 241533 - DNA, 16 bp, P. troglodytes
gaaaatgctctttcct

SEQ ID NO: 241534 - DNA, 16 bp, P. troglodytes
gaaaatgctgggatta

SEQ ID NO: 241535 - DNA, 16 bp, P. troglodytes
gaaaatgctttgaaaa

SEQ ID NO: 241536 - DNA, 16 bp, P. troglodytes
gaaaatggaaaacaga

SEQ ID NO: 241537 - DNA, 16 bp, P. troglodytes
gaaaatggaaaccaaa

SEQ ID NO: 241538 - DNA, 16 bp, P. troglodytes
gaaaatggaattttta

SEQ ID NO: 241539 - DNA, 16 bp, P. troglodytes
gaaaatggacaaagga

SEQ ID NO: 241540 - DNA, 16 bp, P. troglodytes
gaaaatggatttttct

SEQ ID NO: 241541 - DNA, 16 bp, P. troglodytes
gaaaatggcagagctg

SEQ ID NO: 241542 - DNA, 16 bp, P. troglodytes
gaaaatgggtttctct

SEQ ID NO: 241543 - DNA, 16 bp, P. troglodytes
gaaaatgtgaattaaa

SEQ ID NO: 241544 - DNA, 16 bp, P. troglodytes
gaaaatgtgatccata

SEQ ID NO: 241545 - DNA, 16 bp, P. troglodytes
gaaaatgtgcagcctg

SEQ ID NO: 241546 - DNA, 16 bp, P. troglodytes
gaaaatgtggaagtga

SEQ ID NO: 241547 - DNA, 16 bp, P. troglodytes
gaaaatgtgggaaatt

SEQ ID NO: 241548 - DNA, 16 bp, P. troglodytes
gaaaatgttattttat

SEQ ID NO: 241549 - DNA, 16 bp, P. troglodytes
gaaaatgttctaaaat

SEQ ID NO: 241550 - DNA, 16 bp, P. troglodytes
gaaaatgttgaaagca

SEQ ID NO: 241551 - DNA, 16 bp, P. troglodytes
gaaaatgttgatattt

SEQ ID NO: 241552 - DNA, 16 bp, P. troglodytes
gaaaatgtttaaatat

SEQ ID NO: 241553 - DNA, 16 bp, P. troglodytes
gaaaatgtttcaagaa

SEQ ID NO: 241554 - DNA, 16 bp, P. troglodytes
gaaaatgttttaaaat

SEQ ID NO: 241555 - DNA, 16 bp, P. troglodytes
gaaaattaatgcaaaa

SEQ ID NO: 241556 - DNA, 16 bp, P. troglodytes
gaaaattagcaaggat

SEQ ID NO: 241557 - DNA, 16 bp, P. troglodytes
gaaaattagcttaaaa

SEQ ID NO: 241558 - DNA, 16 bp, P. troglodytes
gaaaattatttctaaa

SEQ ID NO: 241559 - DNA, 16 bp, P. troglodytes
gaaaattcagaagaaa

SEQ ID NO: 241560 - DNA, 16 bp, P. troglodytes
gaaaattctaaagaat

SEQ ID NO: 241561 - DNA, 16 bp, P. troglodytes
gaaaattctagaagat

SEQ ID NO: 241562 - DNA, 16 bp, P. troglodytes
gaaaattctgccattt

SEQ ID NO: 241563 - DNA, 16 bp, P. troglodytes
gaaaattctttttatt

SEQ ID NO: 241564 - DNA, 16 bp, P. troglodytes
gaaaattggataaaga

SEQ ID NO: 241565 - DNA, 16 bp, P. troglodytes
gaaaattggatatcta

SEQ ID NO: 241566 - DNA, 16 bp, P. troglodytes
gaaaattgtgtgtgtg

SEQ ID NO: 241567 - DNA, 16 bp, P. troglodytes
gaaaattgtttaactt

SEQ ID NO: 241568 - DNA, 16 bp, P. troglodytes
gaaaatttaacaaaat

SEQ ID NO: 241569 - DNA, 16 bp, P. troglodytes
gaaaatttagaaaaca

SEQ ID NO: 241570 - DNA, 16 bp, P. troglodytes
gaaaatttagaggaaa

SEQ ID NO: 241571 - DNA, 16 bp, P. troglodytes
gaaaatttgaaattta

SEQ ID NO: 241572 - DNA, 16 bp, P. troglodytes
gaaaatttgcagcttg

SEQ ID NO: 241573 - DNA, 16 bp, P. troglodytes
gaaaatttgctgcctg

SEQ ID NO: 241574 - DNA, 16 bp, P. troglodytes
gaaaattttaattaca

SEQ ID NO: 241575 - DNA, 16 bp, P. troglodytes
gaaaattttcaaacac

SEQ ID NO: 241576 - DNA, 16 bp, P. troglodytes
gaaaattttcttaaaa

SEQ ID NO: 241577 - DNA, 16 bp, P. troglodytes
gaaaattttcttgaaa

SEQ ID NO: 241578 - DNA, 16 bp, P. troglodytes
gaaaattttgttttaa

SEQ ID NO: 241579 - DNA, 16 bp, P. troglodytes
gaaaatttttgcaaat

SEQ ID NO: 241580 - DNA, 16 bp, P. troglodytes
gaaacaaaaagttggt

SEQ ID NO: 241581 - DNA, 16 bp, P. troglodytes
gaaacaaagtctcact

SEQ ID NO: 241582 - DNA, 16 bp, P. troglodytes
gaaacaaataatattt

SEQ ID NO: 241583 - DNA, 16 bp, P. troglodytes
gaaacaaatgaaaatg

SEQ ID NO: 241584 - DNA, 16 bp, P. troglodytes
gaaacaaatggaagaa

SEQ ID NO: 241585 - DNA, 16 bp, P. troglodytes
gaaacaacagaagctg

SEQ ID NO: 241586 - DNA, 16 bp, P. troglodytes
gaaacaacagatgcca

SEQ ID NO: 241587 - DNA, 16 bp, P. troglodytes
gaaacaagattttttt

SEQ ID NO: 241588 - DNA, 16 bp, P. troglodytes
gaaacaagctggaaaa

SEQ ID NO: 241589 - DNA, 16 bp, P. troglodytes
gaaacaatacaaatgt

SEQ ID NO: 241590 - DNA, 16 bp, P. troglodytes
gaaacaatataaatgt

SEQ ID NO: 241591 - DNA, 16 bp, P. troglodytes
gaaacaatctaaatgt

SEQ ID NO: 241592 - DNA, 16 bp, P. troglodytes
gaaacacaataatagt

SEQ ID NO: 241593 - DNA, 16 bp, P. troglodytes
gaaacacatttcacct

SEQ ID NO: 241594 - DNA, 16 bp, P. troglodytes
gaaacaccatctccac

SEQ ID NO: 241595 - DNA, 16 bp, P. troglodytes
gaaacaccatctctac

SEQ ID NO: 241596 - DNA, 16 bp, P. troglodytes
gaaacactgctctctt

SEQ ID NO: 241597 - DNA, 16 bp, P. troglodytes
gaaacactttttttgt

SEQ ID NO: 241598 - DNA, 16 bp, P. troglodytes
gaaacagaaaatatga

SEQ ID NO: 241599 - DNA, 16 bp, P. troglodytes
gaaacagaaaatctga

SEQ ID NO: 241600 - DNA, 16 bp, P. troglodytes
gaaacagaaagtgaaa

SEQ ID NO: 241601 - DNA, 16 bp, P. troglodytes
gaaacagaaattcaaa

SEQ ID NO: 241602 - DNA, 16 bp, P. troglodytes
gaaacagaagaaatat

SEQ ID NO: 241603 - DNA, 16 bp, P. troglodytes
gaaacagagaagttaa

SEQ ID NO: 241604 - DNA, 16 bp, P. troglodytes
gaaacagagcaagacc

SEQ ID NO: 241605 - DNA, 16 bp, P. troglodytes
gaaacagatttttaaa

SEQ ID NO: 241606 - DNA, 18 bp, P. troglodytes
gaaacagcaggtgctgga

SEQ ID NO: 241607 - DNA, 16 bp, P. troglodytes
gaaacaggaaatcaaa

SEQ ID NO: 241608 - DNA, 16 bp, P. troglodytes
gaaacaggaagaaatt

SEQ ID NO: 241609 - DNA, 16 bp, P. troglodytes
gaaacaggcccagaga

SEQ ID NO: 241610 - DNA, 16 bp, P. troglodytes
gaaacaggctcagaga

SEQ ID NO: 241611 - DNA, 16 bp, P. troglodytes
gaaacagggtcttcct

SEQ ID NO: 241612 - DNA, 16 bp, P. troglodytes
gaaacaggttcagaga

SEQ ID NO: 241613 - DNA, 16 bp, P. troglodytes
gaaacaggtttttttt

SEQ ID NO: 241614 - DNA, 16 bp, P. troglodytes
gaaacatcatctctac

SEQ ID NO: 241615 - DNA, 16 bp, P. troglodytes
gaaacatgaagaaaac

SEQ ID NO: 241616 - DNA, 16 bp, P. troglodytes
gaaacatgaagaaaat

SEQ ID NO: 241617 - DNA, 16 bp, P. troglodytes
gaaacatggaaaggaa

SEQ ID NO: 241618 - DNA, 16 bp, P. troglodytes
gaaacatggtgaaacc

SEQ ID NO: 241619 - DNA, 16 bp, P. troglodytes
gaaacatgttttgggg

SEQ ID NO: 241620 - DNA, 16 bp, P. troglodytes
gaaacattcaaattat

SEQ ID NO: 241621 - DNA, 16 bp, P. troglodytes
gaaacattctacaaaa

SEQ ID NO: 241622 - DNA, 16 bp, P. troglodytes
gaaacattttcatttt

SEQ ID NO: 241623 - DNA, 16 bp, P. troglodytes
gaaacatttttgaaaa

SEQ ID NO: 241624 - DNA, 16 bp, P. troglodytes
gaaacatttttttaaa

SEQ ID NO: 241625 - DNA, 16 bp, P. troglodytes
gaaaccaaggcacaga

SEQ ID NO: 241626 - DNA, 16 bp, P. troglodytes
gaaaccaaggctgaga

SEQ ID NO: 241627 - DNA, 16 bp, P. troglodytes
gaaaccacctctctac

SEQ ID NO: 241628 - DNA, 16 bp, P. troglodytes
gaaaccacttctctac

SEQ ID NO: 241629 - DNA, 16 bp, P. troglodytes
gaaaccagcctgaaca

SEQ ID NO: 241630 - DNA, 16 bp, P. troglodytes
gaaaccagcctggaca

SEQ ID NO: 241631 - DNA, 16 bp, P. troglodytes
gaaaccaggcctgggc

SEQ ID NO: 241632 - DNA, 16 bp, P. troglodytes
gaaaccagggctcaga

SEQ ID NO: 241633 - DNA, 16 bp, P. troglodytes
gaaaccatacaaatgt

SEQ ID NO: 241634 - DNA, 16 bp, P. troglodytes
gaaaccatcatgctca

SEQ ID NO: 241635 - DNA, 16 bp, P. troglodytes
gaaaccatggaagcca

SEQ ID NO: 241636 - DNA, 16 bp, P. troglodytes
gaaacccagcctctac

SEQ ID NO: 241637 - DNA, 16 bp, P. troglodytes
gaaaccccatctcttt

SEQ ID NO: 241638 - DNA, 16 bp, P. troglodytes
gaaaccccctatctac

SEQ ID NO: 241639 - DNA, 16 bp, P. troglodytes
gaaaccccgtatctac

SEQ ID NO: 241640 - DNA, 16 bp, P. troglodytes
gaaaccccgtctccac

SEQ ID NO: 241641 - DNA, 16 bp, P. troglodytes
gaaaccccgtctctat

SEQ ID NO: 241642 - DNA, 16 bp, P. troglodytes
gaaaccccgtctctta

SEQ ID NO: 241643 - DNA, 16 bp, P. troglodytes
gaaacccctaataaac

SEQ ID NO: 241644 - DNA, 16 bp, P. troglodytes
gaaacccgatctctac

SEQ ID NO: 241645 - DNA, 16 bp, P. troglodytes
gaaacccggtgtctac

SEQ ID NO: 241646 - DNA, 18 bp, P. troglodytes
gaaaccctacaaatgtaa

SEQ ID NO: 241647 - DNA, 21 bp, P. troglodytes
gaaaccctacaagccagaaga

SEQ ID NO: 241648 - DNA, 16 bp, P. troglodytes
gaaaccctgtccccac

SEQ ID NO: 241649 - DNA, 16 bp, P. troglodytes
gaaaccctgtctctat

SEQ ID NO: 241650 - DNA, 16 bp, P. troglodytes
gaaaccctgtctgtaa

SEQ ID NO: 241651 - DNA, 16 bp, P. troglodytes
gaaaccctgtttctaa

SEQ ID NO: 241652 - DNA, 16 bp, P. troglodytes
gaaacctcagatagta

SEQ ID NO: 241653 - DNA, 16 bp, P. troglodytes
gaaacctccaccttcc

SEQ ID NO: 241654 - DNA, 16 bp, P. troglodytes
gaaacctccagaggaa

SEQ ID NO: 241655 - DNA, 16 bp, P. troglodytes
gaaacctgaggctcag

SEQ ID NO: 241656 - DNA, 16 bp, P. troglodytes
gaaacctggaggcaga

SEQ ID NO: 241657 - DNA, 16 bp, P. troglodytes
gaaaccttagaaatct

SEQ ID NO: 241658 - DNA, 16 bp, P. troglodytes
gaaaccttatctctac

SEQ ID NO: 241659 - DNA, 17 bp, P. troglodytes
gaaaccttgtctctaca

SEQ ID NO: 241660 - DNA, 16 bp, P. troglodytes
gaaacgcctggatgcc

SEQ ID NO: 241661 - DNA, 16 bp, P. troglodytes
gaaacggagtctcact

SEQ ID NO: 241662 - DNA, 16 bp, P. troglodytes
gaaactaaaattttaa

SEQ ID NO: 241663 - DNA, 16 bp, P. troglodytes
gaaactaatgagaaaa

SEQ ID NO: 241664 - DNA, 16 bp, P. troglodytes
gaaactacatttccca

SEQ ID NO: 241665 - DNA, 16 bp, P. troglodytes
gaaactaccagaagaa

SEQ ID NO: 241666 - DNA, 18 bp, P. troglodytes
gaaactaccatcagagtc

SEQ ID NO: 241667 - DNA, 16 bp, P. troglodytes
gaaactacccaaatgt

SEQ ID NO: 241668 - DNA, 16 bp, P. troglodytes
gaaactactttgtgat

SEQ ID NO: 241669 - DNA, 16 bp, P. troglodytes
gaaactagaaaaagat

SEQ ID NO: 241670 - DNA, 16 bp, P. troglodytes
gaaactcaggctcaga

SEQ ID NO: 241671 - DNA, 17 bp, P. troglodytes
gaaactccgaacacatc

SEQ ID NO: 241672 - DNA, 16 bp, P. troglodytes
gaaactccgtctcaat

SEQ ID NO: 241673 - DNA, 16 bp, P. troglodytes
gaaactccgtctccac

SEQ ID NO: 241674 - DNA, 16 bp, P. troglodytes
gaaactctggctcaaa

SEQ ID NO: 241675 - DNA, 16 bp, P. troglodytes
gaaactctgtccccat

SEQ ID NO: 241676 - DNA, 16 bp, P. troglodytes
gaaactgaagaagaca

SEQ ID NO: 241677 - DNA, 16 bp, P. troglodytes
gaaactgaatcaacta

SEQ ID NO: 241678 - DNA, 16 bp, P. troglodytes
gaaactgaattttaaa

SEQ ID NO: 241679 - DNA, 16 bp, P. troglodytes
gaaactgagacacaaa

SEQ ID NO: 241680 - DNA, 16 bp, P. troglodytes
gaaactgagacccagg

SEQ ID NO: 241681 - DNA, 16 bp, P. troglodytes
gaaactgagacctgga

SEQ ID NO: 241682 - DNA, 16 bp, P. troglodytes
gaaactgaggcacaga

SEQ ID NO: 241683 - DNA, 16 bp, P. troglodytes
gaaactgaggctgcag

SEQ ID NO: 241684 - DNA, 16 bp, P. troglodytes
gaaactgaggctggag

SEQ ID NO: 241685 - DNA, 16 bp, P. troglodytes
gaaactgaggttcaag

SEQ ID NO: 241686 - DNA, 16 bp, P. troglodytes
gaaactgaggttcagg

SEQ ID NO: 241687 - DNA, 16 bp, P. troglodytes
gaaactgatgctcaga

SEQ ID NO: 241688 - DNA, 16 bp, P. troglodytes
gaaactgatttgtgat

SEQ ID NO: 241689 - DNA, 16 bp, P. troglodytes
gaaactgcagaagaaa

SEQ ID NO: 241690 - DNA, 16 bp, P. troglodytes
gaaactgcatctcaaa

SEQ ID NO: 241691 - DNA, 16 bp, P. troglodytes
gaaactgccacactgt

SEQ ID NO: 241692 - DNA, 16 bp, P. troglodytes
gaaactgcccacatga

SEQ ID NO: 241693 - DNA, 16 bp, P. troglodytes
gaaactgctacaagaa

SEQ ID NO: 241694 - DNA, 16 bp, P. troglodytes
gaaactggaatcctca

SEQ ID NO: 241695 - DNA, 16 bp, P. troglodytes
gaaactggacccattc

SEQ ID NO: 241696 - DNA, 16 bp, P. troglodytes
gaaactggagctcaga

SEQ ID NO: 241697 - DNA, 16 bp, P. troglodytes
gaaactgggaagaaaa

SEQ ID NO: 241698 - DNA, 16 bp, P. troglodytes
gaaactggtttgtgat

SEQ ID NO: 241699 - DNA, 16 bp, P. troglodytes
gaaactgtcaaactat

SEQ ID NO: 241700 - DNA, 17 bp, P. troglodytes
gaaactgtgtctcaaaa

SEQ ID NO: 241701 - DNA, 16 bp, P. troglodytes
gaaactgttttaaaat

SEQ ID NO: 241702 - DNA, 16 bp, P. troglodytes
gaaacttaatccctaa

SEQ ID NO: 241703 - DNA, 16 bp, P. troglodytes
gaaacttaccagatca

SEQ ID NO: 241704 - DNA, 16 bp, P. troglodytes
gaaacttctggaggtc

SEQ ID NO: 241705 - DNA, 16 bp, P. troglodytes
gaaagaaaaaaatgtc

SEQ ID NO: 241706 - DNA, 16 bp, P. troglodytes
gaaagaaaaaagtctt

SEQ ID NO: 241707 - DNA, 16 bp, P. troglodytes
gaaagaaaaaatgcta

SEQ ID NO: 241708 - DNA, 16 bp, P. troglodytes
gaaagaaaaatatcac

SEQ ID NO: 241709 - DNA, 16 bp, P. troglodytes
gaaagaaaaattctaa

SEQ ID NO: 241710 - DNA, 16 bp, P. troglodytes
gaaagaaaacatttct

SEQ ID NO: 241711 - DNA, 16 bp, P. troglodytes
gaaagaaaagaaactt

SEQ ID NO: 241712 - DNA, 16 bp, P. troglodytes
gaaagaaaagaacatt

SEQ ID NO: 241713 - DNA, 16 bp, P. troglodytes
gaaagaaaagaatgct

SEQ ID NO: 241714 - DNA, 16 bp, P. troglodytes
gaaagaaaagaccatt

SEQ ID NO: 241715 - DNA, 16 bp, P. troglodytes
gaaagaaaaggacatt

SEQ ID NO: 241716 - DNA, 16 bp, P. troglodytes
gaaagaaaatcagaga

SEQ ID NO: 241717 - DNA, 16 bp, P. troglodytes
gaaagaaaatcccatt

SEQ ID NO: 241718 - DNA, 16 bp, P. troglodytes
gaaagaaaatccttta

SEQ ID NO: 241719 - DNA, 16 bp, P. troglodytes
gaaagaaaatgttatt

SEQ ID NO: 241720 - DNA, 16 bp, P. troglodytes
gaaagaaacagatttt

SEQ ID NO: 241721 - DNA, 16 bp, P. troglodytes
gaaagaaagaaaacct

SEQ ID NO: 241722 - DNA, 16 bp, P. troglodytes
gaaagaaagaaacatg

SEQ ID NO: 241723 - DNA, 16 bp, P. troglodytes
gaaagaaagaaactgc

SEQ ID NO: 241724 - DNA, 16 bp, P. troglodytes
gaaagaaagaaatcta

SEQ ID NO: 241725 - DNA, 16 bp, P. troglodytes
gaaagaaagaaattct

SEQ ID NO: 241726 - DNA, 16 bp, P. troglodytes
gaaagaaaggtagcag

SEQ ID NO: 241727 - DNA, 16 bp, P. troglodytes
gaaagaaattgaagat

SEQ ID NO: 241728 - DNA, 16 bp, P. troglodytes
gaaagaaatttaaagg

SEQ ID NO: 241729 - DNA, 16 bp, P. troglodytes
gaaagaacttaaacaa

SEQ ID NO: 241730 - DNA, 16 bp, P. troglodytes
gaaagaactttaaaaa

SEQ ID NO: 241731 - DNA, 16 bp, P. troglodytes
gaaagaagatccaaat

SEQ ID NO: 241732 - DNA, 16 bp, P. troglodytes
gaaagaagccagcctg

SEQ ID NO: 241733 - DNA, 16 bp, P. troglodytes
gaaagaagttgattcc

SEQ ID NO: 241734 - DNA, 16 bp, P. troglodytes
gaaagaataaatgttt

SEQ ID NO: 241735 - DNA, 16 bp, P. troglodytes
gaaagaatcaatatca

SEQ ID NO: 241736 - DNA, 16 bp, P. troglodytes
gaaagaatgagtgagc

SEQ ID NO: 241737 - DNA, 16 bp, P. troglodytes
gaaagaatttcagaaa

SEQ ID NO: 241738 - DNA, 16 bp, P. troglodytes
gaaagacaaaaatcat

SEQ ID NO: 241739 - DNA, 16 bp, P. troglodytes
gaaagacaaatatttt

SEQ ID NO: 241740 - DNA, 16 bp, P. troglodytes
gaaagactggccccca

SEQ ID NO: 241741 - DNA, 16 bp, P. troglodytes
gaaagacttaatattg

SEQ ID NO: 241742 - DNA, 16 bp, P. troglodytes
gaaagagaaaatgcaa

SEQ ID NO: 241743 - DNA, 16 bp, P. troglodytes
gaaagagaagagtcaa

SEQ ID NO: 241744 - DNA, 16 bp, P. troglodytes
gaaagagaattcaaaa

SEQ ID NO: 241745 - DNA, 16 bp, P. troglodytes
gaaagagatttttttt

SEQ ID NO: 241746 - DNA, 16 bp, P. troglodytes
gaaagagcactggact

SEQ ID NO: 241747 - DNA, 16 bp, P. troglodytes
gaaagaggaaggcctc

SEQ ID NO: 241748 - DNA, 16 bp, P. troglodytes
gaaagaggagacatca

SEQ ID NO: 241749 - DNA, 17 bp, P. troglodytes
gaaagaggtagacatgg

SEQ ID NO: 241750 - DNA, 16 bp, P. troglodytes
gaaagagtaagaccct

SEQ ID NO: 241751 - DNA, 16 bp, P. troglodytes
gaaagagtgagactcc

SEQ ID NO: 241752 - DNA, 16 bp, P. troglodytes
gaaagagtttgagaag

SEQ ID NO: 241753 - DNA, 16 bp, P. troglodytes
gaaagataaataccac

SEQ ID NO: 241754 - DNA, 16 bp, P. troglodytes
gaaagatacagtcatt

SEQ ID NO: 241755 - DNA, 16 bp, P. troglodytes
gaaagatatcaacatt

SEQ ID NO: 241756 - DNA, 16 bp, P. troglodytes
gaaagatccaccccca

SEQ ID NO: 241757 - DNA, 16 bp, P. troglodytes
gaaagatgtgtgtgtg

SEQ ID NO: 241758 - DNA, 16 bp, P. troglodytes
gaaagatgttaccaga

SEQ ID NO: 241759 - DNA, 16 bp, P. troglodytes
gaaagatttaaatgta

SEQ ID NO: 241760 - DNA, 16 bp, P. troglodytes
gaaagatttcaaataa

SEQ ID NO: 241761 - DNA, 16 bp, P. troglodytes
gaaagatttggaaaat

SEQ ID NO: 241762 - DNA, 16 bp, P. troglodytes
gaaagcaaaaggaaat

SEQ ID NO: 241763 - DNA, 16 bp, P. troglodytes
gaaagcaaccaaaatg

SEQ ID NO: 241764 - DNA, 16 bp, P. troglodytes
gaaagcaatgagaaca

SEQ ID NO: 241765 - DNA, 16 bp, P. troglodytes
gaaagcaatgtggcaa

SEQ ID NO: 241766 - DNA, 16 bp, P. troglodytes
gaaagcaattgacttt

SEQ ID NO: 241767 - DNA, 16 bp, P. troglodytes
gaaagcaattgcaaca

SEQ ID NO: 241768 - DNA, 16 bp, P. troglodytes
gaaagcaatttttaaa

SEQ ID NO: 241769 - DNA, 16 bp, P. troglodytes
gaaagcagagaaaata

SEQ ID NO: 241770 - DNA, 16 bp, P. troglodytes
gaaagcattttctgca

SEQ ID NO: 241771 - DNA, 16 bp, P. troglodytes
gaaagccaagcaaaag

SEQ ID NO: 241772 - DNA, 18 bp, P. troglodytes
gaaagcctacaagccaga

SEQ ID NO: 241773 - DNA, 16 bp, P. troglodytes
gaaagcctcagatggg

SEQ ID NO: 241774 - DNA, 16 bp, P. troglodytes
gaaagctgaaactgaa

SEQ ID NO: 241775 - DNA, 16 bp, P. troglodytes
gaaagctgaggcccag

SEQ ID NO: 241776 - DNA, 16 bp, P. troglodytes
gaaagctgaggtggaa

SEQ ID NO: 241777 - DNA, 16 bp, P. troglodytes
gaaagcttcctggagg

SEQ ID NO: 241778 - DNA, 16 bp, P. troglodytes
gaaagctttcagtctt

SEQ ID NO: 241779 - DNA, 16 bp, P. troglodytes
gaaaggaaaaccagac

SEQ ID NO: 241780 - DNA, 16 bp, P. troglodytes
gaaaggaaacaaaatt

SEQ ID NO: 241781 - DNA, 16 bp, P. troglodytes
gaaaggaaattagtat

SEQ ID NO: 241782 - DNA, 16 bp, P. troglodytes
gaaaggaacaacctgt

SEQ ID NO: 241783 - DNA, 16 bp, P. troglodytes
gaaaggaaggacccag

SEQ ID NO: 241784 - DNA, 16 bp, P. troglodytes
gaaaggaaggcaggca

SEQ ID NO: 241785 - DNA, 16 bp, P. troglodytes
gaaaggcaaatcaaaa

SEQ ID NO: 241786 - DNA, 16 bp, P. troglodytes
gaaaggcaggacaact

SEQ ID NO: 241787 - DNA, 16 bp, P. troglodytes
gaaaggccgaggcagg

SEQ ID NO: 241788 - DNA, 16 bp, P. troglodytes
gaaagggaaatgatca

SEQ ID NO: 241789 - DNA, 19 bp, P. troglodytes
gaaagggagactccctttc

SEQ ID NO: 241790 - DNA, 16 bp, P. troglodytes
gaaagggctttattca

SEQ ID NO: 241791 - DNA, 16 bp, P. troglodytes
gaaaggggaggtgcta

SEQ ID NO: 241792 - DNA, 16 bp, P. troglodytes
gaaaggggtccagttt

SEQ ID NO: 241793 - DNA, 16 bp, P. troglodytes
gaaaggggtggctgtg

SEQ ID NO: 241794 - DNA, 16 bp, P. troglodytes
gaaaggtacagtaaaa

SEQ ID NO: 241795 - DNA, 16 bp, P. troglodytes
gaaaggtgaaaaagct

SEQ ID NO: 241796 - DNA, 16 bp, P. troglodytes
gaaaggtttttgtttt

SEQ ID NO: 241797 - DNA, 16 bp, P. troglodytes
gaaagtaatgacaaaa

SEQ ID NO: 241798 - DNA, 16 bp, P. troglodytes
gaaagtactttataaa

SEQ ID NO: 241799 - DNA, 16 bp, P. troglodytes
gaaagtatttctcctt

SEQ ID NO: 241800 - DNA, 16 bp, P. troglodytes
gaaagtatttttttaa

SEQ ID NO: 241801 - DNA, 16 bp, P. troglodytes
gaaagtcagagagaga

SEQ ID NO: 241802 - DNA, 16 bp, P. troglodytes
gaaagtccatctctac

SEQ ID NO: 241803 - DNA, 16 bp, P. troglodytes
gaaagtctttatctct

SEQ ID NO: 241804 - DNA, 16 bp, P. troglodytes
gaaagtgaaggaatgg

SEQ ID NO: 241805 - DNA, 16 bp, P. troglodytes
gaaagtgatatgcatt

SEQ ID NO: 241806 - DNA, 16 bp, P. troglodytes
gaaagtgctgggatta

SEQ ID NO: 241807 - DNA, 16 bp, P. troglodytes
gaaagtgctttgtaaa

SEQ ID NO: 241808 - DNA, 16 bp, P. troglodytes
gaaagtggaccccttc

SEQ ID NO: 241809 - DNA, 16 bp, P. troglodytes
gaaagtgtctacccag

SEQ ID NO: 241810 - DNA, 16 bp, P. troglodytes
gaaagttaatttttaa

SEQ ID NO: 241811 - DNA, 16 bp, P. troglodytes
gaaagttcactgaaaa

SEQ ID NO: 241812 - DNA, 16 bp, P. troglodytes
gaaagttctttatata

SEQ ID NO: 241813 - DNA, 16 bp, P. troglodytes
gaaagtttatgaattt

SEQ ID NO: 241814 - DNA, 16 bp, P. troglodytes
gaaagtttgaaacttc

SEQ ID NO: 241815 - DNA, 16 bp, P. troglodytes
gaaagttttcagctat

SEQ ID NO: 241816 - DNA, 16 bp, P. troglodytes
gaaataaaaatgttct

SEQ ID NO: 241817 - DNA, 16 bp, P. troglodytes
gaaataaaacaggata

SEQ ID NO: 241818 - DNA, 16 bp, P. troglodytes
gaaataaaactttaaa

SEQ ID NO: 241819 - DNA, 16 bp, P. troglodytes
gaaataaaactttttt

SEQ ID NO: 241820 - DNA, 16 bp, P. troglodytes
gaaataaaagacatct

SEQ ID NO: 241821 - DNA, 16 bp, P. troglodytes
gaaataaaagcatttt

SEQ ID NO: 241822 - DNA, 16 bp, P. troglodytes
gaaataaaaggacaga

SEQ ID NO: 241823 - DNA, 16 bp, P. troglodytes
gaaataaaagtcatcc

SEQ ID NO: 241824 - DNA, 16 bp, P. troglodytes
gaaataaaatcactat

SEQ ID NO: 241825 - DNA, 16 bp, P. troglodytes
gaaataaaatcttttc

SEQ ID NO: 241826 - DNA, 16 bp, P. troglodytes
gaaataaacttatttt

SEQ ID NO: 241827 - DNA, 16 bp, P. troglodytes
gaaataaagacttttt

SEQ ID NO: 241828 - DNA, 16 bp, P. troglodytes
gaaataaaggcagaaa

SEQ ID NO: 241829 - DNA, 17 bp, P. troglodytes
gaaataaagggtattca

SEQ ID NO: 241830 - DNA, 16 bp, P. troglodytes
gaaataaagtattttt

SEQ ID NO: 241831 - DNA, 16 bp, P. troglodytes
gaaataaataaagtgt

SEQ ID NO: 241832 - DNA, 16 bp, P. troglodytes
gaaataaatgtctgtg

SEQ ID NO: 241833 - DNA, 16 bp, P. troglodytes
gaaataaatgtctgtt

SEQ ID NO: 241834 - DNA, 16 bp, P. troglodytes
gaaataaattcaaata

SEQ ID NO: 241835 - DNA, 16 bp, P. troglodytes
gaaataaatttctgat

SEQ ID NO: 241836 - DNA, 16 bp, P. troglodytes
gaaataacacaaatgt

SEQ ID NO: 241837 - DNA, 16 bp, P. troglodytes
gaaataacccaaatat

SEQ ID NO: 241838 - DNA, 17 bp, P. troglodytes
gaaataactaagatcac

SEQ ID NO: 241839 - DNA, 16 bp, P. troglodytes
gaaataactccaagaa

SEQ ID NO: 241840 - DNA, 16 bp, P. troglodytes
gaaataactgagatca

SEQ ID NO: 241841 - DNA, 16 bp, P. troglodytes
gaaataagagagaaca

SEQ ID NO: 241842 - DNA, 16 bp, P. troglodytes
gaaataagatcttttt

SEQ ID NO: 241843 - DNA, 16 bp, P. troglodytes
gaaataagccagccac

SEQ ID NO: 241844 - DNA, 18 bp, P. troglodytes
gaaataataccacacatc

SEQ ID NO: 241845 - DNA, 16 bp, P. troglodytes
gaaataatcaagatca

SEQ ID NO: 241846 - DNA, 16 bp, P. troglodytes
gaaataatcagcagaa

SEQ ID NO: 241847 - DNA, 16 bp, P. troglodytes
gaaataatctaaatgt

SEQ ID NO: 241848 - DNA, 16 bp, P. troglodytes
gaaataatgactaaaa

SEQ ID NO: 241849 - DNA, 16 bp, P. troglodytes
gaaataatgtcatttg

SEQ ID NO: 241850 - DNA, 16 bp, P. troglodytes
gaaataattaagctta

SEQ ID NO: 241851 - DNA, 16 bp, P. troglodytes
gaaataattatttgaa

SEQ ID NO: 241852 - DNA, 16 bp, P. troglodytes
gaaataattgataagc

SEQ ID NO: 241853 - DNA, 16 bp, P. troglodytes
gaaataattgccaaat

SEQ ID NO: 241854 - DNA, 16 bp, P. troglodytes
gaaatacaaagaggaa

SEQ ID NO: 241855 - DNA, 16 bp, P. troglodytes
gaaatacagagaaagc

SEQ ID NO: 241856 - DNA, 23 bp, P. troglodytes
gaaatacagagaacgccacaaag

SEQ ID NO: 241857 - DNA, 16 bp, P. troglodytes
gaaatacatatttttt

SEQ ID NO: 241858 - DNA, 16 bp, P. troglodytes
gaaatacatgtttgtt

SEQ ID NO: 241859 - DNA, 16 bp, P. troglodytes
gaaatacatttaaaaa

SEQ ID NO: 241860 - DNA, 16 bp, P. troglodytes
gaaatacatttctgtt

SEQ ID NO: 241861 - DNA, 16 bp, P. troglodytes
gaaatacattttcttt

SEQ ID NO: 241862 - DNA, 19 bp, P. troglodytes
gaaataccatttgacccag

SEQ ID NO: 241863 - DNA, 16 bp, P. troglodytes
gaaatactaaagaaag

SEQ ID NO: 241864 - DNA, 16 bp, P. troglodytes
gaaatactcttcttga

SEQ ID NO: 241865 - DNA, 16 bp, P. troglodytes
gaaatacttgggacca

SEQ ID NO: 241866 - DNA, 16 bp, P. troglodytes
gaaatagaattagaag

SEQ ID NO: 241867 - DNA, 16 bp, P. troglodytes
gaaatagacacaataa

SEQ ID NO: 241868 - DNA, 16 bp, P. troglodytes
gaaatagcactgaatc

SEQ ID NO: 241869 - DNA, 16 bp, P. troglodytes
gaaataggatcttgct

SEQ ID NO: 241870 - DNA, 16 bp, P. troglodytes
gaaatatacaatgaaa

SEQ ID NO: 241871 - DNA, 16 bp, P. troglodytes
gaaatatagagaatgc

SEQ ID NO: 241872 - DNA, 16 bp, P. troglodytes
gaaatatatgtatttt

SEQ ID NO: 241873 - DNA, 16 bp, P. troglodytes
gaaatatatgtgtata

SEQ ID NO: 241874 - DNA, 16 bp, P. troglodytes
gaaatatatgtgtgtg

SEQ ID NO: 241875 - DNA, 16 bp, P. troglodytes
gaaatatatttcataa

SEQ ID NO: 241876 - DNA, 16 bp, P. troglodytes
gaaatatatttgtata

SEQ ID NO: 241877 - DNA, 16 bp, P. troglodytes
gaaatatctaaaattg

SEQ ID NO: 241878 - DNA, 16 bp, P. troglodytes
gaaatatctatttaaa

SEQ ID NO: 241879 - DNA, 16 bp, P. troglodytes
gaaatatcttcagaaa

SEQ ID NO: 241880 - DNA, 16 bp, P. troglodytes
gaaatatgaacatttt

SEQ ID NO: 241881 - DNA, 16 bp, P. troglodytes
gaaatatttctacttt

SEQ ID NO: 241882 - DNA, 16 bp, P. troglodytes
gaaatatttctttttt

SEQ ID NO: 241883 - DNA, 16 bp, P. troglodytes
gaaatatttgaagaaa

SEQ ID NO: 241884 - DNA, 16 bp, P. troglodytes
gaaatattttcatgat

SEQ ID NO: 241885 - DNA, 16 bp, P. troglodytes
gaaatattttctcatt

SEQ ID NO: 241886 - DNA, 16 bp, P. troglodytes
gaaatatttttttttc

SEQ ID NO: 241887 - DNA, 16 bp, P. troglodytes
gaaatcaaagaagaca

SEQ ID NO: 241888 - DNA, 16 bp, P. troglodytes
gaaatcaaatcaaaat

SEQ ID NO: 241889 - DNA, 16 bp, P. troglodytes
gaaatcaaatggaaat

SEQ ID NO: 241890 - DNA, 16 bp, P. troglodytes
gaaatcaagatgaaaa

SEQ ID NO: 241891 - DNA, 16 bp, P. troglodytes
gaaatcaataaacgta

SEQ ID NO: 241892 - DNA, 16 bp, P. troglodytes
gaaatcacaatggaaa

SEQ ID NO: 241893 - DNA, 16 bp, P. troglodytes
gaaatcacagatgaca

SEQ ID NO: 241894 - DNA, 16 bp, P. troglodytes
gaaatcagagattaca

SEQ ID NO: 241895 - DNA, 16 bp, P. troglodytes
gaaatcaggaaaataa

SEQ ID NO: 241896 - DNA, 16 bp, P. troglodytes
gaaatcaggaaaggaa

SEQ ID NO: 241897 - DNA, 16 bp, P. troglodytes
gaaatcatgtcttttg

SEQ ID NO: 241898 - DNA, 16 bp, P. troglodytes
gaaatcattgatgctt

SEQ ID NO: 241899 - DNA, 16 bp, P. troglodytes
gaaatcattttttcct

SEQ ID NO: 241900 - DNA, 16 bp, P. troglodytes
gaaatccaagatgaag

SEQ ID NO: 241901 - DNA, 16 bp, P. troglodytes
gaaatccatttttttt

SEQ ID NO: 241902 - DNA, 16 bp, P. troglodytes
gaaatcccagctactc

SEQ ID NO: 241903 - DNA, 16 bp, P. troglodytes
gaaatcccatatctac

SEQ ID NO: 241904 - DNA, 16 bp, P. troglodytes
gaaatccctgataaaa

SEQ ID NO: 241905 - DNA, 16 bp, P. troglodytes
gaaatcctaagcaaaa

SEQ ID NO: 241906 - DNA, 16 bp, P. troglodytes
gaaatcctgtctctat

SEQ ID NO: 241907 - DNA, 16 bp, P. troglodytes
gaaatctgaataaact

SEQ ID NO: 241908 - DNA, 16 bp, P. troglodytes
gaaatctgcattttaa

SEQ ID NO: 241909 - DNA, 16 bp, P. troglodytes
gaaatctggcagtctg

SEQ ID NO: 241910 - DNA, 16 bp, P. troglodytes
gaaatctggggaagag

SEQ ID NO: 241911 - DNA, 16 bp, P. troglodytes
gaaatctttgccaagg

SEQ ID NO: 241912 - DNA, 16 bp, P. troglodytes
gaaatctttgctgttc

SEQ ID NO: 241913 - DNA, 16 bp, P. troglodytes
gaaatgaaaaagcaga

SEQ ID NO: 241914 - DNA, 16 bp, P. troglodytes
gaaatgaaaacaaatg

SEQ ID NO: 241915 - DNA, 16 bp, P. troglodytes
gaaatgaaaacatagg

SEQ ID NO: 241916 - DNA, 16 bp, P. troglodytes
gaaatgaaacagaaga

SEQ ID NO: 241917 - DNA, 16 bp, P. troglodytes
gaaatgaaatgggaga

SEQ ID NO: 241918 - DNA, 16 bp, P. troglodytes
gaaatgaactcatcct

SEQ ID NO: 241919 - DNA, 16 bp, P. troglodytes
gaaatgaagccagttg

SEQ ID NO: 241920 - DNA, 16 bp, P. troglodytes
gaaatgaaggcaaaaa

SEQ ID NO: 241921 - DNA, 16 bp, P. troglodytes
gaaatgaagtcagaaa

SEQ ID NO: 241922 - DNA, 16 bp, P. troglodytes
gaaatgaatgaaaatg

SEQ ID NO: 241923 - DNA, 16 bp, P. troglodytes
gaaatgaatgaaacta

SEQ ID NO: 241924 - DNA, 16 bp, P. troglodytes
gaaatgagaattttaa

SEQ ID NO: 241925 - DNA, 16 bp, P. troglodytes
gaaatgagatgagatg

SEQ ID NO: 241926 - DNA, 16 bp, P. troglodytes
gaaatgatcaacaaaa

SEQ ID NO: 241927 - DNA, 16 bp, P. troglodytes
gaaatgattgccacaa

SEQ ID NO: 241928 - DNA, 16 bp, P. troglodytes
gaaatgatttcaaaat

SEQ ID NO: 241929 - DNA, 16 bp, P. troglodytes
gaaatgattttttaaa

SEQ ID NO: 241930 - DNA, 16 bp, P. troglodytes
gaaatgcaaattaaaa

SEQ ID NO: 241931 - DNA, 16 bp, P. troglodytes
gaaatgcaaattgaaa

SEQ ID NO: 241932 - DNA, 16 bp, P. troglodytes
gaaatgcacattcttg

SEQ ID NO: 241933 - DNA, 16 bp, P. troglodytes
gaaatgcagaaattac

SEQ ID NO: 241934 - DNA, 16 bp, P. troglodytes
gaaatgccttcagaat

SEQ ID NO: 241935 - DNA, 16 bp, P. troglodytes
gaaatgctgtccagga

SEQ ID NO: 241936 - DNA, 16 bp, P. troglodytes
gaaatgcttcagaaca

SEQ ID NO: 241937 - DNA, 16 bp, P. troglodytes
gaaatggaagaagaca

SEQ ID NO: 241938 - DNA, 16 bp, P. troglodytes
gaaatggaagctcaga

SEQ ID NO: 241939 - DNA, 16 bp, P. troglodytes
gaaatggaatctcact

SEQ ID NO: 241940 - DNA, 16 bp, P. troglodytes
gaaatggagacagaga

SEQ ID NO: 241941 - DNA, 16 bp, P. troglodytes
gaaatggagagttgtt

SEQ ID NO: 241942 - DNA, 16 bp, P. troglodytes
gaaatggaggcccaga

SEQ ID NO: 241943 - DNA, 17 bp, P. troglodytes
gaaatggatacattcct

SEQ ID NO: 241944 - DNA, 16 bp, P. troglodytes
gaaatggatggatgga

SEQ ID NO: 241945 - DNA, 16 bp, P. troglodytes
gaaatggcaccactgc

SEQ ID NO: 241946 - DNA, 16 bp, P. troglodytes
gaaatggctttgtgat

SEQ ID NO: 241947 - DNA, 16 bp, P. troglodytes
gaaatgggagaaaatt

SEQ ID NO: 241948 - DNA, 16 bp, P. troglodytes
gaaatgggagttcact

SEQ ID NO: 241949 - DNA, 16 bp, P. troglodytes
gaaatgggagttttat

SEQ ID NO: 241950 - DNA, 16 bp, P. troglodytes
gaaatggggttttgct

SEQ ID NO: 241951 - DNA, 16 bp, P. troglodytes
gaaatgggtgtattta

SEQ ID NO: 241952 - DNA, 16 bp, P. troglodytes
gaaatggttaatttta

SEQ ID NO: 241953 - DNA, 16 bp, P. troglodytes
gaaatgtaaactagta

SEQ ID NO: 241954 - DNA, 16 bp, P. troglodytes
gaaatgtacttttttt

SEQ ID NO: 241955 - DNA, 16 bp, P. troglodytes
gaaatgtccaaaatag

SEQ ID NO: 241956 - DNA, 16 bp, P. troglodytes
gaaatgtctcttcaag

SEQ ID NO: 241957 - DNA, 16 bp, P. troglodytes
gaaatgtcttcaaaat

SEQ ID NO: 241958 - DNA, 16 bp, P. troglodytes
gaaatgtgggattgga

SEQ ID NO: 241959 - DNA, 16 bp, P. troglodytes
gaaatgttcattttta

SEQ ID NO: 241960 - DNA, 16 bp, P. troglodytes
gaaatgttctacatct

SEQ ID NO: 241961 - DNA, 16 bp, P. troglodytes
gaaatgttctatatct

SEQ ID NO: 241962 - DNA, 16 bp, P. troglodytes
gaaatgttctgtattt

SEQ ID NO: 241963 - DNA, 16 bp, P. troglodytes
gaaatgtttcagattt

SEQ ID NO: 241964 - DNA, 16 bp, P. troglodytes
gaaatgttttaaattt

SEQ ID NO: 241965 - DNA, 16 bp, P. troglodytes
gaaatgttttgtaaat

SEQ ID NO: 241966 - DNA, 16 bp, P. troglodytes
gaaattaaagaagaca

SEQ ID NO: 241967 - DNA, 16 bp, P. troglodytes
gaaattaacaaagcct

SEQ ID NO: 241968 - DNA, 16 bp, P. troglodytes
gaaattaaggcagaga

SEQ ID NO: 241969 - DNA, 16 bp, P. troglodytes
gaaattaatgttgttt

SEQ ID NO: 241970 - DNA, 16 bp, P. troglodytes
gaaattacaaaaatta

SEQ ID NO: 241971 - DNA, 16 bp, P. troglodytes
gaaattagacaagaaa

SEQ ID NO: 241972 - DNA, 16 bp, P. troglodytes
gaaattagccgggcat

SEQ ID NO: 241973 - DNA, 16 bp, P. troglodytes
gaaattagctgggcat

SEQ ID NO: 241974 - DNA, 16 bp, P. troglodytes
gaaattagctgggtgt

SEQ ID NO: 241975 - DNA, 16 bp, P. troglodytes
gaaattatgtcaaaat

SEQ ID NO: 241976 - DNA, 16 bp, P. troglodytes
gaaattcaagataaca

SEQ ID NO: 241977 - DNA, 16 bp, P. troglodytes
gaaattcagaatctca

SEQ ID NO: 241978 - DNA, 16 bp, P. troglodytes
gaaattcagattttta

SEQ ID NO: 241979 - DNA, 16 bp, P. troglodytes
gaaattcaggctgtga

SEQ ID NO: 241980 - DNA, 16 bp, P. troglodytes
gaaattccatctcaaa

SEQ ID NO: 241981 - DNA, 16 bp, P. troglodytes
gaaattcctatcaaaa

SEQ ID NO: 241982 - DNA, 16 bp, P. troglodytes
gaaattccttaaagaa

SEQ ID NO: 241983 - DNA, 16 bp, P. troglodytes
gaaattctagaattga

SEQ ID NO: 241984 - DNA, 16 bp, P. troglodytes
gaaattctataatttt

SEQ ID NO: 241985 - DNA, 16 bp, P. troglodytes
gaaattgaaaaagaca

SEQ ID NO: 241986 - DNA, 16 bp, P. troglodytes
gaaattgaaatcagta

SEQ ID NO: 241987 - DNA, 16 bp, P. troglodytes
gaaattgaagaaaaca

SEQ ID NO: 241988 - DNA, 16 bp, P. troglodytes
gaaattgaagctcaaa

SEQ ID NO: 241989 - DNA, 16 bp, P. troglodytes
gaaattgaggcaatag

SEQ ID NO: 241990 - DNA, 16 bp, P. troglodytes
gaaattgaggcacaaa

SEQ ID NO: 241991 - DNA, 16 bp, P. troglodytes
gaaattgaggcacaga

SEQ ID NO: 241992 - DNA, 16 bp, P. troglodytes
gaaattgaggcagaaa

SEQ ID NO: 241993 - DNA, 16 bp, P. troglodytes
gaaattgaggcagaga

SEQ ID NO: 241994 - DNA, 16 bp, P. troglodytes
gaaattgaggcccaaa

SEQ ID NO: 241995 - DNA, 16 bp, P. troglodytes
gaaattgccacagcca

SEQ ID NO: 241996 - DNA, 16 bp, P. troglodytes
gaaattgctgagtcaa

SEQ ID NO: 241997 - DNA, 16 bp, P. troglodytes
gaaatttaaaacataa

SEQ ID NO: 241998 - DNA, 16 bp, P. troglodytes
gaaatttatcagaaaa

SEQ ID NO: 241999 - DNA, 16 bp, P. troglodytes
gaaatttattatctca

SEQ ID NO: 242000 - DNA, 16 bp, P. troglodytes
gaaatttatttcttat

SEQ ID NO: 242001 - DNA, 16 bp, P. troglodytes
gaaatttctgaataac

SEQ ID NO: 242002 - DNA, 16 bp, P. troglodytes
gaaatttcttttttct

SEQ ID NO: 242003 - DNA, 16 bp, P. troglodytes
gaaatttgagaccagc

SEQ ID NO: 242004 - DNA, 16 bp, P. troglodytes
gaaatttgttttcttt

SEQ ID NO: 242005 - DNA, 16 bp, P. troglodytes
gaaattttacatttta

SEQ ID NO: 242006 - DNA, 16 bp, P. troglodytes
gaaattttactgaagt

SEQ ID NO: 242007 - DNA, 16 bp, P. troglodytes
gaaattttcatggatg

SEQ ID NO: 242008 - DNA, 16 bp, P. troglodytes
gaaattttcatttttt

SEQ ID NO: 242009 - DNA, 16 bp, P. troglodytes
gaaattttcttttatt

SEQ ID NO: 242010 - DNA, 16 bp, P. troglodytes
gaaatttttagaaata

SEQ ID NO: 242011 - DNA, 16 bp, P. troglodytes
gaaatttttcaacata

SEQ ID NO: 242012 - DNA, 16 bp, P. troglodytes
gaacaaaactggatgg

SEQ ID NO: 242013 - DNA, 16 bp, P. troglodytes
gaacaaagaacagatg

SEQ ID NO: 242014 - DNA, 16 bp, P. troglodytes
gaacaaagacaaaatg

SEQ ID NO: 242015 - DNA, 16 bp, P. troglodytes
gaacaaagagttaagt

SEQ ID NO: 242016 - DNA, 16 bp, P. troglodytes
gaacaaagatgtaaaa

SEQ ID NO: 242017 - DNA, 16 bp, P. troglodytes
gaacaaagcctccatg

SEQ ID NO: 242018 - DNA, 23 bp, P. troglodytes
gaacaaagctggatggagaatga

SEQ ID NO: 242019 - DNA, 16 bp, P. troglodytes
gaacaaagttgaagga

SEQ ID NO: 242020 - DNA, 16 bp, P. troglodytes
gaacaaagttggaggt

SEQ ID NO: 242021 - DNA, 16 bp, P. troglodytes
gaacaaatgaagaaat

SEQ ID NO: 242022 - DNA, 16 bp, P. troglodytes
gaacaacagagcaaga

SEQ ID NO: 242023 - DNA, 17 bp, P. troglodytes
gaacaacatggtgaaac

SEQ ID NO: 242024 - DNA, 16 bp, P. troglodytes
gaacaagacagacatg

SEQ ID NO: 242025 - DNA, 16 bp, P. troglodytes
gaacaagctgctcctg

SEQ ID NO: 242026 - DNA, 16 bp, P. troglodytes
gaacaaggcctccaag

SEQ ID NO: 242027 - DNA, 16 bp, P. troglodytes
gaacaatgagaactct

SEQ ID NO: 242028 - DNA, 16 bp, P. troglodytes
gaacaatgagacagaa

SEQ ID NO: 242029 - DNA, 16 bp, P. troglodytes
gaacacaatagagaac

SEQ ID NO: 242030 - DNA, 16 bp, P. troglodytes
gaacacagccatgctt

SEQ ID NO: 242031 - DNA, 16 bp, P. troglodytes
gaacacagccctgctg

SEQ ID NO: 242032 - DNA, 16 bp, P. troglodytes
gaacacattcaaatca

SEQ ID NO: 242033 - DNA, 16 bp, P. troglodytes
gaacaccacacactgg

SEQ ID NO: 242034 - DNA, 16 bp, P. troglodytes
gaacacctgacctcaa

SEQ ID NO: 242035 - DNA, 16 bp, P. troglodytes
gaacacctgaggctgg

SEQ ID NO: 242036 - DNA, 16 bp, P. troglodytes
gaacactgtgctggga

SEQ ID NO: 242037 - DNA, 17 bp, P. troglodytes
gaacacttggacacagg

SEQ ID NO: 242038 - DNA, 16 bp, P. troglodytes
gaacactttgggaggc

SEQ ID NO: 242039 - DNA, 16 bp, P. troglodytes
gaacagaaagccaaat

SEQ ID NO: 242040 - DNA, 16 bp, P. troglodytes
gaacagaaaggacatc

SEQ ID NO: 242041 - DNA, 16 bp, P. troglodytes
gaacagaaatttctca

SEQ ID NO: 242042 - DNA, 16 bp, P. troglodytes
gaacagaataaagagt

SEQ ID NO: 242043 - DNA, 16 bp, P. troglodytes
gaacagaattgagaat

SEQ ID NO: 242044 - DNA, 16 bp, P. troglodytes
gaacagagagacagag

SEQ ID NO: 242045 - DNA, 16 bp, P. troglodytes
gaacagagcaagaccc

SEQ ID NO: 242046 - DNA, 16 bp, P. troglodytes
gaacagagtccagaaa

SEQ ID NO: 242047 - DNA, 16 bp, P. troglodytes
gaacagatatttattt

SEQ ID NO: 242048 - DNA, 16 bp, P. troglodytes
gaacagattctcccct

SEQ ID NO: 242049 - DNA, 16 bp, P. troglodytes
gaacagcaaatgcaaa

SEQ ID NO: 242050 - DNA, 16 bp, P. troglodytes
gaacagcatggaaaaa

SEQ ID NO: 242051 - DNA, 16 bp, P. troglodytes
gaacagcatgtgcaga

SEQ ID NO: 242052 - DNA, 16 bp, P. troglodytes
gaacagtatggaaaaa

SEQ ID NO: 242053 - DNA, 16 bp, P. troglodytes
gaacagtatggggaaa

SEQ ID NO: 242054 - DNA, 16 bp, P. troglodytes
gaacagtgccacaata

SEQ ID NO: 242055 - DNA, 16 bp, P. troglodytes
gaacagtgggttttgt

SEQ ID NO: 242056 - DNA, 16 bp, P. troglodytes
gaacagtggttaccag

SEQ ID NO: 242057 - DNA, 16 bp, P. troglodytes
gaacagtggttctcag

SEQ ID NO: 242058 - DNA, 16 bp, P. troglodytes
gaacagtgtgtggaga

SEQ ID NO: 242059 - DNA, 16 bp, P. troglodytes
gaacatcaaactccaa

SEQ ID NO: 242060 - DNA, 17 bp, P. troglodytes
gaacatcacacaccggg

SEQ ID NO: 242061 - DNA, 16 bp, P. troglodytes
gaacatccttatctct

SEQ ID NO: 242062 - DNA, 16 bp, P. troglodytes
gaacatctttccattt

SEQ ID NO: 242063 - DNA, 16 bp, P. troglodytes
gaacatctttttatat

SEQ ID NO: 242064 - DNA, 16 bp, P. troglodytes
gaacatgcagttttgt

SEQ ID NO: 242065 - DNA, 16 bp, P. troglodytes
gaacatggattgtgaa

SEQ ID NO: 242066 - DNA, 16 bp, P. troglodytes
gaacatggtttgaaca

SEQ ID NO: 242067 - DNA, 16 bp, P. troglodytes
gaacattccaattcca

SEQ ID NO: 242068 - DNA, 16 bp, P. troglodytes
gaacattcttaaagaa

SEQ ID NO: 242069 - DNA, 16 bp, P. troglodytes
gaacattgagaacaca

SEQ ID NO: 242070 - DNA, 16 bp, P. troglodytes
gaacatttcagatttc

SEQ ID NO: 242071 - DNA, 16 bp, P. troglodytes
gaacatttcagatttt

SEQ ID NO: 242072 - DNA, 16 bp, P. troglodytes
gaacatttcatgtaaa

SEQ ID NO: 242073 - DNA, 16 bp, P. troglodytes
gaacatttccatcacc

SEQ ID NO: 242074 - DNA, 16 bp, P. troglodytes
gaacatttccattacc

SEQ ID NO: 242075 - DNA, 16 bp, P. troglodytes
gaacatttgaattgtt

SEQ ID NO: 242076 - DNA, 16 bp, P. troglodytes
gaacattttaacagta

SEQ ID NO: 242077 - DNA, 16 bp, P. troglodytes
gaacattttcatcatc

SEQ ID NO: 242078 - DNA, 16 bp, P. troglodytes
gaacattttttaaaaa

SEQ ID NO: 242079 - DNA, 16 bp, P. troglodytes
gaaccaaaaatcagat

SEQ ID NO: 242080 - DNA, 16 bp, P. troglodytes
gaaccaaataaaagcc

SEQ ID NO: 242081 - DNA, 16 bp, P. troglodytes
gaaccaaatcaagaat

SEQ ID NO: 242082 - DNA, 16 bp, P. troglodytes
gaaccaagaaataaag

SEQ ID NO: 242083 - DNA, 16 bp, P. troglodytes
gaaccaaggaggcaga

SEQ ID NO: 242084 - DNA, 16 bp, P. troglodytes
gaaccaattccttgaa

SEQ ID NO: 242085 - DNA, 16 bp, P. troglodytes
gaaccacaggcacaca

SEQ ID NO: 242086 - DNA, 16 bp, P. troglodytes
gaaccaccctgcccag

SEQ ID NO: 242087 - DNA, 16 bp, P. troglodytes
gaaccagaaactctgg

SEQ ID NO: 242088 - DNA, 16 bp, P. troglodytes
gaaccagactccgtct

SEQ ID NO: 242089 - DNA, 16 bp, P. troglodytes
gaaccagagcccacac

SEQ ID NO: 242090 - DNA, 16 bp, P. troglodytes
gaaccagcctggccaa

SEQ ID NO: 242091 - DNA, 16 bp, P. troglodytes
gaaccaggaaagccag

SEQ ID NO: 242092 - DNA, 16 bp, P. troglodytes
gaaccaggctgcacag

SEQ ID NO: 242093 - DNA, 16 bp, P. troglodytes
gaaccagggaagcaga

SEQ ID NO: 242094 - DNA, 16 bp, P. troglodytes
gaaccagggaggagga

SEQ ID NO: 242095 - DNA, 16 bp, P. troglodytes
gaaccagggaggtaga

SEQ ID NO: 242096 - DNA, 16 bp, P. troglodytes
gaaccagtgcaagaac

SEQ ID NO: 242097 - DNA, 16 bp, P. troglodytes
gaacccagaaacaaat

SEQ ID NO: 242098 - DNA, 16 bp, P. troglodytes
gaacccaggaaatgga

SEQ ID NO: 242099 - DNA, 16 bp, P. troglodytes
gaacccaggagaaaga

SEQ ID NO: 242100 - DNA, 20 bp, P. troglodytes
gaaccccgtctctactaaaa

SEQ ID NO: 242101 - DNA, 16 bp, P. troglodytes
gaacccctgcccccgg

SEQ ID NO: 242102 - DNA, 16 bp, P. troglodytes
gaacccctgggttcaa

SEQ ID NO: 242103 - DNA, 16 bp, P. troglodytes
gaacccgggaggggag

SEQ ID NO: 242104 - DNA, 18 bp, P. troglodytes
gaacccgggatacagaaa

SEQ ID NO: 242105 - DNA, 16 bp, P. troglodytes
gaacccggggagcaga

SEQ ID NO: 242106 - DNA, 16 bp, P. troglodytes
gaaccgagatcgtgcc

SEQ ID NO: 242107 - DNA, 16 bp, P. troglodytes
gaacctaaaatagaag

SEQ ID NO: 242108 - DNA, 16 bp, P. troglodytes
gaacctagaaggtgga

SEQ ID NO: 242109 - DNA, 16 bp, P. troglodytes
gaacctcagtttcccc

SEQ ID NO: 242110 - DNA, 16 bp, P. troglodytes
gaacctccgcctcccg

SEQ ID NO: 242111 - DNA, 16 bp, P. troglodytes
gaacctctgacctcag

SEQ ID NO: 242112 - DNA, 16 bp, P. troglodytes
gaacctgagactcaga

SEQ ID NO: 242113 - DNA, 16 bp, P. troglodytes
gaacctgaggctcaga

SEQ ID NO: 242114 - DNA, 16 bp, P. troglodytes
gaacctgctggcacct

SEQ ID NO: 242115 - DNA, 16 bp, P. troglodytes
gaacctggaaggggga

SEQ ID NO: 242116 - DNA, 16 bp, P. troglodytes
gaacctggaggcagag

SEQ ID NO: 242117 - DNA, 16 bp, P. troglodytes
gaacctggaggcggag

SEQ ID NO: 242118 - DNA, 16 bp, P. troglodytes
gaacctgggagatgga

SEQ ID NO: 242119 - DNA, 16 bp, P. troglodytes
gaacctgggagcagag

SEQ ID NO: 242120 - DNA, 16 bp, P. troglodytes
gaacctgggaggccaa

SEQ ID NO: 242121 - DNA, 16 bp, P. troglodytes
gaacctgggaggcggg

SEQ ID NO: 242122 - DNA, 16 bp, P. troglodytes
gaacctgggaggggag

SEQ ID NO: 242123 - DNA, 16 bp, P. troglodytes
gaacctgggagttcaa

SEQ ID NO: 242124 - DNA, 16 bp, P. troglodytes
gaacctgtgaatgtta

SEQ ID NO: 242125 - DNA, 16 bp, P. troglodytes
gaacctgtgttttgat

SEQ ID NO: 242126 - DNA, 16 bp, P. troglodytes
gaacgcctgacctcgt

SEQ ID NO: 242127 - DNA, 16 bp, P. troglodytes
gaacgcgggaggcaga

SEQ ID NO: 242128 - DNA, 17 bp, P. troglodytes
gaacgttgaatattggc

SEQ ID NO: 242129 - DNA, 16 bp, P. troglodytes
gaactaaaaaagcaag

SEQ ID NO: 242130 - DNA, 16 bp, P. troglodytes
gaactaaaggagatag

SEQ ID NO: 242131 - DNA, 16 bp, P. troglodytes
gaactaacgagcaaaa

SEQ ID NO: 242132 - DNA, 16 bp, P. troglodytes
gaactaatttttttaa

SEQ ID NO: 242133 - DNA, 16 bp, P. troglodytes
gaactaccatctgacc

SEQ ID NO: 242134 - DNA, 16 bp, P. troglodytes
gaactactgcaggaat

SEQ ID NO: 242135 - DNA, 16 bp, P. troglodytes
gaactagaaaaagaag

SEQ ID NO: 242136 - DNA, 16 bp, P. troglodytes
gaactagaaaagcaaa

SEQ ID NO: 242137 - DNA, 16 bp, P. troglodytes
gaactagatagtggtg

SEQ ID NO: 242138 - DNA, 16 bp, P. troglodytes
gaactaggaagaaatt

SEQ ID NO: 242139 - DNA, 18 bp, P. troglodytes
gaactatactacaaggct

SEQ ID NO: 242140 - DNA, 16 bp, P. troglodytes
gaactataggcatgtg

SEQ ID NO: 242141 - DNA, 16 bp, P. troglodytes
gaactatgagaaaata

SEQ ID NO: 242142 - DNA, 16 bp, P. troglodytes
gaactcaaacaagtca

SEQ ID NO: 242143 - DNA, 16 bp, P. troglodytes
gaactcaaatgatcct

SEQ ID NO: 242144 - DNA, 16 bp, P. troglodytes
gaactcagctctggaa

SEQ ID NO: 242145 - DNA, 16 bp, P. troglodytes
gaactcaggaggagga

SEQ ID NO: 242146 - DNA, 16 bp, P. troglodytes
gaactcaggcaatccg

SEQ ID NO: 242147 - DNA, 16 bp, P. troglodytes
gaactcagggggcaga

SEQ ID NO: 242148 - DNA, 16 bp, P. troglodytes
gaactcatacaactca

SEQ ID NO: 242149 - DNA, 16 bp, P. troglodytes
gaactcatgaggcaga

SEQ ID NO: 242150 - DNA, 16 bp, P. troglodytes
gaactccaacaaattt

SEQ ID NO: 242151 - DNA, 16 bp, P. troglodytes
gaactccagcctgagc

SEQ ID NO: 242152 - DNA, 16 bp, P. troglodytes
gaactccaggctgggc

SEQ ID NO: 242153 - DNA, 16 bp, P. troglodytes
gaactccaggttctct

SEQ ID NO: 242154 - DNA, 16 bp, P. troglodytes
gaactcctaacctcag

SEQ ID NO: 242155 - DNA, 16 bp, P. troglodytes
gaactcctgaactcaa

SEQ ID NO: 242156 - DNA, 16 bp, P. troglodytes
gaactcctgacatcaa

SEQ ID NO: 242157 - DNA, 16 bp, P. troglodytes
gaactcctgaccctca

SEQ ID NO: 242158 - DNA, 17 bp, P. troglodytes
gaactcctgacctcatg

SEQ ID NO: 242159 - DNA, 16 bp, P. troglodytes
gaactcctgaccttaa

SEQ ID NO: 242160 - DNA, 16 bp, P. troglodytes
gaactcctgactgcaa

SEQ ID NO: 242161 - DNA, 16 bp, P. troglodytes
gaactcctgactttag

SEQ ID NO: 242162 - DNA, 16 bp, P. troglodytes
gaactcctgagttcag

SEQ ID NO: 242163 - DNA, 16 bp, P. troglodytes
gaactcctggactcta

SEQ ID NO: 242164 - DNA, 18 bp, P. troglodytes
gaactcctggcctcatgt

SEQ ID NO: 242165 - DNA, 16 bp, P. troglodytes
gaactcctggccttga

SEQ ID NO: 242166 - DNA, 16 bp, P. troglodytes
gaactcctggcgtcaa

SEQ ID NO: 242167 - DNA, 16 bp, P. troglodytes
gaactcctgggcccaa

SEQ ID NO: 242168 - DNA, 16 bp, P. troglodytes
gaactcctgggcctca

SEQ ID NO: 242169 - DNA, 16 bp, P. troglodytes
gaactctgaaaattaa

SEQ ID NO: 242170 - DNA, 16 bp, P. troglodytes
gaactctgacctcagg

SEQ ID NO: 242171 - DNA, 16 bp, P. troglodytes
gaactctgtattttct

SEQ ID NO: 242172 - DNA, 16 bp, P. troglodytes
gaactcttagaagaaa

SEQ ID NO: 242173 - DNA, 16 bp, P. troglodytes
gaactcttgacctcaa

SEQ ID NO: 242174 - DNA, 16 bp, P. troglodytes
gaactcttgacctcag

SEQ ID NO: 242175 - DNA, 16 bp, P. troglodytes
gaactcttgggctcaa

SEQ ID NO: 242176 - DNA, 16 bp, P. troglodytes
gaactgaaacatcagc

SEQ ID NO: 242177 - DNA, 16 bp, P. troglodytes
gaactgaaattttaat

SEQ ID NO: 242178 - DNA, 16 bp, P. troglodytes
gaactgaacaataata

SEQ ID NO: 242179 - DNA, 16 bp, P. troglodytes
gaactgaaggaaatac

SEQ ID NO: 242180 - DNA, 16 bp, P. troglodytes
gaactgaaggaaatgg

SEQ ID NO: 242181 - DNA, 16 bp, P. troglodytes
gaactgaattccttcc

SEQ ID NO: 242182 - DNA, 16 bp, P. troglodytes
gaactgagattgtgcc

SEQ ID NO: 242183 - DNA, 16 bp, P. troglodytes
gaactgataaattcag

SEQ ID NO: 242184 - DNA, 16 bp, P. troglodytes
gaactgcccgccttgg

SEQ ID NO: 242185 - DNA, 16 bp, P. troglodytes
gaactgctgacctcaa

SEQ ID NO: 242186 - DNA, 16 bp, P. troglodytes
gaactgctggaaccca

SEQ ID NO: 242187 - DNA, 16 bp, P. troglodytes
gaactgcttgaatctg

SEQ ID NO: 242188 - DNA, 16 bp, P. troglodytes
gaactggaaatcatta

SEQ ID NO: 242189 - DNA, 16 bp, P. troglodytes
gaactggaacaagaaa

SEQ ID NO: 242190 - DNA, 16 bp, P. troglodytes
gaactggaagaagaca

SEQ ID NO: 242191 - DNA, 16 bp, P. troglodytes
gaactggaataaaggt

SEQ ID NO: 242192 - DNA, 16 bp, P. troglodytes
gaactggaattagaag

SEQ ID NO: 242193 - DNA, 16 bp, P. troglodytes
gaactggagaagcaag

SEQ ID NO: 242194 - DNA, 16 bp, P. troglodytes
gaactggagattatta

SEQ ID NO: 242195 - DNA, 16 bp, P. troglodytes
gaactgggcccagaga

SEQ ID NO: 242196 - DNA, 16 bp, P. troglodytes
gaactgtcttccaaag

SEQ ID NO: 242197 - DNA, 17 bp, P. troglodytes
gaactgtgagtcaatta

SEQ ID NO: 242198 - DNA, 16 bp, P. troglodytes
gaactgtgggacaata

SEQ ID NO: 242199 - DNA, 16 bp, P. troglodytes
gaactgtttatttctg

SEQ ID NO: 242200 - DNA, 16 bp, P. troglodytes
gaactgttttatatca

SEQ ID NO: 242201 - DNA, 16 bp, P. troglodytes
gaacttaaaataaaag

SEQ ID NO: 242202 - DNA, 16 bp, P. troglodytes
gaacttaaagtaaaaa

SEQ ID NO: 242203 - DNA, 16 bp, P. troglodytes
gaacttaaagtatgat

SEQ ID NO: 242204 - DNA, 16 bp, P. troglodytes
gaacttaaagtgaaat

SEQ ID NO: 242205 - DNA, 16 bp, P. troglodytes
gaacttacaatcatgg

SEQ ID NO: 242206 - DNA, 16 bp, P. troglodytes
gaacttacagtaaaat

SEQ ID NO: 242207 - DNA, 16 bp, P. troglodytes
gaacttatggtgcttt

SEQ ID NO: 242208 - DNA, 16 bp, P. troglodytes
gaacttattcctccta

SEQ ID NO: 242209 - DNA, 16 bp, P. troglodytes
gaacttattgggaact

SEQ ID NO: 242210 - DNA, 16 bp, P. troglodytes
gaacttcaaagtagtt

SEQ ID NO: 242211 - DNA, 16 bp, P. troglodytes
gaacttcagagaacaa

SEQ ID NO: 242212 - DNA, 16 bp, P. troglodytes
gaacttccaaaactat

SEQ ID NO: 242213 - DNA, 16 bp, P. troglodytes
gaacttctgacctcat

SEQ ID NO: 242214 - DNA, 16 bp, P. troglodytes
gaacttctgaccttgt

SEQ ID NO: 242215 - DNA, 16 bp, P. troglodytes
gaacttgaaataaaag

SEQ ID NO: 242216 - DNA, 16 bp, P. troglodytes
gaacttgaacccaggt

SEQ ID NO: 242217 - DNA, 16 bp, P. troglodytes
gaacttgaagtataat

SEQ ID NO: 242218 - DNA, 16 bp, P. troglodytes
gaacttgaggctgcag

SEQ ID NO: 242219 - DNA, 16 bp, P. troglodytes
gaacttgctggaaatg

SEQ ID NO: 242220 - DNA, 16 bp, P. troglodytes
gaacttgggcaagtca

SEQ ID NO: 242221 - DNA, 16 bp, P. troglodytes
gaacttgttagaaagg

SEQ ID NO: 242222 - DNA, 16 bp, P. troglodytes
gaactttttaaaagaa

SEQ ID NO: 242223 - DNA, 16 bp, P. troglodytes
gaagaaaaacaaaggt

SEQ ID NO: 242224 - DNA, 16 bp, P. troglodytes
gaagaaaaagaaatcc

SEQ ID NO: 242225 - DNA, 16 bp, P. troglodytes
gaagaaaaagaatttt

SEQ ID NO: 242226 - DNA, 16 bp, P. troglodytes
gaagaaaaagcatttg

SEQ ID NO: 242227 - DNA, 16 bp, P. troglodytes
gaagaaaaaggtttaa

SEQ ID NO: 242228 - DNA, 16 bp, P. troglodytes
gaagaaaaatgtattt

SEQ ID NO: 242229 - DNA, 16 bp, P. troglodytes
gaagaaaacttcctca

SEQ ID NO: 242230 - DNA, 16 bp, P. troglodytes
gaagaaaagaatttta

SEQ ID NO: 242231 - DNA, 16 bp, P. troglodytes
gaagaaaagacagctg

SEQ ID NO: 242232 - DNA, 16 bp, P. troglodytes
gaagaaaagaggtttc

SEQ ID NO: 242233 - DNA, 16 bp, P. troglodytes
gaagaaaagatttgaa

SEQ ID NO: 242234 - DNA, 16 bp, P. troglodytes
gaagaaaagtattttt

SEQ ID NO: 242235 - DNA, 16 bp, P. troglodytes
gaagaaaatattcaaa

SEQ ID NO: 242236 - DNA, 16 bp, P. troglodytes
gaagaaaatattgcaa

SEQ ID NO: 242237 - DNA, 16 bp, P. troglodytes
gaagaaaatctaaaat

SEQ ID NO: 242238 - DNA, 16 bp, P. troglodytes
gaagaaaatcttaaaa

SEQ ID NO: 242239 - DNA, 16 bp, P. troglodytes
gaagaaaatgtaggca

SEQ ID NO: 242240 - DNA, 16 bp, P. troglodytes
gaagaaaatgtcaaaa

SEQ ID NO: 242241 - DNA, 16 bp, P. troglodytes
gaagaaaatgttttca

SEQ ID NO: 242242 - DNA, 16 bp, P. troglodytes
gaagaaaattatttta

SEQ ID NO: 242243 - DNA, 16 bp, P. troglodytes
gaagaaaattattttt

SEQ ID NO: 242244 - DNA, 16 bp, P. troglodytes
gaagaaacagaaaatg

SEQ ID NO: 242245 - DNA, 16 bp, P. troglodytes
gaagaaacagaaggat

SEQ ID NO: 242246 - DNA, 16 bp, P. troglodytes
gaagaaaccaaacctg

SEQ ID NO: 242247 - DNA, 16 bp, P. troglodytes
gaagaaactgaagaaa

SEQ ID NO: 242248 - DNA, 16 bp, P. troglodytes
gaagaaactgcatgaa

SEQ ID NO: 242249 - DNA, 16 bp, P. troglodytes
gaagaaactgcattaa

SEQ ID NO: 242250 - DNA, 16 bp, P. troglodytes
gaagaaactgtatcaa

SEQ ID NO: 242251 - DNA, 16 bp, P. troglodytes
gaagaaagaaattcaa

SEQ ID NO: 242252 - DNA, 16 bp, P. troglodytes
gaagaaaggatatcag

SEQ ID NO: 242253 - DNA, 16 bp, P. troglodytes
gaagaaagggtatcag

SEQ ID NO: 242254 - DNA, 16 bp, P. troglodytes
gaagaaagtatttcaa

SEQ ID NO: 242255 - DNA, 16 bp, P. troglodytes
gaagaaagtccttggt

SEQ ID NO: 242256 - DNA, 16 bp, P. troglodytes
gaagaaataaagagca

SEQ ID NO: 242257 - DNA, 16 bp, P. troglodytes
gaagaaatacctgagg

SEQ ID NO: 242258 - DNA, 16 bp, P. troglodytes
gaagaaatattttcat

SEQ ID NO: 242259 - DNA, 16 bp, P. troglodytes
gaagaaatcaatgaaa

SEQ ID NO: 242260 - DNA, 16 bp, P. troglodytes
gaagaaatcacaagga

SEQ ID NO: 242261 - DNA, 16 bp, P. troglodytes
gaagaaatgcttcagg

SEQ ID NO: 242262 - DNA, 16 bp, P. troglodytes
gaagaaatggataatt

SEQ ID NO: 242263 - DNA, 16 bp, P. troglodytes
gaagaaatgtataaat

SEQ ID NO: 242264 - DNA, 16 bp, P. troglodytes
gaagaaattgaggctt

SEQ ID NO: 242265 - DNA, 16 bp, P. troglodytes
gaagaacaaaaaccat

SEQ ID NO: 242266 - DNA, 16 bp, P. troglodytes
gaagaacccagtcctg

SEQ ID NO: 242267 - DNA, 16 bp, P. troglodytes
gaagaagaagaaacat

SEQ ID NO: 242268 - DNA, 16 bp, P. troglodytes
gaagaagaagaagctg

SEQ ID NO: 242269 - DNA, 16 bp, P. troglodytes
gaagaagaagaaggct

SEQ ID NO: 242270 - DNA, 16 bp, P. troglodytes
gaagaagaagaatttt

SEQ ID NO: 242271 - DNA, 16 bp, P. troglodytes
gaagaagaattgtctt

SEQ ID NO: 242272 - DNA, 16 bp, P. troglodytes
gaagaagaattttctt

SEQ ID NO: 242273 - DNA, 16 bp, P. troglodytes
gaagaagacaaagatg

SEQ ID NO: 242274 - DNA, 16 bp, P. troglodytes
gaagaagagaaatctg

SEQ ID NO: 242275 - DNA, 16 bp, P. troglodytes
gaagaagagcataaaa

SEQ ID NO: 242276 - DNA, 16 bp, P. troglodytes
gaagaagatattccat

SEQ ID NO: 242277 - DNA, 17 bp, P. troglodytes
gaagaagatgaatctct

SEQ ID NO: 242278 - DNA, 16 bp, P. troglodytes
gaagaagcagcagaag

SEQ ID NO: 242279 - DNA, 16 bp, P. troglodytes
gaagaagctgaggcaa

SEQ ID NO: 242280 - DNA, 16 bp, P. troglodytes
gaagaagctgaggctc

SEQ ID NO: 242281 - DNA, 16 bp, P. troglodytes
gaagaagctgcagaag

SEQ ID NO: 242282 - DNA, 16 bp, P. troglodytes
gaagaagctttttaac

SEQ ID NO: 242283 - DNA, 16 bp, P. troglodytes
gaagaaggaaatatct

SEQ ID NO: 242284 - DNA, 16 bp, P. troglodytes
gaagaaggacttgttt

SEQ ID NO: 242285 - DNA, 16 bp, P. troglodytes
gaagaagtaaaactct

SEQ ID NO: 242286 - DNA, 16 bp, P. troglodytes
gaagaagtaaaatttt

SEQ ID NO: 242287 - DNA, 16 bp, P. troglodytes
gaagaagtcaaattgt

SEQ ID NO: 242288 - DNA, 16 bp, P. troglodytes
gaagaatatgccttgg

SEQ ID NO: 242289 - DNA, 16 bp, P. troglodytes
gaagaatatttgaaaa

SEQ ID NO: 242290 - DNA, 16 bp, P. troglodytes
gaagaatatttttctt

SEQ ID NO: 242291 - DNA, 16 bp, P. troglodytes
gaagaatcaaataaat

SEQ ID NO: 242292 - DNA, 16 bp, P. troglodytes
gaagaatcactggaac

SEQ ID NO: 242293 - DNA, 16 bp, P. troglodytes
gaagaatcagaaatca

SEQ ID NO: 242294 - DNA, 16 bp, P. troglodytes
gaagaatcagatcaca

SEQ ID NO: 242295 - DNA, 16 bp, P. troglodytes
gaagaatcggatcaca

SEQ ID NO: 242296 - DNA, 16 bp, P. troglodytes
gaagaatctagacaga

SEQ ID NO: 242297 - DNA, 16 bp, P. troglodytes
gaagaatggaaccaag

SEQ ID NO: 242298 - DNA, 16 bp, P. troglodytes
gaagaatgtttattct

SEQ ID NO: 242299 - DNA, 16 bp, P. troglodytes
gaagaattgccacact

SEQ ID NO: 242300 - DNA, 16 bp, P. troglodytes
gaagaattgctaacta

SEQ ID NO: 242301 - DNA, 16 bp, P. troglodytes
gaagaattgcttgaag

SEQ ID NO: 242302 - DNA, 16 bp, P. troglodytes
gaagaattgtcttggg

SEQ ID NO: 242303 - DNA, 16 bp, P. troglodytes
gaagaatttgagaagg

SEQ ID NO: 242304 - DNA, 16 bp, P. troglodytes
gaagacaaaggcagag

SEQ ID NO: 242305 - DNA, 16 bp, P. troglodytes
gaagacaaggaggagc

SEQ ID NO: 242306 - DNA, 16 bp, P. troglodytes
gaagacaatatttcca

SEQ ID NO: 242307 - DNA, 16 bp, P. troglodytes
gaagacaatttttcca

SEQ ID NO: 242308 - DNA, 16 bp, P. troglodytes
gaagacacacaaatgg

SEQ ID NO: 242309 - DNA, 16 bp, P. troglodytes
gaagacacagggagaa

SEQ ID NO: 242310 - DNA, 16 bp, P. troglodytes
gaagacacccagctgg

SEQ ID NO: 242311 - DNA, 16 bp, P. troglodytes
gaagacacctaccctg

SEQ ID NO: 242312 - DNA, 16 bp, P. troglodytes
gaagacagaagcagag

SEQ ID NO: 242313 - DNA, 16 bp, P. troglodytes
gaagacagaggcagaa

SEQ ID NO: 242314 - DNA, 16 bp, P. troglodytes
gaagacagaggcagag

SEQ ID NO: 242315 - DNA, 16 bp, P. troglodytes
gaagacagccctcacc

SEQ ID NO: 242316 - DNA, 16 bp, P. troglodytes
gaagacagtgacagat

SEQ ID NO: 242317 - DNA, 16 bp, P. troglodytes
gaagacatacaagcag

SEQ ID NO: 242318 - DNA, 16 bp, P. troglodytes
gaagacatataaatga

SEQ ID NO: 242319 - DNA, 16 bp, P. troglodytes
gaagacatgagacatc

SEQ ID NO: 242320 - DNA, 16 bp, P. troglodytes
gaagacattatgttaa

SEQ ID NO: 242321 - DNA, 16 bp, P. troglodytes
gaagacatttatgagg

SEQ ID NO: 242322 - DNA, 16 bp, P. troglodytes
gaagacattttaaaaa

SEQ ID NO: 242323 - DNA, 16 bp, P. troglodytes
gaagaccatccccaag

SEQ ID NO: 242324 - DNA, 17 bp, P. troglodytes
gaagaccatcctggcca

SEQ ID NO: 242325 - DNA, 16 bp, P. troglodytes
gaagactctgctcctc

SEQ ID NO: 242326 - DNA, 16 bp, P. troglodytes
gaagactctgtctcta

SEQ ID NO: 242327 - DNA, 16 bp, P. troglodytes
gaagagaaaggactca

SEQ ID NO: 242328 - DNA, 16 bp, P. troglodytes
gaagagaaatgaaaac

SEQ ID NO: 242329 - DNA, 16 bp, P. troglodytes
gaagagaacagaggcc

SEQ ID NO: 242330 - DNA, 16 bp, P. troglodytes
gaagagaagatcacaa

SEQ ID NO: 242331 - DNA, 16 bp, P. troglodytes
gaagagaatgaagtga

SEQ ID NO: 242332 - DNA, 16 bp, P. troglodytes
gaagagacaaatctcc

SEQ ID NO: 242333 - DNA, 16 bp, P. troglodytes
gaagagacaaatcttc

SEQ ID NO: 242334 - DNA, 16 bp, P. troglodytes
gaagagacaccagagc

SEQ ID NO: 242335 - DNA, 16 bp, P. troglodytes
gaagagacagggtctt

SEQ ID NO: 242336 - DNA, 16 bp, P. troglodytes
gaagagacctggagcc

SEQ ID NO: 242337 - DNA, 16 bp, P. troglodytes
gaagagactttccttt

SEQ ID NO: 242338 - DNA, 16 bp, P. troglodytes
gaagagagaaaaatct

SEQ ID NO: 242339 - DNA, 16 bp, P. troglodytes
gaagagagaaatagac

SEQ ID NO: 242340 - DNA, 16 bp, P. troglodytes
gaagagaggaagccaa

SEQ ID NO: 242341 - DNA, 16 bp, P. troglodytes
gaagagatagataaat

SEQ ID NO: 242342 - DNA, 16 bp, P. troglodytes
gaagagattttttaaa

SEQ ID NO: 242343 - DNA, 16 bp, P. troglodytes
gaagagcctttgggcc

SEQ ID NO: 242344 - DNA, 16 bp, P. troglodytes
gaagagctctggctgg

SEQ ID NO: 242345 - DNA, 16 bp, P. troglodytes
gaagagctgaaatgtt

SEQ ID NO: 242346 - DNA, 16 bp, P. troglodytes
gaagagctgcagccct

SEQ ID NO: 242347 - DNA, 16 bp, P. troglodytes
gaagaggaaactaaag

SEQ ID NO: 242348 - DNA, 16 bp, P. troglodytes
gaagaggaaactgaga

SEQ ID NO: 242349 - DNA, 16 bp, P. troglodytes
gaagaggaagcaaggc

SEQ ID NO: 242350 - DNA, 16 bp, P. troglodytes
gaagaggaagcaggca

SEQ ID NO: 242351 - DNA, 16 bp, P. troglodytes
gaagaggacacaaata

SEQ ID NO: 242352 - DNA, 16 bp, P. troglodytes
gaagaggacctgggag

SEQ ID NO: 242353 - DNA, 16 bp, P. troglodytes
gaagaggagactgagg

SEQ ID NO: 242354 - DNA, 16 bp, P. troglodytes
gaagaggagattaaga

SEQ ID NO: 242355 - DNA, 16 bp, P. troglodytes
gaagaggaggagccag

SEQ ID NO: 242356 - DNA, 16 bp, P. troglodytes
gaagaggcaaatccat

SEQ ID NO: 242357 - DNA, 16 bp, P. troglodytes
gaagaggcagagctgg

SEQ ID NO: 242358 - DNA, 16 bp, P. troglodytes
gaagaggctgggcgtg

SEQ ID NO: 242359 - DNA, 16 bp, P. troglodytes
gaagaggggctgaagg

SEQ ID NO: 242360 - DNA, 16 bp, P. troglodytes
gaagagggtgggggcc

SEQ ID NO: 242361 - DNA, 16 bp, P. troglodytes
gaagagggtggttccc

SEQ ID NO: 242362 - DNA, 16 bp, P. troglodytes
gaagaggttacagtga

SEQ ID NO: 242363 - DNA, 16 bp, P. troglodytes
gaagagtttgagaaga

SEQ ID NO: 242364 - DNA, 16 bp, P. troglodytes
gaagataaaagcagag

SEQ ID NO: 242365 - DNA, 16 bp, P. troglodytes
gaagataaatatattt

SEQ ID NO: 242366 - DNA, 16 bp, P. troglodytes
gaagataatttttaaa

SEQ ID NO: 242367 - DNA, 16 bp, P. troglodytes
gaagatacaaataaat

SEQ ID NO: 242368 - DNA, 16 bp, P. troglodytes
gaagatataccaagca

SEQ ID NO: 242369 - DNA, 16 bp, P. troglodytes
gaagatccagtttcat

SEQ ID NO: 242370 - DNA, 16 bp, P. troglodytes
gaagatctaaataaac

SEQ ID NO: 242371 - DNA, 16 bp, P. troglodytes
gaagatctctgaaatg

SEQ ID NO: 242372 - DNA, 16 bp, P. troglodytes
gaagatctgttaggag

SEQ ID NO: 242373 - DNA, 16 bp, P. troglodytes
gaagatgaaaatgttc

SEQ ID NO: 242374 - DNA, 16 bp, P. troglodytes
gaagatgaggaaactg

SEQ ID NO: 242375 - DNA, 16 bp, P. troglodytes
gaagatgaggctgcag

SEQ ID NO: 242376 - DNA, 16 bp, P. troglodytes
gaagatgatgatggtg

SEQ ID NO: 242377 - DNA, 16 bp, P. troglodytes
gaagatgatggtgatg

SEQ ID NO: 242378 - DNA, 16 bp, P. troglodytes
gaagatgcagtgagcc

SEQ ID NO: 242379 - DNA, 16 bp, P. troglodytes
gaagatgctatgaaca

SEQ ID NO: 242380 - DNA, 16 bp, P. troglodytes
gaagatgctggccttg

SEQ ID NO: 242381 - DNA, 16 bp, P. troglodytes
gaagatgctgtgaaca

SEQ ID NO: 242382 - DNA, 16 bp, P. troglodytes
gaagatgctgtgaata

SEQ ID NO: 242383 - DNA, 16 bp, P. troglodytes
gaagatgtgaagaaat

SEQ ID NO: 242384 - DNA, 16 bp, P. troglodytes
gaagatgtggaaaagt

SEQ ID NO: 242385 - DNA, 16 bp, P. troglodytes
gaagatgtttttattt

SEQ ID NO: 242386 - DNA, 16 bp, P. troglodytes
gaagattaaaccagcc

SEQ ID NO: 242387 - DNA, 16 bp, P. troglodytes
gaagatttttcccttc

SEQ ID NO: 242388 - DNA, 16 bp, P. troglodytes
gaagcaaaaagtagaa

SEQ ID NO: 242389 - DNA, 16 bp, P. troglodytes
gaagcaaacacgtctt

SEQ ID NO: 242390 - DNA, 16 bp, P. troglodytes
gaagcaaacacttcct

SEQ ID NO: 242391 - DNA, 16 bp, P. troglodytes
gaagcaaacatgccct

SEQ ID NO: 242392 - DNA, 16 bp, P. troglodytes
gaagcaaatttggaac

SEQ ID NO: 242393 - DNA, 16 bp, P. troglodytes
gaagcaagaaattaaa

SEQ ID NO: 242394 - DNA, 16 bp, P. troglodytes
gaagcaagaggattgc

SEQ ID NO: 242395 - DNA, 16 bp, P. troglodytes
gaagcaagcaccttct

SEQ ID NO: 242396 - DNA, 16 bp, P. troglodytes
gaagcaagcagatcac

SEQ ID NO: 242397 - DNA, 16 bp, P. troglodytes
gaagcaagctgccatg

SEQ ID NO: 242398 - DNA, 16 bp, P. troglodytes
gaagcaatcctcccac

SEQ ID NO: 242399 - DNA, 16 bp, P. troglodytes
gaagcacagagagatt

SEQ ID NO: 242400 - DNA, 16 bp, P. troglodytes
gaagcacagagaggct

SEQ ID NO: 242401 - DNA, 16 bp, P. troglodytes
gaagcacagaggaggg

SEQ ID NO: 242402 - DNA, 16 bp, P. troglodytes
gaagcacccagattca

SEQ ID NO: 242403 - DNA, 16 bp, P. troglodytes
gaagcagaaatgagaa

SEQ ID NO: 242404 - DNA, 16 bp, P. troglodytes
gaagcagaaccagtag

SEQ ID NO: 242405 - DNA, 16 bp, P. troglodytes
gaagcagaagcagaag

SEQ ID NO: 242406 - DNA, 16 bp, P. troglodytes
gaagcagaagcaggag

SEQ ID NO: 242407 - DNA, 16 bp, P. troglodytes
gaagcagaaggatcac

SEQ ID NO: 242408 - DNA, 16 bp, P. troglodytes
gaagcagacttttcag

SEQ ID NO: 242409 - DNA, 16 bp, P. troglodytes
gaagcagaggctcaga

SEQ ID NO: 242410 - DNA, 16 bp, P. troglodytes
gaagcagaggtcagag

SEQ ID NO: 242411 - DNA, 16 bp, P. troglodytes
gaagcagaggttacag

SEQ ID NO: 242412 - DNA, 16 bp, P. troglodytes
gaagcagaggttggaa

SEQ ID NO: 242413 - DNA, 16 bp, P. troglodytes
gaagcagatcataaaa

SEQ ID NO: 242414 - DNA, 16 bp, P. troglodytes
gaagcagatgctggtg

SEQ ID NO: 242415 - DNA, 16 bp, P. troglodytes
gaagcagcagcagctg

SEQ ID NO: 242416 - DNA, 16 bp, P. troglodytes
gaagcagcagcaggaa

SEQ ID NO: 242417 - DNA, 16 bp, P. troglodytes
gaagcagcagcccaag

SEQ ID NO: 242418 - DNA, 16 bp, P. troglodytes
gaagcagcaggtgctg

SEQ ID NO: 242419 - DNA, 16 bp, P. troglodytes
gaagcagccaagatgt

SEQ ID NO: 242420 - DNA, 16 bp, P. troglodytes
gaagcagcctgaggtc

SEQ ID NO: 242421 - DNA, 16 bp, P. troglodytes
gaagcagctggacatc

SEQ ID NO: 242422 - DNA, 16 bp, P. troglodytes
gaagcagcttgaggcc

SEQ ID NO: 242423 - DNA, 16 bp, P. troglodytes
gaagcaggacagagaa

SEQ ID NO: 242424 - DNA, 16 bp, P. troglodytes
gaagcaggcaggcctc

SEQ ID NO: 242425 - DNA, 16 bp, P. troglodytes
gaagcagggcaccaag

SEQ ID NO: 242426 - DNA, 16 bp, P. troglodytes
gaagcaggtagatcac

SEQ ID NO: 242427 - DNA, 16 bp, P. troglodytes
gaagcagttacagaaa

SEQ ID NO: 242428 - DNA, 16 bp, P. troglodytes
gaagcagtttctcaga

SEQ ID NO: 242429 - DNA, 16 bp, P. troglodytes
gaagcatttcagattt

SEQ ID NO: 242430 - DNA, 16 bp, P. troglodytes
gaagccaaagcaggag

SEQ ID NO: 242431 - DNA, 16 bp, P. troglodytes
gaagccaaagcaggca

SEQ ID NO: 242432 - DNA, 16 bp, P. troglodytes
gaagccaacctgaaaa

SEQ ID NO: 242433 - DNA, 16 bp, P. troglodytes
gaagccaagcagatac

SEQ ID NO: 242434 - DNA, 16 bp, P. troglodytes
gaagccaatctgaaaa

SEQ ID NO: 242435 - DNA, 16 bp, P. troglodytes
gaagccacagcccgag

SEQ ID NO: 242436 - DNA, 16 bp, P. troglodytes
gaagccagaagagaag

SEQ ID NO: 242437 - DNA, 16 bp, P. troglodytes
gaagccagagagacca

SEQ ID NO: 242438 - DNA, 16 bp, P. troglodytes
gaagccagcaagacca

SEQ ID NO: 242439 - DNA, 16 bp, P. troglodytes
gaagccagccaggctt

SEQ ID NO: 242440 - DNA, 16 bp, P. troglodytes
gaagccagctgccatg

SEQ ID NO: 242441 - DNA, 16 bp, P. troglodytes
gaagccaggagttcga

SEQ ID NO: 242442 - DNA, 16 bp, P. troglodytes
gaagccagggccatgc

SEQ ID NO: 242443 - DNA, 16 bp, P. troglodytes
gaagccagtggtggat

SEQ ID NO: 242444 - DNA, 16 bp, P. troglodytes
gaagccatcatcttca

SEQ ID NO: 242445 - DNA, 16 bp, P. troglodytes
gaagccatctggacct

SEQ ID NO: 242446 - DNA, 16 bp, P. troglodytes
gaagccattattctca

SEQ ID NO: 242447 - DNA, 16 bp, P. troglodytes
gaagccatttccataa

SEQ ID NO: 242448 - DNA, 16 bp, P. troglodytes
gaagcccaggaggaaa

SEQ ID NO: 242449 - DNA, 16 bp, P. troglodytes
gaagccccctccccgc

SEQ ID NO: 242450 - DNA, 16 bp, P. troglodytes
gaagccctctctcacc

SEQ ID NO: 242451 - DNA, 16 bp, P. troglodytes
gaagccctttataaaa

SEQ ID NO: 242452 - DNA, 16 bp, P. troglodytes
gaagccgacttgatca

SEQ ID NO: 242453 - DNA, 16 bp, P. troglodytes
gaagccgagcagatgc

SEQ ID NO: 242454 - DNA, 16 bp, P. troglodytes
gaagcctcaaattcct

SEQ ID NO: 242455 - DNA, 16 bp, P. troglodytes
gaagcctcagggagct

SEQ ID NO: 242456 - DNA, 16 bp, P. troglodytes
gaagcctccacctcct

SEQ ID NO: 242457 - DNA, 16 bp, P. troglodytes
gaagcctctgcctccc

SEQ ID NO: 242458 - DNA, 16 bp, P. troglodytes
gaagcctgagatcaag

SEQ ID NO: 242459 - DNA, 16 bp, P. troglodytes
gaagcctgaggcagga

SEQ ID NO: 242460 - DNA, 16 bp, P. troglodytes
gaagccttcctggagg

SEQ ID NO: 242461 - DNA, 16 bp, P. troglodytes
gaagcgagtggatcac

SEQ ID NO: 242462 - DNA, 16 bp, P. troglodytes
gaagcgattctcctgt

SEQ ID NO: 242463 - DNA, 16 bp, P. troglodytes
gaagcggaagttgcag

SEQ ID NO: 242464 - DNA, 16 bp, P. troglodytes
gaagcggaggttgtgg

SEQ ID NO: 242465 - DNA, 16 bp, P. troglodytes
gaagctaaaaaaaatt

SEQ ID NO: 242466 - DNA, 16 bp, P. troglodytes
gaagctagcagaagtt

SEQ ID NO: 242467 - DNA, 16 bp, P. troglodytes
gaagctagcagaggtt

SEQ ID NO: 242468 - DNA, 16 bp, P. troglodytes
gaagctatctgtgaaa

SEQ ID NO: 242469 - DNA, 16 bp, P. troglodytes
gaagctcaagatcaag

SEQ ID NO: 242470 - DNA, 16 bp, P. troglodytes
gaagctcagagaggtg

SEQ ID NO: 242471 - DNA, 16 bp, P. troglodytes
gaagctccacacccct

SEQ ID NO: 242472 - DNA, 16 bp, P. troglodytes
gaagctctggccaggg

SEQ ID NO: 242473 - DNA, 16 bp, P. troglodytes
gaagctgaaaaaggca

SEQ ID NO: 242474 - DNA, 16 bp, P. troglodytes
gaagctgaagaaaaaa

SEQ ID NO: 242475 - DNA, 16 bp, P. troglodytes
gaagctgaagaacttg

SEQ ID NO: 242476 - DNA, 16 bp, P. troglodytes
gaagctgaagagggag

SEQ ID NO: 242477 - DNA, 16 bp, P. troglodytes
gaagctgaagcaggag

SEQ ID NO: 242478 - DNA, 16 bp, P. troglodytes
gaagctgacagtgcag

SEQ ID NO: 242479 - DNA, 16 bp, P. troglodytes
gaagctgacgcaggag

SEQ ID NO: 242480 - DNA, 16 bp, P. troglodytes
gaagctgagacaggca

SEQ ID NO: 242481 - DNA, 16 bp, P. troglodytes
gaagctgaggaaggag

SEQ ID NO: 242482 - DNA, 20 bp, P. troglodytes
gaagctgaggcagaagaatt

SEQ ID NO: 242483 - DNA, 16 bp, P. troglodytes
gaagctgaggcagaga

SEQ ID NO: 242484 - DNA, 16 bp, P. troglodytes
gaagctgaggcaggaa

SEQ ID NO: 242485 - DNA, 16 bp, P. troglodytes
gaagctgaggcaggag

SEQ ID NO: 242486 - DNA, 16 bp, P. troglodytes
gaagctgaggcagggc

SEQ ID NO: 242487 - DNA, 16 bp, P. troglodytes
gaagctgaggctcagg

SEQ ID NO: 242488 - DNA, 16 bp, P. troglodytes
gaagctgaggctgaag

SEQ ID NO: 242489 - DNA, 16 bp, P. troglodytes
gaagctgaggctgcag

SEQ ID NO: 242490 - DNA, 16 bp, P. troglodytes
gaagctgaggtggtag

SEQ ID NO: 242491 - DNA, 16 bp, P. troglodytes
gaagctgcaaaagaaa

SEQ ID NO: 242492 - DNA, 16 bp, P. troglodytes
gaagctgcagaacagc

SEQ ID NO: 242493 - DNA, 16 bp, P. troglodytes
gaagctgcagaagaaa

SEQ ID NO: 242494 - DNA, 16 bp, P. troglodytes
gaagctgcagaccttg

SEQ ID NO: 242495 - DNA, 16 bp, P. troglodytes
gaagctgcagtgagcc

SEQ ID NO: 242496 - DNA, 16 bp, P. troglodytes
gaagctgcttgtggtg

SEQ ID NO: 242497 - DNA, 16 bp, P. troglodytes
gaagctggaaaagaca

SEQ ID NO: 242498 - DNA, 16 bp, P. troglodytes
gaagctggaaacatca

SEQ ID NO: 242499 - DNA, 16 bp, P. troglodytes
gaagctggaaaccatt

SEQ ID NO: 242500 - DNA, 16 bp, P. troglodytes
gaagctggaaagggca

SEQ ID NO: 242501 - DNA, 16 bp, P. troglodytes
gaagctggaagaggca

SEQ ID NO: 242502 - DNA, 16 bp, P. troglodytes
gaagctggaaggcaga

SEQ ID NO: 242503 - DNA, 16 bp, P. troglodytes
gaagctggaagttcaa

SEQ ID NO: 242504 - DNA, 16 bp, P. troglodytes
gaagctggaatgccca

SEQ ID NO: 242505 - DNA, 16 bp, P. troglodytes
gaagctggagaagaaa

SEQ ID NO: 242506 - DNA, 16 bp, P. troglodytes
gaagctggagaaggca

SEQ ID NO: 242507 - DNA, 16 bp, P. troglodytes
gaagctggaggacatt

SEQ ID NO: 242508 - DNA, 16 bp, P. troglodytes
gaagctggaggcagag

SEQ ID NO: 242509 - DNA, 16 bp, P. troglodytes
gaagctgggagaggca

SEQ ID NO: 242510 - DNA, 16 bp, P. troglodytes
gaagcttccaaaggaa

SEQ ID NO: 242511 - DNA, 16 bp, P. troglodytes
gaagcttcctgaggcc

SEQ ID NO: 242512 - DNA, 16 bp, P. troglodytes
gaagcttgcaatcatg

SEQ ID NO: 242513 - DNA, 16 bp, P. troglodytes
gaagctttatttgtaa

SEQ ID NO: 242514 - DNA, 16 bp, P. troglodytes
gaaggaaaaaaatgtt

SEQ ID NO: 242515 - DNA, 16 bp, P. troglodytes
gaaggaaaaactgtta

SEQ ID NO: 242516 - DNA, 16 bp, P. troglodytes
gaaggaaaaatgttaa

SEQ ID NO: 242517 - DNA, 16 bp, P. troglodytes
gaaggaaaacattttt

SEQ ID NO: 242518 - DNA, 16 bp, P. troglodytes
gaaggaaaactaagaa

SEQ ID NO: 242519 - DNA, 16 bp, P. troglodytes
gaaggaaaccaaaata

SEQ ID NO: 242520 - DNA, 16 bp, P. troglodytes
gaaggaaagatacagt

SEQ ID NO: 242521 - DNA, 16 bp, P. troglodytes
gaaggaaaggacccag

SEQ ID NO: 242522 - DNA, 16 bp, P. troglodytes
gaaggaaatcaagaca

SEQ ID NO: 242523 - DNA, 16 bp, P. troglodytes
gaaggaaatcctatca

SEQ ID NO: 242524 - DNA, 16 bp, P. troglodytes
gaaggaaatgaacaga

SEQ ID NO: 242525 - DNA, 16 bp, P. troglodytes
gaaggaaattgagaca

SEQ ID NO: 242526 - DNA, 16 bp, P. troglodytes
gaaggaaatttatagt

SEQ ID NO: 242527 - DNA, 16 bp, P. troglodytes
gaaggaaatttgggga

SEQ ID NO: 242528 - DNA, 16 bp, P. troglodytes
gaaggaaattttaaaa

SEQ ID NO: 242529 - DNA, 16 bp, P. troglodytes
gaaggaacaaattcca

SEQ ID NO: 242530 - DNA, 16 bp, P. troglodytes
gaaggaactccccaaa

SEQ ID NO: 242531 - DNA, 16 bp, P. troglodytes
gaaggaacttgccttg

SEQ ID NO: 242532 - DNA, 16 bp, P. troglodytes
gaaggaagaaactcag

SEQ ID NO: 242533 - DNA, 16 bp, P. troglodytes
gaaggaagagaagact

SEQ ID NO: 242534 - DNA, 16 bp, P. troglodytes
gaaggaagtaactgca

SEQ ID NO: 242535 - DNA, 16 bp, P. troglodytes
gaaggaataaattcaa

SEQ ID NO: 242536 - DNA, 16 bp, P. troglodytes
gaaggaataaattcca

SEQ ID NO: 242537 - DNA, 16 bp, P. troglodytes
gaaggaatctcactct

SEQ ID NO: 242538 - DNA, 16 bp, P. troglodytes
gaaggaattttttttt

SEQ ID NO: 242539 - DNA, 16 bp, P. troglodytes
gaaggacatgaacaga

SEQ ID NO: 242540 - DNA, 18 bp, P. troglodytes
gaaggacatgaacagaca

SEQ ID NO: 242541 - DNA, 16 bp, P. troglodytes
gaaggacatgatctca

SEQ ID NO: 242542 - DNA, 16 bp, P. troglodytes
gaaggaccaggtggag

SEQ ID NO: 242543 - DNA, 16 bp, P. troglodytes
gaaggagaagcagcag

SEQ ID NO: 242544 - DNA, 16 bp, P. troglodytes
gaaggagaagcaggca

SEQ ID NO: 242545 - DNA, 16 bp, P. troglodytes
gaaggagagcataaaa

SEQ ID NO: 242546 - DNA, 16 bp, P. troglodytes
gaaggagatgaacaga

SEQ ID NO: 242547 - DNA, 16 bp, P. troglodytes
gaaggagctggaggcc

SEQ ID NO: 242548 - DNA, 16 bp, P. troglodytes
gaaggaggaagagccc

SEQ ID NO: 242549 - DNA, 16 bp, P. troglodytes
gaaggaggctgggtgc

SEQ ID NO: 242550 - DNA, 16 bp, P. troglodytes
gaaggagtccctcttt

SEQ ID NO: 242551 - DNA, 16 bp, P. troglodytes
gaaggatgcaaagtat

SEQ ID NO: 242552 - DNA, 16 bp, P. troglodytes
gaaggatggtggccct

SEQ ID NO: 242553 - DNA, 16 bp, P. troglodytes
gaaggattctgagaaa

SEQ ID NO: 242554 - DNA, 16 bp, P. troglodytes
gaaggattggtaccag

SEQ ID NO: 242555 - DNA, 16 bp, P. troglodytes
gaaggcaaagaggagc

SEQ ID NO: 242556 - DNA, 16 bp, P. troglodytes
gaaggcaaggaggagc

SEQ ID NO: 242557 - DNA, 16 bp, P. troglodytes
gaaggcagaaataaaa

SEQ ID NO: 242558 - DNA, 16 bp, P. troglodytes
gaaggcagcatacgtc

SEQ ID NO: 242559 - DNA, 16 bp, P. troglodytes
gaaggcagcatgctca

SEQ ID NO: 242560 - DNA, 16 bp, P. troglodytes
gaaggcagctgtctgc

SEQ ID NO: 242561 - DNA, 16 bp, P. troglodytes
gaaggcagggtggcag

SEQ ID NO: 242562 - DNA, 16 bp, P. troglodytes
gaaggcagtggcatga

SEQ ID NO: 242563 - DNA, 16 bp, P. troglodytes
gaaggcatccttgagg

SEQ ID NO: 242564 - DNA, 16 bp, P. troglodytes
gaaggccaagatcaag

SEQ ID NO: 242565 - DNA, 16 bp, P. troglodytes
gaaggccaagatgggc

SEQ ID NO: 242566 - DNA, 16 bp, P. troglodytes
gaaggccaaggggaag

SEQ ID NO: 242567 - DNA, 16 bp, P. troglodytes
gaaggccaaggtgggt

SEQ ID NO: 242568 - DNA, 16 bp, P. troglodytes
gaaggccatgaagaga

SEQ ID NO: 242569 - DNA, 16 bp, P. troglodytes
gaaggccattatcctt

SEQ ID NO: 242570 - DNA, 16 bp, P. troglodytes
gaaggccctggtggag

SEQ ID NO: 242571 - DNA, 16 bp, P. troglodytes
gaaggctacagtgagc

SEQ ID NO: 242572 - DNA, 16 bp, P. troglodytes
gaaggctcaactgggg

SEQ ID NO: 242573 - DNA, 16 bp, P. troglodytes
gaaggctcaggtgatc

SEQ ID NO: 242574 - DNA, 16 bp, P. troglodytes
gaaggctctgcccctg

SEQ ID NO: 242575 - DNA, 16 bp, P. troglodytes
gaaggctgaggcagaa

SEQ ID NO: 242576 - DNA, 16 bp, P. troglodytes
gaaggctgaggtgggc

SEQ ID NO: 242577 - DNA, 16 bp, P. troglodytes
gaaggctgtttctgcc

SEQ ID NO: 242578 - DNA, 16 bp, P. troglodytes
gaaggcttaggcagga

SEQ ID NO: 242579 - DNA, 16 bp, P. troglodytes
gaaggcttccctgacc

SEQ ID NO: 242580 - DNA, 16 bp, P. troglodytes
gaaggcttctcagagg

SEQ ID NO: 242581 - DNA, 16 bp, P. troglodytes
gaaggcttctctgaag

SEQ ID NO: 242582 - DNA, 16 bp, P. troglodytes
gaaggctttaatcagg

SEQ ID NO: 242583 - DNA, 16 bp, P. troglodytes
gaagggaaaataaatt

SEQ ID NO: 242584 - DNA, 16 bp, P. troglodytes
gaagggaaatttgggg

SEQ ID NO: 242585 - DNA, 16 bp, P. troglodytes
gaagggcatcttggtt

SEQ ID NO: 242586 - DNA, 16 bp, P. troglodytes
gaagggctgggtgtgg

SEQ ID NO: 242587 - DNA, 16 bp, P. troglodytes
gaaggggaagatcaca

SEQ ID NO: 242588 - DNA, 16 bp, P. troglodytes
gaaggggaaggtgcta

SEQ ID NO: 242589 - DNA, 16 bp, P. troglodytes
gaaggggcagctgtgg

SEQ ID NO: 242590 - DNA, 16 bp, P. troglodytes
gaaggggcagggctcc

SEQ ID NO: 242591 - DNA, 16 bp, P. troglodytes
gaaggggctgggcatg

SEQ ID NO: 242592 - DNA, 24 bp, P. troglodytes
gaaggggtggcctgcccctccaca

SEQ ID NO: 242593 - DNA, 16 bp, P. troglodytes
gaaggtacttaatgcc

SEQ ID NO: 242594 - DNA, 16 bp, P. troglodytes
gaaggtcaagaccagc

SEQ ID NO: 242595 - DNA, 17 bp, P. troglodytes
gaaggtcagttgaagtc

SEQ ID NO: 242596 - DNA, 16 bp, P. troglodytes
gaaggtcctcaccaga

SEQ ID NO: 242597 - DNA, 16 bp, P. troglodytes
gaaggtgaagcaggag

SEQ ID NO: 242598 - DNA, 16 bp, P. troglodytes
gaaggtgaagcgggag

SEQ ID NO: 242599 - DNA, 16 bp, P. troglodytes
gaaggtgaatgagaag

SEQ ID NO: 242600 - DNA, 16 bp, P. troglodytes
gaaggtggaggtggca

SEQ ID NO: 242601 - DNA, 16 bp, P. troglodytes
gaaggttaagtgactt

SEQ ID NO: 242602 - DNA, 16 bp, P. troglodytes
gaaggttgaggcagga

SEQ ID NO: 242603 - DNA, 16 bp, P. troglodytes
gaaggtttatggcaac

SEQ ID NO: 242604 - DNA, 16 bp, P. troglodytes
gaaggtttcaccatgt

SEQ ID NO: 242605 - DNA, 16 bp, P. troglodytes
gaaggtttgtaaaaat

SEQ ID NO: 242606 - DNA, 16 bp, P. troglodytes
gaagtaaaatttctgg

SEQ ID NO: 242607 - DNA, 16 bp, P. troglodytes
gaagtaattaaggtta

SEQ ID NO: 242608 - DNA, 16 bp, P. troglodytes
gaagtactgacacatg

SEQ ID NO: 242609 - DNA, 16 bp, P. troglodytes
gaagtagctattctta

SEQ ID NO: 242610 - DNA, 16 bp, P. troglodytes
gaagtattctctcctc

SEQ ID NO: 242611 - DNA, 16 bp, P. troglodytes
gaagtcactcactatc

SEQ ID NO: 242612 - DNA, 16 bp, P. troglodytes
gaagtcactgcagatg

SEQ ID NO: 242613 - DNA, 16 bp, P. troglodytes
gaagtcagatgtaatt

SEQ ID NO: 242614 - DNA, 16 bp, P. troglodytes
gaagtcaggcattgac

SEQ ID NO: 242615 - DNA, 16 bp, P. troglodytes
gaagtcagtgagatca

SEQ ID NO: 242616 - DNA, 16 bp, P. troglodytes
gaagtccaaaatcaag

SEQ ID NO: 242617 - DNA, 16 bp, P. troglodytes
gaagtccaagatcaag

SEQ ID NO: 242618 - DNA, 16 bp, P. troglodytes
gaagtccaagatgaaa

SEQ ID NO: 242619 - DNA, 16 bp, P. troglodytes
gaagtccacaatcaag

SEQ ID NO: 242620 - DNA, 16 bp, P. troglodytes
gaagtccaggctgagg

SEQ ID NO: 242621 - DNA, 16 bp, P. troglodytes
gaagtcccatctctac

SEQ ID NO: 242622 - DNA, 16 bp, P. troglodytes
gaagtcctaaaatcaa

SEQ ID NO: 242623 - DNA, 16 bp, P. troglodytes
gaagtcctgggattac

SEQ ID NO: 242624 - DNA, 16 bp, P. troglodytes
gaagtctcaggaaact

SEQ ID NO: 242625 - DNA, 16 bp, P. troglodytes
gaagtctccaaaagca

SEQ ID NO: 242626 - DNA, 16 bp, P. troglodytes
gaagtctcgctctgtc

SEQ ID NO: 242627 - DNA, 16 bp, P. troglodytes
gaagtctctctctgtc

SEQ ID NO: 242628 - DNA, 16 bp, P. troglodytes
gaagtctgaaatgggt

SEQ ID NO: 242629 - DNA, 16 bp, P. troglodytes
gaagtctgaggtcaag

SEQ ID NO: 242630 - DNA, 16 bp, P. troglodytes
gaagtctgcccccatg

SEQ ID NO: 242631 - DNA, 16 bp, P. troglodytes
gaagtgaaagagctct

SEQ ID NO: 242632 - DNA, 16 bp, P. troglodytes
gaagtgaaataagcca

SEQ ID NO: 242633 - DNA, 16 bp, P. troglodytes
gaagtgaaatatttaa

SEQ ID NO: 242634 - DNA, 16 bp, P. troglodytes
gaagtgacttacccaa

SEQ ID NO: 242635 - DNA, 16 bp, P. troglodytes
gaagtgagccctcacc

SEQ ID NO: 242636 - DNA, 16 bp, P. troglodytes
gaagtgcagaaatcac

SEQ ID NO: 242637 - DNA, 18 bp, P. troglodytes
gaagtgcagtggtgcgat

SEQ ID NO: 242638 - DNA, 16 bp, P. troglodytes
gaagtgccaagcaaag

SEQ ID NO: 242639 - DNA, 16 bp, P. troglodytes
gaagtgcctgctcctg

SEQ ID NO: 242640 - DNA, 17 bp, P. troglodytes
gaagtgctgagattaca

SEQ ID NO: 242641 - DNA, 17 bp, P. troglodytes
gaagtgctggaattaca

SEQ ID NO: 242642 - DNA, 17 bp, P. troglodytes
gaagtgctgggattaca

SEQ ID NO: 242643 - DNA, 18 bp, P. troglodytes
gaagtgctgggattacaa

SEQ ID NO: 242644 - DNA, 24 bp, P. troglodytes
gaagtgctgggattacaggcgtga

SEQ ID NO: 242645 - DNA, 16 bp, P. troglodytes
gaagtgcttttttttt

SEQ ID NO: 242646 - DNA, 16 bp, P. troglodytes
gaagtggaattgatgg

SEQ ID NO: 242647 - DNA, 16 bp, P. troglodytes
gaagtggaattgctgg

SEQ ID NO: 242648 - DNA, 16 bp, P. troglodytes
gaagtggaggccatta

SEQ ID NO: 242649 - DNA, 16 bp, P. troglodytes
gaagtggaggctgcag

SEQ ID NO: 242650 - DNA, 16 bp, P. troglodytes
gaagtgggaagatggc

SEQ ID NO: 242651 - DNA, 16 bp, P. troglodytes
gaagtgggatttctgg

SEQ ID NO: 242652 - DNA, 16 bp, P. troglodytes
gaagtgggtggatcac

SEQ ID NO: 242653 - DNA, 16 bp, P. troglodytes
gaagtgtctgttcagg

SEQ ID NO: 242654 - DNA, 16 bp, P. troglodytes
gaagtgtgaggatcac

SEQ ID NO: 242655 - DNA, 16 bp, P. troglodytes
gaagttaaacattttt

SEQ ID NO: 242656 - DNA, 16 bp, P. troglodytes
gaagttaccctatatg

SEQ ID NO: 242657 - DNA, 16 bp, P. troglodytes
gaagttatttttaaaa

SEQ ID NO: 242658 - DNA, 16 bp, P. troglodytes
gaagttcaaaatcaag

SEQ ID NO: 242659 - DNA, 16 bp, P. troglodytes
gaagttcaagactagc

SEQ ID NO: 242660 - DNA, 16 bp, P. troglodytes
gaagttcaagagcatg

SEQ ID NO: 242661 - DNA, 16 bp, P. troglodytes
gaagttcaagatcaaa

SEQ ID NO: 242662 - DNA, 16 bp, P. troglodytes
gaagttcaagatgaag

SEQ ID NO: 242663 - DNA, 16 bp, P. troglodytes
gaagttccacactttc

SEQ ID NO: 242664 - DNA, 16 bp, P. troglodytes
gaagttccagactttc

SEQ ID NO: 242665 - DNA, 16 bp, P. troglodytes
gaagttccaggctgca

SEQ ID NO: 242666 - DNA, 16 bp, P. troglodytes
gaagttctctgaaatg

SEQ ID NO: 242667 - DNA, 16 bp, P. troglodytes
gaagttctctgacatg

SEQ ID NO: 242668 - DNA, 16 bp, P. troglodytes
gaagttctgcccactg

SEQ ID NO: 242669 - DNA, 16 bp, P. troglodytes
gaagttctgggattac

SEQ ID NO: 242670 - DNA, 16 bp, P. troglodytes
gaagttgaggcagcag

SEQ ID NO: 242671 - DNA, 17 bp, P. troglodytes
gaagttgcagtgacctg

SEQ ID NO: 242672 - DNA, 16 bp, P. troglodytes
gaagttgcagtgagcc

SEQ ID NO: 242673 - DNA, 16 bp, P. troglodytes
gaagttgcagtgagtc

SEQ ID NO: 242674 - DNA, 16 bp, P. troglodytes
gaagttggaggatcac

SEQ ID NO: 242675 - DNA, 16 bp, P. troglodytes
gaagttgtagtgagca

SEQ ID NO: 242676 - DNA, 17 bp, P. troglodytes
gaagttgtctgctgcct

SEQ ID NO: 242677 - DNA, 16 bp, P. troglodytes
gaagtttaagatcaag

SEQ ID NO: 242678 - DNA, 16 bp, P. troglodytes
gaagtttacagcaata

SEQ ID NO: 242679 - DNA, 16 bp, P. troglodytes
gaagtttcatagtttt

SEQ ID NO: 242680 - DNA, 16 bp, P. troglodytes
gaagtttcccagaatg

SEQ ID NO: 242681 - DNA, 16 bp, P. troglodytes
gaagttttaaaaatat

SEQ ID NO: 242682 - DNA, 16 bp, P. troglodytes
gaagttttctttaaaa

SEQ ID NO: 242683 - DNA, 16 bp, P. troglodytes
gaagttttgcctcatc

SEQ ID NO: 242684 - DNA, 16 bp, P. troglodytes
gaataaaacaaggatg

SEQ ID NO: 242685 - DNA, 16 bp, P. troglodytes
gaataaaacattttaa

SEQ ID NO: 242686 - DNA, 16 bp, P. troglodytes
gaataaaactataaat

SEQ ID NO: 242687 - DNA, 16 bp, P. troglodytes
gaataaaagaatgtct

SEQ ID NO: 242688 - DNA, 17 bp, P. troglodytes
gaataaaagcaggctgc

SEQ ID NO: 242689 - DNA, 16 bp, P. troglodytes
gaataaaatacctaga

SEQ ID NO: 242690 - DNA, 16 bp, P. troglodytes
gaataaaatactggca

SEQ ID NO: 242691 - DNA, 16 bp, P. troglodytes
gaataaaggtgattct

SEQ ID NO: 242692 - DNA, 16 bp, P. troglodytes
gaataaagtttatttt

SEQ ID NO: 242693 - DNA, 16 bp, P. troglodytes
gaataaatagaaaacc

SEQ ID NO: 242694 - DNA, 16 bp, P. troglodytes
gaataaatattttagg

SEQ ID NO: 242695 - DNA, 16 bp, P. troglodytes
gaataaatgattgaat

SEQ ID NO: 242696 - DNA, 16 bp, P. troglodytes
gaataaatttaatcaa

SEQ ID NO: 242697 - DNA, 16 bp, P. troglodytes
gaataaatttttgttg

SEQ ID NO: 242698 - DNA, 16 bp, P. troglodytes
gaataacagacactgg

SEQ ID NO: 242699 - DNA, 16 bp, P. troglodytes
gaataaggacataaag

SEQ ID NO: 242700 - DNA, 16 bp, P. troglodytes
gaataatattcagcaa

SEQ ID NO: 242701 - DNA, 16 bp, P. troglodytes
gaataatattttattg

SEQ ID NO: 242702 - DNA, 16 bp, P. troglodytes
gaataatgtcttttta

SEQ ID NO: 242703 - DNA, 16 bp, P. troglodytes
gaataatttgaatgtt

SEQ ID NO: 242704 - DNA, 16 bp, P. troglodytes
gaatacaaaattcttg

SEQ ID NO: 242705 - DNA, 16 bp, P. troglodytes
gaatacaggaggcaga

SEQ ID NO: 242706 - DNA, 16 bp, P. troglodytes
gaatacatttttcttt

SEQ ID NO: 242707 - DNA, 16 bp, P. troglodytes
gaatagaaggaaacta

SEQ ID NO: 242708 - DNA, 16 bp, P. troglodytes
gaatagaagtggtgat

SEQ ID NO: 242709 - DNA, 16 bp, P. troglodytes
gaatagaatatacttt

SEQ ID NO: 242710 - DNA, 16 bp, P. troglodytes
gaatagaatggtggtt

SEQ ID NO: 242711 - DNA, 16 bp, P. troglodytes
gaatagacatttcccc

SEQ ID NO: 242712 - DNA, 16 bp, P. troglodytes
gaatagcaagtgaaag

SEQ ID NO: 242713 - DNA, 16 bp, P. troglodytes
gaatagcacagaaaag

SEQ ID NO: 242714 - DNA, 16 bp, P. troglodytes
gaatagcattgaatct

SEQ ID NO: 242715 - DNA, 16 bp, P. troglodytes
gaatagctgggatcac

SEQ ID NO: 242716 - DNA, 16 bp, P. troglodytes
gaataggagtggcaag

SEQ ID NO: 242717 - DNA, 16 bp, P. troglodytes
gaatagtggtttccag

SEQ ID NO: 242718 - DNA, 16 bp, P. troglodytes
gaatataaaatcaaca

SEQ ID NO: 242719 - DNA, 16 bp, P. troglodytes
gaatataaatgcaaaa

SEQ ID NO: 242720 - DNA, 16 bp, P. troglodytes
gaatataatgaagttg

SEQ ID NO: 242721 - DNA, 16 bp, P. troglodytes
gaatatacattctttt

SEQ ID NO: 242722 - DNA, 16 bp, P. troglodytes
gaatatactacaattt

SEQ ID NO: 242723 - DNA, 16 bp, P. troglodytes
gaatatataatacata

SEQ ID NO: 242724 - DNA, 16 bp, P. troglodytes
gaatatatatggaata

SEQ ID NO: 242725 - DNA, 16 bp, P. troglodytes
gaatatatgaatgaat

SEQ ID NO: 242726 - DNA, 16 bp, P. troglodytes
gaatatatgtgtgcat

SEQ ID NO: 242727 - DNA, 16 bp, P. troglodytes
gaatatccaggacttg

SEQ ID NO: 242728 - DNA, 16 bp, P. troglodytes
gaatatctttccattt

SEQ ID NO: 242729 - DNA, 16 bp, P. troglodytes
gaatattacacagcca

SEQ ID NO: 242730 - DNA, 16 bp, P. troglodytes
gaatattatttagcca

SEQ ID NO: 242731 - DNA, 16 bp, P. troglodytes
gaatattctttttaaa

SEQ ID NO: 242732 - DNA, 16 bp, P. troglodytes
gaatatttattgagta

SEQ ID NO: 242733 - DNA, 16 bp, P. troglodytes
gaatatttattttgaa

SEQ ID NO: 242734 - DNA, 16 bp, P. troglodytes
gaatattttcaatcca

SEQ ID NO: 242735 - DNA, 16 bp, P. troglodytes
gaatattttccaaaat

SEQ ID NO: 242736 - DNA, 16 bp, P. troglodytes
gaatatttttgcattt

SEQ ID NO: 242737 - DNA, 16 bp, P. troglodytes
gaatcaaaagaaagat

SEQ ID NO: 242738 - DNA, 16 bp, P. troglodytes
gaatcaacctaagttt

SEQ ID NO: 242739 - DNA, 16 bp, P. troglodytes
gaatcaacttcttcca

SEQ ID NO: 242740 - DNA, 16 bp, P. troglodytes
gaatcaatgaagaaat

SEQ ID NO: 242741 - DNA, 16 bp, P. troglodytes
gaatcacacagtatgt

SEQ ID NO: 242742 - DNA, 16 bp, P. troglodytes
gaatcacctgaatcca

SEQ ID NO: 242743 - DNA, 16 bp, P. troglodytes
gaatcacctggagagc

SEQ ID NO: 242744 - DNA, 16 bp, P. troglodytes
gaatcactcgaacccg

SEQ ID NO: 242745 - DNA, 16 bp, P. troglodytes
gaatcagaaactctgg

SEQ ID NO: 242746 - DNA, 16 bp, P. troglodytes
gaatcagaggttgcag

SEQ ID NO: 242747 - DNA, 16 bp, P. troglodytes
gaatcagccatttttc

SEQ ID NO: 242748 - DNA, 16 bp, P. troglodytes
gaatcaggaaaaataa

SEQ ID NO: 242749 - DNA, 16 bp, P. troglodytes
gaatcaggcagcctcc

SEQ ID NO: 242750 - DNA, 16 bp, P. troglodytes
gaatcatacaaaatgt

SEQ ID NO: 242751 - DNA, 16 bp, P. troglodytes
gaatcatacaatattt

SEQ ID NO: 242752 - DNA, 32 bp, P. troglodytes
gaatcatgagtgaactcccattcacaattgct

SEQ ID NO: 242753 - DNA, 16 bp, P. troglodytes
gaatcatggcgggagg

SEQ ID NO: 242754 - DNA, 16 bp, P. troglodytes
gaatcatgggggtgtt

SEQ ID NO: 242755 - DNA, 16 bp, P. troglodytes
gaatcatgggtgtggt

SEQ ID NO: 242756 - DNA, 16 bp, P. troglodytes
gaatcatggtgggagg

SEQ ID NO: 242757 - DNA, 16 bp, P. troglodytes
gaatcattatctatgg

SEQ ID NO: 242758 - DNA, 16 bp, P. troglodytes
gaatccagaaggtgga

SEQ ID NO: 242759 - DNA, 16 bp, P. troglodytes
gaatcccaacactttg

SEQ ID NO: 242760 - DNA, 16 bp, P. troglodytes
gaatcccagcactctg

SEQ ID NO: 242761 - DNA, 16 bp, P. troglodytes
gaatcccagcacttcg

SEQ ID NO: 242762 - DNA, 19 bp, P. troglodytes
gaatcccagcactttggga

SEQ ID NO: 242763 - DNA, 16 bp, P. troglodytes
gaatcccattactggg

SEQ ID NO: 242764 - DNA, 17 bp, P. troglodytes
gaatcccggaggcagag

SEQ ID NO: 242765 - DNA, 16 bp, P. troglodytes
gaatccctcctcctca

SEQ ID NO: 242766 - DNA, 16 bp, P. troglodytes
gaatccctgggctcaa

SEQ ID NO: 242767 - DNA, 16 bp, P. troglodytes
gaatcctacttctgtc

SEQ ID NO: 242768 - DNA, 16 bp, P. troglodytes
gaatcctagcactttg

SEQ ID NO: 242769 - DNA, 16 bp, P. troglodytes
gaatccttcccccatt

SEQ ID NO: 242770 - DNA, 17 bp, P. troglodytes
gaatctacagtgaactc

SEQ ID NO: 242771 - DNA, 16 bp, P. troglodytes
gaatctacctatgacc

SEQ ID NO: 242772 - DNA, 16 bp, P. troglodytes
gaatctccaaagtgat

SEQ ID NO: 242773 - DNA, 16 bp, P. troglodytes
gaatctctgagacaca

SEQ ID NO: 242774 - DNA, 16 bp, P. troglodytes
gaatctgatgaaagct

SEQ ID NO: 242775 - DNA, 16 bp, P. troglodytes
gaatctgatgattgtg

SEQ ID NO: 242776 - DNA, 16 bp, P. troglodytes
gaatctgcattttaac

SEQ ID NO: 242777 - DNA, 16 bp, P. troglodytes
gaatctgggtgctctg

SEQ ID NO: 242778 - DNA, 16 bp, P. troglodytes
gaatcttagtttggct

SEQ ID NO: 242779 - DNA, 16 bp, P. troglodytes
gaatcttcaacccaga

SEQ ID NO: 242780 - DNA, 16 bp, P. troglodytes
gaatcttgctatgttg

SEQ ID NO: 242781 - DNA, 16 bp, P. troglodytes
gaatcttgctctgtgg

SEQ ID NO: 242782 - DNA, 16 bp, P. troglodytes
gaatcttgctcttgtc

SEQ ID NO: 242783 - DNA, 16 bp, P. troglodytes
gaatctttgttttgtt

SEQ ID NO: 242784 - DNA, 16 bp, P. troglodytes
gaatcttttcatgtgc

SEQ ID NO: 242785 - DNA, 16 bp, P. troglodytes
gaatctttttatattt

SEQ ID NO: 242786 - DNA, 16 bp, P. troglodytes
gaatgaaaatgaacaa

SEQ ID NO: 242787 - DNA, 16 bp, P. troglodytes
gaatgaaaccctgtct

SEQ ID NO: 242788 - DNA, 16 bp, P. troglodytes
gaatgaaagagtgaat

SEQ ID NO: 242789 - DNA, 16 bp, P. troglodytes
gaatgaaagtgaaaat

SEQ ID NO: 242790 - DNA, 16 bp, P. troglodytes
gaatgaaataatggca

SEQ ID NO: 242791 - DNA, 16 bp, P. troglodytes
gaatgaaataatgtct

SEQ ID NO: 242792 - DNA, 16 bp, P. troglodytes
gaatgaaatcctatca

SEQ ID NO: 242793 - DNA, 16 bp, P. troglodytes
gaatgaaatggaatgg

SEQ ID NO: 242794 - DNA, 16 bp, P. troglodytes
gaatgaaattgagaca

SEQ ID NO: 242795 - DNA, 16 bp, P. troglodytes
gaatgaacaaaatctc

SEQ ID NO: 242796 - DNA, 23 bp, P. troglodytes
gaatgaacaaagcctccaagaaa

SEQ ID NO: 242797 - DNA, 16 bp, P. troglodytes
gaatgaagaaaagcaa

SEQ ID NO: 242798 - DNA, 16 bp, P. troglodytes
gaatgaagacctttat

SEQ ID NO: 242799 - DNA, 16 bp, P. troglodytes
gaatgaagccatggac

SEQ ID NO: 242800 - DNA, 16 bp, P. troglodytes
gaatgaagctggaggc

SEQ ID NO: 242801 - DNA, 16 bp, P. troglodytes
gaatgaaggacaaaat

SEQ ID NO: 242802 - DNA, 16 bp, P. troglodytes
gaatgaatatttttaa

SEQ ID NO: 242803 - DNA, 16 bp, P. troglodytes
gaatgaatgaacaaaa

SEQ ID NO: 242804 - DNA, 16 bp, P. troglodytes
gaatgaatgaagaaat

SEQ ID NO: 242805 - DNA, 16 bp, P. troglodytes
gaatgaatgaatgaat

SEQ ID NO: 242806 - DNA, 16 bp, P. troglodytes
gaatgaatgaatgact

SEQ ID NO: 242807 - DNA, 16 bp, P. troglodytes
gaatgaatgaatgagc

SEQ ID NO: 242808 - DNA, 16 bp, P. troglodytes
gaatgaatgaattcca

SEQ ID NO: 242809 - DNA, 16 bp, P. troglodytes
gaatgaatggataaac

SEQ ID NO: 242810 - DNA, 16 bp, P. troglodytes
gaatgacaactttggt

SEQ ID NO: 242811 - DNA, 16 bp, P. troglodytes
gaatgacatctttaaa

SEQ ID NO: 242812 - DNA, 16 bp, P. troglodytes
gaatgactgcatggag

SEQ ID NO: 242813 - DNA, 16 bp, P. troglodytes
gaatgactttggggta

SEQ ID NO: 242814 - DNA, 16 bp, P. troglodytes
gaatgagaacatgcaa

SEQ ID NO: 242815 - DNA, 16 bp, P. troglodytes
gaatgagaagagacag

SEQ ID NO: 242816 - DNA, 16 bp, P. troglodytes
gaatgagagaaaatat

SEQ ID NO: 242817 - DNA, 16 bp, P. troglodytes
gaatgagagaatgaat

SEQ ID NO: 242818 - DNA, 16 bp, P. troglodytes
gaatgagagagagaat

SEQ ID NO: 242819 - DNA, 16 bp, P. troglodytes
gaatgagatcatgtgc

SEQ ID NO: 242820 - DNA, 16 bp, P. troglodytes
gaatgataagaaaaca

SEQ ID NO: 242821 - DNA, 16 bp, P. troglodytes
gaatgatatttcattg

SEQ ID NO: 242822 - DNA, 16 bp, P. troglodytes
gaatgatgctttccag

SEQ ID NO: 242823 - DNA, 16 bp, P. troglodytes
gaatgattctgtctag

SEQ ID NO: 242824 - DNA, 16 bp, P. troglodytes
gaatgatttcttttcc

SEQ ID NO: 242825 - DNA, 16 bp, P. troglodytes
gaatgcaaaaataaat

SEQ ID NO: 242826 - DNA, 16 bp, P. troglodytes
gaatgcaatggtgtaa

SEQ ID NO: 242827 - DNA, 16 bp, P. troglodytes
gaatgcacaatttctg

SEQ ID NO: 242828 - DNA, 16 bp, P. troglodytes
gaatgcagctggaggc

SEQ ID NO: 242829 - DNA, 16 bp, P. troglodytes
gaatgcaggcagcctc

SEQ ID NO: 242830 - DNA, 16 bp, P. troglodytes
gaatgccaaggactgc

SEQ ID NO: 242831 - DNA, 16 bp, P. troglodytes
gaatgcctggactcaa

SEQ ID NO: 242832 - DNA, 16 bp, P. troglodytes
gaatgctgtgctggga

SEQ ID NO: 242833 - DNA, 18 bp, P. troglodytes
gaatgcttgtgatttttg

SEQ ID NO: 242834 - DNA, 16 bp, P. troglodytes
gaatgcttgtgttttt

SEQ ID NO: 242835 - DNA, 16 bp, P. troglodytes
gaatgctttttcactg

SEQ ID NO: 242836 - DNA, 16 bp, P. troglodytes
gaatggaaaaaatatt

SEQ ID NO: 242837 - DNA, 16 bp, P. troglodytes
gaatggaaggaaatat

SEQ ID NO: 242838 - DNA, 16 bp, P. troglodytes
gaatggaagtggtgag

SEQ ID NO: 242839 - DNA, 16 bp, P. troglodytes
gaatggagctggagga

SEQ ID NO: 242840 - DNA, 16 bp, P. troglodytes
gaatggagcttgcagg

SEQ ID NO: 242841 - DNA, 16 bp, P. troglodytes
gaatggaggacaaaaa

SEQ ID NO: 242842 - DNA, 16 bp, P. troglodytes
gaatggataaacaaaa

SEQ ID NO: 242843 - DNA, 16 bp, P. troglodytes
gaatggatgaataaat

SEQ ID NO: 242844 - DNA, 16 bp, P. troglodytes
gaatggatgttgtgtt

SEQ ID NO: 242845 - DNA, 21 bp, P. troglodytes
gaatggcatgaacctaggagg

SEQ ID NO: 242846 - DNA, 16 bp, P. troglodytes
gaatggcatttctgga

SEQ ID NO: 242847 - DNA, 21 bp, P. troglodytes
gaatggcgtaaacccaggagg

SEQ ID NO: 242848 - DNA, 16 bp, P. troglodytes
gaatggcgtgagccca

SEQ ID NO: 242849 - DNA, 16 bp, P. troglodytes
gaatggctaactaaaa

SEQ ID NO: 242850 - DNA, 16 bp, P. troglodytes
gaatggctttgacaaa

SEQ ID NO: 242851 - DNA, 16 bp, P. troglodytes
gaatgggaacatcaca

SEQ ID NO: 242852 - DNA, 16 bp, P. troglodytes
gaatgggaagaaatat

SEQ ID NO: 242853 - DNA, 16 bp, P. troglodytes
gaatgggagaaaaatt

SEQ ID NO: 242854 - DNA, 16 bp, P. troglodytes
gaatgggattagtgct

SEQ ID NO: 242855 - DNA, 16 bp, P. troglodytes
gaatgggcaaaagctg

SEQ ID NO: 242856 - DNA, 16 bp, P. troglodytes
gaatggggaacctcac

SEQ ID NO: 242857 - DNA, 16 bp, P. troglodytes
gaatggggaatgctga

SEQ ID NO: 242858 - DNA, 16 bp, P. troglodytes
gaatggggagatgttg

SEQ ID NO: 242859 - DNA, 16 bp, P. troglodytes
gaatggtgaaatcatt

SEQ ID NO: 242860 - DNA, 16 bp, P. troglodytes
gaatggtgccatattg

SEQ ID NO: 242861 - DNA, 16 bp, P. troglodytes
gaatggtgcctggcac

SEQ ID NO: 242862 - DNA, 16 bp, P. troglodytes
gaatggtgctgcagtg

SEQ ID NO: 242863 - DNA, 16 bp, P. troglodytes
gaatgtaaaatatctt

SEQ ID NO: 242864 - DNA, 16 bp, P. troglodytes
gaatgtaaacaaattt

SEQ ID NO: 242865 - DNA, 16 bp, P. troglodytes
gaatgtaaggaatgtg

SEQ ID NO: 242866 - DNA, 16 bp, P. troglodytes
gaatgtacaacacaaa

SEQ ID NO: 242867 - DNA, 16 bp, P. troglodytes
gaatgtacattcttct

SEQ ID NO: 242868 - DNA, 16 bp, P. troglodytes
gaatgtattccttcta

SEQ ID NO: 242869 - DNA, 16 bp, P. troglodytes
gaatgtcattggcatt

SEQ ID NO: 242870 - DNA, 17 bp, P. troglodytes
gaatgtctcggtgtaaa

SEQ ID NO: 242871 - DNA, 16 bp, P. troglodytes
gaatgtctttattttg

SEQ ID NO: 242872 - DNA, 16 bp, P. troglodytes
gaatgtgaaggcccag

SEQ ID NO: 242873 - DNA, 16 bp, P. troglodytes
gaatgtgacctttttt

SEQ ID NO: 242874 - DNA, 16 bp, P. troglodytes
gaatgtgcaaaagctg

SEQ ID NO: 242875 - DNA, 16 bp, P. troglodytes
gaatgtggcttttgtt

SEQ ID NO: 242876 - DNA, 16 bp, P. troglodytes
gaatgtgtattttgca

SEQ ID NO: 242877 - DNA, 16 bp, P. troglodytes
gaatgttcatagaagc

SEQ ID NO: 242878 - DNA, 16 bp, P. troglodytes
gaatgttcatggcagc

SEQ ID NO: 242879 - DNA, 16 bp, P. troglodytes
gaatgttctggaatta

SEQ ID NO: 242880 - DNA, 16 bp, P. troglodytes
gaatgttcttccccca

SEQ ID NO: 242881 - DNA, 16 bp, P. troglodytes
gaatgttgaattttat

SEQ ID NO: 242882 - DNA, 16 bp, P. troglodytes
gaatgtttccaacctg

SEQ ID NO: 242883 - DNA, 16 bp, P. troglodytes
gaatgtttgtaacaca

SEQ ID NO: 242884 - DNA, 16 bp, P. troglodytes
gaattaaaaatgtttt

SEQ ID NO: 242885 - DNA, 16 bp, P. troglodytes
gaattaaactaaaaat

SEQ ID NO: 242886 - DNA, 16 bp, P. troglodytes
gaattaaatgagaaat

SEQ ID NO: 242887 - DNA, 16 bp, P. troglodytes
gaattaatattgtgaa

SEQ ID NO: 242888 - DNA, 16 bp, P. troglodytes
gaattaatattgttga

SEQ ID NO: 242889 - DNA, 16 bp, P. troglodytes
gaattaattaatgaat

SEQ ID NO: 242890 - DNA, 16 bp, P. troglodytes
gaattactgagtcaaa

SEQ ID NO: 242891 - DNA, 16 bp, P. troglodytes
gaattagaaataccat

SEQ ID NO: 242892 - DNA, 16 bp, P. troglodytes
gaattagaagtggagc

SEQ ID NO: 242893 - DNA, 16 bp, P. troglodytes
gaattagccaggcatg

SEQ ID NO: 242894 - DNA, 16 bp, P. troglodytes
gaattagctgggtgtg

SEQ ID NO: 242895 - DNA, 16 bp, P. troglodytes
gaattagtaatttaaa

SEQ ID NO: 242896 - DNA, 16 bp, P. troglodytes
gaattataaaaacaga

SEQ ID NO: 242897 - DNA, 16 bp, P. troglodytes
gaattataatccccaa

SEQ ID NO: 242898 - DNA, 16 bp, P. troglodytes
gaattatacaatattt

SEQ ID NO: 242899 - DNA, 16 bp, P. troglodytes
gaattatataatatgt

SEQ ID NO: 242900 - DNA, 16 bp, P. troglodytes
gaattattttgataaa

SEQ ID NO: 242901 - DNA, 16 bp, P. troglodytes
gaattattttgtttct

SEQ ID NO: 242902 - DNA, 16 bp, P. troglodytes
gaattcaaacccagat

SEQ ID NO: 242903 - DNA, 16 bp, P. troglodytes
gaattcaacaatatat

SEQ ID NO: 242904 - DNA, 16 bp, P. troglodytes
gaattcagctctggac

SEQ ID NO: 242905 - DNA, 16 bp, P. troglodytes
gaattcataatttaaa

SEQ ID NO: 242906 - DNA, 16 bp, P. troglodytes
gaattcataattttaa

SEQ ID NO: 242907 - DNA, 16 bp, P. troglodytes
gaattccagaaaaaga

SEQ ID NO: 242908 - DNA, 16 bp, P. troglodytes
gaattcctggaaacat

SEQ ID NO: 242909 - DNA, 16 bp, P. troglodytes
gaattcctggcctcaa

SEQ ID NO: 242910 - DNA, 16 bp, P. troglodytes
gaattccttcagtttt

SEQ ID NO: 242911 - DNA, 17 bp, P. troglodytes
gaattccttgaacctgg

SEQ ID NO: 242912 - DNA, 16 bp, P. troglodytes
gaattctaatttgatt

SEQ ID NO: 242913 - DNA, 16 bp, P. troglodytes
gaattctaccaaatat

SEQ ID NO: 242914 - DNA, 16 bp, P. troglodytes
gaattctcactctctg

SEQ ID NO: 242915 - DNA, 16 bp, P. troglodytes
gaattctctgtactat

SEQ ID NO: 242916 - DNA, 16 bp, P. troglodytes
gaattctggggagaca

SEQ ID NO: 242917 - DNA, 16 bp, P. troglodytes
gaattcttccaaactc

SEQ ID NO: 242918 - DNA, 16 bp, P. troglodytes
gaattctttatatatt

SEQ ID NO: 242919 - DNA, 16 bp, P. troglodytes
gaattgaagaaaatat

SEQ ID NO: 242920 - DNA, 16 bp, P. troglodytes
gaattgaattgaattg

SEQ ID NO: 242921 - DNA, 16 bp, P. troglodytes
gaattgacacttttat

SEQ ID NO: 242922 - DNA, 16 bp, P. troglodytes
gaattgacccttttat

SEQ ID NO: 242923 - DNA, 16 bp, P. troglodytes
gaattgagagtccaga

SEQ ID NO: 242924 - DNA, 16 bp, P. troglodytes
gaattgagtgttgtga

SEQ ID NO: 242925 - DNA, 16 bp, P. troglodytes
gaattgccagaaaaaa

SEQ ID NO: 242926 - DNA, 16 bp, P. troglodytes
gaattgcccatcccag

SEQ ID NO: 242927 - DNA, 16 bp, P. troglodytes
gaattgcttgaggcca

SEQ ID NO: 242928 - DNA, 16 bp, P. troglodytes
gaattggaagaattaa

SEQ ID NO: 242929 - DNA, 16 bp, P. troglodytes
gaattggaagccatta

SEQ ID NO: 242930 - DNA, 16 bp, P. troglodytes
gaattggttccttcca

SEQ ID NO: 242931 - DNA, 16 bp, P. troglodytes
gaattgtaattcccat

SEQ ID NO: 242932 - DNA, 16 bp, P. troglodytes
gaattgtacatttaaa

SEQ ID NO: 242933 - DNA, 16 bp, P. troglodytes
gaattgtatgatatgt

SEQ ID NO: 242934 - DNA, 16 bp, P. troglodytes
gaattgtcttggcacc

SEQ ID NO: 242935 - DNA, 16 bp, P. troglodytes
gaattgttttgtagct

SEQ ID NO: 242936 - DNA, 16 bp, P. troglodytes
gaatttaaaaattagc

SEQ ID NO: 242937 - DNA, 16 bp, P. troglodytes
gaatttactaaatgga

SEQ ID NO: 242938 - DNA, 16 bp, P. troglodytes
gaatttatccatctct

SEQ ID NO: 242939 - DNA, 16 bp, P. troglodytes
gaatttattaaggagt

SEQ ID NO: 242940 - DNA, 16 bp, P. troglodytes
gaatttattcatctct

SEQ ID NO: 242941 - DNA, 16 bp, P. troglodytes
gaatttcaaaagaaat

SEQ ID NO: 242942 - DNA, 16 bp, P. troglodytes
gaatttcaaaatataa

SEQ ID NO: 242943 - DNA, 16 bp, P. troglodytes
gaatttcaaataattt

SEQ ID NO: 242944 - DNA, 16 bp, P. troglodytes
gaatttcactcttgtt

SEQ ID NO: 242945 - DNA, 16 bp, P. troglodytes
gaatttcatcatgttg

SEQ ID NO: 242946 - DNA, 16 bp, P. troglodytes
gaatttcattgagctt

SEQ ID NO: 242947 - DNA, 16 bp, P. troglodytes
gaatttcattgagttt

SEQ ID NO: 242948 - DNA, 16 bp, P. troglodytes
gaatttcctcctgtag

SEQ ID NO: 242949 - DNA, 16 bp, P. troglodytes
gaatttctgcttggtt

SEQ ID NO: 242950 - DNA, 16 bp, P. troglodytes
gaatttctgttgtttt

SEQ ID NO: 242951 - DNA, 16 bp, P. troglodytes
gaatttcttatgtctt

SEQ ID NO: 242952 - DNA, 16 bp, P. troglodytes
gaatttcttcccagaa

SEQ ID NO: 242953 - DNA, 16 bp, P. troglodytes
gaatttcttctgccag

SEQ ID NO: 242954 - DNA, 16 bp, P. troglodytes
gaatttcttttcttta

SEQ ID NO: 242955 - DNA, 16 bp, P. troglodytes
gaatttgaaattattt

SEQ ID NO: 242956 - DNA, 16 bp, P. troglodytes
gaatttgacaattatg

SEQ ID NO: 242957 - DNA, 16 bp, P. troglodytes
gaatttgatttaaaaa

SEQ ID NO: 242958 - DNA, 16 bp, P. troglodytes
gaatttgcatgtctaa

SEQ ID NO: 242959 - DNA, 16 bp, P. troglodytes
gaatttgcatttcaaa

SEQ ID NO: 242960 - DNA, 16 bp, P. troglodytes
gaatttggagtctgat

SEQ ID NO: 242961 - DNA, 16 bp, P. troglodytes
gaatttgtcaccagca

SEQ ID NO: 242962 - DNA, 16 bp, P. troglodytes
gaatttgttagaaatg

SEQ ID NO: 242963 - DNA, 16 bp, P. troglodytes
gaatttgttttcttaa

SEQ ID NO: 242964 - DNA, 16 bp, P. troglodytes
gaattttaaaaatgtg

SEQ ID NO: 242965 - DNA, 16 bp, P. troglodytes
gaattttaaaatgttt

SEQ ID NO: 242966 - DNA, 16 bp, P. troglodytes
gaattttcaaaagaaa

SEQ ID NO: 242967 - DNA, 16 bp, P. troglodytes
gaattttcaacacaga

SEQ ID NO: 242968 - DNA, 17 bp, P. troglodytes
gaattttcagcttttct

SEQ ID NO: 242969 - DNA, 16 bp, P. troglodytes
gaattttccaattttc

SEQ ID NO: 242970 - DNA, 16 bp, P. troglodytes
gaattttccacttgtg

SEQ ID NO: 242971 - DNA, 16 bp, P. troglodytes
gaattttggacttgca

SEQ ID NO: 242972 - DNA, 16 bp, P. troglodytes
gaattttgtttaaaaa

SEQ ID NO: 242973 - DNA, 16 bp, P. troglodytes
gaatttttaaaggaaa

SEQ ID NO: 242974 - DNA, 16 bp, P. troglodytes
gaatttttcaattcag

SEQ ID NO: 242975 - DNA, 16 bp, P. troglodytes
gaatttttcagctcca

SEQ ID NO: 242976 - DNA, 16 bp, P. troglodytes
gaatttttcagttcca

SEQ ID NO: 242977 - DNA, 16 bp, P. troglodytes
gacaaaacaatctgta

SEQ ID NO: 242978 - DNA, 16 bp, P. troglodytes
gacaaaacttctcttt

SEQ ID NO: 242979 - DNA, 16 bp, P. troglodytes
gacaaaagaatctgaa

SEQ ID NO: 242980 - DNA, 16 bp, P. troglodytes
gacaaaattgaaaacc

SEQ ID NO: 242981 - DNA, 16 bp, P. troglodytes
gacaaacaaaatgtgg

SEQ ID NO: 242982 - DNA, 16 bp, P. troglodytes
gacaaacccaaagcca

SEQ ID NO: 242983 - DNA, 16 bp, P. troglodytes
gacaaaccctgtctct

SEQ ID NO: 242984 - DNA, 16 bp, P. troglodytes
gacaaactcttggaaa

SEQ ID NO: 242985 - DNA, 16 bp, P. troglodytes
gacaaagaaagtcatt

SEQ ID NO: 242986 - DNA, 16 bp, P. troglodytes
gacaaagaattcagaa

SEQ ID NO: 242987 - DNA, 16 bp, P. troglodytes
gacaaagagagaattc

SEQ ID NO: 242988 - DNA, 16 bp, P. troglodytes
gacaaagataccaaaa

SEQ ID NO: 242989 - DNA, 16 bp, P. troglodytes
gacaaagcaagactct

SEQ ID NO: 242990 - DNA, 16 bp, P. troglodytes
gacaaagccacagcca

SEQ ID NO: 242991 - DNA, 16 bp, P. troglodytes
gacaaagcgaaactcc

SEQ ID NO: 242992 - DNA, 16 bp, P. troglodytes
gacaaagcgagactcc

SEQ ID NO: 242993 - DNA, 16 bp, P. troglodytes
gacaaagcttccagag

SEQ ID NO: 242994 - DNA, 16 bp, P. troglodytes
gacaaaggagcaaagg

SEQ ID NO: 242995 - DNA, 16 bp, P. troglodytes
gacaaaggtcaaatat

SEQ ID NO: 242996 - DNA, 16 bp, P. troglodytes
gacaaaggtgcaaaag

SEQ ID NO: 242997 - DNA, 16 bp, P. troglodytes
gacaaagtgagactcc

SEQ ID NO: 242998 - DNA, 16 bp, P. troglodytes
gacaaatcatgaatga

SEQ ID NO: 242999 - DNA, 16 bp, P. troglodytes
gacaacaaaatgagac

SEQ ID NO: 243000 - DNA, 16 bp, P. troglodytes
gacaacatgacaaaac

SEQ ID NO: 243001 - DNA, 16 bp, P. troglodytes
gacaaccagaggtcac

SEQ ID NO: 243002 - DNA, 17 bp, P. troglodytes
gacaaccataaggtctg

SEQ ID NO: 243003 - DNA, 16 bp, P. troglodytes
gacaacccacaggatg

SEQ ID NO: 243004 - DNA, 16 bp, P. troglodytes
gacaacctgcctgtgg

SEQ ID NO: 243005 - DNA, 16 bp, P. troglodytes
gacaactggaagcagg

SEQ ID NO: 243006 - DNA, 16 bp, P. troglodytes
gacaagagcaaaactc

SEQ ID NO: 243007 - DNA, 16 bp, P. troglodytes
gacaagagcaagactt

SEQ ID NO: 243008 - DNA, 16 bp, P. troglodytes
gacaagagcgaaactc

SEQ ID NO: 243009 - DNA, 16 bp, P. troglodytes
gacaagagtgaaaatc

SEQ ID NO: 243010 - DNA, 16 bp, P. troglodytes
gacaagagtgaaactc

SEQ ID NO: 243011 - DNA, 17 bp, P. troglodytes
gacaagagtgagactct

SEQ ID NO: 243012 - DNA, 16 bp, P. troglodytes
gacaagagtgccaaga

SEQ ID NO: 243013 - DNA, 16 bp, P. troglodytes
gacaagatggtggatc

SEQ ID NO: 243014 - DNA, 16 bp, P. troglodytes
gacaagcaaatgctgg

SEQ ID NO: 243015 - DNA, 16 bp, P. troglodytes
gacaagccaagtccct

SEQ ID NO: 243016 - DNA, 16 bp, P. troglodytes
gacaaggacttcatga

SEQ ID NO: 243017 - DNA, 16 bp, P. troglodytes
gacaaggatgctctct

SEQ ID NO: 243018 - DNA, 16 bp, P. troglodytes
gacaaggatgtggaga

SEQ ID NO: 243019 - DNA, 16 bp, P. troglodytes
gacaaggatgttcact

SEQ ID NO: 243020 - DNA, 16 bp, P. troglodytes
gacaaggctgacaaaa

SEQ ID NO: 243021 - DNA, 16 bp, P. troglodytes
gacaagggattaatag

SEQ ID NO: 243022 - DNA, 16 bp, P. troglodytes
gacaaggtctcactct

SEQ ID NO: 243023 - DNA, 16 bp, P. troglodytes
gacaaggttttaccat

SEQ ID NO: 243024 - DNA, 16 bp, P. troglodytes
gacaatctcactctgt

SEQ ID NO: 243025 - DNA, 16 bp, P. troglodytes
gacaatgcctttcaaa

SEQ ID NO: 243026 - DNA, 16 bp, P. troglodytes
gacaatggcggttttg

SEQ ID NO: 243027 - DNA, 16 bp, P. troglodytes
gacaatgggggaaatg

SEQ ID NO: 243028 - DNA, 16 bp, P. troglodytes
gacaatgggtgcagcc

SEQ ID NO: 243029 - DNA, 16 bp, P. troglodytes
gacaattcaacaataa

SEQ ID NO: 243030 - DNA, 16 bp, P. troglodytes
gacaattctgatgatt

SEQ ID NO: 243031 - DNA, 16 bp, P. troglodytes
gacaatttgactttct

SEQ ID NO: 243032 - DNA, 16 bp, P. troglodytes
gacacaaagccagaga

SEQ ID NO: 243033 - DNA, 16 bp, P. troglodytes
gacacaattggagaaa

SEQ ID NO: 243034 - DNA, 16 bp, P. troglodytes
gacacacacacacact

SEQ ID NO: 243035 - DNA, 16 bp, P. troglodytes
gacacacacagacaca

SEQ ID NO: 243036 - DNA, 16 bp, P. troglodytes
gacacacacatatata

SEQ ID NO: 243037 - DNA, 16 bp, P. troglodytes
gacacacactcacaca

SEQ ID NO: 243038 - DNA, 16 bp, P. troglodytes
gacacacagagacaca

SEQ ID NO: 243039 - DNA, 16 bp, P. troglodytes
gacacacatgcacaca

SEQ ID NO: 243040 - DNA, 16 bp, P. troglodytes
gacacacccaggaaaa

SEQ ID NO: 243041 - DNA, 16 bp, P. troglodytes
gacacagaaagaaggt

SEQ ID NO: 243042 - DNA, 16 bp, P. troglodytes
gacacagaaagacaca

SEQ ID NO: 243043 - DNA, 16 bp, P. troglodytes
gacacagagaagggaa

SEQ ID NO: 243044 - DNA, 16 bp, P. troglodytes
gacacagagacacaca

SEQ ID NO: 243045 - DNA, 16 bp, P. troglodytes
gacacagagacagaca

SEQ ID NO: 243046 - DNA, 16 bp, P. troglodytes
gacacagagaccaatg

SEQ ID NO: 243047 - DNA, 16 bp, P. troglodytes
gacacagaggcaaacc

SEQ ID NO: 243048 - DNA, 16 bp, P. troglodytes
gacacagatccaaacc

SEQ ID NO: 243049 - DNA, 16 bp, P. troglodytes
gacacagatgaagctg

SEQ ID NO: 243050 - DNA, 16 bp, P. troglodytes
gacacagcctcaggag

SEQ ID NO: 243051 - DNA, 16 bp, P. troglodytes
gacacagcgagactcc

SEQ ID NO: 243052 - DNA, 16 bp, P. troglodytes
gacacaggcacatgta

SEQ ID NO: 243053 - DNA, 16 bp, P. troglodytes
gacacagggagaggaa

SEQ ID NO: 243054 - DNA, 16 bp, P. troglodytes
gacacagggtctcact

SEQ ID NO: 243055 - DNA, 16 bp, P. troglodytes
gacacagggtcttact

SEQ ID NO: 243056 - DNA, 16 bp, P. troglodytes
gacacagtctcactct

SEQ ID NO: 243057 - DNA, 16 bp, P. troglodytes
gacacagtgagactcc

SEQ ID NO: 243058 - DNA, 16 bp, P. troglodytes
gacacagtgaggggaa

SEQ ID NO: 243059 - DNA, 16 bp, P. troglodytes
gacacagtttcactct

SEQ ID NO: 243060 - DNA, 19 bp, P. troglodytes
gacacatctgaacatctga

SEQ ID NO: 243061 - DNA, 16 bp, P. troglodytes
gacacatctgataaag

SEQ ID NO: 243062 - DNA, 16 bp, P. troglodytes
gacacatgctacagca

SEQ ID NO: 243063 - DNA, 16 bp, P. troglodytes
gacacattctgagaaa

SEQ ID NO: 243064 - DNA, 16 bp, P. troglodytes
gacaccaaatctgctg

SEQ ID NO: 243065 - DNA, 16 bp, P. troglodytes
gacaccaacaaatgga

SEQ ID NO: 243066 - DNA, 16 bp, P. troglodytes
gacaccacctcctcaa

SEQ ID NO: 243067 - DNA, 16 bp, P. troglodytes
gacaccacctcctcca

SEQ ID NO: 243068 - DNA, 16 bp, P. troglodytes
gacaccatctacctgg

SEQ ID NO: 243069 - DNA, 16 bp, P. troglodytes
gacaccctgctggatc

SEQ ID NO: 243070 - DNA, 16 bp, P. troglodytes
gacacctgtcattgga

SEQ ID NO: 243071 - DNA, 16 bp, P. troglodytes
gacaccttgattttgg

SEQ ID NO: 243072 - DNA, 18 bp, P. troglodytes
gacacgccacctttaaga

SEQ ID NO: 243073 - DNA, 16 bp, P. troglodytes
gacactatcaagagag

SEQ ID NO: 243074 - DNA, 16 bp, P. troglodytes
gacactgctgctgata

SEQ ID NO: 243075 - DNA, 16 bp, P. troglodytes
gacactggttatttta

SEQ ID NO: 243076 - DNA, 16 bp, P. troglodytes
gacactgtctacctgg

SEQ ID NO: 243077 - DNA, 16 bp, P. troglodytes
gacactgttggtggga

SEQ ID NO: 243078 - DNA, 16 bp, P. troglodytes
gacacttggggattat

SEQ ID NO: 243079 - DNA, 16 bp, P. troglodytes
gacagaaaaccagaca

SEQ ID NO: 243080 - DNA, 16 bp, P. troglodytes
gacagaaaatcagtaa

SEQ ID NO: 243081 - DNA, 16 bp, P. troglodytes
gacagaaacaagcaat

SEQ ID NO: 243082 - DNA, 16 bp, P. troglodytes
gacagaaaccatatga

SEQ ID NO: 243083 - DNA, 16 bp, P. troglodytes
gacagaaagttaaaaa

SEQ ID NO: 243084 - DNA, 16 bp, P. troglodytes
gacagaaataaagatg

SEQ ID NO: 243085 - DNA, 16 bp, P. troglodytes
gacagaaatccaaacc

SEQ ID NO: 243086 - DNA, 16 bp, P. troglodytes
gacagaacaagactcc

SEQ ID NO: 243087 - DNA, 16 bp, P. troglodytes
gacagaacgagactcc

SEQ ID NO: 243088 - DNA, 16 bp, P. troglodytes
gacagaagcagaggga

SEQ ID NO: 243089 - DNA, 16 bp, P. troglodytes
gacagaaggcaaggag

SEQ ID NO: 243090 - DNA, 16 bp, P. troglodytes
gacagaaggggaagca

SEQ ID NO: 243091 - DNA, 16 bp, P. troglodytes
gacagaaggtgaagga

SEQ ID NO: 243092 - DNA, 16 bp, P. troglodytes
gacagaatcttgctct

SEQ ID NO: 243093 - DNA, 16 bp, P. troglodytes
gacagaatcttgttct

SEQ ID NO: 243094 - DNA, 16 bp, P. troglodytes
gacagaatgaaactcc

SEQ ID NO: 243095 - DNA, 16 bp, P. troglodytes
gacagaatttttaaaa

SEQ ID NO: 243096 - DNA, 16 bp, P. troglodytes
gacagacacacataca

SEQ ID NO: 243097 - DNA, 16 bp, P. troglodytes
gacagacacagaggga

SEQ ID NO: 243098 - DNA, 16 bp, P. troglodytes
gacagacaccaaacca

SEQ ID NO: 243099 - DNA, 16 bp, P. troglodytes
gacagacagacacaga

SEQ ID NO: 243100 - DNA, 16 bp, P. troglodytes
gacagacagacagagg

SEQ ID NO: 243101 - DNA, 16 bp, P. troglodytes
gacagacagagagagg

SEQ ID NO: 243102 - DNA, 16 bp, P. troglodytes
gacagacaggcagaca

SEQ ID NO: 243103 - DNA, 16 bp, P. troglodytes
gacagacatatagatc

SEQ ID NO: 243104 - DNA, 16 bp, P. troglodytes
gacagaccacatatac

SEQ ID NO: 243105 - DNA, 16 bp, P. troglodytes
gacagaccgagactcc

SEQ ID NO: 243106 - DNA, 16 bp, P. troglodytes
gacagactgagaccct

SEQ ID NO: 243107 - DNA, 16 bp, P. troglodytes
gacagagaaaaatttg

SEQ ID NO: 243108 - DNA, 16 bp, P. troglodytes
gacagagacacaacca

SEQ ID NO: 243109 - DNA, 17 bp, P. troglodytes
gacagagaccctgtctc

SEQ ID NO: 243110 - DNA, 16 bp, P. troglodytes
gacagagactccatct

SEQ ID NO: 243111 - DNA, 16 bp, P. troglodytes
gacagagactctgtct

SEQ ID NO: 243112 - DNA, 16 bp, P. troglodytes
gacagagagaccctgt

SEQ ID NO: 243113 - DNA, 16 bp, P. troglodytes
gacagagagagaccat

SEQ ID NO: 243114 - DNA, 16 bp, P. troglodytes
gacagagagagactcc

SEQ ID NO: 243115 - DNA, 16 bp, P. troglodytes
gacagagagagactct

SEQ ID NO: 243116 - DNA, 16 bp, P. troglodytes
gacagagagaggctct

SEQ ID NO: 243117 - DNA, 16 bp, P. troglodytes
gacagagcaaaactcc

SEQ ID NO: 243118 - DNA, 16 bp, P. troglodytes
gacagagcaaaactgt

SEQ ID NO: 243119 - DNA, 16 bp, P. troglodytes
gacagagcaagacccc

SEQ ID NO: 243120 - DNA, 16 bp, P. troglodytes
gacagagcaagactcc

SEQ ID NO: 243121 - DNA, 16 bp, P. troglodytes
gacagagcaagactcg

SEQ ID NO: 243122 - DNA, 16 bp, P. troglodytes
gacagagcaagactgt

SEQ ID NO: 243123 - DNA, 16 bp, P. troglodytes
gacagagcaagatcct

SEQ ID NO: 243124 - DNA, 16 bp, P. troglodytes
gacagagcaaggcctt

SEQ ID NO: 243125 - DNA, 16 bp, P. troglodytes
gacagagcaaggctcc

SEQ ID NO: 243126 - DNA, 16 bp, P. troglodytes
gacagagcaatactcc

SEQ ID NO: 243127 - DNA, 16 bp, P. troglodytes
gacagagcatgaccct

SEQ ID NO: 243128 - DNA, 16 bp, P. troglodytes
gacagagccagaccct

SEQ ID NO: 243129 - DNA, 16 bp, P. troglodytes
gacagagccagactcc

SEQ ID NO: 243130 - DNA, 16 bp, P. troglodytes
gacagagccttgctct

SEQ ID NO: 243131 - DNA, 16 bp, P. troglodytes
gacagagcgaaactcc

SEQ ID NO: 243132 - DNA, 16 bp, P. troglodytes
gacagagcgacactcc

SEQ ID NO: 243133 - DNA, 16 bp, P. troglodytes
gacagagcgagaatcc

SEQ ID NO: 243134 - DNA, 16 bp, P. troglodytes
gacagagcgagacacc

SEQ ID NO: 243135 - DNA, 16 bp, P. troglodytes
gacagagcgagactcc

SEQ ID NO: 243136 - DNA, 16 bp, P. troglodytes
gacagagcgagattcc

SEQ ID NO: 243137 - DNA, 16 bp, P. troglodytes
gacagagcgagcctcc

SEQ ID NO: 243138 - DNA, 16 bp, P. troglodytes
gacagagctagactcc

SEQ ID NO: 243139 - DNA, 16 bp, P. troglodytes
gacagaggaagactcc

SEQ ID NO: 243140 - DNA, 16 bp, P. troglodytes
gacagaggcagagatg

SEQ ID NO: 243141 - DNA, 16 bp, P. troglodytes
gacagaggcaggagaa

SEQ ID NO: 243142 - DNA, 16 bp, P. troglodytes
gacagagggagacttg

SEQ ID NO: 243143 - DNA, 16 bp, P. troglodytes
gacagagtaagacctt

SEQ ID NO: 243144 - DNA, 16 bp, P. troglodytes
gacagagtaagactgt

SEQ ID NO: 243145 - DNA, 16 bp, P. troglodytes
gacagagtctcactct

SEQ ID NO: 243146 - DNA, 16 bp, P. troglodytes
gacagagtctcagtca

SEQ ID NO: 243147 - DNA, 16 bp, P. troglodytes
gacagagtctcagtct

SEQ ID NO: 243148 - DNA, 17 bp, P. troglodytes
gacagagtcttgctctt

SEQ ID NO: 243149 - DNA, 16 bp, P. troglodytes
gacagagtcttgctgt

SEQ ID NO: 243150 - DNA, 16 bp, P. troglodytes
gacagagtcttgttct

SEQ ID NO: 243151 - DNA, 16 bp, P. troglodytes
gacagagtgaaaccct

SEQ ID NO: 243152 - DNA, 16 bp, P. troglodytes
gacagagtgaaactcc

SEQ ID NO: 243153 - DNA, 16 bp, P. troglodytes
gacagagtgagactat

SEQ ID NO: 243154 - DNA, 16 bp, P. troglodytes
gacagagtgagactcc

SEQ ID NO: 243155 - DNA, 16 bp, P. troglodytes
gacagagtgagactgt

SEQ ID NO: 243156 - DNA, 16 bp, P. troglodytes
gacagagtgagacttg

SEQ ID NO: 243157 - DNA, 16 bp, P. troglodytes
gacagagtgaggccct

SEQ ID NO: 243158 - DNA, 16 bp, P. troglodytes
gacagagtgtgtgtgt

SEQ ID NO: 243159 - DNA, 16 bp, P. troglodytes
gacagagtgttgctct

SEQ ID NO: 243160 - DNA, 16 bp, P. troglodytes
gacagagtttcaccat

SEQ ID NO: 243161 - DNA, 17 bp, P. troglodytes
gacagagtttcactctc

SEQ ID NO: 243162 - DNA, 17 bp, P. troglodytes
gacagagtttcgctcta

SEQ ID NO: 243163 - DNA, 16 bp, P. troglodytes
gacagagtttggctct

SEQ ID NO: 243164 - DNA, 16 bp, P. troglodytes
gacagataataaacaa

SEQ ID NO: 243165 - DNA, 20 bp, P. troglodytes
gacagatcaacgagacagaa

SEQ ID NO: 243166 - DNA, 16 bp, P. troglodytes
gacagatcatcagaca

SEQ ID NO: 243167 - DNA, 16 bp, P. troglodytes
gacagatgatttctgc

SEQ ID NO: 243168 - DNA, 16 bp, P. troglodytes
gacagatggacagaca

SEQ ID NO: 243169 - DNA, 16 bp, P. troglodytes
gacagattgcctgagc

SEQ ID NO: 243170 - DNA, 16 bp, P. troglodytes
gacagattttcaccat

SEQ ID NO: 243171 - DNA, 16 bp, P. troglodytes
gacagattttttttaa

SEQ ID NO: 243172 - DNA, 16 bp, P. troglodytes
gacagcaaaaccaacc

SEQ ID NO: 243173 - DNA, 16 bp, P. troglodytes
gacagcaaaactaaaa

SEQ ID NO: 243174 - DNA, 16 bp, P. troglodytes
gacagcaagaccaacc

SEQ ID NO: 243175 - DNA, 16 bp, P. troglodytes
gacagcaagccagtga

SEQ ID NO: 243176 - DNA, 16 bp, P. troglodytes
gacagcaccactgcac

SEQ ID NO: 243177 - DNA, 16 bp, P. troglodytes
gacagcagcctggcca

SEQ ID NO: 243178 - DNA, 16 bp, P. troglodytes
gacagcatcaagccat

SEQ ID NO: 243179 - DNA, 16 bp, P. troglodytes
gacagccaagtaaaaa

SEQ ID NO: 243180 - DNA, 16 bp, P. troglodytes
gacagccatctgcaag

SEQ ID NO: 243181 - DNA, 16 bp, P. troglodytes
gacagctgaagaaagg

SEQ ID NO: 243182 - DNA, 16 bp, P. troglodytes
gacagctgctgcccac

SEQ ID NO: 243183 - DNA, 16 bp, P. troglodytes
gacagcttgcaccatg

SEQ ID NO: 243184 - DNA, 16 bp, P. troglodytes
gacagcttgcactgtg

SEQ ID NO: 243185 - DNA, 16 bp, P. troglodytes
gacaggaaaccaaaca

SEQ ID NO: 243186 - DNA, 16 bp, P. troglodytes
gacaggaagacacagt

SEQ ID NO: 243187 - DNA, 16 bp, P. troglodytes
gacaggatcaattgta

SEQ ID NO: 243188 - DNA, 16 bp, P. troglodytes
gacaggatctcagtct

SEQ ID NO: 243189 - DNA, 16 bp, P. troglodytes
gacaggatctcattct

SEQ ID NO: 243190 - DNA, 16 bp, P. troglodytes
gacaggatcttcctct

SEQ ID NO: 243191 - DNA, 16 bp, P. troglodytes
gacaggatgtcactct

SEQ ID NO: 243192 - DNA, 16 bp, P. troglodytes
gacaggattttgctgt

SEQ ID NO: 243193 - DNA, 18 bp, P. troglodytes
gacaggccccggtgtgtg

SEQ ID NO: 243194 - DNA, 16 bp, P. troglodytes
gacaggcctcagtgtg

SEQ ID NO: 243195 - DNA, 16 bp, P. troglodytes
gacaggcctggtggtg

SEQ ID NO: 243196 - DNA, 19 bp, P. troglodytes
gacaggctggtctcgaact

SEQ ID NO: 243197 - DNA, 16 bp, P. troglodytes
gacagggacagggaga

SEQ ID NO: 243198 - DNA, 16 bp, P. troglodytes
gacagggactcactct

SEQ ID NO: 243199 - DNA, 16 bp, P. troglodytes
gacagggagagactcc

SEQ ID NO: 243200 - DNA, 16 bp, P. troglodytes
gacagggcaagactcc

SEQ ID NO: 243201 - DNA, 20 bp, P. troglodytes
gacagggccaccagagggct

SEQ ID NO: 243202 - DNA, 16 bp, P. troglodytes
gacagggcgagactcc

SEQ ID NO: 243203 - DNA, 16 bp, P. troglodytes
gacagggggtctcact

SEQ ID NO: 243204 - DNA, 16 bp, P. troglodytes
gacagggtatcaccat

SEQ ID NO: 243205 - DNA, 16 bp, P. troglodytes
gacagggtttcaccat

SEQ ID NO: 243206 - DNA, 24 bp, P. troglodytes
gacagggtttcaccatgttggccg

SEQ ID NO: 243207 - DNA, 16 bp, P. troglodytes
gacagggtttcactgt

SEQ ID NO: 243208 - DNA, 16 bp, P. troglodytes
gacagggttttgtcat

SEQ ID NO: 243209 - DNA, 16 bp, P. troglodytes
gacaggtcatcaagac

SEQ ID NO: 243210 - DNA, 16 bp, P. troglodytes
gacaggtgcgtgccac

SEQ ID NO: 243211 - DNA, 16 bp, P. troglodytes
gacaggtggatggatg

SEQ ID NO: 243212 - DNA, 16 bp, P. troglodytes
gacagtatttgcaagc

SEQ ID NO: 243213 - DNA, 16 bp, P. troglodytes
gacagtcagacaagaa

SEQ ID NO: 243214 - DNA, 16 bp, P. troglodytes
gacagtctcactctgt

SEQ ID NO: 243215 - DNA, 16 bp, P. troglodytes
gacagtctgacttcct

SEQ ID NO: 243216 - DNA, 16 bp, P. troglodytes
gacagtcttgctctgt

SEQ ID NO: 243217 - DNA, 16 bp, P. troglodytes
gacagtgaaagagatc

SEQ ID NO: 243218 - DNA, 16 bp, P. troglodytes
gacagtgaccctcttc

SEQ ID NO: 243219 - DNA, 16 bp, P. troglodytes
gacagtgccactgcac

SEQ ID NO: 243220 - DNA, 18 bp, P. troglodytes
gacagtgggtgcagccca

SEQ ID NO: 243221 - DNA, 16 bp, P. troglodytes
gacagtgtggcgattc

SEQ ID NO: 243222 - DNA, 16 bp, P. troglodytes
gacagtttttccatgg

SEQ ID NO: 243223 - DNA, 16 bp, P. troglodytes
gacataaattttgggg

SEQ ID NO: 243224 - DNA, 16 bp, P. troglodytes
gacatacagagtagaa

SEQ ID NO: 243225 - DNA, 16 bp, P. troglodytes
gacatacttttttttt

SEQ ID NO: 243226 - DNA, 16 bp, P. troglodytes
gacatagatgaaattg

SEQ ID NO: 243227 - DNA, 16 bp, P. troglodytes
gacatagtgagaagtg

SEQ ID NO: 243228 - DNA, 16 bp, P. troglodytes
gacatatatatgtgtg

SEQ ID NO: 243229 - DNA, 16 bp, P. troglodytes
gacatatctgcactcc

SEQ ID NO: 243230 - DNA, 16 bp, P. troglodytes
gacatatgaaaaaatg

SEQ ID NO: 243231 - DNA, 16 bp, P. troglodytes
gacatcacatggcaag

SEQ ID NO: 243232 - DNA, 16 bp, P. troglodytes
gacatcatagatgaca

SEQ ID NO: 243233 - DNA, 16 bp, P. troglodytes
gacatccacaccaaaa

SEQ ID NO: 243234 - DNA, 16 bp, P. troglodytes
gacatcccatcacctt

SEQ ID NO: 243235 - DNA, 16 bp, P. troglodytes
gacatctttttctttt

SEQ ID NO: 243236 - DNA, 16 bp, P. troglodytes
gacatgaaagacctct

SEQ ID NO: 243237 - DNA, 16 bp, P. troglodytes
gacatgaaccactgtg

SEQ ID NO: 243238 - DNA, 18 bp, P. troglodytes
gacatgaattcatcattt

SEQ ID NO: 243239 - DNA, 16 bp, P. troglodytes
gacatgagccacctca

SEQ ID NO: 243240 - DNA, 16 bp, P. troglodytes
gacatgatggcacatg

SEQ ID NO: 243241 - DNA, 16 bp, P. troglodytes
gacatgatttccttct

SEQ ID NO: 243242 - DNA, 16 bp, P. troglodytes
gacatgctgtacaggt

SEQ ID NO: 243243 - DNA, 16 bp, P. troglodytes
gacatggaagttcatt

SEQ ID NO: 243244 - DNA, 16 bp, P. troglodytes
gacatggacacacaca

SEQ ID NO: 243245 - DNA, 16 bp, P. troglodytes
gacatggactcaacct

SEQ ID NO: 243246 - DNA, 16 bp, P. troglodytes
gacatggagaaactgg

SEQ ID NO: 243247 - DNA, 16 bp, P. troglodytes
gacatggagtcaagga

SEQ ID NO: 243248 - DNA, 16 bp, P. troglodytes
gacatggatgaagttg

SEQ ID NO: 243249 - DNA, 16 bp, P. troglodytes
gacatgggagacttca

SEQ ID NO: 243250 - DNA, 16 bp, P. troglodytes
gacatgggatttggga

SEQ ID NO: 243251 - DNA, 16 bp, P. troglodytes
gacatgggcaaagatt

SEQ ID NO: 243252 - DNA, 16 bp, P. troglodytes
gacatggtgaaacccc

SEQ ID NO: 243253 - DNA, 16 bp, P. troglodytes
gacatggtggctcagg

SEQ ID NO: 243254 - DNA, 16 bp, P. troglodytes
gacatggtttcaccac

SEQ ID NO: 243255 - DNA, 16 bp, P. troglodytes
gacattaatgcagcca

SEQ ID NO: 243256 - DNA, 16 bp, P. troglodytes
gacattacaattgata

SEQ ID NO: 243257 - DNA, 16 bp, P. troglodytes
gacattcaagtggaga

SEQ ID NO: 243258 - DNA, 16 bp, P. troglodytes
gacattcaccccattt

SEQ ID NO: 243259 - DNA, 16 bp, P. troglodytes
gacattcaggtgtttc

SEQ ID NO: 243260 - DNA, 16 bp, P. troglodytes
gacattcctccaaaga

SEQ ID NO: 243261 - DNA, 17 bp, P. troglodytes
gacattcctgccttctt

SEQ ID NO: 243262 - DNA, 16 bp, P. troglodytes
gacattctacaaaata

SEQ ID NO: 243263 - DNA, 16 bp, P. troglodytes
gacattctagaaaaga

SEQ ID NO: 243264 - DNA, 16 bp, P. troglodytes
gacattgaggcaggca

SEQ ID NO: 243265 - DNA, 16 bp, P. troglodytes
gacattgtgaatttta

SEQ ID NO: 243266 - DNA, 16 bp, P. troglodytes
gacatttcaaataaat

SEQ ID NO: 243267 - DNA, 16 bp, P. troglodytes
gacatttcatatcaat

SEQ ID NO: 243268 - DNA, 16 bp, P. troglodytes
gacatttcatatgaat

SEQ ID NO: 243269 - DNA, 16 bp, P. troglodytes
gacatttctctaaaaa

SEQ ID NO: 243270 - DNA, 16 bp, P. troglodytes
gacatttcttccacca

SEQ ID NO: 243271 - DNA, 16 bp, P. troglodytes
gacatttctttttctt

SEQ ID NO: 243272 - DNA, 16 bp, P. troglodytes
gacatttgaattgttt

SEQ ID NO: 243273 - DNA, 16 bp, P. troglodytes
gacatttgagcagaaa

SEQ ID NO: 243274 - DNA, 16 bp, P. troglodytes
gacatttggcaacatc

SEQ ID NO: 243275 - DNA, 16 bp, P. troglodytes
gacatttgggctggat

SEQ ID NO: 243276 - DNA, 16 bp, P. troglodytes
gacattttatttattt

SEQ ID NO: 243277 - DNA, 16 bp, P. troglodytes
gacattttggaaaagg

SEQ ID NO: 243278 - DNA, 16 bp, P. troglodytes
gacattttgggctgga

SEQ ID NO: 243279 - DNA, 16 bp, P. troglodytes
gacatttttattttat

SEQ ID NO: 243280 - DNA, 16 bp, P. troglodytes
gaccaaaatgttgtta

SEQ ID NO: 243281 - DNA, 16 bp, P. troglodytes
gaccaaacagattcac

SEQ ID NO: 243282 - DNA, 16 bp, P. troglodytes
gaccaaagcacagcca

SEQ ID NO: 243283 - DNA, 16 bp, P. troglodytes
gaccaacatctctcca

SEQ ID NO: 243284 - DNA, 16 bp, P. troglodytes
gaccaacatgctgaaa

SEQ ID NO: 243285 - DNA, 16 bp, P. troglodytes
gaccaacatggagaag

SEQ ID NO: 243286 - DNA, 16 bp, P. troglodytes
gaccaaccagcttcaa

SEQ ID NO: 243287 - DNA, 16 bp, P. troglodytes
gaccaacctggagaaa

SEQ ID NO: 243288 - DNA, 16 bp, P. troglodytes
gaccaacctggccaat

SEQ ID NO: 243289 - DNA, 16 bp, P. troglodytes
gaccaacgtgggcaac

SEQ ID NO: 243290 - DNA, 16 bp, P. troglodytes
gaccaatatggagaaa

SEQ ID NO: 243291 - DNA, 17 bp, P. troglodytes
gaccacaaggtcaggag

SEQ ID NO: 243292 - DNA, 16 bp, P. troglodytes
gaccacactttcagaa

SEQ ID NO: 243293 - DNA, 16 bp, P. troglodytes
gaccacactttgagaa

SEQ ID NO: 243294 - DNA, 16 bp, P. troglodytes
gaccacaggcaagcac

SEQ ID NO: 243295 - DNA, 16 bp, P. troglodytes
gaccacaggcaagtgc

SEQ ID NO: 243296 - DNA, 16 bp, P. troglodytes
gaccacaggcactcac

SEQ ID NO: 243297 - DNA, 16 bp, P. troglodytes
gaccacaggtgtgtgt

SEQ ID NO: 243298 - DNA, 16 bp, P. troglodytes
gaccacattttgctta

SEQ ID NO: 243299 - DNA, 16 bp, P. troglodytes
gaccaccaaggaaata

SEQ ID NO: 243300 - DNA, 16 bp, P. troglodytes
gaccacccagaacatg

SEQ ID NO: 243301 - DNA, 16 bp, P. troglodytes
gaccaccctgagcaac

SEQ ID NO: 243302 - DNA, 16 bp, P. troglodytes
gaccaccctggccagc

SEQ ID NO: 243303 - DNA, 16 bp, P. troglodytes
gaccacctcagcctgt

SEQ ID NO: 243304 - DNA, 16 bp, P. troglodytes
gaccacctgaagtcag

SEQ ID NO: 243305 - DNA, 17 bp, P. troglodytes
gaccacgaggtcaggag

SEQ ID NO: 243306 - DNA, 19 bp, P. troglodytes
gaccacgcccagctaattt

SEQ ID NO: 243307 - DNA, 16 bp, P. troglodytes
gaccacgccctcctct

SEQ ID NO: 243308 - DNA, 16 bp, P. troglodytes
gaccactgactcaaat

SEQ ID NO: 243309 - DNA, 16 bp, P. troglodytes
gaccacttcagcctgg

SEQ ID NO: 243310 - DNA, 16 bp, P. troglodytes
gaccagactgggcaaa

SEQ ID NO: 243311 - DNA, 16 bp, P. troglodytes
gaccagcagcatcaac

SEQ ID NO: 243312 - DNA, 16 bp, P. troglodytes
gaccagccctagccag

SEQ ID NO: 243313 - DNA, 17 bp, P. troglodytes
gaccagcctgaacaaca

SEQ ID NO: 243314 - DNA, 16 bp, P. troglodytes
gaccagcctgaccagc

SEQ ID NO: 243315 - DNA, 16 bp, P. troglodytes
gaccagcctggcccac

SEQ ID NO: 243316 - DNA, 16 bp, P. troglodytes
gaccagcctggctcac

SEQ ID NO: 243317 - DNA, 16 bp, P. troglodytes
gaccagcctggggaaa

SEQ ID NO: 243318 - DNA, 16 bp, P. troglodytes
gaccagcctggtcacc

SEQ ID NO: 243319 - DNA, 16 bp, P. troglodytes
gaccagcctgtccagc

SEQ ID NO: 243320 - DNA, 16 bp, P. troglodytes
gaccagccttgccagc

SEQ ID NO: 243321 - DNA, 16 bp, P. troglodytes
gaccagcttgggcaat

SEQ ID NO: 243322 - DNA, 16 bp, P. troglodytes
gaccaggagttcgaga

SEQ ID NO: 243323 - DNA, 16 bp, P. troglodytes
gaccaggctggagtgt

SEQ ID NO: 243324 - DNA, 16 bp, P. troglodytes
gaccaggctggccaag

SEQ ID NO: 243325 - DNA, 16 bp, P. troglodytes
gaccaggctggtctag

SEQ ID NO: 243326 - DNA, 16 bp, P. troglodytes
gaccaggctggtgtca

SEQ ID NO: 243327 - DNA, 16 bp, P. troglodytes
gaccagggaggcagag

SEQ ID NO: 243328 - DNA, 16 bp, P. troglodytes
gaccaggtggaggtga

SEQ ID NO: 243329 - DNA, 16 bp, P. troglodytes
gaccagtagcatcagc

SEQ ID NO: 243330 - DNA, 16 bp, P. troglodytes
gaccagtctgcccaac

SEQ ID NO: 243331 - DNA, 16 bp, P. troglodytes
gaccagtgaggatgag

SEQ ID NO: 243332 - DNA, 16 bp, P. troglodytes
gaccagtgatgatgat

SEQ ID NO: 243333 - DNA, 16 bp, P. troglodytes
gaccagtgtgaccaac

SEQ ID NO: 243334 - DNA, 16 bp, P. troglodytes
gaccagttaggagact

SEQ ID NO: 243335 - DNA, 25 bp, P. troglodytes
gaccataaaaaccctagaagaaaac

SEQ ID NO: 243336 - DNA, 16 bp, P. troglodytes
gaccataataaatcaa

SEQ ID NO: 243337 - DNA, 16 bp, P. troglodytes
gaccatactttgagaa

SEQ ID NO: 243338 - DNA, 16 bp, P. troglodytes
gaccatcccggccaac

SEQ ID NO: 243339 - DNA, 16 bp, P. troglodytes
gaccatggaaacccac

SEQ ID NO: 243340 - DNA, 16 bp, P. troglodytes
gaccatgtttcaaaaa

SEQ ID NO: 243341 - DNA, 16 bp, P. troglodytes
gacccaaaaatgctaa

SEQ ID NO: 243342 - DNA, 17 bp, P. troglodytes
gacccaaagagtgagca

SEQ ID NO: 243343 - DNA, 16 bp, P. troglodytes
gacccaagtctaaaca

SEQ ID NO: 243344 - DNA, 16 bp, P. troglodytes
gacccacccccatgac

SEQ ID NO: 243345 - DNA, 16 bp, P. troglodytes
gacccactgagccagg

SEQ ID NO: 243346 - DNA, 16 bp, P. troglodytes
gacccacttgaggaag

SEQ ID NO: 243347 - DNA, 16 bp, P. troglodytes
gacccagaatagccaa

SEQ ID NO: 243348 - DNA, 16 bp, P. troglodytes
gacccagcaataccat

SEQ ID NO: 243349 - DNA, 16 bp, P. troglodytes
gacccagcaatcccct

SEQ ID NO: 243350 - DNA, 16 bp, P. troglodytes
gacccaggaagtccag

SEQ ID NO: 243351 - DNA, 16 bp, P. troglodytes
gacccaggaggtggag

SEQ ID NO: 243352 - DNA, 16 bp, P. troglodytes
gacccaggcctggcca

SEQ ID NO: 243353 - DNA, 16 bp, P. troglodytes
gacccagggaggcaga

SEQ ID NO: 243354 - DNA, 16 bp, P. troglodytes
gacccagtgatctgtt

SEQ ID NO: 243355 - DNA, 16 bp, P. troglodytes
gacccatggagaattg

SEQ ID NO: 243356 - DNA, 16 bp, P. troglodytes
gacccccactcctgcc

SEQ ID NO: 243357 - DNA, 16 bp, P. troglodytes
gacccccgtgcctcct

SEQ ID NO: 243358 - DNA, 16 bp, P. troglodytes
gaccccgtgatccacc

SEQ ID NO: 243359 - DNA, 16 bp, P. troglodytes
gacccctcagctgcag

SEQ ID NO: 243360 - DNA, 16 bp, P. troglodytes
gacccctgctgggagg

SEQ ID NO: 243361 - DNA, 16 bp, P. troglodytes
gacccctggaccgacc

SEQ ID NO: 243362 - DNA, 16 bp, P. troglodytes
gaccccttcctcacac

SEQ ID NO: 243363 - DNA, 16 bp, P. troglodytes
gacccgagatcacacc

SEQ ID NO: 243364 - DNA, 16 bp, P. troglodytes
gacccgcctgggcaac

SEQ ID NO: 243365 - DNA, 16 bp, P. troglodytes
gaccctctgccttatc

SEQ ID NO: 243366 - DNA, 16 bp, P. troglodytes
gaccctgaaacttgga

SEQ ID NO: 243367 - DNA, 16 bp, P. troglodytes
gaccctgcccttctct

SEQ ID NO: 243368 - DNA, 16 bp, P. troglodytes
gaccctgcctcaaaac

SEQ ID NO: 243369 - DNA, 16 bp, P. troglodytes
gaccctgcggccctcc

SEQ ID NO: 243370 - DNA, 16 bp, P. troglodytes
gaccctggacaagtta

SEQ ID NO: 243371 - DNA, 16 bp, P. troglodytes
gaccctgggctcagcc

SEQ ID NO: 243372 - DNA, 16 bp, P. troglodytes
gaccctgtctaaaata

SEQ ID NO: 243373 - DNA, 16 bp, P. troglodytes
gaccctgtctctccaa

SEQ ID NO: 243374 - DNA, 16 bp, P. troglodytes
gaccctgtctgtattt

SEQ ID NO: 243375 - DNA, 16 bp, P. troglodytes
gaccctgtgatccgcc

SEQ ID NO: 243376 - DNA, 16 bp, P. troglodytes
gaccctgtggccttcc

SEQ ID NO: 243377 - DNA, 16 bp, P. troglodytes
gacccttgaacaacaa

SEQ ID NO: 243378 - DNA, 16 bp, P. troglodytes
gaccctttccttacac

SEQ ID NO: 243379 - DNA, 16 bp, P. troglodytes
gaccgacctggccaac

SEQ ID NO: 243380 - DNA, 16 bp, P. troglodytes
gaccgccaccacgcct

SEQ ID NO: 243381 - DNA, 16 bp, P. troglodytes
gaccggttttgtggaa

SEQ ID NO: 243382 - DNA, 16 bp, P. troglodytes
gaccgtcctggccaac

SEQ ID NO: 243383 - DNA, 16 bp, P. troglodytes
gacctaaacataaaag

SEQ ID NO: 243384 - DNA, 16 bp, P. troglodytes
gacctaaagtgatcca

SEQ ID NO: 243385 - DNA, 16 bp, P. troglodytes
gacctacagaatcaga

SEQ ID NO: 243386 - DNA, 16 bp, P. troglodytes
gacctacctggccaac

SEQ ID NO: 243387 - DNA, 16 bp, P. troglodytes
gacctactggatcaga

SEQ ID NO: 243388 - DNA, 16 bp, P. troglodytes
gacctcaagccatcca

SEQ ID NO: 243389 - DNA, 16 bp, P. troglodytes
gacctcaagccatcct

SEQ ID NO: 243390 - DNA, 16 bp, P. troglodytes
gacctcactttgagaa

SEQ ID NO: 243391 - DNA, 16 bp, P. troglodytes
gacctcagcatgggct

SEQ ID NO: 243392 - DNA, 16 bp, P. troglodytes
gacctcagctcaccgc

SEQ ID NO: 243393 - DNA, 25 bp, P. troglodytes
gacctcaggtgatctgcccgcctcg

SEQ ID NO: 243394 - DNA, 16 bp, P. troglodytes
gacctcagtttcccca

SEQ ID NO: 243395 - DNA, 16 bp, P. troglodytes
gacctcagtttcctca

SEQ ID NO: 243396 - DNA, 16 bp, P. troglodytes
gacctcatcagcctgg

SEQ ID NO: 243397 - DNA, 16 bp, P. troglodytes
gacctcatcatccacc

SEQ ID NO: 243398 - DNA, 16 bp, P. troglodytes
gacctcatctctacca

SEQ ID NO: 243399 - DNA, 16 bp, P. troglodytes
gacctcatctctgaaa

SEQ ID NO: 243400 - DNA, 16 bp, P. troglodytes
gacctcatgaactgcc

SEQ ID NO: 243401 - DNA, 16 bp, P. troglodytes
gacctccccagctcaa

SEQ ID NO: 243402 - DNA, 16 bp, P. troglodytes
gacctccctcccccag

SEQ ID NO: 243403 - DNA, 16 bp, P. troglodytes
gacctcctgggcacaa

SEQ ID NO: 243404 - DNA, 16 bp, P. troglodytes
gacctcctggtctcaa

SEQ ID NO: 243405 - DNA, 16 bp, P. troglodytes
gacctcgtgagccgcc

SEQ ID NO: 243406 - DNA, 26 bp, P. troglodytes
gacctcgtgatccacccgcctcagcc

SEQ ID NO: 243407 - DNA, 23 bp, P. troglodytes
gacctcgtgatctgcccacctca

SEQ ID NO: 243408 - DNA, 16 bp, P. troglodytes
gacctctacaaggaaa

SEQ ID NO: 243409 - DNA, 16 bp, P. troglodytes
gacctctgggcctgtg

SEQ ID NO: 243410 - DNA, 16 bp, P. troglodytes
gacctcttcaagaaga

SEQ ID NO: 243411 - DNA, 16 bp, P. troglodytes
gacctcttcaaggaaa

SEQ ID NO: 243412 - DNA, 16 bp, P. troglodytes
gacctgaagctataaa

SEQ ID NO: 243413 - DNA, 16 bp, P. troglodytes
gacctgaagctgaggg

SEQ ID NO: 243414 - DNA, 16 bp, P. troglodytes
gacctgaaggaagtga

SEQ ID NO: 243415 - DNA, 16 bp, P. troglodytes
gacctgaaggaggtga

SEQ ID NO: 243416 - DNA, 16 bp, P. troglodytes
gacctgagtgggttgc

SEQ ID NO: 243417 - DNA, 16 bp, P. troglodytes
gacctgatggggctga

SEQ ID NO: 243418 - DNA, 16 bp, P. troglodytes
gacctgcaggcacgca

SEQ ID NO: 243419 - DNA, 16 bp, P. troglodytes
gacctgcccaaggcca

SEQ ID NO: 243420 - DNA, 16 bp, P. troglodytes
gacctgcccaaggtca

SEQ ID NO: 243421 - DNA, 16 bp, P. troglodytes
gacctgccccccatga

SEQ ID NO: 243422 - DNA, 16 bp, P. troglodytes
gacctgccccttctct

SEQ ID NO: 243423 - DNA, 16 bp, P. troglodytes
gacctgccctcatgat

SEQ ID NO: 243424 - DNA, 16 bp, P. troglodytes
gacctggaagccctct

SEQ ID NO: 243425 - DNA, 16 bp, P. troglodytes
gacctggccaacatgg

SEQ ID NO: 243426 - DNA, 21 bp, P. troglodytes
gacctggggttcttggcctca

SEQ ID NO: 243427 - DNA, 16 bp, P. troglodytes
gacctggtgatctgcc

SEQ ID NO: 243428 - DNA, 16 bp, P. troglodytes
gacctgttgctggccc

SEQ ID NO: 243429 - DNA, 16 bp, P. troglodytes
gaccttccaggctcaa

SEQ ID NO: 243430 - DNA, 20 bp, P. troglodytes
gaccttcgcagtgagtgtta

SEQ ID NO: 243431 - DNA, 16 bp, P. troglodytes
gaccttctatctcatc

SEQ ID NO: 243432 - DNA, 16 bp, P. troglodytes
gaccttgaacaagtca

SEQ ID NO: 243433 - DNA, 16 bp, P. troglodytes
gaccttgagcaagtga

SEQ ID NO: 243434 - DNA, 16 bp, P. troglodytes
gaccttggaaaatctg

SEQ ID NO: 243435 - DNA, 16 bp, P. troglodytes
gaccttggacaagcca

SEQ ID NO: 243436 - DNA, 16 bp, P. troglodytes
gaccttggacaggtca

SEQ ID NO: 243437 - DNA, 16 bp, P. troglodytes
gaccttggagaagtca

SEQ ID NO: 243438 - DNA, 16 bp, P. troglodytes
gaccttgggaaagtca

SEQ ID NO: 243439 - DNA, 16 bp, P. troglodytes
gaccttgggcaagttg

SEQ ID NO: 243440 - DNA, 16 bp, P. troglodytes
gaccttgttagaaatg

SEQ ID NO: 243441 - DNA, 16 bp, P. troglodytes
gacctttctctctctc

SEQ ID NO: 243442 - DNA, 16 bp, P. troglodytes
gacctttgtcacatgc

SEQ ID NO: 243443 - DNA, 16 bp, P. troglodytes
gacgaaccttgaaaac

SEQ ID NO: 243444 - DNA, 16 bp, P. troglodytes
gacgagactccgtctc

SEQ ID NO: 243445 - DNA, 16 bp, P. troglodytes
gacgaggtttcaccat

SEQ ID NO: 243446 - DNA, 16 bp, P. troglodytes
gacgatcctggccaac

SEQ ID NO: 243447 - DNA, 16 bp, P. troglodytes
gacgcaggttgcagtg

SEQ ID NO: 243448 - DNA, 16 bp, P. troglodytes
gacggagcaagactgt

SEQ ID NO: 243449 - DNA, 16 bp, P. troglodytes
gacggaggcaggagaa

SEQ ID NO: 243450 - DNA, 16 bp, P. troglodytes
gacggagtcccactct

SEQ ID NO: 243451 - DNA, 19 bp, P. troglodytes
gacggagtctcgctttgtt

SEQ ID NO: 243452 - DNA, 16 bp, P. troglodytes
gacggagtctctctca

SEQ ID NO: 243453 - DNA, 16 bp, P. troglodytes
gacggagtcttgctgt

SEQ ID NO: 243454 - DNA, 16 bp, P. troglodytes
gacggagtttcaccat

SEQ ID NO: 243455 - DNA, 16 bp, P. troglodytes
gacggccagtgatgat

SEQ ID NO: 243456 - DNA, 16 bp, P. troglodytes
gacggcgtttcgccat

SEQ ID NO: 243457 - DNA, 16 bp, P. troglodytes
gacgggatttctccat

SEQ ID NO: 243458 - DNA, 16 bp, P. troglodytes
gacgggcacggtggct

SEQ ID NO: 243459 - DNA, 16 bp, P. troglodytes
gacgggctttcaccat

SEQ ID NO: 243460 - DNA, 16 bp, P. troglodytes
gacggggtctcgctgt

SEQ ID NO: 243461 - DNA, 16 bp, P. troglodytes
gacggggttacaccat

SEQ ID NO: 243462 - DNA, 16 bp, P. troglodytes
gacggggtttcaccac

SEQ ID NO: 243463 - DNA, 16 bp, P. troglodytes
gacggggtttcaccat

SEQ ID NO: 243464 - DNA, 30 bp, P. troglodytes
gacggggtttcaccatgttggccaggctgt

SEQ ID NO: 243465 - DNA, 16 bp, P. troglodytes
gacggggtttcacctt

SEQ ID NO: 243466 - DNA, 16 bp, P. troglodytes
gacggggtttccccat

SEQ ID NO: 243467 - DNA, 16 bp, P. troglodytes
gacggggtttcgccat

SEQ ID NO: 243468 - DNA, 16 bp, P. troglodytes
gacggggtttctccat

SEQ ID NO: 243469 - DNA, 16 bp, P. troglodytes
gacggggttttgccat

SEQ ID NO: 243470 - DNA, 16 bp, P. troglodytes
gacgggtggatcatga

SEQ ID NO: 243471 - DNA, 16 bp, P. troglodytes
gacgggtttcaccatt

SEQ ID NO: 243472 - DNA, 16 bp, P. troglodytes
gacgggttttcaccat

SEQ ID NO: 243473 - DNA, 16 bp, P. troglodytes
gacggtggctcacgcc

SEQ ID NO: 243474 - DNA, 16 bp, P. troglodytes
gacggtgtcccctgag

SEQ ID NO: 243475 - DNA, 16 bp, P. troglodytes
gacggtgtctcgctct

SEQ ID NO: 243476 - DNA, 16 bp, P. troglodytes
gacgtggatgaaattg

SEQ ID NO: 243477 - DNA, 16 bp, P. troglodytes
gacgtggtggcgggtg

SEQ ID NO: 243478 - DNA, 16 bp, P. troglodytes
gacgtggtggctcacg

SEQ ID NO: 243479 - DNA, 16 bp, P. troglodytes
gacgtgtgccaccatg

SEQ ID NO: 243480 - DNA, 16 bp, P. troglodytes
gactaaaccaggagga

SEQ ID NO: 243481 - DNA, 16 bp, P. troglodytes
gactaacatctcccca

SEQ ID NO: 243482 - DNA, 16 bp, P. troglodytes
gactaatccactccac

SEQ ID NO: 243483 - DNA, 16 bp, P. troglodytes
gactacaagtatgcac

SEQ ID NO: 243484 - DNA, 16 bp, P. troglodytes
gactacaggaacatac

SEQ ID NO: 243485 - DNA, 16 bp, P. troglodytes
gactacaggcaggtgc

SEQ ID NO: 243486 - DNA, 16 bp, P. troglodytes
gactacaggcctgtgc

SEQ ID NO: 243487 - DNA, 16 bp, P. troglodytes
gactacatttcccaga

SEQ ID NO: 243488 - DNA, 16 bp, P. troglodytes
gactaccagctgcaga

SEQ ID NO: 243489 - DNA, 16 bp, P. troglodytes
gactaccggcgcctgc

SEQ ID NO: 243490 - DNA, 16 bp, P. troglodytes
gactagcctaggcaat

SEQ ID NO: 243491 - DNA, 16 bp, P. troglodytes
gactaggagtgtgacc

SEQ ID NO: 243492 - DNA, 16 bp, P. troglodytes
gactataaaacccctg

SEQ ID NO: 243493 - DNA, 16 bp, P. troglodytes
gactatagtcaataac

SEQ ID NO: 243494 - DNA, 16 bp, P. troglodytes
gactatagttgataat

SEQ ID NO: 243495 - DNA, 18 bp, P. troglodytes
gactatgcagccataaaa

SEQ ID NO: 243496 - DNA, 16 bp, P. troglodytes
gactattctttccccc

SEQ ID NO: 243497 - DNA, 16 bp, P. troglodytes
gactcaaaatagccaa

SEQ ID NO: 243498 - DNA, 16 bp, P. troglodytes
gactcaagggctgctg

SEQ ID NO: 243499 - DNA, 16 bp, P. troglodytes
gactcaagtgaccctc

SEQ ID NO: 243500 - DNA, 16 bp, P. troglodytes
gactcacaattccaca

SEQ ID NO: 243501 - DNA, 16 bp, P. troglodytes
gactcacagccaaatt

SEQ ID NO: 243502 - DNA, 16 bp, P. troglodytes
gactcacagttccaca

SEQ ID NO: 243503 - DNA, 16 bp, P. troglodytes
gactcactgcaacttc

SEQ ID NO: 243504 - DNA, 16 bp, P. troglodytes
gactcagcagaggcag

SEQ ID NO: 243505 - DNA, 26 bp, P. troglodytes
gactcagcccacctgcacccaggtga

SEQ ID NO: 243506 - DNA, 16 bp, P. troglodytes
gactcagcctcctgag

SEQ ID NO: 243507 - DNA, 19 bp, P. troglodytes
gactcagcctgcctgcacc

SEQ ID NO: 243508 - DNA, 16 bp, P. troglodytes
gactcagccttctgag

SEQ ID NO: 243509 - DNA, 16 bp, P. troglodytes
gactccaaagcctgtg

SEQ ID NO: 243510 - DNA, 16 bp, P. troglodytes
gactccaattctgaaa

SEQ ID NO: 243511 - DNA, 16 bp, P. troglodytes
gactccacaggcaggg

SEQ ID NO: 243512 - DNA, 16 bp, P. troglodytes
gactccagaactgtga

SEQ ID NO: 243513 - DNA, 16 bp, P. troglodytes
gactccagagcccaca

SEQ ID NO: 243514 - DNA, 16 bp, P. troglodytes
gactccagagtagctg

SEQ ID NO: 243515 - DNA, 16 bp, P. troglodytes
gactccagagttccaa

SEQ ID NO: 243516 - DNA, 16 bp, P. troglodytes
gactccagcctgggcg

SEQ ID NO: 243517 - DNA, 16 bp, P. troglodytes
gactccagtctgggtg

SEQ ID NO: 243518 - DNA, 16 bp, P. troglodytes
gactccatctccaaac

SEQ ID NO: 243519 - DNA, 16 bp, P. troglodytes
gactccatctctgaaa

SEQ ID NO: 243520 - DNA, 16 bp, P. troglodytes
gactccatctttacaa

SEQ ID NO: 243521 - DNA, 16 bp, P. troglodytes
gactccatttaaaaaa

SEQ ID NO: 243522 - DNA, 16 bp, P. troglodytes
gactccccagacccct

SEQ ID NO: 243523 - DNA, 16 bp, P. troglodytes
gactccctctttttct

SEQ ID NO: 243524 - DNA, 16 bp, P. troglodytes
gactccctggttcagg

SEQ ID NO: 243525 - DNA, 17 bp, P. troglodytes
gactccgtctctacaaa

SEQ ID NO: 243526 - DNA, 16 bp, P. troglodytes
gactcctgacctcagg

SEQ ID NO: 243527 - DNA, 16 bp, P. troglodytes
gactcctgggtctgaa

SEQ ID NO: 243528 - DNA, 16 bp, P. troglodytes
gactcctgggttcaag

SEQ ID NO: 243529 - DNA, 16 bp, P. troglodytes
gactcctggttgacac

SEQ ID NO: 243530 - DNA, 16 bp, P. troglodytes
gactctctcaaaaaaa

SEQ ID NO: 243531 - DNA, 16 bp, P. troglodytes
gactctgcagatgtga

SEQ ID NO: 243532 - DNA, 16 bp, P. troglodytes
gactctgtctcagtaa

SEQ ID NO: 243533 - DNA, 16 bp, P. troglodytes
gactctgtcttaaaag

SEQ ID NO: 243534 - DNA, 16 bp, P. troglodytes
gactctgtcttggaaa

SEQ ID NO: 243535 - DNA, 16 bp, P. troglodytes
gactctgtgtggggct

SEQ ID NO: 243536 - DNA, 16 bp, P. troglodytes
gactctgtttccaaaa

SEQ ID NO: 243537 - DNA, 16 bp, P. troglodytes
gactcttgcagccaga

SEQ ID NO: 243538 - DNA, 16 bp, P. troglodytes
gactctttatccagct

SEQ ID NO: 243539 - DNA, 16 bp, P. troglodytes
gactcttttacattat

SEQ ID NO: 243540 - DNA, 16 bp, P. troglodytes
gactgaaataattaaa

SEQ ID NO: 243541 - DNA, 16 bp, P. troglodytes
gactgaagcaggtgga

SEQ ID NO: 243542 - DNA, 16 bp, P. troglodytes
gactgaagtgggagaa

SEQ ID NO: 243543 - DNA, 16 bp, P. troglodytes
gactgacagctgactt

SEQ ID NO: 243544 - DNA, 16 bp, P. troglodytes
gactgactgactgaat

SEQ ID NO: 243545 - DNA, 16 bp, P. troglodytes
gactgagacagaagaa

SEQ ID NO: 243546 - DNA, 16 bp, P. troglodytes
gactgagaccctgcct

SEQ ID NO: 243547 - DNA, 16 bp, P. troglodytes
gactgagactccatct

SEQ ID NO: 243548 - DNA, 16 bp, P. troglodytes
gactgaggcaggagat

SEQ ID NO: 243549 - DNA, 16 bp, P. troglodytes
gactgaggtccctgtt

SEQ ID NO: 243550 - DNA, 16 bp, P. troglodytes
gactgagtctccctct

SEQ ID NO: 243551 - DNA, 16 bp, P. troglodytes
gactgcagccccagct

SEQ ID NO: 243552 - DNA, 16 bp, P. troglodytes
gactgcaggtgtgcac

SEQ ID NO: 243553 - DNA, 16 bp, P. troglodytes
gactgcagtggcataa

SEQ ID NO: 243554 - DNA, 16 bp, P. troglodytes
gactgccttctttcac

SEQ ID NO: 243555 - DNA, 16 bp, P. troglodytes
gactgcggtccccaga

SEQ ID NO: 243556 - DNA, 16 bp, P. troglodytes
gactgctgggaaggca

SEQ ID NO: 243557 - DNA, 16 bp, P. troglodytes
gactgcttgagttcag

SEQ ID NO: 243558 - DNA, 16 bp, P. troglodytes
gactgcttgggcccag

SEQ ID NO: 243559 - DNA, 16 bp, P. troglodytes
gactggaaggcctcag

SEQ ID NO: 243560 - DNA, 16 bp, P. troglodytes
gactggactgcagtgg

SEQ ID NO: 243561 - DNA, 16 bp, P. troglodytes
gactggagagagaaaa

SEQ ID NO: 243562 - DNA, 16 bp, P. troglodytes
gactggagctgctcct

SEQ ID NO: 243563 - DNA, 16 bp, P. troglodytes
gactggagtgcaatgg

SEQ ID NO: 243564 - DNA, 16 bp, P. troglodytes
gactggataatttttt

SEQ ID NO: 243565 - DNA, 16 bp, P. troglodytes
gactggatcatggggg

SEQ ID NO: 243566 - DNA, 16 bp, P. troglodytes
gactggattatttcaa

SEQ ID NO: 243567 - DNA, 16 bp, P. troglodytes
gactggcaaagcagaa

SEQ ID NO: 243568 - DNA, 16 bp, P. troglodytes
gactggctgatttcac

SEQ ID NO: 243569 - DNA, 16 bp, P. troglodytes
gactgggagaagcaga

SEQ ID NO: 243570 - DNA, 17 bp, P. troglodytes
gactgggcatggtggct

SEQ ID NO: 243571 - DNA, 16 bp, P. troglodytes
gactgggctcagctgg

SEQ ID NO: 243572 - DNA, 16 bp, P. troglodytes
gactgggcttggtggc

SEQ ID NO: 243573 - DNA, 16 bp, P. troglodytes
gactggggaggcctca

SEQ ID NO: 243574 - DNA, 16 bp, P. troglodytes
gactggggtgcaatgg

SEQ ID NO: 243575 - DNA, 16 bp, P. troglodytes
gactgggtggcttgaa

SEQ ID NO: 243576 - DNA, 16 bp, P. troglodytes
gactgggtttcaccac

SEQ ID NO: 243577 - DNA, 16 bp, P. troglodytes
gactgggttttaccat

SEQ ID NO: 243578 - DNA, 16 bp, P. troglodytes
gactggtgcatttaca

SEQ ID NO: 243579 - DNA, 16 bp, P. troglodytes
gactggtgtccttata

SEQ ID NO: 243580 - DNA, 16 bp, P. troglodytes
gactgtaagcttcctg

SEQ ID NO: 243581 - DNA, 16 bp, P. troglodytes
gactgtaatttataaa

SEQ ID NO: 243582 - DNA, 16 bp, P. troglodytes
gactgtgaatggtttg

SEQ ID NO: 243583 - DNA, 16 bp, P. troglodytes
gactgtgacagtttct

SEQ ID NO: 243584 - DNA, 16 bp, P. troglodytes
gactgtgagaaataaa

SEQ ID NO: 243585 - DNA, 16 bp, P. troglodytes
gactgtggccctcttc

SEQ ID NO: 243586 - DNA, 16 bp, P. troglodytes
gactgtggtggggttg

SEQ ID NO: 243587 - DNA, 16 bp, P. troglodytes
gactgtgtctcaagaa

SEQ ID NO: 243588 - DNA, 16 bp, P. troglodytes
gactgtgttccttctg

SEQ ID NO: 243589 - DNA, 16 bp, P. troglodytes
gactgttaaaaaaaaa

SEQ ID NO: 243590 - DNA, 16 bp, P. troglodytes
gactgttccttttgcc

SEQ ID NO: 243591 - DNA, 16 bp, P. troglodytes
gactgtttttatttct

SEQ ID NO: 243592 - DNA, 16 bp, P. troglodytes
gacttaaagtgagaga

SEQ ID NO: 243593 - DNA, 16 bp, P. troglodytes
gacttaactgtaaaac

SEQ ID NO: 243594 - DNA, 16 bp, P. troglodytes
gacttattttcctttg

SEQ ID NO: 243595 - DNA, 16 bp, P. troglodytes
gacttatttttattat

SEQ ID NO: 243596 - DNA, 16 bp, P. troglodytes
gacttcaaaacatatt

SEQ ID NO: 243597 - DNA, 16 bp, P. troglodytes
gacttcaccttgtgat

SEQ ID NO: 243598 - DNA, 16 bp, P. troglodytes
gacttcagtgaaggaa

SEQ ID NO: 243599 - DNA, 16 bp, P. troglodytes
gacttcataaaaatta

SEQ ID NO: 243600 - DNA, 16 bp, P. troglodytes
gacttcatgaccaaaa

SEQ ID NO: 243601 - DNA, 16 bp, P. troglodytes
gacttcattaaaatta

SEQ ID NO: 243602 - DNA, 16 bp, P. troglodytes
gacttccagctccatc

SEQ ID NO: 243603 - DNA, 16 bp, P. troglodytes
gacttccagtataatg

SEQ ID NO: 243604 - DNA, 16 bp, P. troglodytes
gacttccagtcaacag

SEQ ID NO: 243605 - DNA, 16 bp, P. troglodytes
gacttcctctctttct

SEQ ID NO: 243606 - DNA, 16 bp, P. troglodytes
gacttcctgcctccag

SEQ ID NO: 243607 - DNA, 16 bp, P. troglodytes
gacttcctggaggaag

SEQ ID NO: 243608 - DNA, 16 bp, P. troglodytes
gacttcctgggctgaa

SEQ ID NO: 243609 - DNA, 21 bp, P. troglodytes
gacttcctgggtcgagtgggg

SEQ ID NO: 243610 - DNA, 16 bp, P. troglodytes
gacttccttcttttta

SEQ ID NO: 243611 - DNA, 16 bp, P. troglodytes
gacttcgtgatctgcc

SEQ ID NO: 243612 - DNA, 16 bp, P. troglodytes
gacttctcagcctcca

SEQ ID NO: 243613 - DNA, 16 bp, P. troglodytes
gacttctcagcctcct

SEQ ID NO: 243614 - DNA, 16 bp, P. troglodytes
gacttctgacttccag

SEQ ID NO: 243615 - DNA, 18 bp, P. troglodytes
gacttcttcctggtttag

SEQ ID NO: 243616 - DNA, 16 bp, P. troglodytes
gacttgaaaatatttt

SEQ ID NO: 243617 - DNA, 16 bp, P. troglodytes
gacttgaacatctgtg

SEQ ID NO: 243618 - DNA, 16 bp, P. troglodytes
gacttgagaccaggag

SEQ ID NO: 243619 - DNA, 16 bp, P. troglodytes
gacttgcaccctctga

SEQ ID NO: 243620 - DNA, 16 bp, P. troglodytes
gacttgcatggggcct

SEQ ID NO: 243621 - DNA, 16 bp, P. troglodytes
gacttgctcaaagtca

SEQ ID NO: 243622 - DNA, 16 bp, P. troglodytes
gacttgctgagtcttc

SEQ ID NO: 243623 - DNA, 16 bp, P. troglodytes
gacttgctttgtggcc

SEQ ID NO: 243624 - DNA, 16 bp, P. troglodytes
gacttggactgagcca

SEQ ID NO: 243625 - DNA, 16 bp, P. troglodytes
gacttggatttttttt

SEQ ID NO: 243626 - DNA, 16 bp, P. troglodytes
gacttgggagtgtcca

SEQ ID NO: 243627 - DNA, 16 bp, P. troglodytes
gacttggtgggaggtg

SEQ ID NO: 243628 - DNA, 16 bp, P. troglodytes
gacttgtccaaggtca

SEQ ID NO: 243629 - DNA, 16 bp, P. troglodytes
gacttgtcttgtctca

SEQ ID NO: 243630 - DNA, 16 bp, P. troglodytes
gacttgttttgtgacc

SEQ ID NO: 243631 - DNA, 16 bp, P. troglodytes
gactttactttttaaa

SEQ ID NO: 243632 - DNA, 16 bp, P. troglodytes
gactttatgtctaaaa

SEQ ID NO: 243633 - DNA, 16 bp, P. troglodytes
gactttattattattt

SEQ ID NO: 243634 - DNA, 16 bp, P. troglodytes
gactttcacaatggtt

SEQ ID NO: 243635 - DNA, 16 bp, P. troglodytes
gactttctcttttcct

SEQ ID NO: 243636 - DNA, 16 bp, P. troglodytes
gactttgagaggccaa

SEQ ID NO: 243637 - DNA, 16 bp, P. troglodytes
gactttgcattggaac

SEQ ID NO: 243638 - DNA, 16 bp, P. troglodytes
gactttgcggcaccta

SEQ ID NO: 243639 - DNA, 16 bp, P. troglodytes
gactttgctcttcatt

SEQ ID NO: 243640 - DNA, 16 bp, P. troglodytes
gactttggacttggac

SEQ ID NO: 243641 - DNA, 16 bp, P. troglodytes
gactttgggaggccga

SEQ ID NO: 243642 - DNA, 16 bp, P. troglodytes
gactttgggcaagtga

SEQ ID NO: 243643 - DNA, 16 bp, P. troglodytes
gactttggggggctgt

SEQ ID NO: 243644 - DNA, 16 bp, P. troglodytes
gactttgtaaacactg

SEQ ID NO: 243645 - DNA, 16 bp, P. troglodytes
gacttttattttaaaa

SEQ ID NO: 243646 - DNA, 16 bp, P. troglodytes
gacttttcatcagaaa

SEQ ID NO: 243647 - DNA, 16 bp, P. troglodytes
gactttttaaaaaaaa

SEQ ID NO: 243648 - DNA, 16 bp, P. troglodytes
gactttttaaaaaaat

SEQ ID NO: 243649 - DNA, 16 bp, P. troglodytes
gactttttaaaaaatg

SEQ ID NO: 243650 - DNA, 16 bp, P. troglodytes
gactttttaacaaaag

SEQ ID NO: 243651 - DNA, 16 bp, P. troglodytes
gactttttagtaataa

SEQ ID NO: 243652 - DNA, 16 bp, P. troglodytes
gacttttttaaagctg

SEQ ID NO: 243653 - DNA, 16 bp, P. troglodytes
gacttttttaatgatt

SEQ ID NO: 243654 - DNA, 16 bp, P. troglodytes
gactttttttggtttg

SEQ ID NO: 243655 - DNA, 16 bp, P. troglodytes
gagaaaaaccacatga

SEQ ID NO: 243656 - DNA, 16 bp, P. troglodytes
gagaaaaaccatatga

SEQ ID NO: 243657 - DNA, 16 bp, P. troglodytes
gagaaaaagaagtcat

SEQ ID NO: 243658 - DNA, 16 bp, P. troglodytes
gagaaaaatcattttt

SEQ ID NO: 243659 - DNA, 16 bp, P. troglodytes
gagaaaaatctttaaa

SEQ ID NO: 243660 - DNA, 16 bp, P. troglodytes
gagaaaaatgttgcaa

SEQ ID NO: 243661 - DNA, 16 bp, P. troglodytes
gagaaaaattttaaag

SEQ ID NO: 243662 - DNA, 16 bp, P. troglodytes
gagaaaacagaattca

SEQ ID NO: 243663 - DNA, 16 bp, P. troglodytes
gagaaaacatttgcaa

SEQ ID NO: 243664 - DNA, 16 bp, P. troglodytes
gagaaaactcaaagaa

SEQ ID NO: 243665 - DNA, 16 bp, P. troglodytes
gagaaaactgaagctc

SEQ ID NO: 243666 - DNA, 16 bp, P. troglodytes
gagaaaactgaggcca

SEQ ID NO: 243667 - DNA, 16 bp, P. troglodytes
gagaaaactgaggctt

SEQ ID NO: 243668 - DNA, 16 bp, P. troglodytes
gagaaaagtgaacact

SEQ ID NO: 243669 - DNA, 16 bp, P. troglodytes
gagaaaataaacatct

SEQ ID NO: 243670 - DNA, 16 bp, P. troglodytes
gagaaaatatgtgtgt

SEQ ID NO: 243671 - DNA, 16 bp, P. troglodytes
gagaaaatatttgaaa

SEQ ID NO: 243672 - DNA, 16 bp, P. troglodytes
gagaaaatgaaatcat

SEQ ID NO: 243673 - DNA, 16 bp, P. troglodytes
gagaaaatgaattttt

SEQ ID NO: 243674 - DNA, 16 bp, P. troglodytes
gagaaaatggaagcaa

SEQ ID NO: 243675 - DNA, 16 bp, P. troglodytes
gagaaaatggtttcat

SEQ ID NO: 243676 - DNA, 16 bp, P. troglodytes
gagaaaatgtttgcag

SEQ ID NO: 243677 - DNA, 16 bp, P. troglodytes
gagaaaatttttcttt

SEQ ID NO: 243678 - DNA, 16 bp, P. troglodytes
gagaaacaaaggcagt

SEQ ID NO: 243679 - DNA, 16 bp, P. troglodytes
gagaaacagaaccagc

SEQ ID NO: 243680 - DNA, 16 bp, P. troglodytes
gagaaacatagtgaga

SEQ ID NO: 243681 - DNA, 16 bp, P. troglodytes
gagaaacatttatttt

SEQ ID NO: 243682 - DNA, 16 bp, P. troglodytes
gagaaaccccatctcc

SEQ ID NO: 243683 - DNA, 16 bp, P. troglodytes
gagaaaccctataaat

SEQ ID NO: 243684 - DNA, 16 bp, P. troglodytes
gagaaaccctgctgta

SEQ ID NO: 243685 - DNA, 16 bp, P. troglodytes
gagaaacctaaagact

SEQ ID NO: 243686 - DNA, 16 bp, P. troglodytes
gagaaactagaaaaac

SEQ ID NO: 243687 - DNA, 16 bp, P. troglodytes
gagaaactgaaactct

SEQ ID NO: 243688 - DNA, 16 bp, P. troglodytes
gagaaactgaaagaaa

SEQ ID NO: 243689 - DNA, 16 bp, P. troglodytes
gagaaactgaaagcct

SEQ ID NO: 243690 - DNA, 16 bp, P. troglodytes
gagaaactgaagcaca

SEQ ID NO: 243691 - DNA, 16 bp, P. troglodytes
gagaaactggaactct

SEQ ID NO: 243692 - DNA, 16 bp, P. troglodytes
gagaaagaaactcaga

SEQ ID NO: 243693 - DNA, 16 bp, P. troglodytes
gagaaagaaataaagc

SEQ ID NO: 243694 - DNA, 16 bp, P. troglodytes
gagaaagacagaaata

SEQ ID NO: 243695 - DNA, 16 bp, P. troglodytes
gagaaagaccctgtct

SEQ ID NO: 243696 - DNA, 16 bp, P. troglodytes
gagaaagagaatgcat

SEQ ID NO: 243697 - DNA, 16 bp, P. troglodytes
gagaaagagactgaaa

SEQ ID NO: 243698 - DNA, 16 bp, P. troglodytes
gagaaagagagagcca

SEQ ID NO: 243699 - DNA, 16 bp, P. troglodytes
gagaaagagctccaga

SEQ ID NO: 243700 - DNA, 16 bp, P. troglodytes
gagaaagagggaatcc

SEQ ID NO: 243701 - DNA, 16 bp, P. troglodytes
gagaaagagtttaatt

SEQ ID NO: 243702 - DNA, 16 bp, P. troglodytes
gagaaagatgaagacc

SEQ ID NO: 243703 - DNA, 16 bp, P. troglodytes
gagaaagatggaggct

SEQ ID NO: 243704 - DNA, 16 bp, P. troglodytes
gagaaagatgtaggct

SEQ ID NO: 243705 - DNA, 16 bp, P. troglodytes
gagaaaggaaaatatt

SEQ ID NO: 243706 - DNA, 16 bp, P. troglodytes
gagaaaggaatcaaac

SEQ ID NO: 243707 - DNA, 16 bp, P. troglodytes
gagaaaggagaactct

SEQ ID NO: 243708 - DNA, 16 bp, P. troglodytes
gagaaaggagagccag

SEQ ID NO: 243709 - DNA, 16 bp, P. troglodytes
gagaaaggccagatca

SEQ ID NO: 243710 - DNA, 16 bp, P. troglodytes
gagaaagtcaacaaag

SEQ ID NO: 243711 - DNA, 16 bp, P. troglodytes
gagaaataaatgtctt

SEQ ID NO: 243712 - DNA, 16 bp, P. troglodytes
gagaaataaattcctt

SEQ ID NO: 243713 - DNA, 16 bp, P. troglodytes
gagaaataattttcta

SEQ ID NO: 243714 - DNA, 16 bp, P. troglodytes
gagaaatacaaatcaa

SEQ ID NO: 243715 - DNA, 16 bp, P. troglodytes
gagaaatacatcatta

SEQ ID NO: 243716 - DNA, 16 bp, P. troglodytes
gagaaatatgagatta

SEQ ID NO: 243717 - DNA, 22 bp, P. troglodytes
gagaaatattgctgaattcttt

SEQ ID NO: 243718 - DNA, 16 bp, P. troglodytes
gagaaatatttgtaaa

SEQ ID NO: 243719 - DNA, 16 bp, P. troglodytes
gagaaatcaatttctg

SEQ ID NO: 243720 - DNA, 16 bp, P. troglodytes
gagaaatcgagcacag

SEQ ID NO: 243721 - DNA, 16 bp, P. troglodytes
gagaaatctttttttt

SEQ ID NO: 243722 - DNA, 16 bp, P. troglodytes
gagaaatgaaacagga

SEQ ID NO: 243723 - DNA, 16 bp, P. troglodytes
gagaaatgaaacatat

SEQ ID NO: 243724 - DNA, 16 bp, P. troglodytes
gagaaatgaggtcaca

SEQ ID NO: 243725 - DNA, 16 bp, P. troglodytes
gagaaatggagtcaaa

SEQ ID NO: 243726 - DNA, 16 bp, P. troglodytes
gagaaatgtctatcca

SEQ ID NO: 243727 - DNA, 16 bp, P. troglodytes
gagaaattcaagctag

SEQ ID NO: 243728 - DNA, 16 bp, P. troglodytes
gagaaattgaaactct

SEQ ID NO: 243729 - DNA, 16 bp, P. troglodytes
gagaaattggccaaaa

SEQ ID NO: 243730 - DNA, 16 bp, P. troglodytes
gagaaatttattttct

SEQ ID NO: 243731 - DNA, 16 bp, P. troglodytes
gagaaatttgaagatg

SEQ ID NO: 243732 - DNA, 16 bp, P. troglodytes
gagaaatttgatgatg

SEQ ID NO: 243733 - DNA, 16 bp, P. troglodytes
gagaacacacaatatt

SEQ ID NO: 243734 - DNA, 16 bp, P. troglodytes
gagaacacagagccaa

SEQ ID NO: 243735 - DNA, 17 bp, P. troglodytes
gagaacacgtggacaca

SEQ ID NO: 243736 - DNA, 16 bp, P. troglodytes
gagaacagagaaaata

SEQ ID NO: 243737 - DNA, 16 bp, P. troglodytes
gagaacagcatgagag

SEQ ID NO: 243738 - DNA, 16 bp, P. troglodytes
gagaacagcatgggtg

SEQ ID NO: 243739 - DNA, 16 bp, P. troglodytes
gagaacagcctgggca

SEQ ID NO: 243740 - DNA, 16 bp, P. troglodytes
gagaacagtgtggggg

SEQ ID NO: 243741 - DNA, 16 bp, P. troglodytes
gagaacatcatgctaa

SEQ ID NO: 243742 - DNA, 17 bp, P. troglodytes
gagaacatcctggctaa

SEQ ID NO: 243743 - DNA, 16 bp, P. troglodytes
gagaacatttggtgtt

SEQ ID NO: 243744 - DNA, 16 bp, P. troglodytes
gagaaccactgattta

SEQ ID NO: 243745 - DNA, 16 bp, P. troglodytes
gagaaccactggtcta

SEQ ID NO: 243746 - DNA, 16 bp, P. troglodytes
gagaaccaggagcact

SEQ ID NO: 243747 - DNA, 16 bp, P. troglodytes
gagaacctgtctcaga

SEQ ID NO: 243748 - DNA, 16 bp, P. troglodytes
gagaactataaaacat

SEQ ID NO: 243749 - DNA, 16 bp, P. troglodytes
gagaactgaaggagat

SEQ ID NO: 243750 - DNA, 16 bp, P. troglodytes
gagaactgcttgagct

SEQ ID NO: 243751 - DNA, 16 bp, P. troglodytes
gagaacttccccaact

SEQ ID NO: 243752 - DNA, 16 bp, P. troglodytes
gagaacttccccaatt

SEQ ID NO: 243753 - DNA, 16 bp, P. troglodytes
gagaacttcttgattt

SEQ ID NO: 243754 - DNA, 16 bp, P. troglodytes
gagaacttgccccagg

SEQ ID NO: 243755 - DNA, 16 bp, P. troglodytes
gagaacttgctttatg

SEQ ID NO: 243756 - DNA, 16 bp, P. troglodytes
gagaacttgttaaaaa

SEQ ID NO: 243757 - DNA, 16 bp, P. troglodytes
gagaagaaaatatatt

SEQ ID NO: 243758 - DNA, 16 bp, P. troglodytes
gagaagaaaatgctga

SEQ ID NO: 243759 - DNA, 16 bp, P. troglodytes
gagaagaaatcagaaa

SEQ ID NO: 243760 - DNA, 16 bp, P. troglodytes
gagaagaacaaagttg

SEQ ID NO: 243761 - DNA, 16 bp, P. troglodytes
gagaagaactgaaaga

SEQ ID NO: 243762 - DNA, 16 bp, P. troglodytes
gagaagaaggccactg

SEQ ID NO: 243763 - DNA, 16 bp, P. troglodytes
gagaagaatgtgaatt

SEQ ID NO: 243764 - DNA, 16 bp, P. troglodytes
gagaagacagccatct

SEQ ID NO: 243765 - DNA, 16 bp, P. troglodytes
gagaagacagctgtct

SEQ ID NO: 243766 - DNA, 16 bp, P. troglodytes
gagaagacctgcagga

SEQ ID NO: 243767 - DNA, 16 bp, P. troglodytes
gagaagactctgctcc

SEQ ID NO: 243768 - DNA, 16 bp, P. troglodytes
gagaagagcaacacca

SEQ ID NO: 243769 - DNA, 16 bp, P. troglodytes
gagaagaggaggcctg

SEQ ID NO: 243770 - DNA, 16 bp, P. troglodytes
gagaagaggtttaatt

SEQ ID NO: 243771 - DNA, 16 bp, P. troglodytes
gagaagagtctgttca

SEQ ID NO: 243772 - DNA, 16 bp, P. troglodytes
gagaagatatttgcaa

SEQ ID NO: 243773 - DNA, 16 bp, P. troglodytes
gagaagatcaataaaa

SEQ ID NO: 243774 - DNA, 16 bp, P. troglodytes
gagaagatcacttgag

SEQ ID NO: 243775 - DNA, 16 bp, P. troglodytes
gagaagatggccacca

SEQ ID NO: 243776 - DNA, 16 bp, P. troglodytes
gagaagatggccatct

SEQ ID NO: 243777 - DNA, 16 bp, P. troglodytes
gagaagcaaacatgtc

SEQ ID NO: 243778 - DNA, 16 bp, P. troglodytes
gagaagcaagtacctt

SEQ ID NO: 243779 - DNA, 16 bp, P. troglodytes
gagaagcagaagcaga

SEQ ID NO: 243780 - DNA, 16 bp, P. troglodytes
gagaagcagcagcagc

SEQ ID NO: 243781 - DNA, 16 bp, P. troglodytes
gagaagcagcagccag

SEQ ID NO: 243782 - DNA, 16 bp, P. troglodytes
gagaagcagcttctgc

SEQ ID NO: 243783 - DNA, 16 bp, P. troglodytes
gagaagccaggcagag

SEQ ID NO: 243784 - DNA, 16 bp, P. troglodytes
gagaagcctcaggaaa

SEQ ID NO: 243785 - DNA, 16 bp, P. troglodytes
gagaagctgaaggagg

SEQ ID NO: 243786 - DNA, 16 bp, P. troglodytes
gagaagcttagagaaa

SEQ ID NO: 243787 - DNA, 16 bp, P. troglodytes
gagaaggaaatctcca

SEQ ID NO: 243788 - DNA, 16 bp, P. troglodytes
gagaaggaagagcagt

SEQ ID NO: 243789 - DNA, 16 bp, P. troglodytes
gagaaggacatgagat

SEQ ID NO: 243790 - DNA, 16 bp, P. troglodytes
gagaaggagcagccag

SEQ ID NO: 243791 - DNA, 16 bp, P. troglodytes
gagaaggagccagaaa

SEQ ID NO: 243792 - DNA, 16 bp, P. troglodytes
gagaaggaggaggtgc

SEQ ID NO: 243793 - DNA, 16 bp, P. troglodytes
gagaaggatatgagat

SEQ ID NO: 243794 - DNA, 16 bp, P. troglodytes
gagaaggattctgagg

SEQ ID NO: 243795 - DNA, 16 bp, P. troglodytes
gagaaggattttattt

SEQ ID NO: 243796 - DNA, 16 bp, P. troglodytes
gagaagggtctgttca

SEQ ID NO: 243797 - DNA, 16 bp, P. troglodytes
gagaaggtatctcatt

SEQ ID NO: 243798 - DNA, 16 bp, P. troglodytes
gagaaggtcagagaga

SEQ ID NO: 243799 - DNA, 16 bp, P. troglodytes
gagaaggtgatatttg

SEQ ID NO: 243800 - DNA, 16 bp, P. troglodytes
gagaaggtggcatctg

SEQ ID NO: 243801 - DNA, 16 bp, P. troglodytes
gagaagtcaaattgtc

SEQ ID NO: 243802 - DNA, 16 bp, P. troglodytes
gagaagtcagtgcctg

SEQ ID NO: 243803 - DNA, 16 bp, P. troglodytes
gagaagtgtgtgtgtg

SEQ ID NO: 243804 - DNA, 16 bp, P. troglodytes
gagaagtttaaagaaa

SEQ ID NO: 243805 - DNA, 17 bp, P. troglodytes
gagaagtttagagaaaa

SEQ ID NO: 243806 - DNA, 16 bp, P. troglodytes
gagaagtttctgagaa

SEQ ID NO: 243807 - DNA, 16 bp, P. troglodytes
gagaatacaatgagaa

SEQ ID NO: 243808 - DNA, 16 bp, P. troglodytes
gagaataccttgaacc

SEQ ID NO: 243809 - DNA, 16 bp, P. troglodytes
gagaatagcttgaact

SEQ ID NO: 243810 - DNA, 16 bp, P. troglodytes
gagaatatacgatgtt

SEQ ID NO: 243811 - DNA, 16 bp, P. troglodytes
gagaatattatgaaca

SEQ ID NO: 243812 - DNA, 16 bp, P. troglodytes
gagaatcacttgaacc

SEQ ID NO: 243813 - DNA, 16 bp, P. troglodytes
gagaatcacttgaata

SEQ ID NO: 243814 - DNA, 16 bp, P. troglodytes
gagaatcacttgatcc

SEQ ID NO: 243815 - DNA, 16 bp, P. troglodytes
gagaatcatttgaacc

SEQ ID NO: 243816 - DNA, 16 bp, P. troglodytes
gagaatccatctaaaa

SEQ ID NO: 243817 - DNA, 16 bp, P. troglodytes
gagaatcccttgaacc

SEQ ID NO: 243818 - DNA, 16 bp, P. troglodytes
gagaatcgctcgaacc

SEQ ID NO: 243819 - DNA, 16 bp, P. troglodytes
gagaatctgtgtgctt

SEQ ID NO: 243820 - DNA, 16 bp, P. troglodytes
gagaatgaaaaggcaa

SEQ ID NO: 243821 - DNA, 16 bp, P. troglodytes
gagaatgaagaccttt

SEQ ID NO: 243822 - DNA, 16 bp, P. troglodytes
gagaatgagaatgaat

SEQ ID NO: 243823 - DNA, 16 bp, P. troglodytes
gagaatgaggaagaca

SEQ ID NO: 243824 - DNA, 16 bp, P. troglodytes
gagaatgatgatttct

SEQ ID NO: 243825 - DNA, 16 bp, P. troglodytes
gagaatgatggcttct

SEQ ID NO: 243826 - DNA, 16 bp, P. troglodytes
gagaatgcagagaaaa

SEQ ID NO: 243827 - DNA, 16 bp, P. troglodytes
gagaatgcagcccagc

SEQ ID NO: 243828 - DNA, 16 bp, P. troglodytes
gagaatgcagtgagct

SEQ ID NO: 243829 - DNA, 16 bp, P. troglodytes
gagaatggattggagg

SEQ ID NO: 243830 - DNA, 16 bp, P. troglodytes
gagaatggcttgaacc

SEQ ID NO: 243831 - DNA, 16 bp, P. troglodytes
gagaatgtaaattatt

SEQ ID NO: 243832 - DNA, 16 bp, P. troglodytes
gagaatgtgaagaaat

SEQ ID NO: 243833 - DNA, 16 bp, P. troglodytes
gagaattaaatgatat

SEQ ID NO: 243834 - DNA, 16 bp, P. troglodytes
gagaattatctgttca

SEQ ID NO: 243835 - DNA, 16 bp, P. troglodytes
gagaattctatggcca

SEQ ID NO: 243836 - DNA, 16 bp, P. troglodytes
gagaattgctagagcc

SEQ ID NO: 243837 - DNA, 16 bp, P. troglodytes
gagaattgcttgaaat

SEQ ID NO: 243838 - DNA, 17 bp, P. troglodytes
gagaattgcttgagcct

SEQ ID NO: 243839 - DNA, 16 bp, P. troglodytes
gagaattgcttggact

SEQ ID NO: 243840 - DNA, 16 bp, P. troglodytes
gagaatttcaggccaa

SEQ ID NO: 243841 - DNA, 16 bp, P. troglodytes
gagaatttgcttttct

SEQ ID NO: 243842 - DNA, 16 bp, P. troglodytes
gagaattttgaatgtt

SEQ ID NO: 243843 - DNA, 16 bp, P. troglodytes
gagacaaacagttgca

SEQ ID NO: 243844 - DNA, 16 bp, P. troglodytes
gagacaaagaaagcca

SEQ ID NO: 243845 - DNA, 22 bp, P. troglodytes
gagacaaagaaggccattacat

SEQ ID NO: 243846 - DNA, 16 bp, P. troglodytes
gagacaaaggagacat

SEQ ID NO: 243847 - DNA, 16 bp, P. troglodytes
gagacaaagtctggct

SEQ ID NO: 243848 - DNA, 16 bp, P. troglodytes
gagacaaagtcttgct

SEQ ID NO: 243849 - DNA, 16 bp, P. troglodytes
gagacaaagtcttgtt

SEQ ID NO: 243850 - DNA, 16 bp, P. troglodytes
gagacaaagttttgct

SEQ ID NO: 243851 - DNA, 16 bp, P. troglodytes
gagacaaatattcaaa

SEQ ID NO: 243852 - DNA, 16 bp, P. troglodytes
gagacaagatctcatt

SEQ ID NO: 243853 - DNA, 16 bp, P. troglodytes
gagacaaggcctcact

SEQ ID NO: 243854 - DNA, 16 bp, P. troglodytes
gagacaaggtcacact

SEQ ID NO: 243855 - DNA, 16 bp, P. troglodytes
gagacaaggtctcgct

SEQ ID NO: 243856 - DNA, 16 bp, P. troglodytes
gagacaaggtctgact

SEQ ID NO: 243857 - DNA, 16 bp, P. troglodytes
gagacaaggtcttcct

SEQ ID NO: 243858 - DNA, 16 bp, P. troglodytes
gagacaaggtcttgct

SEQ ID NO: 243859 - DNA, 16 bp, P. troglodytes
gagacacagaaaggtt

SEQ ID NO: 243860 - DNA, 16 bp, P. troglodytes
gagacacagacacaga

SEQ ID NO: 243861 - DNA, 16 bp, P. troglodytes
gagacacagccttgct

SEQ ID NO: 243862 - DNA, 16 bp, P. troglodytes
gagacacggtctcact

SEQ ID NO: 243863 - DNA, 16 bp, P. troglodytes
gagacactgtcaaaaa

SEQ ID NO: 243864 - DNA, 16 bp, P. troglodytes
gagacagaaaacaaat

SEQ ID NO: 243865 - DNA, 16 bp, P. troglodytes
gagacagaaaatgaaa

SEQ ID NO: 243866 - DNA, 16 bp, P. troglodytes
gagacagaaagtggaa

SEQ ID NO: 243867 - DNA, 16 bp, P. troglodytes
gagacagaactgttca

SEQ ID NO: 243868 - DNA, 16 bp, P. troglodytes
gagacagaatctcact

SEQ ID NO: 243869 - DNA, 16 bp, P. troglodytes
gagacagacacacaca

SEQ ID NO: 243870 - DNA, 16 bp, P. troglodytes
gagacagacacagaga

SEQ ID NO: 243871 - DNA, 16 bp, P. troglodytes
gagacagagacagaca

SEQ ID NO: 243872 - DNA, 16 bp, P. troglodytes
gagacagagacagagg

SEQ ID NO: 243873 - DNA, 16 bp, P. troglodytes
gagacagagagacaga

SEQ ID NO: 243874 - DNA, 16 bp, P. troglodytes
gagacagagagatgga

SEQ ID NO: 243875 - DNA, 16 bp, P. troglodytes
gagacagagagtgaag

SEQ ID NO: 243876 - DNA, 16 bp, P. troglodytes
gagacagagatagaaa

SEQ ID NO: 243877 - DNA, 16 bp, P. troglodytes
gagacagagatcagag

SEQ ID NO: 243878 - DNA, 16 bp, P. troglodytes
gagacagagctagact

SEQ ID NO: 243879 - DNA, 16 bp, P. troglodytes
gagacagagctggcca

SEQ ID NO: 243880 - DNA, 16 bp, P. troglodytes
gagacagaggcagagg

SEQ ID NO: 243881 - DNA, 16 bp, P. troglodytes
gagacagaggctcgct

SEQ ID NO: 243882 - DNA, 16 bp, P. troglodytes
gagacagagtctcact

SEQ ID NO: 243883 - DNA, 16 bp, P. troglodytes
gagacagagtctcatt

SEQ ID NO: 243884 - DNA, 16 bp, P. troglodytes
gagacagagtctcgct

SEQ ID NO: 243885 - DNA, 16 bp, P. troglodytes
gagacagagtctgact

SEQ ID NO: 243886 - DNA, 16 bp, P. troglodytes
gagacagagtctggct

SEQ ID NO: 243887 - DNA, 16 bp, P. troglodytes
gagacagagtcttact

SEQ ID NO: 243888 - DNA, 16 bp, P. troglodytes
gagacagagtcttgat

SEQ ID NO: 243889 - DNA, 16 bp, P. troglodytes
gagacagagttctcac

SEQ ID NO: 243890 - DNA, 16 bp, P. troglodytes
gagacagagtttcact

SEQ ID NO: 243891 - DNA, 16 bp, P. troglodytes
gagacagagtttcgcc

SEQ ID NO: 243892 - DNA, 16 bp, P. troglodytes
gagacagagttttgcc

SEQ ID NO: 243893 - DNA, 16 bp, P. troglodytes
gagacagcaagaacaa

SEQ ID NO: 243894 - DNA, 16 bp, P. troglodytes
gagacagcaagaccaa

SEQ ID NO: 243895 - DNA, 16 bp, P. troglodytes
gagacagcaccactgc

SEQ ID NO: 243896 - DNA, 16 bp, P. troglodytes
gagacagcgtttctcc

SEQ ID NO: 243897 - DNA, 16 bp, P. troglodytes
gagacaggagaatggc

SEQ ID NO: 243898 - DNA, 16 bp, P. troglodytes
gagacaggagacagga

SEQ ID NO: 243899 - DNA, 16 bp, P. troglodytes
gagacaggatctcact

SEQ ID NO: 243900 - DNA, 16 bp, P. troglodytes
gagacaggatttcacc

SEQ ID NO: 243901 - DNA, 16 bp, P. troglodytes
gagacaggatttcact

SEQ ID NO: 243902 - DNA, 16 bp, P. troglodytes
gagacagggactcact

SEQ ID NO: 243903 - DNA, 16 bp, P. troglodytes
gagacagggtcatgct

SEQ ID NO: 243904 - DNA, 16 bp, P. troglodytes
gagacagggtcctgct

SEQ ID NO: 243905 - DNA, 16 bp, P. troglodytes
gagacagggtctcact

SEQ ID NO: 243906 - DNA, 16 bp, P. troglodytes
gagacagggtctcatt

SEQ ID NO: 243907 - DNA, 16 bp, P. troglodytes
gagacagggtctccct

SEQ ID NO: 243908 - DNA, 16 bp, P. troglodytes
gagacagggtctcgct

SEQ ID NO: 243909 - DNA, 16 bp, P. troglodytes
gagacagggtctggct

SEQ ID NO: 243910 - DNA, 16 bp, P. troglodytes
gagacagggtcttact

SEQ ID NO: 243911 - DNA, 16 bp, P. troglodytes
gagacagggtcttgct

SEQ ID NO: 243912 - DNA, 16 bp, P. troglodytes
gagacagggtcttgtt

SEQ ID NO: 243913 - DNA, 16 bp, P. troglodytes
gagacagggtctttac

SEQ ID NO: 243914 - DNA, 16 bp, P. troglodytes
gagacagggtgtcact

SEQ ID NO: 243915 - DNA, 16 bp, P. troglodytes
gagacagggtgttgcc

SEQ ID NO: 243916 - DNA, 16 bp, P. troglodytes
gagacagggtttggct

SEQ ID NO: 243917 - DNA, 16 bp, P. troglodytes
gagacagggttttcca

SEQ ID NO: 243918 - DNA, 16 bp, P. troglodytes
gagacagggttttgct

SEQ ID NO: 243919 - DNA, 16 bp, P. troglodytes
gagacagggttttttc

SEQ ID NO: 243920 - DNA, 16 bp, P. troglodytes
gagacagtaaaaggat

SEQ ID NO: 243921 - DNA, 16 bp, P. troglodytes
gagacagtgtctctgt

SEQ ID NO: 243922 - DNA, 16 bp, P. troglodytes
gagacagttaacaacc

SEQ ID NO: 243923 - DNA, 16 bp, P. troglodytes
gagacagtttctctct

SEQ ID NO: 243924 - DNA, 16 bp, P. troglodytes
gagacatctgcacccc

SEQ ID NO: 243925 - DNA, 16 bp, P. troglodytes
gagacatgatcatgcc

SEQ ID NO: 243926 - DNA, 16 bp, P. troglodytes
gagacatggggtttta

SEQ ID NO: 243927 - DNA, 16 bp, P. troglodytes
gagacatttgaaattt

SEQ ID NO: 243928 - DNA, 16 bp, P. troglodytes
gagacatttttgtttg

SEQ ID NO: 243929 - DNA, 16 bp, P. troglodytes
gagacattttttgttg

SEQ ID NO: 243930 - DNA, 16 bp, P. troglodytes
gagaccaaagcaggag

SEQ ID NO: 243931 - DNA, 16 bp, P. troglodytes
gagaccaagaacccac

SEQ ID NO: 243932 - DNA, 16 bp, P. troglodytes
gagaccaccacaaaga

SEQ ID NO: 243933 - DNA, 16 bp, P. troglodytes
gagaccaccctggaca

SEQ ID NO: 243934 - DNA, 16 bp, P. troglodytes
gagaccagcctgaccg

SEQ ID NO: 243935 - DNA, 17 bp, P. troglodytes
gagaccagcctggccac

SEQ ID NO: 243936 - DNA, 17 bp, P. troglodytes
gagaccagcctggccat

SEQ ID NO: 243937 - DNA, 16 bp, P. troglodytes
gagaccagcctggccc

SEQ ID NO: 243938 - DNA, 16 bp, P. troglodytes
gagaccagcctggccg

SEQ ID NO: 243939 - DNA, 16 bp, P. troglodytes
gagaccagcctgggca

SEQ ID NO: 243940 - DNA, 17 bp, P. troglodytes
gagaccagcctgggcag

SEQ ID NO: 243941 - DNA, 16 bp, P. troglodytes
gagaccagcctgggga

SEQ ID NO: 243942 - DNA, 19 bp, P. troglodytes
gagaccagcctggggaaca

SEQ ID NO: 243943 - DNA, 16 bp, P. troglodytes
gagaccagcctggggc

SEQ ID NO: 243944 - DNA, 16 bp, P. troglodytes
gagaccagcctgtcta

SEQ ID NO: 243945 - DNA, 17 bp, P. troglodytes
gagaccagccttgccaa

SEQ ID NO: 243946 - DNA, 16 bp, P. troglodytes
gagaccagcgtgggca

SEQ ID NO: 243947 - DNA, 16 bp, P. troglodytes
gagaccagctcagtca

SEQ ID NO: 243948 - DNA, 16 bp, P. troglodytes
gagaccagctcagtcg

SEQ ID NO: 243949 - DNA, 16 bp, P. troglodytes
gagaccagctgggcaa

SEQ ID NO: 243950 - DNA, 16 bp, P. troglodytes
gagaccaggtctccct

SEQ ID NO: 243951 - DNA, 16 bp, P. troglodytes
gagaccatccctggcc

SEQ ID NO: 243952 - DNA, 16 bp, P. troglodytes
gagaccatccgggcca

SEQ ID NO: 243953 - DNA, 16 bp, P. troglodytes
gagaccatccgggcta

SEQ ID NO: 243954 - DNA, 17 bp, P. troglodytes
gagaccatcctgaccaa

SEQ ID NO: 243955 - DNA, 16 bp, P. troglodytes
gagaccatgtggcctg

SEQ ID NO: 243956 - DNA, 16 bp, P. troglodytes
gagaccattattctaa

SEQ ID NO: 243957 - DNA, 16 bp, P. troglodytes
gagacccacaaagaga

SEQ ID NO: 243958 - DNA, 16 bp, P. troglodytes
gagacccacagtgggt

SEQ ID NO: 243959 - DNA, 16 bp, P. troglodytes
gagacccacctgggca

SEQ ID NO: 243960 - DNA, 16 bp, P. troglodytes
gagacccagcctgacc

SEQ ID NO: 243961 - DNA, 16 bp, P. troglodytes
gagacccaggaaagag

SEQ ID NO: 243962 - DNA, 16 bp, P. troglodytes
gagaccccagagagct

SEQ ID NO: 243963 - DNA, 16 bp, P. troglodytes
gagaccccatccctac

SEQ ID NO: 243964 - DNA, 16 bp, P. troglodytes
gagaccccatctcaat

SEQ ID NO: 243965 - DNA, 16 bp, P. troglodytes
gagaccccatctctta

SEQ ID NO: 243966 - DNA, 16 bp, P. troglodytes
gagaccccatctcttt

SEQ ID NO: 243967 - DNA, 17 bp, P. troglodytes
gagaccccgtctctaca

SEQ ID NO: 243968 - DNA, 16 bp, P. troglodytes
gagaccctatctcaga

SEQ ID NO: 243969 - DNA, 16 bp, P. troglodytes
gagaccctccgcctgg

SEQ ID NO: 243970 - DNA, 16 bp, P. troglodytes
gagaccctcctggcca

SEQ ID NO: 243971 - DNA, 16 bp, P. troglodytes
gagaccctgagccaga

SEQ ID NO: 243972 - DNA, 18 bp, P. troglodytes
gagaccctgtctcaaaat

SEQ ID NO: 243973 - DNA, 16 bp, P. troglodytes
gagaccctgtctccac

SEQ ID NO: 243974 - DNA, 17 bp, P. troglodytes
gagaccctgtctctaaa

SEQ ID NO: 243975 - DNA, 16 bp, P. troglodytes
gagaccctgtctctca

SEQ ID NO: 243976 - DNA, 16 bp, P. troglodytes
gagaccgaggcgggcg

SEQ ID NO: 243977 - DNA, 16 bp, P. troglodytes
gagaccgaggcgggtg

SEQ ID NO: 243978 - DNA, 16 bp, P. troglodytes
gagaccgaggtgggca

SEQ ID NO: 243979 - DNA, 16 bp, P. troglodytes
gagaccgagtctcact

SEQ ID NO: 243980 - DNA, 16 bp, P. troglodytes
gagacctcatcagcct

SEQ ID NO: 243981 - DNA, 16 bp, P. troglodytes
gagacctcatctccaa

SEQ ID NO: 243982 - DNA, 16 bp, P. troglodytes
gagacctcatctctat

SEQ ID NO: 243983 - DNA, 16 bp, P. troglodytes
gagacctggaacagat

SEQ ID NO: 243984 - DNA, 16 bp, P. troglodytes
gagacctggccaacat

SEQ ID NO: 243985 - DNA, 16 bp, P. troglodytes
gagacctgggtttgaa

SEQ ID NO: 243986 - DNA, 16 bp, P. troglodytes
gagaccttcctggcca

SEQ ID NO: 243987 - DNA, 16 bp, P. troglodytes
gagaccttgtctctat

SEQ ID NO: 243988 - DNA, 16 bp, P. troglodytes
gagacgaagtctcgct

SEQ ID NO: 243989 - DNA, 16 bp, P. troglodytes
gagacgaagtcttgct

SEQ ID NO: 243990 - DNA, 16 bp, P. troglodytes
gagacggagtctagct

SEQ ID NO: 243991 - DNA, 16 bp, P. troglodytes
gagacggagtctcgca

SEQ ID NO: 243992 - DNA, 16 bp, P. troglodytes
gagacggagtctcgct

SEQ ID NO: 243993 - DNA, 16 bp, P. troglodytes
gagacggagtctctct

SEQ ID NO: 243994 - DNA, 16 bp, P. troglodytes
gagacggagtctggct

SEQ ID NO: 243995 - DNA, 16 bp, P. troglodytes
gagacggagtttcact

SEQ ID NO: 243996 - DNA, 16 bp, P. troglodytes
gagacggagtttcgcc

SEQ ID NO: 243997 - DNA, 16 bp, P. troglodytes
gagacggagtttctct

SEQ ID NO: 243998 - DNA, 16 bp, P. troglodytes
gagacggagttttgct

SEQ ID NO: 243999 - DNA, 16 bp, P. troglodytes
gagacggggtctcact

SEQ ID NO: 244000 - DNA, 17 bp, P. troglodytes
gagacggggtttagcca

SEQ ID NO: 244001 - DNA, 16 bp, P. troglodytes
gagacgtagtcttgct

SEQ ID NO: 244002 - DNA, 16 bp, P. troglodytes
gagactagcttggcca

SEQ ID NO: 244003 - DNA, 16 bp, P. troglodytes
gagactatagaatacc

SEQ ID NO: 244004 - DNA, 16 bp, P. troglodytes
gagactatcctggcta

SEQ ID NO: 244005 - DNA, 16 bp, P. troglodytes
gagactattactctaa

SEQ ID NO: 244006 - DNA, 16 bp, P. troglodytes
gagactcagaaggagg

SEQ ID NO: 244007 - DNA, 16 bp, P. troglodytes
gagactccatctaaaa

SEQ ID NO: 244008 - DNA, 18 bp, P. troglodytes
gagactccatctcaaaaa

SEQ ID NO: 244009 - DNA, 16 bp, P. troglodytes
gagactccatctctac

SEQ ID NO: 244010 - DNA, 16 bp, P. troglodytes
gagactccgtctcaat

SEQ ID NO: 244011 - DNA, 16 bp, P. troglodytes
gagactccgtctcaca

SEQ ID NO: 244012 - DNA, 16 bp, P. troglodytes
gagactctgcttcaaa

SEQ ID NO: 244013 - DNA, 16 bp, P. troglodytes
gagactctgtcacaaa

SEQ ID NO: 244014 - DNA, 16 bp, P. troglodytes
gagactgaagcaggag

SEQ ID NO: 244015 - DNA, 16 bp, P. troglodytes
gagactgaataattta

SEQ ID NO: 244016 - DNA, 16 bp, P. troglodytes
gagactgagacaagag

SEQ ID NO: 244017 - DNA, 16 bp, P. troglodytes
gagactgagacagaga

SEQ ID NO: 244018 - DNA, 16 bp, P. troglodytes
gagactgaggagggag

SEQ ID NO: 244019 - DNA, 16 bp, P. troglodytes
gagactgaggcaagag

SEQ ID NO: 244020 - DNA, 16 bp, P. troglodytes
gagactgaggcgggag

SEQ ID NO: 244021 - DNA, 16 bp, P. troglodytes
gagactgaggtgggag

SEQ ID NO: 244022 - DNA, 16 bp, P. troglodytes
gagactgaggtgggca

SEQ ID NO: 244023 - DNA, 16 bp, P. troglodytes
gagactgaggtggtag

SEQ ID NO: 244024 - DNA, 16 bp, P. troglodytes
gagactgaggttcaga

SEQ ID NO: 244025 - DNA, 16 bp, P. troglodytes
gagactgagtcttact

SEQ ID NO: 244026 - DNA, 16 bp, P. troglodytes
gagactgagtcttgct

SEQ ID NO: 244027 - DNA, 16 bp, P. troglodytes
gagactgagttttgct

SEQ ID NO: 244028 - DNA, 16 bp, P. troglodytes
gagactgattttggac

SEQ ID NO: 244029 - DNA, 16 bp, P. troglodytes
gagactgcagagaaaa

SEQ ID NO: 244030 - DNA, 16 bp, P. troglodytes
gagactggataattta

SEQ ID NO: 244031 - DNA, 16 bp, P. troglodytes
gagactggatcttgct

SEQ ID NO: 244032 - DNA, 16 bp, P. troglodytes
gagactgggccactgc

SEQ ID NO: 244033 - DNA, 23 bp, P. troglodytes
gagactggggtctatttcacccc

SEQ ID NO: 244034 - DNA, 16 bp, P. troglodytes
gagactgggtttcact

SEQ ID NO: 244035 - DNA, 21 bp, P. troglodytes
gagactgtctcaaaaaaaaaa

SEQ ID NO: 244036 - DNA, 16 bp, P. troglodytes
gagactgtggaaagag

SEQ ID NO: 244037 - DNA, 16 bp, P. troglodytes
gagacttcaacatccc

SEQ ID NO: 244038 - DNA, 16 bp, P. troglodytes
gagacttcagtgagcc

SEQ ID NO: 244039 - DNA, 16 bp, P. troglodytes
gagacttcatcaaaaa

SEQ ID NO: 244040 - DNA, 16 bp, P. troglodytes
gagacttcttctttga

SEQ ID NO: 244041 - DNA, 16 bp, P. troglodytes
gagactttggatttgg

SEQ ID NO: 244042 - DNA, 16 bp, P. troglodytes
gagagaaaacagaaat

SEQ ID NO: 244043 - DNA, 16 bp, P. troglodytes
gagagaaaatatttgt

SEQ ID NO: 244044 - DNA, 16 bp, P. troglodytes
gagagaaagagactga

SEQ ID NO: 244045 - DNA, 16 bp, P. troglodytes
gagagaaagagaggct

SEQ ID NO: 244046 - DNA, 16 bp, P. troglodytes
gagagaaagatacaga

SEQ ID NO: 244047 - DNA, 16 bp, P. troglodytes
gagagaaaggccaagt

SEQ ID NO: 244048 - DNA, 16 bp, P. troglodytes
gagagaaattaaagat

SEQ ID NO: 244049 - DNA, 16 bp, P. troglodytes
gagagaagattcaaat

SEQ ID NO: 244050 - DNA, 16 bp, P. troglodytes
gagagaagcaagagca

SEQ ID NO: 244051 - DNA, 16 bp, P. troglodytes
gagagaagcagagaca

SEQ ID NO: 244052 - DNA, 16 bp, P. troglodytes
gagagaataaatttcc

SEQ ID NO: 244053 - DNA, 16 bp, P. troglodytes
gagagaatgagagaca

SEQ ID NO: 244054 - DNA, 16 bp, P. troglodytes
gagagaatgagatgat

SEQ ID NO: 244055 - DNA, 16 bp, P. troglodytes
gagagacagagacaga

SEQ ID NO: 244056 - DNA, 16 bp, P. troglodytes
gagagacagaggcagg

SEQ ID NO: 244057 - DNA, 16 bp, P. troglodytes
gagagacagagttttg

SEQ ID NO: 244058 - DNA, 16 bp, P. troglodytes
gagagacctcaggaaa

SEQ ID NO: 244059 - DNA, 16 bp, P. troglodytes
gagagactaagggagg

SEQ ID NO: 244060 - DNA, 16 bp, P. troglodytes
gagagactgaggcaag

SEQ ID NO: 244061 - DNA, 16 bp, P. troglodytes
gagagactgtttgttt

SEQ ID NO: 244062 - DNA, 16 bp, P. troglodytes
gagagagaaattgaga

SEQ ID NO: 244063 - DNA, 16 bp, P. troglodytes
gagagagaataagcaa

SEQ ID NO: 244064 - DNA, 16 bp, P. troglodytes
gagagagacacacaga

SEQ ID NO: 244065 - DNA, 16 bp, P. troglodytes
gagagagacagacaga

SEQ ID NO: 244066 - DNA, 16 bp, P. troglodytes
gagagagacctcatct

SEQ ID NO: 244067 - DNA, 16 bp, P. troglodytes
gagagagactccctct

SEQ ID NO: 244068 - DNA, 16 bp, P. troglodytes
gagagagactgtgtct

SEQ ID NO: 244069 - DNA, 16 bp, P. troglodytes
gagagagagaaaatct

SEQ ID NO: 244070 - DNA, 16 bp, P. troglodytes
gagagagagaaactga

SEQ ID NO: 244071 - DNA, 16 bp, P. troglodytes
gagagagagaaagcca

SEQ ID NO: 244072 - DNA, 16 bp, P. troglodytes
gagagagagaaagtca

SEQ ID NO: 244073 - DNA, 16 bp, P. troglodytes
gagagagagaaatcaa

SEQ ID NO: 244074 - DNA, 16 bp, P. troglodytes
gagagagagaaattca

SEQ ID NO: 244075 - DNA, 16 bp, P. troglodytes
gagagagagaaattgg

SEQ ID NO: 244076 - DNA, 16 bp, P. troglodytes
gagagagagaacattt

SEQ ID NO: 244077 - DNA, 16 bp, P. troglodytes
gagagagagaagcagc

SEQ ID NO: 244078 - DNA, 16 bp, P. troglodytes
gagagagagaatcaga

SEQ ID NO: 244079 - DNA, 16 bp, P. troglodytes
gagagagagaatgagc

SEQ ID NO: 244080 - DNA, 16 bp, P. troglodytes
gagagagagacagctt

SEQ ID NO: 244081 - DNA, 16 bp, P. troglodytes
gagagagagaccgaga

SEQ ID NO: 244082 - DNA, 16 bp, P. troglodytes
gagagagagactgaga

SEQ ID NO: 244083 - DNA, 16 bp, P. troglodytes
gagagagagagaaatt

SEQ ID NO: 244084 - DNA, 16 bp, P. troglodytes
gagagagagagaactg

SEQ ID NO: 244085 - DNA, 16 bp, P. troglodytes
gagagagagagacata

SEQ ID NO: 244086 - DNA, 16 bp, P. troglodytes
gagagagagagacttt

SEQ ID NO: 244087 - DNA, 16 bp, P. troglodytes
gagagagagagagttg

SEQ ID NO: 244088 - DNA, 16 bp, P. troglodytes
gagagagagagatggt

SEQ ID NO: 244089 - DNA, 16 bp, P. troglodytes
gagagagagagcatga

SEQ ID NO: 244090 - DNA, 16 bp, P. troglodytes
gagagagagaggcagc

SEQ ID NO: 244091 - DNA, 16 bp, P. troglodytes
gagagagagccagaga

SEQ ID NO: 244092 - DNA, 16 bp, P. troglodytes
gagagagagcgagagc

SEQ ID NO: 244093 - DNA, 16 bp, P. troglodytes
gagagagagtttcacc

SEQ ID NO: 244094 - DNA, 16 bp, P. troglodytes
gagagagatgatttaa

SEQ ID NO: 244095 - DNA, 16 bp, P. troglodytes
gagagagatgatttgg

SEQ ID NO: 244096 - DNA, 16 bp, P. troglodytes
gagagagattgagaaa

SEQ ID NO: 244097 - DNA, 16 bp, P. troglodytes
gagagagcatcaggat

SEQ ID NO: 244098 - DNA, 18 bp, P. troglodytes
gagagagccaaatcatga

SEQ ID NO: 244099 - DNA, 16 bp, P. troglodytes
gagagaggacacaaac

SEQ ID NO: 244100 - DNA, 16 bp, P. troglodytes
gagagaggaggggctg

SEQ ID NO: 244101 - DNA, 16 bp, P. troglodytes
gagagaggatgatatt

SEQ ID NO: 244102 - DNA, 16 bp, P. troglodytes
gagagaggcttcagaa

SEQ ID NO: 244103 - DNA, 16 bp, P. troglodytes
gagagagggtctcact

SEQ ID NO: 244104 - DNA, 16 bp, P. troglodytes
gagagagggtcttgct

SEQ ID NO: 244105 - DNA, 16 bp, P. troglodytes
gagagaggtctcagaa

SEQ ID NO: 244106 - DNA, 16 bp, P. troglodytes
gagagaggtttcacca

SEQ ID NO: 244107 - DNA, 16 bp, P. troglodytes
gagagagtcagagaga

SEQ ID NO: 244108 - DNA, 16 bp, P. troglodytes
gagagagtctctctct

SEQ ID NO: 244109 - DNA, 16 bp, P. troglodytes
gagagagtgagagtga

SEQ ID NO: 244110 - DNA, 16 bp, P. troglodytes
gagagatgcaggtcag

SEQ ID NO: 244111 - DNA, 16 bp, P. troglodytes
gagagattaaatgact

SEQ ID NO: 244112 - DNA, 16 bp, P. troglodytes
gagagcaaaactccat

SEQ ID NO: 244113 - DNA, 16 bp, P. troglodytes
gagagcaagacagaga

SEQ ID NO: 244114 - DNA, 18 bp, P. troglodytes
gagagcaagactccgtct

SEQ ID NO: 244115 - DNA, 16 bp, P. troglodytes
gagagcaagactctgt

SEQ ID NO: 244116 - DNA, 16 bp, P. troglodytes
gagagcaccacatcaa

SEQ ID NO: 244117 - DNA, 16 bp, P. troglodytes
gagagcagagcccagg

SEQ ID NO: 244118 - DNA, 16 bp, P. troglodytes
gagagcagcctgccca

SEQ ID NO: 244119 - DNA, 16 bp, P. troglodytes
gagagcagcctggaca

SEQ ID NO: 244120 - DNA, 16 bp, P. troglodytes
gagagcagcctgtcca

SEQ ID NO: 244121 - DNA, 16 bp, P. troglodytes
gagagcaggagcaaga

SEQ ID NO: 244122 - DNA, 16 bp, P. troglodytes
gagagcatcaggataa

SEQ ID NO: 244123 - DNA, 16 bp, P. troglodytes
gagagccaagcaaagg

SEQ ID NO: 244124 - DNA, 16 bp, P. troglodytes
gagagccaccgtgccc

SEQ ID NO: 244125 - DNA, 16 bp, P. troglodytes
gagagccacttccacc

SEQ ID NO: 244126 - DNA, 16 bp, P. troglodytes
gagagccctgcccctg

SEQ ID NO: 244127 - DNA, 19 bp, P. troglodytes
gagagcgagaccatcctgg

SEQ ID NO: 244128 - DNA, 18 bp, P. troglodytes
gagagcgagactccgtct

SEQ ID NO: 244129 - DNA, 16 bp, P. troglodytes
gagagcgagagcgaga

SEQ ID NO: 244130 - DNA, 16 bp, P. troglodytes
gagagcgagcgagaga

SEQ ID NO: 244131 - DNA, 16 bp, P. troglodytes
gagagctctcttcctg

SEQ ID NO: 244132 - DNA, 16 bp, P. troglodytes
gagagctctggtgtct

SEQ ID NO: 244133 - DNA, 16 bp, P. troglodytes
gagagcttcagagacc

SEQ ID NO: 244134 - DNA, 16 bp, P. troglodytes
gagagcttgttagaaa

SEQ ID NO: 244135 - DNA, 16 bp, P. troglodytes
gagagcttttctgtca

SEQ ID NO: 244136 - DNA, 16 bp, P. troglodytes
gagaggaagaccacag

SEQ ID NO: 244137 - DNA, 16 bp, P. troglodytes
gagaggacatggagaa

SEQ ID NO: 244138 - DNA, 16 bp, P. troglodytes
gagaggagcctggcca

SEQ ID NO: 244139 - DNA, 16 bp, P. troglodytes
gagaggagctgcccac

SEQ ID NO: 244140 - DNA, 16 bp, P. troglodytes
gagaggaggaggtgcc

SEQ ID NO: 244141 - DNA, 16 bp, P. troglodytes
gagaggatcaggagaa

SEQ ID NO: 244142 - DNA, 16 bp, P. troglodytes
gagaggcagaggcaga

SEQ ID NO: 244143 - DNA, 16 bp, P. troglodytes
gagaggccaggtgcag

SEQ ID NO: 244144 - DNA, 16 bp, P. troglodytes
gagaggcctcagagga

SEQ ID NO: 244145 - DNA, 16 bp, P. troglodytes
gagaggcctggaacag

SEQ ID NO: 244146 - DNA, 16 bp, P. troglodytes
gagaggcctggggagg

SEQ ID NO: 244147 - DNA, 16 bp, P. troglodytes
gagaggctgaagcaga

SEQ ID NO: 244148 - DNA, 16 bp, P. troglodytes
gagaggctgagatggg

SEQ ID NO: 244149 - DNA, 16 bp, P. troglodytes
gagaggctgaggagag

SEQ ID NO: 244150 - DNA, 16 bp, P. troglodytes
gagaggctgaggcaag

SEQ ID NO: 244151 - DNA, 16 bp, P. troglodytes
gagaggctgaggcgga

SEQ ID NO: 244152 - DNA, 16 bp, P. troglodytes
gagaggctgagggagg

SEQ ID NO: 244153 - DNA, 16 bp, P. troglodytes
gagaggctggaggaga

SEQ ID NO: 244154 - DNA, 16 bp, P. troglodytes
gagaggctgtgggggt

SEQ ID NO: 244155 - DNA, 16 bp, P. troglodytes
gagagggagactgtgg

SEQ ID NO: 244156 - DNA, 16 bp, P. troglodytes
gagagggagtctggct

SEQ ID NO: 244157 - DNA, 23 bp, P. troglodytes
gagaggtgacagcatgctggcag

SEQ ID NO: 244158 - DNA, 16 bp, P. troglodytes
gagaggttaagcagct

SEQ ID NO: 244159 - DNA, 16 bp, P. troglodytes
gagaggttctaagaga

SEQ ID NO: 244160 - DNA, 16 bp, P. troglodytes
gagagtcagagagaga

SEQ ID NO: 244161 - DNA, 16 bp, P. troglodytes
gagagtcttgttctgt

SEQ ID NO: 244162 - DNA, 16 bp, P. troglodytes
gagagtgacctctggt

SEQ ID NO: 244163 - DNA, 16 bp, P. troglodytes
gagagtgagactccat

SEQ ID NO: 244164 - DNA, 25 bp, P. troglodytes
gagagtgagactccgtctcaaaaaa

SEQ ID NO: 244165 - DNA, 16 bp, P. troglodytes
gagagtgttttgagaa

SEQ ID NO: 244166 - DNA, 16 bp, P. troglodytes
gagagttcattcatga

SEQ ID NO: 244167 - DNA, 20 bp, P. troglodytes
gagagttcgagaccagcctg

SEQ ID NO: 244168 - DNA, 16 bp, P. troglodytes
gagagtttgttataat

SEQ ID NO: 244169 - DNA, 16 bp, P. troglodytes
gagataataaatgggt

SEQ ID NO: 244170 - DNA, 16 bp, P. troglodytes
gagataatatacataa

SEQ ID NO: 244171 - DNA, 16 bp, P. troglodytes
gagataatatgtgtaa

SEQ ID NO: 244172 - DNA, 16 bp, P. troglodytes
gagataatcatgtggt

SEQ ID NO: 244173 - DNA, 16 bp, P. troglodytes
gagataatgcatataa

SEQ ID NO: 244174 - DNA, 16 bp, P. troglodytes
gagataatgcatgtga

SEQ ID NO: 244175 - DNA, 16 bp, P. troglodytes
gagatacagaaataaa

SEQ ID NO: 244176 - DNA, 16 bp, P. troglodytes
gagatagacagtagaa

SEQ ID NO: 244177 - DNA, 16 bp, P. troglodytes
gagatagagacagaga

SEQ ID NO: 244178 - DNA, 16 bp, P. troglodytes
gagatagagaccaatg

SEQ ID NO: 244179 - DNA, 16 bp, P. troglodytes
gagatagagagtagaa

SEQ ID NO: 244180 - DNA, 16 bp, P. troglodytes
gagatagagttttgct

SEQ ID NO: 244181 - DNA, 16 bp, P. troglodytes
gagataggagaaaaac

SEQ ID NO: 244182 - DNA, 16 bp, P. troglodytes
gagatagggtctcact

SEQ ID NO: 244183 - DNA, 16 bp, P. troglodytes
gagatagggtctctgt

SEQ ID NO: 244184 - DNA, 16 bp, P. troglodytes
gagatagggtctggct

SEQ ID NO: 244185 - DNA, 21 bp, P. troglodytes
gagatagggtttcaccatgtc

SEQ ID NO: 244186 - DNA, 16 bp, P. troglodytes
gagatattttactttt

SEQ ID NO: 244187 - DNA, 16 bp, P. troglodytes
gagatattttgataga

SEQ ID NO: 244188 - DNA, 16 bp, P. troglodytes
gagatattttggtaca

SEQ ID NO: 244189 - DNA, 17 bp, P. troglodytes
gagatcaacaccatcct

SEQ ID NO: 244190 - DNA, 16 bp, P. troglodytes
gagatcaagagtttga

SEQ ID NO: 244191 - DNA, 16 bp, P. troglodytes
gagatcaaggccagcc

SEQ ID NO: 244192 - DNA, 16 bp, P. troglodytes
gagatcaataccatcc

SEQ ID NO: 244193 - DNA, 16 bp, P. troglodytes
gagatcacgccactgt

SEQ ID NO: 244194 - DNA, 16 bp, P. troglodytes
gagatcacgctactgt

SEQ ID NO: 244195 - DNA, 16 bp, P. troglodytes
gagatcacgctgctgc

SEQ ID NO: 244196 - DNA, 16 bp, P. troglodytes
gagatcactgaatcat

SEQ ID NO: 244197 - DNA, 16 bp, P. troglodytes
gagatcagcctgccca

SEQ ID NO: 244198 - DNA, 16 bp, P. troglodytes
gagatcatggcctttg

SEQ ID NO: 244199 - DNA, 16 bp, P. troglodytes
gagatcccagaggaag

SEQ ID NO: 244200 - DNA, 16 bp, P. troglodytes
gagatcccatctcaca

SEQ ID NO: 244201 - DNA, 16 bp, P. troglodytes
gagatccgccactgca

SEQ ID NO: 244202 - DNA, 16 bp, P. troglodytes
gagatcctgtttctac

SEQ ID NO: 244203 - DNA, 16 bp, P. troglodytes
gagatccttaacttaa

SEQ ID NO: 244204 - DNA, 16 bp, P. troglodytes
gagatcgagaccatct

SEQ ID NO: 244205 - DNA, 17 bp, P. troglodytes
gagatcgaggccagcct

SEQ ID NO: 244206 - DNA, 16 bp, P. troglodytes
gagatcgaggccatcc

SEQ ID NO: 244207 - DNA, 20 bp, P. troglodytes
gagatcgataccatcctggc

SEQ ID NO: 244208 - DNA, 19 bp, P. troglodytes
gagatcgcaccattgcact

SEQ ID NO: 244209 - DNA, 16 bp, P. troglodytes
gagatcgccccactgc

SEQ ID NO: 244210 - DNA, 19 bp, P. troglodytes
gagatcgcgccactgtact

SEQ ID NO: 244211 - DNA, 19 bp, P. troglodytes
gagatcgctccattgcact

SEQ ID NO: 244212 - DNA, 16 bp, P. troglodytes
gagatcgtgccactgt

SEQ ID NO: 244213 - DNA, 16 bp, P. troglodytes
gagatctgaaggatga

SEQ ID NO: 244214 - DNA, 16 bp, P. troglodytes
gagatcttttacttct

SEQ ID NO: 244215 - DNA, 16 bp, P. troglodytes
gagatgaaatcacagg

SEQ ID NO: 244216 - DNA, 16 bp, P. troglodytes
gagatgaaattttgct

SEQ ID NO: 244217 - DNA, 16 bp, P. troglodytes
gagatgaagaaactga

SEQ ID NO: 244218 - DNA, 16 bp, P. troglodytes
gagatgaagtcttgct

SEQ ID NO: 244219 - DNA, 16 bp, P. troglodytes
gagatgacatctcatt

SEQ ID NO: 244220 - DNA, 16 bp, P. troglodytes
gagatgagcctggaca

SEQ ID NO: 244221 - DNA, 16 bp, P. troglodytes
gagatgaggaaggctg

SEQ ID NO: 244222 - DNA, 16 bp, P. troglodytes
gagatgagggtctcgc

SEQ ID NO: 244223 - DNA, 17 bp, P. troglodytes
gagatgaggtttcacct

SEQ ID NO: 244224 - DNA, 16 bp, P. troglodytes
gagatgatcagaaaaa

SEQ ID NO: 244225 - DNA, 16 bp, P. troglodytes
gagatgatggtggctt

SEQ ID NO: 244226 - DNA, 16 bp, P. troglodytes
gagatgcggtttcacc

SEQ ID NO: 244227 - DNA, 16 bp, P. troglodytes
gagatgctggtcaaag

SEQ ID NO: 244228 - DNA, 16 bp, P. troglodytes
gagatgcttgaagaag

SEQ ID NO: 244229 - DNA, 16 bp, P. troglodytes
gagatggaatctcact

SEQ ID NO: 244230 - DNA, 16 bp, P. troglodytes
gagatggaattttgct

SEQ ID NO: 244231 - DNA, 16 bp, P. troglodytes
gagatggagagagatg

SEQ ID NO: 244232 - DNA, 16 bp, P. troglodytes
gagatggagatgagga

SEQ ID NO: 244233 - DNA, 16 bp, P. troglodytes
gagatggagccattgc

SEQ ID NO: 244234 - DNA, 16 bp, P. troglodytes
gagatggagcctggct

SEQ ID NO: 244235 - DNA, 16 bp, P. troglodytes
gagatggaggccatcc

SEQ ID NO: 244236 - DNA, 16 bp, P. troglodytes
gagatggaggctgtgg

SEQ ID NO: 244237 - DNA, 16 bp, P. troglodytes
gagatggagtatcgct

SEQ ID NO: 244238 - DNA, 16 bp, P. troglodytes
gagatggagtctcacg

SEQ ID NO: 244239 - DNA, 16 bp, P. troglodytes
gagatggagtctcgcc

SEQ ID NO: 244240 - DNA, 16 bp, P. troglodytes
gagatggagtctcgct

SEQ ID NO: 244241 - DNA, 17 bp, P. troglodytes
gagatggagttcgctct

SEQ ID NO: 244242 - DNA, 16 bp, P. troglodytes
gagatggagtttcact

SEQ ID NO: 244243 - DNA, 16 bp, P. troglodytes
gagatggagtttcgcc

SEQ ID NO: 244244 - DNA, 16 bp, P. troglodytes
gagatggagtttcgct

SEQ ID NO: 244245 - DNA, 16 bp, P. troglodytes
gagatggagtttggct

SEQ ID NO: 244246 - DNA, 16 bp, P. troglodytes
gagatggatgaagctg

SEQ ID NO: 244247 - DNA, 16 bp, P. troglodytes
gagatggatggtgatg

SEQ ID NO: 244248 - DNA, 16 bp, P. troglodytes
gagatggatttgaggg

SEQ ID NO: 244249 - DNA, 16 bp, P. troglodytes
gagatggcactgctgc

SEQ ID NO: 244250 - DNA, 16 bp, P. troglodytes
gagatggcagcagcac

SEQ ID NO: 244251 - DNA, 16 bp, P. troglodytes
gagatggcagcagtac

SEQ ID NO: 244252 - DNA, 16 bp, P. troglodytes
gagatggcatctcact

SEQ ID NO: 244253 - DNA, 16 bp, P. troglodytes
gagatggcgcccctgc

SEQ ID NO: 244254 - DNA, 16 bp, P. troglodytes
gagatggcgtcttgct

SEQ ID NO: 244255 - DNA, 16 bp, P. troglodytes
gagatggcgtttcacc

SEQ ID NO: 244256 - DNA, 16 bp, P. troglodytes
gagatgggatctcact

SEQ ID NO: 244257 - DNA, 16 bp, P. troglodytes
gagatgggatcttgct

SEQ ID NO: 244258 - DNA, 16 bp, P. troglodytes
gagatggggaagactg

SEQ ID NO: 244259 - DNA, 16 bp, P. troglodytes
gagatggggatctcac

SEQ ID NO: 244260 - DNA, 16 bp, P. troglodytes
gagatggggatggtta

SEQ ID NO: 244261 - DNA, 16 bp, P. troglodytes
gagatggggcctttgg

SEQ ID NO: 244262 - DNA, 16 bp, P. troglodytes
gagatgggggctgcag

SEQ ID NO: 244263 - DNA, 16 bp, P. troglodytes
gagatgggggtctcac

SEQ ID NO: 244264 - DNA, 16 bp, P. troglodytes
gagatggggtctcact

SEQ ID NO: 244265 - DNA, 16 bp, P. troglodytes
gagatggggtctcgct

SEQ ID NO: 244266 - DNA, 16 bp, P. troglodytes
gagatggggtcttact

SEQ ID NO: 244267 - DNA, 16 bp, P. troglodytes
gagatggggtcttgct

SEQ ID NO: 244268 - DNA, 22 bp, P. troglodytes
gagatggggtttcactgtgttg

SEQ ID NO: 244269 - DNA, 16 bp, P. troglodytes
gagatggggtttcgcc

SEQ ID NO: 244270 - DNA, 16 bp, P. troglodytes
gagatggggttttact

SEQ ID NO: 244271 - DNA, 16 bp, P. troglodytes
gagatgggtcttctga

SEQ ID NO: 244272 - DNA, 16 bp, P. troglodytes
gagatgggttctcact

SEQ ID NO: 244273 - DNA, 16 bp, P. troglodytes
gagatgttatttgtgg

SEQ ID NO: 244274 - DNA, 16 bp, P. troglodytes
gagatgttggactgtg

SEQ ID NO: 244275 - DNA, 16 bp, P. troglodytes
gagatgtttttggttg

SEQ ID NO: 244276 - DNA, 16 bp, P. troglodytes
gagattaacttttttt

SEQ ID NO: 244277 - DNA, 16 bp, P. troglodytes
gagattaagtgacttg

SEQ ID NO: 244278 - DNA, 21 bp, P. troglodytes
gagattacaaagtacattgat

SEQ ID NO: 244279 - DNA, 16 bp, P. troglodytes
gagattacaatttgac

SEQ ID NO: 244280 - DNA, 16 bp, P. troglodytes
gagattacagtcatga

SEQ ID NO: 244281 - DNA, 16 bp, P. troglodytes
gagattaggagttcaa

SEQ ID NO: 244282 - DNA, 16 bp, P. troglodytes
gagattattatgaaca

SEQ ID NO: 244283 - DNA, 16 bp, P. troglodytes
gagattcacatttgag

SEQ ID NO: 244284 - DNA, 16 bp, P. troglodytes
gagattcacccatgtt

SEQ ID NO: 244285 - DNA, 16 bp, P. troglodytes
gagattcatctgtgtt

SEQ ID NO: 244286 - DNA, 16 bp, P. troglodytes
gagattctgattcagc

SEQ ID NO: 244287 - DNA, 16 bp, P. troglodytes
gagattctgattcagt

SEQ ID NO: 244288 - DNA, 16 bp, P. troglodytes
gagattctgccactgc

SEQ ID NO: 244289 - DNA, 16 bp, P. troglodytes
gagattctggcatgtt

SEQ ID NO: 244290 - DNA, 16 bp, P. troglodytes
gagattctgtcaccac

SEQ ID NO: 244291 - DNA, 16 bp, P. troglodytes
gagattcttttttatt

SEQ ID NO: 244292 - DNA, 16 bp, P. troglodytes
gagattgaaataataa

SEQ ID NO: 244293 - DNA, 16 bp, P. troglodytes
gagattgcagtaagcc

SEQ ID NO: 244294 - DNA, 16 bp, P. troglodytes
gagattgcagtgagcc

SEQ ID NO: 244295 - DNA, 16 bp, P. troglodytes
gagattgcagtgagtc

SEQ ID NO: 244296 - DNA, 16 bp, P. troglodytes
gagattgcggtgagcc

SEQ ID NO: 244297 - DNA, 16 bp, P. troglodytes
gagattgctgaatcat

SEQ ID NO: 244298 - DNA, 16 bp, P. troglodytes
gagattgggcaattta

SEQ ID NO: 244299 - DNA, 16 bp, P. troglodytes
gagattgggttttgct

SEQ ID NO: 244300 - DNA, 16 bp, P. troglodytes
gagattgtggagaaaa

SEQ ID NO: 244301 - DNA, 16 bp, P. troglodytes
gagatttcacataaaa

SEQ ID NO: 244302 - DNA, 16 bp, P. troglodytes
gagatttctccaagaa

SEQ ID NO: 244303 - DNA, 16 bp, P. troglodytes
gagatttggaaggggc

SEQ ID NO: 244304 - DNA, 16 bp, P. troglodytes
gagatttggatgggac

SEQ ID NO: 244305 - DNA, 16 bp, P. troglodytes
gagatttgggtgggat

SEQ ID NO: 244306 - DNA, 16 bp, P. troglodytes
gagattttcctggatt

SEQ ID NO: 244307 - DNA, 16 bp, P. troglodytes
gagattttggtgagga

SEQ ID NO: 244308 - DNA, 16 bp, P. troglodytes
gagatttttttcccca

SEQ ID NO: 244309 - DNA, 16 bp, P. troglodytes
gagattttttttcaaa

SEQ ID NO: 244310 - DNA, 16 bp, P. troglodytes
gagcaaaatcatctaa

SEQ ID NO: 244311 - DNA, 16 bp, P. troglodytes
gagcaaagaaattcaa

SEQ ID NO: 244312 - DNA, 16 bp, P. troglodytes
gagcaaagaacatgaa

SEQ ID NO: 244313 - DNA, 16 bp, P. troglodytes
gagcaaagctggagga

SEQ ID NO: 244314 - DNA, 16 bp, P. troglodytes
gagcaaagctggatgg

SEQ ID NO: 244315 - DNA, 16 bp, P. troglodytes
gagcaaaggcaattca

SEQ ID NO: 244316 - DNA, 16 bp, P. troglodytes
gagcaacagagggaga

SEQ ID NO: 244317 - DNA, 16 bp, P. troglodytes
gagcaacaggaacttt

SEQ ID NO: 244318 - DNA, 16 bp, P. troglodytes
gagcaacatagcaaaa

SEQ ID NO: 244319 - DNA, 16 bp, P. troglodytes
gagcaacatagtgagg

SEQ ID NO: 244320 - DNA, 16 bp, P. troglodytes
gagcaaccgcgcccgg

SEQ ID NO: 244321 - DNA, 16 bp, P. troglodytes
gagcaactggaacttt

SEQ ID NO: 244322 - DNA, 16 bp, P. troglodytes
gagcaagaccctgttc

SEQ ID NO: 244323 - DNA, 16 bp, P. troglodytes
gagcaagaccctgttt

SEQ ID NO: 244324 - DNA, 16 bp, P. troglodytes
gagcaagactttgttt

SEQ ID NO: 244325 - DNA, 16 bp, P. troglodytes
gagcaagcagctcaag

SEQ ID NO: 244326 - DNA, 16 bp, P. troglodytes
gagcaagccccccaaa

SEQ ID NO: 244327 - DNA, 16 bp, P. troglodytes
gagcaattttcttatt

SEQ ID NO: 244328 - DNA, 16 bp, P. troglodytes
gagcacagccctgctg

SEQ ID NO: 244329 - DNA, 16 bp, P. troglodytes
gagcacagcctgccag

SEQ ID NO: 244330 - DNA, 16 bp, P. troglodytes
gagcaccacatcaagg

SEQ ID NO: 244331 - DNA, 16 bp, P. troglodytes
gagcacctggaggaag

SEQ ID NO: 244332 - DNA, 16 bp, P. troglodytes
gagcactggaaatgtg

SEQ ID NO: 244333 - DNA, 16 bp, P. troglodytes
gagcactgtgctggga

SEQ ID NO: 244334 - DNA, 16 bp, P. troglodytes
gagcactttctatgtg

SEQ ID NO: 244335 - DNA, 16 bp, P. troglodytes
gagcactttgaggcct

SEQ ID NO: 244336 - DNA, 16 bp, P. troglodytes
gagcactttgggaggc

SEQ ID NO: 244337 - DNA, 18 bp, P. troglodytes
gagcagaaaagctgaaaa

SEQ ID NO: 244338 - DNA, 16 bp, P. troglodytes
gagcagagcagagcag

SEQ ID NO: 244339 - DNA, 16 bp, P. troglodytes
gagcagagccctcatg

SEQ ID NO: 244340 - DNA, 16 bp, P. troglodytes
gagcagaggctgagga

SEQ ID NO: 244341 - DNA, 16 bp, P. troglodytes
gagcagaggggtgact

SEQ ID NO: 244342 - DNA, 16 bp, P. troglodytes
gagcagagtttccagg

SEQ ID NO: 244343 - DNA, 16 bp, P. troglodytes
gagcagcagagcaaga

SEQ ID NO: 244344 - DNA, 16 bp, P. troglodytes
gagcagcagtcagaga

SEQ ID NO: 244345 - DNA, 16 bp, P. troglodytes
gagcagccagccggcc

SEQ ID NO: 244346 - DNA, 16 bp, P. troglodytes
gagcagccctgggctg

SEQ ID NO: 244347 - DNA, 17 bp, P. troglodytes
gagcagccggccagccc

SEQ ID NO: 244348 - DNA, 16 bp, P. troglodytes
gagcagcctagccaac

SEQ ID NO: 244349 - DNA, 16 bp, P. troglodytes
gagcagcctgggcaat

SEQ ID NO: 244350 - DNA, 16 bp, P. troglodytes
gagcagcctgggcagc

SEQ ID NO: 244351 - DNA, 16 bp, P. troglodytes
gagcagctggaacaca

SEQ ID NO: 244352 - DNA, 16 bp, P. troglodytes
gagcagctggggttac

SEQ ID NO: 244353 - DNA, 16 bp, P. troglodytes
gagcagctgtgctgtg

SEQ ID NO: 244354 - DNA, 16 bp, P. troglodytes
gagcaggagaagatgg

SEQ ID NO: 244355 - DNA, 16 bp, P. troglodytes
gagcaggagagagaca

SEQ ID NO: 244356 - DNA, 16 bp, P. troglodytes
gagcaggaggaagaca

SEQ ID NO: 244357 - DNA, 16 bp, P. troglodytes
gagcaggagtagctgt

SEQ ID NO: 244358 - DNA, 16 bp, P. troglodytes
gagcagggagaggcca

SEQ ID NO: 244359 - DNA, 16 bp, P. troglodytes
gagcaggggaaactgc

SEQ ID NO: 244360 - DNA, 16 bp, P. troglodytes
gagcagggggcggtgc

SEQ ID NO: 244361 - DNA, 16 bp, P. troglodytes
gagcaggtgaccaggg

SEQ ID NO: 244362 - DNA, 16 bp, P. troglodytes
gagcaggtgctgggag

SEQ ID NO: 244363 - DNA, 16 bp, P. troglodytes
gagcaggtggtgtttg

SEQ ID NO: 244364 - DNA, 16 bp, P. troglodytes
gagcagtcagaacaca

SEQ ID NO: 244365 - DNA, 16 bp, P. troglodytes
gagcagtgagagaggg

SEQ ID NO: 244366 - DNA, 16 bp, P. troglodytes
gagcagtgaggatgac

SEQ ID NO: 244367 - DNA, 16 bp, P. troglodytes
gagcagtggctcaccc

SEQ ID NO: 244368 - DNA, 16 bp, P. troglodytes
gagcagtggctcaggc

SEQ ID NO: 244369 - DNA, 16 bp, P. troglodytes
gagcagttaaaaaaaa

SEQ ID NO: 244370 - DNA, 16 bp, P. troglodytes
gagcatattatttaat

SEQ ID NO: 244371 - DNA, 16 bp, P. troglodytes
gagcatattttcatgt

SEQ ID NO: 244372 - DNA, 16 bp, P. troglodytes
gagcatattttcattt

SEQ ID NO: 244373 - DNA, 16 bp, P. troglodytes
gagcatgcagccccag

SEQ ID NO: 244374 - DNA, 16 bp, P. troglodytes
gagcatgccactgtac

SEQ ID NO: 244375 - DNA, 16 bp, P. troglodytes
gagcatgggctctggg

SEQ ID NO: 244376 - DNA, 16 bp, P. troglodytes
gagcatggtggttcat

SEQ ID NO: 244377 - DNA, 16 bp, P. troglodytes
gagcattcctaatcca

SEQ ID NO: 244378 - DNA, 16 bp, P. troglodytes
gagcattgaatgtttt

SEQ ID NO: 244379 - DNA, 16 bp, P. troglodytes
gagcattttgtcatat

SEQ ID NO: 244380 - DNA, 16 bp, P. troglodytes
gagcattttttttctt

SEQ ID NO: 244381 - DNA, 16 bp, P. troglodytes
gagccaaattctacca

SEQ ID NO: 244382 - DNA, 16 bp, P. troglodytes
gagccaagaacatgcc

SEQ ID NO: 244383 - DNA, 16 bp, P. troglodytes
gagccaagatcctgcc

SEQ ID NO: 244384 - DNA, 16 bp, P. troglodytes
gagccaagattcaaac

SEQ ID NO: 244385 - DNA, 16 bp, P. troglodytes
gagccaagcacagcct

SEQ ID NO: 244386 - DNA, 16 bp, P. troglodytes
gagccaaggaggtcaa

SEQ ID NO: 244387 - DNA, 16 bp, P. troglodytes
gagccaattctttaaa

SEQ ID NO: 244388 - DNA, 16 bp, P. troglodytes
gagccacagagcctgg

SEQ ID NO: 244389 - DNA, 16 bp, P. troglodytes
gagccacagcacccag

SEQ ID NO: 244390 - DNA, 16 bp, P. troglodytes
gagccacagcgcccaa

SEQ ID NO: 244391 - DNA, 16 bp, P. troglodytes
gagccacagggcctgg

SEQ ID NO: 244392 - DNA, 16 bp, P. troglodytes
gagccacagtgccagg

SEQ ID NO: 244393 - DNA, 16 bp, P. troglodytes
gagccacagtgctcag

SEQ ID NO: 244394 - DNA, 16 bp, P. troglodytes
gagccaccacgccagc

SEQ ID NO: 244395 - DNA, 16 bp, P. troglodytes
gagccaccactcccag

SEQ ID NO: 244396 - DNA, 16 bp, P. troglodytes
gagccaccactcctag

SEQ ID NO: 244397 - DNA, 16 bp, P. troglodytes
gagccaccacttccag

SEQ ID NO: 244398 - DNA, 16 bp, P. troglodytes
gagccaccagcccagc

SEQ ID NO: 244399 - DNA, 16 bp, P. troglodytes
gagccaccatgccaag

SEQ ID NO: 244400 - DNA, 16 bp, P. troglodytes
gagccaccatgcctgc

SEQ ID NO: 244401 - DNA, 16 bp, P. troglodytes
gagccaccccacctgg

SEQ ID NO: 244402 - DNA, 16 bp, P. troglodytes
gagccaccctgcccag

SEQ ID NO: 244403 - DNA, 16 bp, P. troglodytes
gagccaccgcagccgg

SEQ ID NO: 244404 - DNA, 16 bp, P. troglodytes
gagccaccgtggctgg

SEQ ID NO: 244405 - DNA, 16 bp, P. troglodytes
gagccacctccaccac

SEQ ID NO: 244406 - DNA, 16 bp, P. troglodytes
gagccacctggcccag

SEQ ID NO: 244407 - DNA, 16 bp, P. troglodytes
gagccacctggcctgg

SEQ ID NO: 244408 - DNA, 16 bp, P. troglodytes
gagccacggcacccag

SEQ ID NO: 244409 - DNA, 16 bp, P. troglodytes
gagccactgaactcca

SEQ ID NO: 244410 - DNA, 16 bp, P. troglodytes
gagccactgagcctga

SEQ ID NO: 244411 - DNA, 16 bp, P. troglodytes
gagccactgccccagg

SEQ ID NO: 244412 - DNA, 16 bp, P. troglodytes
gagccactgcccccaa

SEQ ID NO: 244413 - DNA, 16 bp, P. troglodytes
gagccactgcccccag

SEQ ID NO: 244414 - DNA, 16 bp, P. troglodytes
gagccactgcgcccat

SEQ ID NO: 244415 - DNA, 17 bp, P. troglodytes
gagccactgcgcccggc

SEQ ID NO: 244416 - DNA, 16 bp, P. troglodytes
gagccactggacctgg

SEQ ID NO: 244417 - DNA, 16 bp, P. troglodytes
gagccactgggccagg

SEQ ID NO: 244418 - DNA, 16 bp, P. troglodytes
gagccactgtgaccag

SEQ ID NO: 244419 - DNA, 16 bp, P. troglodytes
gagccactgtggccag

SEQ ID NO: 244420 - DNA, 16 bp, P. troglodytes
gagccacttcacctgg

SEQ ID NO: 244421 - DNA, 16 bp, P. troglodytes
gagccagagaagtgac

SEQ ID NO: 244422 - DNA, 16 bp, P. troglodytes
gagccagaggctgcag

SEQ ID NO: 244423 - DNA, 16 bp, P. troglodytes
gagccaggcacagagc

SEQ ID NO: 244424 - DNA, 16 bp, P. troglodytes
gagccaggccctggag

SEQ ID NO: 244425 - DNA, 16 bp, P. troglodytes
gagccagggaggctgg

SEQ ID NO: 244426 - DNA, 17 bp, P. troglodytes
gagccaggtgcggtggc

SEQ ID NO: 244427 - DNA, 16 bp, P. troglodytes
gagccaggtgtggtga

SEQ ID NO: 244428 - DNA, 16 bp, P. troglodytes
gagccagtatttcaaa

SEQ ID NO: 244429 - DNA, 16 bp, P. troglodytes
gagccatccttgcatc

SEQ ID NO: 244430 - DNA, 16 bp, P. troglodytes
gagccatggtgcccag

SEQ ID NO: 244431 - DNA, 16 bp, P. troglodytes
gagccatggtggtttg

SEQ ID NO: 244432 - DNA, 16 bp, P. troglodytes
gagccattgtacccag

SEQ ID NO: 244433 - DNA, 16 bp, P. troglodytes
gagcccaacagtttga

SEQ ID NO: 244434 - DNA, 16 bp, P. troglodytes
gagcccaagagtccaa

SEQ ID NO: 244435 - DNA, 16 bp, P. troglodytes
gagcccaaggaggtca

SEQ ID NO: 244436 - DNA, 16 bp, P. troglodytes
gagcccaccacagttc

SEQ ID NO: 244437 - DNA, 19 bp, P. troglodytes
gagcccactccctcagctt

SEQ ID NO: 244438 - DNA, 16 bp, P. troglodytes
gagcccactgaggcct

SEQ ID NO: 244439 - DNA, 16 bp, P. troglodytes
gagcccagaggtggag

SEQ ID NO: 244440 - DNA, 16 bp, P. troglodytes
gagcccagaggttcaa

SEQ ID NO: 244441 - DNA, 17 bp, P. troglodytes
gagcccagatcgcgcca

SEQ ID NO: 244442 - DNA, 16 bp, P. troglodytes
gagcccagcaagacca

SEQ ID NO: 244443 - DNA, 16 bp, P. troglodytes
gagcccagcccagccc

SEQ ID NO: 244444 - DNA, 16 bp, P. troglodytes
gagcccagcctgagca

SEQ ID NO: 244445 - DNA, 16 bp, P. troglodytes
gagcccaggaggagga

SEQ ID NO: 244446 - DNA, 16 bp, P. troglodytes
gagcccaggaggctga

SEQ ID NO: 244447 - DNA, 16 bp, P. troglodytes
gagcccaggaggtggg

SEQ ID NO: 244448 - DNA, 16 bp, P. troglodytes
gagcccaggagtcaag

SEQ ID NO: 244449 - DNA, 16 bp, P. troglodytes
gagcccaggagtccaa

SEQ ID NO: 244450 - DNA, 16 bp, P. troglodytes
gagcccaggagtccca

SEQ ID NO: 244451 - DNA, 17 bp, P. troglodytes
gagcccaggcagaggag

SEQ ID NO: 244452 - DNA, 16 bp, P. troglodytes
gagcccaggctgttgc

SEQ ID NO: 244453 - DNA, 16 bp, P. troglodytes
gagcccagggatgctg

SEQ ID NO: 244454 - DNA, 16 bp, P. troglodytes
gagcccagtagttcaa

SEQ ID NO: 244455 - DNA, 16 bp, P. troglodytes
gagcccatgcccaccc

SEQ ID NO: 244456 - DNA, 16 bp, P. troglodytes
gagcccattgccctga

SEQ ID NO: 244457 - DNA, 16 bp, P. troglodytes
gagccccacagcctgc

SEQ ID NO: 244458 - DNA, 16 bp, P. troglodytes
gagccccagtctgagg

SEQ ID NO: 244459 - DNA, 16 bp, P. troglodytes
gagcccccaggagctg

SEQ ID NO: 244460 - DNA, 16 bp, P. troglodytes
gagcccccgcgcctgg

SEQ ID NO: 244461 - DNA, 16 bp, P. troglodytes
gagcccctgggccctg

SEQ ID NO: 244462 - DNA, 16 bp, P. troglodytes
gagcccgggaagcgga

SEQ ID NO: 244463 - DNA, 16 bp, P. troglodytes
gagcccgggagacaga

SEQ ID NO: 244464 - DNA, 16 bp, P. troglodytes
gagccctcatcagaca

SEQ ID NO: 244465 - DNA, 16 bp, P. troglodytes
gagccctcatgaatgg

SEQ ID NO: 244466 - DNA, 16 bp, P. troglodytes
gagccctgccccgtgg

SEQ ID NO: 244467 - DNA, 16 bp, P. troglodytes
gagccctggattccat

SEQ ID NO: 244468 - DNA, 17 bp, P. troglodytes
gagccgagaccatgcca

SEQ ID NO: 244469 - DNA, 17 bp, P. troglodytes
gagccgagatcacgcca

SEQ ID NO: 244470 - DNA, 16 bp, P. troglodytes
gagccgagatcccacc

SEQ ID NO: 244471 - DNA, 16 bp, P. troglodytes
gagccgagatggagcc

SEQ ID NO: 244472 - DNA, 16 bp, P. troglodytes
gagccgagatggctcc

SEQ ID NO: 244473 - DNA, 16 bp, P. troglodytes
gagccgaggctggact

SEQ ID NO: 244474 - DNA, 16 bp, P. troglodytes
gagccgccattttgaa

SEQ ID NO: 244475 - DNA, 16 bp, P. troglodytes
gagccgcccgcctcgg

SEQ ID NO: 244476 - DNA, 16 bp, P. troglodytes
gagccgccgcacccgg

SEQ ID NO: 244477 - DNA, 16 bp, P. troglodytes
gagccgctgcacctgg

SEQ ID NO: 244478 - DNA, 16 bp, P. troglodytes
gagccgggattacagg

SEQ ID NO: 244479 - DNA, 16 bp, P. troglodytes
gagccgggcatggtgg

SEQ ID NO: 244480 - DNA, 16 bp, P. troglodytes
gagccgggcgtggtgg

SEQ ID NO: 244481 - DNA, 16 bp, P. troglodytes
gagccgtgatctcacc

SEQ ID NO: 244482 - DNA, 16 bp, P. troglodytes
gagcctaaggtgggag

SEQ ID NO: 244483 - DNA, 16 bp, P. troglodytes
gagcctcagttccctc

SEQ ID NO: 244484 - DNA, 16 bp, P. troglodytes
gagcctcagtttccct

SEQ ID NO: 244485 - DNA, 16 bp, P. troglodytes
gagcctcatctgtaaa

SEQ ID NO: 244486 - DNA, 16 bp, P. troglodytes
gagcctccagaaggga

SEQ ID NO: 244487 - DNA, 16 bp, P. troglodytes
gagcctccccaacgag

SEQ ID NO: 244488 - DNA, 16 bp, P. troglodytes
gagcctccgtgcccag

SEQ ID NO: 244489 - DNA, 16 bp, P. troglodytes
gagcctctgcacccag

SEQ ID NO: 244490 - DNA, 16 bp, P. troglodytes
gagcctctggagggag

SEQ ID NO: 244491 - DNA, 16 bp, P. troglodytes
gagcctctgtgcctgg

SEQ ID NO: 244492 - DNA, 16 bp, P. troglodytes
gagcctgaaaaaatgc

SEQ ID NO: 244493 - DNA, 16 bp, P. troglodytes
gagcctgaagcaggag

SEQ ID NO: 244494 - DNA, 16 bp, P. troglodytes
gagcctgaggctggag

SEQ ID NO: 244495 - DNA, 16 bp, P. troglodytes
gagcctgcagagggag

SEQ ID NO: 244496 - DNA, 17 bp, P. troglodytes
gagcctgcaggtgcaca

SEQ ID NO: 244497 - DNA, 16 bp, P. troglodytes
gagcctgcagtgagcc

SEQ ID NO: 244498 - DNA, 16 bp, P. troglodytes
gagcctggcatggtgg

SEQ ID NO: 244499 - DNA, 16 bp, P. troglodytes
gagcctggccaacatg

SEQ ID NO: 244500 - DNA, 16 bp, P. troglodytes
gagcctgggaagttga

SEQ ID NO: 244501 - DNA, 16 bp, P. troglodytes
gagcctgggcaacata

SEQ ID NO: 244502 - DNA, 16 bp, P. troglodytes
gagcctggggaggagg

SEQ ID NO: 244503 - DNA, 16 bp, P. troglodytes
gagcctggggaggtgg

SEQ ID NO: 244504 - DNA, 16 bp, P. troglodytes
gagcctggggctgggg

SEQ ID NO: 244505 - DNA, 16 bp, P. troglodytes
gagcctgtggtctcag

SEQ ID NO: 244506 - DNA, 16 bp, P. troglodytes
gagcctgtgtgtgtct

SEQ ID NO: 244507 - DNA, 16 bp, P. troglodytes
gagccttcagaaatga

SEQ ID NO: 244508 - DNA, 16 bp, P. troglodytes
gagccttcagatgaga

SEQ ID NO: 244509 - DNA, 16 bp, P. troglodytes
gagccttgctctgttg

SEQ ID NO: 244510 - DNA, 16 bp, P. troglodytes
gagccttggtttcccc

SEQ ID NO: 244511 - DNA, 16 bp, P. troglodytes
gagcgaaacttcatct

SEQ ID NO: 244512 - DNA, 16 bp, P. troglodytes
gagcgactgtgcccag

SEQ ID NO: 244513 - DNA, 16 bp, P. troglodytes
gagcgagactccatcc

SEQ ID NO: 244514 - DNA, 16 bp, P. troglodytes
gagcgagagagcgaga

SEQ ID NO: 244515 - DNA, 16 bp, P. troglodytes
gagcgagcgagagaga

SEQ ID NO: 244516 - DNA, 16 bp, P. troglodytes
gagcgagcgagcgagc

SEQ ID NO: 244517 - DNA, 16 bp, P. troglodytes
gagcgtggtggtgggc

SEQ ID NO: 244518 - DNA, 16 bp, P. troglodytes
gagcgtggtggtgtgt

SEQ ID NO: 244519 - DNA, 16 bp, P. troglodytes
gagctaaataaatgga

SEQ ID NO: 244520 - DNA, 16 bp, P. troglodytes
gagctaagaatggttt

SEQ ID NO: 244521 - DNA, 16 bp, P. troglodytes
gagctaatttttgtat

SEQ ID NO: 244522 - DNA, 16 bp, P. troglodytes
gagctacaggccccat

SEQ ID NO: 244523 - DNA, 16 bp, P. troglodytes
gagctactgcgcctgg

SEQ ID NO: 244524 - DNA, 16 bp, P. troglodytes
gagctactgtgccagg

SEQ ID NO: 244525 - DNA, 16 bp, P. troglodytes
gagctaggatttgaat

SEQ ID NO: 244526 - DNA, 16 bp, P. troglodytes
gagctatgagaaataa

SEQ ID NO: 244527 - DNA, 16 bp, P. troglodytes
gagctatgtggagtct

SEQ ID NO: 244528 - DNA, 16 bp, P. troglodytes
gagctcaagaaatcct

SEQ ID NO: 244529 - DNA, 16 bp, P. troglodytes
gagctcaaggctgcag

SEQ ID NO: 244530 - DNA, 16 bp, P. troglodytes
gagctcaataaatgtt

SEQ ID NO: 244531 - DNA, 16 bp, P. troglodytes
gagctcacagtctaga

SEQ ID NO: 244532 - DNA, 16 bp, P. troglodytes
gagctcactgaggcca

SEQ ID NO: 244533 - DNA, 16 bp, P. troglodytes
gagctcactgcaacct

SEQ ID NO: 244534 - DNA, 16 bp, P. troglodytes
gagctcagaagttcca

SEQ ID NO: 244535 - DNA, 16 bp, P. troglodytes
gagctcaggaagttga

SEQ ID NO: 244536 - DNA, 16 bp, P. troglodytes
gagctcaggcagtaat

SEQ ID NO: 244537 - DNA, 16 bp, P. troglodytes
gagctcaggtggtaat

SEQ ID NO: 244538 - DNA, 16 bp, P. troglodytes
gagctcccaaaggaag

SEQ ID NO: 244539 - DNA, 16 bp, P. troglodytes
gagctcccagattcat

SEQ ID NO: 244540 - DNA, 16 bp, P. troglodytes
gagctccctgagggca

SEQ ID NO: 244541 - DNA, 16 bp, P. troglodytes
gagctcctaaatttat

SEQ ID NO: 244542 - DNA, 16 bp, P. troglodytes
gagctcctgaaagaaa

SEQ ID NO: 244543 - DNA, 16 bp, P. troglodytes
gagctcctgcacagca

SEQ ID NO: 244544 - DNA, 16 bp, P. troglodytes
gagctcctggcctcaa

SEQ ID NO: 244545 - DNA, 16 bp, P. troglodytes
gagctcggattttaag

SEQ ID NO: 244546 - DNA, 20 bp, P. troglodytes
gagctcggctcttgagacag

SEQ ID NO: 244547 - DNA, 16 bp, P. troglodytes
gagctctcctgtatga

SEQ ID NO: 244548 - DNA, 16 bp, P. troglodytes
gagctctggagtcaga

SEQ ID NO: 244549 - DNA, 16 bp, P. troglodytes
gagctcttgggtgact

SEQ ID NO: 244550 - DNA, 16 bp, P. troglodytes
gagctctttgaggaat

SEQ ID NO: 244551 - DNA, 16 bp, P. troglodytes
gagctgaagaccagcc

SEQ ID NO: 244552 - DNA, 16 bp, P. troglodytes
gagctgaagagagaga

SEQ ID NO: 244553 - DNA, 16 bp, P. troglodytes
gagctgaaggttgcag

SEQ ID NO: 244554 - DNA, 16 bp, P. troglodytes
gagctgagactgtgct

SEQ ID NO: 244555 - DNA, 16 bp, P. troglodytes
gagctgagagccttga

SEQ ID NO: 244556 - DNA, 16 bp, P. troglodytes
gagctgagataatgcc

SEQ ID NO: 244557 - DNA, 16 bp, P. troglodytes
gagctgagatcaagcc

SEQ ID NO: 244558 - DNA, 16 bp, P. troglodytes
gagctgagatcgtggc

SEQ ID NO: 244559 - DNA, 16 bp, P. troglodytes
gagctgagattgcagc

SEQ ID NO: 244560 - DNA, 16 bp, P. troglodytes
gagctgagcaaagggg

SEQ ID NO: 244561 - DNA, 16 bp, P. troglodytes
gagctgagctgagctg

SEQ ID NO: 244562 - DNA, 16 bp, P. troglodytes
gagctgaggctggagc

SEQ ID NO: 244563 - DNA, 16 bp, P. troglodytes
gagctgagggtggagg

SEQ ID NO: 244564 - DNA, 19 bp, P. troglodytes
gagctgatggagctgaaag

SEQ ID NO: 244565 - DNA, 16 bp, P. troglodytes
gagctgatgggtgcag

SEQ ID NO: 244566 - DNA, 16 bp, P. troglodytes
gagctgcaacattaaa

SEQ ID NO: 244567 - DNA, 16 bp, P. troglodytes
gagctgcagacataga

SEQ ID NO: 244568 - DNA, 16 bp, P. troglodytes
gagctgcagagatgac

SEQ ID NO: 244569 - DNA, 16 bp, P. troglodytes
gagctgccacgcccag

SEQ ID NO: 244570 - DNA, 16 bp, P. troglodytes
gagctgcccaaaacca

SEQ ID NO: 244571 - DNA, 16 bp, P. troglodytes
gagctgcccggttggg

SEQ ID NO: 244572 - DNA, 16 bp, P. troglodytes
gagctgccgtgcctgg

SEQ ID NO: 244573 - DNA, 16 bp, P. troglodytes
gagctgcctgccttgg

SEQ ID NO: 244574 - DNA, 16 bp, P. troglodytes
gagctgctgcgcctgg

SEQ ID NO: 244575 - DNA, 16 bp, P. troglodytes
gagctgctgtgcccag

SEQ ID NO: 244576 - DNA, 16 bp, P. troglodytes
gagctggaagctatta

SEQ ID NO: 244577 - DNA, 16 bp, P. troglodytes
gagctggaattcaaac

SEQ ID NO: 244578 - DNA, 16 bp, P. troglodytes
gagctggagcagctgg

SEQ ID NO: 244579 - DNA, 16 bp, P. troglodytes
gagctggatgcagtgg

SEQ ID NO: 244580 - DNA, 16 bp, P. troglodytes
gagctggatggtggtg

SEQ ID NO: 244581 - DNA, 16 bp, P. troglodytes
gagctggcacccaagc

SEQ ID NO: 244582 - DNA, 16 bp, P. troglodytes
gagctgggactacagg

SEQ ID NO: 244583 - DNA, 16 bp, P. troglodytes
gagctgggactatagg

SEQ ID NO: 244584 - DNA, 16 bp, P. troglodytes
gagctgggagctgggg

SEQ ID NO: 244585 - DNA, 16 bp, P. troglodytes
gagctgggatcacagg

SEQ ID NO: 244586 - DNA, 17 bp, P. troglodytes
gagctgggattacaggc

SEQ ID NO: 244587 - DNA, 17 bp, P. troglodytes
gagctgggattacaggt

SEQ ID NO: 244588 - DNA, 16 bp, P. troglodytes
gagctgggatttcaac

SEQ ID NO: 244589 - DNA, 16 bp, P. troglodytes
gagctgggatttgaac

SEQ ID NO: 244590 - DNA, 16 bp, P. troglodytes
gagctgggcatggtgg

SEQ ID NO: 244591 - DNA, 16 bp, P. troglodytes
gagctgggcccagggc

SEQ ID NO: 244592 - DNA, 16 bp, P. troglodytes
gagctgggcctggaga

SEQ ID NO: 244593 - DNA, 16 bp, P. troglodytes
gagctgggcctggtgg

SEQ ID NO: 244594 - DNA, 16 bp, P. troglodytes
gagctgggcgtggtgg

SEQ ID NO: 244595 - DNA, 16 bp, P. troglodytes
gagctggggccacagg

SEQ ID NO: 244596 - DNA, 16 bp, P. troglodytes
gagctgggggagggat

SEQ ID NO: 244597 - DNA, 16 bp, P. troglodytes
gagctggggtctcact

SEQ ID NO: 244598 - DNA, 16 bp, P. troglodytes
gagctggggtcttgct

SEQ ID NO: 244599 - DNA, 16 bp, P. troglodytes
gagctgggtgcagtgg

SEQ ID NO: 244600 - DNA, 16 bp, P. troglodytes
gagctgggtgtgatgg

SEQ ID NO: 244601 - DNA, 16 bp, P. troglodytes
gagctggtctcggcaa

SEQ ID NO: 244602 - DNA, 16 bp, P. troglodytes
gagctgtaaacactca

SEQ ID NO: 244603 - DNA, 16 bp, P. troglodytes
gagctgtaacactcac

SEQ ID NO: 244604 - DNA, 16 bp, P. troglodytes
gagctgtacctgggcc

SEQ ID NO: 244605 - DNA, 16 bp, P. troglodytes
gagctgtgagaagaga

SEQ ID NO: 244606 - DNA, 16 bp, P. troglodytes
gagctgtgatcacaac

SEQ ID NO: 244607 - DNA, 16 bp, P. troglodytes
gagctgtggcagagga

SEQ ID NO: 244608 - DNA, 16 bp, P. troglodytes
gagctgtgggaagggg

SEQ ID NO: 244609 - DNA, 24 bp, P. troglodytes
gagctgttcctattcggccatctt

SEQ ID NO: 244610 - DNA, 16 bp, P. troglodytes
gagctgtttgagttcc

SEQ ID NO: 244611 - DNA, 16 bp, P. troglodytes
gagctgtttggaaaca

SEQ ID NO: 244612 - DNA, 16 bp, P. troglodytes
gagcttaatttttttt

SEQ ID NO: 244613 - DNA, 16 bp, P. troglodytes
gagcttatattctagt

SEQ ID NO: 244614 - DNA, 16 bp, P. troglodytes
gagcttcccggctgct

SEQ ID NO: 244615 - DNA, 16 bp, P. troglodytes
gagcttccttgccatc

SEQ ID NO: 244616 - DNA, 16 bp, P. troglodytes
gagcttctccacagca

SEQ ID NO: 244617 - DNA, 16 bp, P. troglodytes
gagcttctgtgccctc

SEQ ID NO: 244618 - DNA, 16 bp, P. troglodytes
gagcttgacagcttcc

SEQ ID NO: 244619 - DNA, 16 bp, P. troglodytes
gagcttgaggtgggag

SEQ ID NO: 244620 - DNA, 16 bp, P. troglodytes
gagcttgcagagagcc

SEQ ID NO: 244621 - DNA, 16 bp, P. troglodytes
gagcttgcagcaagcc

SEQ ID NO: 244622 - DNA, 16 bp, P. troglodytes
gagcttgcagtaagcc

SEQ ID NO: 244623 - DNA, 16 bp, P. troglodytes
gagcttgcagtgacct

SEQ ID NO: 244624 - DNA, 16 bp, P. troglodytes
gagcttgcagtgagcc

SEQ ID NO: 244625 - DNA, 16 bp, P. troglodytes
gagcttgcagtgggcc

SEQ ID NO: 244626 - DNA, 16 bp, P. troglodytes
gagcttgccagctccc

SEQ ID NO: 244627 - DNA, 16 bp, P. troglodytes
gagcttggaagcagat

SEQ ID NO: 244628 - DNA, 16 bp, P. troglodytes
gagcttggatttgaac

SEQ ID NO: 244629 - DNA, 16 bp, P. troglodytes
gagcttgggctgtggc

SEQ ID NO: 244630 - DNA, 16 bp, P. troglodytes
gagcttgtagtgagcc

SEQ ID NO: 244631 - DNA, 16 bp, P. troglodytes
gagcttgtgcaggaaa

SEQ ID NO: 244632 - DNA, 16 bp, P. troglodytes
gagcttgttagaaatg

SEQ ID NO: 244633 - DNA, 16 bp, P. troglodytes
gagctttggagtcaga

SEQ ID NO: 244634 - DNA, 16 bp, P. troglodytes
gaggaaaaaatggttt

SEQ ID NO: 244635 - DNA, 16 bp, P. troglodytes
gaggaaaaaatgtttt

SEQ ID NO: 244636 - DNA, 16 bp, P. troglodytes
gaggaaaaagtggttt

SEQ ID NO: 244637 - DNA, 16 bp, P. troglodytes
gaggaaaactccatct

SEQ ID NO: 244638 - DNA, 16 bp, P. troglodytes
gaggaaaactgaggct

SEQ ID NO: 244639 - DNA, 16 bp, P. troglodytes
gaggaaaactggaaaa

SEQ ID NO: 244640 - DNA, 16 bp, P. troglodytes
gaggaaaagcagggtg

SEQ ID NO: 244641 - DNA, 16 bp, P. troglodytes
gaggaaaagcattcag

SEQ ID NO: 244642 - DNA, 16 bp, P. troglodytes
gaggaaaagctttcag

SEQ ID NO: 244643 - DNA, 16 bp, P. troglodytes
gaggaaaaggcacata

SEQ ID NO: 244644 - DNA, 16 bp, P. troglodytes
gaggaaaataaattgt

SEQ ID NO: 244645 - DNA, 16 bp, P. troglodytes
gaggaaacaacagatg

SEQ ID NO: 244646 - DNA, 16 bp, P. troglodytes
gaggaaacagacaaat

SEQ ID NO: 244647 - DNA, 16 bp, P. troglodytes
gaggaaactaaggctc

SEQ ID NO: 244648 - DNA, 16 bp, P. troglodytes
gaggaaactgaagttc

SEQ ID NO: 244649 - DNA, 16 bp, P. troglodytes
gaggaaactgaggtcc

SEQ ID NO: 244650 - DNA, 16 bp, P. troglodytes
gaggaaactgagtcac

SEQ ID NO: 244651 - DNA, 16 bp, P. troglodytes
gaggaaactgcagaag

SEQ ID NO: 244652 - DNA, 16 bp, P. troglodytes
gaggaaagaacaactc

SEQ ID NO: 244653 - DNA, 16 bp, P. troglodytes
gaggaaagagcaggca

SEQ ID NO: 244654 - DNA, 16 bp, P. troglodytes
gaggaaagaggtttaa

SEQ ID NO: 244655 - DNA, 16 bp, P. troglodytes
gaggaaagggaaccct

SEQ ID NO: 244656 - DNA, 16 bp, P. troglodytes
gaggaaatatttccaa

SEQ ID NO: 244657 - DNA, 16 bp, P. troglodytes
gaggaaatcaatgaaa

SEQ ID NO: 244658 - DNA, 16 bp, P. troglodytes
gaggaaatgaggaaat

SEQ ID NO: 244659 - DNA, 16 bp, P. troglodytes
gaggaaatgccacact

SEQ ID NO: 244660 - DNA, 16 bp, P. troglodytes
gaggaaatttaaatgc

SEQ ID NO: 244661 - DNA, 16 bp, P. troglodytes
gaggaacacctgagcc

SEQ ID NO: 244662 - DNA, 16 bp, P. troglodytes
gaggaactgaatttta

SEQ ID NO: 244663 - DNA, 16 bp, P. troglodytes
gaggaactgaggcaca

SEQ ID NO: 244664 - DNA, 16 bp, P. troglodytes
gaggaacttccaaaca

SEQ ID NO: 244665 - DNA, 16 bp, P. troglodytes
gaggaacttgccaaac

SEQ ID NO: 244666 - DNA, 16 bp, P. troglodytes
gaggaagaaactgaag

SEQ ID NO: 244667 - DNA, 16 bp, P. troglodytes
gaggaagagaagacca

SEQ ID NO: 244668 - DNA, 16 bp, P. troglodytes
gaggaagaggatcagg

SEQ ID NO: 244669 - DNA, 16 bp, P. troglodytes
gaggaagatctaccca

SEQ ID NO: 244670 - DNA, 16 bp, P. troglodytes
gaggaagcagcagcag

SEQ ID NO: 244671 - DNA, 16 bp, P. troglodytes
gaggaagctgaagaag

SEQ ID NO: 244672 - DNA, 16 bp, P. troglodytes
gaggaagctgaggctc

SEQ ID NO: 244673 - DNA, 16 bp, P. troglodytes
gaggaaggactcctcc

SEQ ID NO: 244674 - DNA, 16 bp, P. troglodytes
gaggaaggagaatggc

SEQ ID NO: 244675 - DNA, 17 bp, P. troglodytes
gaggaaggatcaggcag

SEQ ID NO: 244676 - DNA, 16 bp, P. troglodytes
gaggaaggcttcagaa

SEQ ID NO: 244677 - DNA, 16 bp, P. troglodytes
gaggaaggggccctgc

SEQ ID NO: 244678 - DNA, 16 bp, P. troglodytes
gaggaagtcagactgt

SEQ ID NO: 244679 - DNA, 16 bp, P. troglodytes
gaggaagtgccaggct

SEQ ID NO: 244680 - DNA, 16 bp, P. troglodytes
gaggaatacatttctg

SEQ ID NO: 244681 - DNA, 16 bp, P. troglodytes
gaggaatccctcctcc

SEQ ID NO: 244682 - DNA, 16 bp, P. troglodytes
gaggaatgaacaactc

SEQ ID NO: 244683 - DNA, 16 bp, P. troglodytes
gaggaattcaaggctg

SEQ ID NO: 244684 - DNA, 16 bp, P. troglodytes
gaggaattccagaaga

SEQ ID NO: 244685 - DNA, 16 bp, P. troglodytes
gaggacaaggctgcag

SEQ ID NO: 244686 - DNA, 16 bp, P. troglodytes
gaggacacaaacaaag

SEQ ID NO: 244687 - DNA, 16 bp, P. troglodytes
gaggacacaaagacat

SEQ ID NO: 244688 - DNA, 16 bp, P. troglodytes
gaggacacaatgagaa

SEQ ID NO: 244689 - DNA, 16 bp, P. troglodytes
gaggacacagagaagg

SEQ ID NO: 244690 - DNA, 16 bp, P. troglodytes
gaggacagctgcctgg

SEQ ID NO: 244691 - DNA, 16 bp, P. troglodytes
gaggacaggagtttga

SEQ ID NO: 244692 - DNA, 16 bp, P. troglodytes
gaggacattatgttaa

SEQ ID NO: 244693 - DNA, 16 bp, P. troglodytes
gaggacattctgctaa

SEQ ID NO: 244694 - DNA, 16 bp, P. troglodytes
gaggacccaggacatc

SEQ ID NO: 244695 - DNA, 16 bp, P. troglodytes
gaggaccctcagctgc

SEQ ID NO: 244696 - DNA, 16 bp, P. troglodytes
gaggaccctggggcct

SEQ ID NO: 244697 - DNA, 16 bp, P. troglodytes
gaggacgaggcaggtg

SEQ ID NO: 244698 - DNA, 16 bp, P. troglodytes
gaggactcagaagaag

SEQ ID NO: 244699 - DNA, 16 bp, P. troglodytes
gaggactcagaagaca

SEQ ID NO: 244700 - DNA, 16 bp, P. troglodytes
gaggactccccagcca

SEQ ID NO: 244701 - DNA, 16 bp, P. troglodytes
gaggactctcttcctg

SEQ ID NO: 244702 - DNA, 16 bp, P. troglodytes
gaggactgcctgagct

SEQ ID NO: 244703 - DNA, 16 bp, P. troglodytes
gaggactgcttgtgcc

SEQ ID NO: 244704 - DNA, 16 bp, P. troglodytes
gaggacttcctggagg

SEQ ID NO: 244705 - DNA, 16 bp, P. troglodytes
gaggacttggagaact

SEQ ID NO: 244706 - DNA, 16 bp, P. troglodytes
gaggactttttttttt

SEQ ID NO: 244707 - DNA, 16 bp, P. troglodytes
gaggagaaaaatgtgt

SEQ ID NO: 244708 - DNA, 16 bp, P. troglodytes
gaggagaagcagcagc

SEQ ID NO: 244709 - DNA, 16 bp, P. troglodytes
gaggagaagcagctgg

SEQ ID NO: 244710 - DNA, 16 bp, P. troglodytes
gaggagaaggccatgt

SEQ ID NO: 244711 - DNA, 16 bp, P. troglodytes
gaggagaatcacttga

SEQ ID NO: 244712 - DNA, 16 bp, P. troglodytes
gaggagaatggtgtga

SEQ ID NO: 244713 - DNA, 16 bp, P. troglodytes
gaggagagccagagaa

SEQ ID NO: 244714 - DNA, 16 bp, P. troglodytes
gaggagagcccaggcc

SEQ ID NO: 244715 - DNA, 16 bp, P. troglodytes
gaggagaggcattctg

SEQ ID NO: 244716 - DNA, 16 bp, P. troglodytes
gaggagagtcacatca

SEQ ID NO: 244717 - DNA, 16 bp, P. troglodytes
gaggagatggaggact

SEQ ID NO: 244718 - DNA, 16 bp, P. troglodytes
gaggagatggatttga

SEQ ID NO: 244719 - DNA, 16 bp, P. troglodytes
gaggagcaaaggcatg

SEQ ID NO: 244720 - DNA, 16 bp, P. troglodytes
gaggagcacctgctgg

SEQ ID NO: 244721 - DNA, 16 bp, P. troglodytes
gaggagcagaagagca

SEQ ID NO: 244722 - DNA, 16 bp, P. troglodytes
gaggagcagaggagca

SEQ ID NO: 244723 - DNA, 16 bp, P. troglodytes
gaggagcagcagcagc

SEQ ID NO: 244724 - DNA, 16 bp, P. troglodytes
gaggagcagcagcagg

SEQ ID NO: 244725 - DNA, 16 bp, P. troglodytes
gaggagcagggctggg

SEQ ID NO: 244726 - DNA, 16 bp, P. troglodytes
gaggagccaagatggc

SEQ ID NO: 244727 - DNA, 16 bp, P. troglodytes
gaggagcctggcctct

SEQ ID NO: 244728 - DNA, 16 bp, P. troglodytes
gaggagctgagagaag

SEQ ID NO: 244729 - DNA, 16 bp, P. troglodytes
gaggagctgccaaact

SEQ ID NO: 244730 - DNA, 16 bp, P. troglodytes
gaggagctggaaccat

SEQ ID NO: 244731 - DNA, 16 bp, P. troglodytes
gaggagctgggcctgg

SEQ ID NO: 244732 - DNA, 16 bp, P. troglodytes
gaggagctgtgagaag

SEQ ID NO: 244733 - DNA, 16 bp, P. troglodytes
gaggaggaaactgagg

SEQ ID NO: 244734 - DNA, 16 bp, P. troglodytes
gaggaggaaattgagg

SEQ ID NO: 244735 - DNA, 16 bp, P. troglodytes
gaggaggaagcagcag

SEQ ID NO: 244736 - DNA, 16 bp, P. troglodytes
gaggaggagacaccag

SEQ ID NO: 244737 - DNA, 16 bp, P. troglodytes
gaggaggagaggtgct

SEQ ID NO: 244738 - DNA, 16 bp, P. troglodytes
gaggaggagcagcagc

SEQ ID NO: 244739 - DNA, 16 bp, P. troglodytes
gaggaggaggagctgg

SEQ ID NO: 244740 - DNA, 16 bp, P. troglodytes
gaggaggaggaggact

SEQ ID NO: 244741 - DNA, 16 bp, P. troglodytes
gaggaggaggatgcag

SEQ ID NO: 244742 - DNA, 16 bp, P. troglodytes
gaggaggaggctgagg

SEQ ID NO: 244743 - DNA, 16 bp, P. troglodytes
gaggaggaggtggcag

SEQ ID NO: 244744 - DNA, 16 bp, P. troglodytes
gaggaggagtttgcag

SEQ ID NO: 244745 - DNA, 16 bp, P. troglodytes
gaggaggcaggagaat

SEQ ID NO: 244746 - DNA, 16 bp, P. troglodytes
gaggaggcagtgagct

SEQ ID NO: 244747 - DNA, 16 bp, P. troglodytes
gaggaggccaggcatg

SEQ ID NO: 244748 - DNA, 16 bp, P. troglodytes
gaggaggcgccgagag

SEQ ID NO: 244749 - DNA, 16 bp, P. troglodytes
gaggaggctggggctg

SEQ ID NO: 244750 - DNA, 16 bp, P. troglodytes
gaggagggagagcatc

SEQ ID NO: 244751 - DNA, 16 bp, P. troglodytes
gaggaggggctgggcc

SEQ ID NO: 244752 - DNA, 16 bp, P. troglodytes
gaggaggggcttggtg

SEQ ID NO: 244753 - DNA, 16 bp, P. troglodytes
gaggaggttgaggctg

SEQ ID NO: 244754 - DNA, 16 bp, P. troglodytes
gaggaggtttcagtga

SEQ ID NO: 244755 - DNA, 16 bp, P. troglodytes
gaggagtatcaaagaa

SEQ ID NO: 244756 - DNA, 16 bp, P. troglodytes
gaggagtgcgggcaca

SEQ ID NO: 244757 - DNA, 16 bp, P. troglodytes
gaggatacagagaaaa

SEQ ID NO: 244758 - DNA, 16 bp, P. troglodytes
gaggatcacaagatca

SEQ ID NO: 244759 - DNA, 16 bp, P. troglodytes
gaggatcacatgagcc

SEQ ID NO: 244760 - DNA, 16 bp, P. troglodytes
gaggatcacttcagct

SEQ ID NO: 244761 - DNA, 16 bp, P. troglodytes
gaggatcacttgaaat

SEQ ID NO: 244762 - DNA, 16 bp, P. troglodytes
gaggatcacttgagac

SEQ ID NO: 244763 - DNA, 16 bp, P. troglodytes
gaggatcacttgagtt

SEQ ID NO: 244764 - DNA, 16 bp, P. troglodytes
gaggatcacttgggcc

SEQ ID NO: 244765 - DNA, 16 bp, P. troglodytes
gaggatcagaaaaata

SEQ ID NO: 244766 - DNA, 16 bp, P. troglodytes
gaggatcaggaaaaac

SEQ ID NO: 244767 - DNA, 16 bp, P. troglodytes
gaggatcccctgagcc

SEQ ID NO: 244768 - DNA, 16 bp, P. troglodytes
gaggatcccttgagct

SEQ ID NO: 244769 - DNA, 17 bp, P. troglodytes
gaggatcgcctgagcct

SEQ ID NO: 244770 - DNA, 16 bp, P. troglodytes
gaggatcttttgagcc

SEQ ID NO: 244771 - DNA, 16 bp, P. troglodytes
gaggatgaagatcttt

SEQ ID NO: 244772 - DNA, 16 bp, P. troglodytes
gaggatgaagcaggag

SEQ ID NO: 244773 - DNA, 16 bp, P. troglodytes
gaggatgaggcaggag

SEQ ID NO: 244774 - DNA, 16 bp, P. troglodytes
gaggatgatggtttcc

SEQ ID NO: 244775 - DNA, 16 bp, P. troglodytes
gaggatgcagcaagaa

SEQ ID NO: 244776 - DNA, 16 bp, P. troglodytes
gaggatgccttgagcc

SEQ ID NO: 244777 - DNA, 16 bp, P. troglodytes
gaggatggaggcagag

SEQ ID NO: 244778 - DNA, 16 bp, P. troglodytes
gaggatggatcacctg

SEQ ID NO: 244779 - DNA, 16 bp, P. troglodytes
gaggatggatcacttg

SEQ ID NO: 244780 - DNA, 16 bp, P. troglodytes
gaggatggcaccaagc

SEQ ID NO: 244781 - DNA, 16 bp, P. troglodytes
gaggatggggcaggag

SEQ ID NO: 244782 - DNA, 16 bp, P. troglodytes
gaggatggtgaccctc

SEQ ID NO: 244783 - DNA, 16 bp, P. troglodytes
gaggatggtggccctc

SEQ ID NO: 244784 - DNA, 16 bp, P. troglodytes
gaggatgtgaagaaaa

SEQ ID NO: 244785 - DNA, 16 bp, P. troglodytes
gaggatgtggtgagcc

SEQ ID NO: 244786 - DNA, 16 bp, P. troglodytes
gaggattattttatgt

SEQ ID NO: 244787 - DNA, 16 bp, P. troglodytes
gaggattccctctgtt

SEQ ID NO: 244788 - DNA, 16 bp, P. troglodytes
gaggattgactctaat

SEQ ID NO: 244789 - DNA, 16 bp, P. troglodytes
gaggatttcccttcac

SEQ ID NO: 244790 - DNA, 16 bp, P. troglodytes
gaggatttttccatca

SEQ ID NO: 244791 - DNA, 16 bp, P. troglodytes
gaggcaagaactgagg

SEQ ID NO: 244792 - DNA, 16 bp, P. troglodytes
gaggcaagcctggcca

SEQ ID NO: 244793 - DNA, 16 bp, P. troglodytes
gaggcaaggtgggagg

SEQ ID NO: 244794 - DNA, 16 bp, P. troglodytes
gaggcacaagaatggc

SEQ ID NO: 244795 - DNA, 16 bp, P. troglodytes
gaggcacagaaagttt

SEQ ID NO: 244796 - DNA, 16 bp, P. troglodytes
gaggcacagagagatg

SEQ ID NO: 244797 - DNA, 16 bp, P. troglodytes
gaggcacagcttgcag

SEQ ID NO: 244798 - DNA, 16 bp, P. troglodytes
gaggcactgggaaaag

SEQ ID NO: 244799 - DNA, 16 bp, P. troglodytes
gaggcagaagaaaatc

SEQ ID NO: 244800 - DNA, 16 bp, P. troglodytes
gaggcagaagaggcag

SEQ ID NO: 244801 - DNA, 16 bp, P. troglodytes
gaggcagaagctgcag

SEQ ID NO: 244802 - DNA, 16 bp, P. troglodytes
gaggcagaagtgggag

SEQ ID NO: 244803 - DNA, 16 bp, P. troglodytes
gaggcagagactgggg

SEQ ID NO: 244804 - DNA, 16 bp, P. troglodytes
gaggcagagactgtag

SEQ ID NO: 244805 - DNA, 16 bp, P. troglodytes
gaggcagagattagag

SEQ ID NO: 244806 - DNA, 16 bp, P. troglodytes
gaggcagagcccaggc

SEQ ID NO: 244807 - DNA, 16 bp, P. troglodytes
gaggcagagctggcag

SEQ ID NO: 244808 - DNA, 16 bp, P. troglodytes
gaggcagaggcaagag

SEQ ID NO: 244809 - DNA, 16 bp, P. troglodytes
gaggcagaggcagaag

SEQ ID NO: 244810 - DNA, 16 bp, P. troglodytes
gaggcagaggcagaga

SEQ ID NO: 244811 - DNA, 16 bp, P. troglodytes
gaggcagaggcagcag

SEQ ID NO: 244812 - DNA, 16 bp, P. troglodytes
gaggcagaggccacag

SEQ ID NO: 244813 - DNA, 17 bp, P. troglodytes
gaggcagaggcgggcag

SEQ ID NO: 244814 - DNA, 16 bp, P. troglodytes
gaggcagaggctggag

SEQ ID NO: 244815 - DNA, 16 bp, P. troglodytes
gaggcagagggtgcag

SEQ ID NO: 244816 - DNA, 16 bp, P. troglodytes
gaggcagaggtgacag

SEQ ID NO: 244817 - DNA, 16 bp, P. troglodytes
gaggcagaggtggagg

SEQ ID NO: 244818 - DNA, 16 bp, P. troglodytes
gaggcagaggttaaag

SEQ ID NO: 244819 - DNA, 16 bp, P. troglodytes
gaggcagagtctcgct

SEQ ID NO: 244820 - DNA, 16 bp, P. troglodytes
gaggcagagttcaggc

SEQ ID NO: 244821 - DNA, 16 bp, P. troglodytes
gaggcagcagggagct

SEQ ID NO: 244822 - DNA, 16 bp, P. troglodytes
gaggcagcagtgagcc

SEQ ID NO: 244823 - DNA, 16 bp, P. troglodytes
gaggcagccggatcac

SEQ ID NO: 244824 - DNA, 16 bp, P. troglodytes
gaggcagctgaggcct

SEQ ID NO: 244825 - DNA, 16 bp, P. troglodytes
gaggcagctggatcat

SEQ ID NO: 244826 - DNA, 16 bp, P. troglodytes
gaggcaggaaggatcc

SEQ ID NO: 244827 - DNA, 16 bp, P. troglodytes
gaggcaggagaacctc

SEQ ID NO: 244828 - DNA, 16 bp, P. troglodytes
gaggcaggagaagctc

SEQ ID NO: 244829 - DNA, 16 bp, P. troglodytes
gaggcaggagagtcag

SEQ ID NO: 244830 - DNA, 16 bp, P. troglodytes
gaggcaggagagtggc

SEQ ID NO: 244831 - DNA, 16 bp, P. troglodytes
gaggcaggagctgggc

SEQ ID NO: 244832 - DNA, 16 bp, P. troglodytes
gaggcaggaggaccat

SEQ ID NO: 244833 - DNA, 16 bp, P. troglodytes
gaggcaggaggagctc

SEQ ID NO: 244834 - DNA, 16 bp, P. troglodytes
gaggcaggaggatgga

SEQ ID NO: 244835 - DNA, 16 bp, P. troglodytes
gaggcaggagggtccc

SEQ ID NO: 244836 - DNA, 16 bp, P. troglodytes
gaggcaggatcttgct

SEQ ID NO: 244837 - DNA, 16 bp, P. troglodytes
gaggcaggcaaattgc

SEQ ID NO: 244838 - DNA, 16 bp, P. troglodytes
gaggcaggcagatcac

SEQ ID NO: 244839 - DNA, 19 bp, P. troglodytes
gaggcaggcagatcactta

SEQ ID NO: 244840 - DNA, 16 bp, P. troglodytes
gaggcaggcagatctc

SEQ ID NO: 244841 - DNA, 16 bp, P. troglodytes
gaggcaggcgaatcat

SEQ ID NO: 244842 - DNA, 16 bp, P. troglodytes
gaggcaggcggatcac

SEQ ID NO: 244843 - DNA, 19 bp, P. troglodytes
gaggcaggcggatcaccta

SEQ ID NO: 244844 - DNA, 16 bp, P. troglodytes
gaggcaggcggctcac

SEQ ID NO: 244845 - DNA, 16 bp, P. troglodytes
gaggcagggatcagag

SEQ ID NO: 244846 - DNA, 16 bp, P. troglodytes
gaggcagggattggag

SEQ ID NO: 244847 - DNA, 16 bp, P. troglodytes
gaggcaggggctgcag

SEQ ID NO: 244848 - DNA, 16 bp, P. troglodytes
gaggcagggggatcac

SEQ ID NO: 244849 - DNA, 16 bp, P. troglodytes
gaggcagggtcttgct

SEQ ID NO: 244850 - DNA, 16 bp, P. troglodytes
gaggcaggtggatcac

SEQ ID NO: 244851 - DNA, 22 bp, P. troglodytes
gaggcaggtggatcacttgagc

SEQ ID NO: 244852 - DNA, 16 bp, P. troglodytes
gaggcagtctgtcctt

SEQ ID NO: 244853 - DNA, 16 bp, P. troglodytes
gaggcagtggcaggag

SEQ ID NO: 244854 - DNA, 16 bp, P. troglodytes
gaggcatttttttttt

SEQ ID NO: 244855 - DNA, 16 bp, P. troglodytes
gaggccaaagaaggag

SEQ ID NO: 244856 - DNA, 16 bp, P. troglodytes
gaggccaaagagggag

SEQ ID NO: 244857 - DNA, 16 bp, P. troglodytes
gaggccaaagcaagag

SEQ ID NO: 244858 - DNA, 16 bp, P. troglodytes
gaggccaaagtgagca

SEQ ID NO: 244859 - DNA, 16 bp, P. troglodytes
gaggccaacctgggca

SEQ ID NO: 244860 - DNA, 16 bp, P. troglodytes
gaggccaagacaggcg

SEQ ID NO: 244861 - DNA, 16 bp, P. troglodytes
gaggccaagatggatg

SEQ ID NO: 244862 - DNA, 16 bp, P. troglodytes
gaggccaaggaggaca

SEQ ID NO: 244863 - DNA, 16 bp, P. troglodytes
gaggccaaggagggca

SEQ ID NO: 244864 - DNA, 16 bp, P. troglodytes
gaggccaaggagggta

SEQ ID NO: 244865 - DNA, 16 bp, P. troglodytes
gaggccaaggcaagaa

SEQ ID NO: 244866 - DNA, 16 bp, P. troglodytes
gaggccaaggcagcca

SEQ ID NO: 244867 - DNA, 16 bp, P. troglodytes
gaggccaaggcaggac

SEQ ID NO: 244868 - DNA, 16 bp, P. troglodytes
gaggccaaggcatgag

SEQ ID NO: 244869 - DNA, 16 bp, P. troglodytes
gaggccaaggccagag

SEQ ID NO: 244870 - DNA, 19 bp, P. troglodytes
gaggccaaggcgagtggat

SEQ ID NO: 244871 - DNA, 16 bp, P. troglodytes
gaggccaaggcggccg

SEQ ID NO: 244872 - DNA, 16 bp, P. troglodytes
gaggccaaggcggtgg

SEQ ID NO: 244873 - DNA, 16 bp, P. troglodytes
gaggccaaggctgcag

SEQ ID NO: 244874 - DNA, 16 bp, P. troglodytes
gaggccaaggctggag

SEQ ID NO: 244875 - DNA, 16 bp, P. troglodytes
gaggccaaggtaagag

SEQ ID NO: 244876 - DNA, 16 bp, P. troglodytes
gaggccaaggtgggat

SEQ ID NO: 244877 - DNA, 16 bp, P. troglodytes
gaggccacggcaggag

SEQ ID NO: 244878 - DNA, 16 bp, P. troglodytes
gaggccagaagtttga

SEQ ID NO: 244879 - DNA, 16 bp, P. troglodytes
gaggccagaattctga

SEQ ID NO: 244880 - DNA, 16 bp, P. troglodytes
gaggccagagaattgc

SEQ ID NO: 244881 - DNA, 16 bp, P. troglodytes
gaggccagcccaggca

SEQ ID NO: 244882 - DNA, 16 bp, P. troglodytes
gaggccagctgggctc

SEQ ID NO: 244883 - DNA, 16 bp, P. troglodytes
gaggccaggaacttga

SEQ ID NO: 244884 - DNA, 16 bp, P. troglodytes
gaggccaggagctcaa

SEQ ID NO: 244885 - DNA, 16 bp, P. troglodytes
gaggccaggagttcaa

SEQ ID NO: 244886 - DNA, 16 bp, P. troglodytes
gaggccaggagttcat

SEQ ID NO: 244887 - DNA, 16 bp, P. troglodytes
gaggccaggcacagtg

SEQ ID NO: 244888 - DNA, 16 bp, P. troglodytes
gaggccaggcaggcag

SEQ ID NO: 244889 - DNA, 16 bp, P. troglodytes
gaggccaggccaggag

SEQ ID NO: 244890 - DNA, 16 bp, P. troglodytes
gaggccaggctgggca

SEQ ID NO: 244891 - DNA, 16 bp, P. troglodytes
gaggccagggaggctg

SEQ ID NO: 244892 - DNA, 16 bp, P. troglodytes
gaggccagggatgcta

SEQ ID NO: 244893 - DNA, 16 bp, P. troglodytes
gaggccagggatgctg

SEQ ID NO: 244894 - DNA, 16 bp, P. troglodytes
gaggccagggctgctg

SEQ ID NO: 244895 - DNA, 16 bp, P. troglodytes
gaggccagggctgggg

SEQ ID NO: 244896 - DNA, 16 bp, P. troglodytes
gaggccaggggtggtg

SEQ ID NO: 244897 - DNA, 16 bp, P. troglodytes
gaggccagggtgggca

SEQ ID NO: 244898 - DNA, 16 bp, P. troglodytes
gaggccaggtgggtgg

SEQ ID NO: 244899 - DNA, 16 bp, P. troglodytes
gaggccagtgtgggag

SEQ ID NO: 244900 - DNA, 16 bp, P. troglodytes
gaggcccaagaattgg

SEQ ID NO: 244901 - DNA, 16 bp, P. troglodytes
gaggcccaagcaggag

SEQ ID NO: 244902 - DNA, 16 bp, P. troglodytes
gaggcccaaggagagg

SEQ ID NO: 244903 - DNA, 16 bp, P. troglodytes
gaggcccagagaagtg

SEQ ID NO: 244904 - DNA, 16 bp, P. troglodytes
gaggcccagagagggg

SEQ ID NO: 244905 - DNA, 16 bp, P. troglodytes
gaggcccagctaattt

SEQ ID NO: 244906 - DNA, 16 bp, P. troglodytes
gaggcccaggcctgga

SEQ ID NO: 244907 - DNA, 16 bp, P. troglodytes
gaggcccaggctgcag

SEQ ID NO: 244908 - DNA, 16 bp, P. troglodytes
gaggcccaggtgggcg

SEQ ID NO: 244909 - DNA, 16 bp, P. troglodytes
gaggccccaggaagct

SEQ ID NO: 244910 - DNA, 16 bp, P. troglodytes
gaggccctggagtggg

SEQ ID NO: 244911 - DNA, 16 bp, P. troglodytes
gaggccctgggcctgg

SEQ ID NO: 244912 - DNA, 16 bp, P. troglodytes
gaggccgaagcaggag

SEQ ID NO: 244913 - DNA, 16 bp, P. troglodytes
gaggccgagctgggca

SEQ ID NO: 244914 - DNA, 16 bp, P. troglodytes
gaggccgagctgggtg

SEQ ID NO: 244915 - DNA, 17 bp, P. troglodytes
gaggccgaggcaggcga

SEQ ID NO: 244916 - DNA, 16 bp, P. troglodytes
gaggccgaggccagtg

SEQ ID NO: 244917 - DNA, 17 bp, P. troglodytes
gaggccgaggccagtgg

SEQ ID NO: 244918 - DNA, 16 bp, P. troglodytes
gaggccgaggctggct

SEQ ID NO: 244919 - DNA, 16 bp, P. troglodytes
gaggccgaggtaggag

SEQ ID NO: 244920 - DNA, 16 bp, P. troglodytes
gaggccgaggtaggcg

SEQ ID NO: 244921 - DNA, 16 bp, P. troglodytes
gaggccgaggtgaggg

SEQ ID NO: 244922 - DNA, 16 bp, P. troglodytes
gaggccgaggtggagg

SEQ ID NO: 244923 - DNA, 16 bp, P. troglodytes
gaggccgaggtggcag

SEQ ID NO: 244924 - DNA, 17 bp, P. troglodytes
gaggccgaggtgggcgg

SEQ ID NO: 244925 - DNA, 16 bp, P. troglodytes
gaggccgagtgggtgg

SEQ ID NO: 244926 - DNA, 16 bp, P. troglodytes
gaggccgcagtgagct

SEQ ID NO: 244927 - DNA, 16 bp, P. troglodytes
gaggccgggcccagtg

SEQ ID NO: 244928 - DNA, 16 bp, P. troglodytes
gaggccggggcaggca

SEQ ID NO: 244929 - DNA, 16 bp, P. troglodytes
gaggcctaggaggaaa

SEQ ID NO: 244930 - DNA, 16 bp, P. troglodytes
gaggcctaggcagaag

SEQ ID NO: 244931 - DNA, 16 bp, P. troglodytes
gaggcctcagaagaaa

SEQ ID NO: 244932 - DNA, 16 bp, P. troglodytes
gaggcctcagaattat

SEQ ID NO: 244933 - DNA, 16 bp, P. troglodytes
gaggcctcagagagct

SEQ ID NO: 244934 - DNA, 16 bp, P. troglodytes
gaggcctcccagccac

SEQ ID NO: 244935 - DNA, 16 bp, P. troglodytes
gaggcctccccagcca

SEQ ID NO: 244936 - DNA, 16 bp, P. troglodytes
gaggcctccccagctc

SEQ ID NO: 244937 - DNA, 16 bp, P. troglodytes
gaggcctcccccagcc

SEQ ID NO: 244938 - DNA, 16 bp, P. troglodytes
gaggcctcctcagtca

SEQ ID NO: 244939 - DNA, 16 bp, P. troglodytes
gaggcctgaggagagg

SEQ ID NO: 244940 - DNA, 16 bp, P. troglodytes
gaggcctgagggagct

SEQ ID NO: 244941 - DNA, 16 bp, P. troglodytes
gaggcctgaggtcagg

SEQ ID NO: 244942 - DNA, 16 bp, P. troglodytes
gaggcctgcccctgag

SEQ ID NO: 244943 - DNA, 16 bp, P. troglodytes
gaggcctgggaggaaa

SEQ ID NO: 244944 - DNA, 16 bp, P. troglodytes
gaggcctgtgtggctg

SEQ ID NO: 244945 - DNA, 16 bp, P. troglodytes
gaggcctgtgttctgt

SEQ ID NO: 244946 - DNA, 16 bp, P. troglodytes
gaggccttcccagccc

SEQ ID NO: 244947 - DNA, 16 bp, P. troglodytes
gaggccttccctggcc

SEQ ID NO: 244948 - DNA, 16 bp, P. troglodytes
gaggccttgggaagct

SEQ ID NO: 244949 - DNA, 16 bp, P. troglodytes
gaggcggaagctgcag

SEQ ID NO: 244950 - DNA, 16 bp, P. troglodytes
gaggcggagctgcagt

SEQ ID NO: 244951 - DNA, 16 bp, P. troglodytes
gaggcggaggcagcag

SEQ ID NO: 244952 - DNA, 16 bp, P. troglodytes
gaggcggaggtggcag

SEQ ID NO: 244953 - DNA, 16 bp, P. troglodytes
gaggcggctgaggccc

SEQ ID NO: 244954 - DNA, 16 bp, P. troglodytes
gaggcgggagggatag

SEQ ID NO: 244955 - DNA, 16 bp, P. troglodytes
gaggcgggcaaatcac

SEQ ID NO: 244956 - DNA, 16 bp, P. troglodytes
gaggcgggcagataat

SEQ ID NO: 244957 - DNA, 16 bp, P. troglodytes
gaggcgggcagatcac

SEQ ID NO: 244958 - DNA, 16 bp, P. troglodytes
gaggcgggcagattac

SEQ ID NO: 244959 - DNA, 16 bp, P. troglodytes
gaggcgggcagattgc

SEQ ID NO: 244960 - DNA, 24 bp, P. troglodytes
gaggcgggcggatcacgaggtcaa

SEQ ID NO: 244961 - DNA, 16 bp, P. troglodytes
gaggcgggcggatcat

SEQ ID NO: 244962 - DNA, 16 bp, P. troglodytes
gaggcgggcggatgac

SEQ ID NO: 244963 - DNA, 16 bp, P. troglodytes
gaggcggggcctttgg

SEQ ID NO: 244964 - DNA, 16 bp, P. troglodytes
gaggcggggtctcact

SEQ ID NO: 244965 - DNA, 16 bp, P. troglodytes
gaggcggggtttcgcc

SEQ ID NO: 244966 - DNA, 16 bp, P. troglodytes
gaggcgggtggatcac

SEQ ID NO: 244967 - DNA, 16 bp, P. troglodytes
gaggcgggtggatgac

SEQ ID NO: 244968 - DNA, 16 bp, P. troglodytes
gaggcgggtgggtcac

SEQ ID NO: 244969 - DNA, 16 bp, P. troglodytes
gaggcgtgagaatcac

SEQ ID NO: 244970 - DNA, 16 bp, P. troglodytes
gaggcgtgagccacag

SEQ ID NO: 244971 - DNA, 16 bp, P. troglodytes
gaggctaagacaggag

SEQ ID NO: 244972 - DNA, 16 bp, P. troglodytes
gaggctaaggagagag

SEQ ID NO: 244973 - DNA, 16 bp, P. troglodytes
gaggctaaggcaagaa

SEQ ID NO: 244974 - DNA, 16 bp, P. troglodytes
gaggctaaggcagcag

SEQ ID NO: 244975 - DNA, 16 bp, P. troglodytes
gaggctaaggcaggag

SEQ ID NO: 244976 - DNA, 16 bp, P. troglodytes
gaggctaaggcagggg

SEQ ID NO: 244977 - DNA, 16 bp, P. troglodytes
gaggctaaggtgggag

SEQ ID NO: 244978 - DNA, 16 bp, P. troglodytes
gaggctaagtcaggag

SEQ ID NO: 244979 - DNA, 16 bp, P. troglodytes
gaggctaatgcaggag

SEQ ID NO: 244980 - DNA, 16 bp, P. troglodytes
gaggctacaagtccaa

SEQ ID NO: 244981 - DNA, 16 bp, P. troglodytes
gaggctacaatgagct

SEQ ID NO: 244982 - DNA, 16 bp, P. troglodytes
gaggctacggcaggag

SEQ ID NO: 244983 - DNA, 16 bp, P. troglodytes
gaggctactatgagca

SEQ ID NO: 244984 - DNA, 16 bp, P. troglodytes
gaggctagaagttcaa

SEQ ID NO: 244985 - DNA, 16 bp, P. troglodytes
gaggctcagaaaagtt

SEQ ID NO: 244986 - DNA, 16 bp, P. troglodytes
gaggctcagaaagttt

SEQ ID NO: 244987 - DNA, 16 bp, P. troglodytes
gaggctcagagaactt

SEQ ID NO: 244988 - DNA, 16 bp, P. troglodytes
gaggctcagagagatt

SEQ ID NO: 244989 - DNA, 16 bp, P. troglodytes
gaggctcagagaggaa

SEQ ID NO: 244990 - DNA, 16 bp, P. troglodytes
gaggctcaggcagaag

SEQ ID NO: 244991 - DNA, 16 bp, P. troglodytes
gaggctcaggcaggag

SEQ ID NO: 244992 - DNA, 16 bp, P. troglodytes
gaggctcccaaacctc

SEQ ID NO: 244993 - DNA, 16 bp, P. troglodytes
gaggctctcaacagca

SEQ ID NO: 244994 - DNA, 16 bp, P. troglodytes
gaggctctgagggaga

SEQ ID NO: 244995 - DNA, 16 bp, P. troglodytes
gaggctctgggcctgg

SEQ ID NO: 244996 - DNA, 16 bp, P. troglodytes
gaggctgaaacaggag

SEQ ID NO: 244997 - DNA, 16 bp, P. troglodytes
gaggctgaaagtccaa

SEQ ID NO: 244998 - DNA, 16 bp, P. troglodytes
gaggctgaagaagaga

SEQ ID NO: 244999 - DNA, 16 bp, P. troglodytes
gaggctgaagaaggag

SEQ ID NO: 245000 - DNA, 16 bp, P. troglodytes
gaggctgaagcagagg

SEQ ID NO: 245001 - DNA, 16 bp, P. troglodytes
gaggctgaagcaggaa

SEQ ID NO: 245002 - DNA, 16 bp, P. troglodytes
gaggctgaagcaggag

SEQ ID NO: 245003 - DNA, 19 bp, P. troglodytes
gaggctgaagcaggagaac

SEQ ID NO: 245004 - DNA, 16 bp, P. troglodytes
gaggctgaagcagggg

SEQ ID NO: 245005 - DNA, 16 bp, P. troglodytes
gaggctgaagccaggg

SEQ ID NO: 245006 - DNA, 16 bp, P. troglodytes
gaggctgaagcgggag

SEQ ID NO: 245007 - DNA, 16 bp, P. troglodytes
gaggctgaagctgaag

SEQ ID NO: 245008 - DNA, 16 bp, P. troglodytes
gaggctgaagctgcag

SEQ ID NO: 245009 - DNA, 16 bp, P. troglodytes
gaggctgaaggaagag

SEQ ID NO: 245010 - DNA, 16 bp, P. troglodytes
gaggctgaaggaggag

SEQ ID NO: 245011 - DNA, 16 bp, P. troglodytes
gaggctgaagtgggag

SEQ ID NO: 245012 - DNA, 16 bp, P. troglodytes
gaggctgaagttgcag

SEQ ID NO: 245013 - DNA, 16 bp, P. troglodytes
gaggctgacatgggtg

SEQ ID NO: 245014 - DNA, 16 bp, P. troglodytes
gaggctgagaaaggta

SEQ ID NO: 245015 - DNA, 16 bp, P. troglodytes
gaggctgagaaggaga

SEQ ID NO: 245016 - DNA, 16 bp, P. troglodytes
gaggctgagaagggaa

SEQ ID NO: 245017 - DNA, 16 bp, P. troglodytes
gaggctgagacaggag

SEQ ID NO: 245018 - DNA, 16 bp, P. troglodytes
gaggctgagacaggat

SEQ ID NO: 245019 - DNA, 16 bp, P. troglodytes
gaggctgagacataag

SEQ ID NO: 245020 - DNA, 16 bp, P. troglodytes
gaggctgagacctact

SEQ ID NO: 245021 - DNA, 16 bp, P. troglodytes
gaggctgagagaggag

SEQ ID NO: 245022 - DNA, 16 bp, P. troglodytes
gaggctgagaggctgg

SEQ ID NO: 245023 - DNA, 16 bp, P. troglodytes
gaggctgagataagag

SEQ ID NO: 245024 - DNA, 16 bp, P. troglodytes
gaggctgagatgagaa

SEQ ID NO: 245025 - DNA, 16 bp, P. troglodytes
gaggctgagatgagag

SEQ ID NO: 245026 - DNA, 16 bp, P. troglodytes
gaggctgagatggaag

SEQ ID NO: 245027 - DNA, 16 bp, P. troglodytes
gaggctgagatgggaa

SEQ ID NO: 245028 - DNA, 16 bp, P. troglodytes
gaggctgagatgggca

SEQ ID NO: 245029 - DNA, 16 bp, P. troglodytes
gaggctgagcaggaga

SEQ ID NO: 245030 - DNA, 16 bp, P. troglodytes
gaggctgagcagggag

SEQ ID NO: 245031 - DNA, 16 bp, P. troglodytes
gaggctgagccaagag

SEQ ID NO: 245032 - DNA, 16 bp, P. troglodytes
gaggctgagccagaga

SEQ ID NO: 245033 - DNA, 16 bp, P. troglodytes
gaggctgagccaggtg

SEQ ID NO: 245034 - DNA, 16 bp, P. troglodytes
gaggctgagccgggag

SEQ ID NO: 245035 - DNA, 16 bp, P. troglodytes
gaggctgagcctggag

SEQ ID NO: 245036 - DNA, 20 bp, P. troglodytes
gaggctgagcttgcagtgag

SEQ ID NO: 245037 - DNA, 16 bp, P. troglodytes
gaggctgaggaagaga

SEQ ID NO: 245038 - DNA, 16 bp, P. troglodytes
gaggctgaggaaggag

SEQ ID NO: 245039 - DNA, 16 bp, P. troglodytes
gaggctgaggagagag

SEQ ID NO: 245040 - DNA, 16 bp, P. troglodytes
gaggctgaggaggaag

SEQ ID NO: 245041 - DNA, 16 bp, P. troglodytes
gaggctgaggagggaa

SEQ ID NO: 245042 - DNA, 16 bp, P. troglodytes
gaggctgaggagggag

SEQ ID NO: 245043 - DNA, 16 bp, P. troglodytes
gaggctgaggcaagag

SEQ ID NO: 245044 - DNA, 16 bp, P. troglodytes
gaggctgaggcacaac

SEQ ID NO: 245045 - DNA, 17 bp, P. troglodytes
gaggctgaggcacgaga

SEQ ID NO: 245046 - DNA, 16 bp, P. troglodytes
gaggctgaggcagcac

SEQ ID NO: 245047 - DNA, 16 bp, P. troglodytes
gaggctgaggcagcag

SEQ ID NO: 245048 - DNA, 16 bp, P. troglodytes
gaggctgaggcaggaa

SEQ ID NO: 245049 - DNA, 16 bp, P. troglodytes
gaggctgaggcaggac

SEQ ID NO: 245050 - DNA, 19 bp, P. troglodytes
gaggctgaggcaggagaac

SEQ ID NO: 245051 - DNA, 19 bp, P. troglodytes
gaggctgaggcaggagaat

SEQ ID NO: 245052 - DNA, 18 bp, P. troglodytes
gaggctgaggcaggagac

SEQ ID NO: 245053 - DNA, 18 bp, P. troglodytes
gaggctgaggcaggagag

SEQ ID NO: 245054 - DNA, 16 bp, P. troglodytes
gaggctgaggcaggat

SEQ ID NO: 245055 - DNA, 16 bp, P. troglodytes
gaggctgaggcagggc

SEQ ID NO: 245056 - DNA, 16 bp, P. troglodytes
gaggctgaggcaggtg

SEQ ID NO: 245057 - DNA, 16 bp, P. troglodytes
gaggctgaggcatcag

SEQ ID NO: 245058 - DNA, 16 bp, P. troglodytes
gaggctgaggccaaag

SEQ ID NO: 245059 - DNA, 16 bp, P. troglodytes
gaggctgaggccagag

SEQ ID NO: 245060 - DNA, 19 bp, P. troglodytes
gaggctgaggccagagaat

SEQ ID NO: 245061 - DNA, 16 bp, P. troglodytes
gaggctgaggccagca

SEQ ID NO: 245062 - DNA, 16 bp, P. troglodytes
gaggctgaggccggag

SEQ ID NO: 245063 - DNA, 19 bp, P. troglodytes
gaggctgaggcgggcagat

SEQ ID NO: 245064 - DNA, 16 bp, P. troglodytes
gaggctgaggcgtgtg

SEQ ID NO: 245065 - DNA, 16 bp, P. troglodytes
gaggctgaggctagag

SEQ ID NO: 245066 - DNA, 16 bp, P. troglodytes
gaggctgaggctgaca

SEQ ID NO: 245067 - DNA, 16 bp, P. troglodytes
gaggctgaggctgaga

SEQ ID NO: 245068 - DNA, 16 bp, P. troglodytes
gaggctgaggctgagg

SEQ ID NO: 245069 - DNA, 16 bp, P. troglodytes
gaggctgaggctgcag

SEQ ID NO: 245070 - DNA, 16 bp, P. troglodytes
gaggctgaggctggag

SEQ ID NO: 245071 - DNA, 16 bp, P. troglodytes
gaggctgaggctgggg

SEQ ID NO: 245072 - DNA, 16 bp, P. troglodytes
gaggctgaggctgtgg

SEQ ID NO: 245073 - DNA, 16 bp, P. troglodytes
gaggctgagggaggag

SEQ ID NO: 245074 - DNA, 16 bp, P. troglodytes
gaggctgaggtaaaag

SEQ ID NO: 245075 - DNA, 16 bp, P. troglodytes
gaggctgaggtaagag

SEQ ID NO: 245076 - DNA, 16 bp, P. troglodytes
gaggctgaggtaggag

SEQ ID NO: 245077 - DNA, 19 bp, P. troglodytes
gaggctgaggtaggtggat

SEQ ID NO: 245078 - DNA, 16 bp, P. troglodytes
gaggctgaggtgagag

SEQ ID NO: 245079 - DNA, 16 bp, P. troglodytes
gaggctgaggtgagcg

SEQ ID NO: 245080 - DNA, 16 bp, P. troglodytes
gaggctgaggtgggaa

SEQ ID NO: 245081 - DNA, 16 bp, P. troglodytes
gaggctgaggtgggag

SEQ ID NO: 245082 - DNA, 16 bp, P. troglodytes
gaggctgaggtgggct

SEQ ID NO: 245083 - DNA, 16 bp, P. troglodytes
gaggctgaggtggtag

SEQ ID NO: 245084 - DNA, 16 bp, P. troglodytes
gaggctgaggttggag

SEQ ID NO: 245085 - DNA, 16 bp, P. troglodytes
gaggctgaggttgtgg

SEQ ID NO: 245086 - DNA, 16 bp, P. troglodytes
gaggctgagtcaggag

SEQ ID NO: 245087 - DNA, 16 bp, P. troglodytes
gaggctgatgcaggag

SEQ ID NO: 245088 - DNA, 16 bp, P. troglodytes
gaggctgatgcgggtg

SEQ ID NO: 245089 - DNA, 16 bp, P. troglodytes
gaggctgcaatgagcc

SEQ ID NO: 245090 - DNA, 16 bp, P. troglodytes
gaggctgcactgagct

SEQ ID NO: 245091 - DNA, 16 bp, P. troglodytes
gaggctgcagaacaac

SEQ ID NO: 245092 - DNA, 16 bp, P. troglodytes
gaggctgcagaacagc

SEQ ID NO: 245093 - DNA, 16 bp, P. troglodytes
gaggctgcagagcagc

SEQ ID NO: 245094 - DNA, 16 bp, P. troglodytes
gaggctgcagcaagct

SEQ ID NO: 245095 - DNA, 16 bp, P. troglodytes
gaggctgcagcaggag

SEQ ID NO: 245096 - DNA, 16 bp, P. troglodytes
gaggctgcagcgagct

SEQ ID NO: 245097 - DNA, 16 bp, P. troglodytes
gaggctgcagctgcag

SEQ ID NO: 245098 - DNA, 16 bp, P. troglodytes
gaggctgcaggaagcc

SEQ ID NO: 245099 - DNA, 16 bp, P. troglodytes
gaggctgcagggagct

SEQ ID NO: 245100 - DNA, 16 bp, P. troglodytes
gaggctgcaggtggag

SEQ ID NO: 245101 - DNA, 16 bp, P. troglodytes
gaggctgcagtcagct

SEQ ID NO: 245102 - DNA, 16 bp, P. troglodytes
gaggctgcagtgaacc

SEQ ID NO: 245103 - DNA, 16 bp, P. troglodytes
gaggctgcagtgaact

SEQ ID NO: 245104 - DNA, 16 bp, P. troglodytes
gaggctgcagtgagca

SEQ ID NO: 245105 - DNA, 16 bp, P. troglodytes
gaggctgcagtgagcc

SEQ ID NO: 245106 - DNA, 16 bp, P. troglodytes
gaggctgcagtgagct

SEQ ID NO: 245107 - DNA, 16 bp, P. troglodytes
gaggctgcagtgagtc

SEQ ID NO: 245108 - DNA, 17 bp, P. troglodytes
gaggctgcagtgagttg

SEQ ID NO: 245109 - DNA, 16 bp, P. troglodytes
gaggctgcagtggagc

SEQ ID NO: 245110 - DNA, 16 bp, P. troglodytes
gaggctgcagtgggag

SEQ ID NO: 245111 - DNA, 16 bp, P. troglodytes
gaggctgcagttagcc

SEQ ID NO: 245112 - DNA, 16 bp, P. troglodytes
gaggctgcctaccaca

SEQ ID NO: 245113 - DNA, 16 bp, P. troglodytes
gaggctgcgatgagcc

SEQ ID NO: 245114 - DNA, 16 bp, P. troglodytes
gaggctgcggcaagag

SEQ ID NO: 245115 - DNA, 16 bp, P. troglodytes
gaggctgcggcagaag

SEQ ID NO: 245116 - DNA, 16 bp, P. troglodytes
gaggctgcggcaggag

SEQ ID NO: 245117 - DNA, 16 bp, P. troglodytes
gaggctgcggtgagcc

SEQ ID NO: 245118 - DNA, 16 bp, P. troglodytes
gaggctgcggtgagct

SEQ ID NO: 245119 - DNA, 16 bp, P. troglodytes
gaggctgctcagagaa

SEQ ID NO: 245120 - DNA, 16 bp, P. troglodytes
gaggctgctgctgagg

SEQ ID NO: 245121 - DNA, 16 bp, P. troglodytes
gaggctgctgtgagct

SEQ ID NO: 245122 - DNA, 16 bp, P. troglodytes
gaggctggaagagttt

SEQ ID NO: 245123 - DNA, 16 bp, P. troglodytes
gaggctggaagtcaga

SEQ ID NO: 245124 - DNA, 16 bp, P. troglodytes
gaggctggaagttcaa

SEQ ID NO: 245125 - DNA, 16 bp, P. troglodytes
gaggctggagaagaga

SEQ ID NO: 245126 - DNA, 16 bp, P. troglodytes
gaggctggagaagagg

SEQ ID NO: 245127 - DNA, 16 bp, P. troglodytes
gaggctggagaaggag

SEQ ID NO: 245128 - DNA, 16 bp, P. troglodytes
gaggctggagaggcag

SEQ ID NO: 245129 - DNA, 17 bp, P. troglodytes
gaggctggagtgcagtg

SEQ ID NO: 245130 - DNA, 18 bp, P. troglodytes
gaggctggagtgcagtgg

SEQ ID NO: 245131 - DNA, 16 bp, P. troglodytes
gaggctggagtgggag

SEQ ID NO: 245132 - DNA, 16 bp, P. troglodytes
gaggctggatggccct

SEQ ID NO: 245133 - DNA, 16 bp, P. troglodytes
gaggctggcagcattt

SEQ ID NO: 245134 - DNA, 16 bp, P. troglodytes
gaggctgggaagggga

SEQ ID NO: 245135 - DNA, 16 bp, P. troglodytes
gaggctgggaagtccg

SEQ ID NO: 245136 - DNA, 16 bp, P. troglodytes
gaggctgggaagtcct

SEQ ID NO: 245137 - DNA, 16 bp, P. troglodytes
gaggctgggacaggag

SEQ ID NO: 245138 - DNA, 16 bp, P. troglodytes
gaggctgggaggtgga

SEQ ID NO: 245139 - DNA, 16 bp, P. troglodytes
gaggctgggatgggag

SEQ ID NO: 245140 - DNA, 19 bp, P. troglodytes
gaggctgggcacggtggct

SEQ ID NO: 245141 - DNA, 16 bp, P. troglodytes
gaggctgggcccagtg

SEQ ID NO: 245142 - DNA, 16 bp, P. troglodytes
gaggctgggcctgggg

SEQ ID NO: 245143 - DNA, 16 bp, P. troglodytes
gaggctgggctgggag

SEQ ID NO: 245144 - DNA, 16 bp, P. troglodytes
gaggctggggaatcac

SEQ ID NO: 245145 - DNA, 16 bp, P. troglodytes
gaggctggggagaagg

SEQ ID NO: 245146 - DNA, 16 bp, P. troglodytes
gaggctggggaggctg

SEQ ID NO: 245147 - DNA, 16 bp, P. troglodytes
gaggctggggcagaga

SEQ ID NO: 245148 - DNA, 16 bp, P. troglodytes
gaggctggggcagagg

SEQ ID NO: 245149 - DNA, 16 bp, P. troglodytes
gaggctggggctggtg

SEQ ID NO: 245150 - DNA, 16 bp, P. troglodytes
gaggctgggggcagtg

SEQ ID NO: 245151 - DNA, 16 bp, P. troglodytes
gaggctgggggcctgg

SEQ ID NO: 245152 - DNA, 16 bp, P. troglodytes
gaggctggggtgcagg

SEQ ID NO: 245153 - DNA, 16 bp, P. troglodytes
gaggctggggtgggca

SEQ ID NO: 245154 - DNA, 16 bp, P. troglodytes
gaggctggggttgcag

SEQ ID NO: 245155 - DNA, 16 bp, P. troglodytes
gaggctgggtaattta

SEQ ID NO: 245156 - DNA, 16 bp, P. troglodytes
gaggctgggtcaggag

SEQ ID NO: 245157 - DNA, 16 bp, P. troglodytes
gaggctgggtgtagtg

SEQ ID NO: 245158 - DNA, 17 bp, P. troglodytes
gaggctggtctcaaact

SEQ ID NO: 245159 - DNA, 16 bp, P. troglodytes
gaggctggtgcaggag

SEQ ID NO: 245160 - DNA, 16 bp, P. troglodytes
gaggctgtggaaaaat

SEQ ID NO: 245161 - DNA, 16 bp, P. troglodytes
gaggctgtggcagaga

SEQ ID NO: 245162 - DNA, 16 bp, P. troglodytes
gaggctgtgggggtga

SEQ ID NO: 245163 - DNA, 16 bp, P. troglodytes
gaggctgtggtgagct

SEQ ID NO: 245164 - DNA, 16 bp, P. troglodytes
gaggcttaggcaggag

SEQ ID NO: 245165 - DNA, 16 bp, P. troglodytes
gaggcttccccagcca

SEQ ID NO: 245166 - DNA, 16 bp, P. troglodytes
gaggcttccccagccc

SEQ ID NO: 245167 - DNA, 16 bp, P. troglodytes
gaggcttccccaggca

SEQ ID NO: 245168 - DNA, 16 bp, P. troglodytes
gaggcttgcttgagcc

SEQ ID NO: 245169 - DNA, 16 bp, P. troglodytes
gaggcttggactgctt

SEQ ID NO: 245170 - DNA, 16 bp, P. troglodytes
gaggcttgggtgggag

SEQ ID NO: 245171 - DNA, 16 bp, P. troglodytes
gagggaaaaaagacta

SEQ ID NO: 245172 - DNA, 16 bp, P. troglodytes
gagggaaaaatggttt

SEQ ID NO: 245173 - DNA, 16 bp, P. troglodytes
gagggaaatgggaaat

SEQ ID NO: 245174 - DNA, 16 bp, P. troglodytes
gagggaacagcatgag

SEQ ID NO: 245175 - DNA, 16 bp, P. troglodytes
gagggaatctcctgat

SEQ ID NO: 245176 - DNA, 16 bp, P. troglodytes
gagggaatggtaccag

SEQ ID NO: 245177 - DNA, 17 bp, P. troglodytes
gagggaccggctgaagc

SEQ ID NO: 245178 - DNA, 16 bp, P. troglodytes
gagggacctggaggga

SEQ ID NO: 245179 - DNA, 16 bp, P. troglodytes
gagggactcctcccta

SEQ ID NO: 245180 - DNA, 16 bp, P. troglodytes
gagggactggctgaag

SEQ ID NO: 245181 - DNA, 16 bp, P. troglodytes
gagggagaccatgggg

SEQ ID NO: 245182 - DNA, 16 bp, P. troglodytes
gagggagctggaggcc

SEQ ID NO: 245183 - DNA, 16 bp, P. troglodytes
gagggaggaaggggct

SEQ ID NO: 245184 - DNA, 16 bp, P. troglodytes
gagggaggagaatccc

SEQ ID NO: 245185 - DNA, 16 bp, P. troglodytes
gagggagtcttgcttt

SEQ ID NO: 245186 - DNA, 16 bp, P. troglodytes
gagggagtgtgcgaat

SEQ ID NO: 245187 - DNA, 16 bp, P. troglodytes
gagggagtttcaccat

SEQ ID NO: 245188 - DNA, 16 bp, P. troglodytes
gagggcaaggactgtg

SEQ ID NO: 245189 - DNA, 16 bp, P. troglodytes
gagggcaaggcaggcg

SEQ ID NO: 245190 - DNA, 16 bp, P. troglodytes
gagggcacctggaaaa

SEQ ID NO: 245191 - DNA, 16 bp, P. troglodytes
gagggcagagcccttg

SEQ ID NO: 245192 - DNA, 16 bp, P. troglodytes
gagggcagaggctgca

SEQ ID NO: 245193 - DNA, 16 bp, P. troglodytes
gagggcagcctgggca

SEQ ID NO: 245194 - DNA, 16 bp, P. troglodytes
gagggcaggaaccatg

SEQ ID NO: 245195 - DNA, 16 bp, P. troglodytes
gagggcaggaagaacc

SEQ ID NO: 245196 - DNA, 16 bp, P. troglodytes
gagggcagggactgtg

SEQ ID NO: 245197 - DNA, 16 bp, P. troglodytes
gagggcagggactttg

SEQ ID NO: 245198 - DNA, 16 bp, P. troglodytes
gagggcaggggctgcc

SEQ ID NO: 245199 - DNA, 16 bp, P. troglodytes
gagggcatggaagctc

SEQ ID NO: 245200 - DNA, 16 bp, P. troglodytes
gagggccaccatcctc

SEQ ID NO: 245201 - DNA, 16 bp, P. troglodytes
gagggccactgtcctc

SEQ ID NO: 245202 - DNA, 16 bp, P. troglodytes
gagggccattgtcctc

SEQ ID NO: 245203 - DNA, 16 bp, P. troglodytes
gagggccgaggtgggc

SEQ ID NO: 245204 - DNA, 16 bp, P. troglodytes
gagggccgggcgcggt

SEQ ID NO: 245205 - DNA, 16 bp, P. troglodytes
gagggcctgctttctg

SEQ ID NO: 245206 - DNA, 16 bp, P. troglodytes
gagggctccagcctca

SEQ ID NO: 245207 - DNA, 16 bp, P. troglodytes
gagggctctgcccctg

SEQ ID NO: 245208 - DNA, 16 bp, P. troglodytes
gagggctgcaagggct

SEQ ID NO: 245209 - DNA, 16 bp, P. troglodytes
gagggctgcctggagg

SEQ ID NO: 245210 - DNA, 16 bp, P. troglodytes
gagggctgcttgaggc

SEQ ID NO: 245211 - DNA, 16 bp, P. troglodytes
gagggctgtgaggaag

SEQ ID NO: 245212 - DNA, 16 bp, P. troglodytes
gagggcttcatggagg

SEQ ID NO: 245213 - DNA, 16 bp, P. troglodytes
gagggcttcctggagg

SEQ ID NO: 245214 - DNA, 16 bp, P. troglodytes
gagggcttgtgcaggg

SEQ ID NO: 245215 - DNA, 16 bp, P. troglodytes
gagggctttttttttt

SEQ ID NO: 245216 - DNA, 16 bp, P. troglodytes
gaggggagagggagct

SEQ ID NO: 245217 - DNA, 16 bp, P. troglodytes
gaggggaggaggtgcc

SEQ ID NO: 245218 - DNA, 16 bp, P. troglodytes
gaggggattttgccat

SEQ ID NO: 245219 - DNA, 16 bp, P. troglodytes
gaggggcagggcctgg

SEQ ID NO: 245220 - DNA, 16 bp, P. troglodytes
gaggggccacatctgg

SEQ ID NO: 245221 - DNA, 16 bp, P. troglodytes
gaggggccaggtgcag

SEQ ID NO: 245222 - DNA, 16 bp, P. troglodytes
gaggggcccttcagcc

SEQ ID NO: 245223 - DNA, 16 bp, P. troglodytes
gaggggcgcttctgcc

SEQ ID NO: 245224 - DNA, 17 bp, P. troglodytes
gaggggctcctcacttc

SEQ ID NO: 245225 - DNA, 16 bp, P. troglodytes
gaggggctgcagtgaa

SEQ ID NO: 245226 - DNA, 16 bp, P. troglodytes
gaggggctgccacaaa

SEQ ID NO: 245227 - DNA, 16 bp, P. troglodytes
gaggggctgggtgcag

SEQ ID NO: 245228 - DNA, 16 bp, P. troglodytes
gaggggcttctcactt

SEQ ID NO: 245229 - DNA, 16 bp, P. troglodytes
gaggggcttctggcca

SEQ ID NO: 245230 - DNA, 16 bp, P. troglodytes
gagggggaaactgagg

SEQ ID NO: 245231 - DNA, 16 bp, P. troglodytes
gagggggagcttgcag

SEQ ID NO: 245232 - DNA, 16 bp, P. troglodytes
gagggggcggctggcc

SEQ ID NO: 245233 - DNA, 16 bp, P. troglodytes
gaggggggcggatcac

SEQ ID NO: 245234 - DNA, 16 bp, P. troglodytes
gagggtagatcttaag

SEQ ID NO: 245235 - DNA, 16 bp, P. troglodytes
gagggtatttctggaa

SEQ ID NO: 245236 - DNA, 16 bp, P. troglodytes
gagggtcatctgcttt

SEQ ID NO: 245237 - DNA, 16 bp, P. troglodytes
gagggtcccagtggga

SEQ ID NO: 245238 - DNA, 16 bp, P. troglodytes
gagggtcccatgccca

SEQ ID NO: 245239 - DNA, 16 bp, P. troglodytes
gagggtcctacgccca

SEQ ID NO: 245240 - DNA, 16 bp, P. troglodytes
gagggtcctggtggga

SEQ ID NO: 245241 - DNA, 16 bp, P. troglodytes
gagggtctccctctgt

SEQ ID NO: 245242 - DNA, 22 bp, P. troglodytes
gagggtctcctcacttctcaga

SEQ ID NO: 245243 - DNA, 16 bp, P. troglodytes
gagggtgaggctgcag

SEQ ID NO: 245244 - DNA, 16 bp, P. troglodytes
gagggtgaggctggag

SEQ ID NO: 245245 - DNA, 16 bp, P. troglodytes
gagggtgcaagcccaa

SEQ ID NO: 245246 - DNA, 16 bp, P. troglodytes
gagggtgcaagcccca

SEQ ID NO: 245247 - DNA, 16 bp, P. troglodytes
gagggtgcagtgagcc

SEQ ID NO: 245248 - DNA, 16 bp, P. troglodytes
gagggtgcccagggca

SEQ ID NO: 245249 - DNA, 16 bp, P. troglodytes
gagggtgcggtgagcc

SEQ ID NO: 245250 - DNA, 16 bp, P. troglodytes
gagggtggagccccca

SEQ ID NO: 245251 - DNA, 16 bp, P. troglodytes
gagggtggatcatttg

SEQ ID NO: 245252 - DNA, 16 bp, P. troglodytes
gagggtgggaggacag

SEQ ID NO: 245253 - DNA, 16 bp, P. troglodytes
gagggtgtcctttccc

SEQ ID NO: 245254 - DNA, 16 bp, P. troglodytes
gagggttaggacttca

SEQ ID NO: 245255 - DNA, 16 bp, P. troglodytes
gagggttccaatttct

SEQ ID NO: 245256 - DNA, 16 bp, P. troglodytes
gaggtacttttttttt

SEQ ID NO: 245257 - DNA, 16 bp, P. troglodytes
gaggtagaggctgcag

SEQ ID NO: 245258 - DNA, 16 bp, P. troglodytes
gaggtagaggtggcag

SEQ ID NO: 245259 - DNA, 16 bp, P. troglodytes
gaggtagcagtgagcc

SEQ ID NO: 245260 - DNA, 16 bp, P. troglodytes
gaggtagcagtgagct

SEQ ID NO: 245261 - DNA, 16 bp, P. troglodytes
gaggtaggagggttgc

SEQ ID NO: 245262 - DNA, 16 bp, P. troglodytes
gaggtaggataattgc

SEQ ID NO: 245263 - DNA, 16 bp, P. troglodytes
gaggtatgcctgtact

SEQ ID NO: 245264 - DNA, 16 bp, P. troglodytes
gaggtattttgataca

SEQ ID NO: 245265 - DNA, 16 bp, P. troglodytes
gaggtcaaagtgggag

SEQ ID NO: 245266 - DNA, 16 bp, P. troglodytes
gaggtcaaggaaggag

SEQ ID NO: 245267 - DNA, 16 bp, P. troglodytes
gaggtcaaggctgaag

SEQ ID NO: 245268 - DNA, 16 bp, P. troglodytes
gaggtcacacagcagg

SEQ ID NO: 245269 - DNA, 16 bp, P. troglodytes
gaggtcacagtgagcc

SEQ ID NO: 245270 - DNA, 16 bp, P. troglodytes
gaggtcacagtgagct

SEQ ID NO: 245271 - DNA, 16 bp, P. troglodytes
gaggtcagcagatgga

SEQ ID NO: 245272 - DNA, 16 bp, P. troglodytes
gaggtcagcagtttga

SEQ ID NO: 245273 - DNA, 16 bp, P. troglodytes
gaggtcaggaatttaa

SEQ ID NO: 245274 - DNA, 16 bp, P. troglodytes
gaggtcaggagaccga

SEQ ID NO: 245275 - DNA, 16 bp, P. troglodytes
gaggtcaggaggtgga

SEQ ID NO: 245276 - DNA, 16 bp, P. troglodytes
gaggtcaggagtcaga

SEQ ID NO: 245277 - DNA, 16 bp, P. troglodytes
gaggtcagggagtttg

SEQ ID NO: 245278 - DNA, 16 bp, P. troglodytes
gaggtcagggtttgag

SEQ ID NO: 245279 - DNA, 16 bp, P. troglodytes
gaggtccactccagat

SEQ ID NO: 245280 - DNA, 16 bp, P. troglodytes
gaggtccacttcagac

SEQ ID NO: 245281 - DNA, 16 bp, P. troglodytes
gaggtccccaaccccc

SEQ ID NO: 245282 - DNA, 16 bp, P. troglodytes
gaggtccctgtggcct

SEQ ID NO: 245283 - DNA, 16 bp, P. troglodytes
gaggtcgaggctgaag

SEQ ID NO: 245284 - DNA, 16 bp, P. troglodytes
gaggtcgcagtgagcc

SEQ ID NO: 245285 - DNA, 16 bp, P. troglodytes
gaggtcgggagatgga

SEQ ID NO: 245286 - DNA, 16 bp, P. troglodytes
gaggtctccccagcca

SEQ ID NO: 245287 - DNA, 16 bp, P. troglodytes
gaggtctcgctctgtc

SEQ ID NO: 245288 - DNA, 16 bp, P. troglodytes
gaggtcttactatatt

SEQ ID NO: 245289 - DNA, 16 bp, P. troglodytes
gaggtgaacatcacac

SEQ ID NO: 245290 - DNA, 16 bp, P. troglodytes
gaggtgaagaagctgc

SEQ ID NO: 245291 - DNA, 16 bp, P. troglodytes
gaggtgaagattgcag

SEQ ID NO: 245292 - DNA, 16 bp, P. troglodytes
gaggtgaagcctttgg

SEQ ID NO: 245293 - DNA, 16 bp, P. troglodytes
gaggtgatggatactc

SEQ ID NO: 245294 - DNA, 16 bp, P. troglodytes
gaggtgatggatgtgt

SEQ ID NO: 245295 - DNA, 16 bp, P. troglodytes
gaggtgattaggtcat

SEQ ID NO: 245296 - DNA, 16 bp, P. troglodytes
gaggtgccatacactt

SEQ ID NO: 245297 - DNA, 16 bp, P. troglodytes
gaggtggaagtggcag

SEQ ID NO: 245298 - DNA, 16 bp, P. troglodytes
gaggtggaagttacag

SEQ ID NO: 245299 - DNA, 16 bp, P. troglodytes
gaggtggaatctatag

SEQ ID NO: 245300 - DNA, 16 bp, P. troglodytes
gaggtggagattgtag

SEQ ID NO: 245301 - DNA, 16 bp, P. troglodytes
gaggtggagattgtgg

SEQ ID NO: 245302 - DNA, 16 bp, P. troglodytes
gaggtggagctcaggt

SEQ ID NO: 245303 - DNA, 16 bp, P. troglodytes
gaggtggagctggcag

SEQ ID NO: 245304 - DNA, 16 bp, P. troglodytes
gaggtggagcttccag

SEQ ID NO: 245305 - DNA, 16 bp, P. troglodytes
gaggtggaggagcaga

SEQ ID NO: 245306 - DNA, 16 bp, P. troglodytes
gaggtggaggaggcag

SEQ ID NO: 245307 - DNA, 16 bp, P. troglodytes
gaggtggaggctgagg

SEQ ID NO: 245308 - DNA, 16 bp, P. troglodytes
gaggtggaggctgcag

SEQ ID NO: 245309 - DNA, 16 bp, P. troglodytes
gaggtggaggctgctg

SEQ ID NO: 245310 - DNA, 16 bp, P. troglodytes
gaggtggaggttgcac

SEQ ID NO: 245311 - DNA, 16 bp, P. troglodytes
gaggtggagtctcgct

SEQ ID NO: 245312 - DNA, 16 bp, P. troglodytes
gaggtggagtcttact

SEQ ID NO: 245313 - DNA, 16 bp, P. troglodytes
gaggtggcagaggcag

SEQ ID NO: 245314 - DNA, 16 bp, P. troglodytes
gaggtggcagaggtgg

SEQ ID NO: 245315 - DNA, 16 bp, P. troglodytes
gaggtggcagtgagcc

SEQ ID NO: 245316 - DNA, 16 bp, P. troglodytes
gaggtggcagtgagct

SEQ ID NO: 245317 - DNA, 16 bp, P. troglodytes
gaggtggcagtggcag

SEQ ID NO: 245318 - DNA, 16 bp, P. troglodytes
gaggtgggaagatcat

SEQ ID NO: 245319 - DNA, 16 bp, P. troglodytes
gaggtgggaggacagc

SEQ ID NO: 245320 - DNA, 16 bp, P. troglodytes
gaggtgggaggagagc

SEQ ID NO: 245321 - DNA, 22 bp, P. troglodytes
gaggtgggaggatcacttgagg

SEQ ID NO: 245322 - DNA, 16 bp, P. troglodytes
gaggtgggcggatcac

SEQ ID NO: 245323 - DNA, 16 bp, P. troglodytes
gaggtgggcggatctc

SEQ ID NO: 245324 - DNA, 16 bp, P. troglodytes
gaggtgggcggctcac

SEQ ID NO: 245325 - DNA, 16 bp, P. troglodytes
gaggtgggctccaccc

SEQ ID NO: 245326 - DNA, 16 bp, P. troglodytes
gaggtggggagatcac

SEQ ID NO: 245327 - DNA, 16 bp, P. troglodytes
gaggtggggcccttgg

SEQ ID NO: 245328 - DNA, 16 bp, P. troglodytes
gaggtggggcctggag

SEQ ID NO: 245329 - DNA, 16 bp, P. troglodytes
gaggtggggcttgcag

SEQ ID NO: 245330 - DNA, 16 bp, P. troglodytes
gaggtggggcttttgg

SEQ ID NO: 245331 - DNA, 16 bp, P. troglodytes
gaggtgggggtgtcag

SEQ ID NO: 245332 - DNA, 16 bp, P. troglodytes
gaggtggggtttcact

SEQ ID NO: 245333 - DNA, 16 bp, P. troglodytes
gaggtgggtagatcac

SEQ ID NO: 245334 - DNA, 16 bp, P. troglodytes
gaggtgggtgaatcac

SEQ ID NO: 245335 - DNA, 16 bp, P. troglodytes
gaggtgggtggaccac

SEQ ID NO: 245336 - DNA, 16 bp, P. troglodytes
gaggtgggtggatcac

SEQ ID NO: 245337 - DNA, 21 bp, P. troglodytes
gaggtgggtggatcacttgag

SEQ ID NO: 245338 - DNA, 20 bp, P. troglodytes
gaggtgggtggatcatttga

SEQ ID NO: 245339 - DNA, 16 bp, P. troglodytes
gaggtgggtgggtcac

SEQ ID NO: 245340 - DNA, 16 bp, P. troglodytes
gaggtggtttcagatg

SEQ ID NO: 245341 - DNA, 16 bp, P. troglodytes
gaggttaaaggaaaga

SEQ ID NO: 245342 - DNA, 16 bp, P. troglodytes
gaggttaaatgacttg

SEQ ID NO: 245343 - DNA, 16 bp, P. troglodytes
gaggttaagtgacttg

SEQ ID NO: 245344 - DNA, 16 bp, P. troglodytes
gaggttacagtgagca

SEQ ID NO: 245345 - DNA, 16 bp, P. troglodytes
gaggttacagtgagcc

SEQ ID NO: 245346 - DNA, 16 bp, P. troglodytes
gaggttacagtgagct

SEQ ID NO: 245347 - DNA, 16 bp, P. troglodytes
gaggttacagtgatcc

SEQ ID NO: 245348 - DNA, 16 bp, P. troglodytes
gaggttatagtgagct

SEQ ID NO: 245349 - DNA, 16 bp, P. troglodytes
gaggttattatgttaa

SEQ ID NO: 245350 - DNA, 16 bp, P. troglodytes
gaggttcagagaggtt

SEQ ID NO: 245351 - DNA, 16 bp, P. troglodytes
gaggttcatccatgtt

SEQ ID NO: 245352 - DNA, 16 bp, P. troglodytes
gaggttccagtgagcc

SEQ ID NO: 245353 - DNA, 16 bp, P. troglodytes
gaggttctgagaacat

SEQ ID NO: 245354 - DNA, 16 bp, P. troglodytes
gaggttgaagtgagcc

SEQ ID NO: 245355 - DNA, 16 bp, P. troglodytes
gaggttgaagtgggag

SEQ ID NO: 245356 - DNA, 16 bp, P. troglodytes
gaggttgagacagaag

SEQ ID NO: 245357 - DNA, 16 bp, P. troglodytes
gaggttgagacaggag

SEQ ID NO: 245358 - DNA, 16 bp, P. troglodytes
gaggttgaggcaggag

SEQ ID NO: 245359 - DNA, 16 bp, P. troglodytes
gaggttgaggtaggag

SEQ ID NO: 245360 - DNA, 16 bp, P. troglodytes
gaggttgaggtgagag

SEQ ID NO: 245361 - DNA, 16 bp, P. troglodytes
gaggttgcaatgagcc

SEQ ID NO: 245362 - DNA, 16 bp, P. troglodytes
gaggttgcaatttttt

SEQ ID NO: 245363 - DNA, 16 bp, P. troglodytes
gaggttgcactgagcc

SEQ ID NO: 245364 - DNA, 16 bp, P. troglodytes
gaggttgcagaggaaa

SEQ ID NO: 245365 - DNA, 16 bp, P. troglodytes
gaggttgcaggagctg

SEQ ID NO: 245366 - DNA, 16 bp, P. troglodytes
gaggttgcagggagca

SEQ ID NO: 245367 - DNA, 16 bp, P. troglodytes
gaggttgcagggagcc

SEQ ID NO: 245368 - DNA, 16 bp, P. troglodytes
gaggttgcaggttgca

SEQ ID NO: 245369 - DNA, 16 bp, P. troglodytes
gaggttgcagtaagcc

SEQ ID NO: 245370 - DNA, 16 bp, P. troglodytes
gaggttgcagtcagcc

SEQ ID NO: 245371 - DNA, 16 bp, P. troglodytes
gaggttgcagtgaacc

SEQ ID NO: 245372 - DNA, 16 bp, P. troglodytes
gaggttgcagtgaccc

SEQ ID NO: 245373 - DNA, 16 bp, P. troglodytes
gaggttgcagtgagcc

SEQ ID NO: 245374 - DNA, 16 bp, P. troglodytes
gaggttgcagtgatcc

SEQ ID NO: 245375 - DNA, 16 bp, P. troglodytes
gaggttgcagtgattg

SEQ ID NO: 245376 - DNA, 16 bp, P. troglodytes
gaggttgcagtgcacc

SEQ ID NO: 245377 - DNA, 16 bp, P. troglodytes
gaggttgcagtggacc

SEQ ID NO: 245378 - DNA, 16 bp, P. troglodytes
gaggttgcagtgggcc

SEQ ID NO: 245379 - DNA, 16 bp, P. troglodytes
gaggttgcagtgtgcc

SEQ ID NO: 245380 - DNA, 16 bp, P. troglodytes
gaggttgcagttagcc

SEQ ID NO: 245381 - DNA, 16 bp, P. troglodytes
gaggttgcattgagcc

SEQ ID NO: 245382 - DNA, 16 bp, P. troglodytes
gaggttgccagtgagc

SEQ ID NO: 245383 - DNA, 16 bp, P. troglodytes
gaggttgccgtgagcc

SEQ ID NO: 245384 - DNA, 16 bp, P. troglodytes
gaggttgcggtgagcc

SEQ ID NO: 245385 - DNA, 16 bp, P. troglodytes
gaggttgctgtgagcc

SEQ ID NO: 245386 - DNA, 16 bp, P. troglodytes
gaggttgtagtgagcc

SEQ ID NO: 245387 - DNA, 16 bp, P. troglodytes
gaggttgtagtgagtc

SEQ ID NO: 245388 - DNA, 16 bp, P. troglodytes
gaggttgtgatgagcc

SEQ ID NO: 245389 - DNA, 16 bp, P. troglodytes
gaggttgtggtaagcc

SEQ ID NO: 245390 - DNA, 16 bp, P. troglodytes
gaggttgtggtgagcc

SEQ ID NO: 245391 - DNA, 16 bp, P. troglodytes
gaggtttcagtgagcc

SEQ ID NO: 245392 - DNA, 16 bp, P. troglodytes
gaggtttccccagcca

SEQ ID NO: 245393 - DNA, 16 bp, P. troglodytes
gaggtttctcaaagaa

SEQ ID NO: 245394 - DNA, 16 bp, P. troglodytes
gaggtttggggactca

SEQ ID NO: 245395 - DNA, 16 bp, P. troglodytes
gaggttttgataggtt

SEQ ID NO: 245396 - DNA, 16 bp, P. troglodytes
gagtaaaaccctgtct

SEQ ID NO: 245397 - DNA, 16 bp, P. troglodytes
gagtaaaaggatggtt

SEQ ID NO: 245398 - DNA, 16 bp, P. troglodytes
gagtaaaccctaatgt

SEQ ID NO: 245399 - DNA, 16 bp, P. troglodytes
gagtaaatatttgcaa

SEQ ID NO: 245400 - DNA, 16 bp, P. troglodytes
gagtaaattttaagtg

SEQ ID NO: 245401 - DNA, 16 bp, P. troglodytes
gagtaatatcccacaa

SEQ ID NO: 245402 - DNA, 16 bp, P. troglodytes
gagtacaggtgcccac

SEQ ID NO: 245403 - DNA, 16 bp, P. troglodytes
gagtacagtgccatga

SEQ ID NO: 245404 - DNA, 16 bp, P. troglodytes
gagtacagtggcacca

SEQ ID NO: 245405 - DNA, 16 bp, P. troglodytes
gagtacatactatgtg

SEQ ID NO: 245406 - DNA, 16 bp, P. troglodytes
gagtacctaatgttta

SEQ ID NO: 245407 - DNA, 16 bp, P. troglodytes
gagtacctgggactac

SEQ ID NO: 245408 - DNA, 16 bp, P. troglodytes
gagtactattcagtca

SEQ ID NO: 245409 - DNA, 16 bp, P. troglodytes
gagtactattcggcca

SEQ ID NO: 245410 - DNA, 16 bp, P. troglodytes
gagtactgggattaca

SEQ ID NO: 245411 - DNA, 16 bp, P. troglodytes
gagtagaattgctgaa

SEQ ID NO: 245412 - DNA, 16 bp, P. troglodytes
gagtagcagagattac

SEQ ID NO: 245413 - DNA, 16 bp, P. troglodytes
gagtagcagggactat

SEQ ID NO: 245414 - DNA, 16 bp, P. troglodytes
gagtagcagggattac

SEQ ID NO: 245415 - DNA, 16 bp, P. troglodytes
gagtagctgggataac

SEQ ID NO: 245416 - DNA, 21 bp, P. troglodytes
gagtagctgggatgacaggca

SEQ ID NO: 245417 - DNA, 16 bp, P. troglodytes
gagtagctgggattat

SEQ ID NO: 245418 - DNA, 16 bp, P. troglodytes
gagtagctgggattca

SEQ ID NO: 245419 - DNA, 16 bp, P. troglodytes
gagtagctgggattta

SEQ ID NO: 245420 - DNA, 16 bp, P. troglodytes
gagtagctgtgactac

SEQ ID NO: 245421 - DNA, 16 bp, P. troglodytes
gagtagcttggactac

SEQ ID NO: 245422 - DNA, 16 bp, P. troglodytes
gagtagttgggacaac

SEQ ID NO: 245423 - DNA, 16 bp, P. troglodytes
gagtatatacccaaaa

SEQ ID NO: 245424 - DNA, 16 bp, P. troglodytes
gagtatatgccctttg

SEQ ID NO: 245425 - DNA, 16 bp, P. troglodytes
gagtatatgtaccaca

SEQ ID NO: 245426 - DNA, 16 bp, P. troglodytes
gagtatgtggagaaat

SEQ ID NO: 245427 - DNA, 16 bp, P. troglodytes
gagtcaaggtcttgct

SEQ ID NO: 245428 - DNA, 16 bp, P. troglodytes
gagtcagaatttgaat

SEQ ID NO: 245429 - DNA, 16 bp, P. troglodytes
gagtcagacagatctg

SEQ ID NO: 245430 - DNA, 16 bp, P. troglodytes
gagtcagagtcagaga

SEQ ID NO: 245431 - DNA, 16 bp, P. troglodytes
gagtcagagtctcgct

SEQ ID NO: 245432 - DNA, 16 bp, P. troglodytes
gagtcaggagacctgg

SEQ ID NO: 245433 - DNA, 16 bp, P. troglodytes
gagtcaggaggcctgg

SEQ ID NO: 245434 - DNA, 16 bp, P. troglodytes
gagtcaggatttgaac

SEQ ID NO: 245435 - DNA, 16 bp, P. troglodytes
gagtcagtgaactggg

SEQ ID NO: 245436 - DNA, 16 bp, P. troglodytes
gagtccaaggcaggag

SEQ ID NO: 245437 - DNA, 16 bp, P. troglodytes
gagtccagcaagctaa

SEQ ID NO: 245438 - DNA, 16 bp, P. troglodytes
gagtccagcctggcca

SEQ ID NO: 245439 - DNA, 16 bp, P. troglodytes
gagtccagcctgggaa

SEQ ID NO: 245440 - DNA, 16 bp, P. troglodytes
gagtccagcctgggca

SEQ ID NO: 245441 - DNA, 16 bp, P. troglodytes
gagtccaggagctgga

SEQ ID NO: 245442 - DNA, 16 bp, P. troglodytes
gagtcccagctactca

SEQ ID NO: 245443 - DNA, 16 bp, P. troglodytes
gagtccctgctggggc

SEQ ID NO: 245444 - DNA, 16 bp, P. troglodytes
gagtccgaggtgggtg

SEQ ID NO: 245445 - DNA, 16 bp, P. troglodytes
gagtcctcatctctac

SEQ ID NO: 245446 - DNA, 16 bp, P. troglodytes
gagtcctgccttgggg

SEQ ID NO: 245447 - DNA, 16 bp, P. troglodytes
gagtcctgctttgttg

SEQ ID NO: 245448 - DNA, 17 bp, P. troglodytes
gagtcctgggattacag

SEQ ID NO: 245449 - DNA, 16 bp, P. troglodytes
gagtccttccttttca

SEQ ID NO: 245450 - DNA, 16 bp, P. troglodytes
gagtctaaggcaggag

SEQ ID NO: 245451 - DNA, 16 bp, P. troglodytes
gagtctacagaagcag

SEQ ID NO: 245452 - DNA, 16 bp, P. troglodytes
gagtctcaccctgtca

SEQ ID NO: 245453 - DNA, 16 bp, P. troglodytes
gagtctcactatgtca

SEQ ID NO: 245454 - DNA, 16 bp, P. troglodytes
gagtctcactccatca

SEQ ID NO: 245455 - DNA, 16 bp, P. troglodytes
gagtctcactctgtcg

SEQ ID NO: 245456 - DNA, 16 bp, P. troglodytes
gagtctcactctgtgg

SEQ ID NO: 245457 - DNA, 16 bp, P. troglodytes
gagtctcactttgttg

SEQ ID NO: 245458 - DNA, 16 bp, P. troglodytes
gagtctcaggcctggc

SEQ ID NO: 245459 - DNA, 16 bp, P. troglodytes
gagtctcagtctgttg

SEQ ID NO: 245460 - DNA, 16 bp, P. troglodytes
gagtctcatgctgttg

SEQ ID NO: 245461 - DNA, 16 bp, P. troglodytes
gagtctcattctgtcg

SEQ ID NO: 245462 - DNA, 16 bp, P. troglodytes
gagtctccagaaggaa

SEQ ID NO: 245463 - DNA, 16 bp, P. troglodytes
gagtctccctttgtca

SEQ ID NO: 245464 - DNA, 16 bp, P. troglodytes
gagtctcctctgtcac

SEQ ID NO: 245465 - DNA, 16 bp, P. troglodytes
gagtctcctgcctcaa

SEQ ID NO: 245466 - DNA, 16 bp, P. troglodytes
gagtctcctgcctcag

SEQ ID NO: 245467 - DNA, 16 bp, P. troglodytes
gagtctcgctctgtta

SEQ ID NO: 245468 - DNA, 16 bp, P. troglodytes
gagtctcgctctgttg

SEQ ID NO: 245469 - DNA, 16 bp, P. troglodytes
gagtctcgctgtattg

SEQ ID NO: 245470 - DNA, 16 bp, P. troglodytes
gagtctcgctgtgtca

SEQ ID NO: 245471 - DNA, 16 bp, P. troglodytes
gagtctcgctttgtca

SEQ ID NO: 245472 - DNA, 16 bp, P. troglodytes
gagtctcgttctgtca

SEQ ID NO: 245473 - DNA, 16 bp, P. troglodytes
gagtctcgttctgttg

SEQ ID NO: 245474 - DNA, 16 bp, P. troglodytes
gagtctcgttttgttg

SEQ ID NO: 245475 - DNA, 16 bp, P. troglodytes
gagtctctccttttca

SEQ ID NO: 245476 - DNA, 16 bp, P. troglodytes
gagtctctctctgtca

SEQ ID NO: 245477 - DNA, 16 bp, P. troglodytes
gagtctctctgtgttg

SEQ ID NO: 245478 - DNA, 16 bp, P. troglodytes
gagtctctgtctgtca

SEQ ID NO: 245479 - DNA, 16 bp, P. troglodytes
gagtctgaagcaggag

SEQ ID NO: 245480 - DNA, 16 bp, P. troglodytes
gagtctgaggcaagag

SEQ ID NO: 245481 - DNA, 16 bp, P. troglodytes
gagtctgaggcaggag

SEQ ID NO: 245482 - DNA, 16 bp, P. troglodytes
gagtctgcagtgagct

SEQ ID NO: 245483 - DNA, 16 bp, P. troglodytes
gagtctggctctgtcg

SEQ ID NO: 245484 - DNA, 16 bp, P. troglodytes
gagtctggcttatttc

SEQ ID NO: 245485 - DNA, 16 bp, P. troglodytes
gagtctgggatgcaga

SEQ ID NO: 245486 - DNA, 16 bp, P. troglodytes
gagtctgtctctgtcg

SEQ ID NO: 245487 - DNA, 16 bp, P. troglodytes
gagtcttacatttaag

SEQ ID NO: 245488 - DNA, 16 bp, P. troglodytes
gagtcttactctgtcc

SEQ ID NO: 245489 - DNA, 16 bp, P. troglodytes
gagtcttactgtgtca

SEQ ID NO: 245490 - DNA, 16 bp, P. troglodytes
gagtcttgatctgtca

SEQ ID NO: 245491 - DNA, 16 bp, P. troglodytes
gagtcttgccctgtca

SEQ ID NO: 245492 - DNA, 16 bp, P. troglodytes
gagtcttgccctgtcg

SEQ ID NO: 245493 - DNA, 16 bp, P. troglodytes
gagtcttgctatgtca

SEQ ID NO: 245494 - DNA, 16 bp, P. troglodytes
gagtcttgctcctgtc

SEQ ID NO: 245495 - DNA, 18 bp, P. troglodytes
gagtcttgctctgtcact

SEQ ID NO: 245496 - DNA, 16 bp, P. troglodytes
gagtcttgctgtgtca

SEQ ID NO: 245497 - DNA, 16 bp, P. troglodytes
gagtcttgctttgtca

SEQ ID NO: 245498 - DNA, 16 bp, P. troglodytes
gagtcttgctttgtgg

SEQ ID NO: 245499 - DNA, 16 bp, P. troglodytes
gagtctttctatgttg

SEQ ID NO: 245500 - DNA, 16 bp, P. troglodytes
gagtctttctctgtca

SEQ ID NO: 245501 - DNA, 16 bp, P. troglodytes
gagtgaaaccccatct

SEQ ID NO: 245502 - DNA, 16 bp, P. troglodytes
gagtgaaactgcatct

SEQ ID NO: 245503 - DNA, 16 bp, P. troglodytes
gagtgaaattggaatg

SEQ ID NO: 245504 - DNA, 18 bp, P. troglodytes
gagtgaagctgcagatct

SEQ ID NO: 245505 - DNA, 16 bp, P. troglodytes
gagtgaaggaggcttg

SEQ ID NO: 245506 - DNA, 16 bp, P. troglodytes
gagtgacatgatctga

SEQ ID NO: 245507 - DNA, 16 bp, P. troglodytes
gagtgagaacgtgcag

SEQ ID NO: 245508 - DNA, 16 bp, P. troglodytes
gagtgagaccagccct

SEQ ID NO: 245509 - DNA, 16 bp, P. troglodytes
gagtgagactatgtct

SEQ ID NO: 245510 - DNA, 16 bp, P. troglodytes
gagtgagactcctgtc

SEQ ID NO: 245511 - DNA, 16 bp, P. troglodytes
gagtgagactctgtcc

SEQ ID NO: 245512 - DNA, 16 bp, P. troglodytes
gagtgagacttcatca

SEQ ID NO: 245513 - DNA, 16 bp, P. troglodytes
gagtgagatgatattt

SEQ ID NO: 245514 - DNA, 16 bp, P. troglodytes
gagtgaggccctatct

SEQ ID NO: 245515 - DNA, 16 bp, P. troglodytes
gagtgaggctgtgtct

SEQ ID NO: 245516 - DNA, 16 bp, P. troglodytes
gagtgagggttgaaaa

SEQ ID NO: 245517 - DNA, 16 bp, P. troglodytes
gagtgagtgagtgaag

SEQ ID NO: 245518 - DNA, 16 bp, P. troglodytes
gagtgagtgagtgtgg

SEQ ID NO: 245519 - DNA, 16 bp, P. troglodytes
gagtgagtgccagcag

SEQ ID NO: 245520 - DNA, 16 bp, P. troglodytes
gagtgataaaaatgtt

SEQ ID NO: 245521 - DNA, 16 bp, P. troglodytes
gagtgatcatagctca

SEQ ID NO: 245522 - DNA, 16 bp, P. troglodytes
gagtgatggggagcag

SEQ ID NO: 245523 - DNA, 16 bp, P. troglodytes
gagtgcaagccccaag

SEQ ID NO: 245524 - DNA, 16 bp, P. troglodytes
gagtgcaatggaacaa

SEQ ID NO: 245525 - DNA, 17 bp, P. troglodytes
gagtgcaatggtgcgat

SEQ ID NO: 245526 - DNA, 16 bp, P. troglodytes
gagtgcagaaatctct

SEQ ID NO: 245527 - DNA, 16 bp, P. troglodytes
gagtgcagcagtgcag

SEQ ID NO: 245528 - DNA, 16 bp, P. troglodytes
gagtgcagtgattgtg

SEQ ID NO: 245529 - DNA, 16 bp, P. troglodytes
gagtgcagtggagcaa

SEQ ID NO: 245530 - DNA, 16 bp, P. troglodytes
gagtgcggtggtgcaa

SEQ ID NO: 245531 - DNA, 16 bp, P. troglodytes
gagtgctcctgtattg

SEQ ID NO: 245532 - DNA, 16 bp, P. troglodytes
gagtgctgctgtaaag

SEQ ID NO: 245533 - DNA, 16 bp, P. troglodytes
gagtgcttgagcctgg

SEQ ID NO: 245534 - DNA, 16 bp, P. troglodytes
gagtggaagcagcttg

SEQ ID NO: 245535 - DNA, 16 bp, P. troglodytes
gagtggaatggagtgg

SEQ ID NO: 245536 - DNA, 16 bp, P. troglodytes
gagtggaattcctggg

SEQ ID NO: 245537 - DNA, 16 bp, P. troglodytes
gagtggcagagctggg

SEQ ID NO: 245538 - DNA, 20 bp, P. troglodytes
gagtggctcacacctgtaat

SEQ ID NO: 245539 - DNA, 16 bp, P. troglodytes
gagtggctcatgcctg

SEQ ID NO: 245540 - DNA, 16 bp, P. troglodytes
gagtggctgaggcagg

SEQ ID NO: 245541 - DNA, 16 bp, P. troglodytes
gagtggctgctgccat

SEQ ID NO: 245542 - DNA, 17 bp, P. troglodytes
gagtggctttgagtgag

SEQ ID NO: 245543 - DNA, 18 bp, P. troglodytes
gagtgggaagatgatctt

SEQ ID NO: 245544 - DNA, 16 bp, P. troglodytes
gagtgggaaggactgt

SEQ ID NO: 245545 - DNA, 16 bp, P. troglodytes
gagtggggcagggaag

SEQ ID NO: 245546 - DNA, 16 bp, P. troglodytes
gagtggggcctgagat

SEQ ID NO: 245547 - DNA, 16 bp, P. troglodytes
gagtggtggaggtggc

SEQ ID NO: 245548 - DNA, 16 bp, P. troglodytes
gagtggtggcacgcgc

SEQ ID NO: 245549 - DNA, 16 bp, P. troglodytes
gagtggtggtgggcgc

SEQ ID NO: 245550 - DNA, 16 bp, P. troglodytes
gagtggttaaaaaaaa

SEQ ID NO: 245551 - DNA, 17 bp, P. troglodytes
gagtgtctgcggctttt

SEQ ID NO: 245552 - DNA, 16 bp, P. troglodytes
gagtgtgaatgtgtgt

SEQ ID NO: 245553 - DNA, 16 bp, P. troglodytes
gagtgtgaccaaaact

SEQ ID NO: 245554 - DNA, 16 bp, P. troglodytes
gagtgtgagaccctgt

SEQ ID NO: 245555 - DNA, 16 bp, P. troglodytes
gagtgtgaggcaggag

SEQ ID NO: 245556 - DNA, 16 bp, P. troglodytes
gagtgtgaggcctccc

SEQ ID NO: 245557 - DNA, 16 bp, P. troglodytes
gagtgtgaggctgcag

SEQ ID NO: 245558 - DNA, 16 bp, P. troglodytes
gagtgtggggcccacc

SEQ ID NO: 245559 - DNA, 16 bp, P. troglodytes
gagtgtgtatgtgtgt

SEQ ID NO: 245560 - DNA, 16 bp, P. troglodytes
gagtgtgtgagtgtgt

SEQ ID NO: 245561 - DNA, 16 bp, P. troglodytes
gagtgtgtgccatgtg

SEQ ID NO: 245562 - DNA, 16 bp, P. troglodytes
gagtgtgtgtatgtgt

SEQ ID NO: 245563 - DNA, 16 bp, P. troglodytes
gagttaaataaaatct

SEQ ID NO: 245564 - DNA, 16 bp, P. troglodytes
gagttcaaaatgggtc

SEQ ID NO: 245565 - DNA, 16 bp, P. troglodytes
gagttcaagacaggcc

SEQ ID NO: 245566 - DNA, 16 bp, P. troglodytes
gagttcaaggtcacag

SEQ ID NO: 245567 - DNA, 16 bp, P. troglodytes
gagttcaagtggttct

SEQ ID NO: 245568 - DNA, 16 bp, P. troglodytes
gagttcacagtctagt

SEQ ID NO: 245569 - DNA, 16 bp, P. troglodytes
gagttcactcttgttg

SEQ ID NO: 245570 - DNA, 16 bp, P. troglodytes
gagttcagcaaggtca

SEQ ID NO: 245571 - DNA, 16 bp, P. troglodytes
gagttcaggagagagg

SEQ ID NO: 245572 - DNA, 40 bp, P. troglodytes
gagttcatgtcctttgtagggacatggatgaaactggaaa

SEQ ID NO: 245573 - DNA, 16 bp, P. troglodytes
gagttcatgttctttg

SEQ ID NO: 245574 - DNA, 16 bp, P. troglodytes
gagttccactcttgtt

SEQ ID NO: 245575 - DNA, 16 bp, P. troglodytes
gagttccagaaggaga

SEQ ID NO: 245576 - DNA, 16 bp, P. troglodytes
gagttccagacctgcc

SEQ ID NO: 245577 - DNA, 16 bp, P. troglodytes
gagttcctgaccagcc

SEQ ID NO: 245578 - DNA, 16 bp, P. troglodytes
gagttccttcctcagg

SEQ ID NO: 245579 - DNA, 16 bp, P. troglodytes
gagttcgagaccatgc

SEQ ID NO: 245580 - DNA, 16 bp, P. troglodytes
gagttctagagctggg

SEQ ID NO: 245581 - DNA, 16 bp, P. troglodytes
gagttctcactatgtt

SEQ ID NO: 245582 - DNA, 16 bp, P. troglodytes
gagttctccaactttg

SEQ ID NO: 245583 - DNA, 16 bp, P. troglodytes
gagttctgtgagctgt

SEQ ID NO: 245584 - DNA, 16 bp, P. troglodytes
gagttcttcatatatt

SEQ ID NO: 245585 - DNA, 16 bp, P. troglodytes
gagttctttacatatt

SEQ ID NO: 245586 - DNA, 16 bp, P. troglodytes
gagttctttatatgtt

SEQ ID NO: 245587 - DNA, 16 bp, P. troglodytes
gagttgaagctgtctt

SEQ ID NO: 245588 - DNA, 16 bp, P. troglodytes
gagttgcttcacttag

SEQ ID NO: 245589 - DNA, 16 bp, P. troglodytes
gagttggaatttgaac

SEQ ID NO: 245590 - DNA, 16 bp, P. troglodytes
gagttggagaccaggc

SEQ ID NO: 245591 - DNA, 16 bp, P. troglodytes
gagttggcaaactatg

SEQ ID NO: 245592 - DNA, 16 bp, P. troglodytes
gagttgggaggatcac

SEQ ID NO: 245593 - DNA, 16 bp, P. troglodytes
gagttggggaggagtc

SEQ ID NO: 245594 - DNA, 17 bp, P. troglodytes
gagttgttcattcctcc

SEQ ID NO: 245595 - DNA, 16 bp, P. troglodytes
gagttgtttccttgat

SEQ ID NO: 245596 - DNA, 16 bp, P. troglodytes
gagtttaattgagcaa

SEQ ID NO: 245597 - DNA, 16 bp, P. troglodytes
gagtttatgaccagcc

SEQ ID NO: 245598 - DNA, 16 bp, P. troglodytes
gagtttattgtagatt

SEQ ID NO: 245599 - DNA, 16 bp, P. troglodytes
gagtttcaccacgttg

SEQ ID NO: 245600 - DNA, 16 bp, P. troglodytes
gagtttcaccatatta

SEQ ID NO: 245601 - DNA, 16 bp, P. troglodytes
gagtttcactctgtca

SEQ ID NO: 245602 - DNA, 16 bp, P. troglodytes
gagtttcactcttgtc

SEQ ID NO: 245603 - DNA, 16 bp, P. troglodytes
gagtttcactcttttt

SEQ ID NO: 245604 - DNA, 16 bp, P. troglodytes
gagtttcagaacagcc

SEQ ID NO: 245605 - DNA, 16 bp, P. troglodytes
gagtttcgctcttgtc

SEQ ID NO: 245606 - DNA, 16 bp, P. troglodytes
gagtttctatttcttc

SEQ ID NO: 245607 - DNA, 21 bp, P. troglodytes
gagtttcttccttctggtggg

SEQ ID NO: 245608 - DNA, 16 bp, P. troglodytes
gagtttctttttcctt

SEQ ID NO: 245609 - DNA, 16 bp, P. troglodytes
gagtttgaaaccaccc

SEQ ID NO: 245610 - DNA, 16 bp, P. troglodytes
gagtttgaatcttggc

SEQ ID NO: 245611 - DNA, 17 bp, P. troglodytes
gagtttgacagcagcct

SEQ ID NO: 245612 - DNA, 16 bp, P. troglodytes
gagtttgaccagcctg

SEQ ID NO: 245613 - DNA, 16 bp, P. troglodytes
gagtttgagaaaaatt

SEQ ID NO: 245614 - DNA, 16 bp, P. troglodytes
gagtttgagaagaatt

SEQ ID NO: 245615 - DNA, 16 bp, P. troglodytes
gagtttgagttcagcc

SEQ ID NO: 245616 - DNA, 16 bp, P. troglodytes
gagtttgcagagaaaa

SEQ ID NO: 245617 - DNA, 16 bp, P. troglodytes
gagtttgcagtcagcc

SEQ ID NO: 245618 - DNA, 16 bp, P. troglodytes
gagtttgcagtgagcc

SEQ ID NO: 245619 - DNA, 16 bp, P. troglodytes
gagtttggctctgtca

SEQ ID NO: 245620 - DNA, 16 bp, P. troglodytes
gagtttgtctgatgtt

SEQ ID NO: 245621 - DNA, 21 bp, P. troglodytes
gagtttgttccttctgatgtt

SEQ ID NO: 245622 - DNA, 16 bp, P. troglodytes
gagttttaaaatttga

SEQ ID NO: 245623 - DNA, 16 bp, P. troglodytes
gagttttagtttgatt

SEQ ID NO: 245624 - DNA, 16 bp, P. troglodytes
gagttttatcatgttg

SEQ ID NO: 245625 - DNA, 16 bp, P. troglodytes
gagttttattttaaaa

SEQ ID NO: 245626 - DNA, 16 bp, P. troglodytes
gagttttctggaggtc

SEQ ID NO: 245627 - DNA, 16 bp, P. troglodytes
gagttttgatgggaaa

SEQ ID NO: 245628 - DNA, 16 bp, P. troglodytes
gagttttgcccaggcc

SEQ ID NO: 245629 - DNA, 16 bp, P. troglodytes
gagttttgcccttgtc

SEQ ID NO: 245630 - DNA, 16 bp, P. troglodytes
gagttttgctatgttg

SEQ ID NO: 245631 - DNA, 16 bp, P. troglodytes
gagttttgctcttgta

SEQ ID NO: 245632 - DNA, 16 bp, P. troglodytes
gagttttgctcttgtc

SEQ ID NO: 245633 - DNA, 17 bp, P. troglodytes
gagttttgctcttgtta

SEQ ID NO: 245634 - DNA, 16 bp, P. troglodytes
gagttttggaggagac

SEQ ID NO: 245635 - DNA, 16 bp, P. troglodytes
gagtttttaatatgaa

SEQ ID NO: 245636 - DNA, 16 bp, P. troglodytes
gagtttttagcatgaa

SEQ ID NO: 245637 - DNA, 16 bp, P. troglodytes
gagtttttatcaggaa

SEQ ID NO: 245638 - DNA, 16 bp, P. troglodytes
gagtttttctcttgtt

SEQ ID NO: 245639 - DNA, 16 bp, P. troglodytes
gagttttttccttctg

SEQ ID NO: 245640 - DNA, 16 bp, P. troglodytes
gagttttttttaaaaa

SEQ ID NO: 245641 - DNA, 16 bp, P. troglodytes
gataaaaaactacata

SEQ ID NO: 245642 - DNA, 16 bp, P. troglodytes
gataaaaactacaaag

SEQ ID NO: 245643 - DNA, 16 bp, P. troglodytes
gataaaaatatttgca

SEQ ID NO: 245644 - DNA, 16 bp, P. troglodytes
gataaaacaagttgca

SEQ ID NO: 245645 - DNA, 16 bp, P. troglodytes
gataaaacagagttta

SEQ ID NO: 245646 - DNA, 16 bp, P. troglodytes
gataaaaccataaaga

SEQ ID NO: 245647 - DNA, 16 bp, P. troglodytes
gataaaagcaaaggca

SEQ ID NO: 245648 - DNA, 16 bp, P. troglodytes
gataaaagccattcta

SEQ ID NO: 245649 - DNA, 16 bp, P. troglodytes
gataaaattcaacagc

SEQ ID NO: 245650 - DNA, 16 bp, P. troglodytes
gataaaattctgaatt

SEQ ID NO: 245651 - DNA, 16 bp, P. troglodytes
gataaaattgcacaga

SEQ ID NO: 245652 - DNA, 16 bp, P. troglodytes
gataaacaaaactgat

SEQ ID NO: 245653 - DNA, 16 bp, P. troglodytes
gataaacacagatgca

SEQ ID NO: 245654 - DNA, 16 bp, P. troglodytes
gataaacccaaagaaa

SEQ ID NO: 245655 - DNA, 16 bp, P. troglodytes
gataaacttttaaaaa

SEQ ID NO: 245656 - DNA, 16 bp, P. troglodytes
gataaagaaaaatgtg

SEQ ID NO: 245657 - DNA, 16 bp, P. troglodytes
gataaagaaaatgtca

SEQ ID NO: 245658 - DNA, 16 bp, P. troglodytes
gataaagaaaatgtgg

SEQ ID NO: 245659 - DNA, 16 bp, P. troglodytes
gataaagaaaatgtgt

SEQ ID NO: 245660 - DNA, 16 bp, P. troglodytes
gataaagaaaatttgg

SEQ ID NO: 245661 - DNA, 16 bp, P. troglodytes
gataaagactttaaaa

SEQ ID NO: 245662 - DNA, 16 bp, P. troglodytes
gataaagactttccca

SEQ ID NO: 245663 - DNA, 16 bp, P. troglodytes
gataaagagttaatat

SEQ ID NO: 245664 - DNA, 16 bp, P. troglodytes
gataaagattcaagac

SEQ ID NO: 245665 - DNA, 16 bp, P. troglodytes
gataaagcctacttga

SEQ ID NO: 245666 - DNA, 16 bp, P. troglodytes
gataaatatctttaaa

SEQ ID NO: 245667 - DNA, 16 bp, P. troglodytes
gataaatatttgaata

SEQ ID NO: 245668 - DNA, 16 bp, P. troglodytes
gataaatatttgttga

SEQ ID NO: 245669 - DNA, 16 bp, P. troglodytes
gataaattcctagaag

SEQ ID NO: 245670 - DNA, 16 bp, P. troglodytes
gataaattgtggtata

SEQ ID NO: 245671 - DNA, 16 bp, P. troglodytes
gataacataagagaaa

SEQ ID NO: 245672 - DNA, 16 bp, P. troglodytes
gataagaaattactta

SEQ ID NO: 245673 - DNA, 16 bp, P. troglodytes
gataaggaaaaataac

SEQ ID NO: 245674 - DNA, 16 bp, P. troglodytes
gataaggaaactgaga

SEQ ID NO: 245675 - DNA, 16 bp, P. troglodytes
gataaggaaattgaga

SEQ ID NO: 245676 - DNA, 16 bp, P. troglodytes
gataagggatgaaata

SEQ ID NO: 245677 - DNA, 16 bp, P. troglodytes
gataagtggaaaagag

SEQ ID NO: 245678 - DNA, 16 bp, P. troglodytes
gataataacagaactt

SEQ ID NO: 245679 - DNA, 16 bp, P. troglodytes
gataatacatgtaaag

SEQ ID NO: 245680 - DNA, 16 bp, P. troglodytes
gataatcatgttgttt

SEQ ID NO: 245681 - DNA, 16 bp, P. troglodytes
gataatcgcttgaacc

SEQ ID NO: 245682 - DNA, 16 bp, P. troglodytes
gataatcttttcaaca

SEQ ID NO: 245683 - DNA, 16 bp, P. troglodytes
gataatgataataatg

SEQ ID NO: 245684 - DNA, 16 bp, P. troglodytes
gataatgatgatgaca

SEQ ID NO: 245685 - DNA, 16 bp, P. troglodytes
gataatgatgtgtcaa

SEQ ID NO: 245686 - DNA, 16 bp, P. troglodytes
gataatggcttccaga

SEQ ID NO: 245687 - DNA, 16 bp, P. troglodytes
gataatggggaaaatg

SEQ ID NO: 245688 - DNA, 16 bp, P. troglodytes
gataatgtatgtaaag

SEQ ID NO: 245689 - DNA, 16 bp, P. troglodytes
gataatttcttttgct

SEQ ID NO: 245690 - DNA, 16 bp, P. troglodytes
gataatttgacttctt

SEQ ID NO: 245691 - DNA, 16 bp, P. troglodytes
gataatttgttatggc

SEQ ID NO: 245692 - DNA, 16 bp, P. troglodytes
gatacaaacacatgga

SEQ ID NO: 245693 - DNA, 16 bp, P. troglodytes
gatacaacaaaagcag

SEQ ID NO: 245694 - DNA, 16 bp, P. troglodytes
gatacaactcaggaac

SEQ ID NO: 245695 - DNA, 16 bp, P. troglodytes
gatacaagataaatat

SEQ ID NO: 245696 - DNA, 16 bp, P. troglodytes
gatacaagttccttat

SEQ ID NO: 245697 - DNA, 16 bp, P. troglodytes
gatacacaaatggtca

SEQ ID NO: 245698 - DNA, 16 bp, P. troglodytes
gatacagatacagata

SEQ ID NO: 245699 - DNA, 16 bp, P. troglodytes
gatacagtgagaaggc

SEQ ID NO: 245700 - DNA, 16 bp, P. troglodytes
gatacattttgagaaa

SEQ ID NO: 245701 - DNA, 16 bp, P. troglodytes
gatacatttttatttt

SEQ ID NO: 245702 - DNA, 16 bp, P. troglodytes
gataccaagggatgac

SEQ ID NO: 245703 - DNA, 16 bp, P. troglodytes
gataccagctcagcca

SEQ ID NO: 245704 - DNA, 16 bp, P. troglodytes
gataccattccttctg

SEQ ID NO: 245705 - DNA, 16 bp, P. troglodytes
gatacctccagatttg

SEQ ID NO: 245706 - DNA, 16 bp, P. troglodytes
gatacggtttggattt

SEQ ID NO: 245707 - DNA, 16 bp, P. troglodytes
gatactatctgagact

SEQ ID NO: 245708 - DNA, 16 bp, P. troglodytes
gatactgattctttct

SEQ ID NO: 245709 - DNA, 16 bp, P. troglodytes
gatagaagattcattc

SEQ ID NO: 245710 - DNA, 16 bp, P. troglodytes
gatagaaggaacatac

SEQ ID NO: 245711 - DNA, 16 bp, P. troglodytes
gatagacttgattaag

SEQ ID NO: 245712 - DNA, 16 bp, P. troglodytes
gatagagacggggttt

SEQ ID NO: 245713 - DNA, 16 bp, P. troglodytes
gatagagctgaaaaac

SEQ ID NO: 245714 - DNA, 16 bp, P. troglodytes
gatagagtgagactcc

SEQ ID NO: 245715 - DNA, 16 bp, P. troglodytes
gatagataagatagat

SEQ ID NO: 245716 - DNA, 16 bp, P. troglodytes
gatagataggtagatg

SEQ ID NO: 245717 - DNA, 16 bp, P. troglodytes
gatagatgaatgaatg

SEQ ID NO: 245718 - DNA, 16 bp, P. troglodytes
gatagcattgaatctg

SEQ ID NO: 245719 - DNA, 16 bp, P. troglodytes
gatagctcatttcatt

SEQ ID NO: 245720 - DNA, 16 bp, P. troglodytes
gatagcttgaactcag

SEQ ID NO: 245721 - DNA, 16 bp, P. troglodytes
gatagggtctcgcttt

SEQ ID NO: 245722 - DNA, 16 bp, P. troglodytes
gatagggtttcactat

SEQ ID NO: 245723 - DNA, 16 bp, P. troglodytes
gataggtagatagata

SEQ ID NO: 245724 - DNA, 16 bp, P. troglodytes
gataggtgcagcaaaa

SEQ ID NO: 245725 - DNA, 16 bp, P. troglodytes
gatagtactgaaccct

SEQ ID NO: 245726 - DNA, 16 bp, P. troglodytes
gatagtgagtgagttt

SEQ ID NO: 245727 - DNA, 16 bp, P. troglodytes
gatagttcccttgacc

SEQ ID NO: 245728 - DNA, 16 bp, P. troglodytes
gatagtttactgagaa

SEQ ID NO: 245729 - DNA, 16 bp, P. troglodytes
gatagtttctattgct

SEQ ID NO: 245730 - DNA, 16 bp, P. troglodytes
gatagtttcttttgtg

SEQ ID NO: 245731 - DNA, 16 bp, P. troglodytes
gatagtttgaaaatat

SEQ ID NO: 245732 - DNA, 16 bp, P. troglodytes
gatataaaatggtaca

SEQ ID NO: 245733 - DNA, 16 bp, P. troglodytes
gatatacaatcatgtt

SEQ ID NO: 245734 - DNA, 16 bp, P. troglodytes
gatatacatatataca

SEQ ID NO: 245735 - DNA, 16 bp, P. troglodytes
gatatacccatgtaac

SEQ ID NO: 245736 - DNA, 16 bp, P. troglodytes
gatatatacaaatata

SEQ ID NO: 245737 - DNA, 16 bp, P. troglodytes
gatatatacatatata

SEQ ID NO: 245738 - DNA, 16 bp, P. troglodytes
gatatatatacacaca

SEQ ID NO: 245739 - DNA, 16 bp, P. troglodytes
gatatatatatatatg

SEQ ID NO: 245740 - DNA, 16 bp, P. troglodytes
gatatatcattgtggt

SEQ ID NO: 245741 - DNA, 16 bp, P. troglodytes
gatatcacctcacact

SEQ ID NO: 245742 - DNA, 16 bp, P. troglodytes
gatatcattttaaaaa

SEQ ID NO: 245743 - DNA, 16 bp, P. troglodytes
gatatccagttgtttc

SEQ ID NO: 245744 - DNA, 16 bp, P. troglodytes
gatatccatcacttca

SEQ ID NO: 245745 - DNA, 16 bp, P. troglodytes
gatatcccaattacac

SEQ ID NO: 245746 - DNA, 16 bp, P. troglodytes
gatatctcaaagaact

SEQ ID NO: 245747 - DNA, 16 bp, P. troglodytes
gatatctcattatata

SEQ ID NO: 245748 - DNA, 16 bp, P. troglodytes
gatatgactgaattgc

SEQ ID NO: 245749 - DNA, 16 bp, P. troglodytes
gatatgatctcctggt

SEQ ID NO: 245750 - DNA, 16 bp, P. troglodytes
gatatgccaaagagaa

SEQ ID NO: 245751 - DNA, 16 bp, P. troglodytes
gatatgcctgctcccc

SEQ ID NO: 245752 - DNA, 16 bp, P. troglodytes
gatatgcctttcacct

SEQ ID NO: 245753 - DNA, 16 bp, P. troglodytes
gatatgctaaacaagg

SEQ ID NO: 245754 - DNA, 16 bp, P. troglodytes
gatatggagaaagttt

SEQ ID NO: 245755 - DNA, 16 bp, P. troglodytes
gatatggggtcttgct

SEQ ID NO: 245756 - DNA, 16 bp, P. troglodytes
gatatggtttgaatat

SEQ ID NO: 245757 - DNA, 16 bp, P. troglodytes
gatattaaacattttt

SEQ ID NO: 245758 - DNA, 16 bp, P. troglodytes
gatattcaacctgtac

SEQ ID NO: 245759 - DNA, 16 bp, P. troglodytes
gatattgacaaactga

SEQ ID NO: 245760 - DNA, 16 bp, P. troglodytes
gatattgataagatgt

SEQ ID NO: 245761 - DNA, 16 bp, P. troglodytes
gatattgatatggttt

SEQ ID NO: 245762 - DNA, 16 bp, P. troglodytes
gatattgatattgata

SEQ ID NO: 245763 - DNA, 16 bp, P. troglodytes
gatattgatgctgctg

SEQ ID NO: 245764 - DNA, 16 bp, P. troglodytes
gatattgtcagtcttt

SEQ ID NO: 245765 - DNA, 16 bp, P. troglodytes
gatattgtgaatagtg

SEQ ID NO: 245766 - DNA, 16 bp, P. troglodytes
gatatttcagttgaag

SEQ ID NO: 245767 - DNA, 16 bp, P. troglodytes
gatatttgctgtgggt

SEQ ID NO: 245768 - DNA, 16 bp, P. troglodytes
gatatttgggtggaga

SEQ ID NO: 245769 - DNA, 16 bp, P. troglodytes
gatattttaaagattt

SEQ ID NO: 245770 - DNA, 16 bp, P. troglodytes
gatattttgataaatg

SEQ ID NO: 245771 - DNA, 16 bp, P. troglodytes
gatatttttcacagaa

SEQ ID NO: 245772 - DNA, 16 bp, P. troglodytes
gatcaaaaccattcaa

SEQ ID NO: 245773 - DNA, 16 bp, P. troglodytes
gatcaacaaaactgat

SEQ ID NO: 245774 - DNA, 20 bp, P. troglodytes
gatcaacaaaattgatagac

SEQ ID NO: 245775 - DNA, 16 bp, P. troglodytes
gatcaactgaaagaaa

SEQ ID NO: 245776 - DNA, 16 bp, P. troglodytes
gatcaactgagatcag

SEQ ID NO: 245777 - DNA, 16 bp, P. troglodytes
gatcaactgagcccag

SEQ ID NO: 245778 - DNA, 16 bp, P. troglodytes
gatcaagaagaaagaa

SEQ ID NO: 245779 - DNA, 16 bp, P. troglodytes
gatcaagaagctgtca

SEQ ID NO: 245780 - DNA, 16 bp, P. troglodytes
gatcaagatacagaac

SEQ ID NO: 245781 - DNA, 16 bp, P. troglodytes
gatcaagccactgaac

SEQ ID NO: 245782 - DNA, 16 bp, P. troglodytes
gatcaagcggaagaaa

SEQ ID NO: 245783 - DNA, 16 bp, P. troglodytes
gatcaaggtgctggcc

SEQ ID NO: 245784 - DNA, 16 bp, P. troglodytes
gatcaatcaaaagaaa

SEQ ID NO: 245785 - DNA, 17 bp, P. troglodytes
gatcacaaagtcaggag

SEQ ID NO: 245786 - DNA, 17 bp, P. troglodytes
gatcacaagatcaggag

SEQ ID NO: 245787 - DNA, 17 bp, P. troglodytes
gatcacaaggtcaagag

SEQ ID NO: 245788 - DNA, 17 bp, P. troglodytes
gatcacaaggtcagaag

SEQ ID NO: 245789 - DNA, 17 bp, P. troglodytes
gatcacaaggtcaggag

SEQ ID NO: 245790 - DNA, 17 bp, P. troglodytes
gatcacaccattgtact

SEQ ID NO: 245791 - DNA, 17 bp, P. troglodytes
gatcacagctcactgca

SEQ ID NO: 245792 - DNA, 17 bp, P. troglodytes
gatcacagctcattgca

SEQ ID NO: 245793 - DNA, 16 bp, P. troglodytes
gatcacaggcatgagc

SEQ ID NO: 245794 - DNA, 17 bp, P. troglodytes
gatcaccaggtcaggag

SEQ ID NO: 245795 - DNA, 16 bp, P. troglodytes
gatcaccccactgcac

SEQ ID NO: 245796 - DNA, 16 bp, P. troglodytes
gatcaccctgaggtca

SEQ ID NO: 245797 - DNA, 16 bp, P. troglodytes
gatcacctgagcctgg

SEQ ID NO: 245798 - DNA, 16 bp, P. troglodytes
gatcacctgaggccaa

SEQ ID NO: 245799 - DNA, 16 bp, P. troglodytes
gatcacctgaggtcac

SEQ ID NO: 245800 - DNA, 20 bp, P. troglodytes
gatcacctgaggtcaggagg

SEQ ID NO: 245801 - DNA, 16 bp, P. troglodytes
gatcacctgaggtcga

SEQ ID NO: 245802 - DNA, 21 bp, P. troglodytes
gatcacctgaggtgaggagtt

SEQ ID NO: 245803 - DNA, 16 bp, P. troglodytes
gatcacgaagtcaaga

SEQ ID NO: 245804 - DNA, 17 bp, P. troglodytes
gatcacgaagtcaggag

SEQ ID NO: 245805 - DNA, 17 bp, P. troglodytes
gatcacgagatcaggag

SEQ ID NO: 245806 - DNA, 16 bp, P. troglodytes
gatcacgaggtcaaca

SEQ ID NO: 245807 - DNA, 17 bp, P. troglodytes
gatcacgaggtcaagag

SEQ ID NO: 245808 - DNA, 19 bp, P. troglodytes
gatcacgaggtcaagagat

SEQ ID NO: 245809 - DNA, 17 bp, P. troglodytes
gatcacgaggtcaggaa

SEQ ID NO: 245810 - DNA, 17 bp, P. troglodytes
gatcacgaggtcaggag

SEQ ID NO: 245811 - DNA, 16 bp, P. troglodytes
gatcacgaggtcaggc

SEQ ID NO: 245812 - DNA, 16 bp, P. troglodytes
gatcacgaggtcaggt

SEQ ID NO: 245813 - DNA, 16 bp, P. troglodytes
gatcacgaggtcagta

SEQ ID NO: 245814 - DNA, 17 bp, P. troglodytes
gatcacgagttcaggag

SEQ ID NO: 245815 - DNA, 17 bp, P. troglodytes
gatcacgatgtcaggag

SEQ ID NO: 245816 - DNA, 17 bp, P. troglodytes
gatcacgccactgtact

SEQ ID NO: 245817 - DNA, 16 bp, P. troglodytes
gatcacgccagtgcac

SEQ ID NO: 245818 - DNA, 17 bp, P. troglodytes
gatcacgcggtcaggag

SEQ ID NO: 245819 - DNA, 17 bp, P. troglodytes
gatcacggggtcaggag

SEQ ID NO: 245820 - DNA, 17 bp, P. troglodytes
gatcacgtcactgcact

SEQ ID NO: 245821 - DNA, 23 bp, P. troglodytes
gatcactcgcggttaggagctgg

SEQ ID NO: 245822 - DNA, 16 bp, P. troglodytes
gatcactgaagcccag

SEQ ID NO: 245823 - DNA, 16 bp, P. troglodytes
gatcactgaggccagg

SEQ ID NO: 245824 - DNA, 16 bp, P. troglodytes
gatcacttaagcccag

SEQ ID NO: 245825 - DNA, 16 bp, P. troglodytes
gatcacttgatatcag

SEQ ID NO: 245826 - DNA, 16 bp, P. troglodytes
gatcacttgcatccag

SEQ ID NO: 245827 - DNA, 16 bp, P. troglodytes
gatcacttggggtcag

SEQ ID NO: 245828 - DNA, 16 bp, P. troglodytes
gatcagatggatgaat

SEQ ID NO: 245829 - DNA, 16 bp, P. troglodytes
gatcagcctggccaag

SEQ ID NO: 245830 - DNA, 16 bp, P. troglodytes
gatcagtagttctcaa

SEQ ID NO: 245831 - DNA, 16 bp, P. troglodytes
gatcagtgatgttcag

SEQ ID NO: 245832 - DNA, 16 bp, P. troglodytes
gatcagttcatctttt

SEQ ID NO: 245833 - DNA, 17 bp, P. troglodytes
gatcataaggtcaggag

SEQ ID NO: 245834 - DNA, 17 bp, P. troglodytes
gatcatagctcactgca

SEQ ID NO: 245835 - DNA, 16 bp, P. troglodytes
gatcatcatcatcatc

SEQ ID NO: 245836 - DNA, 16 bp, P. troglodytes
gatcatcctggccaat

SEQ ID NO: 245837 - DNA, 17 bp, P. troglodytes
gatcatgagatcaggag

SEQ ID NO: 245838 - DNA, 16 bp, P. troglodytes
gatcatgagggcagga

SEQ ID NO: 245839 - DNA, 17 bp, P. troglodytes
gatcatgaggtcaagag

SEQ ID NO: 245840 - DNA, 16 bp, P. troglodytes
gatcatgaggtcagaa

SEQ ID NO: 245841 - DNA, 17 bp, P. troglodytes
gatcatgaggtcaggaa

SEQ ID NO: 245842 - DNA, 17 bp, P. troglodytes
gatcatgaggtcaggag

SEQ ID NO: 245843 - DNA, 17 bp, P. troglodytes
gatcatgaggttaggag

SEQ ID NO: 245844 - DNA, 16 bp, P. troglodytes
gatcatgatgtcaaga

SEQ ID NO: 245845 - DNA, 16 bp, P. troglodytes
gatcatgccactgcag

SEQ ID NO: 245846 - DNA, 16 bp, P. troglodytes
gatcatgccattgcat

SEQ ID NO: 245847 - DNA, 17 bp, P. troglodytes
gatcatggctcactgca

SEQ ID NO: 245848 - DNA, 16 bp, P. troglodytes
gatcatgggggtggat

SEQ ID NO: 245849 - DNA, 16 bp, P. troglodytes
gatcatggtttactgc

SEQ ID NO: 245850 - DNA, 16 bp, P. troglodytes
gatcatgtcatcagca

SEQ ID NO: 245851 - DNA, 16 bp, P. troglodytes
gatcattaaaaagcca

SEQ ID NO: 245852 - DNA, 20 bp, P. troglodytes
gatcatttgagcccaggagg

SEQ ID NO: 245853 - DNA, 16 bp, P. troglodytes
gatcatttgtattttt

SEQ ID NO: 245854 - DNA, 16 bp, P. troglodytes
gatcattttgaaactt

SEQ ID NO: 245855 - DNA, 16 bp, P. troglodytes
gatcattttggacctt

SEQ ID NO: 245856 - DNA, 16 bp, P. troglodytes
gatccaagaagagaaa

SEQ ID NO: 245857 - DNA, 16 bp, P. troglodytes
gatccaccagcttcgg

SEQ ID NO: 245858 - DNA, 20 bp, P. troglodytes
gatccacccacctcagcctt

SEQ ID NO: 245859 - DNA, 16 bp, P. troglodytes
gatccacccacttcag

SEQ ID NO: 245860 - DNA, 16 bp, P. troglodytes
gatccacccactttgg

SEQ ID NO: 245861 - DNA, 16 bp, P. troglodytes
gatccacccgcctcca

SEQ ID NO: 245862 - DNA, 19 bp, P. troglodytes
gatccacctgtcttggcct

SEQ ID NO: 245863 - DNA, 16 bp, P. troglodytes
gatccagcttcagctt

SEQ ID NO: 245864 - DNA, 16 bp, P. troglodytes
gatccaggttttgtgg

SEQ ID NO: 245865 - DNA, 16 bp, P. troglodytes
gatccagtgctgtgct

SEQ ID NO: 245866 - DNA, 16 bp, P. troglodytes
gatccatttttttaaa

SEQ ID NO: 245867 - DNA, 16 bp, P. troglodytes
gatcccacacctgcca

SEQ ID NO: 245868 - DNA, 16 bp, P. troglodytes
gatcccacagaaatag

SEQ ID NO: 245869 - DNA, 16 bp, P. troglodytes
gatcccacatttccct

SEQ ID NO: 245870 - DNA, 16 bp, P. troglodytes
gatcccaccactgtac

SEQ ID NO: 245871 - DNA, 16 bp, P. troglodytes
gatcccatctccaaaa

SEQ ID NO: 245872 - DNA, 16 bp, P. troglodytes
gatcccctcatgagcc

SEQ ID NO: 245873 - DNA, 17 bp, P. troglodytes
gatccctgaggaatcac

SEQ ID NO: 245874 - DNA, 16 bp, P. troglodytes
gatcccttccctccct

SEQ ID NO: 245875 - DNA, 16 bp, P. troglodytes
gatcctaagcaaaaag

SEQ ID NO: 245876 - DNA, 16 bp, P. troglodytes
gatcctacagaaatac

SEQ ID NO: 245877 - DNA, 16 bp, P. troglodytes
gatcctcccacctcaa

SEQ ID NO: 245878 - DNA, 16 bp, P. troglodytes
gatcctcccaccttag

SEQ ID NO: 245879 - DNA, 16 bp, P. troglodytes
gatcctccctcttcag

SEQ ID NO: 245880 - DNA, 16 bp, P. troglodytes
gatcctcctgcctctg

SEQ ID NO: 245881 - DNA, 16 bp, P. troglodytes
gatcctcctgctgcag

SEQ ID NO: 245882 - DNA, 16 bp, P. troglodytes
gatcctcctgcttcag

SEQ ID NO: 245883 - DNA, 16 bp, P. troglodytes
gatcctctcgccttag

SEQ ID NO: 245884 - DNA, 16 bp, P. troglodytes
gatcctctctccttgg

SEQ ID NO: 245885 - DNA, 16 bp, P. troglodytes
gatcctgaaacagaaa

SEQ ID NO: 245886 - DNA, 16 bp, P. troglodytes
gatcctggaagagaaa

SEQ ID NO: 245887 - DNA, 16 bp, P. troglodytes
gatcctggagaggatg

SEQ ID NO: 245888 - DNA, 16 bp, P. troglodytes
gatcctggctcaccac

SEQ ID NO: 245889 - DNA, 16 bp, P. troglodytes
gatcctggttcactgc

SEQ ID NO: 245890 - DNA, 16 bp, P. troglodytes
gatcctgtttctacaa

SEQ ID NO: 245891 - DNA, 16 bp, P. troglodytes
gatccttccatctcag

SEQ ID NO: 245892 - DNA, 16 bp, P. troglodytes
gatccttctgtctcag

SEQ ID NO: 245893 - DNA, 16 bp, P. troglodytes
gatccttggggtgttg

SEQ ID NO: 245894 - DNA, 16 bp, P. troglodytes
gatcctttgagtccag

SEQ ID NO: 245895 - DNA, 16 bp, P. troglodytes
gatcctttggagaaga

SEQ ID NO: 245896 - DNA, 16 bp, P. troglodytes
gatcgagaccatccag

SEQ ID NO: 245897 - DNA, 16 bp, P. troglodytes
gatcgagactccgtct

SEQ ID NO: 245898 - DNA, 16 bp, P. troglodytes
gatcgagtccatcctg

SEQ ID NO: 245899 - DNA, 16 bp, P. troglodytes
gatcgcaccactgcat

SEQ ID NO: 245900 - DNA, 17 bp, P. troglodytes
gatcgcgaggtcaggag

SEQ ID NO: 245901 - DNA, 21 bp, P. troglodytes
gatcgcgccactacactccag

SEQ ID NO: 245902 - DNA, 17 bp, P. troglodytes
gatcgcgccactgtact

SEQ ID NO: 245903 - DNA, 20 bp, P. troglodytes
gatcgtgccactgaactcca

SEQ ID NO: 245904 - DNA, 18 bp, P. troglodytes
gatcgtgccactgcactt

SEQ ID NO: 245905 - DNA, 16 bp, P. troglodytes
gatcgtgccactgcat

SEQ ID NO: 245906 - DNA, 16 bp, P. troglodytes
gatctaaatataaaac

SEQ ID NO: 245907 - DNA, 16 bp, P. troglodytes
gatctaataatatttg

SEQ ID NO: 245908 - DNA, 16 bp, P. troglodytes
gatctacccaccttgg

SEQ ID NO: 245909 - DNA, 19 bp, P. troglodytes
gatctagaactagaaatac

SEQ ID NO: 245910 - DNA, 16 bp, P. troglodytes
gatctagaagcagaaa

SEQ ID NO: 245911 - DNA, 16 bp, P. troglodytes
gatctagacattcaaa

SEQ ID NO: 245912 - DNA, 16 bp, P. troglodytes
gatctcaaagagatat

SEQ ID NO: 245913 - DNA, 16 bp, P. troglodytes
gatctcactctgtcac

SEQ ID NO: 245914 - DNA, 16 bp, P. troglodytes
gatctcagactgccgt

SEQ ID NO: 245915 - DNA, 16 bp, P. troglodytes
gatctcagctactcgg

SEQ ID NO: 245916 - DNA, 16 bp, P. troglodytes
gatctcagctcactcc

SEQ ID NO: 245917 - DNA, 16 bp, P. troglodytes
gatctcagctcactct

SEQ ID NO: 245918 - DNA, 16 bp, P. troglodytes
gatctcagctcactgg

SEQ ID NO: 245919 - DNA, 16 bp, P. troglodytes
gatctcatctcactgc

SEQ ID NO: 245920 - DNA, 16 bp, P. troglodytes
gatctcatgggactta

SEQ ID NO: 245921 - DNA, 17 bp, P. troglodytes
gatctccactcactgca

SEQ ID NO: 245922 - DNA, 16 bp, P. troglodytes
gatctccccacctcag

SEQ ID NO: 245923 - DNA, 16 bp, P. troglodytes
gatctcctgaccccat

SEQ ID NO: 245924 - DNA, 17 bp, P. troglodytes
gatctcctgacctcata

SEQ ID NO: 245925 - DNA, 16 bp, P. troglodytes
gatctcctgaccttga

SEQ ID NO: 245926 - DNA, 16 bp, P. troglodytes
gatctcctggcctcaa

SEQ ID NO: 245927 - DNA, 17 bp, P. troglodytes
gatctcgaggtcaggag

SEQ ID NO: 245928 - DNA, 17 bp, P. troglodytes
gatctcggctcacggca

SEQ ID NO: 245929 - DNA, 21 bp, P. troglodytes
gatctcggttcactgcaagct

SEQ ID NO: 245930 - DNA, 17 bp, P. troglodytes
gatctctcagcagaaac

SEQ ID NO: 245931 - DNA, 16 bp, P. troglodytes
gatctctcatggcttg

SEQ ID NO: 245932 - DNA, 17 bp, P. troglodytes
gatctctcggcagaaac

SEQ ID NO: 245933 - DNA, 16 bp, P. troglodytes
gatctctgctcactgc

SEQ ID NO: 245934 - DNA, 16 bp, P. troglodytes
gatctctggagcccag

SEQ ID NO: 245935 - DNA, 16 bp, P. troglodytes
gatctcttgaagtcag

SEQ ID NO: 245936 - DNA, 16 bp, P. troglodytes
gatctgaccaccttgg

SEQ ID NO: 245937 - DNA, 16 bp, P. troglodytes
gatctgcccacttcag

SEQ ID NO: 245938 - DNA, 16 bp, P. troglodytes
gatctgccggccttgg

SEQ ID NO: 245939 - DNA, 16 bp, P. troglodytes
gatctgcctgcatcgg

SEQ ID NO: 245940 - DNA, 16 bp, P. troglodytes
gatctgcctggctcag

SEQ ID NO: 245941 - DNA, 16 bp, P. troglodytes
gatctgcttgccttgg

SEQ ID NO: 245942 - DNA, 16 bp, P. troglodytes
gatctgctttctatca

SEQ ID NO: 245943 - DNA, 16 bp, P. troglodytes
gatctggaaccagaaa

SEQ ID NO: 245944 - DNA, 16 bp, P. troglodytes
gatctggaagaattct

SEQ ID NO: 245945 - DNA, 16 bp, P. troglodytes
gatctgggctcgctgc

SEQ ID NO: 245946 - DNA, 16 bp, P. troglodytes
gatctgtctgatattg

SEQ ID NO: 245947 - DNA, 16 bp, P. troglodytes
gatctgtggaaatttg

SEQ ID NO: 245948 - DNA, 16 bp, P. troglodytes
gatctgttgcacagca

SEQ ID NO: 245949 - DNA, 16 bp, P. troglodytes
gatcttatttttaaaa

SEQ ID NO: 245950 - DNA, 16 bp, P. troglodytes
gatcttcctccatcct

SEQ ID NO: 245951 - DNA, 16 bp, P. troglodytes
gatcttcctgccttag

SEQ ID NO: 245952 - DNA, 16 bp, P. troglodytes
gatcttccttcctcag

SEQ ID NO: 245953 - DNA, 16 bp, P. troglodytes
gatcttgagcaagtca

SEQ ID NO: 245954 - DNA, 16 bp, P. troglodytes
gatcttgctatgttgc

SEQ ID NO: 245955 - DNA, 16 bp, P. troglodytes
gatcttggaagctaag

SEQ ID NO: 245956 - DNA, 16 bp, P. troglodytes
gatcttggacaaatta

SEQ ID NO: 245957 - DNA, 17 bp, P. troglodytes
gatcttggcttactgca

SEQ ID NO: 245958 - DNA, 16 bp, P. troglodytes
gatcttgtctcactgc

SEQ ID NO: 245959 - DNA, 16 bp, P. troglodytes
gatcttgtctcttaaa

SEQ ID NO: 245960 - DNA, 16 bp, P. troglodytes
gatcttgtctttaaaa

SEQ ID NO: 245961 - DNA, 16 bp, P. troglodytes
gatcttgttaaaatgc

SEQ ID NO: 245962 - DNA, 16 bp, P. troglodytes
gatctttccactgaaa

SEQ ID NO: 245963 - DNA, 16 bp, P. troglodytes
gatctttttgcagtga

SEQ ID NO: 245964 - DNA, 16 bp, P. troglodytes
gatgaaaaaactaagg

SEQ ID NO: 245965 - DNA, 16 bp, P. troglodytes
gatgaaaaaggaaaca

SEQ ID NO: 245966 - DNA, 16 bp, P. troglodytes
gatgaaaaattactaa

SEQ ID NO: 245967 - DNA, 16 bp, P. troglodytes
gatgaaaagacaagcc

SEQ ID NO: 245968 - DNA, 16 bp, P. troglodytes
gatgaaaatgacactt

SEQ ID NO: 245969 - DNA, 16 bp, P. troglodytes
gatgaaaatgccaaaa

SEQ ID NO: 245970 - DNA, 16 bp, P. troglodytes
gatgaaaatgtcaaaa

SEQ ID NO: 245971 - DNA, 16 bp, P. troglodytes
gatgaaacaccatctc

SEQ ID NO: 245972 - DNA, 16 bp, P. troglodytes
gatgaaactgaggctt

SEQ ID NO: 245973 - DNA, 16 bp, P. troglodytes
gatgaaataaagacat

SEQ ID NO: 245974 - DNA, 16 bp, P. troglodytes
gatgaaatatgccctg

SEQ ID NO: 245975 - DNA, 16 bp, P. troglodytes
gatgaaattgccaaaa

SEQ ID NO: 245976 - DNA, 16 bp, P. troglodytes
gatgaaattggaaaac

SEQ ID NO: 245977 - DNA, 16 bp, P. troglodytes
gatgaacatagacaca

SEQ ID NO: 245978 - DNA, 16 bp, P. troglodytes
gatgaactcttggaaa

SEQ ID NO: 245979 - DNA, 16 bp, P. troglodytes
gatgaactttttttca

SEQ ID NO: 245980 - DNA, 16 bp, P. troglodytes
gatgaagaaaaagcat

SEQ ID NO: 245981 - DNA, 16 bp, P. troglodytes
gatgaagaaaagaatc

SEQ ID NO: 245982 - DNA, 16 bp, P. troglodytes
gatgaagaaaatgagg

SEQ ID NO: 245983 - DNA, 16 bp, P. troglodytes
gatgaagaaacagact

SEQ ID NO: 245984 - DNA, 16 bp, P. troglodytes
gatgaagaaacagatt

SEQ ID NO: 245985 - DNA, 16 bp, P. troglodytes
gatgaagaaactgagg

SEQ ID NO: 245986 - DNA, 16 bp, P. troglodytes
gatgaagaaagtgagg

SEQ ID NO: 245987 - DNA, 16 bp, P. troglodytes
gatgaagaaatggaag

SEQ ID NO: 245988 - DNA, 16 bp, P. troglodytes
gatgaagaaattgaaa

SEQ ID NO: 245989 - DNA, 16 bp, P. troglodytes
gatgaagaaattgaag

SEQ ID NO: 245990 - DNA, 16 bp, P. troglodytes
gatgaagaagatgatg

SEQ ID NO: 245991 - DNA, 16 bp, P. troglodytes
gatgaagacactgagg

SEQ ID NO: 245992 - DNA, 16 bp, P. troglodytes
gatgaagagactgaag

SEQ ID NO: 245993 - DNA, 16 bp, P. troglodytes
gatgaagagatgaaga

SEQ ID NO: 245994 - DNA, 16 bp, P. troglodytes
gatgaagagttctgga

SEQ ID NO: 245995 - DNA, 16 bp, P. troglodytes
gatgaagataccaaaa

SEQ ID NO: 245996 - DNA, 16 bp, P. troglodytes
gatgaagatccagttt

SEQ ID NO: 245997 - DNA, 16 bp, P. troglodytes
gatgaagatgatggtg

SEQ ID NO: 245998 - DNA, 16 bp, P. troglodytes
gatgaagcagaagaaa

SEQ ID NO: 245999 - DNA, 16 bp, P. troglodytes
gatgaagccaacttga

SEQ ID NO: 246000 - DNA, 16 bp, P. troglodytes
gatgaagcctacttga

SEQ ID NO: 246001 - DNA, 16 bp, P. troglodytes
gatgaagctagaagcc

SEQ ID NO: 246002 - DNA, 16 bp, P. troglodytes
gatgaagctgaggaca

SEQ ID NO: 246003 - DNA, 16 bp, P. troglodytes
gatgaagcttcactgg

SEQ ID NO: 246004 - DNA, 16 bp, P. troglodytes
gatgaaggaagagcaa

SEQ ID NO: 246005 - DNA, 16 bp, P. troglodytes
gatgaaggggatatca

SEQ ID NO: 246006 - DNA, 16 bp, P. troglodytes
gatgaaggtgccagca

SEQ ID NO: 246007 - DNA, 16 bp, P. troglodytes
gatgaaggtggctata

SEQ ID NO: 246008 - DNA, 16 bp, P. troglodytes
gatgaagtaactgagg

SEQ ID NO: 246009 - DNA, 16 bp, P. troglodytes
gatgaagtgagaccct

SEQ ID NO: 246010 - DNA, 16 bp, P. troglodytes
gatgaagtttccagag

SEQ ID NO: 246011 - DNA, 16 bp, P. troglodytes
gatgaatgaataaaca

SEQ ID NO: 246012 - DNA, 16 bp, P. troglodytes
gatgaatgaatgaata

SEQ ID NO: 246013 - DNA, 16 bp, P. troglodytes
gatgaatgaattaaaa

SEQ ID NO: 246014 - DNA, 16 bp, P. troglodytes
gatgaatgaatttaaa

SEQ ID NO: 246015 - DNA, 16 bp, P. troglodytes
gatgaatggattaaaa

SEQ ID NO: 246016 - DNA, 16 bp, P. troglodytes
gatgacaacagaggaa

SEQ ID NO: 246017 - DNA, 16 bp, P. troglodytes
gatgacaaggtcaaga

SEQ ID NO: 246018 - DNA, 16 bp, P. troglodytes
gatgacaatgatgata

SEQ ID NO: 246019 - DNA, 16 bp, P. troglodytes
gatgacaatgatgatg

SEQ ID NO: 246020 - DNA, 16 bp, P. troglodytes
gatgacagaacaagat

SEQ ID NO: 246021 - DNA, 16 bp, P. troglodytes
gatgacaggagtgagc

SEQ ID NO: 246022 - DNA, 16 bp, P. troglodytes
gatgacaggcttgagc

SEQ ID NO: 246023 - DNA, 16 bp, P. troglodytes
gatgacaggtatgagc

SEQ ID NO: 246024 - DNA, 16 bp, P. troglodytes
gatgacaggtgcccgc

SEQ ID NO: 246025 - DNA, 16 bp, P. troglodytes
gatgacattccaccac

SEQ ID NO: 246026 - DNA, 16 bp, P. troglodytes
gatgacctgttctgtg

SEQ ID NO: 246027 - DNA, 18 bp, P. troglodytes
gatgactcttaacgagca

SEQ ID NO: 246028 - DNA, 16 bp, P. troglodytes
gatgacttgaagccag

SEQ ID NO: 246029 - DNA, 16 bp, P. troglodytes
gatgagaaaaaaccag

SEQ ID NO: 246030 - DNA, 16 bp, P. troglodytes
gatgagaaaacaggct

SEQ ID NO: 246031 - DNA, 16 bp, P. troglodytes
gatgagaaaaccaaag

SEQ ID NO: 246032 - DNA, 16 bp, P. troglodytes
gatgagaaaactaaga

SEQ ID NO: 246033 - DNA, 16 bp, P. troglodytes
gatgagaaaactgggg

SEQ ID NO: 246034 - DNA, 16 bp, P. troglodytes
gatgagaaaattaaag

SEQ ID NO: 246035 - DNA, 16 bp, P. troglodytes
gatgagaaaattgaaa

SEQ ID NO: 246036 - DNA, 16 bp, P. troglodytes
gatgagaaagctgaag

SEQ ID NO: 246037 - DNA, 16 bp, P. troglodytes
gatgagaaagttgagg

SEQ ID NO: 246038 - DNA, 16 bp, P. troglodytes
gatgagaagaatatat

SEQ ID NO: 246039 - DNA, 16 bp, P. troglodytes
gatgagaatgatggtt

SEQ ID NO: 246040 - DNA, 16 bp, P. troglodytes
gatgagaatgttctgg

SEQ ID NO: 246041 - DNA, 16 bp, P. troglodytes
gatgagaccacagccc

SEQ ID NO: 246042 - DNA, 16 bp, P. troglodytes
gatgagaccctgtctc

SEQ ID NO: 246043 - DNA, 16 bp, P. troglodytes
gatgagactatggact

SEQ ID NO: 246044 - DNA, 16 bp, P. troglodytes
gatgagaggggctgct

SEQ ID NO: 246045 - DNA, 16 bp, P. troglodytes
gatgagagtggacatc

SEQ ID NO: 246046 - DNA, 16 bp, P. troglodytes
gatgagcatttttttc

SEQ ID NO: 246047 - DNA, 16 bp, P. troglodytes
gatgagctgagatcat

SEQ ID NO: 246048 - DNA, 16 bp, P. troglodytes
gatgagctgcagacaa

SEQ ID NO: 246049 - DNA, 16 bp, P. troglodytes
gatgaggaaatagaag

SEQ ID NO: 246050 - DNA, 16 bp, P. troglodytes
gatgaggaaatggagg

SEQ ID NO: 246051 - DNA, 16 bp, P. troglodytes
gatgaggaaattaaga

SEQ ID NO: 246052 - DNA, 16 bp, P. troglodytes
gatgaggaaattgaaa

SEQ ID NO: 246053 - DNA, 16 bp, P. troglodytes
gatgaggaaattgaag

SEQ ID NO: 246054 - DNA, 16 bp, P. troglodytes
gatgaggaaattgaga

SEQ ID NO: 246055 - DNA, 16 bp, P. troglodytes
gatgaggaacctgaga

SEQ ID NO: 246056 - DNA, 16 bp, P. troglodytes
gatgaggaactgaggc

SEQ ID NO: 246057 - DNA, 16 bp, P. troglodytes
gatgaggaagaaattt

SEQ ID NO: 246058 - DNA, 16 bp, P. troglodytes
gatgaggaatctgaga

SEQ ID NO: 246059 - DNA, 16 bp, P. troglodytes
gatgaggacacagaca

SEQ ID NO: 246060 - DNA, 16 bp, P. troglodytes
gatgaggacactgagg

SEQ ID NO: 246061 - DNA, 16 bp, P. troglodytes
gatgaggacagggagg

SEQ ID NO: 246062 - DNA, 16 bp, P. troglodytes
gatgaggatgaagacc

SEQ ID NO: 246063 - DNA, 16 bp, P. troglodytes
gatgaggatgatggtg

SEQ ID NO: 246064 - DNA, 16 bp, P. troglodytes
gatgaggcaagagaat

SEQ ID NO: 246065 - DNA, 16 bp, P. troglodytes
gatgaggcccacccat

SEQ ID NO: 246066 - DNA, 16 bp, P. troglodytes
gatgaggctgcagaga

SEQ ID NO: 246067 - DNA, 16 bp, P. troglodytes
gatgagggtgccagca

SEQ ID NO: 246068 - DNA, 16 bp, P. troglodytes
gatgaggtcagagaag

SEQ ID NO: 246069 - DNA, 16 bp, P. troglodytes
gatgaggtgggaggat

SEQ ID NO: 246070 - DNA, 35 bp, P. troglodytes; identical to SEQ ID NO: 104078

SEQ ID NO: 246071 - DNA, 16 bp, P. troglodytes
gatgagttcttgtcct

SEQ ID NO: 246072 - DNA, 16 bp, P. troglodytes
gatgatagtgatgatg

SEQ ID NO: 246073 - DNA, 16 bp, P. troglodytes
gatgatatcctgaaga

SEQ ID NO: 246074 - DNA, 16 bp, P. troglodytes
gatgatattactcccc

SEQ ID NO: 246075 - DNA, 16 bp, P. troglodytes
gatgatattgattctt

SEQ ID NO: 246076 - DNA, 16 bp, P. troglodytes
gatgatcattaaaaag

SEQ ID NO: 246077 - DNA, 16 bp, P. troglodytes
gatgatcttgaccctg

SEQ ID NO: 246078 - DNA, 16 bp, P. troglodytes
gatgatgaaactgaag

SEQ ID NO: 246079 - DNA, 16 bp, P. troglodytes
gatgatgaagatgatg

SEQ ID NO: 246080 - DNA, 16 bp, P. troglodytes
gatgatgacgatgata

SEQ ID NO: 246081 - DNA, 16 bp, P. troglodytes
gatgatgacggtgatg

SEQ ID NO: 246082 - DNA, 16 bp, P. troglodytes
gatgatgataatagca

SEQ ID NO: 246083 - DNA, 16 bp, P. troglodytes
gatgatgatgaaaata

SEQ ID NO: 246084 - DNA, 16 bp, P. troglodytes
gatgatgatgaagaag

SEQ ID NO: 246085 - DNA, 16 bp, P. troglodytes
gatgatgatgaagata

SEQ ID NO: 246086 - DNA, 18 bp, P. troglodytes
gatgatgatgatgatgaa

SEQ ID NO: 246087 - DNA, 19 bp, P. troglodytes
gatgatgatgatgatgaag

SEQ ID NO: 246088 - DNA, 16 bp, P. troglodytes
gatgatgatgatggag

SEQ ID NO: 246089 - DNA, 16 bp, P. troglodytes
gatgatgatgatggca

SEQ ID NO: 246090 - DNA, 16 bp, P. troglodytes
gatgatgatgatgtta

SEQ ID NO: 246091 - DNA, 16 bp, P. troglodytes
gatgatgatgatgttg

SEQ ID NO: 246092 - DNA, 16 bp, P. troglodytes
gatgatgatgattttg

SEQ ID NO: 246093 - DNA, 16 bp, P. troglodytes
gatgatgatggagatg

SEQ ID NO: 246094 - DNA, 16 bp, P. troglodytes
gatgatgatggtggtg

SEQ ID NO: 246095 - DNA, 16 bp, P. troglodytes
gatgatgatgttgatg

SEQ ID NO: 246096 - DNA, 16 bp, P. troglodytes
gatgatgattccattt

SEQ ID NO: 246097 - DNA, 16 bp, P. troglodytes
gatgatgcaacagaaa

SEQ ID NO: 246098 - DNA, 16 bp, P. troglodytes
gatgatgctgatgctg

SEQ ID NO: 246099 - DNA, 16 bp, P. troglodytes
gatgatggtgatgaca

SEQ ID NO: 246100 - DNA, 16 bp, P. troglodytes
gatgattaaataagat

SEQ ID NO: 246101 - DNA, 16 bp, P. troglodytes
gatgattatgatgatg

SEQ ID NO: 246102 - DNA, 16 bp, P. troglodytes
gatgattctaaaattt

SEQ ID NO: 246103 - DNA, 16 bp, P. troglodytes
gatgattctgatgatt

SEQ ID NO: 246104 - DNA, 16 bp, P. troglodytes
gatgattctgatgcat

SEQ ID NO: 246105 - DNA, 16 bp, P. troglodytes
gatgattttaaaaata

SEQ ID NO: 246106 - DNA, 16 bp, P. troglodytes
gatgattttataaaag

SEQ ID NO: 246107 - DNA, 16 bp, P. troglodytes
gatgatttttttaaaa

SEQ ID NO: 246108 - DNA, 16 bp, P. troglodytes
gatgcacaaaaggcct

SEQ ID NO: 246109 - DNA, 16 bp, P. troglodytes
gatgcagaaaagtctt

SEQ ID NO: 246110 - DNA, 16 bp, P. troglodytes
gatgcagagcttgcag

SEQ ID NO: 246111 - DNA, 16 bp, P. troglodytes
gatgcagaggttgcag

SEQ ID NO: 246112 - DNA, 16 bp, P. troglodytes
gatgcagatgctgctg

SEQ ID NO: 246113 - DNA, 16 bp, P. troglodytes
gatgcagctgggggcc

SEQ ID NO: 246114 - DNA, 16 bp, P. troglodytes
gatgcagtttcttcct

SEQ ID NO: 246115 - DNA, 16 bp, P. troglodytes
gatgcagttttgccat

SEQ ID NO: 246116 - DNA, 16 bp, P. troglodytes
gatgcatatctgattt

SEQ ID NO: 246117 - DNA, 16 bp, P. troglodytes
gatgcatgctacaaca

SEQ ID NO: 246118 - DNA, 16 bp, P. troglodytes
gatgcatgtgcagaat

SEQ ID NO: 246119 - DNA, 16 bp, P. troglodytes
gatgcattcaaagcag

SEQ ID NO: 246120 - DNA, 16 bp, P. troglodytes
gatgcattgtttgcaa

SEQ ID NO: 246121 - DNA, 16 bp, P. troglodytes
gatgcatttctcagga

SEQ ID NO: 246122 - DNA, 16 bp, P. troglodytes
gatgccaaaaaagcat

SEQ ID NO: 246123 - DNA, 16 bp, P. troglodytes
gatgccaagaacctgg

SEQ ID NO: 246124 - DNA, 16 bp, P. troglodytes
gatgccagcaccatgt

SEQ ID NO: 246125 - DNA, 16 bp, P. troglodytes
gatgccagcagcaccc

SEQ ID NO: 246126 - DNA, 16 bp, P. troglodytes
gatgccagctggagct

SEQ ID NO: 246127 - DNA, 16 bp, P. troglodytes
gatgccagtagcactc

SEQ ID NO: 246128 - DNA, 16 bp, P. troglodytes
gatgccccaccctgct

SEQ ID NO: 246129 - DNA, 16 bp, P. troglodytes
gatgcctccagctttc

SEQ ID NO: 246130 - DNA, 16 bp, P. troglodytes
gatgccttcagcttta

SEQ ID NO: 246131 - DNA, 16 bp, P. troglodytes
gatgctcaacctcact

SEQ ID NO: 246132 - DNA, 16 bp, P. troglodytes
gatgctcaacctgtat

SEQ ID NO: 246133 - DNA, 16 bp, P. troglodytes
gatgctcaagttcctg

SEQ ID NO: 246134 - DNA, 16 bp, P. troglodytes
gatgctcaataaatgt

SEQ ID NO: 246135 - DNA, 16 bp, P. troglodytes
gatgctcctcgactta

SEQ ID NO: 246136 - DNA, 16 bp, P. troglodytes
gatgctgaggcagaag

SEQ ID NO: 246137 - DNA, 16 bp, P. troglodytes
gatgctgaggcaggag

SEQ ID NO: 246138 - DNA, 16 bp, P. troglodytes
gatgctgaggtgggtg

SEQ ID NO: 246139 - DNA, 16 bp, P. troglodytes
gatgctgatgaggatg

SEQ ID NO: 246140 - DNA, 16 bp, P. troglodytes
gatgctgatgctgctg

SEQ ID NO: 246141 - DNA, 16 bp, P. troglodytes
gatgctgcagaggctg

SEQ ID NO: 246142 - DNA, 16 bp, P. troglodytes
gatgctgctaaacatc

SEQ ID NO: 246143 - DNA, 16 bp, P. troglodytes
gatgctgctgctgctg

SEQ ID NO: 246144 - DNA, 16 bp, P. troglodytes
gatgctggaaaccatc

SEQ ID NO: 246145 - DNA, 16 bp, P. troglodytes
gatgctggacaagaac

SEQ ID NO: 246146 - DNA, 16 bp, P. troglodytes
gatgctggattttatc

SEQ ID NO: 246147 - DNA, 16 bp, P. troglodytes
gatgctggcagaagac

SEQ ID NO: 246148 - DNA, 16 bp, P. troglodytes
gatgctggcttcacag

SEQ ID NO: 246149 - DNA, 16 bp, P. troglodytes
gatgctggggaggatg

SEQ ID NO: 246150 - DNA, 16 bp, P. troglodytes
gatgctggggtgggag

SEQ ID NO: 246151 - DNA, 16 bp, P. troglodytes
gatgctggtgaagatg

SEQ ID NO: 246152 - DNA, 16 bp, P. troglodytes
gatgctggtgaggatg

SEQ ID NO: 246153 - DNA, 16 bp, P. troglodytes
gatgctggtgatgctg

SEQ ID NO: 246154 - DNA, 16 bp, P. troglodytes
gatgctggtgctgctg

SEQ ID NO: 246155 - DNA, 16 bp, P. troglodytes
gatgctgttcagctgc

SEQ ID NO: 246156 - DNA, 17 bp, P. troglodytes
gatgcttgtgatttttg

SEQ ID NO: 246157 - DNA, 16 bp, P. troglodytes
gatggaaaaaaatcta

SEQ ID NO: 246158 - DNA, 16 bp, P. troglodytes
gatggaaaaatatatt

SEQ ID NO: 246159 - DNA, 16 bp, P. troglodytes
gatggaaatgaggaaa

SEQ ID NO: 246160 - DNA, 16 bp, P. troglodytes
gatggaaatttttttt

SEQ ID NO: 246161 - DNA, 16 bp, P. troglodytes
gatggaactagagatc

SEQ ID NO: 246162 - DNA, 16 bp, P. troglodytes
gatggaactttgttcc

SEQ ID NO: 246163 - DNA, 16 bp, P. troglodytes
gatggaagaaaatatt

SEQ ID NO: 246164 - DNA, 16 bp, P. troglodytes
gatggaagtggaagtg

SEQ ID NO: 246165 - DNA, 16 bp, P. troglodytes
gatggaattaaagttg

SEQ ID NO: 246166 - DNA, 16 bp, P. troglodytes
gatggacacttaggtt

SEQ ID NO: 246167 - DNA, 16 bp, P. troglodytes
gatggacagacagaca

SEQ ID NO: 246168 - DNA, 16 bp, P. troglodytes
gatggacagatggatg

SEQ ID NO: 246169 - DNA, 16 bp, P. troglodytes
gatggaccttgaaaac

SEQ ID NO: 246170 - DNA, 16 bp, P. troglodytes
gatggagaaaaatcta

SEQ ID NO: 246171 - DNA, 16 bp, P. troglodytes
gatggagaaataaaat

SEQ ID NO: 246172 - DNA, 16 bp, P. troglodytes
gatggagaagaggaac

SEQ ID NO: 246173 - DNA, 16 bp, P. troglodytes
gatggagacagagatt

SEQ ID NO: 246174 - DNA, 16 bp, P. troglodytes
gatggagagatggaga

SEQ ID NO: 246175 - DNA, 16 bp, P. troglodytes
gatggagataaggaac

SEQ ID NO: 246176 - DNA, 16 bp, P. troglodytes
gatggagatgaggaaa

SEQ ID NO: 246177 - DNA, 16 bp, P. troglodytes
gatggagatggagatg

SEQ ID NO: 246178 - DNA, 16 bp, P. troglodytes
gatggagccactgtac

SEQ ID NO: 246179 - DNA, 16 bp, P. troglodytes
gatggagcgagactcc

SEQ ID NO: 246180 - DNA, 16 bp, P. troglodytes
gatggagctggagggc

SEQ ID NO: 246181 - DNA, 16 bp, P. troglodytes
gatggagtcctgctct

SEQ ID NO: 246182 - DNA, 16 bp, P. troglodytes
gatggagtctcactat

SEQ ID NO: 246183 - DNA, 16 bp, P. troglodytes
gatggagtctcactgt

SEQ ID NO: 246184 - DNA, 16 bp, P. troglodytes
gatggagtctcatgct

SEQ ID NO: 246185 - DNA, 16 bp, P. troglodytes
gatggagtctccctcc

SEQ ID NO: 246186 - DNA, 18 bp, P. troglodytes
gatggagtctcgctctgc

SEQ ID NO: 246187 - DNA, 16 bp, P. troglodytes
gatggagtctctgtca

SEQ ID NO: 246188 - DNA, 16 bp, P. troglodytes
gatggagtctttctct

SEQ ID NO: 246189 - DNA, 16 bp, P. troglodytes
gatggagtgcaatggc

SEQ ID NO: 246190 - DNA, 16 bp, P. troglodytes
gatggagttggaggcc

SEQ ID NO: 246191 - DNA, 16 bp, P. troglodytes
gatggagtttcacact

SEQ ID NO: 246192 - DNA, 16 bp, P. troglodytes
gatggagtttcaccat

SEQ ID NO: 246193 - DNA, 16 bp, P. troglodytes
gatggagtttcaccgt

SEQ ID NO: 246194 - DNA, 16 bp, P. troglodytes
gatggagtttcgccat

SEQ ID NO: 246195 - DNA, 16 bp, P. troglodytes
gatggagtttcgctgt

SEQ ID NO: 246196 - DNA, 16 bp, P. troglodytes
gatggatatcccattt

SEQ ID NO: 246197 - DNA, 16 bp, P. troglodytes
gatggatatgttaatt

SEQ ID NO: 246198 - DNA, 16 bp, P. troglodytes
gatggatcactggagg

SEQ ID NO: 246199 - DNA, 16 bp, P. troglodytes
gatggatgaataggtg

SEQ ID NO: 246200 - DNA, 16 bp, P. troglodytes
gatggatgaatgggtg

SEQ ID NO: 246201 - DNA, 16 bp, P. troglodytes
gatggatggaagaatg

SEQ ID NO: 246202 - DNA, 16 bp, P. troglodytes
gatggatggatgatgg

SEQ ID NO: 246203 - DNA, 16 bp, P. troglodytes
gatggatggtgatgat

SEQ ID NO: 246204 - DNA, 16 bp, P. troglodytes
gatggatgtttggatg

SEQ ID NO: 246205 - DNA, 20 bp, P. troglodytes
gatggcaccattgcactcca

SEQ ID NO: 246206 - DNA, 17 bp, P. troglodytes
gatggccaacccacctc

SEQ ID NO: 246207 - DNA, 16 bp, P. troglodytes
gatggccattctaact

SEQ ID NO: 246208 - DNA, 16 bp, P. troglodytes
gatggccttctttgtc

SEQ ID NO: 246209 - DNA, 18 bp, P. troglodytes
gatggcgccaccgcactc

SEQ ID NO: 246210 - DNA, 19 bp, P. troglodytes
gatggcgccactgcactct

SEQ ID NO: 246211 - DNA, 16 bp, P. troglodytes
gatggctaaaataaaa

SEQ ID NO: 246212 - DNA, 21 bp, P. troglodytes
gatggctataatggatttggt

SEQ ID NO: 246213 - DNA, 17 bp, P. troglodytes
gatggctcacatctgta

SEQ ID NO: 246214 - DNA, 16 bp, P. troglodytes
gatggctgccttcttg

SEQ ID NO: 246215 - DNA, 16 bp, P. troglodytes
gatggctgttatcaaa

SEQ ID NO: 246216 - DNA, 16 bp, P. troglodytes
gatgggaacatcacac

SEQ ID NO: 246217 - DNA, 16 bp, P. troglodytes
gatgggaagaatggaa

SEQ ID NO: 246218 - DNA, 16 bp, P. troglodytes
gatgggacccaagtct

SEQ ID NO: 246219 - DNA, 16 bp, P. troglodytes
gatgggactacaggta

SEQ ID NO: 246220 - DNA, 16 bp, P. troglodytes
gatgggaggagaccct

SEQ ID NO: 246221 - DNA, 16 bp, P. troglodytes
gatgggaggagctgcc

SEQ ID NO: 246222 - DNA, 17 bp, P. troglodytes
gatgggagttttgctct

SEQ ID NO: 246223 - DNA, 16 bp, P. troglodytes
gatgggattacaagtg

SEQ ID NO: 246224 - DNA, 16 bp, P. troglodytes
gatgggattagtgccc

SEQ ID NO: 246225 - DNA, 16 bp, P. troglodytes
gatggggaaaatgagg

SEQ ID NO: 246226 - DNA, 16 bp, P. troglodytes
gatggggaaactaagg

SEQ ID NO: 246227 - DNA, 17 bp, P. troglodytes
gatggggaaccaatcga

SEQ ID NO: 246228 - DNA, 16 bp, P. troglodytes
gatggggagccagaag

SEQ ID NO: 246229 - DNA, 16 bp, P. troglodytes
gatggggatacattct

SEQ ID NO: 246230 - DNA, 16 bp, P. troglodytes
gatggggtcttgccat

SEQ ID NO: 246231 - DNA, 16 bp, P. troglodytes
gatggggtggggccgt

SEQ ID NO: 246232 - DNA, 16 bp, P. troglodytes
gatggggtttcaacat

SEQ ID NO: 246233 - DNA, 16 bp, P. troglodytes
gatggggtttcaccat

SEQ ID NO: 246234 - DNA, 16 bp, P. troglodytes
gatggggtttcaccca

SEQ ID NO: 246235 - DNA, 16 bp, P. troglodytes
gatggggtttcacctt

SEQ ID NO: 246236 - DNA, 16 bp, P. troglodytes
gatggggtttctccac

SEQ ID NO: 246237 - DNA, 16 bp, P. troglodytes
gatggggtttgaccat

SEQ ID NO: 246238 - DNA, 16 bp, P. troglodytes
gatggggtttgccatg

SEQ ID NO: 246239 - DNA, 16 bp, P. troglodytes
gatggggttttaccat

SEQ ID NO: 246240 - DNA, 16 bp, P. troglodytes
gatggggttttgccat

SEQ ID NO: 246241 - DNA, 16 bp, P. troglodytes
gatgggtgcagcgaac

SEQ ID NO: 246242 - DNA, 16 bp, P. troglodytes
gatgggtggatggatg

SEQ ID NO: 246243 - DNA, 17 bp, P. troglodytes
gatgggttgacgggtgc

SEQ ID NO: 246244 - DNA, 16 bp, P. troglodytes
gatgggttttgactct

SEQ ID NO: 246245 - DNA, 16 bp, P. troglodytes
gatggtaaaaccctgt

SEQ ID NO: 246246 - DNA, 16 bp, P. troglodytes
gatggtaacagacctt

SEQ ID NO: 246247 - DNA, 16 bp, P. troglodytes
gatggtaatgatgatg

SEQ ID NO: 246248 - DNA, 16 bp, P. troglodytes
gatggtattttctttt

SEQ ID NO: 246249 - DNA, 16 bp, P. troglodytes
gatggtcacatgggga

SEQ ID NO: 246250 - DNA, 16 bp, P. troglodytes
gatggtcttgatgctt

SEQ ID NO: 246251 - DNA, 16 bp, P. troglodytes
gatggtgaaacccctt

SEQ ID NO: 246252 - DNA, 16 bp, P. troglodytes
gatggtgcaaaagtga

SEQ ID NO: 246253 - DNA, 16 bp, P. troglodytes
gatggtgccactgtac

SEQ ID NO: 246254 - DNA, 16 bp, P. troglodytes
gatggtggatgcctgt

SEQ ID NO: 246255 - DNA, 16 bp, P. troglodytes
gatggtggcacatgcc

SEQ ID NO: 246256 - DNA, 16 bp, P. troglodytes
gatggtggtattctga

SEQ ID NO: 246257 - DNA, 16 bp, P. troglodytes
gatggtggtctcataa

SEQ ID NO: 246258 - DNA, 16 bp, P. troglodytes
gatggtggtgatgact

SEQ ID NO: 246259 - DNA, 16 bp, P. troglodytes
gatggtggtgatgctg

SEQ ID NO: 246260 - DNA, 16 bp, P. troglodytes
gatggtggtggcagtg

SEQ ID NO: 246261 - DNA, 16 bp, P. troglodytes
gatggtgtcaatctct

SEQ ID NO: 246262 - DNA, 17 bp, P. troglodytes
gatggtgtctcactttg

SEQ ID NO: 246263 - DNA, 16 bp, P. troglodytes
gatggtttggggatga

SEQ ID NO: 246264 - DNA, 16 bp, P. troglodytes
gatggttttataaggc

SEQ ID NO: 246265 - DNA, 16 bp, P. troglodytes
gatggttttgagatga

SEQ ID NO: 246266 - DNA, 16 bp, P. troglodytes
gatggttttgggatga

SEQ ID NO: 246267 - DNA, 16 bp, P. troglodytes
gatgtaatgcatgtct

SEQ ID NO: 246268 - DNA, 16 bp, P. troglodytes
gatgtccagctgcttc

SEQ ID NO: 246269 - DNA, 16 bp, P. troglodytes
gatgtccaggcagatg

SEQ ID NO: 246270 - DNA, 16 bp, P. troglodytes
gatgtcctttctgctt

SEQ ID NO: 246271 - DNA, 16 bp, P. troglodytes
gatgtctcactatgtt

SEQ ID NO: 246272 - DNA, 16 bp, P. troglodytes
gatgtctggggcctca

SEQ ID NO: 246273 - DNA, 16 bp, P. troglodytes
gatgtcttatgtctcc

SEQ ID NO: 246274 - DNA, 16 bp, P. troglodytes
gatgtcttgacctcat

SEQ ID NO: 246275 - DNA, 16 bp, P. troglodytes
gatgtcttttatttct

SEQ ID NO: 246276 - DNA, 16 bp, P. troglodytes
gatgtcttttctttct

SEQ ID NO: 246277 - DNA, 16 bp, P. troglodytes
gatgtgaaaactgagg

SEQ ID NO: 246278 - DNA, 16 bp, P. troglodytes
gatgtgacttgctcct

SEQ ID NO: 246279 - DNA, 16 bp, P. troglodytes
gatgtgatgaaaaggg

SEQ ID NO: 246280 - DNA, 16 bp, P. troglodytes
gatgtgatgaaaatgg

SEQ ID NO: 246281 - DNA, 16 bp, P. troglodytes
gatgtgatggctcacg

SEQ ID NO: 246282 - DNA, 16 bp, P. troglodytes
gatgtgattttttttc

SEQ ID NO: 246283 - DNA, 16 bp, P. troglodytes
gatgtgccaccatgcc

SEQ ID NO: 246284 - DNA, 16 bp, P. troglodytes
gatgtgcctgctttcc

SEQ ID NO: 246285 - DNA, 16 bp, P. troglodytes
gatgtgctgctggatt

SEQ ID NO: 246286 - DNA, 16 bp, P. troglodytes
gatgtgctttggtcaa

SEQ ID NO: 246287 - DNA, 16 bp, P. troglodytes
gatgtggaacccatgg

SEQ ID NO: 246288 - DNA, 16 bp, P. troglodytes
gatgtggagaaaatgg

SEQ ID NO: 246289 - DNA, 16 bp, P. troglodytes
gatgtggagaaagtgg

SEQ ID NO: 246290 - DNA, 16 bp, P. troglodytes
gatgtggagaaattgg

SEQ ID NO: 246291 - DNA, 16 bp, P. troglodytes
gatgtggagacatagg

SEQ ID NO: 246292 - DNA, 16 bp, P. troglodytes
gatgtggagatgcagg

SEQ ID NO: 246293 - DNA, 16 bp, P. troglodytes
gatgtggctggggttt

SEQ ID NO: 246294 - DNA, 16 bp, P. troglodytes
gatgtgggaggactgc

SEQ ID NO: 246295 - DNA, 16 bp, P. troglodytes
gatgtgggcaaactca

SEQ ID NO: 246296 - DNA, 16 bp, P. troglodytes
gatgtggtgactcatg

SEQ ID NO: 246297 - DNA, 16 bp, P. troglodytes
gatgtggtttcatcat

SEQ ID NO: 246298 - DNA, 16 bp, P. troglodytes
gatgtgtgcctgtggt

SEQ ID NO: 246299 - DNA, 16 bp, P. troglodytes
gatgtgtgtatatata

SEQ ID NO: 246300 - DNA, 16 bp, P. troglodytes
gatgtgtgtcccctcc

SEQ ID NO: 246301 - DNA, 16 bp, P. troglodytes
gatgtgttcatgtcct

SEQ ID NO: 246302 - DNA, 16 bp, P. troglodytes
gatgttacaaaatcat

SEQ ID NO: 246303 - DNA, 16 bp, P. troglodytes
gatgttccccaccctg

SEQ ID NO: 246304 - DNA, 16 bp, P. troglodytes
gatgttccctgccctg

SEQ ID NO: 246305 - DNA, 16 bp, P. troglodytes
gatgttcttcagtgtc

SEQ ID NO: 246306 - DNA, 16 bp, P. troglodytes
gatgttgaactttttt

SEQ ID NO: 246307 - DNA, 16 bp, P. troglodytes
gatgttgaagatgaag

SEQ ID NO: 246308 - DNA, 16 bp, P. troglodytes
gatgttgacatggatg

SEQ ID NO: 246309 - DNA, 16 bp, P. troglodytes
gatgttgagcagtttt

SEQ ID NO: 246310 - DNA, 16 bp, P. troglodytes
gatgttgagcttgttt

SEQ ID NO: 246311 - DNA, 16 bp, P. troglodytes
gatgttgaggtgggag

SEQ ID NO: 246312 - DNA, 16 bp, P. troglodytes
gatgttgatgatgatg

SEQ ID NO: 246313 - DNA, 16 bp, P. troglodytes
gatgttgcagtgaacc

SEQ ID NO: 246314 - DNA, 16 bp, P. troglodytes
gatgttgcagtgagcc

SEQ ID NO: 246315 - DNA, 16 bp, P. troglodytes
gatgttgtggtgagcc

SEQ ID NO: 246316 - DNA, 16 bp, P. troglodytes
gatgtttaatgacata

SEQ ID NO: 246317 - DNA, 16 bp, P. troglodytes
gatgtttcagtgagcc

SEQ ID NO: 246318 - DNA, 16 bp, P. troglodytes
gatgtttgctgaatga

SEQ ID NO: 246319 - DNA, 16 bp, P. troglodytes
gatgtttgtacaatga

SEQ ID NO: 246320 - DNA, 16 bp, P. troglodytes
gattaaaacaagacaa

SEQ ID NO: 246321 - DNA, 16 bp, P. troglodytes
gattaaagacttaatg

SEQ ID NO: 246322 - DNA, 16 bp, P. troglodytes
gattaaatgagaaaat

SEQ ID NO: 246323 - DNA, 16 bp, P. troglodytes
gattaaatgagataat

SEQ ID NO: 246324 - DNA, 16 bp, P. troglodytes
gattaaatgagctaat

SEQ ID NO: 246325 - DNA, 16 bp, P. troglodytes
gattaaatgaggtaat

SEQ ID NO: 246326 - DNA, 16 bp, P. troglodytes
gattaacaggcatgag

SEQ ID NO: 246327 - DNA, 16 bp, P. troglodytes
gattaacatccaaagg

SEQ ID NO: 246328 - DNA, 16 bp, P. troglodytes
gattaagaaactcaaa

SEQ ID NO: 246329 - DNA, 16 bp, P. troglodytes
gattaagcaatcctcc

SEQ ID NO: 246330 - DNA, 16 bp, P. troglodytes
gattaaggaaatgtgg

SEQ ID NO: 246331 - DNA, 16 bp, P. troglodytes
gattaaggatgctcaa

SEQ ID NO: 246332 - DNA, 17 bp, P. troglodytes
gattacaaggtcaggag

SEQ ID NO: 246333 - DNA, 16 bp, P. troglodytes
gattacaggaatgaga

SEQ ID NO: 246334 - DNA, 16 bp, P. troglodytes
gattacaggcatcagt

SEQ ID NO: 246335 - DNA, 16 bp, P. troglodytes
gattacaggcatgaga

SEQ ID NO: 246336 - DNA, 16 bp, P. troglodytes
gattacagggatgagc

SEQ ID NO: 246337 - DNA, 16 bp, P. troglodytes
gattacaggtatgagc

SEQ ID NO: 246338 - DNA, 16 bp, P. troglodytes
gattacaggtggctgc

SEQ ID NO: 246339 - DNA, 16 bp, P. troglodytes
gattacaggtgtgagg

SEQ ID NO: 246340 - DNA, 16 bp, P. troglodytes
gattacatcaagctaa

SEQ ID NO: 246341 - DNA, 16 bp, P. troglodytes
gattacatgcacctgc

SEQ ID NO: 246342 - DNA, 16 bp, P. troglodytes
gattactattttcact

SEQ ID NO: 246343 - DNA, 16 bp, P. troglodytes
gattactggatcatat

SEQ ID NO: 246344 - DNA, 16 bp, P. troglodytes
gattactgtagcttta

SEQ ID NO: 246345 - DNA, 16 bp, P. troglodytes
gattagagggttagaa

SEQ ID NO: 246346 - DNA, 16 bp, P. troglodytes
gattagataaggtcat

SEQ ID NO: 246347 - DNA, 17 bp, P. troglodytes
gattagccaggcatggt

SEQ ID NO: 246348 - DNA, 16 bp, P. troglodytes
gattagggtgggccct

SEQ ID NO: 246349 - DNA, 16 bp, P. troglodytes
gattatatggtttttg

SEQ ID NO: 246350 - DNA, 16 bp, P. troglodytes
gattatatttcaatat

SEQ ID NO: 246351 - DNA, 16 bp, P. troglodytes
gattatgaaaatgtgg

SEQ ID NO: 246352 - DNA, 16 bp, P. troglodytes
gattattaaaatcttc

SEQ ID NO: 246353 - DNA, 16 bp, P. troglodytes
gattatttcatcaacc

SEQ ID NO: 246354 - DNA, 16 bp, P. troglodytes
gattattttcagtttt

SEQ ID NO: 246355 - DNA, 16 bp, P. troglodytes
gattcaaataaacaca

SEQ ID NO: 246356 - DNA, 16 bp, P. troglodytes
gattcaagcaattctc

SEQ ID NO: 246357 - DNA, 16 bp, P. troglodytes
gattcacagcagaatt

SEQ ID NO: 246358 - DNA, 16 bp, P. troglodytes
gattcactattctaga

SEQ ID NO: 246359 - DNA, 16 bp, P. troglodytes
gattcactgctgctaa

SEQ ID NO: 246360 - DNA, 16 bp, P. troglodytes
gattcagcattttgga

SEQ ID NO: 246361 - DNA, 16 bp, P. troglodytes
gattcagtgtctggca

SEQ ID NO: 246362 - DNA, 16 bp, P. troglodytes
gattcatctcacagtg

SEQ ID NO: 246363 - DNA, 16 bp, P. troglodytes
gattcattcattcatt

SEQ ID NO: 246364 - DNA, 17 bp, P. troglodytes
gattccaccattgcact

SEQ ID NO: 246365 - DNA, 16 bp, P. troglodytes
gattccagcaattctc

SEQ ID NO: 246366 - DNA, 16 bp, P. troglodytes
gattccagggctgggg

SEQ ID NO: 246367 - DNA, 16 bp, P. troglodytes
gattccaggtgtgagc

SEQ ID NO: 246368 - DNA, 16 bp, P. troglodytes
gattccatctttttct

SEQ ID NO: 246369 - DNA, 16 bp, P. troglodytes
gattccatttatgtaa

SEQ ID NO: 246370 - DNA, 16 bp, P. troglodytes
gattccatttatttat

SEQ ID NO: 246371 - DNA, 16 bp, P. troglodytes
gattccatttgatgat

SEQ ID NO: 246372 - DNA, 16 bp, P. troglodytes
gattcccaggaatatg

SEQ ID NO: 246373 - DNA, 16 bp, P. troglodytes
gattccccttcctcag

SEQ ID NO: 246374 - DNA, 16 bp, P. troglodytes
gattccctctctttct

SEQ ID NO: 246375 - DNA, 16 bp, P. troglodytes
gattccctttatttct

SEQ ID NO: 246376 - DNA, 16 bp, P. troglodytes
gattcctcaagaatct

SEQ ID NO: 246377 - DNA, 17 bp, P. troglodytes
gattcctcaaggatcta

SEQ ID NO: 246378 - DNA, 16 bp, P. troglodytes
gattcctgatccacag

SEQ ID NO: 246379 - DNA, 16 bp, P. troglodytes
gattcctgcatttcca

SEQ ID NO: 246380 - DNA, 16 bp, P. troglodytes
gattcctgggccccac

SEQ ID NO: 246381 - DNA, 16 bp, P. troglodytes
gattcctgggccccat

SEQ ID NO: 246382 - DNA, 16 bp, P. troglodytes
gattcctttcaaaatg

SEQ ID NO: 246383 - DNA, 16 bp, P. troglodytes
gattctacaaaaaaag

SEQ ID NO: 246384 - DNA, 16 bp, P. troglodytes
gattctacacaagaag

SEQ ID NO: 246385 - DNA, 16 bp, P. troglodytes
gattctacttcttcct

SEQ ID NO: 246386 - DNA, 16 bp, P. troglodytes
gattctcactctgtca

SEQ ID NO: 246387 - DNA, 17 bp, P. troglodytes
gattctcataaggagcg

SEQ ID NO: 246388 - DNA, 16 bp, P. troglodytes
gattctcccctggagc

SEQ ID NO: 246389 - DNA, 16 bp, P. troglodytes
gattctcccgtctcag

SEQ ID NO: 246390 - DNA, 16 bp, P. troglodytes
gattctcctgccacag

SEQ ID NO: 246391 - DNA, 18 bp, P. troglodytes
gattctcctgcctcagct

SEQ ID NO: 246392 - DNA, 16 bp, P. troglodytes
gattctcctgcctcct

SEQ ID NO: 246393 - DNA, 16 bp, P. troglodytes
gattctcctgtttcag

SEQ ID NO: 246394 - DNA, 16 bp, P. troglodytes
gattctgagtggaggt

SEQ ID NO: 246395 - DNA, 16 bp, P. troglodytes
gattctgatgcacact

SEQ ID NO: 246396 - DNA, 16 bp, P. troglodytes
gattctgatgctgctg

SEQ ID NO: 246397 - DNA, 16 bp, P. troglodytes
gattctgattcaggag

SEQ ID NO: 246398 - DNA, 16 bp, P. troglodytes
gattctgcatttctaa

SEQ ID NO: 246399 - DNA, 16 bp, P. troglodytes
gattctggatattaga

SEQ ID NO: 246400 - DNA, 16 bp, P. troglodytes
gattctgtatcttggc

SEQ ID NO: 246401 - DNA, 16 bp, P. troglodytes
gattctgttaatgtga

SEQ ID NO: 246402 - DNA, 16 bp, P. troglodytes
gattcttaggtatttt

SEQ ID NO: 246403 - DNA, 16 bp, P. troglodytes
gattcttatgcctcag

SEQ ID NO: 246404 - DNA, 16 bp, P. troglodytes
gattcttccacctcgg

SEQ ID NO: 246405 - DNA, 16 bp, P. troglodytes
gattcttctctctttt

SEQ ID NO: 246406 - DNA, 16 bp, P. troglodytes
gattcttctgactcag

SEQ ID NO: 246407 - DNA, 16 bp, P. troglodytes
gattcttttgcctcag

SEQ ID NO: 246408 - DNA, 16 bp, P. troglodytes
gattgacttcttgatt

SEQ ID NO: 246409 - DNA, 16 bp, P. troglodytes
gattgagaaagagaga

SEQ ID NO: 246410 - DNA, 16 bp, P. troglodytes
gattgagaccatcctg

SEQ ID NO: 246411 - DNA, 16 bp, P. troglodytes
gattgagcccctgcac

SEQ ID NO: 246412 - DNA, 16 bp, P. troglodytes
gattgataaagcaagt

SEQ ID NO: 246413 - DNA, 16 bp, P. troglodytes
gattgatgcagaagac

SEQ ID NO: 246414 - DNA, 16 bp, P. troglodytes
gattgcaaaaaccatg

SEQ ID NO: 246415 - DNA, 16 bp, P. troglodytes
gattgcaccacggcac

SEQ ID NO: 246416 - DNA, 16 bp, P. troglodytes
gattgcaccactgcag

SEQ ID NO: 246417 - DNA, 16 bp, P. troglodytes
gattgcaccattgccc

SEQ ID NO: 246418 - DNA, 16 bp, P. troglodytes
gattgcaccctgcact

SEQ ID NO: 246419 - DNA, 16 bp, P. troglodytes
gattgcattggctcct

SEQ ID NO: 246420 - DNA, 16 bp, P. troglodytes
gattgcctcctcaagt

SEQ ID NO: 246421 - DNA, 16 bp, P. troglodytes
gattgcctcctttgga

SEQ ID NO: 246422 - DNA, 16 bp, P. troglodytes
gattgcctgagaccag

SEQ ID NO: 246423 - DNA, 16 bp, P. troglodytes
gattgcctgagctcag

SEQ ID NO: 246424 - DNA, 16 bp, P. troglodytes
gattgcgccactggac

SEQ ID NO: 246425 - DNA, 17 bp, P. troglodytes
gattgcgccattgcaca

SEQ ID NO: 246426 - DNA, 16 bp, P. troglodytes
gattgctcgaggccag

SEQ ID NO: 246427 - DNA, 16 bp, P. troglodytes
gattgcttcagcccaa

SEQ ID NO: 246428 - DNA, 16 bp, P. troglodytes
gattgcttcagcccag

SEQ ID NO: 246429 - DNA, 16 bp, P. troglodytes
gattggaaacttcctg

SEQ ID NO: 246430 - DNA, 16 bp, P. troglodytes
gattggaagaattagt

SEQ ID NO: 246431 - DNA, 16 bp, P. troglodytes
gattggacacccctgc

SEQ ID NO: 246432 - DNA, 16 bp, P. troglodytes
gattggaggattgctt

SEQ ID NO: 246433 - DNA, 16 bp, P. troglodytes
gattggattatggagg

SEQ ID NO: 246434 - DNA, 16 bp, P. troglodytes
gattggattgaaggat

SEQ ID NO: 246435 - DNA, 16 bp, P. troglodytes
gattggcacaagagta

SEQ ID NO: 246436 - DNA, 16 bp, P. troglodytes
gattggtattagtttt

SEQ ID NO: 246437 - DNA, 16 bp, P. troglodytes
gattggtgttcctgaa

SEQ ID NO: 246438 - DNA, 16 bp, P. troglodytes
gattggttggtttgta

SEQ ID NO: 246439 - DNA, 16 bp, P. troglodytes
gattgtaccactgcat

SEQ ID NO: 246440 - DNA, 16 bp, P. troglodytes
gattgtcagtttcctg

SEQ ID NO: 246441 - DNA, 16 bp, P. troglodytes
gattgtcttggctatt

SEQ ID NO: 246442 - DNA, 17 bp, P. troglodytes
gattgtgccactgcaca

SEQ ID NO: 246443 - DNA, 16 bp, P. troglodytes
gattgtgccactgcca

SEQ ID NO: 246444 - DNA, 16 bp, P. troglodytes
gattgtggtaatcatt

SEQ ID NO: 246445 - DNA, 16 bp, P. troglodytes
gattgtggtgatggtt

SEQ ID NO: 246446 - DNA, 16 bp, P. troglodytes
gattgtgttaactgta

SEQ ID NO: 246447 - DNA, 16 bp, P. troglodytes
gattgtttactttgct

SEQ ID NO: 246448 - DNA, 16 bp, P. troglodytes
gattgtttgtaacaaa

SEQ ID NO: 246449 - DNA, 16 bp, P. troglodytes
gatttaaaaatatgta

SEQ ID NO: 246450 - DNA, 16 bp, P. troglodytes
gatttaatgacaaagg

SEQ ID NO: 246451 - DNA, 16 bp, P. troglodytes
gatttataaagaaaag

SEQ ID NO: 246452 - DNA, 16 bp, P. troglodytes
gatttataaagcaaat

SEQ ID NO: 246453 - DNA, 16 bp, P. troglodytes
gatttcaaatgaaaat

SEQ ID NO: 246454 - DNA, 16 bp, P. troglodytes
gatttcaattcttttg

SEQ ID NO: 246455 - DNA, 16 bp, P. troglodytes
gatttcaccagttttt

SEQ ID NO: 246456 - DNA, 16 bp, P. troglodytes
gatttcactatgttgc

SEQ ID NO: 246457 - DNA, 16 bp, P. troglodytes
gatttcagattttttt

SEQ ID NO: 246458 - DNA, 16 bp, P. troglodytes
gatttcatggacactt

SEQ ID NO: 246459 - DNA, 16 bp, P. troglodytes
gatttcattcttattt

SEQ ID NO: 246460 - DNA, 16 bp, P. troglodytes
gatttcattctttgtt

SEQ ID NO: 246461 - DNA, 16 bp, P. troglodytes
gatttccagcttcatc

SEQ ID NO: 246462 - DNA, 16 bp, P. troglodytes
gatttccattcctttg

SEQ ID NO: 246463 - DNA, 16 bp, P. troglodytes
gatttcccaggctcaa

SEQ ID NO: 246464 - DNA, 16 bp, P. troglodytes
gatttcctcagtggct

SEQ ID NO: 246465 - DNA, 16 bp, P. troglodytes
gatttcctcttttcca

SEQ ID NO: 246466 - DNA, 16 bp, P. troglodytes
gatttccttttctttc

SEQ ID NO: 246467 - DNA, 16 bp, P. troglodytes
gatttctcaaagaact

SEQ ID NO: 246468 - DNA, 16 bp, P. troglodytes
gatttctcagcagaaa

SEQ ID NO: 246469 - DNA, 16 bp, P. troglodytes
gatttctcatcagaaa

SEQ ID NO: 246470 - DNA, 16 bp, P. troglodytes
gatttctcatctgaaa

SEQ ID NO: 246471 - DNA, 16 bp, P. troglodytes
gatttctctgtaacat

SEQ ID NO: 246472 - DNA, 16 bp, P. troglodytes
gatttctcttctctgg

SEQ ID NO: 246473 - DNA, 16 bp, P. troglodytes
gatttctcttcttcct

SEQ ID NO: 246474 - DNA, 16 bp, P. troglodytes
gatttctgaaaaacaa

SEQ ID NO: 246475 - DNA, 16 bp, P. troglodytes
gatttctgatattttg

SEQ ID NO: 246476 - DNA, 16 bp, P. troglodytes
gatttctgcctcaatt

SEQ ID NO: 246477 - DNA, 16 bp, P. troglodytes
gatttcttcttgattt

SEQ ID NO: 246478 - DNA, 16 bp, P. troglodytes
gatttcttcttgctca

SEQ ID NO: 246479 - DNA, 16 bp, P. troglodytes
gatttcttgacctcat

SEQ ID NO: 246480 - DNA, 16 bp, P. troglodytes
gatttctttgtagcat

SEQ ID NO: 246481 - DNA, 16 bp, P. troglodytes
gatttgaaaccaggca

SEQ ID NO: 246482 - DNA, 16 bp, P. troglodytes
gatttgaaatattccc

SEQ ID NO: 246483 - DNA, 16 bp, P. troglodytes
gatttgaagacaaaaa

SEQ ID NO: 246484 - DNA, 16 bp, P. troglodytes
gatttgaatccaggcc

SEQ ID NO: 246485 - DNA, 16 bp, P. troglodytes
gatttgaatttttaaa

SEQ ID NO: 246486 - DNA, 16 bp, P. troglodytes
gatttgataaacaaat

SEQ ID NO: 246487 - DNA, 16 bp, P. troglodytes
gatttgatatatgtat

SEQ ID NO: 246488 - DNA, 16 bp, P. troglodytes
gatttgcaggagaaaa

SEQ ID NO: 246489 - DNA, 16 bp, P. troglodytes
gatttgcatttcagaa

SEQ ID NO: 246490 - DNA, 16 bp, P. troglodytes
gatttgcatttttaaa

SEQ ID NO: 246491 - DNA, 16 bp, P. troglodytes
gatttgcctattctgt

SEQ ID NO: 246492 - DNA, 16 bp, P. troglodytes
gatttgcctgttctgg

SEQ ID NO: 246493 - DNA, 16 bp, P. troglodytes
gatttgctgagcatac

SEQ ID NO: 246494 - DNA, 16 bp, P. troglodytes
gatttgctttaaaata

SEQ ID NO: 246495 - DNA, 16 bp, P. troglodytes
gatttgctttatgaat

SEQ ID NO: 246496 - DNA, 16 bp, P. troglodytes
gatttggagtcagaca

SEQ ID NO: 246497 - DNA, 16 bp, P. troglodytes
gatttggctttctgtc

SEQ ID NO: 246498 - DNA, 16 bp, P. troglodytes
gatttgggatgctcaa

SEQ ID NO: 246499 - DNA, 16 bp, P. troglodytes
gatttgggtgggaaca

SEQ ID NO: 246500 - DNA, 16 bp, P. troglodytes
gatttggtgtctgctg

SEQ ID NO: 246501 - DNA, 16 bp, P. troglodytes
gatttgtaagagttct

SEQ ID NO: 246502 - DNA, 16 bp, P. troglodytes
gatttgtatccagaat

SEQ ID NO: 246503 - DNA, 16 bp, P. troglodytes
gatttgtatttcttta

SEQ ID NO: 246504 - DNA, 16 bp, P. troglodytes
gatttgttttaatcag

SEQ ID NO: 246505 - DNA, 16 bp, P. troglodytes
gattttaaaaacatga

SEQ ID NO: 246506 - DNA, 16 bp, P. troglodytes
gattttaaaaatcatt

SEQ ID NO: 246507 - DNA, 16 bp, P. troglodytes
gattttaaaaatgtgg

SEQ ID NO: 246508 - DNA, 16 bp, P. troglodytes
gattttaatttacatt

SEQ ID NO: 246509 - DNA, 16 bp, P. troglodytes
gattttagatttttct

SEQ ID NO: 246510 - DNA, 16 bp, P. troglodytes
gattttataggatggt

SEQ ID NO: 246511 - DNA, 16 bp, P. troglodytes
gattttatatttagaa

SEQ ID NO: 246512 - DNA, 16 bp, P. troglodytes
gattttatggctaaga

SEQ ID NO: 246513 - DNA, 16 bp, P. troglodytes
gattttattctaagta

SEQ ID NO: 246514 - DNA, 16 bp, P. troglodytes
gattttatttctcttg

SEQ ID NO: 246515 - DNA, 16 bp, P. troglodytes
gattttcagatgttaa

SEQ ID NO: 246516 - DNA, 16 bp, P. troglodytes
gattttccagtttatt

SEQ ID NO: 246517 - DNA, 16 bp, P. troglodytes
gattttctaatgttga

SEQ ID NO: 246518 - DNA, 16 bp, P. troglodytes
gattttcttctacctc

SEQ ID NO: 246519 - DNA, 16 bp, P. troglodytes
gattttgaaaagaaaa

SEQ ID NO: 246520 - DNA, 16 bp, P. troglodytes
gattttgaagcatttc

SEQ ID NO: 246521 - DNA, 16 bp, P. troglodytes
gattttgattaaaatt

SEQ ID NO: 246522 - DNA, 16 bp, P. troglodytes
gattttgattcttcct

SEQ ID NO: 246523 - DNA, 16 bp, P. troglodytes
gattttgattgggatt

SEQ ID NO: 246524 - DNA, 16 bp, P. troglodytes
gattttgcagatgtaa

SEQ ID NO: 246525 - DNA, 16 bp, P. troglodytes
gattttggaattgcat

SEQ ID NO: 246526 - DNA, 16 bp, P. troglodytes
gattttggacttgcca

SEQ ID NO: 246527 - DNA, 16 bp, P. troglodytes
gattttggagcatttc

SEQ ID NO: 246528 - DNA, 16 bp, P. troglodytes
gattttggaggcaaca

SEQ ID NO: 246529 - DNA, 16 bp, P. troglodytes
gattttgtatcctgat

SEQ ID NO: 246530 - DNA, 16 bp, P. troglodytes
gattttgtcaaatatt

SEQ ID NO: 246531 - DNA, 24 bp, P. troglodytes
gattttgtcaccaccaggcctgcc

SEQ ID NO: 246532 - DNA, 16 bp, P. troglodytes
gattttgtcttggttt

SEQ ID NO: 246533 - DNA, 16 bp, P. troglodytes
gattttgtgggccagg

SEQ ID NO: 246534 - DNA, 16 bp, P. troglodytes
gatttttaaaagtgaa

SEQ ID NO: 246535 - DNA, 16 bp, P. troglodytes
gatttttaaaatgtta

SEQ ID NO: 246536 - DNA, 16 bp, P. troglodytes
gatttttaaagaaatt

SEQ ID NO: 246537 - DNA, 16 bp, P. troglodytes
gatttttccacctcag

SEQ ID NO: 246538 - DNA, 16 bp, P. troglodytes
gatttttctatgttga

SEQ ID NO: 246539 - DNA, 16 bp, P. troglodytes
gatttttctccatcct

SEQ ID NO: 246540 - DNA, 16 bp, P. troglodytes
gatttttgacaaagat

SEQ ID NO: 246541 - DNA, 16 bp, P. troglodytes
gatttttgcacattaa

SEQ ID NO: 246542 - DNA, 16 bp, P. troglodytes
gatttttgcatatatg

SEQ ID NO: 246543 - DNA, 16 bp, P. troglodytes
gatttttgcgtctatg

SEQ ID NO: 246544 - DNA, 16 bp, P. troglodytes
gatttttggttcttat

SEQ ID NO: 246545 - DNA, 16 bp, P. troglodytes
gattttttaaaaatcc

SEQ ID NO: 246546 - DNA, 16 bp, P. troglodytes
gattttttaaaaattg

SEQ ID NO: 246547 - DNA, 16 bp, P. troglodytes
gattttttaaaatgca

SEQ ID NO: 246548 - DNA, 16 bp, P. troglodytes
gatttttttccccatt

SEQ ID NO: 246549 - DNA, 16 bp, P. troglodytes
gatttttttcccctaa

SEQ ID NO: 246550 - DNA, 16 bp, P. troglodytes
gatttttttctattaa

SEQ ID NO: 246551 - DNA, 16 bp, P. troglodytes
gatttttttttaatgc

SEQ ID NO: 246552 - DNA, 16 bp, P. troglodytes
gcaaaaactgaaagaa

SEQ ID NO: 246553 - DNA, 16 bp, P. troglodytes
gcaaaaagaataaagc

SEQ ID NO: 246554 - DNA, 16 bp, P. troglodytes
gcaaaaagcagaacca

SEQ ID NO: 246555 - DNA, 16 bp, P. troglodytes
gcaaaaataatacaga

SEQ ID NO: 246556 - DNA, 16 bp, P. troglodytes
gcaaaaatatgtatgt

SEQ ID NO: 246557 - DNA, 16 bp, P. troglodytes
gcaaaaattaacaaat

SEQ ID NO: 246558 - DNA, 16 bp, P. troglodytes
gcaaaacattcaagat

SEQ ID NO: 246559 - DNA, 16 bp, P. troglodytes
gcaaaacccccatctc

SEQ ID NO: 246560 - DNA, 16 bp, P. troglodytes
gcaaaactaaatgaaa

SEQ ID NO: 246561 - DNA, 16 bp, P. troglodytes
gcaaaactaataaaga

SEQ ID NO: 246562 - DNA, 16 bp, P. troglodytes
gcaaaagaaacagcag

SEQ ID NO: 246563 - DNA, 16 bp, P. troglodytes
gcaaaagaaatttcta

SEQ ID NO: 246564 - DNA, 16 bp, P. troglodytes
gcaaaagcagaagcaa

SEQ ID NO: 246565 - DNA, 16 bp, P. troglodytes
gcaaaagctggaagaa

SEQ ID NO: 246566 - DNA, 16 bp, P. troglodytes
gcaaaaggaagaaaat

SEQ ID NO: 246567 - DNA, 16 bp, P. troglodytes
gcaaaaggcaaagggg

SEQ ID NO: 246568 - DNA, 31 bp, P. troglodytes
gcaaaaggggcagggtaaagagtgtgagtca

SEQ ID NO: 246569 - DNA, 16 bp, P. troglodytes
gcaaaatagtgaaacc

SEQ ID NO: 246570 - DNA, 16 bp, P. troglodytes
gcaaaatcatgccaaa

SEQ ID NO: 246571 - DNA, 16 bp, P. troglodytes
gcaaaatgagaaaaat

SEQ ID NO: 246572 - DNA, 16 bp, P. troglodytes
gcaaaatgcaaatcaa

SEQ ID NO: 246573 - DNA, 17 bp, P. troglodytes
gcaaaatgctgggatta

SEQ ID NO: 246574 - DNA, 16 bp, P. troglodytes
gcaaaattagacaaat

SEQ ID NO: 246575 - DNA, 16 bp, P. troglodytes
gcaaaattgaaactct

SEQ ID NO: 246576 - DNA, 16 bp, P. troglodytes
gcaaaattgagagaaa

SEQ ID NO: 246577 - DNA, 16 bp, P. troglodytes
gcaaaatttttttttt

SEQ ID NO: 246578 - DNA, 16 bp, P. troglodytes
gcaaacaaccccatca

SEQ ID NO: 246579 - DNA, 16 bp, P. troglodytes
gcaaacaaggacaatt

SEQ ID NO: 246580 - DNA, 16 bp, P. troglodytes
gcaaacattagctggg

SEQ ID NO: 246581 - DNA, 16 bp, P. troglodytes
gcaaacattgacaaat

SEQ ID NO: 246582 - DNA, 16 bp, P. troglodytes
gcaaacattttttgag

SEQ ID NO: 246583 - DNA, 16 bp, P. troglodytes
gcaaaccaggacagtt

SEQ ID NO: 246584 - DNA, 21 bp, P. troglodytes
gcaaaccgaatccagcagcac

SEQ ID NO: 246585 - DNA, 16 bp, P. troglodytes
gcaaactgacacctca

SEQ ID NO: 246586 - DNA, 16 bp, P. troglodytes
gcaaactttttttttt

SEQ ID NO: 246587 - DNA, 16 bp, P. troglodytes
gcaaagaagttaaaag

SEQ ID NO: 246588 - DNA, 16 bp, P. troglodytes
gcaaagacttcatggc

SEQ ID NO: 246589 - DNA, 16 bp, P. troglodytes
gcaaagagactagtgg

SEQ ID NO: 246590 - DNA, 16 bp, P. troglodytes
gcaaagatgtgaagaa

SEQ ID NO: 246591 - DNA, 16 bp, P. troglodytes
gcaaagatttcttagg

SEQ ID NO: 246592 - DNA, 16 bp, P. troglodytes
gcaaagcaaaagcaag

SEQ ID NO: 246593 - DNA, 16 bp, P. troglodytes
gcaaagcacaataaaa

SEQ ID NO: 246594 - DNA, 16 bp, P. troglodytes
gcaaagcattcaagac

SEQ ID NO: 246595 - DNA, 16 bp, P. troglodytes
gcaaagcattcaagag

SEQ ID NO: 246596 - DNA, 16 bp, P. troglodytes
gcaaagcctaaaatat

SEQ ID NO: 246597 - DNA, 16 bp, P. troglodytes
gcaaagctaaaagagc

SEQ ID NO: 246598 - DNA, 16 bp, P. troglodytes
gcaaagcttttaacca

SEQ ID NO: 246599 - DNA, 16 bp, P. troglodytes
gcaaaggaaaaatatt

SEQ ID NO: 246600 - DNA, 16 bp, P. troglodytes
gcaaaggaaatgaaca

SEQ ID NO: 246601 - DNA, 16 bp, P. troglodytes
gcaaaggcaggaggat

SEQ ID NO: 246602 - DNA, 16 bp, P. troglodytes
gcaaaggcagtttcag

SEQ ID NO: 246603 - DNA, 16 bp, P. troglodytes
gcaaaggccctggggc

SEQ ID NO: 246604 - DNA, 16 bp, P. troglodytes
gcaaagggacatctta

SEQ ID NO: 246605 - DNA, 16 bp, P. troglodytes
gcaaagggcatgaact

SEQ ID NO: 246606 - DNA, 16 bp, P. troglodytes
gcaaaggggaagtaag

SEQ ID NO: 246607 - DNA, 16 bp, P. troglodytes
gcaaaggtctgtggct

SEQ ID NO: 246608 - DNA, 16 bp, P. troglodytes
gcaaagtactgttcct

SEQ ID NO: 246609 - DNA, 16 bp, P. troglodytes
gcaaagtctcagaata

SEQ ID NO: 246610 - DNA, 16 bp, P. troglodytes
gcaaagtgaaagaagc

SEQ ID NO: 246611 - DNA, 17 bp, P. troglodytes
gcaaagtgctgggatta

SEQ ID NO: 246612 - DNA, 16 bp, P. troglodytes
gcaaagtgtgtgtgtg

SEQ ID NO: 246613 - DNA, 16 bp, P. troglodytes
gcaaagtgttcaagaa

SEQ ID NO: 246614 - DNA, 16 bp, P. troglodytes
gcaaataaataaacat

SEQ ID NO: 246615 - DNA, 16 bp, P. troglodytes
gcaaataaattagaaa

SEQ ID NO: 246616 - DNA, 16 bp, P. troglodytes
gcaaatatcacaataa

SEQ ID NO: 246617 - DNA, 16 bp, P. troglodytes
gcaaatattccaaatt

SEQ ID NO: 246618 - DNA, 16 bp, P. troglodytes
gcaaatattgcagaac

SEQ ID NO: 246619 - DNA, 16 bp, P. troglodytes
gcaaatatttcatgat

SEQ ID NO: 246620 - DNA, 16 bp, P. troglodytes
gcaaatattttctacc

SEQ ID NO: 246621 - DNA, 16 bp, P. troglodytes
gcaaatcatttatctg

SEQ ID NO: 246622 - DNA, 16 bp, P. troglodytes
gcaaatgagaagaatg

SEQ ID NO: 246623 - DNA, 16 bp, P. troglodytes
gcaaatgcaacaaaat

SEQ ID NO: 246624 - DNA, 16 bp, P. troglodytes
gcaaatgcaacagaaa

SEQ ID NO: 246625 - DNA, 16 bp, P. troglodytes
gcaaatgctggaccca

SEQ ID NO: 246626 - DNA, 16 bp, P. troglodytes
gcaaatggaagacaaa

SEQ ID NO: 246627 - DNA, 16 bp, P. troglodytes
gcaaatgttcattgca

SEQ ID NO: 246628 - DNA, 19 bp, P. troglodytes
gcaaatgttgctgcctgat

SEQ ID NO: 246629 - DNA, 16 bp, P. troglodytes
gcaaattaaaacaaga

SEQ ID NO: 246630 - DNA, 16 bp, P. troglodytes
gcaaattaaagccaca

SEQ ID NO: 246631 - DNA, 16 bp, P. troglodytes
gcaaattaaatccaaa

SEQ ID NO: 246632 - DNA, 16 bp, P. troglodytes
gcaaattgcttgagcc

SEQ ID NO: 246633 - DNA, 16 bp, P. troglodytes
gcaaattgcttgagct

SEQ ID NO: 246634 - DNA, 16 bp, P. troglodytes
gcaaattggaaaaaga

SEQ ID NO: 246635 - DNA, 16 bp, P. troglodytes
gcaacaaagtgagact

SEQ ID NO: 246636 - DNA, 16 bp, P. troglodytes
gcaacaagagcaaaat

SEQ ID NO: 246637 - DNA, 16 bp, P. troglodytes
gcaacacagtgagacc

SEQ ID NO: 246638 - DNA, 16 bp, P. troglodytes
gcaacacggcaagacc

SEQ ID NO: 246639 - DNA, 16 bp, P. troglodytes
gcaacactgtctcaaa

SEQ ID NO: 246640 - DNA, 16 bp, P. troglodytes
gcaacagaacaagacc

SEQ ID NO: 246641 - DNA, 16 bp, P. troglodytes
gcaacagacttctcaa

SEQ ID NO: 246642 - DNA, 16 bp, P. troglodytes
gcaacagagaaagact

SEQ ID NO: 246643 - DNA, 16 bp, P. troglodytes
gcaacagagcaagaaa

SEQ ID NO: 246644 - DNA, 16 bp, P. troglodytes
gcaacagagggagacc

SEQ ID NO: 246645 - DNA, 16 bp, P. troglodytes
gcaacagagtgtgact

SEQ ID NO: 246646 - DNA, 16 bp, P. troglodytes
gcaacataacaagacc

SEQ ID NO: 246647 - DNA, 16 bp, P. troglodytes
gcaacataatgagact

SEQ ID NO: 246648 - DNA, 17 bp, P. troglodytes
gcaacatagcaagacct

SEQ ID NO: 246649 - DNA, 16 bp, P. troglodytes
gcaacatagtgagaca

SEQ ID NO: 246650 - DNA, 16 bp, P. troglodytes
gcaacatagtgagacc

SEQ ID NO: 246651 - DNA, 23 bp, P. troglodytes
gcaacatgatgaaaccccatctc

SEQ ID NO: 246652 - DNA, 16 bp, P. troglodytes
gcaacattattcacaa

SEQ ID NO: 246653 - DNA, 16 bp, P. troglodytes
gcaacattttcttttt

SEQ ID NO: 246654 - DNA, 16 bp, P. troglodytes
gcaaccacttgctaga

SEQ ID NO: 246655 - DNA, 19 bp, P. troglodytes
gcaaccatccgatttctca

SEQ ID NO: 246656 - DNA, 16 bp, P. troglodytes
gcaacccctgtctccc

SEQ ID NO: 246657 - DNA, 16 bp, P. troglodytes
gcaacctccacattcc

SEQ ID NO: 246658 - DNA, 16 bp, P. troglodytes
gcaacctccacccccg

SEQ ID NO: 246659 - DNA, 16 bp, P. troglodytes
gcaacctccaccttcc

SEQ ID NO: 246660 - DNA, 16 bp, P. troglodytes
gcaacctccatctccc

SEQ ID NO: 246661 - DNA, 16 bp, P. troglodytes
gcaacctccatcttcc

SEQ ID NO: 246662 - DNA, 16 bp, P. troglodytes
gcaacctccttctccc

SEQ ID NO: 246663 - DNA, 16 bp, P. troglodytes
gcaacctcggcctccc

SEQ ID NO: 246664 - DNA, 16 bp, P. troglodytes
gcaacctctctctccc

SEQ ID NO: 246665 - DNA, 16 bp, P. troglodytes
gcaacctctgactccc

SEQ ID NO: 246666 - DNA, 16 bp, P. troglodytes
gcaacctctgccactc

SEQ ID NO: 246667 - DNA, 16 bp, P. troglodytes
gcaacctctgccttcc

SEQ ID NO: 246668 - DNA, 16 bp, P. troglodytes
gcaacctctgccttct

SEQ ID NO: 246669 - DNA, 16 bp, P. troglodytes
gcaacctctgcttccc

SEQ ID NO: 246670 - DNA, 16 bp, P. troglodytes
gcaacctctgtctcct

SEQ ID NO: 246671 - DNA, 16 bp, P. troglodytes
gcaaccttggcctcct

SEQ ID NO: 246672 - DNA, 16 bp, P. troglodytes
gcaaccttgggcaagt

SEQ ID NO: 246673 - DNA, 16 bp, P. troglodytes
gcaacctttgccttct

SEQ ID NO: 246674 - DNA, 16 bp, P. troglodytes
gcaactacttgggagg

SEQ ID NO: 246675 - DNA, 16 bp, P. troglodytes
gcaactgagaaactga

SEQ ID NO: 246676 - DNA, 16 bp, P. troglodytes
gcaactgcagtcccag

SEQ ID NO: 246677 - DNA, 16 bp, P. troglodytes
gcaactgccgcctcct

SEQ ID NO: 246678 - DNA, 16 bp, P. troglodytes
gcaacttccgtctccc

SEQ ID NO: 246679 - DNA, 16 bp, P. troglodytes
gcaacttcggcctccc

SEQ ID NO: 246680 - DNA, 16 bp, P. troglodytes
gcaagaaaaaaaattt

SEQ ID NO: 246681 - DNA, 16 bp, P. troglodytes
gcaagaaaatatgaca

SEQ ID NO: 246682 - DNA, 16 bp, P. troglodytes
gcaagaaactaaatta

SEQ ID NO: 246683 - DNA, 16 bp, P. troglodytes
gcaagaaagagaaata

SEQ ID NO: 246684 - DNA, 16 bp, P. troglodytes
gcaagaaataattcag

SEQ ID NO: 246685 - DNA, 16 bp, P. troglodytes
gcaagaaattaaaaca

SEQ ID NO: 246686 - DNA, 16 bp, P. troglodytes
gcaagaacttgtctca

SEQ ID NO: 246687 - DNA, 16 bp, P. troglodytes
gcaagacccccatctt

SEQ ID NO: 246688 - DNA, 16 bp, P. troglodytes
gcaagacctcatctcc

SEQ ID NO: 246689 - DNA, 16 bp, P. troglodytes
gcaagactccacctct

SEQ ID NO: 246690 - DNA, 16 bp, P. troglodytes
gcaagactccatctct

SEQ ID NO: 246691 - DNA, 16 bp, P. troglodytes
gcaagactctgtctct

SEQ ID NO: 246692 - DNA, 16 bp, P. troglodytes
gcaagagaaaataaac

SEQ ID NO: 246693 - DNA, 16 bp, P. troglodytes
gcaagagaaaatgaga

SEQ ID NO: 246694 - DNA, 16 bp, P. troglodytes
gcaagagagaagcaac

SEQ ID NO: 246695 - DNA, 16 bp, P. troglodytes
gcaagatcctgtctca

SEQ ID NO: 246696 - DNA, 16 bp, P. troglodytes
gcaagatcctgtttca

SEQ ID NO: 246697 - DNA, 16 bp, P. troglodytes
gcaagattcatcacct

SEQ ID NO: 246698 - DNA, 16 bp, P. troglodytes
gcaagcaacagaaaca

SEQ ID NO: 246699 - DNA, 16 bp, P. troglodytes
gcaagcaccaccatgc

SEQ ID NO: 246700 - DNA, 16 bp, P. troglodytes
gcaagcaggcaggcag

SEQ ID NO: 246701 - DNA, 16 bp, P. troglodytes
gcaagccaaggaaaga

SEQ ID NO: 246702 - DNA, 17 bp, P. troglodytes
gcaagccacccaggtgc

SEQ ID NO: 246703 - DNA, 16 bp, P. troglodytes
gcaagccaggaaggga

SEQ ID NO: 246704 - DNA, 16 bp, P. troglodytes
gcaagccctaagcctt

SEQ ID NO: 246705 - DNA, 16 bp, P. troglodytes
gcaagccctgcctcag

SEQ ID NO: 246706 - DNA, 16 bp, P. troglodytes
gcaagctccacatccc

SEQ ID NO: 246707 - DNA, 16 bp, P. troglodytes
gcaagctccccctccc

SEQ ID NO: 246708 - DNA, 18 bp, P. troglodytes
gcaagctctgcctcctgg

SEQ ID NO: 246709 - DNA, 16 bp, P. troglodytes
gcaagctcttcctccc

SEQ ID NO: 246710 - DNA, 16 bp, P. troglodytes
gcaagctgtcagtgga

SEQ ID NO: 246711 - DNA, 16 bp, P. troglodytes
gcaaggaaaaaattaa

SEQ ID NO: 246712 - DNA, 16 bp, P. troglodytes
gcaaggaaacatgaca

SEQ ID NO: 246713 - DNA, 16 bp, P. troglodytes
gcaaggaaccagtgac

SEQ ID NO: 246714 - DNA, 16 bp, P. troglodytes
gcaaggaaggctggga

SEQ ID NO: 246715 - DNA, 16 bp, P. troglodytes
gcaaggaatggattct

SEQ ID NO: 246716 - DNA, 16 bp, P. troglodytes
gcaaggaggagcaggt

SEQ ID NO: 246717 - DNA, 16 bp, P. troglodytes
gcaaggcatctctgaa

SEQ ID NO: 246718 - DNA, 16 bp, P. troglodytes
gcaaggcatgtcttac

SEQ ID NO: 246719 - DNA, 16 bp, P. troglodytes
gcaaggccctgggcct

SEQ ID NO: 246720 - DNA, 17 bp, P. troglodytes
gcaaggctgggggaggg

SEQ ID NO: 246721 - DNA, 16 bp, P. troglodytes
gcaaggctttgtttag

SEQ ID NO: 246722 - DNA, 16 bp, P. troglodytes
gcaaggtgaagcagca

SEQ ID NO: 246723 - DNA, 16 bp, P. troglodytes
gcaaggtgggtggatc

SEQ ID NO: 246724 - DNA, 16 bp, P. troglodytes
gcaaggtggtgtgcac

SEQ ID NO: 246725 - DNA, 16 bp, P. troglodytes
gcaagtaaatacagca

SEQ ID NO: 246726 - DNA, 16 bp, P. troglodytes
gcaagtattttctctc

SEQ ID NO: 246727 - DNA, 16 bp, P. troglodytes
gcaagtcaggaagaga

SEQ ID NO: 246728 - DNA, 16 bp, P. troglodytes
gcaagtcatgtggcca

SEQ ID NO: 246729 - DNA, 16 bp, P. troglodytes
gcaagtcatttaacct

SEQ ID NO: 246730 - DNA, 16 bp, P. troglodytes
gcaagtccaaaaccta

SEQ ID NO: 246731 - DNA, 16 bp, P. troglodytes
gcaagtccaaaatcca

SEQ ID NO: 246732 - DNA, 16 bp, P. troglodytes
gcaagtcctagtgctg

SEQ ID NO: 246733 - DNA, 16 bp, P. troglodytes
gcaagtccttagagat

SEQ ID NO: 246734 - DNA, 16 bp, P. troglodytes
gcaagtctgaaatcca

SEQ ID NO: 246735 - DNA, 16 bp, P. troglodytes
gcaagtggttgctcca

SEQ ID NO: 246736 - DNA, 16 bp, P. troglodytes
gcaagttacctaacct

SEQ ID NO: 246737 - DNA, 16 bp, P. troglodytes
gcaataaacataaatg

SEQ ID NO: 246738 - DNA, 16 bp, P. troglodytes
gcaataaacatgggag

SEQ ID NO: 246739 - DNA, 16 bp, P. troglodytes
gcaataaagcaagtca

SEQ ID NO: 246740 - DNA, 16 bp, P. troglodytes
gcaatagtcttgaata

SEQ ID NO: 246741 - DNA, 16 bp, P. troglodytes
gcaatatagggagact

SEQ ID NO: 246742 - DNA, 16 bp, P. troglodytes
gcaatatgacaaaaca

SEQ ID NO: 246743 - DNA, 16 bp, P. troglodytes
gcaatatgcatttaag

SEQ ID NO: 246744 - DNA, 16 bp, P. troglodytes
gcaatatggcaaaacc

SEQ ID NO: 246745 - DNA, 16 bp, P. troglodytes
gcaatcaaactggaac

SEQ ID NO: 246746 - DNA, 16 bp, P. troglodytes
gcaatcatagctaact

SEQ ID NO: 246747 - DNA, 16 bp, P. troglodytes
gcaatcatggctcact

SEQ ID NO: 246748 - DNA, 16 bp, P. troglodytes
gcaatccacccacctg

SEQ ID NO: 246749 - DNA, 16 bp, P. troglodytes
gcaatccacctgcctt

SEQ ID NO: 246750 - DNA, 16 bp, P. troglodytes
gcaatccagcctggat

SEQ ID NO: 246751 - DNA, 16 bp, P. troglodytes
gcaatccccaaccttt

SEQ ID NO: 246752 - DNA, 16 bp, P. troglodytes
gcaatccgccagcctc

SEQ ID NO: 246753 - DNA, 16 bp, P. troglodytes
gcaatcctcacacctt

SEQ ID NO: 246754 - DNA, 16 bp, P. troglodytes
gcaatcctcccatctc

SEQ ID NO: 246755 - DNA, 16 bp, P. troglodytes
gcaatccttccacctc

SEQ ID NO: 246756 - DNA, 17 bp, P. troglodytes
gcaatctcggctcaccg

SEQ ID NO: 246757 - DNA, 16 bp, P. troglodytes
gcaatctctgcctctg

SEQ ID NO: 246758 - DNA, 16 bp, P. troglodytes
gcaatcttcctgcctc

SEQ ID NO: 246759 - DNA, 16 bp, P. troglodytes
gcaatgaaaagaaaca

SEQ ID NO: 246760 - DNA, 16 bp, P. troglodytes
gcaatgaacaatctga

SEQ ID NO: 246761 - DNA, 16 bp, P. troglodytes
gcaatgaacatgggag

SEQ ID NO: 246762 - DNA, 16 bp, P. troglodytes
gcaatggaacaaaact

SEQ ID NO: 246763 - DNA, 16 bp, P. troglodytes
gcaatggaattgctgg

SEQ ID NO: 246764 - DNA, 16 bp, P. troglodytes
gcaatggcacagtcat

SEQ ID NO: 246765 - DNA, 16 bp, P. troglodytes
gcaatggcacagtctc

SEQ ID NO: 246766 - DNA, 16 bp, P. troglodytes
gcaatggcaccgtctc

SEQ ID NO: 246767 - DNA, 17 bp, P. troglodytes
gcaatggctcatgccta

SEQ ID NO: 246768 - DNA, 16 bp, P. troglodytes
gcaatggctccatctc

SEQ ID NO: 246769 - DNA, 16 bp, P. troglodytes
gcaatgggaacaaaag

SEQ ID NO: 246770 - DNA, 16 bp, P. troglodytes
gcaatgggaagccatt

SEQ ID NO: 246771 - DNA, 16 bp, P. troglodytes
gcaatggtggatgccc

SEQ ID NO: 246772 - DNA, 16 bp, P. troglodytes
gcaatgtgactttgca

SEQ ID NO: 246773 - DNA, 16 bp, P. troglodytes
gcaattaacatttggc

SEQ ID NO: 246774 - DNA, 16 bp, P. troglodytes
gcaattcctcaaaaag

SEQ ID NO: 246775 - DNA, 16 bp, P. troglodytes
gcaattcctctgtctt

SEQ ID NO: 246776 - DNA, 16 bp, P. troglodytes
gcaattctctaatgac

SEQ ID NO: 246777 - DNA, 16 bp, P. troglodytes
gcaatttgagaggctg

SEQ ID NO: 246778 - DNA, 16 bp, P. troglodytes
gcaatttgcctgcctt

SEQ ID NO: 246779 - DNA, 16 bp, P. troglodytes
gcaattttgaaatgta

SEQ ID NO: 246780 - DNA, 16 bp, P. troglodytes
gcaattttggcctcag

SEQ ID NO: 246781 - DNA, 16 bp, P. troglodytes
gcaatttttctgcctc

SEQ ID NO: 246782 - DNA, 16 bp, P. troglodytes
gcaatttttttaaaaa

SEQ ID NO: 246783 - DNA, 16 bp, P. troglodytes
gcacaaaagctgtgag

SEQ ID NO: 246784 - DNA, 16 bp, P. troglodytes
gcacaaatttcttttt

SEQ ID NO: 246785 - DNA, 16 bp, P. troglodytes
gcacaacaaaaagctt

SEQ ID NO: 246786 - DNA, 16 bp, P. troglodytes
gcacaacaatgtgaat

SEQ ID NO: 246787 - DNA, 16 bp, P. troglodytes
gcacaactacatggaa

SEQ ID NO: 246788 - DNA, 16 bp, P. troglodytes
gcacaagacaaggatg

SEQ ID NO: 246789 - DNA, 16 bp, P. troglodytes
gcacaagactctgtct

SEQ ID NO: 246790 - DNA, 16 bp, P. troglodytes
gcacaatgcctggctc

SEQ ID NO: 246791 - DNA, 16 bp, P. troglodytes
gcacaatgcctggtac

SEQ ID NO: 246792 - DNA, 16 bp, P. troglodytes
gcacacacaaaaaagt

SEQ ID NO: 246793 - DNA, 16 bp, P. troglodytes
gcacacacacacacgc

SEQ ID NO: 246794 - DNA, 16 bp, P. troglodytes
gcacacacacactctc

SEQ ID NO: 246795 - DNA, 16 bp, P. troglodytes
gcacacacacagacac

SEQ ID NO: 246796 - DNA, 16 bp, P. troglodytes
gcacacacacgcacac

SEQ ID NO: 246797 - DNA, 16 bp, P. troglodytes
gcacacacactcacac

SEQ ID NO: 246798 - DNA, 16 bp, P. troglodytes
gcacacacagacacac

SEQ ID NO: 246799 - DNA, 16 bp, P. troglodytes
gcacacacaggcacac

SEQ ID NO: 246800 - DNA, 16 bp, P. troglodytes
gcacacacatacacat

SEQ ID NO: 246801 - DNA, 16 bp, P. troglodytes
gcacacacatacatac

SEQ ID NO: 246802 - DNA, 16 bp, P. troglodytes
gcacacacatgcatgc

SEQ ID NO: 246803 - DNA, 16 bp, P. troglodytes
gcacacacgcacacac

SEQ ID NO: 246804 - DNA, 16 bp, P. troglodytes
gcacacactggctccc

SEQ ID NO: 246805 - DNA, 16 bp, P. troglodytes
gcacacactggggcct

SEQ ID NO: 246806 - DNA, 16 bp, P. troglodytes
gcacacagcacacagc

SEQ ID NO: 246807 - DNA, 16 bp, P. troglodytes
gcacacagcagggagg

SEQ ID NO: 246808 - DNA, 16 bp, P. troglodytes
gcacacaggcacacat

SEQ ID NO: 246809 - DNA, 16 bp, P. troglodytes
gcacacagtaggcatt

SEQ ID NO: 246810 - DNA, 16 bp, P. troglodytes
gcacacagtaggtact

SEQ ID NO: 246811 - DNA, 16 bp, P. troglodytes
gcacacagtaggtgct

SEQ ID NO: 246812 - DNA, 16 bp, P. troglodytes
gcacacatgcacacac

SEQ ID NO: 246813 - DNA, 16 bp, P. troglodytes
gcacaccaccatgccc

SEQ ID NO: 246814 - DNA, 16 bp, P. troglodytes
gcacaccagcctggac

SEQ ID NO: 246815 - DNA, 17 bp, P. troglodytes
gcacacctataatccca

SEQ ID NO: 246816 - DNA, 16 bp, P. troglodytes
gcacacctcggcctcc

SEQ ID NO: 246817 - DNA, 16 bp, P. troglodytes
gcacacctgaacaaag

SEQ ID NO: 246818 - DNA, 16 bp, P. troglodytes
gcacacctgcacacac

SEQ ID NO: 246819 - DNA, 16 bp, P. troglodytes
gcacacctgcaggccc

SEQ ID NO: 246820 - DNA, 16 bp, P. troglodytes
gcacacgcacacgcac

SEQ ID NO: 246821 - DNA, 16 bp, P. troglodytes
gcacacgcacgcacac

SEQ ID NO: 246822 - DNA, 16 bp, P. troglodytes
gcacactccagcctgg

SEQ ID NO: 246823 - DNA, 16 bp, P. troglodytes
gcacactcctgcctca

SEQ ID NO: 246824 - DNA, 16 bp, P. troglodytes
gcacactgcaacctcc

SEQ ID NO: 246825 - DNA, 16 bp, P. troglodytes
gcacactgcagccttg

SEQ ID NO: 246826 - DNA, 16 bp, P. troglodytes
gcacagagaaggtgct

SEQ ID NO: 246827 - DNA, 16 bp, P. troglodytes
gcacagagaagttaag

SEQ ID NO: 246828 - DNA, 16 bp, P. troglodytes
gcacagagataagagg

SEQ ID NO: 246829 - DNA, 16 bp, P. troglodytes
gcacagagcagatgct

SEQ ID NO: 246830 - DNA, 16 bp, P. troglodytes
gcacagagcagcaggg

SEQ ID NO: 246831 - DNA, 16 bp, P. troglodytes
gcacagagcctggccc

SEQ ID NO: 246832 - DNA, 16 bp, P. troglodytes
gcacagagtaagtgct

SEQ ID NO: 246833 - DNA, 16 bp, P. troglodytes
gcacagcagagtgact

SEQ ID NO: 246834 - DNA, 16 bp, P. troglodytes
gcacagcagcctggac

SEQ ID NO: 246835 - DNA, 16 bp, P. troglodytes
gcacagcatcacttct

SEQ ID NO: 246836 - DNA, 16 bp, P. troglodytes
gcacagccaaagaaat

SEQ ID NO: 246837 - DNA, 16 bp, P. troglodytes
gcacagctgcagccac

SEQ ID NO: 246838 - DNA, 16 bp, P. troglodytes
gcacagcttagctggg

SEQ ID NO: 246839 - DNA, 16 bp, P. troglodytes
gcacaggacagcccct

SEQ ID NO: 246840 - DNA, 16 bp, P. troglodytes
gcacaggaggcagagg

SEQ ID NO: 246841 - DNA, 16 bp, P. troglodytes
gcacaggatgggggca

SEQ ID NO: 246842 - DNA, 16 bp, P. troglodytes
gcacaggatgggggcg

SEQ ID NO: 246843 - DNA, 16 bp, P. troglodytes
gcacaggggtcaggga

SEQ ID NO: 246844 - DNA, 16 bp, P. troglodytes
gcacaggtgccagctc

SEQ ID NO: 246845 - DNA, 16 bp, P. troglodytes
gcacagtgagccactc

SEQ ID NO: 246846 - DNA, 16 bp, P. troglodytes
gcacagtgcctcacac

SEQ ID NO: 246847 - DNA, 16 bp, P. troglodytes
gcacagtgctgggcac

SEQ ID NO: 246848 - DNA, 18 bp, P. troglodytes
gcacagtggcccatgcct

SEQ ID NO: 246849 - DNA, 16 bp, P. troglodytes
gcacagttgctcatgc

SEQ ID NO: 246850 - DNA, 16 bp, P. troglodytes
gcacataatagacact

SEQ ID NO: 246851 - DNA, 16 bp, P. troglodytes
gcacatacacatgcat

SEQ ID NO: 246852 - DNA, 16 bp, P. troglodytes
gcacatacctgtagtc

SEQ ID NO: 246853 - DNA, 16 bp, P. troglodytes
gcacatagtaagaact

SEQ ID NO: 246854 - DNA, 16 bp, P. troglodytes
gcacatagtaggtgct

SEQ ID NO: 246855 - DNA, 16 bp, P. troglodytes
gcacatagtcatcaag

SEQ ID NO: 246856 - DNA, 16 bp, P. troglodytes
gcacatatacatccag

SEQ ID NO: 246857 - DNA, 16 bp, P. troglodytes
gcacatatatatatat

SEQ ID NO: 246858 - DNA, 16 bp, P. troglodytes
gcacatcaccatgccc

SEQ ID NO: 246859 - DNA, 16 bp, P. troglodytes
gcacatgaaaaaatgc

SEQ ID NO: 246860 - DNA, 16 bp, P. troglodytes
gcacatgcatgcacac

SEQ ID NO: 246861 - DNA, 16 bp, P. troglodytes
gcacatgcatgtgcat

SEQ ID NO: 246862 - DNA, 16 bp, P. troglodytes
gcacatgccaccaaac

SEQ ID NO: 246863 - DNA, 16 bp, P. troglodytes
gcacatgccaccacgt

SEQ ID NO: 246864 - DNA, 16 bp, P. troglodytes
gcacatgcctggaatc

SEQ ID NO: 246865 - DNA, 16 bp, P. troglodytes
gcacatgcctgtaggc

SEQ ID NO: 246866 - DNA, 16 bp, P. troglodytes
gcacatggcaggtgct

SEQ ID NO: 246867 - DNA, 16 bp, P. troglodytes
gcacatgtacccccaa

SEQ ID NO: 246868 - DNA, 16 bp, P. troglodytes
gcacatgttctcaggg

SEQ ID NO: 246869 - DNA, 16 bp, P. troglodytes
gcaccaaaaactgcaa

SEQ ID NO: 246870 - DNA, 16 bp, P. troglodytes
gcaccaaaatttcaga

SEQ ID NO: 246871 - DNA, 16 bp, P. troglodytes
gcaccaacacgcccag

SEQ ID NO: 246872 - DNA, 16 bp, P. troglodytes
gcaccaccacaccctg

SEQ ID NO: 246873 - DNA, 16 bp, P. troglodytes
gcaccaccacactggc

SEQ ID NO: 246874 - DNA, 16 bp, P. troglodytes
gcaccaccacgtccag

SEQ ID NO: 246875 - DNA, 16 bp, P. troglodytes
gcaccaccagccacag

SEQ ID NO: 246876 - DNA, 16 bp, P. troglodytes
gcaccaccatatctgg

SEQ ID NO: 246877 - DNA, 16 bp, P. troglodytes
gcaccaccatgtccag

SEQ ID NO: 246878 - DNA, 16 bp, P. troglodytes
gcaccaccattcccag

SEQ ID NO: 246879 - DNA, 16 bp, P. troglodytes
gcaccaccctgcctgg

SEQ ID NO: 246880 - DNA, 16 bp, P. troglodytes
gcaccaccgcacccag

SEQ ID NO: 246881 - DNA, 16 bp, P. troglodytes
gcaccacctttgctgt

SEQ ID NO: 246882 - DNA, 16 bp, P. troglodytes
gcaccactacacttgg

SEQ ID NO: 246883 - DNA, 16 bp, P. troglodytes
gcaccactatgcccag

SEQ ID NO: 246884 - DNA, 16 bp, P. troglodytes
gcaccactgcaccctg

SEQ ID NO: 246885 - DNA, 16 bp, P. troglodytes
gcaccagcacacccgg

SEQ ID NO: 246886 - DNA, 16 bp, P. troglodytes
gcaccaggaactggtt

SEQ ID NO: 246887 - DNA, 16 bp, P. troglodytes
gcaccagtagtcccag

SEQ ID NO: 246888 - DNA, 16 bp, P. troglodytes
gcaccattgtaaagtc

SEQ ID NO: 246889 - DNA, 16 bp, P. troglodytes
gcaccattgttgaaaa

SEQ ID NO: 246890 - DNA, 16 bp, P. troglodytes
gcaccatttattgagt

SEQ ID NO: 246891 - DNA, 16 bp, P. troglodytes
gcaccatttggagttt

SEQ ID NO: 246892 - DNA, 16 bp, P. troglodytes
gcacccaccaccatgc

SEQ ID NO: 246893 - DNA, 16 bp, P. troglodytes
gcacccaccactgcac

SEQ ID NO: 246894 - DNA, 16 bp, P. troglodytes
gcacccactgacctgc

SEQ ID NO: 246895 - DNA, 16 bp, P. troglodytes
gcacccagagagggca

SEQ ID NO: 246896 - DNA, 16 bp, P. troglodytes
gcacccagcacccagc

SEQ ID NO: 246897 - DNA, 16 bp, P. troglodytes
gcacccagcctgggca

SEQ ID NO: 246898 - DNA, 16 bp, P. troglodytes
gcacccagctaatttt

SEQ ID NO: 246899 - DNA, 16 bp, P. troglodytes
gcaccccagccagggc

SEQ ID NO: 246900 - DNA, 16 bp, P. troglodytes
gcaccccatcctgggc

SEQ ID NO: 246901 - DNA, 16 bp, P. troglodytes
gcacccgtcacctgag

SEQ ID NO: 246902 - DNA, 16 bp, P. troglodytes
gcacccgttgtttcct

SEQ ID NO: 246903 - DNA, 16 bp, P. troglodytes
gcaccctcaacctcct

SEQ ID NO: 246904 - DNA, 16 bp, P. troglodytes
gcaccctgaggagggg

SEQ ID NO: 246905 - DNA, 16 bp, P. troglodytes
gcaccctgcagtgccc

SEQ ID NO: 246906 - DNA, 16 bp, P. troglodytes
gcaccctgggcctggt

SEQ ID NO: 246907 - DNA, 16 bp, P. troglodytes
gcaccgtgcacgagcc

SEQ ID NO: 246908 - DNA, 16 bp, P. troglodytes
gcacctagattcataa

SEQ ID NO: 246909 - DNA, 16 bp, P. troglodytes
gcacctcagcaggttg

SEQ ID NO: 246910 - DNA, 16 bp, P. troglodytes
gcacctcagcctcccg

SEQ ID NO: 246911 - DNA, 16 bp, P. troglodytes
gcacctcccctgcctg

SEQ ID NO: 246912 - DNA, 16 bp, P. troglodytes
gcacctccctgctctc

SEQ ID NO: 246913 - DNA, 16 bp, P. troglodytes
gcacctcctccttctc

SEQ ID NO: 246914 - DNA, 16 bp, P. troglodytes
gcacctctgcccagcc

SEQ ID NO: 246915 - DNA, 16 bp, P. troglodytes
gcacctcttcacaggg

SEQ ID NO: 246916 - DNA, 16 bp, P. troglodytes
gcacctcttcccggcc

SEQ ID NO: 246917 - DNA, 16 bp, P. troglodytes
gcacctgacaaaggtc

SEQ ID NO: 246918 - DNA, 16 bp, P. troglodytes
gcacctgcaattccag

SEQ ID NO: 246919 - DNA, 16 bp, P. troglodytes
gcacctgccaccacag

SEQ ID NO: 246920 - DNA, 17 bp, P. troglodytes
gcacctgccaccacgcc

SEQ ID NO: 246921 - DNA, 16 bp, P. troglodytes
gcacctgccaccacgg

SEQ ID NO: 246922 - DNA, 16 bp, P. troglodytes
gcacctgccaccccac

SEQ ID NO: 246923 - DNA, 16 bp, P. troglodytes
gcacctgcctcggcct

SEQ ID NO: 246924 - DNA, 16 bp, P. troglodytes
gcacctgctgttcttt

SEQ ID NO: 246925 - DNA, 16 bp, P. troglodytes
gcacctggaaaatcag

SEQ ID NO: 246926 - DNA, 16 bp, P. troglodytes
gcacctggaacaccag

SEQ ID NO: 246927 - DNA, 16 bp, P. troglodytes
gcacctggaactgttt

SEQ ID NO: 246928 - DNA, 16 bp, P. troglodytes
gcacctggccaaaaac

SEQ ID NO: 246929 - DNA, 16 bp, P. troglodytes
gcacctggcctgtttc

SEQ ID NO: 246930 - DNA, 16 bp, P. troglodytes
gcacctggctaatttt

SEQ ID NO: 246931 - DNA, 17 bp, P. troglodytes
gcacctgtagtcccagt

SEQ ID NO: 246932 - DNA, 16 bp, P. troglodytes
gcacctgtagtccgag

SEQ ID NO: 246933 - DNA, 16 bp, P. troglodytes
gcacctgtagtttcag

SEQ ID NO: 246934 - DNA, 16 bp, P. troglodytes
gcacctgtggtcctgg

SEQ ID NO: 246935 - DNA, 16 bp, P. troglodytes
gcacctgtggttccag

SEQ ID NO: 246936 - DNA, 16 bp, P. troglodytes
gcacctgttatcccag

SEQ ID NO: 246937 - DNA, 16 bp, P. troglodytes
gcaccttttcatgtac

SEQ ID NO: 246938 - DNA, 16 bp, P. troglodytes
gcacgatctcggctct

SEQ ID NO: 246939 - DNA, 17 bp, P. troglodytes
gcacgatcttggctcat

SEQ ID NO: 246940 - DNA, 18 bp, P. troglodytes
gcacgatggctcacgcct

SEQ ID NO: 246941 - DNA, 16 bp, P. troglodytes
gcacgcacgcacgcac

SEQ ID NO: 246942 - DNA, 18 bp, P. troglodytes
gcacgcccagctaatttt

SEQ ID NO: 246943 - DNA, 16 bp, P. troglodytes
gcacgcccggctaatt

SEQ ID NO: 246944 - DNA, 18 bp, P. troglodytes
gcacgcctggctaatttt

SEQ ID NO: 246945 - DNA, 16 bp, P. troglodytes
gcacgcgccaccactc

SEQ ID NO: 246946 - DNA, 16 bp, P. troglodytes
gcacgctggctcacac

SEQ ID NO: 246947 - DNA, 16 bp, P. troglodytes
gcacggtggtgcatgc

SEQ ID NO: 246948 - DNA, 16 bp, P. troglodytes
gcacgtagtaggtgct

SEQ ID NO: 246949 - DNA, 16 bp, P. troglodytes
gcacgtgcaaaggccc

SEQ ID NO: 246950 - DNA, 20 bp, P. troglodytes
gcactaaacgtggaaaggaa

SEQ ID NO: 246951 - DNA, 16 bp, P. troglodytes
gcactacagccccttt

SEQ ID NO: 246952 - DNA, 16 bp, P. troglodytes
gcactactatgcccag

SEQ ID NO: 246953 - DNA, 16 bp, P. troglodytes
gcactatgttgaataa

SEQ ID NO: 246954 - DNA, 16 bp, P. troglodytes
gcactattttacattt

SEQ ID NO: 246955 - DNA, 16 bp, P. troglodytes
gcactcaataaatgat

SEQ ID NO: 246956 - DNA, 16 bp, P. troglodytes
gcactcaataaatgtt

SEQ ID NO: 246957 - DNA, 16 bp, P. troglodytes
gcactcacagtacctg

SEQ ID NO: 246958 - DNA, 16 bp, P. troglodytes
gcactcaccaccatgc

SEQ ID NO: 246959 - DNA, 16 bp, P. troglodytes
gcactcaggaggctga

SEQ ID NO: 246960 - DNA, 16 bp, P. troglodytes
gcactccagccaaaaa

SEQ ID NO: 246961 - DNA, 16 bp, P. troglodytes
gcactccagccccagc

SEQ ID NO: 246962 - DNA, 16 bp, P. troglodytes
gcactccagccctgag

SEQ ID NO: 246963 - DNA, 16 bp, P. troglodytes
gcactccagccgaggc

SEQ ID NO: 246964 - DNA, 16 bp, P. troglodytes
gcactccagctccagc

SEQ ID NO: 246965 - DNA, 16 bp, P. troglodytes
gcactccagcttcggc

SEQ ID NO: 246966 - DNA, 16 bp, P. troglodytes
gcactccccacatctc

SEQ ID NO: 246967 - DNA, 16 bp, P. troglodytes
gcactccttcctgggc

SEQ ID NO: 246968 - DNA, 16 bp, P. troglodytes
gcactctggcctggac

SEQ ID NO: 246969 - DNA, 16 bp, P. troglodytes
gcactgatggcctcat

SEQ ID NO: 246970 - DNA, 17 bp, P. troglodytes
gcactgcacccactgtc

SEQ ID NO: 246971 - DNA, 17 bp, P. troglodytes
gcactgccctccagcct

SEQ ID NO: 246972 - DNA, 16 bp, P. troglodytes
gcactgcgcccagcca

SEQ ID NO: 246973 - DNA, 16 bp, P. troglodytes
gcactgctgaaagaaa

SEQ ID NO: 246974 - DNA, 16 bp, P. troglodytes
gcactgctgggggacc

SEQ ID NO: 246975 - DNA, 16 bp, P. troglodytes
gcactgctgggggact

SEQ ID NO: 246976 - DNA, 16 bp, P. troglodytes
gcactgctggtgggaa

SEQ ID NO: 246977 - DNA, 16 bp, P. troglodytes
gcactggggatacaaa

SEQ ID NO: 246978 - DNA, 16 bp, P. troglodytes
gcactgggtctcaccc

SEQ ID NO: 246979 - DNA, 16 bp, P. troglodytes
gcactggttcagaagc

SEQ ID NO: 246980 - DNA, 16 bp, P. troglodytes
gcactgtgaaaatgga

SEQ ID NO: 246981 - DNA, 16 bp, P. troglodytes
gcactgttttacattt

SEQ ID NO: 246982 - DNA, 16 bp, P. troglodytes
gcacttaataaatatt

SEQ ID NO: 246983 - DNA, 16 bp, P. troglodytes
gcacttataatcccag

SEQ ID NO: 246984 - DNA, 16 bp, P. troglodytes
gcacttcactccagcc

SEQ ID NO: 246985 - DNA, 16 bp, P. troglodytes
gcacttcagcctgagc

SEQ ID NO: 246986 - DNA, 16 bp, P. troglodytes
gcacttcagcctgggc

SEQ ID NO: 246987 - DNA, 16 bp, P. troglodytes
gcacttctcccacctc

SEQ ID NO: 246988 - DNA, 16 bp, P. troglodytes
gcacttcttcttcctg

SEQ ID NO: 246989 - DNA, 16 bp, P. troglodytes
gcacttgaaatgtgcc

SEQ ID NO: 246990 - DNA, 16 bp, P. troglodytes
gcacttggatctctca

SEQ ID NO: 246991 - DNA, 16 bp, P. troglodytes
gcacttgtggtcccag

SEQ ID NO: 246992 - DNA, 16 bp, P. troglodytes
gcactttatatatatt

SEQ ID NO: 246993 - DNA, 16 bp, P. troglodytes
gcactttgagaggctg

SEQ ID NO: 246994 - DNA, 16 bp, P. troglodytes
gcactttgggaagctg

SEQ ID NO: 246995 - DNA, 16 bp, P. troglodytes
gcactttgggagacca

SEQ ID NO: 246996 - DNA, 16 bp, P. troglodytes
gcactttggggaggcc

SEQ ID NO: 246997 - DNA, 16 bp, P. troglodytes
gcacttttcacaatag

SEQ ID NO: 246998 - DNA, 16 bp, P. troglodytes
gcacttttccaatggg

SEQ ID NO: 246999 - DNA, 16 bp, P. troglodytes
gcagaaaaactggaaa

SEQ ID NO: 247000 - DNA, 16 bp, P. troglodytes
gcagaaaaagtttgct

SEQ ID NO: 247001 - DNA, 16 bp, P. troglodytes
gcagaaaaatgaaact

SEQ ID NO: 247002 - DNA, 16 bp, P. troglodytes
gcagaaaacctgaaaa

SEQ ID NO: 247003 - DNA, 16 bp, P. troglodytes
gcagaaacacacacac

SEQ ID NO: 247004 - DNA, 16 bp, P. troglodytes
gcagaaaccttacaaa

SEQ ID NO: 247005 - DNA, 16 bp, P. troglodytes
gcagaaacttctgcag

SEQ ID NO: 247006 - DNA, 16 bp, P. troglodytes
gcagaaagcaaaggag

SEQ ID NO: 247007 - DNA, 16 bp, P. troglodytes
gcagaaaggctgaaaa

SEQ ID NO: 247008 - DNA, 16 bp, P. troglodytes
gcagaaagtgaaggag

SEQ ID NO: 247009 - DNA, 16 bp, P. troglodytes
gcagaaataaaaatgt

SEQ ID NO: 247010 - DNA, 16 bp, P. troglodytes
gcagaaatcaccatct

SEQ ID NO: 247011 - DNA, 16 bp, P. troglodytes
gcagaaatcagtgaaa

SEQ ID NO: 247012 - DNA, 16 bp, P. troglodytes
gcagaaatgaaggaaa

SEQ ID NO: 247013 - DNA, 16 bp, P. troglodytes
gcagaaattctacaag

SEQ ID NO: 247014 - DNA, 16 bp, P. troglodytes
gcagaaattgcagtga

SEQ ID NO: 247015 - DNA, 16 bp, P. troglodytes
gcagaacaagaattaa

SEQ ID NO: 247016 - DNA, 16 bp, P. troglodytes
gcagaacaagaccctg

SEQ ID NO: 247017 - DNA, 16 bp, P. troglodytes
gcagaacagaaaatat

SEQ ID NO: 247018 - DNA, 16 bp, P. troglodytes
gcagaaccatgaacca

SEQ ID NO: 247019 - DNA, 16 bp, P. troglodytes
gcagaactgaagcaga

SEQ ID NO: 247020 - DNA, 16 bp, P. troglodytes
gcagaactggatggag

SEQ ID NO: 247021 - DNA, 16 bp, P. troglodytes
gcagaagaaaatctgt

SEQ ID NO: 247022 - DNA, 16 bp, P. troglodytes
gcagaagaaatatttg

SEQ ID NO: 247023 - DNA, 17 bp, P. troglodytes
gcagaagaatctcttga

SEQ ID NO: 247024 - DNA, 20 bp, P. troglodytes
gcagaagaatggcgtgaacc

SEQ ID NO: 247025 - DNA, 16 bp, P. troglodytes
gcagaagaatggtgtg

SEQ ID NO: 247026 - DNA, 16 bp, P. troglodytes
gcagaagaatgtggat

SEQ ID NO: 247027 - DNA, 16 bp, P. troglodytes
gcagaagaattccttg

SEQ ID NO: 247028 - DNA, 18 bp, P. troglodytes
gcagaagcagcagcagca

SEQ ID NO: 247029 - DNA, 16 bp, P. troglodytes
gcagaagcaggaaggt

SEQ ID NO: 247030 - DNA, 16 bp, P. troglodytes
gcagaagctatttagt

SEQ ID NO: 247031 - DNA, 16 bp, P. troglodytes
gcagaagctctgtagt

SEQ ID NO: 247032 - DNA, 16 bp, P. troglodytes
gcagaagctgcagaac

SEQ ID NO: 247033 - DNA, 16 bp, P. troglodytes
gcagaagctgcagcaa

SEQ ID NO: 247034 - DNA, 16 bp, P. troglodytes
gcagaagctggaagca

SEQ ID NO: 247035 - DNA, 16 bp, P. troglodytes
gcagaaggaacagcag

SEQ ID NO: 247036 - DNA, 16 bp, P. troglodytes
gcagaaggagaagcag

SEQ ID NO: 247037 - DNA, 16 bp, P. troglodytes
gcagaaggcaaaagag

SEQ ID NO: 247038 - DNA, 16 bp, P. troglodytes
gcagaaggcaagggga

SEQ ID NO: 247039 - DNA, 16 bp, P. troglodytes
gcagaaggcagaagtg

SEQ ID NO: 247040 - DNA, 16 bp, P. troglodytes
gcagaaggcagaggag

SEQ ID NO: 247041 - DNA, 16 bp, P. troglodytes
gcagaagggaaagcag

SEQ ID NO: 247042 - DNA, 16 bp, P. troglodytes
gcagaagggcaagaga

SEQ ID NO: 247043 - DNA, 16 bp, P. troglodytes
gcagaaggggaagcag

SEQ ID NO: 247044 - DNA, 16 bp, P. troglodytes
gcagaaggtgaagcag

SEQ ID NO: 247045 - DNA, 16 bp, P. troglodytes
gcagaaggtgaagggc

SEQ ID NO: 247046 - DNA, 16 bp, P. troglodytes
gcagaaggtgaaggtg

SEQ ID NO: 247047 - DNA, 16 bp, P. troglodytes
gcagaaggtggagggg

SEQ ID NO: 247048 - DNA, 16 bp, P. troglodytes
gcagaagtgatggtgt

SEQ ID NO: 247049 - DNA, 16 bp, P. troglodytes
gcagaagttctccatg

SEQ ID NO: 247050 - DNA, 16 bp, P. troglodytes
gcagaagtttgagacc

SEQ ID NO: 247051 - DNA, 16 bp, P. troglodytes
gcagaatctttttttt

SEQ ID NO: 247052 - DNA, 16 bp, P. troglodytes
gcagaatgggagaaaa

SEQ ID NO: 247053 - DNA, 16 bp, P. troglodytes
gcagaatgtgcatgtt

SEQ ID NO: 247054 - DNA, 16 bp, P. troglodytes
gcagaattgagtagtt

SEQ ID NO: 247055 - DNA, 16 bp, P. troglodytes
gcagacaccaagctag

SEQ ID NO: 247056 - DNA, 16 bp, P. troglodytes
gcagacagcagattgt

SEQ ID NO: 247057 - DNA, 16 bp, P. troglodytes
gcagacaggctcctgg

SEQ ID NO: 247058 - DNA, 16 bp, P. troglodytes
gcagacccacccttaa

SEQ ID NO: 247059 - DNA, 16 bp, P. troglodytes
gcagacggccaccttc

SEQ ID NO: 247060 - DNA, 17 bp, P. troglodytes
gcagactggagtgcagt

SEQ ID NO: 247061 - DNA, 16 bp, P. troglodytes
gcagagaaaacagcaa

SEQ ID NO: 247062 - DNA, 16 bp, P. troglodytes
gcagagacagggcttc

SEQ ID NO: 247063 - DNA, 16 bp, P. troglodytes
gcagagacagggtttc

SEQ ID NO: 247064 - DNA, 16 bp, P. troglodytes
gcagagactggaggga

SEQ ID NO: 247065 - DNA, 16 bp, P. troglodytes
gcagagactggcagca

SEQ ID NO: 247066 - DNA, 16 bp, P. troglodytes
gcagagatgctcctca

SEQ ID NO: 247067 - DNA, 16 bp, P. troglodytes
gcagagatgggcagat

SEQ ID NO: 247068 - DNA, 16 bp, P. troglodytes
gcagagattgcagtca

SEQ ID NO: 247069 - DNA, 16 bp, P. troglodytes
gcagagattgtagtga

SEQ ID NO: 247070 - DNA, 16 bp, P. troglodytes
gcagagcaaacagaca

SEQ ID NO: 247071 - DNA, 16 bp, P. troglodytes
gcagagcaagactctg

SEQ ID NO: 247072 - DNA, 17 bp, P. troglodytes
gcagagcaagactgtct

SEQ ID NO: 247073 - DNA, 16 bp, P. troglodytes
gcagagcagggcaggg

SEQ ID NO: 247074 - DNA, 16 bp, P. troglodytes
gcagagcatgcagtga

SEQ ID NO: 247075 - DNA, 16 bp, P. troglodytes
gcagagccaggattcc

SEQ ID NO: 247076 - DNA, 16 bp, P. troglodytes
gcagagccaggtgtac

SEQ ID NO: 247077 - DNA, 16 bp, P. troglodytes
gcagagcccaggccag

SEQ ID NO: 247078 - DNA, 16 bp, P. troglodytes
gcagagccctcatgaa

SEQ ID NO: 247079 - DNA, 16 bp, P. troglodytes
gcagagccctcatgat

SEQ ID NO: 247080 - DNA, 16 bp, P. troglodytes
gcagagcctggatttg

SEQ ID NO: 247081 - DNA, 16 bp, P. troglodytes
gcagagcgagaccctg

SEQ ID NO: 247082 - DNA, 16 bp, P. troglodytes
gcagagctatagtaac

SEQ ID NO: 247083 - DNA, 16 bp, P. troglodytes
gcagagctgggacagg

SEQ ID NO: 247084 - DNA, 16 bp, P. troglodytes
gcagagcttgaagtga

SEQ ID NO: 247085 - DNA, 16 bp, P. troglodytes
gcagaggaaactgagg

SEQ ID NO: 247086 - DNA, 16 bp, P. troglodytes
gcagaggacagagaga

SEQ ID NO: 247087 - DNA, 16 bp, P. troglodytes
gcagaggaggcgccga

SEQ ID NO: 247088 - DNA, 17 bp, P. troglodytes
gcagaggaggcgccgag

SEQ ID NO: 247089 - DNA, 16 bp, P. troglodytes
gcagaggcagagagag

SEQ ID NO: 247090 - DNA, 16 bp, P. troglodytes
gcagaggcaggaggat

SEQ ID NO: 247091 - DNA, 16 bp, P. troglodytes
gcagaggcaggtggat

SEQ ID NO: 247092 - DNA, 16 bp, P. troglodytes
gcagaggccctgaggc

SEQ ID NO: 247093 - DNA, 17 bp, P. troglodytes
gcagaggctctcctcac

SEQ ID NO: 247094 - DNA, 16 bp, P. troglodytes
gcagaggctgcagaac

SEQ ID NO: 247095 - DNA, 17 bp, P. troglodytes
gcagaggctgcagagag

SEQ ID NO: 247096 - DNA, 16 bp, P. troglodytes
gcagaggctgcaggag

SEQ ID NO: 247097 - DNA, 16 bp, P. troglodytes
gcagaggctggaagag

SEQ ID NO: 247098 - DNA, 16 bp, P. troglodytes
gcagaggctggaggat

SEQ ID NO: 247099 - DNA, 16 bp, P. troglodytes
gcagaggctgggcctg

SEQ ID NO: 247100 - DNA, 16 bp, P. troglodytes
gcagagggcagagggc

SEQ ID NO: 247101 - DNA, 16 bp, P. troglodytes
gcagagggggatctgg

SEQ ID NO: 247102 - DNA, 16 bp, P. troglodytes
gcagaggtggaagaaa

SEQ ID NO: 247103 - DNA, 16 bp, P. troglodytes
gcagaggtggcagtgg

SEQ ID NO: 247104 - DNA, 16 bp, P. troglodytes
gcagaggtggtagtga

SEQ ID NO: 247105 - DNA, 16 bp, P. troglodytes
gcagaggtggtggtga

SEQ ID NO: 247106 - DNA, 16 bp, P. troglodytes
gcagaggttacaatga

SEQ ID NO: 247107 - DNA, 17 bp, P. troglodytes
gcagaggttgcaatgaa

SEQ ID NO: 247108 - DNA, 16 bp, P. troglodytes
gcagaggttgcagtga

SEQ ID NO: 247109 - DNA, 16 bp, P. troglodytes
gcagaggttgtaatga

SEQ ID NO: 247110 - DNA, 16 bp, P. troglodytes
gcagagtctcaaagag

SEQ ID NO: 247111 - DNA, 18 bp, P. troglodytes
gcagagtctcactctgtt

SEQ ID NO: 247112 - DNA, 16 bp, P. troglodytes
gcagagtgaagagaca

SEQ ID NO: 247113 - DNA, 16 bp, P. troglodytes
gcagagtgggagaaaa

SEQ ID NO: 247114 - DNA, 16 bp, P. troglodytes
gcagagttgaatagtt

SEQ ID NO: 247115 - DNA, 16 bp, P. troglodytes
gcagagttgccacaaa

SEQ ID NO: 247116 - DNA, 16 bp, P. troglodytes
gcagagttgtaaactg

SEQ ID NO: 247117 - DNA, 16 bp, P. troglodytes
gcagagtttacagtga

SEQ ID NO: 247118 - DNA, 16 bp, P. troglodytes
gcagagtttggctggg

SEQ ID NO: 247119 - DNA, 16 bp, P. troglodytes
gcagatagatagatag

SEQ ID NO: 247120 - DNA, 16 bp, P. troglodytes
gcagatagctgccttc

SEQ ID NO: 247121 - DNA, 16 bp, P. troglodytes
gcagatcaagaccatc

SEQ ID NO: 247122 - DNA, 16 bp, P. troglodytes
gcagatcaccagaggt

SEQ ID NO: 247123 - DNA, 16 bp, P. troglodytes
gcagatcacctcaggt

SEQ ID NO: 247124 - DNA, 18 bp, P. troglodytes
gcagatcacgaggtcaga

SEQ ID NO: 247125 - DNA, 16 bp, P. troglodytes
gcagatcacgaggtga

SEQ ID NO: 247126 - DNA, 16 bp, P. troglodytes
gcagatcatctgaggt

SEQ ID NO: 247127 - DNA, 16 bp, P. troglodytes
gcagatctttcccatg

SEQ ID NO: 247128 - DNA, 16 bp, P. troglodytes
gcagatgaggaaaatg

SEQ ID NO: 247129 - DNA, 16 bp, P. troglodytes
gcagatgctcaagtcc

SEQ ID NO: 247130 - DNA, 16 bp, P. troglodytes
gcagatgctcaataaa

SEQ ID NO: 247131 - DNA, 16 bp, P. troglodytes
gcagatgctgatgcca

SEQ ID NO: 247132 - DNA, 16 bp, P. troglodytes
gcagatgctggtgcca

SEQ ID NO: 247133 - DNA, 16 bp, P. troglodytes
gcagatgcttaataaa

SEQ ID NO: 247134 - DNA, 16 bp, P. troglodytes
gcagatggggaaacag

SEQ ID NO: 247135 - DNA, 16 bp, P. troglodytes
gcagatgttcaataaa

SEQ ID NO: 247136 - DNA, 16 bp, P. troglodytes
gcagattatattttcc

SEQ ID NO: 247137 - DNA, 16 bp, P. troglodytes
gcagattcaaccaact

SEQ ID NO: 247138 - DNA, 16 bp, P. troglodytes
gcagattctacagaaa

SEQ ID NO: 247139 - DNA, 16 bp, P. troglodytes
gcagcaaaagcagtac

SEQ ID NO: 247140 - DNA, 16 bp, P. troglodytes
gcagcaaaagcagtgt

SEQ ID NO: 247141 - DNA, 16 bp, P. troglodytes
gcagcaaacagcagtg

SEQ ID NO: 247142 - DNA, 16 bp, P. troglodytes
gcagcaaaggaaacaa

SEQ ID NO: 247143 - DNA, 16 bp, P. troglodytes
gcagcaacaaggatgg

SEQ ID NO: 247144 - DNA, 16 bp, P. troglodytes
gcagcaacatgaatga

SEQ ID NO: 247145 - DNA, 16 bp, P. troglodytes
gcagcaagaaggccct

SEQ ID NO: 247146 - DNA, 16 bp, P. troglodytes
gcagcaagctgagatc

SEQ ID NO: 247147 - DNA, 16 bp, P. troglodytes
gcagcacatatactaa

SEQ ID NO: 247148 - DNA, 16 bp, P. troglodytes
gcagcacatgactgta

SEQ ID NO: 247149 - DNA, 16 bp, P. troglodytes
gcagcaccacacccag

SEQ ID NO: 247150 - DNA, 16 bp, P. troglodytes
gcagcacctctgcctg

SEQ ID NO: 247151 - DNA, 16 bp, P. troglodytes
gcagcacctgcatctt

SEQ ID NO: 247152 - DNA, 16 bp, P. troglodytes
gcagcactttgggagg

SEQ ID NO: 247153 - DNA, 16 bp, P. troglodytes
gcagcagaagagagag

SEQ ID NO: 247154 - DNA, 16 bp, P. troglodytes
gcagcagaatcccttg

SEQ ID NO: 247155 - DNA, 16 bp, P. troglodytes
gcagcagacaagacag

SEQ ID NO: 247156 - DNA, 16 bp, P. troglodytes
gcagcagagctgggat

SEQ ID NO: 247157 - DNA, 16 bp, P. troglodytes
gcagcagaggctgcag

SEQ ID NO: 247158 - DNA, 16 bp, P. troglodytes
gcagcagagggacctg

SEQ ID NO: 247159 - DNA, 16 bp, P. troglodytes
gcagcagcaagagaaa

SEQ ID NO: 247160 - DNA, 16 bp, P. troglodytes
gcagcagcaaggagaa

SEQ ID NO: 247161 - DNA, 16 bp, P. troglodytes
gcagcagcagcaacaa

SEQ ID NO: 247162 - DNA, 16 bp, P. troglodytes
gcagcagcagcaccag

SEQ ID NO: 247163 - DNA, 16 bp, P. troglodytes
gcagcagcagcagaag

SEQ ID NO: 247164 - DNA, 16 bp, P. troglodytes
gcagcagcagcagcta

SEQ ID NO: 247165 - DNA, 16 bp, P. troglodytes
gcagcagcagcagtgg

SEQ ID NO: 247166 - DNA, 16 bp, P. troglodytes
gcagcagcagtagtag

SEQ ID NO: 247167 - DNA, 16 bp, P. troglodytes
gcagcagccagcactg

SEQ ID NO: 247168 - DNA, 16 bp, P. troglodytes
gcagcagccaggctgg

SEQ ID NO: 247169 - DNA, 16 bp, P. troglodytes
gcagcagcccctgccc

SEQ ID NO: 247170 - DNA, 16 bp, P. troglodytes
gcagcagccctacaga

SEQ ID NO: 247171 - DNA, 16 bp, P. troglodytes
gcagcagctcatgcct

SEQ ID NO: 247172 - DNA, 16 bp, P. troglodytes
gcagcagctccagtca

SEQ ID NO: 247173 - DNA, 16 bp, P. troglodytes
gcagcagctgcagctg

SEQ ID NO: 247174 - DNA, 16 bp, P. troglodytes
gcagcagctgcctctg

SEQ ID NO: 247175 - DNA, 16 bp, P. troglodytes
gcagcagctgctccag

SEQ ID NO: 247176 - DNA, 16 bp, P. troglodytes
gcagcaggaaagagaa

SEQ ID NO: 247177 - DNA, 16 bp, P. troglodytes
gcagcaggaaagagag

SEQ ID NO: 247178 - DNA, 16 bp, P. troglodytes
gcagcaggagaaagga

SEQ ID NO: 247179 - DNA, 16 bp, P. troglodytes
gcagcaggagaatggc

SEQ ID NO: 247180 - DNA, 16 bp, P. troglodytes
gcagcaggagagaaag

SEQ ID NO: 247181 - DNA, 16 bp, P. troglodytes
gcagcaggagagacag

SEQ ID NO: 247182 - DNA, 16 bp, P. troglodytes
gcagcaggagagagag

SEQ ID NO: 247183 - DNA, 16 bp, P. troglodytes
gcagcaggagcatgtc

SEQ ID NO: 247184 - DNA, 16 bp, P. troglodytes
gcagcaggatggagtg

SEQ ID NO: 247185 - DNA, 16 bp, P. troglodytes
gcagcaggcaagagtg

SEQ ID NO: 247186 - DNA, 16 bp, P. troglodytes
gcagcaggcaggagag

SEQ ID NO: 247187 - DNA, 16 bp, P. troglodytes
gcagcaggggctgggg

SEQ ID NO: 247188 - DNA, 16 bp, P. troglodytes
gcagcaggtaaagaga

SEQ ID NO: 247189 - DNA, 16 bp, P. troglodytes
gcagcagttctcaaag

SEQ ID NO: 247190 - DNA, 16 bp, P. troglodytes
gcagcatccttggcct

SEQ ID NO: 247191 - DNA, 16 bp, P. troglodytes
gcagcatgagaacaga

SEQ ID NO: 247192 - DNA, 16 bp, P. troglodytes
gcagcatgcgcctgta

SEQ ID NO: 247193 - DNA, 16 bp, P. troglodytes
gcagcatgtgtcagaa

SEQ ID NO: 247194 - DNA, 16 bp, P. troglodytes
gcagccaagctctttg

SEQ ID NO: 247195 - DNA, 16 bp, P. troglodytes
gcagccaccgctgctg

SEQ ID NO: 247196 - DNA, 16 bp, P. troglodytes
gcagccactccccatt

SEQ ID NO: 247197 - DNA, 16 bp, P. troglodytes
gcagccagaaagaaag

SEQ ID NO: 247198 - DNA, 16 bp, P. troglodytes
gcagccagaggccaca

SEQ ID NO: 247199 - DNA, 16 bp, P. troglodytes
gcagccagaggctgca

SEQ ID NO: 247200 - DNA, 16 bp, P. troglodytes
gcagccaggagagagg

SEQ ID NO: 247201 - DNA, 16 bp, P. troglodytes
gcagccaggagggagg

SEQ ID NO: 247202 - DNA, 16 bp, P. troglodytes
gcagccaggcatggtg

SEQ ID NO: 247203 - DNA, 16 bp, P. troglodytes
gcagccaggccttccc

SEQ ID NO: 247204 - DNA, 16 bp, P. troglodytes
gcagccaggcgcagtg

SEQ ID NO: 247205 - DNA, 16 bp, P. troglodytes
gcagccatagaaagga

SEQ ID NO: 247206 - DNA, 16 bp, P. troglodytes
gcagccatcaccacag

SEQ ID NO: 247207 - DNA, 16 bp, P. troglodytes
gcagccatcttggacc

SEQ ID NO: 247208 - DNA, 16 bp, P. troglodytes
gcagccatgaaaaaga

SEQ ID NO: 247209 - DNA, 16 bp, P. troglodytes
gcagcccaagctgtac

SEQ ID NO: 247210 - DNA, 16 bp, P. troglodytes
gcagcccaccatgccc

SEQ ID NO: 247211 - DNA, 16 bp, P. troglodytes
gcagcccagagggagc

SEQ ID NO: 247212 - DNA, 16 bp, P. troglodytes
gcagcccagcccagcc

SEQ ID NO: 247213 - DNA, 16 bp, P. troglodytes
gcagcccagcccccag

SEQ ID NO: 247214 - DNA, 16 bp, P. troglodytes
gcagcccaggatggct

SEQ ID NO: 247215 - DNA, 16 bp, P. troglodytes
gcagcccaggctggag

SEQ ID NO: 247216 - DNA, 16 bp, P. troglodytes
gcagcccagggctgct

SEQ ID NO: 247217 - DNA, 16 bp, P. troglodytes
gcagcccatctggagc

SEQ ID NO: 247218 - DNA, 16 bp, P. troglodytes
gcagcccccaaatcat

SEQ ID NO: 247219 - DNA, 16 bp, P. troglodytes
gcagcccctgccctcc

SEQ ID NO: 247220 - DNA, 16 bp, P. troglodytes
gcagccctcccacctc

SEQ ID NO: 247221 - DNA, 16 bp, P. troglodytes
gcagccctgacctcct

SEQ ID NO: 247222 - DNA, 16 bp, P. troglodytes
gcagccctgagggctg

SEQ ID NO: 247223 - DNA, 17 bp, P. troglodytes
gcagccgcagcaagacc

SEQ ID NO: 247224 - DNA, 16 bp, P. troglodytes
gcagccgccccatctg

SEQ ID NO: 247225 - DNA, 16 bp, P. troglodytes
gcagcctcaacatccc

SEQ ID NO: 247226 - DNA, 16 bp, P. troglodytes
gcagcctcaaccccct

SEQ ID NO: 247227 - DNA, 16 bp, P. troglodytes
gcagcctcagcctcac

SEQ ID NO: 247228 - DNA, 16 bp, P. troglodytes
gcagcctccaactcct

SEQ ID NO: 247229 - DNA, 16 bp, P. troglodytes
gcagcctccaccttct

SEQ ID NO: 247230 - DNA, 16 bp, P. troglodytes
gcagcctccatctcca

SEQ ID NO: 247231 - DNA, 16 bp, P. troglodytes
gcagcctccctgcctg

SEQ ID NO: 247232 - DNA, 16 bp, P. troglodytes
gcagcctccctggcct

SEQ ID NO: 247233 - DNA, 16 bp, P. troglodytes
gcagcctccgcctccc

SEQ ID NO: 247234 - DNA, 16 bp, P. troglodytes
gcagcctccgcctcct

SEQ ID NO: 247235 - DNA, 16 bp, P. troglodytes
gcagcctccgcctctc

SEQ ID NO: 247236 - DNA, 16 bp, P. troglodytes
gcagcctccgcctgcc

SEQ ID NO: 247237 - DNA, 16 bp, P. troglodytes
gcagcctcctcctccc

SEQ ID NO: 247238 - DNA, 18 bp, P. troglodytes
gcagcctcctgagtagct

SEQ ID NO: 247239 - DNA, 16 bp, P. troglodytes
gcagcctcgacctccc

SEQ ID NO: 247240 - DNA, 16 bp, P. troglodytes
gcagcctcgacttcct

SEQ ID NO: 247241 - DNA, 16 bp, P. troglodytes
gcagcctctgcccccc

SEQ ID NO: 247242 - DNA, 16 bp, P. troglodytes
gcagcctctgccccct

SEQ ID NO: 247243 - DNA, 16 bp, P. troglodytes
gcagcctctgcctacc

SEQ ID NO: 247244 - DNA, 16 bp, P. troglodytes
gcagcctctgcctcgc

SEQ ID NO: 247245 - DNA, 16 bp, P. troglodytes
gcagcctctgcctctg

SEQ ID NO: 247246 - DNA, 16 bp, P. troglodytes
gcagcctgaacagact

SEQ ID NO: 247247 - DNA, 16 bp, P. troglodytes
gcagcctgacaatgag

SEQ ID NO: 247248 - DNA, 16 bp, P. troglodytes
gcagcctgaccaacat

SEQ ID NO: 247249 - DNA, 16 bp, P. troglodytes
gcagcctgagctgccc

SEQ ID NO: 247250 - DNA, 17 bp, P. troglodytes
gcagcctgcttttattc

SEQ ID NO: 247251 - DNA, 16 bp, P. troglodytes
gcagcctggacaacat

SEQ ID NO: 247252 - DNA, 16 bp, P. troglodytes
gcagcctggagaccca

SEQ ID NO: 247253 - DNA, 16 bp, P. troglodytes
gcagcctggagctcct

SEQ ID NO: 247254 - DNA, 16 bp, P. troglodytes
gcagcctggccaacat

SEQ ID NO: 247255 - DNA, 19 bp, P. troglodytes
gcagcctggccaacatggc

SEQ ID NO: 247256 - DNA, 27 bp, P. troglodytes
gcagcctggccaacatggtgaaaccct

SEQ ID NO: 247257 - DNA, 16 bp, P. troglodytes
gcagcctggcctggga

SEQ ID NO: 247258 - DNA, 16 bp, P. troglodytes
gcagcctgggcaacac

SEQ ID NO: 247259 - DNA, 16 bp, P. troglodytes
gcagcctgggcagcag

SEQ ID NO: 247260 - DNA, 16 bp, P. troglodytes
gcagcctggggacttg

SEQ ID NO: 247261 - DNA, 16 bp, P. troglodytes
gcagcctgggggacag

SEQ ID NO: 247262 - DNA, 16 bp, P. troglodytes
gcagcctgtacaggaa

SEQ ID NO: 247263 - DNA, 16 bp, P. troglodytes
gcagccttaacttccc

SEQ ID NO: 247264 - DNA, 16 bp, P. troglodytes
gcagccttgacctctc

SEQ ID NO: 247265 - DNA, 16 bp, P. troglodytes
gcagccttgatctcca

SEQ ID NO: 247266 - DNA, 16 bp, P. troglodytes
gcagccttgatttccc

SEQ ID NO: 247267 - DNA, 16 bp, P. troglodytes
gcagcgagcccagatc

SEQ ID NO: 247268 - DNA, 16 bp, P. troglodytes
gcagcgccagtgggcc

SEQ ID NO: 247269 - DNA, 16 bp, P. troglodytes
gcagcgcccccaggct

SEQ ID NO: 247270 - DNA, 16 bp, P. troglodytes
gcagcgctggtgggcc

SEQ ID NO: 247271 - DNA, 16 bp, P. troglodytes
gcagcggcagcagcgg

SEQ ID NO: 247272 - DNA, 16 bp, P. troglodytes
gcagctaacagacaca

SEQ ID NO: 247273 - DNA, 16 bp, P. troglodytes
gcagctcagcacagag

SEQ ID NO: 247274 - DNA, 16 bp, P. troglodytes
gcagctcccagagaga

SEQ ID NO: 247275 - DNA, 16 bp, P. troglodytes
gcagctcccagtgtga

SEQ ID NO: 247276 - DNA, 16 bp, P. troglodytes
gcagctcctctctgca

SEQ ID NO: 247277 - DNA, 16 bp, P. troglodytes
gcagctccttcaagca

SEQ ID NO: 247278 - DNA, 16 bp, P. troglodytes
gcagctccttgccagc

SEQ ID NO: 247279 - DNA, 16 bp, P. troglodytes
gcagctcctttctgca

SEQ ID NO: 247280 - DNA, 16 bp, P. troglodytes
gcagctctgccctgtg

SEQ ID NO: 247281 - DNA, 16 bp, P. troglodytes
gcagctctggacagag

SEQ ID NO: 247282 - DNA, 16 bp, P. troglodytes
gcagctgaacagcatc

SEQ ID NO: 247283 - DNA, 16 bp, P. troglodytes
gcagctgaagcaggag

SEQ ID NO: 247284 - DNA, 16 bp, P. troglodytes
gcagctgagacacagg

SEQ ID NO: 247285 - DNA, 16 bp, P. troglodytes
gcagctgaggcagaga

SEQ ID NO: 247286 - DNA, 16 bp, P. troglodytes
gcagctgaggcaggag

SEQ ID NO: 247287 - DNA, 16 bp, P. troglodytes
gcagctgaggctgcag

SEQ ID NO: 247288 - DNA, 16 bp, P. troglodytes
gcagctgagggtcctg

SEQ ID NO: 247289 - DNA, 16 bp, P. troglodytes
gcagctgagggtgctg

SEQ ID NO: 247290 - DNA, 16 bp, P. troglodytes
gcagctgatcctgaca

SEQ ID NO: 247291 - DNA, 16 bp, P. troglodytes
gcagctgatctgggca

SEQ ID NO: 247292 - DNA, 16 bp, P. troglodytes
gcagctgcagagggtg

SEQ ID NO: 247293 - DNA, 16 bp, P. troglodytes
gcagctgcagcagcag

SEQ ID NO: 247294 - DNA, 16 bp, P. troglodytes
gcagctgcagctgcac

SEQ ID NO: 247295 - DNA, 16 bp, P. troglodytes
gcagctgccctctgcc

SEQ ID NO: 247296 - DNA, 16 bp, P. troglodytes
gcagctgctggcccgg

SEQ ID NO: 247297 - DNA, 16 bp, P. troglodytes
gcagctgctggcctgg

SEQ ID NO: 247298 - DNA, 16 bp, P. troglodytes
gcagctggaccaggtg

SEQ ID NO: 247299 - DNA, 16 bp, P. troglodytes
gcagctggaggccact

SEQ ID NO: 247300 - DNA, 16 bp, P. troglodytes
gcagctggaggccatt

SEQ ID NO: 247301 - DNA, 16 bp, P. troglodytes
gcagctggccgggcag

SEQ ID NO: 247302 - DNA, 16 bp, P. troglodytes
gcagctgggaagcagg

SEQ ID NO: 247303 - DNA, 16 bp, P. troglodytes
gcagctgggaagcttg

SEQ ID NO: 247304 - DNA, 16 bp, P. troglodytes
gcagctgggactacag

SEQ ID NO: 247305 - DNA, 16 bp, P. troglodytes
gcagctgggatgcagg

SEQ ID NO: 247306 - DNA, 16 bp, P. troglodytes
gcagctgggcctgggg

SEQ ID NO: 247307 - DNA, 16 bp, P. troglodytes
gcagctggggcaggag

SEQ ID NO: 247308 - DNA, 16 bp, P. troglodytes
gcagctggggctgcag

SEQ ID NO: 247309 - DNA, 16 bp, P. troglodytes
gcagctggggctgggg

SEQ ID NO: 247310 - DNA, 16 bp, P. troglodytes
gcagctggtcatcctg

SEQ ID NO: 247311 - DNA, 16 bp, P. troglodytes
gcagctggtgccaggg

SEQ ID NO: 247312 - DNA, 16 bp, P. troglodytes
gcagctgtgccaatag

SEQ ID NO: 247313 - DNA, 16 bp, P. troglodytes
gcagctgtgcctggga

SEQ ID NO: 247314 - DNA, 16 bp, P. troglodytes
gcagctgtgggggctg

SEQ ID NO: 247315 - DNA, 16 bp, P. troglodytes
gcagctgtgtgtgtgt

SEQ ID NO: 247316 - DNA, 16 bp, P. troglodytes
gcagcttcaaattcct

SEQ ID NO: 247317 - DNA, 16 bp, P. troglodytes
gcagcttggcaaagcc

SEQ ID NO: 247318 - DNA, 16 bp, P. troglodytes
gcagcttggctcacag

SEQ ID NO: 247319 - DNA, 16 bp, P. troglodytes
gcagctttggaactgg

SEQ ID NO: 247320 - DNA, 16 bp, P. troglodytes
gcaggaaaaagaaata

SEQ ID NO: 247321 - DNA, 16 bp, P. troglodytes
gcaggaaaacaggaat

SEQ ID NO: 247322 - DNA, 38 bp, P. troglodytes
gcaggaaagatccaaaattgacaccctaacatcacaat

SEQ ID NO: 247323 - DNA, 16 bp, P. troglodytes
gcaggaaatacagaga

SEQ ID NO: 247324 - DNA, 16 bp, P. troglodytes
gcaggaacagaaaact

SEQ ID NO: 247325 - DNA, 16 bp, P. troglodytes
gcaggaaccagggctg

SEQ ID NO: 247326 - DNA, 16 bp, P. troglodytes
gcaggaactacaggca

SEQ ID NO: 247327 - DNA, 16 bp, P. troglodytes
gcaggaagactggaag

SEQ ID NO: 247328 - DNA, 16 bp, P. troglodytes
gcaggaagagagctgg

SEQ ID NO: 247329 - DNA, 16 bp, P. troglodytes
gcaggaatgaaaggaa

SEQ ID NO: 247330 - DNA, 16 bp, P. troglodytes
gcaggaatgggaggca

SEQ ID NO: 247331 - DNA, 16 bp, P. troglodytes
gcaggacctggtggga

SEQ ID NO: 247332 - DNA, 16 bp, P. troglodytes
gcaggactggaagctg

SEQ ID NO: 247333 - DNA, 16 bp, P. troglodytes
gcaggactggggaggc

SEQ ID NO: 247334 - DNA, 16 bp, P. troglodytes
gcaggacttggtgtcc

SEQ ID NO: 247335 - DNA, 16 bp, P. troglodytes
gcaggagaatccctta

SEQ ID NO: 247336 - DNA, 17 bp, P. troglodytes
gcaggagaatctgttga

SEQ ID NO: 247337 - DNA, 24 bp, P. troglodytes
gcaggagacagatgccttcctctt

SEQ ID NO: 247338 - DNA, 17 bp, P. troglodytes
gcaggagaccagggcat

SEQ ID NO: 247339 - DNA, 16 bp, P. troglodytes
gcaggagagagacagc

SEQ ID NO: 247340 - DNA, 16 bp, P. troglodytes
gcaggagaggatgtgg

SEQ ID NO: 247341 - DNA, 16 bp, P. troglodytes
gcaggagagggctccc

SEQ ID NO: 247342 - DNA, 16 bp, P. troglodytes
gcaggagatgaggctg

SEQ ID NO: 247343 - DNA, 16 bp, P. troglodytes
gcaggagcaaaatgcc

SEQ ID NO: 247344 - DNA, 16 bp, P. troglodytes
gcaggagcagcagcag

SEQ ID NO: 247345 - DNA, 16 bp, P. troglodytes
gcaggagcaggagcag

SEQ ID NO: 247346 - DNA, 16 bp, P. troglodytes
gcaggagcaggaggaa

SEQ ID NO: 247347 - DNA, 16 bp, P. troglodytes
gcaggagccaagaagt

SEQ ID NO: 247348 - DNA, 16 bp, P. troglodytes
gcaggagccaggaaca

SEQ ID NO: 247349 - DNA, 16 bp, P. troglodytes
gcaggagccagggcaa

SEQ ID NO: 247350 - DNA, 16 bp, P. troglodytes
gcaggagccctgcccc

SEQ ID NO: 247351 - DNA, 16 bp, P. troglodytes
gcaggagctgggcctg

SEQ ID NO: 247352 - DNA, 16 bp, P. troglodytes
gcaggaggagtgcttg

SEQ ID NO: 247353 - DNA, 16 bp, P. troglodytes
gcaggaggattctttg

SEQ ID NO: 247354 - DNA, 16 bp, P. troglodytes
gcaggaggcagccaaa

SEQ ID NO: 247355 - DNA, 17 bp, P. troglodytes
gcaggaggtggaggttg

SEQ ID NO: 247356 - DNA, 16 bp, P. troglodytes
gcaggaggttcacttg

SEQ ID NO: 247357 - DNA, 16 bp, P. troglodytes
gcaggagtggaggcag

SEQ ID NO: 247358 - DNA, 16 bp, P. troglodytes
gcaggatcagaaaacc

SEQ ID NO: 247359 - DNA, 16 bp, P. troglodytes
gcaggatggatgggga

SEQ ID NO: 247360 - DNA, 16 bp, P. troglodytes
gcaggatgtgcagatt

SEQ ID NO: 247361 - DNA, 16 bp, P. troglodytes
gcaggcaagcgagtga

SEQ ID NO: 247362 - DNA, 16 bp, P. troglodytes
gcaggcagaggcagga

SEQ ID NO: 247363 - DNA, 16 bp, P. troglodytes
gcaggcagatcacatg

SEQ ID NO: 247364 - DNA, 16 bp, P. troglodytes
gcaggcagatgacctg

SEQ ID NO: 247365 - DNA, 16 bp, P. troglodytes
gcaggcagatggcttg

SEQ ID NO: 247366 - DNA, 16 bp, P. troglodytes
gcaggcagcctccaga

SEQ ID NO: 247367 - DNA, 16 bp, P. troglodytes
gcaggcaggagccagg

SEQ ID NO: 247368 - DNA, 16 bp, P. troglodytes
gcaggcaggagtgggg

SEQ ID NO: 247369 - DNA, 16 bp, P. troglodytes
gcaggcaggcagacag

SEQ ID NO: 247370 - DNA, 16 bp, P. troglodytes
gcaggcaggcaggagg

SEQ ID NO: 247371 - DNA, 17 bp, P. troglodytes
gcaggcatgcaccacca

SEQ ID NO: 247372 - DNA, 16 bp, P. troglodytes
gcaggcatggtggcac

SEQ ID NO: 247373 - DNA, 16 bp, P. troglodytes
gcaggcatggtggctc

SEQ ID NO: 247374 - DNA, 16 bp, P. troglodytes
gcaggcatgtgccacc

SEQ ID NO: 247375 - DNA, 16 bp, P. troglodytes
gcaggcccctgtagtc

SEQ ID NO: 247376 - DNA, 16 bp, P. troglodytes
gcaggcctgagactgc

SEQ ID NO: 247377 - DNA, 16 bp, P. troglodytes
gcaggcgccaccacgc

SEQ ID NO: 247378 - DNA, 16 bp, P. troglodytes
gcaggctgaagggctc

SEQ ID NO: 247379 - DNA, 17 bp, P. troglodytes
gcaggctgcaggtcctg

SEQ ID NO: 247380 - DNA, 17 bp, P. troglodytes
gcaggctggagtgcagt

SEQ ID NO: 247381 - DNA, 16 bp, P. troglodytes
gcaggctggagtgtag

SEQ ID NO: 247382 - DNA, 16 bp, P. troglodytes
gcaggctgggggagag

SEQ ID NO: 247383 - DNA, 16 bp, P. troglodytes
gcaggctggtcttgaa

SEQ ID NO: 247384 - DNA, 16 bp, P. troglodytes
gcaggctgtacaggag

SEQ ID NO: 247385 - DNA, 16 bp, P. troglodytes
gcaggcttctgcctgg

SEQ ID NO: 247386 - DNA, 16 bp, P. troglodytes
gcagggaacctaaggc

SEQ ID NO: 247387 - DNA, 16 bp, P. troglodytes
gcagggacatggttgg

SEQ ID NO: 247388 - DNA, 16 bp, P. troglodytes
gcagggacctctgccc

SEQ ID NO: 247389 - DNA, 16 bp, P. troglodytes
gcagggactacaggcg

SEQ ID NO: 247390 - DNA, 16 bp, P. troglodytes
gcagggactatgtctt

SEQ ID NO: 247391 - DNA, 16 bp, P. troglodytes
gcagggcacagccaaa

SEQ ID NO: 247392 - DNA, 16 bp, P. troglodytes
gcagggcagggcaagg

SEQ ID NO: 247393 - DNA, 16 bp, P. troglodytes
gcagggccaggctggg

SEQ ID NO: 247394 - DNA, 16 bp, P. troglodytes
gcagggccaggtgtgg

SEQ ID NO: 247395 - DNA, 16 bp, P. troglodytes
gcagggcctgggcctg

SEQ ID NO: 247396 - DNA, 16 bp, P. troglodytes
gcagggcgcagtggct

SEQ ID NO: 247397 - DNA, 16 bp, P. troglodytes
gcagggctgaggcagg

SEQ ID NO: 247398 - DNA, 16 bp, P. troglodytes
gcagggctgcagtgag

SEQ ID NO: 247399 - DNA, 16 bp, P. troglodytes
gcagggctggaggtgg

SEQ ID NO: 247400 - DNA, 16 bp, P. troglodytes
gcagggctgggactgg

SEQ ID NO: 247401 - DNA, 16 bp, P. troglodytes
gcagggctgggcacgg

SEQ ID NO: 247402 - DNA, 16 bp, P. troglodytes
gcagggctgggggctg

SEQ ID NO: 247403 - DNA, 16 bp, P. troglodytes
gcagggctgtgtttct

SEQ ID NO: 247404 - DNA, 22 bp, P. troglodytes
gcagggcttgggacctgcagcc

SEQ ID NO: 247405 - DNA, 16 bp, P. troglodytes
gcaggggcacaatctc

SEQ ID NO: 247406 - DNA, 16 bp, P. troglodytes
gcaggggccaggcagg

SEQ ID NO: 247407 - DNA, 16 bp, P. troglodytes
gcaggggctgaggcag

SEQ ID NO: 247408 - DNA, 16 bp, P. troglodytes
gcaggggctggggctg

SEQ ID NO: 247409 - DNA, 16 bp, P. troglodytes
gcaggggtgaagccct

SEQ ID NO: 247410 - DNA, 16 bp, P. troglodytes
gcaggggtgaggcagg

SEQ ID NO: 247411 - DNA, 16 bp, P. troglodytes
gcagggtccagggacc

SEQ ID NO: 247412 - DNA, 26 bp, P. troglodytes
gcagggtgataataaggagaaggtca

SEQ ID NO: 247413 - DNA, 16 bp, P. troglodytes
gcagggtgcagtggct

SEQ ID NO: 247414 - DNA, 16 bp, P. troglodytes
gcagggtttgagagga

SEQ ID NO: 247415 - DNA, 16 bp, P. troglodytes
gcaggtactcagtaaa

SEQ ID NO: 247416 - DNA, 16 bp, P. troglodytes
gcaggtatgtgtgtgt

SEQ ID NO: 247417 - DNA, 16 bp, P. troglodytes
gcaggtcagtgggtgc

SEQ ID NO: 247418 - DNA, 18 bp, P. troglodytes
gcaggtgatccacccgcc

SEQ ID NO: 247419 - DNA, 16 bp, P. troglodytes
gcaggtgcatcacctg

SEQ ID NO: 247420 - DNA, 16 bp, P. troglodytes
gcaggtgcctgtccag

SEQ ID NO: 247421 - DNA, 16 bp, P. troglodytes
gcaggtggatcaccag

SEQ ID NO: 247422 - DNA, 17 bp, P. troglodytes
gcaggtggatctcttga

SEQ ID NO: 247423 - DNA, 16 bp, P. troglodytes
gcaggtggatgacctg

SEQ ID NO: 247424 - DNA, 16 bp, P. troglodytes
gcaggtggatgatgag

SEQ ID NO: 247425 - DNA, 16 bp, P. troglodytes
gcaggtggatttcttg

SEQ ID NO: 247426 - DNA, 16 bp, P. troglodytes
gcaggtggtgaagcca

SEQ ID NO: 247427 - DNA, 17 bp, P. troglodytes
gcaggtgtggtggctca

SEQ ID NO: 247428 - DNA, 16 bp, P. troglodytes
gcaggtttgccctgag

SEQ ID NO: 247429 - DNA, 16 bp, P. troglodytes
gcagtacttttttttt

SEQ ID NO: 247430 - DNA, 16 bp, P. troglodytes
gcagtagaaaagaaaa

SEQ ID NO: 247431 - DNA, 16 bp, P. troglodytes
gcagtagaatcacttg

SEQ ID NO: 247432 - DNA, 16 bp, P. troglodytes
gcagtatctgcaaagc

SEQ ID NO: 247433 - DNA, 16 bp, P. troglodytes
gcagtatttgggcaga

SEQ ID NO: 247434 - DNA, 16 bp, P. troglodytes
gcagtattttaaaata

SEQ ID NO: 247435 - DNA, 16 bp, P. troglodytes
gcagtcaccctgaagt

SEQ ID NO: 247436 - DNA, 16 bp, P. troglodytes
gcagtcagccatgatc

SEQ ID NO: 247437 - DNA, 16 bp, P. troglodytes
gcagtcccagctactt

SEQ ID NO: 247438 - DNA, 16 bp, P. troglodytes
gcagtcccagctcctc

SEQ ID NO: 247439 - DNA, 16 bp, P. troglodytes
gcagtcctccagcctt

SEQ ID NO: 247440 - DNA, 16 bp, P. troglodytes
gcagtcctcccagctc

SEQ ID NO: 247441 - DNA, 16 bp, P. troglodytes
gcagtccttctgcctt

SEQ ID NO: 247442 - DNA, 16 bp, P. troglodytes
gcagtccttggcattc

SEQ ID NO: 247443 - DNA, 16 bp, P. troglodytes
gcagtctcactctgtc

SEQ ID NO: 247444 - DNA, 16 bp, P. troglodytes
gcagtctctgcctcct

SEQ ID NO: 247445 - DNA, 16 bp, P. troglodytes
gcagtctggctctgtc

SEQ ID NO: 247446 - DNA, 17 bp, P. troglodytes
gcagtctgtcccttagc

SEQ ID NO: 247447 - DNA, 16 bp, P. troglodytes
gcagtcttgctctgtt

SEQ ID NO: 247448 - DNA, 16 bp, P. troglodytes
gcagtcttggctcact

SEQ ID NO: 247449 - DNA, 16 bp, P. troglodytes
gcagtcttgtgagact

SEQ ID NO: 247450 - DNA, 16 bp, P. troglodytes
gcagtgaaaccatcag

SEQ ID NO: 247451 - DNA, 16 bp, P. troglodytes
gcagtgacactgaaaa

SEQ ID NO: 247452 - DNA, 16 bp, P. troglodytes
gcagtgagcagtgagc

SEQ ID NO: 247453 - DNA, 16 bp, P. troglodytes
gcagtgagctctgatc

SEQ ID NO: 247454 - DNA, 16 bp, P. troglodytes
gcagtgagtggaaatc

SEQ ID NO: 247455 - DNA, 16 bp, P. troglodytes
gcagtgcactgagcat

SEQ ID NO: 247456 - DNA, 16 bp, P. troglodytes
gcagtgcagacccaaa

SEQ ID NO: 247457 - DNA, 16 bp, P. troglodytes
gcagtgcaggagggaa

SEQ ID NO: 247458 - DNA, 16 bp, P. troglodytes
gcagtgccagcccacc

SEQ ID NO: 247459 - DNA, 16 bp, P. troglodytes
gcagtgcctagtggag

SEQ ID NO: 247460 - DNA, 16 bp, P. troglodytes
gcagtgctaagaggaa

SEQ ID NO: 247461 - DNA, 16 bp, P. troglodytes
gcagtgctgggggacc

SEQ ID NO: 247462 - DNA, 16 bp, P. troglodytes
gcagtggagatggaaa

SEQ ID NO: 247463 - DNA, 16 bp, P. troglodytes
gcagtggagatggaga

SEQ ID NO: 247464 - DNA, 16 bp, P. troglodytes
gcagtggcaaaatctc

SEQ ID NO: 247465 - DNA, 16 bp, P. troglodytes
gcagtggcaagatttc

SEQ ID NO: 247466 - DNA, 16 bp, P. troglodytes
gcagtggcaatggcag

SEQ ID NO: 247467 - DNA, 16 bp, P. troglodytes
gcagtggcacaaccat

SEQ ID NO: 247468 - DNA, 16 bp, P. troglodytes
gcagtggcacagtcct

SEQ ID NO: 247469 - DNA, 16 bp, P. troglodytes
gcagtggcaccatcac

SEQ ID NO: 247470 - DNA, 16 bp, P. troglodytes
gcagtggcactgtctt

SEQ ID NO: 247471 - DNA, 16 bp, P. troglodytes
gcagtggcaggatctc

SEQ ID NO: 247472 - DNA, 16 bp, P. troglodytes
gcagtggcaggcacct

SEQ ID NO: 247473 - DNA, 16 bp, P. troglodytes
gcagtggcagtggcag

SEQ ID NO: 247474 - DNA, 16 bp, P. troglodytes
gcagtggcatgatcac

SEQ ID NO: 247475 - DNA, 16 bp, P. troglodytes
gcagtggcatgatgtc

SEQ ID NO: 247476 - DNA, 16 bp, P. troglodytes
gcagtggcgtgatgat

SEQ ID NO: 247477 - DNA, 16 bp, P. troglodytes
gcagtggctcacacct

SEQ ID NO: 247478 - DNA, 16 bp, P. troglodytes
gcagtggctcacactt

SEQ ID NO: 247479 - DNA, 16 bp, P. troglodytes
gcagtggctcagacct

SEQ ID NO: 247480 - DNA, 16 bp, P. troglodytes
gcagtggctcagcctg

SEQ ID NO: 247481 - DNA, 16 bp, P. troglodytes
gcagtggggatggaga

SEQ ID NO: 247482 - DNA, 16 bp, P. troglodytes
gcagtggtccccaacc

SEQ ID NO: 247483 - DNA, 16 bp, P. troglodytes
gcagtggtgcactctt

SEQ ID NO: 247484 - DNA, 16 bp, P. troglodytes
gcagtggtgcagttat

SEQ ID NO: 247485 - DNA, 16 bp, P. troglodytes
gcagtggtgcattcat

SEQ ID NO: 247486 - DNA, 16 bp, P. troglodytes
gcagtggtgccatttc

SEQ ID NO: 247487 - DNA, 16 bp, P. troglodytes
gcagtggtggcagtgg

SEQ ID NO: 247488 - DNA, 16 bp, P. troglodytes
gcagtggtggtggcag

SEQ ID NO: 247489 - DNA, 16 bp, P. troglodytes
gcagtggtgtgatttt

SEQ ID NO: 247490 - DNA, 16 bp, P. troglodytes
gcagtggtgtgctggt

SEQ ID NO: 247491 - DNA, 16 bp, P. troglodytes
gcagtgtgagaagaga

SEQ ID NO: 247492 - DNA, 16 bp, P. troglodytes
gcagtgtgcagaggga

SEQ ID NO: 247493 - DNA, 16 bp, P. troglodytes
gcagtgtgcgcctgta

SEQ ID NO: 247494 - DNA, 16 bp, P. troglodytes
gcagtgtgtgtgtgtg

SEQ ID NO: 247495 - DNA, 16 bp, P. troglodytes
gcagtgttaagaagga

SEQ ID NO: 247496 - DNA, 16 bp, P. troglodytes
gcagtgttgccatctc

SEQ ID NO: 247497 - DNA, 16 bp, P. troglodytes
gcagtgttggtttctt

SEQ ID NO: 247498 - DNA, 16 bp, P. troglodytes
gcagtgtttctcaacc

SEQ ID NO: 247499 - DNA, 16 bp, P. troglodytes
gcagtgttttgtaatt

SEQ ID NO: 247500 - DNA, 16 bp, P. troglodytes
gcagttcccctgcctc

SEQ ID NO: 247501 - DNA, 16 bp, P. troglodytes
gcagttcctggcatct

SEQ ID NO: 247502 - DNA, 16 bp, P. troglodytes
gcagttgcaccatttt

SEQ ID NO: 247503 - DNA, 16 bp, P. troglodytes
gcagttggagaccagc

SEQ ID NO: 247504 - DNA, 16 bp, P. troglodytes
gcagttgtaacacagt

SEQ ID NO: 247505 - DNA, 16 bp, P. troglodytes
gcagttgtcagctaaa

SEQ ID NO: 247506 - DNA, 16 bp, P. troglodytes
gcagtttcactcctga

SEQ ID NO: 247507 - DNA, 16 bp, P. troglodytes
gcagtttcatatggtt

SEQ ID NO: 247508 - DNA, 16 bp, P. troglodytes
gcagtttcctcatctg

SEQ ID NO: 247509 - DNA, 16 bp, P. troglodytes
gcagtttctcacaaaa

SEQ ID NO: 247510 - DNA, 16 bp, P. troglodytes
gcagtttgactatgat

SEQ ID NO: 247511 - DNA, 16 bp, P. troglodytes
gcagtttggctcacag

SEQ ID NO: 247512 - DNA, 16 bp, P. troglodytes
gcagtttgtgtgtgtg

SEQ ID NO: 247513 - DNA, 16 bp, P. troglodytes
gcagtttttaaaaact

SEQ ID NO: 247514 - DNA, 16 bp, P. troglodytes
gcataaaaatggacag

SEQ ID NO: 247515 - DNA, 16 bp, P. troglodytes
gcataagaataataca

SEQ ID NO: 247516 - DNA, 16 bp, P. troglodytes
gcataagtaaccagga

SEQ ID NO: 247517 - DNA, 16 bp, P. troglodytes
gcataataattgtaca

SEQ ID NO: 247518 - DNA, 16 bp, P. troglodytes
gcataatgtttttgag

SEQ ID NO: 247519 - DNA, 16 bp, P. troglodytes
gcatacaagggacata

SEQ ID NO: 247520 - DNA, 16 bp, P. troglodytes
gcatacctcagagata

SEQ ID NO: 247521 - DNA, 19 bp, P. troglodytes
gcatactgaatgggcaaaa

SEQ ID NO: 247522 - DNA, 16 bp, P. troglodytes
gcatagagttgttcat

SEQ ID NO: 247523 - DNA, 16 bp, P. troglodytes
gcatagggagaccctg

SEQ ID NO: 247524 - DNA, 16 bp, P. troglodytes
gcatagtgacttcctt

SEQ ID NO: 247525 - DNA, 16 bp, P. troglodytes
gcatatagaaaacaaa

SEQ ID NO: 247526 - DNA, 16 bp, P. troglodytes
gcatatatacatatat

SEQ ID NO: 247527 - DNA, 16 bp, P. troglodytes
gcatatatatatacac

SEQ ID NO: 247528 - DNA, 16 bp, P. troglodytes
gcatatatgtgtacat

SEQ ID NO: 247529 - DNA, 16 bp, P. troglodytes
gcatatattaattagc

SEQ ID NO: 247530 - DNA, 16 bp, P. troglodytes
gcatatattgagatga

SEQ ID NO: 247531 - DNA, 16 bp, P. troglodytes
gcatatccatgctgta

SEQ ID NO: 247532 - DNA, 16 bp, P. troglodytes
gcatatgaaaaaaaat

SEQ ID NO: 247533 - DNA, 16 bp, P. troglodytes
gcatatgaaaaaaagc

SEQ ID NO: 247534 - DNA, 16 bp, P. troglodytes
gcatatgttgaaacaa

SEQ ID NO: 247535 - DNA, 16 bp, P. troglodytes
gcatattaaaggctct

SEQ ID NO: 247536 - DNA, 16 bp, P. troglodytes
gcatcaaggccagagg

SEQ ID NO: 247537 - DNA, 16 bp, P. troglodytes
gcatcacctggaagct

SEQ ID NO: 247538 - DNA, 16 bp, P. troglodytes
gcatcactggccatca

SEQ ID NO: 247539 - DNA, 16 bp, P. troglodytes
gcatcacttaatgaca

SEQ ID NO: 247540 - DNA, 16 bp, P. troglodytes
gcatcagaatcacctg

SEQ ID NO: 247541 - DNA, 16 bp, P. troglodytes
gcatcagaattgcctg

SEQ ID NO: 247542 - DNA, 16 bp, P. troglodytes
gcatcagcttcctgag

SEQ ID NO: 247543 - DNA, 22 bp, P. troglodytes
gcatcatagacaatgtaaagga

SEQ ID NO: 247544 - DNA, 16 bp, P. troglodytes
gcatcatgcaatatat

SEQ ID NO: 247545 - DNA, 16 bp, P. troglodytes
gcatcatgcagtatac

SEQ ID NO: 247546 - DNA, 16 bp, P. troglodytes
gcatcatggtgaaacc

SEQ ID NO: 247547 - DNA, 16 bp, P. troglodytes
gcatcatttattgaac

SEQ ID NO: 247548 - DNA, 16 bp, P. troglodytes
gcatcattttgcattc

SEQ ID NO: 247549 - DNA, 16 bp, P. troglodytes
gcatccaaataagaaa

SEQ ID NO: 247550 - DNA, 16 bp, P. troglodytes
gcatccaaatcggtaa

SEQ ID NO: 247551 - DNA, 16 bp, P. troglodytes
gcatccaacatgggag

SEQ ID NO: 247552 - DNA, 16 bp, P. troglodytes
gcatccagagagaaag

SEQ ID NO: 247553 - DNA, 16 bp, P. troglodytes
gcatcccagaggtttt

SEQ ID NO: 247554 - DNA, 16 bp, P. troglodytes
gcatcccaggttcaag

SEQ ID NO: 247555 - DNA, 16 bp, P. troglodytes
gcatccccaaccaatc

SEQ ID NO: 247556 - DNA, 16 bp, P. troglodytes
gcatcctggccaacat

SEQ ID NO: 247557 - DNA, 16 bp, P. troglodytes
gcatccttgtctcatt

SEQ ID NO: 247558 - DNA, 16 bp, P. troglodytes
gcatccttttatgatt

SEQ ID NO: 247559 - DNA, 16 bp, P. troglodytes
gcatccttttcttgtg

SEQ ID NO: 247560 - DNA, 16 bp, P. troglodytes
gcatctagcacaggag

SEQ ID NO: 247561 - DNA, 16 bp, P. troglodytes
gcatctatgtctgcag

SEQ ID NO: 247562 - DNA, 16 bp, P. troglodytes
gcatctcattgtctgg

SEQ ID NO: 247563 - DNA, 16 bp, P. troglodytes
gcatctcctgggagct

SEQ ID NO: 247564 - DNA, 16 bp, P. troglodytes
gcatctgccaccatgc

SEQ ID NO: 247565 - DNA, 16 bp, P. troglodytes
gcatctgccactatgc

SEQ ID NO: 247566 - DNA, 16 bp, P. troglodytes
gcatctgtgatcccag

SEQ ID NO: 247567 - DNA, 16 bp, P. troglodytes
gcatctgtggttccag

SEQ ID NO: 247568 - DNA, 16 bp, P. troglodytes
gcatctgttatttttc

SEQ ID NO: 247569 - DNA, 16 bp, P. troglodytes
gcatcttcaccaagag

SEQ ID NO: 247570 - DNA, 16 bp, P. troglodytes
gcatcttctctgacca

SEQ ID NO: 247571 - DNA, 16 bp, P. troglodytes
gcatcttgacaacttt

SEQ ID NO: 247572 - DNA, 16 bp, P. troglodytes
gcatctttgtcttgtg

SEQ ID NO: 247573 - DNA, 16 bp, P. troglodytes
gcatctttgtggtgtt

SEQ ID NO: 247574 - DNA, 16 bp, P. troglodytes
gcatgaacatgggagg

SEQ ID NO: 247575 - DNA, 16 bp, P. troglodytes
gcatgaaccaccgcac

SEQ ID NO: 247576 - DNA, 16 bp, P. troglodytes
gcatgaaccagggagg

SEQ ID NO: 247577 - DNA, 16 bp, P. troglodytes
gcatgaacccaggaag

SEQ ID NO: 247578 - DNA, 16 bp, P. troglodytes
gcatgaacccaggagg

SEQ ID NO: 247579 - DNA, 16 bp, P. troglodytes
gcatgaacccgggagg

SEQ ID NO: 247580 - DNA, 16 bp, P. troglodytes
gcatgaacctgggaag

SEQ ID NO: 247581 - DNA, 16 bp, P. troglodytes
gcatgaacctgggagg

SEQ ID NO: 247582 - DNA, 16 bp, P. troglodytes
gcatgaatcagtactt

SEQ ID NO: 247583 - DNA, 16 bp, P. troglodytes
gcatgaatccaggagg

SEQ ID NO: 247584 - DNA, 16 bp, P. troglodytes
gcatgactgggaggcc

SEQ ID NO: 247585 - DNA, 16 bp, P. troglodytes
gcatgactgtgttttg

SEQ ID NO: 247586 - DNA, 16 bp, P. troglodytes
gcatgagaaaactcat

SEQ ID NO: 247587 - DNA, 16 bp, P. troglodytes
gcatgagccacagcat

SEQ ID NO: 247588 - DNA, 16 bp, P. troglodytes
gcatgagccaccgcac

SEQ ID NO: 247589 - DNA, 16 bp, P. troglodytes
gcatgagccaccgtgc

SEQ ID NO: 247590 - DNA, 16 bp, P. troglodytes
gcatgagccacctccc

SEQ ID NO: 247591 - DNA, 16 bp, P. troglodytes
gcatgagctaccacgt

SEQ ID NO: 247592 - DNA, 16 bp, P. troglodytes
gcatgagctgccatgc

SEQ ID NO: 247593 - DNA, 16 bp, P. troglodytes
gcatgatcttgggtca

SEQ ID NO: 247594 - DNA, 16 bp, P. troglodytes
gcatgatgctgaggtt

SEQ ID NO: 247595 - DNA, 16 bp, P. troglodytes
gcatgcaccaccatgt

SEQ ID NO: 247596 - DNA, 16 bp, P. troglodytes
gcatgcactgccatgc

SEQ ID NO: 247597 - DNA, 16 bp, P. troglodytes
gcatgcaggtgtcttt

SEQ ID NO: 247598 - DNA, 16 bp, P. troglodytes
gcatgcatgtgtatgt

SEQ ID NO: 247599 - DNA, 16 bp, P. troglodytes
gcatgccaccacaccc

SEQ ID NO: 247600 - DNA, 16 bp, P. troglodytes
gcatgccaccaggcct

SEQ ID NO: 247601 - DNA, 18 bp, P. troglodytes
gcatgcccagctaatttt

SEQ ID NO: 247602 - DNA, 18 bp, P. troglodytes
gcatgcctgtaatcccag

SEQ ID NO: 247603 - DNA, 16 bp, P. troglodytes
gcatgcctgtggtcct

SEQ ID NO: 247604 - DNA, 17 bp, P. troglodytes
gcatgcgccaccacgct

SEQ ID NO: 247605 - DNA, 16 bp, P. troglodytes
gcatgcgccactatgc

SEQ ID NO: 247606 - DNA, 16 bp, P. troglodytes
gcatggaagctccaca

SEQ ID NO: 247607 - DNA, 16 bp, P. troglodytes
gcatggagcagagagg

SEQ ID NO: 247608 - DNA, 16 bp, P. troglodytes
gcatggaggaaaccac

SEQ ID NO: 247609 - DNA, 16 bp, P. troglodytes
gcatggaggttcctca

SEQ ID NO: 247610 - DNA, 16 bp, P. troglodytes
gcatggatgaaccttg

SEQ ID NO: 247611 - DNA, 16 bp, P. troglodytes
gcatggatttatatct

SEQ ID NO: 247612 - DNA, 16 bp, P. troglodytes
gcatggctggaaggcc

SEQ ID NO: 247613 - DNA, 16 bp, P. troglodytes
gcatggctggagaggc

SEQ ID NO: 247614 - DNA, 16 bp, P. troglodytes
gcatggctgtgctcca

SEQ ID NO: 247615 - DNA, 16 bp, P. troglodytes
gcatggctgtggtccc

SEQ ID NO: 247616 - DNA, 16 bp, P. troglodytes
gcatgggccactgcac

SEQ ID NO: 247617 - DNA, 16 bp, P. troglodytes
gcatgggctctggagc

SEQ ID NO: 247618 - DNA, 18 bp, P. troglodytes
gcatggtgaaaccccatt

SEQ ID NO: 247619 - DNA, 16 bp, P. troglodytes
gcatggtgcaagctgt

SEQ ID NO: 247620 - DNA, 16 bp, P. troglodytes
gcatggtgctgggcac

SEQ ID NO: 247621 - DNA, 16 bp, P. troglodytes
gcatggtgctgtgcac

SEQ ID NO: 247622 - DNA, 16 bp, P. troglodytes
gcatggtggtgcacgt

SEQ ID NO: 247623 - DNA, 16 bp, P. troglodytes
gcatggtggtgcatgc

SEQ ID NO: 247624 - DNA, 16 bp, P. troglodytes
gcatggtggtggcatg

SEQ ID NO: 247625 - DNA, 16 bp, P. troglodytes
gcatgtaataaaatat

SEQ ID NO: 247626 - DNA, 16 bp, P. troglodytes
gcatgtcagagaactt

SEQ ID NO: 247627 - DNA, 16 bp, P. troglodytes
gcatgtcagagacctt

SEQ ID NO: 247628 - DNA, 16 bp, P. troglodytes
gcatgtgatttttttt

SEQ ID NO: 247629 - DNA, 16 bp, P. troglodytes
gcatgtgcagttcaca

SEQ ID NO: 247630 - DNA, 16 bp, P. troglodytes
gcatgtgccaccacac

SEQ ID NO: 247631 - DNA, 16 bp, P. troglodytes
gcatgtgccaccatac

SEQ ID NO: 247632 - DNA, 16 bp, P. troglodytes
gcatgtggcccaggat

SEQ ID NO: 247633 - DNA, 16 bp, P. troglodytes
gcatgtgtcaccacac

SEQ ID NO: 247634 - DNA, 16 bp, P. troglodytes
gcatgtgtcttttttg

SEQ ID NO: 247635 - DNA, 16 bp, P. troglodytes
gcatgtgtgcatgtgc

SEQ ID NO: 247636 - DNA, 16 bp, P. troglodytes
gcatgtgtgtgtgtga

SEQ ID NO: 247637 - DNA, 16 bp, P. troglodytes
gcatgttcaaaatggc

SEQ ID NO: 247638 - DNA, 17 bp, P. troglodytes
gcatgttctcactcata

SEQ ID NO: 247639 - DNA, 16 bp, P. troglodytes
gcatgttctctctcat

SEQ ID NO: 247640 - DNA, 16 bp, P. troglodytes
gcatgttggtgtgcac

SEQ ID NO: 247641 - DNA, 16 bp, P. troglodytes
gcatgtttatttattt

SEQ ID NO: 247642 - DNA, 16 bp, P. troglodytes
gcattacactccagcc

SEQ ID NO: 247643 - DNA, 16 bp, P. troglodytes
gcattagattctcata

SEQ ID NO: 247644 - DNA, 16 bp, P. troglodytes
gcattagccaccacac

SEQ ID NO: 247645 - DNA, 16 bp, P. troglodytes
gcattagtttgcttag

SEQ ID NO: 247646 - DNA, 16 bp, P. troglodytes
gcattatattttaaaa

SEQ ID NO: 247647 - DNA, 16 bp, P. troglodytes
gcattattattatttt

SEQ ID NO: 247648 - DNA, 16 bp, P. troglodytes
gcattcaataaatatg

SEQ ID NO: 247649 - DNA, 16 bp, P. troglodytes
gcattcaataaatatt

SEQ ID NO: 247650 - DNA, 16 bp, P. troglodytes
gcattcacaaagagat

SEQ ID NO: 247651 - DNA, 16 bp, P. troglodytes
gcattcattcagcaaa

SEQ ID NO: 247652 - DNA, 16 bp, P. troglodytes
gcattccaggcagaag

SEQ ID NO: 247653 - DNA, 16 bp, P. troglodytes
gcattccagtctgggc

SEQ ID NO: 247654 - DNA, 16 bp, P. troglodytes
gcattcccaccaacaa

SEQ ID NO: 247655 - DNA, 16 bp, P. troglodytes
gcattcctagcctcta

SEQ ID NO: 247656 - DNA, 16 bp, P. troglodytes
gcattcctctgatgat

SEQ ID NO: 247657 - DNA, 17 bp, P. troglodytes
gcattccttggcccagt

SEQ ID NO: 247658 - DNA, 16 bp, P. troglodytes
gcattcctttttattg

SEQ ID NO: 247659 - DNA, 16 bp, P. troglodytes
gcattcttggaataaa

SEQ ID NO: 247660 - DNA, 16 bp, P. troglodytes
gcattgaaactataaa

SEQ ID NO: 247661 - DNA, 16 bp, P. troglodytes
gcattgaaataaaagc

SEQ ID NO: 247662 - DNA, 16 bp, P. troglodytes
gcattgaatctctaaa

SEQ ID NO: 247663 - DNA, 16 bp, P. troglodytes
gcattgaatctgtagt

SEQ ID NO: 247664 - DNA, 16 bp, P. troglodytes
gcattggccaggctgg

SEQ ID NO: 247665 - DNA, 16 bp, P. troglodytes
gcattgtccaatatca

SEQ ID NO: 247666 - DNA, 16 bp, P. troglodytes
gcattgtggcacatgc

SEQ ID NO: 247667 - DNA, 16 bp, P. troglodytes
gcattgttatacacca

SEQ ID NO: 247668 - DNA, 16 bp, P. troglodytes
gcattgttgaaaacaa

SEQ ID NO: 247669 - DNA, 16 bp, P. troglodytes
gcatttaaaagaaaat

SEQ ID NO: 247670 - DNA, 16 bp, P. troglodytes
gcatttaaatatttaa

SEQ ID NO: 247671 - DNA, 16 bp, P. troglodytes
gcatttaaattttatt

SEQ ID NO: 247672 - DNA, 16 bp, P. troglodytes
gcatttaaattttttt

SEQ ID NO: 247673 - DNA, 16 bp, P. troglodytes
gcatttaataaaattt

SEQ ID NO: 247674 - DNA, 16 bp, P. troglodytes
gcatttacattgtatt

SEQ ID NO: 247675 - DNA, 16 bp, P. troglodytes
gcatttacttttgggt

SEQ ID NO: 247676 - DNA, 16 bp, P. troglodytes
gcatttatcccagaga

SEQ ID NO: 247677 - DNA, 16 bp, P. troglodytes
gcatttattgagcact

SEQ ID NO: 247678 - DNA, 16 bp, P. troglodytes
gcatttattgagtacc

SEQ ID NO: 247679 - DNA, 16 bp, P. troglodytes
gcatttatttaataaa

SEQ ID NO: 247680 - DNA, 16 bp, P. troglodytes
gcatttcagagacctt

SEQ ID NO: 247681 - DNA, 16 bp, P. troglodytes
gcatttcagagacttt

SEQ ID NO: 247682 - DNA, 16 bp, P. troglodytes
gcatttcatcttttat

SEQ ID NO: 247683 - DNA, 16 bp, P. troglodytes
gcatttcattttattt

SEQ ID NO: 247684 - DNA, 16 bp, P. troglodytes
gcatttctatacacca

SEQ ID NO: 247685 - DNA, 16 bp, P. troglodytes
gcatttctatgatgat

SEQ ID NO: 247686 - DNA, 16 bp, P. troglodytes
gcatttctcctaatgc

SEQ ID NO: 247687 - DNA, 16 bp, P. troglodytes
gcatttcttcatgtgt

SEQ ID NO: 247688 - DNA, 16 bp, P. troglodytes
gcatttgaaaaaaatc

SEQ ID NO: 247689 - DNA, 20 bp, P. troglodytes
gcatttgaggagcccttcag

SEQ ID NO: 247690 - DNA, 16 bp, P. troglodytes
gcatttgatattgtca

SEQ ID NO: 247691 - DNA, 16 bp, P. troglodytes
gcatttgattttctgt

SEQ ID NO: 247692 - DNA, 16 bp, P. troglodytes
gcatttgctgtttcct

SEQ ID NO: 247693 - DNA, 16 bp, P. troglodytes
gcatttggggaggctg

SEQ ID NO: 247694 - DNA, 16 bp, P. troglodytes
gcatttgtaaactgtc

SEQ ID NO: 247695 - DNA, 16 bp, P. troglodytes
gcatttgtgtatctaa

SEQ ID NO: 247696 - DNA, 16 bp, P. troglodytes
gcattttaaaaaatgt

SEQ ID NO: 247697 - DNA, 16 bp, P. troglodytes
gcattttaattaaaaa

SEQ ID NO: 247698 - DNA, 16 bp, P. troglodytes
gcattttacaatccta

SEQ ID NO: 247699 - DNA, 16 bp, P. troglodytes
gcattttacatttcca

SEQ ID NO: 247700 - DNA, 16 bp, P. troglodytes
gcattttatagatgag

SEQ ID NO: 247701 - DNA, 16 bp, P. troglodytes
gcattttgagaaactt

SEQ ID NO: 247702 - DNA, 16 bp, P. troglodytes
gcattttggacaaagc

SEQ ID NO: 247703 - DNA, 16 bp, P. troglodytes
gcattttggattttga

SEQ ID NO: 247704 - DNA, 16 bp, P. troglodytes
gcattttgttgttgtt

SEQ ID NO: 247705 - DNA, 16 bp, P. troglodytes
gcatttttcataatag

SEQ ID NO: 247706 - DNA, 16 bp, P. troglodytes
gcattttttcacatac

SEQ ID NO: 247707 - DNA, 16 bp, P. troglodytes
gcattttttgtagaaa

SEQ ID NO: 247708 - DNA, 16 bp, P. troglodytes
gcatttttttaaaaaa

SEQ ID NO: 247709 - DNA, 16 bp, P. troglodytes
gccaaaaaccacatga

SEQ ID NO: 247710 - DNA, 16 bp, P. troglodytes
gccaaaaaggctgggg

SEQ ID NO: 247711 - DNA, 16 bp, P. troglodytes
gccaaaacctaccaaa

SEQ ID NO: 247712 - DNA, 16 bp, P. troglodytes
gccaaaacggtgaaac

SEQ ID NO: 247713 - DNA, 16 bp, P. troglodytes
gccaaaagaataaagc

SEQ ID NO: 247714 - DNA, 22 bp, P. troglodytes
gccaaaagcaatggcaacaaaa

SEQ ID NO: 247715 - DNA, 16 bp, P. troglodytes
gccaaaatcaacagcc

SEQ ID NO: 247716 - DNA, 16 bp, P. troglodytes
gccaaaatcatgccat

SEQ ID NO: 247717 - DNA, 16 bp, P. troglodytes
gccaaaatggtgaaac

SEQ ID NO: 247718 - DNA, 16 bp, P. troglodytes
gccaaaatggtgaaat

SEQ ID NO: 247719 - DNA, 16 bp, P. troglodytes
gccaaacatcctacaa

SEQ ID NO: 247720 - DNA, 16 bp, P. troglodytes
gccaaagaatgcaggc

SEQ ID NO: 247721 - DNA, 16 bp, P. troglodytes
gccaaagcaggcagat

SEQ ID NO: 247722 - DNA, 16 bp, P. troglodytes
gccaaagccattcaac

SEQ ID NO: 247723 - DNA, 18 bp, P. troglodytes
gccaaagcgggcggatca

SEQ ID NO: 247724 - DNA, 16 bp, P. troglodytes
gccaaagggaaaagtt

SEQ ID NO: 247725 - DNA, 16 bp, P. troglodytes
gccaaaggtcacacag

SEQ ID NO: 247726 - DNA, 18 bp, P. troglodytes
gccaaagtgctgggatta

SEQ ID NO: 247727 - DNA, 16 bp, P. troglodytes
gccaaagtgggcagat

SEQ ID NO: 247728 - DNA, 16 bp, P. troglodytes
gccaaatcacaaatga

SEQ ID NO: 247729 - DNA, 16 bp, P. troglodytes
gccaaatctggcccac

SEQ ID NO: 247730 - DNA, 16 bp, P. troglodytes
gccaaatctgggacaa

SEQ ID NO: 247731 - DNA, 16 bp, P. troglodytes
gccaaattccaccaga

SEQ ID NO: 247732 - DNA, 16 bp, P. troglodytes
gccaaattctactaga

SEQ ID NO: 247733 - DNA, 16 bp, P. troglodytes
gccaaattgtccctgt

SEQ ID NO: 247734 - DNA, 16 bp, P. troglodytes
gccaacaaatgtgaaa

SEQ ID NO: 247735 - DNA, 16 bp, P. troglodytes
gccaacacacccggcc

SEQ ID NO: 247736 - DNA, 16 bp, P. troglodytes
gccaacaccttgactg

SEQ ID NO: 247737 - DNA, 16 bp, P. troglodytes
gccaacacggcaaaac

SEQ ID NO: 247738 - DNA, 16 bp, P. troglodytes
gccaacagatcaggag

SEQ ID NO: 247739 - DNA, 16 bp, P. troglodytes
gccaacatcaccctga

SEQ ID NO: 247740 - DNA, 16 bp, P. troglodytes
gccaaccccatctcta

SEQ ID NO: 247741 - DNA, 16 bp, P. troglodytes
gccaacctcagcctcc

SEQ ID NO: 247742 - DNA, 16 bp, P. troglodytes
gccaagagcgagcgag

SEQ ID NO: 247743 - DNA, 16 bp, P. troglodytes
gccaagaggaccccag

SEQ ID NO: 247744 - DNA, 16 bp, P. troglodytes
gccaagatcacaccac

SEQ ID NO: 247745 - DNA, 17 bp, P. troglodytes
gccaagatcacgccact

SEQ ID NO: 247746 - DNA, 16 bp, P. troglodytes
gccaagatctcaccac

SEQ ID NO: 247747 - DNA, 16 bp, P. troglodytes
gccaagatgatgccac

SEQ ID NO: 247748 - DNA, 16 bp, P. troglodytes
gccaagatgggtggat

SEQ ID NO: 247749 - DNA, 16 bp, P. troglodytes
gccaagatggtctgga

SEQ ID NO: 247750 - DNA, 16 bp, P. troglodytes
gccaagcagatgccag

SEQ ID NO: 247751 - DNA, 16 bp, P. troglodytes
gccaagcagtttttca

SEQ ID NO: 247752 - DNA, 16 bp, P. troglodytes
gccaagcatggtggct

SEQ ID NO: 247753 - DNA, 16 bp, P. troglodytes
gccaagctctttgcta

SEQ ID NO: 247754 - DNA, 16 bp, P. troglodytes
gccaagctggtctcca

SEQ ID NO: 247755 - DNA, 16 bp, P. troglodytes
gccaagcttggtggtg

SEQ ID NO: 247756 - DNA, 16 bp, P. troglodytes
gccaaggaacacctgg

SEQ ID NO: 247757 - DNA, 16 bp, P. troglodytes
gccaaggaaggaggat

SEQ ID NO: 247758 - DNA, 16 bp, P. troglodytes
gccaaggacattccaa

SEQ ID NO: 247759 - DNA, 16 bp, P. troglodytes
gccaaggagacaggcc

SEQ ID NO: 247760 - DNA, 16 bp, P. troglodytes
gccaaggagaggggcc

SEQ ID NO: 247761 - DNA, 16 bp, P. troglodytes
gccaaggagggtggat

SEQ ID NO: 247762 - DNA, 16 bp, P. troglodytes
gccaaggagttcaaga

SEQ ID NO: 247763 - DNA, 16 bp, P. troglodytes
gccaaggcaagtggat

SEQ ID NO: 247764 - DNA, 16 bp, P. troglodytes
gccaaggcagaaagat

SEQ ID NO: 247765 - DNA, 16 bp, P. troglodytes
gccaaggcaggaagac

SEQ ID NO: 247766 - DNA, 16 bp, P. troglodytes
gccaaggcaggaggat

SEQ ID NO: 247767 - DNA, 16 bp, P. troglodytes
gccaaggcagtaggat

SEQ ID NO: 247768 - DNA, 16 bp, P. troglodytes
gccaaggccagagctg

SEQ ID NO: 247769 - DNA, 16 bp, P. troglodytes
gccaaggccagtggat

SEQ ID NO: 247770 - DNA, 16 bp, P. troglodytes
gccaaggccgaggagg

SEQ ID NO: 247771 - DNA, 17 bp, P. troglodytes
gccaaggcgggtggatt

SEQ ID NO: 247772 - DNA, 16 bp, P. troglodytes
gccaaggcgggttgat

SEQ ID NO: 247773 - DNA, 16 bp, P. troglodytes
gccaaggctggaggat

SEQ ID NO: 247774 - DNA, 16 bp, P. troglodytes
gccaaggctggcagat

SEQ ID NO: 247775 - DNA, 16 bp, P. troglodytes
gccaaggctggggtgc

SEQ ID NO: 247776 - DNA, 16 bp, P. troglodytes
gccaaggctggtcttg

SEQ ID NO: 247777 - DNA, 16 bp, P. troglodytes
gccaagggtggtggca

SEQ ID NO: 247778 - DNA, 16 bp, P. troglodytes
gccaaggtaggaagat

SEQ ID NO: 247779 - DNA, 16 bp, P. troglodytes
gccaaggtaggtggat

SEQ ID NO: 247780 - DNA, 16 bp, P. troglodytes
gccaaggtcacagagc

SEQ ID NO: 247781 - DNA, 16 bp, P. troglodytes
gccaaggtggacagat

SEQ ID NO: 247782 - DNA, 16 bp, P. troglodytes
gccaaggtggcaccac

SEQ ID NO: 247783 - DNA, 16 bp, P. troglodytes
gccaaggtgggaggat

SEQ ID NO: 247784 - DNA, 16 bp, P. troglodytes
gccaaggtgggagtat

SEQ ID NO: 247785 - DNA, 16 bp, P. troglodytes
gccaaggtgggctgat

SEQ ID NO: 247786 - DNA, 16 bp, P. troglodytes
gccaaggtgggtaaat

SEQ ID NO: 247787 - DNA, 16 bp, P. troglodytes
gccaagtcaatcccaa

SEQ ID NO: 247788 - DNA, 16 bp, P. troglodytes
gccaagtcttcatttg

SEQ ID NO: 247789 - DNA, 16 bp, P. troglodytes
gccaagtggaactgtg

SEQ ID NO: 247790 - DNA, 16 bp, P. troglodytes
gccaataaacatatga

SEQ ID NO: 247791 - DNA, 16 bp, P. troglodytes
gccaatatggcaaaat

SEQ ID NO: 247792 - DNA, 16 bp, P. troglodytes
gccaatcactgagttt

SEQ ID NO: 247793 - DNA, 16 bp, P. troglodytes
gccaatggaaaccaga

SEQ ID NO: 247794 - DNA, 16 bp, P. troglodytes
gccaatggtggaaaag

SEQ ID NO: 247795 - DNA, 16 bp, P. troglodytes
gccaatgtgcctggcc

SEQ ID NO: 247796 - DNA, 16 bp, P. troglodytes
gccaattaaactatga

SEQ ID NO: 247797 - DNA, 16 bp, P. troglodytes
gccaattcttgggcct

SEQ ID NO: 247798 - DNA, 16 bp, P. troglodytes
gccacaaaaagaaatg

SEQ ID NO: 247799 - DNA, 16 bp, P. troglodytes
gccacaaaaaggaaca

SEQ ID NO: 247800 - DNA, 16 bp, P. troglodytes
gccacaaagcaagact

SEQ ID NO: 247801 - DNA, 16 bp, P. troglodytes
gccacaacagtcccca

SEQ ID NO: 247802 - DNA, 16 bp, P. troglodytes
gccacaaccactacta

SEQ ID NO: 247803 - DNA, 16 bp, P. troglodytes
gccacaagagtgacct

SEQ ID NO: 247804 - DNA, 16 bp, P. troglodytes
gccacaagccaaggaa

SEQ ID NO: 247805 - DNA, 16 bp, P. troglodytes
gccacaaggggtttta

SEQ ID NO: 247806 - DNA, 16 bp, P. troglodytes
gccacaatcatagctc

SEQ ID NO: 247807 - DNA, 16 bp, P. troglodytes
gccacaatgtccagct

SEQ ID NO: 247808 - DNA, 18 bp, P. troglodytes
gccacacccagctaattt

SEQ ID NO: 247809 - DNA, 19 bp, P. troglodytes
gccacacccggctaatttt

SEQ ID NO: 247810 - DNA, 16 bp, P. troglodytes
gccacacctagctgca

SEQ ID NO: 247811 - DNA, 16 bp, P. troglodytes
gccacactgtattcca

SEQ ID NO: 247812 - DNA, 16 bp, P. troglodytes
gccacagaagcagagc

SEQ ID NO: 247813 - DNA, 16 bp, P. troglodytes
gccacagagcccagcc

SEQ ID NO: 247814 - DNA, 16 bp, P. troglodytes
gccacagcacccagca

SEQ ID NO: 247815 - DNA, 16 bp, P. troglodytes
gccacagcccctggcc

SEQ ID NO: 247816 - DNA, 16 bp, P. troglodytes
gccacagctcccagcc

SEQ ID NO: 247817 - DNA, 16 bp, P. troglodytes
gccacagctggagcct

SEQ ID NO: 247818 - DNA, 16 bp, P. troglodytes
gccacaggggcagagt

SEQ ID NO: 247819 - DNA, 16 bp, P. troglodytes
gccacaggtggagctg

SEQ ID NO: 247820 - DNA, 16 bp, P. troglodytes
gccacagtccccacca

SEQ ID NO: 247821 - DNA, 16 bp, P. troglodytes
gccacagtgacttcca

SEQ ID NO: 247822 - DNA, 16 bp, P. troglodytes
gccacagtgcccagct

SEQ ID NO: 247823 - DNA, 16 bp, P. troglodytes
gccacatggtctctgt

SEQ ID NO: 247824 - DNA, 16 bp, P. troglodytes
gccacatgtagctact

SEQ ID NO: 247825 - DNA, 16 bp, P. troglodytes
gccacatgtggctgct

SEQ ID NO: 247826 - DNA, 16 bp, P. troglodytes
gccacatttctttttt

SEQ ID NO: 247827 - DNA, 16 bp, P. troglodytes
gccaccaagcccagct

SEQ ID NO: 247828 - DNA, 16 bp, P. troglodytes
gccaccaagccctgcc

SEQ ID NO: 247829 - DNA, 16 bp, P. troglodytes
gccaccacaccaagct

SEQ ID NO: 247830 - DNA, 16 bp, P. troglodytes
gccaccacaccaggct

SEQ ID NO: 247831 - DNA, 16 bp, P. troglodytes
gccaccacacccaatt

SEQ ID NO: 247832 - DNA, 22 bp, P. troglodytes
gccaccacacccggctaatttt

SEQ ID NO: 247833 - DNA, 16 bp, P. troglodytes
gccaccacaccggcct

SEQ ID NO: 247834 - DNA, 16 bp, P. troglodytes
gccaccacacctagct

SEQ ID NO: 247835 - DNA, 16 bp, P. troglodytes
gccaccacactcggct

SEQ ID NO: 247836 - DNA, 16 bp, P. troglodytes
gccaccacagccagct

SEQ ID NO: 247837 - DNA, 16 bp, P. troglodytes
gccaccacagctggcc

SEQ ID NO: 247838 - DNA, 16 bp, P. troglodytes
gccaccacatgcagct

SEQ ID NO: 247839 - DNA, 16 bp, P. troglodytes
gccaccaccatgcctg

SEQ ID NO: 247840 - DNA, 16 bp, P. troglodytes
gccaccacccctggct

SEQ ID NO: 247841 - DNA, 16 bp, P. troglodytes
gccaccaccctcagct

SEQ ID NO: 247842 - DNA, 16 bp, P. troglodytes
gccaccacctccagcc

SEQ ID NO: 247843 - DNA, 16 bp, P. troglodytes
gccaccacgcacggct

SEQ ID NO: 247844 - DNA, 16 bp, P. troglodytes
gccaccacgcccagca

SEQ ID NO: 247845 - DNA, 16 bp, P. troglodytes
gccaccacgcccagcg

SEQ ID NO: 247846 - DNA, 17 bp, P. troglodytes
gccaccacgcccagctc

SEQ ID NO: 247847 - DNA, 16 bp, P. troglodytes
gccaccacgcccaggc

SEQ ID NO: 247848 - DNA, 16 bp, P. troglodytes
gccaccacgcccgcct

SEQ ID NO: 247849 - DNA, 16 bp, P. troglodytes
gccaccacgcctagcc

SEQ ID NO: 247850 - DNA, 16 bp, P. troglodytes
gccaccacgctgggcc

SEQ ID NO: 247851 - DNA, 16 bp, P. troglodytes
gccaccacgtctggct

SEQ ID NO: 247852 - DNA, 16 bp, P. troglodytes
gccaccactccaggcc

SEQ ID NO: 247853 - DNA, 16 bp, P. troglodytes
gccaccactcccaact

SEQ ID NO: 247854 - DNA, 16 bp, P. troglodytes
gccaccagacctggct

SEQ ID NO: 247855 - DNA, 16 bp, P. troglodytes
gccaccaggagctgga

SEQ ID NO: 247856 - DNA, 16 bp, P. troglodytes
gccaccaggcccggct

SEQ ID NO: 247857 - DNA, 16 bp, P. troglodytes
gccaccaggcctggct

SEQ ID NO: 247858 - DNA, 16 bp, P. troglodytes
gccaccagtctcttta

SEQ ID NO: 247859 - DNA, 16 bp, P. troglodytes
gccaccatacccagtt

SEQ ID NO: 247860 - DNA, 16 bp, P. troglodytes
gccaccatacccggct

SEQ ID NO: 247861 - DNA, 16 bp, P. troglodytes
gccaccataccctgct

SEQ ID NO: 247862 - DNA, 16 bp, P. troglodytes
gccaccatacctggct

SEQ ID NO: 247863 - DNA, 16 bp, P. troglodytes
gccaccatatctggct

SEQ ID NO: 247864 - DNA, 16 bp, P. troglodytes
gccaccatcaccacca

SEQ ID NO: 247865 - DNA, 16 bp, P. troglodytes
gccaccatccccagcc

SEQ ID NO: 247866 - DNA, 16 bp, P. troglodytes
gccaccatccccagct

SEQ ID NO: 247867 - DNA, 16 bp, P. troglodytes
gccaccatcctccaga

SEQ ID NO: 247868 - DNA, 16 bp, P. troglodytes
gccaccatgacaggct

SEQ ID NO: 247869 - DNA, 16 bp, P. troglodytes
gccaccatgccagacc

SEQ ID NO: 247870 - DNA, 16 bp, P. troglodytes
gccaccatgcccacct

SEQ ID NO: 247871 - DNA, 16 bp, P. troglodytes
gccaccatgcccgcct

SEQ ID NO: 247872 - DNA, 16 bp, P. troglodytes
gccaccatgcctacct

SEQ ID NO: 247873 - DNA, 16 bp, P. troglodytes
gccaccatgcctggcc

SEQ ID NO: 247874 - DNA, 16 bp, P. troglodytes
gccaccatgctcagtc

SEQ ID NO: 247875 - DNA, 16 bp, P. troglodytes
gccaccatgctgggcc

SEQ ID NO: 247876 - DNA, 16 bp, P. troglodytes
gccaccatgtcccgct

SEQ ID NO: 247877 - DNA, 16 bp, P. troglodytes
gccaccatttctggct

SEQ ID NO: 247878 - DNA, 16 bp, P. troglodytes
gccacccaaaatgctg

SEQ ID NO: 247879 - DNA, 16 bp, P. troglodytes
gccacccagcctgtgg

SEQ ID NO: 247880 - DNA, 16 bp, P. troglodytes
gccacccagctgagcc

SEQ ID NO: 247881 - DNA, 16 bp, P. troglodytes
gccacccagtggccag

SEQ ID NO: 247882 - DNA, 16 bp, P. troglodytes
gccaccccacccggct

SEQ ID NO: 247883 - DNA, 16 bp, P. troglodytes
gccaccccacctggct

SEQ ID NO: 247884 - DNA, 16 bp, P. troglodytes
gccaccccgcctggcc

SEQ ID NO: 247885 - DNA, 16 bp, P. troglodytes
gccacccctttcccca

SEQ ID NO: 247886 - DNA, 16 bp, P. troglodytes
gccacccgggttcaag

SEQ ID NO: 247887 - DNA, 16 bp, P. troglodytes
gccaccctgtgaagaa

SEQ ID NO: 247888 - DNA, 16 bp, P. troglodytes
gccaccctgtgaagag

SEQ ID NO: 247889 - DNA, 16 bp, P. troglodytes
gccaccgcaccctgct

SEQ ID NO: 247890 - DNA, 16 bp, P. troglodytes
gccaccgcacctggct

SEQ ID NO: 247891 - DNA, 16 bp, P. troglodytes
gccaccgcccctggcc

SEQ ID NO: 247892 - DNA, 16 bp, P. troglodytes
gccaccgcgcccagct

SEQ ID NO: 247893 - DNA, 16 bp, P. troglodytes
gccaccgcgcccggct

SEQ ID NO: 247894 - DNA, 16 bp, P. troglodytes
gccaccgcgcctgggc

SEQ ID NO: 247895 - DNA, 16 bp, P. troglodytes
gccaccgcgctccagc

SEQ ID NO: 247896 - DNA, 16 bp, P. troglodytes
gccaccgcgtccagct

SEQ ID NO: 247897 - DNA, 16 bp, P. troglodytes
gccaccgctcccggcc

SEQ ID NO: 247898 - DNA, 16 bp, P. troglodytes
gccaccgcttccagcc

SEQ ID NO: 247899 - DNA, 16 bp, P. troglodytes
gccaccgggcccagct

SEQ ID NO: 247900 - DNA, 16 bp, P. troglodytes
gccaccgggcctggct

SEQ ID NO: 247901 - DNA, 16 bp, P. troglodytes
gccaccgtccctggcc

SEQ ID NO: 247902 - DNA, 16 bp, P. troglodytes
gccaccgtgcccagtc

SEQ ID NO: 247903 - DNA, 17 bp, P. troglodytes
gccaccgtgcccggctg

SEQ ID NO: 247904 - DNA, 16 bp, P. troglodytes
gccaccgtgccctgcc

SEQ ID NO: 247905 - DNA, 16 bp, P. troglodytes
gccaccgtgccctgct

SEQ ID NO: 247906 - DNA, 16 bp, P. troglodytes
gccaccgtgcctgact

SEQ ID NO: 247907 - DNA, 16 bp, P. troglodytes
gccaccgtgcctggac

SEQ ID NO: 247908 - DNA, 16 bp, P. troglodytes
gccaccgtgctggcca

SEQ ID NO: 247909 - DNA, 16 bp, P. troglodytes
gccaccgtgctggcct

SEQ ID NO: 247910 - DNA, 16 bp, P. troglodytes
gccaccgtgctgggct

SEQ ID NO: 247911 - DNA, 16 bp, P. troglodytes
gccaccgtggccagcc

SEQ ID NO: 247912 - DNA, 16 bp, P. troglodytes
gccaccgtgtccagct

SEQ ID NO: 247913 - DNA, 16 bp, P. troglodytes
gccacctacaagccaa

SEQ ID NO: 247914 - DNA, 16 bp, P. troglodytes
gccacctcccaccagg

SEQ ID NO: 247915 - DNA, 16 bp, P. troglodytes
gccacctccgcctcct

SEQ ID NO: 247916 - DNA, 16 bp, P. troglodytes
gccacctcctccagga

SEQ ID NO: 247917 - DNA, 16 bp, P. troglodytes
gccacctcgcccagcc

SEQ ID NO: 247918 - DNA, 16 bp, P. troglodytes
gccacctcgcccggcc

SEQ ID NO: 247919 - DNA, 16 bp, P. troglodytes
gccacctcgcccggct

SEQ ID NO: 247920 - DNA, 16 bp, P. troglodytes
gccacctcgccctgcc

SEQ ID NO: 247921 - DNA, 16 bp, P. troglodytes
gccaccttcatcaatg

SEQ ID NO: 247922 - DNA, 16 bp, P. troglodytes
gccaccttgcccagcc

SEQ ID NO: 247923 - DNA, 16 bp, P. troglodytes
gccacgacgcccagct

SEQ ID NO: 247924 - DNA, 16 bp, P. troglodytes
gccacgcatggtggtg

SEQ ID NO: 247925 - DNA, 18 bp, P. troglodytes
gccacgcccggctaattt

SEQ ID NO: 247926 - DNA, 16 bp, P. troglodytes
gccacgtgcagtggct

SEQ ID NO: 247927 - DNA, 16 bp, P. troglodytes
gccactaagtttgtga

SEQ ID NO: 247928 - DNA, 16 bp, P. troglodytes
gccactactcccagcc

SEQ ID NO: 247929 - DNA, 16 bp, P. troglodytes
gccactatgccctgcc

SEQ ID NO: 247930 - DNA, 16 bp, P. troglodytes
gccactccacctggcc

SEQ ID NO: 247931 - DNA, 16 bp, P. troglodytes
gccactccggaggctg

SEQ ID NO: 247932 - DNA, 16 bp, P. troglodytes
gccactctggcagctg

SEQ ID NO: 247933 - DNA, 16 bp, P. troglodytes
gccactgagcccggcc

SEQ ID NO: 247934 - DNA, 16 bp, P. troglodytes
gccactgcaaccagcc

SEQ ID NO: 247935 - DNA, 16 bp, P. troglodytes
gccactgcactcagcc

SEQ ID NO: 247936 - DNA, 16 bp, P. troglodytes
gccactgcactctggt

SEQ ID NO: 247937 - DNA, 16 bp, P. troglodytes
gccactgcactctgtc

SEQ ID NO: 247938 - DNA, 16 bp, P. troglodytes
gccactgcactggagc

SEQ ID NO: 247939 - DNA, 16 bp, P. troglodytes
gccactgcactgggct

SEQ ID NO: 247940 - DNA, 16 bp, P. troglodytes
gccactgcagttcagc

SEQ ID NO: 247941 - DNA, 16 bp, P. troglodytes
gccactgccaccacag

SEQ ID NO: 247942 - DNA, 16 bp, P. troglodytes
gccactgccaccccag

SEQ ID NO: 247943 - DNA, 16 bp, P. troglodytes
gccactgccactccag

SEQ ID NO: 247944 - DNA, 16 bp, P. troglodytes
gccactgcccccggct

SEQ ID NO: 247945 - DNA, 16 bp, P. troglodytes
gccactgcgcccagct

SEQ ID NO: 247946 - DNA, 16 bp, P. troglodytes
gccactgcgtctggca

SEQ ID NO: 247947 - DNA, 16 bp, P. troglodytes
gccactgctcccagtc

SEQ ID NO: 247948 - DNA, 16 bp, P. troglodytes
gccactgctcctggcc

SEQ ID NO: 247949 - DNA, 16 bp, P. troglodytes
gccactgctctcttca

SEQ ID NO: 247950 - DNA, 16 bp, P. troglodytes
gccactgctcttcagc

SEQ ID NO: 247951 - DNA, 16 bp, P. troglodytes
gccactgctgccatca

SEQ ID NO: 247952 - DNA, 16 bp, P. troglodytes
gccactgctgctgcca

SEQ ID NO: 247953 - DNA, 16 bp, P. troglodytes
gccactggcactccag

SEQ ID NO: 247954 - DNA, 16 bp, P. troglodytes
gccactgggctcagcc

SEQ ID NO: 247955 - DNA, 16 bp, P. troglodytes
gccactgtacctgacc

SEQ ID NO: 247956 - DNA, 16 bp, P. troglodytes
gccactgtactccagt

SEQ ID NO: 247957 - DNA, 16 bp, P. troglodytes
gccactgtactttagc

SEQ ID NO: 247958 - DNA, 16 bp, P. troglodytes
gccactgtccccagcc

SEQ ID NO: 247959 - DNA, 16 bp, P. troglodytes
gccactgtccctggcc

SEQ ID NO: 247960 - DNA, 16 bp, P. troglodytes
gccactgtcctccaga

SEQ ID NO: 247961 - DNA, 16 bp, P. troglodytes
gccactgtgcatgtgg

SEQ ID NO: 247962 - DNA, 16 bp, P. troglodytes
gccactgtgcccagct

SEQ ID NO: 247963 - DNA, 16 bp, P. troglodytes
gccactgtgcccatcc

SEQ ID NO: 247964 - DNA, 16 bp, P. troglodytes
gccactgtgccccacc

SEQ ID NO: 247965 - DNA, 16 bp, P. troglodytes
gccactgtgccctacc

SEQ ID NO: 247966 - DNA, 17 bp, P. troglodytes
gccactgtgccctgccg

SEQ ID NO: 247967 - DNA, 16 bp, P. troglodytes
gccactgtgcgtggcc

SEQ ID NO: 247968 - DNA, 16 bp, P. troglodytes
gccactgtgctggcca

SEQ ID NO: 247969 - DNA, 16 bp, P. troglodytes
gccactgtggctggcc

SEQ ID NO: 247970 - DNA, 16 bp, P. troglodytes
gccacttcacccagcc

SEQ ID NO: 247971 - DNA, 16 bp, P. troglodytes
gccacttcattccagc

SEQ ID NO: 247972 - DNA, 16 bp, P. troglodytes
gccactttcatcagca

SEQ ID NO: 247973 - DNA, 16 bp, P. troglodytes
gccagaaacagaaagt

SEQ ID NO: 247974 - DNA, 16 bp, P. troglodytes
gccagaagaatcactt

SEQ ID NO: 247975 - DNA, 16 bp, P. troglodytes
gccagaagcccctctc

SEQ ID NO: 247976 - DNA, 16 bp, P. troglodytes
gccagaagggagccca

SEQ ID NO: 247977 - DNA, 16 bp, P. troglodytes
gccagaatttgttatt

SEQ ID NO: 247978 - DNA, 16 bp, P. troglodytes
gccagacccagggccc

SEQ ID NO: 247979 - DNA, 16 bp, P. troglodytes
gccagactgcctgggt

SEQ ID NO: 247980 - DNA, 16 bp, P. troglodytes
gccagagagagagaga

SEQ ID NO: 247981 - DNA, 16 bp, P. troglodytes
gccagagcagaaggaa

SEQ ID NO: 247982 - DNA, 16 bp, P. troglodytes
gccagaggagcagggg

SEQ ID NO: 247983 - DNA, 16 bp, P. troglodytes
gccagaggctggggag

SEQ ID NO: 247984 - DNA, 16 bp, P. troglodytes
gccagatatggtggtg

SEQ ID NO: 247985 - DNA, 16 bp, P. troglodytes
gccagatttagcaaaa

SEQ ID NO: 247986 - DNA, 16 bp, P. troglodytes
gccagcaaaccaccag

SEQ ID NO: 247987 - DNA, 16 bp, P. troglodytes
gccagcaacatcctga

SEQ ID NO: 247988 - DNA, 16 bp, P. troglodytes
gccagcacacctggct

SEQ ID NO: 247989 - DNA, 16 bp, P. troglodytes
gccagcacagcagcag

SEQ ID NO: 247990 - DNA, 16 bp, P. troglodytes
gccagcacagtgctgg

SEQ ID NO: 247991 - DNA, 16 bp, P. troglodytes
gccagcacttgggagg

SEQ ID NO: 247992 - DNA, 16 bp, P. troglodytes
gccagcactttgggag

SEQ ID NO: 247993 - DNA, 16 bp, P. troglodytes
gccagcagaagcaggg

SEQ ID NO: 247994 - DNA, 16 bp, P. troglodytes
gccagcagcagcagca

SEQ ID NO: 247995 - DNA, 16 bp, P. troglodytes
gccagcagccaccaga

SEQ ID NO: 247996 - DNA, 16 bp, P. troglodytes
gccagcagtgctgggg

SEQ ID NO: 247997 - DNA, 16 bp, P. troglodytes
gccagcatctgttact

SEQ ID NO: 247998 - DNA, 16 bp, P. troglodytes
gccagcattatcttga

SEQ ID NO: 247999 - DNA, 16 bp, P. troglodytes
gccagcatttgctatt

SEQ ID NO: 248000 - DNA, 16 bp, P. troglodytes
gccagccatgaaagca

SEQ ID NO: 248001 - DNA, 16 bp, P. troglodytes
gccagccccctgccac

SEQ ID NO: 248002 - DNA, 16 bp, P. troglodytes
gccagcccctccacac

SEQ ID NO: 248003 - DNA, 16 bp, P. troglodytes
gccagccgccccgtcc

SEQ ID NO: 248004 - DNA, 16 bp, P. troglodytes
gccagcctaggcaaca

SEQ ID NO: 248005 - DNA, 16 bp, P. troglodytes
gccagcctcagcctct

SEQ ID NO: 248006 - DNA, 16 bp, P. troglodytes
gccagcctcagccttc

SEQ ID NO: 248007 - DNA, 24 bp, P. troglodytes
gccagcctgaccaacatggtgaaa

SEQ ID NO: 248008 - DNA, 16 bp, P. troglodytes
gccagcctggacaaca

SEQ ID NO: 248009 - DNA, 16 bp, P. troglodytes
gccagcctgggcaaca

SEQ ID NO: 248010 - DNA, 16 bp, P. troglodytes
gccagcctgggccaca

SEQ ID NO: 248011 - DNA, 16 bp, P. troglodytes
gccagcgagaccacga

SEQ ID NO: 248012 - DNA, 16 bp, P. troglodytes
gccagcgtggtggctc

SEQ ID NO: 248013 - DNA, 16 bp, P. troglodytes
gccagctccacctcct

SEQ ID NO: 248014 - DNA, 17 bp, P. troglodytes
gccagctccagtttcag

SEQ ID NO: 248015 - DNA, 16 bp, P. troglodytes
gccagctccctcagct

SEQ ID NO: 248016 - DNA, 16 bp, P. troglodytes
gccagctgaaggcaaa

SEQ ID NO: 248017 - DNA, 16 bp, P. troglodytes
gccagctgccctgtcc

SEQ ID NO: 248018 - DNA, 16 bp, P. troglodytes
gccagctggacttcct

SEQ ID NO: 248019 - DNA, 16 bp, P. troglodytes
gccagctgtgtggcct

SEQ ID NO: 248020 - DNA, 16 bp, P. troglodytes
gccaggaaccacagag

SEQ ID NO: 248021 - DNA, 16 bp, P. troglodytes
gccaggaagctggaac

SEQ ID NO: 248022 - DNA, 17 bp, P. troglodytes
gccaggacggtctcgat

SEQ ID NO: 248023 - DNA, 16 bp, P. troglodytes
gccaggactgggttct

SEQ ID NO: 248024 - DNA, 16 bp, P. troglodytes
gccaggagaatcgctt

SEQ ID NO: 248025 - DNA, 16 bp, P. troglodytes
gccaggaggcagaggt

SEQ ID NO: 248026 - DNA, 16 bp, P. troglodytes
gccaggagggaggctg

SEQ ID NO: 248027 - DNA, 16 bp, P. troglodytes
gccaggaggggagctg

SEQ ID NO: 248028 - DNA, 16 bp, P. troglodytes
gccaggagtagtggct

SEQ ID NO: 248029 - DNA, 16 bp, P. troglodytes
gccaggagtggtgact

SEQ ID NO: 248030 - DNA, 19 bp, P. troglodytes
gccaggagttcaagaccaa

SEQ ID NO: 248031 - DNA, 19 bp, P. troglodytes
gccaggagtttgagaccat

SEQ ID NO: 248032 - DNA, 16 bp, P. troglodytes
gccaggatggcctcaa

SEQ ID NO: 248033 - DNA, 23 bp, P. troglodytes
gccaggatggtctcgatctccta

SEQ ID NO: 248034 - DNA, 19 bp, P. troglodytes
gccaggatggtctctatct

SEQ ID NO: 248035 - DNA, 16 bp, P. troglodytes
gccaggattacaggcc

SEQ ID NO: 248036 - DNA, 16 bp, P. troglodytes
gccaggcacagtggca

SEQ ID NO: 248037 - DNA, 16 bp, P. troglodytes
gccaggcacagtggct

SEQ ID NO: 248038 - DNA, 16 bp, P. troglodytes
gccaggcaccctttta

SEQ ID NO: 248039 - DNA, 16 bp, P. troglodytes
gccaggcactgaggat

SEQ ID NO: 248040 - DNA, 16 bp, P. troglodytes
gccaggcactgggcca

SEQ ID NO: 248041 - DNA, 16 bp, P. troglodytes
gccaggcagaggagct

SEQ ID NO: 248042 - DNA, 16 bp, P. troglodytes
gccaggcaggacagag

SEQ ID NO: 248043 - DNA, 16 bp, P. troglodytes
gccaggcagggtggct

SEQ ID NO: 248044 - DNA, 16 bp, P. troglodytes
gccaggcaggtggctc

SEQ ID NO: 248045 - DNA, 16 bp, P. troglodytes
gccaggcagtgagctg

SEQ ID NO: 248046 - DNA, 16 bp, P. troglodytes
gccaggcatgctggct

SEQ ID NO: 248047 - DNA, 16 bp, P. troglodytes
gccaggcatggcggca

SEQ ID NO: 248048 - DNA, 16 bp, P. troglodytes
gccaggcatgggggtg

SEQ ID NO: 248049 - DNA, 16 bp, P. troglodytes
gccaggcatggtgctg

SEQ ID NO: 248050 - DNA, 16 bp, P. troglodytes
gccaggcatggtgtct

SEQ ID NO: 248051 - DNA, 16 bp, P. troglodytes
gccaggccaggcatgg

SEQ ID NO: 248052 - DNA, 16 bp, P. troglodytes
gccaggccaggccagg

SEQ ID NO: 248053 - DNA, 16 bp, P. troglodytes
gccaggccaggcgcag

SEQ ID NO: 248054 - DNA, 16 bp, P. troglodytes
gccaggcccagggcct

SEQ ID NO: 248055 - DNA, 16 bp, P. troglodytes
gccaggcccagggctc

SEQ ID NO: 248056 - DNA, 16 bp, P. troglodytes
gccaggccctgtgctg

SEQ ID NO: 248057 - DNA, 16 bp, P. troglodytes
gccaggccctgtggct

SEQ ID NO: 248058 - DNA, 16 bp, P. troglodytes
gccaggcctggtgatg

SEQ ID NO: 248059 - DNA, 16 bp, P. troglodytes
gccaggcctggtggtg

SEQ ID NO: 248060 - DNA, 16 bp, P. troglodytes
gccaggcctgtgtcct

SEQ ID NO: 248061 - DNA, 16 bp, P. troglodytes
gccaggcgcggcggct

SEQ ID NO: 248062 - DNA, 16 bp, P. troglodytes
gccaggctagagtgca

SEQ ID NO: 248063 - DNA, 16 bp, P. troglodytes
gccaggctccatctca

SEQ ID NO: 248064 - DNA, 16 bp, P. troglodytes
gccaggctctgtgctg

SEQ ID NO: 248065 - DNA, 16 bp, P. troglodytes
gccaggctctgtggct

SEQ ID NO: 248066 - DNA, 16 bp, P. troglodytes
gccaggctgacctcag

SEQ ID NO: 248067 - DNA, 16 bp, P. troglodytes
gccaggctgagaattt

SEQ ID NO: 248068 - DNA, 16 bp, P. troglodytes
gccaggctgatgtcga

SEQ ID NO: 248069 - DNA, 16 bp, P. troglodytes
gccaggctggaatgca

SEQ ID NO: 248070 - DNA, 16 bp, P. troglodytes
gccaggctggagtaca

SEQ ID NO: 248071 - DNA, 16 bp, P. troglodytes
gccaggctggagtgca

SEQ ID NO: 248072 - DNA, 16 bp, P. troglodytes
gccaggctgggcgcgg

SEQ ID NO: 248073 - DNA, 16 bp, P. troglodytes
gccaggctggggtgca

SEQ ID NO: 248074 - DNA, 17 bp, P. troglodytes
gccaggctggtctcaag

SEQ ID NO: 248075 - DNA, 16 bp, P. troglodytes
gccaggctggtttcca

SEQ ID NO: 248076 - DNA, 16 bp, P. troglodytes
gccagggaagcagagg

SEQ ID NO: 248077 - DNA, 16 bp, P. troglodytes
gccagggaccccaccc

SEQ ID NO: 248078 - DNA, 16 bp, P. troglodytes
gccagggagacagagc

SEQ ID NO: 248079 - DNA, 16 bp, P. troglodytes
gccagggaggtggaag

SEQ ID NO: 248080 - DNA, 16 bp, P. troglodytes
gccagggatggtggct

SEQ ID NO: 248081 - DNA, 16 bp, P. troglodytes
gccagggcaacaaagt

SEQ ID NO: 248082 - DNA, 16 bp, P. troglodytes
gccagggcagggctgg

SEQ ID NO: 248083 - DNA, 16 bp, P. troglodytes
gccagggctctgacac

SEQ ID NO: 248084 - DNA, 16 bp, P. troglodytes
gccagggctggggagg

SEQ ID NO: 248085 - DNA, 16 bp, P. troglodytes
gccagggctggggcag

SEQ ID NO: 248086 - DNA, 16 bp, P. troglodytes
gccaggggcagtggct

SEQ ID NO: 248087 - DNA, 16 bp, P. troglodytes
gccaggggctgcaggg

SEQ ID NO: 248088 - DNA, 16 bp, P. troglodytes
gccaggggctggaggg

SEQ ID NO: 248089 - DNA, 16 bp, P. troglodytes
gccaggggctggggaa

SEQ ID NO: 248090 - DNA, 16 bp, P. troglodytes
gccaggggctggggga

SEQ ID NO: 248091 - DNA, 16 bp, P. troglodytes
gccaggggctgggtgg

SEQ ID NO: 248092 - DNA, 16 bp, P. troglodytes
gccaggggctgtgggg

SEQ ID NO: 248093 - DNA, 16 bp, P. troglodytes
gccagggtggtcttga

SEQ ID NO: 248094 - DNA, 16 bp, P. troglodytes
gccaggtgaggtggct

SEQ ID NO: 248095 - DNA, 16 bp, P. troglodytes
gccaggtgcagtagct

SEQ ID NO: 248096 - DNA, 16 bp, P. troglodytes
gccaggtgcagtggtg

SEQ ID NO: 248097 - DNA, 16 bp, P. troglodytes
gccaggtgccatggct

SEQ ID NO: 248098 - DNA, 16 bp, P. troglodytes
gccaggtgcctgtagt

SEQ ID NO: 248099 - DNA, 16 bp, P. troglodytes
gccaggtgcggcagct

SEQ ID NO: 248100 - DNA, 16 bp, P. troglodytes
gccaggtgcggcggct

SEQ ID NO: 248101 - DNA, 16 bp, P. troglodytes
gccaggtgctgtggct

SEQ ID NO: 248102 - DNA, 16 bp, P. troglodytes
gccaggtgctgtggtg

SEQ ID NO: 248103 - DNA, 16 bp, P. troglodytes
gccaggtggtggctca

SEQ ID NO: 248104 - DNA, 16 bp, P. troglodytes
gccaggtgtgatagca

SEQ ID NO: 248105 - DNA, 16 bp, P. troglodytes
gccaggtgtgctggct

SEQ ID NO: 248106 - DNA, 16 bp, P. troglodytes
gccaggtgtggtgggg

SEQ ID NO: 248107 - DNA, 16 bp, P. troglodytes
gccaggtgtgtgtgtg

SEQ ID NO: 248108 - DNA, 16 bp, P. troglodytes
gccaggttggtcttga

SEQ ID NO: 248109 - DNA, 16 bp, P. troglodytes
gccaggtttcccagca

SEQ ID NO: 248110 - DNA, 16 bp, P. troglodytes
gccagtaaatctttgg

SEQ ID NO: 248111 - DNA, 17 bp, P. troglodytes
gccagtagtcccagcta

SEQ ID NO: 248112 - DNA, 16 bp, P. troglodytes
gccagtgcactccaac

SEQ ID NO: 248113 - DNA, 16 bp, P. troglodytes
gccagtgcccctctgg

SEQ ID NO: 248114 - DNA, 16 bp, P. troglodytes
gccagtgcgcccagcc

SEQ ID NO: 248115 - DNA, 16 bp, P. troglodytes
gccagtgctctccagc

SEQ ID NO: 248116 - DNA, 16 bp, P. troglodytes
gccagtgggccagcac

SEQ ID NO: 248117 - DNA, 16 bp, P. troglodytes
gccagtgggtgcgcgc

SEQ ID NO: 248118 - DNA, 16 bp, P. troglodytes
gccagtgtagctggag

SEQ ID NO: 248119 - DNA, 16 bp, P. troglodytes
gccagtgtggctgcag

SEQ ID NO: 248120 - DNA, 16 bp, P. troglodytes
gccagttattccagca

SEQ ID NO: 248121 - DNA, 16 bp, P. troglodytes
gccagttcttccagca

SEQ ID NO: 248122 - DNA, 16 bp, P. troglodytes
gccagtttatcaatct

SEQ ID NO: 248123 - DNA, 16 bp, P. troglodytes
gccagttttcccaagg

SEQ ID NO: 248124 - DNA, 16 bp, P. troglodytes
gccagttttggggcca

SEQ ID NO: 248125 - DNA, 16 bp, P. troglodytes
gccataccaccctgaa

SEQ ID NO: 248126 - DNA, 16 bp, P. troglodytes
gccatactcccacctc

SEQ ID NO: 248127 - DNA, 16 bp, P. troglodytes
gccatagaaagaatga

SEQ ID NO: 248128 - DNA, 16 bp, P. troglodytes
gccatatgaggacaca

SEQ ID NO: 248129 - DNA, 16 bp, P. troglodytes
gccatcaagtttgtgg

SEQ ID NO: 248130 - DNA, 16 bp, P. troglodytes
gccatcacacctggat

SEQ ID NO: 248131 - DNA, 17 bp, P. troglodytes
gccatcagaagttgaca

SEQ ID NO: 248132 - DNA, 16 bp, P. troglodytes
gccatcaggcagggac

SEQ ID NO: 248133 - DNA, 16 bp, P. troglodytes
gccatcaggcctggct

SEQ ID NO: 248134 - DNA, 16 bp, P. troglodytes
gccatcatcatcatca

SEQ ID NO: 248135 - DNA, 16 bp, P. troglodytes
gccatcatcctcaaca

SEQ ID NO: 248136 - DNA, 16 bp, P. troglodytes
gccatcatcctccaga

SEQ ID NO: 248137 - DNA, 16 bp, P. troglodytes
gccatcatcttcagca

SEQ ID NO: 248138 - DNA, 16 bp, P. troglodytes
gccatcatgcttggct

SEQ ID NO: 248139 - DNA, 16 bp, P. troglodytes
gccatccatctccaga

SEQ ID NO: 248140 - DNA, 16 bp, P. troglodytes
gccatcccagctccag

SEQ ID NO: 248141 - DNA, 16 bp, P. troglodytes
gccatcctagaccagc

SEQ ID NO: 248142 - DNA, 16 bp, P. troglodytes
gccatcctcagcctcc

SEQ ID NO: 248143 - DNA, 16 bp, P. troglodytes
gccatcctcctacctt

SEQ ID NO: 248144 - DNA, 16 bp, P. troglodytes
gccatcctggctaaca

SEQ ID NO: 248145 - DNA, 16 bp, P. troglodytes
gccatcctgggctgca

SEQ ID NO: 248146 - DNA, 16 bp, P. troglodytes
gccatcgtgcccagct

SEQ ID NO: 248147 - DNA, 16 bp, P. troglodytes
gccatctccataacat

SEQ ID NO: 248148 - DNA, 16 bp, P. troglodytes
gccatctgcaaaccaa

SEQ ID NO: 248149 - DNA, 17 bp, P. troglodytes
gccatctgtcacccctt

SEQ ID NO: 248150 - DNA, 16 bp, P. troglodytes
gccatcttcccacctc

SEQ ID NO: 248151 - DNA, 16 bp, P. troglodytes
gccatcttcccatctc

SEQ ID NO: 248152 - DNA, 16 bp, P. troglodytes
gccatcttgctgatgt

SEQ ID NO: 248153 - DNA, 16 bp, P. troglodytes
gccatcttggctcctg

SEQ ID NO: 248154 - DNA, 16 bp, P. troglodytes
gccatcttggctgcca

SEQ ID NO: 248155 - DNA, 16 bp, P. troglodytes
gccatcttggttttag

SEQ ID NO: 248156 - DNA, 16 bp, P. troglodytes
gccatctttaagagct

SEQ ID NO: 248157 - DNA, 16 bp, P. troglodytes
gccatgatgatgccac

SEQ ID NO: 248158 - DNA, 16 bp, P. troglodytes
gccatgatgcccaggc

SEQ ID NO: 248159 - DNA, 16 bp, P. troglodytes
gccatgatgggaaggg

SEQ ID NO: 248160 - DNA, 16 bp, P. troglodytes
gccatgcccagctaat

SEQ ID NO: 248161 - DNA, 16 bp, P. troglodytes
gccatgcccggctaat

SEQ ID NO: 248162 - DNA, 19 bp, P. troglodytes
gccatgcctggctaatttt

SEQ ID NO: 248163 - DNA, 16 bp, P. troglodytes
gccatgctgcccaggc

SEQ ID NO: 248164 - DNA, 16 bp, P. troglodytes
gccatgctgctgtgct

SEQ ID NO: 248165 - DNA, 16 bp, P. troglodytes
gccatggcaatgtcca

SEQ ID NO: 248166 - DNA, 16 bp, P. troglodytes
gccatggcactccagc

SEQ ID NO: 248167 - DNA, 16 bp, P. troglodytes
gccatggcaggtggat

SEQ ID NO: 248168 - DNA, 16 bp, P. troglodytes
gccatggctagagtgg

SEQ ID NO: 248169 - DNA, 16 bp, P. troglodytes
gccatggctccagcca

SEQ ID NO: 248170 - DNA, 16 bp, P. troglodytes
gccatggcttcagaga

SEQ ID NO: 248171 - DNA, 16 bp, P. troglodytes
gccatggcttctgtgc

SEQ ID NO: 248172 - DNA, 16 bp, P. troglodytes
gccatgggtggttttg

SEQ ID NO: 248173 - DNA, 16 bp, P. troglodytes
gccatggtgcccagcc

SEQ ID NO: 248174 - DNA, 16 bp, P. troglodytes
gccatggtggtgcatg

SEQ ID NO: 248175 - DNA, 17 bp, P. troglodytes
gccatgtcggccaggct

SEQ ID NO: 248176 - DNA, 16 bp, P. troglodytes
gccatgtgaagacaga

SEQ ID NO: 248177 - DNA, 16 bp, P. troglodytes
gccatgtgaagatgtg

SEQ ID NO: 248178 - DNA, 16 bp, P. troglodytes
gccatgtgaagtgcct

SEQ ID NO: 248179 - DNA, 16 bp, P. troglodytes
gccatgtggaaatgtg

SEQ ID NO: 248180 - DNA, 16 bp, P. troglodytes
gccatgtggagacaga

SEQ ID NO: 248181 - DNA, 16 bp, P. troglodytes
gccatgttccaataaa

SEQ ID NO: 248182 - DNA, 18 bp, P. troglodytes
gccatgttgcccaggcta

SEQ ID NO: 248183 - DNA, 16 bp, P. troglodytes
gccatgttggcccagc

SEQ ID NO: 248184 - DNA, 16 bp, P. troglodytes
gccatgttggccgggc

SEQ ID NO: 248185 - DNA, 16 bp, P. troglodytes
gccattatgaaaaaca

SEQ ID NO: 248186 - DNA, 16 bp, P. troglodytes
gccattattacttcaa

SEQ ID NO: 248187 - DNA, 16 bp, P. troglodytes
gccattatttcttcaa

SEQ ID NO: 248188 - DNA, 16 bp, P. troglodytes
gccattcacctgcctc

SEQ ID NO: 248189 - DNA, 16 bp, P. troglodytes
gccattctaactggtg

SEQ ID NO: 248190 - DNA, 16 bp, P. troglodytes
gccattctggacatag

SEQ ID NO: 248191 - DNA, 16 bp, P. troglodytes
gccattgattttggtg

SEQ ID NO: 248192 - DNA, 18 bp, P. troglodytes
gccattgcacgccagcct

SEQ ID NO: 248193 - DNA, 16 bp, P. troglodytes
gccatttctccaaaga

SEQ ID NO: 248194 - DNA, 16 bp, P. troglodytes
gccatttctgacttta

SEQ ID NO: 248195 - DNA, 16 bp, P. troglodytes
gccatttgcaataaca

SEQ ID NO: 248196 - DNA, 16 bp, P. troglodytes
gccatttgctaagact

SEQ ID NO: 248197 - DNA, 16 bp, P. troglodytes
gccattttcattatat

SEQ ID NO: 248198 - DNA, 16 bp, P. troglodytes
gccattttcctgcttc

SEQ ID NO: 248199 - DNA, 16 bp, P. troglodytes
gccattttgaaatatg

SEQ ID NO: 248200 - DNA, 16 bp, P. troglodytes
gccatttttccaacag

SEQ ID NO: 248201 - DNA, 16 bp, P. troglodytes
gcccaaaataaaggga

SEQ ID NO: 248202 - DNA, 16 bp, P. troglodytes
gcccaacaccatgccc

SEQ ID NO: 248203 - DNA, 16 bp, P. troglodytes
gcccaagaatgtgcat

SEQ ID NO: 248204 - DNA, 16 bp, P. troglodytes
gcccaagactgtggga

SEQ ID NO: 248205 - DNA, 19 bp, P. troglodytes
gcccaagatattttccttt

SEQ ID NO: 248206 - DNA, 16 bp, P. troglodytes
gcccaagccagcagtg

SEQ ID NO: 248207 - DNA, 16 bp, P. troglodytes
gcccaagctgactaat

SEQ ID NO: 248208 - DNA, 16 bp, P. troglodytes
gcccaagctggaatac

SEQ ID NO: 248209 - DNA, 16 bp, P. troglodytes
gcccaagctggagcgc

SEQ ID NO: 248210 - DNA, 17 bp, P. troglodytes
gcccaagctggagtaca

SEQ ID NO: 248211 - DNA, 16 bp, P. troglodytes
gcccaagggagcttgt

SEQ ID NO: 248212 - DNA, 16 bp, P. troglodytes
gcccaagggcacacag

SEQ ID NO: 248213 - DNA, 16 bp, P. troglodytes
gcccaaggggtcaggg

SEQ ID NO: 248214 - DNA, 16 bp, P. troglodytes
gcccaaggtcacccag

SEQ ID NO: 248215 - DNA, 16 bp, P. troglodytes
gcccaaggtgacacag

SEQ ID NO: 248216 - DNA, 16 bp, P. troglodytes
gcccacagctgcacag

SEQ ID NO: 248217 - DNA, 16 bp, P. troglodytes
gcccacaggcagccag

SEQ ID NO: 248218 - DNA, 16 bp, P. troglodytes
gcccaccaccacacat

SEQ ID NO: 248219 - DNA, 16 bp, P. troglodytes
gcccaccaccatgccc

SEQ ID NO: 248220 - DNA, 16 bp, P. troglodytes
gcccacccacattgtg

SEQ ID NO: 248221 - DNA, 16 bp, P. troglodytes
gcccacccaggttaag

SEQ ID NO: 248222 - DNA, 16 bp, P. troglodytes
gcccacccatggccac

SEQ ID NO: 248223 - DNA, 16 bp, P. troglodytes
gcccacccggaactct

SEQ ID NO: 248224 - DNA, 18 bp, P. troglodytes
gcccaccggcgctgcgct

SEQ ID NO: 248225 - DNA, 16 bp, P. troglodytes
gcccacctcatcctcc

SEQ ID NO: 248226 - DNA, 16 bp, P. troglodytes
gcccacctcggctccc

SEQ ID NO: 248227 - DNA, 16 bp, P. troglodytes
gcccacctctgcctcc

SEQ ID NO: 248228 - DNA, 16 bp, P. troglodytes
gcccacctctgccttc

SEQ ID NO: 248229 - DNA, 16 bp, P. troglodytes
gcccacctctgcttcc

SEQ ID NO: 248230 - DNA, 16 bp, P. troglodytes
gcccacctctgtctcc

SEQ ID NO: 248231 - DNA, 16 bp, P. troglodytes
gcccacctggacctcc

SEQ ID NO: 248232 - DNA, 16 bp, P. troglodytes
gcccaccttggccccc

SEQ ID NO: 248233 - DNA, 16 bp, P. troglodytes
gcccaccttggccctc

SEQ ID NO: 248234 - DNA, 20 bp, P. troglodytes
gcccaccttggcctcccaaa

SEQ ID NO: 248235 - DNA, 22 bp, P. troglodytes
gcccaccttggcctcccaaagt

SEQ ID NO: 248236 - DNA, 26 bp, P. troglodytes
gcccaccttggcctcccaaagtgcta

SEQ ID NO: 248237 - DNA, 16 bp, P. troglodytes
gcccaccttggccttc

SEQ ID NO: 248238 - DNA, 20 bp, P. troglodytes
gcccaccttggtctcccaaa

SEQ ID NO: 248239 - DNA, 16 bp, P. troglodytes
gcccactcggcctggc

SEQ ID NO: 248240 - DNA, 16 bp, P. troglodytes
gcccactgcaacctcc

SEQ ID NO: 248241 - DNA, 16 bp, P. troglodytes
gcccactgcactccag

SEQ ID NO: 248242 - DNA, 16 bp, P. troglodytes
gcccactgcctggaaa

SEQ ID NO: 248243 - DNA, 16 bp, P. troglodytes
gcccacttcggcctct

SEQ ID NO: 248244 - DNA, 16 bp, P. troglodytes
gcccagaaacaaatcc

SEQ ID NO: 248245 - DNA, 16 bp, P. troglodytes
gcccagaaccagatgg

SEQ ID NO: 248246 - DNA, 16 bp, P. troglodytes
gcccagaacctgatgg

SEQ ID NO: 248247 - DNA, 16 bp, P. troglodytes
gcccagaagatggagg

SEQ ID NO: 248248 - DNA, 16 bp, P. troglodytes
gcccagaaggctgagg

SEQ ID NO: 248249 - DNA, 16 bp, P. troglodytes
gcccagaagtgacaca

SEQ ID NO: 248250 - DNA, 16 bp, P. troglodytes
gcccagaagttcaaga

SEQ ID NO: 248251 - DNA, 16 bp, P. troglodytes
gcccagaagttccagg

SEQ ID NO: 248252 - DNA, 16 bp, P. troglodytes
gcccagaagtttaagg

SEQ ID NO: 248253 - DNA, 16 bp, P. troglodytes
gcccagaccaatatcc

SEQ ID NO: 248254 - DNA, 16 bp, P. troglodytes
gcccagactgatcttg

SEQ ID NO: 248255 - DNA, 16 bp, P. troglodytes
gcccagactggggtgc

SEQ ID NO: 248256 - DNA, 16 bp, P. troglodytes
gcccagagaaagagag

SEQ ID NO: 248257 - DNA, 16 bp, P. troglodytes
gcccagagaacctttg

SEQ ID NO: 248258 - DNA, 16 bp, P. troglodytes
gcccagagaagaggaa

SEQ ID NO: 248259 - DNA, 16 bp, P. troglodytes
gcccagagagaaggaa

SEQ ID NO: 248260 - DNA, 16 bp, P. troglodytes
gcccagagagggcaag

SEQ ID NO: 248261 - DNA, 16 bp, P. troglodytes
gcccagagaggtggag

SEQ ID NO: 248262 - DNA, 16 bp, P. troglodytes
gcccagagaggttaaa

SEQ ID NO: 248263 - DNA, 16 bp, P. troglodytes
gcccagagcagtggct

SEQ ID NO: 248264 - DNA, 16 bp, P. troglodytes
gcccagattcaagggg

SEQ ID NO: 248265 - DNA, 16 bp, P. troglodytes
gcccagattgccagct

SEQ ID NO: 248266 - DNA, 16 bp, P. troglodytes
gcccagcactttggga

SEQ ID NO: 248267 - DNA, 16 bp, P. troglodytes
gcccagcaggtggagg

SEQ ID NO: 248268 - DNA, 16 bp, P. troglodytes
gcccagccaacacagc

SEQ ID NO: 248269 - DNA, 16 bp, P. troglodytes
gcccagccaacatggt

SEQ ID NO: 248270 - DNA, 16 bp, P. troglodytes
gcccagccagctgccc

SEQ ID NO: 248271 - DNA, 16 bp, P. troglodytes
gcccagcccagcccct

SEQ ID NO: 248272 - DNA, 16 bp, P. troglodytes
gcccagcccagccctg

SEQ ID NO: 248273 - DNA, 16 bp, P. troglodytes
gcccagccccagcctc

SEQ ID NO: 248274 - DNA, 16 bp, P. troglodytes
gcccagccctggcccc

SEQ ID NO: 248275 - DNA, 16 bp, P. troglodytes
gcccagccctgggcag

SEQ ID NO: 248276 - DNA, 16 bp, P. troglodytes
gcccagccgccccatc

SEQ ID NO: 248277 - DNA, 16 bp, P. troglodytes
gcccagcctgcttttt

SEQ ID NO: 248278 - DNA, 16 bp, P. troglodytes
gcccagcctggcccag

SEQ ID NO: 248279 - DNA, 16 bp, P. troglodytes
gcccagcctggggtgc

SEQ ID NO: 248280 - DNA, 16 bp, P. troglodytes
gcccagctaaattttt

SEQ ID NO: 248281 - DNA, 16 bp, P. troglodytes
gcccagctaattttat

SEQ ID NO: 248282 - DNA, 16 bp, P. troglodytes
gcccagctaattttct

SEQ ID NO: 248283 - DNA, 18 bp, P. troglodytes
gcccagctaattttttaa

SEQ ID NO: 248284 - DNA, 16 bp, P. troglodytes
gcccagctactcggga

SEQ ID NO: 248285 - DNA, 16 bp, P. troglodytes
gcccagctcttcctcc

SEQ ID NO: 248286 - DNA, 17 bp, P. troglodytes
gcccagctggcttcacc

SEQ ID NO: 248287 - DNA, 16 bp, P. troglodytes
gcccagctggcttccc

SEQ ID NO: 248288 - DNA, 16 bp, P. troglodytes
gcccagcttggagtgc

SEQ ID NO: 248289 - DNA, 16 bp, P. troglodytes
gcccaggaaagccaaa

SEQ ID NO: 248290 - DNA, 16 bp, P. troglodytes
gcccaggaaggagaaa

SEQ ID NO: 248291 - DNA, 16 bp, P. troglodytes
gcccaggaattagaga

SEQ ID NO: 248292 - DNA, 16 bp, P. troglodytes
gcccaggaccagatgg

SEQ ID NO: 248293 - DNA, 16 bp, P. troglodytes
gcccaggagacagagc

SEQ ID NO: 248294 - DNA, 16 bp, P. troglodytes
gcccaggagagaggcc

SEQ ID NO: 248295 - DNA, 16 bp, P. troglodytes
gcccaggagatggaag

SEQ ID NO: 248296 - DNA, 16 bp, P. troglodytes
gcccaggagatggaga

SEQ ID NO: 248297 - DNA, 16 bp, P. troglodytes
gcccaggagccagagg

SEQ ID NO: 248298 - DNA, 16 bp, P. troglodytes
gcccaggagcctgtct

SEQ ID NO: 248299 - DNA, 16 bp, P. troglodytes
gcccaggagctccaga

SEQ ID NO: 248300 - DNA, 16 bp, P. troglodytes
gcccaggagctggagg

SEQ ID NO: 248301 - DNA, 16 bp, P. troglodytes
gcccaggaggaggagg

SEQ ID NO: 248302 - DNA, 16 bp, P. troglodytes
gcccaggaggcagaag

SEQ ID NO: 248303 - DNA, 16 bp, P. troglodytes
gcccaggagggtgggg

SEQ ID NO: 248304 - DNA, 16 bp, P. troglodytes
gcccaggaggttgaaa

SEQ ID NO: 248305 - DNA, 16 bp, P. troglodytes
gcccaggaggttgatg

SEQ ID NO: 248306 - DNA, 16 bp, P. troglodytes
gcccaggaggttgggg

SEQ ID NO: 248307 - DNA, 16 bp, P. troglodytes
gcccaggagtacaagg

SEQ ID NO: 248308 - DNA, 16 bp, P. troglodytes
gcccaggagtatgagg

SEQ ID NO: 248309 - DNA, 16 bp, P. troglodytes
gcccaggagtcagagg

SEQ ID NO: 248310 - DNA, 16 bp, P. troglodytes
gcccaggagttcatgg

SEQ ID NO: 248311 - DNA, 16 bp, P. troglodytes
gcccaggagttcgaca

SEQ ID NO: 248312 - DNA, 16 bp, P. troglodytes
gcccaggagttgcagg

SEQ ID NO: 248313 - DNA, 16 bp, P. troglodytes
gcccaggagttgggga

SEQ ID NO: 248314 - DNA, 16 bp, P. troglodytes
gcccaggagtttgaag

SEQ ID NO: 248315 - DNA, 16 bp, P. troglodytes
gcccaggagtttgaca

SEQ ID NO: 248316 - DNA, 16 bp, P. troglodytes
gcccaggatgatctca

SEQ ID NO: 248317 - DNA, 16 bp, P. troglodytes
gcccaggcagcctggc

SEQ ID NO: 248318 - DNA, 16 bp, P. troglodytes
gcccaggcaggaatgc

SEQ ID NO: 248319 - DNA, 16 bp, P. troglodytes
gcccaggcaggcagat

SEQ ID NO: 248320 - DNA, 16 bp, P. troglodytes
gcccaggcaggggagg

SEQ ID NO: 248321 - DNA, 16 bp, P. troglodytes
gcccaggccaggccat

SEQ ID NO: 248322 - DNA, 16 bp, P. troglodytes
gcccaggcccagggcc

SEQ ID NO: 248323 - DNA, 16 bp, P. troglodytes
gcccaggctctggagt

SEQ ID NO: 248324 - DNA, 16 bp, P. troglodytes
gcccaggctgaagagc

SEQ ID NO: 248325 - DNA, 16 bp, P. troglodytes
gcccaggctgacctca

SEQ ID NO: 248326 - DNA, 16 bp, P. troglodytes
gcccaggctgcaggct

SEQ ID NO: 248327 - DNA, 16 bp, P. troglodytes
gcccaggctgccaggc

SEQ ID NO: 248328 - DNA, 16 bp, P. troglodytes
gcccaggctggaccgc

SEQ ID NO: 248329 - DNA, 16 bp, P. troglodytes
gcccaggctggactcc

SEQ ID NO: 248330 - DNA, 16 bp, P. troglodytes
gcccaggctggagcag

SEQ ID NO: 248331 - DNA, 16 bp, P. troglodytes
gcccaggctggagtaa

SEQ ID NO: 248332 - DNA, 16 bp, P. troglodytes
gcccaggctggagtga

SEQ ID NO: 248333 - DNA, 16 bp, P. troglodytes
gcccaggctggccttc

SEQ ID NO: 248334 - DNA, 16 bp, P. troglodytes
gcccaggctgggtttg

SEQ ID NO: 248335 - DNA, 16 bp, P. troglodytes
gcccaggctggtcacg

SEQ ID NO: 248336 - DNA, 16 bp, P. troglodytes
gcccaggctggtgcag

SEQ ID NO: 248337 - DNA, 16 bp, P. troglodytes
gcccaggctggttttg

SEQ ID NO: 248338 - DNA, 16 bp, P. troglodytes
gcccaggcttgtcttg

SEQ ID NO: 248339 - DNA, 16 bp, P. troglodytes
gcccagggaagctaaa

SEQ ID NO: 248340 - DNA, 16 bp, P. troglodytes
gcccagggaggctgag

SEQ ID NO: 248341 - DNA, 16 bp, P. troglodytes
gcccagggcagggagg

SEQ ID NO: 248342 - DNA, 16 bp, P. troglodytes
gcccagggccacacag

SEQ ID NO: 248343 - DNA, 16 bp, P. troglodytes
gcccagggccaggcac

SEQ ID NO: 248344 - DNA, 16 bp, P. troglodytes
gcccagggcctggcac

SEQ ID NO: 248345 - DNA, 16 bp, P. troglodytes
gcccagggctgggagg

SEQ ID NO: 248346 - DNA, 16 bp, P. troglodytes
gcccaggggattggtt

SEQ ID NO: 248347 - DNA, 16 bp, P. troglodytes
gcccagggtggtctgg

SEQ ID NO: 248348 - DNA, 16 bp, P. troglodytes
gcccaggtctgcagcc

SEQ ID NO: 248349 - DNA, 16 bp, P. troglodytes
gcccaggtgatcctcc

SEQ ID NO: 248350 - DNA, 16 bp, P. troglodytes
gcccaggtgggcagat

SEQ ID NO: 248351 - DNA, 16 bp, P. troglodytes
gcccaggtggtctcaa

SEQ ID NO: 248352 - DNA, 16 bp, P. troglodytes
gcccaggtggtggagg

SEQ ID NO: 248353 - DNA, 16 bp, P. troglodytes
gcccagtctgaagtgc

SEQ ID NO: 248354 - DNA, 16 bp, P. troglodytes
gcccagtgcaaaatga

SEQ ID NO: 248355 - DNA, 16 bp, P. troglodytes
gcccagtgctgtgctg

SEQ ID NO: 248356 - DNA, 16 bp, P. troglodytes
gcccagttaacttttg

SEQ ID NO: 248357 - DNA, 16 bp, P. troglodytes
gcccatctcagcctcc

SEQ ID NO: 248358 - DNA, 16 bp, P. troglodytes
gcccatcttggcctcc

SEQ ID NO: 248359 - DNA, 16 bp, P. troglodytes
gcccatgaggcagagg

SEQ ID NO: 248360 - DNA, 16 bp, P. troglodytes
gcccatgcccacccag

SEQ ID NO: 248361 - DNA, 16 bp, P. troglodytes
gcccatgcccacctgg

SEQ ID NO: 248362 - DNA, 16 bp, P. troglodytes
gcccatgcctatgccc

SEQ ID NO: 248363 - DNA, 16 bp, P. troglodytes
gcccatgctgatcttg

SEQ ID NO: 248364 - DNA, 17 bp, P. troglodytes
gcccatgctggagtgca

SEQ ID NO: 248365 - DNA, 16 bp, P. troglodytes
gcccatgctggtcttg

SEQ ID NO: 248366 - DNA, 16 bp, P. troglodytes
gcccatgtggctggag

SEQ ID NO: 248367 - DNA, 16 bp, P. troglodytes
gcccattcctgcctgg

SEQ ID NO: 248368 - DNA, 16 bp, P. troglodytes
gcccattttccagatg

SEQ ID NO: 248369 - DNA, 16 bp, P. troglodytes
gcccatttttaattgt

SEQ ID NO: 248370 - DNA, 16 bp, P. troglodytes
gccccaaactggaaat

SEQ ID NO: 248371 - DNA, 16 bp, P. troglodytes
gccccacagcctgccc

SEQ ID NO: 248372 - DNA, 16 bp, P. troglodytes
gccccacccatcacct

SEQ ID NO: 248373 - DNA, 16 bp, P. troglodytes
gccccaccctcccagg

SEQ ID NO: 248374 - DNA, 16 bp, P. troglodytes
gccccacctcggcctc

SEQ ID NO: 248375 - DNA, 16 bp, P. troglodytes
gccccactcccagtac

SEQ ID NO: 248376 - DNA, 16 bp, P. troglodytes
gccccactcctggctg

SEQ ID NO: 248377 - DNA, 16 bp, P. troglodytes
gccccagagagctccc

SEQ ID NO: 248378 - DNA, 16 bp, P. troglodytes
gccccagaggacaaag

SEQ ID NO: 248379 - DNA, 16 bp, P. troglodytes
gccccagcccagacct

SEQ ID NO: 248380 - DNA, 16 bp, P. troglodytes
gccccagccccagcct

SEQ ID NO: 248381 - DNA, 16 bp, P. troglodytes
gccccagccctgcctg

SEQ ID NO: 248382 - DNA, 16 bp, P. troglodytes
gccccagccctggggc

SEQ ID NO: 248383 - DNA, 16 bp, P. troglodytes
gccccagcctctcgag

SEQ ID NO: 248384 - DNA, 16 bp, P. troglodytes
gccccagcctctggag

SEQ ID NO: 248385 - DNA, 16 bp, P. troglodytes
gccccagccttctgag

SEQ ID NO: 248386 - DNA, 16 bp, P. troglodytes
gccccagctacttggg

SEQ ID NO: 248387 - DNA, 16 bp, P. troglodytes
gccccagctccagccc

SEQ ID NO: 248388 - DNA, 16 bp, P. troglodytes
gccccagctcctgcac

SEQ ID NO: 248389 - DNA, 16 bp, P. troglodytes
gccccaggccacacag

SEQ ID NO: 248390 - DNA, 16 bp, P. troglodytes
gccccaggccctgccc

SEQ ID NO: 248391 - DNA, 16 bp, P. troglodytes
gccccaggctcagcca

SEQ ID NO: 248392 - DNA, 16 bp, P. troglodytes
gccccagggcctttgc

SEQ ID NO: 248393 - DNA, 16 bp, P. troglodytes
gccccagtgtctgatg

SEQ ID NO: 248394 - DNA, 16 bp, P. troglodytes
gccccagtgtgtgtgg

SEQ ID NO: 248395 - DNA, 16 bp, P. troglodytes
gccccagttcccgccc

SEQ ID NO: 248396 - DNA, 16 bp, P. troglodytes
gccccagttttctcat

SEQ ID NO: 248397 - DNA, 16 bp, P. troglodytes
gccccataagattata

SEQ ID NO: 248398 - DNA, 16 bp, P. troglodytes
gccccatccctagggg

SEQ ID NO: 248399 - DNA, 16 bp, P. troglodytes
gccccatccgggaggg

SEQ ID NO: 248400 - DNA, 16 bp, P. troglodytes
gccccatcctgaagct

SEQ ID NO: 248401 - DNA, 16 bp, P. troglodytes
gccccatctctctctc

SEQ ID NO: 248402 - DNA, 16 bp, P. troglodytes
gccccattgcactcca

SEQ ID NO: 248403 - DNA, 16 bp, P. troglodytes
gcccccaagcccagct

SEQ ID NO: 248404 - DNA, 16 bp, P. troglodytes
gcccccaccctcttct

SEQ ID NO: 248405 - DNA, 16 bp, P. troglodytes
gcccccacctcctggg

SEQ ID NO: 248406 - DNA, 16 bp, P. troglodytes
gcccccacgcccagct

SEQ ID NO: 248407 - DNA, 16 bp, P. troglodytes
gcccccaggcttcagg

SEQ ID NO: 248408 - DNA, 16 bp, P. troglodytes
gcccccataattcaat

SEQ ID NO: 248409 - DNA, 16 bp, P. troglodytes
gcccccatgatccaat

SEQ ID NO: 248410 - DNA, 16 bp, P. troglodytes
gcccccatgattcgat

SEQ ID NO: 248411 - DNA, 16 bp, P. troglodytes
gcccccatgcccagct

SEQ ID NO: 248412 - DNA, 16 bp, P. troglodytes
gccccccaagtacctg

SEQ ID NO: 248413 - DNA, 16 bp, P. troglodytes
gccccccaagttcaag

SEQ ID NO: 248414 - DNA, 16 bp, P. troglodytes
gccccccagcccctga

SEQ ID NO: 248415 - DNA, 16 bp, P. troglodytes
gccccccaggttcaag

SEQ ID NO: 248416 - DNA, 16 bp, P. troglodytes
gccccccgagttcaag

SEQ ID NO: 248417 - DNA, 18 bp, P. troglodytes
gcccccctggctgagctg

SEQ ID NO: 248418 - DNA, 16 bp, P. troglodytes
gcccccgagggccatc

SEQ ID NO: 248419 - DNA, 16 bp, P. troglodytes
gcccccgcacctggcc

SEQ ID NO: 248420 - DNA, 16 bp, P. troglodytes
gcccccgcactccagc

SEQ ID NO: 248421 - DNA, 16 bp, P. troglodytes
gcccccgcctggccag

SEQ ID NO: 248422 - DNA, 16 bp, P. troglodytes
gccccctccagacttt

SEQ ID NO: 248423 - DNA, 16 bp, P. troglodytes
gccccctgaggagctg

SEQ ID NO: 248424 - DNA, 16 bp, P. troglodytes
gcccccttcccacagc

SEQ ID NO: 248425 - DNA, 16 bp, P. troglodytes
gccccgagaggtggag

SEQ ID NO: 248426 - DNA, 16 bp, P. troglodytes
gccccgaggaaggggc

SEQ ID NO: 248427 - DNA, 16 bp, P. troglodytes
gccccgctgcactcca

SEQ ID NO: 248428 - DNA, 16 bp, P. troglodytes
gccccggaggtggagg

SEQ ID NO: 248429 - DNA, 16 bp, P. troglodytes
gccccggttcccaccc

SEQ ID NO: 248430 - DNA, 16 bp, P. troglodytes
gcccctaatcccgctt

SEQ ID NO: 248431 - DNA, 16 bp, P. troglodytes
gcccctactgtgtgcc

SEQ ID NO: 248432 - DNA, 16 bp, P. troglodytes
gcccctcccatcatag

SEQ ID NO: 248433 - DNA, 16 bp, P. troglodytes
gcccctccccaagcct

SEQ ID NO: 248434 - DNA, 16 bp, P. troglodytes
gcccctcccccaagga

SEQ ID NO: 248435 - DNA, 16 bp, P. troglodytes
gcccctccctctggga

SEQ ID NO: 248436 - DNA, 16 bp, P. troglodytes
gcccctcctcagggtg

SEQ ID NO: 248437 - DNA, 16 bp, P. troglodytes
gcccctcctccctcag

SEQ ID NO: 248438 - DNA, 16 bp, P. troglodytes
gcccctctatactcta

SEQ ID NO: 248439 - DNA, 16 bp, P. troglodytes
gcccctctctggggct

SEQ ID NO: 248440 - DNA, 18 bp, P. troglodytes
gcccctctgcccggcagc

SEQ ID NO: 248441 - DNA, 16 bp, P. troglodytes
gcccctctgcctggcc

SEQ ID NO: 248442 - DNA, 16 bp, P. troglodytes
gcccctgaagaccttc

SEQ ID NO: 248443 - DNA, 16 bp, P. troglodytes
gcccctgagggccatc

SEQ ID NO: 248444 - DNA, 16 bp, P. troglodytes
gcccctgcacacacac

SEQ ID NO: 248445 - DNA, 16 bp, P. troglodytes
gcccctgcacccagcc

SEQ ID NO: 248446 - DNA, 16 bp, P. troglodytes
gcccctgcactccagc

SEQ ID NO: 248447 - DNA, 16 bp, P. troglodytes
gcccctgccccaggaa

SEQ ID NO: 248448 - DNA, 16 bp, P. troglodytes
gcccctgcctcccaaa

SEQ ID NO: 248449 - DNA, 16 bp, P. troglodytes
gcccctgcctctgcct

SEQ ID NO: 248450 - DNA, 16 bp, P. troglodytes
gcccctgcctctttgc

SEQ ID NO: 248451 - DNA, 16 bp, P. troglodytes
gcccctggaaaagcca

SEQ ID NO: 248452 - DNA, 16 bp, P. troglodytes
gcccctggaaaccacc

SEQ ID NO: 248453 - DNA, 16 bp, P. troglodytes
gcccctggcaaacact

SEQ ID NO: 248454 - DNA, 16 bp, P. troglodytes
gcccctggcaactacc

SEQ ID NO: 248455 - DNA, 16 bp, P. troglodytes
gcccctggcagccacc

SEQ ID NO: 248456 - DNA, 16 bp, P. troglodytes
gcccctgtgcctggct

SEQ ID NO: 248457 - DNA, 16 bp, P. troglodytes
gcccctgtggctctgc

SEQ ID NO: 248458 - DNA, 16 bp, P. troglodytes
gccccttccccagcct

SEQ ID NO: 248459 - DNA, 16 bp, P. troglodytes
gccccttcctccttgt

SEQ ID NO: 248460 - DNA, 16 bp, P. troglodytes
gcccgactcggcctcc

SEQ ID NO: 248461 - DNA, 16 bp, P. troglodytes
gcccgagcctccccga

SEQ ID NO: 248462 - DNA, 16 bp, P. troglodytes
gcccgcattgccaagg

SEQ ID NO: 248463 - DNA, 16 bp, P. troglodytes
gcccgccaccatgccc

SEQ ID NO: 248464 - DNA, 16 bp, P. troglodytes
gcccgccaccgtgccc

SEQ ID NO: 248465 - DNA, 16 bp, P. troglodytes
gcccgccacgatgccc

SEQ ID NO: 248466 - DNA, 16 bp, P. troglodytes
gcccgccactacgccc

SEQ ID NO: 248467 - DNA, 16 bp, P. troglodytes
gcccgccagcatgccc

SEQ ID NO: 248468 - DNA, 16 bp, P. troglodytes
gcccgccgcagcctcc

SEQ ID NO: 248469 - DNA, 17 bp, P. troglodytes
gcccgcctcagcctcct

SEQ ID NO: 248470 - DNA, 16 bp, P. troglodytes
gcccgcctcggcctct

SEQ ID NO: 248471 - DNA, 16 bp, P. troglodytes
gcccgccttggccacc

SEQ ID NO: 248472 - DNA, 20 bp, P. troglodytes
gcccgccttggccttccaaa

SEQ ID NO: 248473 - DNA, 16 bp, P. troglodytes
gcccgctaccacgccc

SEQ ID NO: 248474 - DNA, 16 bp, P. troglodytes
gcccgctaccgcgccc

SEQ ID NO: 248475 - DNA, 16 bp, P. troglodytes
gcccggataatttttt

SEQ ID NO: 248476 - DNA, 16 bp, P. troglodytes
gcccggcaaatttttt

SEQ ID NO: 248477 - DNA, 16 bp, P. troglodytes
gcccggccacacctgg

SEQ ID NO: 248478 - DNA, 16 bp, P. troglodytes
gcccggccagccgctc

SEQ ID NO: 248479 - DNA, 16 bp, P. troglodytes
gcccggcctcagcctg

SEQ ID NO: 248480 - DNA, 16 bp, P. troglodytes
gcccggctaattttgt

SEQ ID NO: 248481 - DNA, 16 bp, P. troglodytes
gcccggggaggttgag

SEQ ID NO: 248482 - DNA, 16 bp, P. troglodytes
gcccgggtaatttttt

SEQ ID NO: 248483 - DNA, 16 bp, P. troglodytes
gcccggtgtggtggtg

SEQ ID NO: 248484 - DNA, 16 bp, P. troglodytes
gccctaaggtggtttt

SEQ ID NO: 248485 - DNA, 16 bp, P. troglodytes
gccctaatccaatttg

SEQ ID NO: 248486 - DNA, 16 bp, P. troglodytes
gccctaatgaatggga

SEQ ID NO: 248487 - DNA, 16 bp, P. troglodytes
gccctagaaatctgtg

SEQ ID NO: 248488 - DNA, 16 bp, P. troglodytes
gccctcaaggagttca

SEQ ID NO: 248489 - DNA, 16 bp, P. troglodytes
gccctcacagccctca

SEQ ID NO: 248490 - DNA, 16 bp, P. troglodytes
gccctcaccaatgtgg

SEQ ID NO: 248491 - DNA, 16 bp, P. troglodytes
gccctcaccagaagct

SEQ ID NO: 248492 - DNA, 16 bp, P. troglodytes
gccctcagggagctca

SEQ ID NO: 248493 - DNA, 16 bp, P. troglodytes
gccctcatcagaaacc

SEQ ID NO: 248494 - DNA, 16 bp, P. troglodytes
gccctccagcccaggc

SEQ ID NO: 248495 - DNA, 16 bp, P. troglodytes
gccctccagcctggcc

SEQ ID NO: 248496 - DNA, 16 bp, P. troglodytes
gccctccagcctgggc

SEQ ID NO: 248497 - DNA, 16 bp, P. troglodytes
gccctccagcctgggg

SEQ ID NO: 248498 - DNA, 16 bp, P. troglodytes
gccctcccagtagctg

SEQ ID NO: 248499 - DNA, 16 bp, P. troglodytes
gccctcctcagcctct

SEQ ID NO: 248500 - DNA, 16 bp, P. troglodytes
gccctcctgcctcagc

SEQ ID NO: 248501 - DNA, 16 bp, P. troglodytes
gccctccttgggctgc

SEQ ID NO: 248502 - DNA, 16 bp, P. troglodytes
gccctccttggtctcc

SEQ ID NO: 248503 - DNA, 16 bp, P. troglodytes
gccctctcctgcccca

SEQ ID NO: 248504 - DNA, 16 bp, P. troglodytes
gccctctcctgctctg

SEQ ID NO: 248505 - DNA, 16 bp, P. troglodytes
gccctctctgggcagc

SEQ ID NO: 248506 - DNA, 16 bp, P. troglodytes
gccctctggcttctgg

SEQ ID NO: 248507 - DNA, 16 bp, P. troglodytes
gccctcttctcacagt

SEQ ID NO: 248508 - DNA, 16 bp, P. troglodytes
gccctcttctgccctg

SEQ ID NO: 248509 - DNA, 16 bp, P. troglodytes
gccctgaacaaaatct

SEQ ID NO: 248510 - DNA, 16 bp, P. troglodytes
gccctgaaggatgagt

SEQ ID NO: 248511 - DNA, 16 bp, P. troglodytes
gccctgcaaagccaca

SEQ ID NO: 248512 - DNA, 16 bp, P. troglodytes
gccctgcagcctgggt

SEQ ID NO: 248513 - DNA, 16 bp, P. troglodytes
gccctgcatcccagct

SEQ ID NO: 248514 - DNA, 16 bp, P. troglodytes
gccctgccagccccag

SEQ ID NO: 248515 - DNA, 16 bp, P. troglodytes
gccctgcccacatcct

SEQ ID NO: 248516 - DNA, 16 bp, P. troglodytes
gccctgcccaccacct

SEQ ID NO: 248517 - DNA, 16 bp, P. troglodytes
gccctgcccagcccag

SEQ ID NO: 248518 - DNA, 16 bp, P. troglodytes
gccctgcccagccctg

SEQ ID NO: 248519 - DNA, 16 bp, P. troglodytes
gccctgccccaccctg

SEQ ID NO: 248520 - DNA, 16 bp, P. troglodytes
gccctgccccatgggg

SEQ ID NO: 248521 - DNA, 16 bp, P. troglodytes
gccctgcccccacctg

SEQ ID NO: 248522 - DNA, 16 bp, P. troglodytes
gccctgccctgcaggg

SEQ ID NO: 248523 - DNA, 16 bp, P. troglodytes
gccctgccctgcccca

SEQ ID NO: 248524 - DNA, 16 bp, P. troglodytes
gccctgccctgcctta

SEQ ID NO: 248525 - DNA, 16 bp, P. troglodytes
gccctgcctgccccag

SEQ ID NO: 248526 - DNA, 16 bp, P. troglodytes
gccctgctaattttta

SEQ ID NO: 248527 - DNA, 16 bp, P. troglodytes
gccctgctcccagagg

SEQ ID NO: 248528 - DNA, 16 bp, P. troglodytes
gccctgctgccctgtg

SEQ ID NO: 248529 - DNA, 16 bp, P. troglodytes
gccctgctgctcaaac

SEQ ID NO: 248530 - DNA, 16 bp, P. troglodytes
gccctgctgctctgtg

SEQ ID NO: 248531 - DNA, 16 bp, P. troglodytes
gccctgcttgctttct

SEQ ID NO: 248532 - DNA, 16 bp, P. troglodytes
gccctggacctggccc

SEQ ID NO: 248533 - DNA, 16 bp, P. troglodytes
gccctggaggtggagg

SEQ ID NO: 248534 - DNA, 16 bp, P. troglodytes
gccctggagttggagg

SEQ ID NO: 248535 - DNA, 16 bp, P. troglodytes
gccctggccagccctg

SEQ ID NO: 248536 - DNA, 16 bp, P. troglodytes
gccctggcccaggccc

SEQ ID NO: 248537 - DNA, 16 bp, P. troglodytes
gccctggccccagccc

SEQ ID NO: 248538 - DNA, 16 bp, P. troglodytes
gccctggccctggcct

SEQ ID NO: 248539 - DNA, 16 bp, P. troglodytes
gccctggctcagggag

SEQ ID NO: 248540 - DNA, 16 bp, P. troglodytes
gccctggctgaggagg

SEQ ID NO: 248541 - DNA, 16 bp, P. troglodytes
gccctggctggagtgc

SEQ ID NO: 248542 - DNA, 16 bp, P. troglodytes
gccctgggccaggccc

SEQ ID NO: 248543 - DNA, 16 bp, P. troglodytes
gccctgggcccagctc

SEQ ID NO: 248544 - DNA, 16 bp, P. troglodytes
gccctgggcctcagtt

SEQ ID NO: 248545 - DNA, 16 bp, P. troglodytes
gccctgggcctggccc

SEQ ID NO: 248546 - DNA, 16 bp, P. troglodytes
gccctggggcaggagt

SEQ ID NO: 248547 - DNA, 16 bp, P. troglodytes
gccctgggggcttctg

SEQ ID NO: 248548 - DNA, 21 bp, P. troglodytes
gccctgggtgggccaggtgtt

SEQ ID NO: 248549 - DNA, 16 bp, P. troglodytes
gccctggtggtgacaa

SEQ ID NO: 248550 - DNA, 16 bp, P. troglodytes
gccctggtttctttta

SEQ ID NO: 248551 - DNA, 16 bp, P. troglodytes
gccctgtcacccaggc

SEQ ID NO: 248552 - DNA, 16 bp, P. troglodytes
gccctgtcctgccctg

SEQ ID NO: 248553 - DNA, 16 bp, P. troglodytes
gccctgtctccaaaca

SEQ ID NO: 248554 - DNA, 16 bp, P. troglodytes
gccctgtctgggaggg

SEQ ID NO: 248555 - DNA, 16 bp, P. troglodytes
gccctgtgcagcctca

SEQ ID NO: 248556 - DNA, 16 bp, P. troglodytes
gccctgtggctggagg

SEQ ID NO: 248557 - DNA, 16 bp, P. troglodytes
gccctgtgtccccacc

SEQ ID NO: 248558 - DNA, 16 bp, P. troglodytes
gccctgttggccaggc

SEQ ID NO: 248559 - DNA, 16 bp, P. troglodytes
gcccttcacatttttt

SEQ ID NO: 248560 - DNA, 16 bp, P. troglodytes
gcccttcagcccacca

SEQ ID NO: 248561 - DNA, 16 bp, P. troglodytes
gcccttcagcctgcca

SEQ ID NO: 248562 - DNA, 16 bp, P. troglodytes
gcccttcagcctgctg

SEQ ID NO: 248563 - DNA, 16 bp, P. troglodytes
gcccttcctccaacac

SEQ ID NO: 248564 - DNA, 16 bp, P. troglodytes
gcccttcctccatcct

SEQ ID NO: 248565 - DNA, 16 bp, P. troglodytes
gcccttgatgtcctgc

SEQ ID NO: 248566 - DNA, 16 bp, P. troglodytes
gcccttggtcattcct

SEQ ID NO: 248567 - DNA, 16 bp, P. troglodytes
gccctttacagagaaa

SEQ ID NO: 248568 - DNA, 16 bp, P. troglodytes
gccctttatttcttcc

SEQ ID NO: 248569 - DNA, 16 bp, P. troglodytes
gccctttggggagccc

SEQ ID NO: 248570 - DNA, 16 bp, P. troglodytes
gccctttgtcttcagt

SEQ ID NO: 248571 - DNA, 16 bp, P. troglodytes
gccgaatccagcagca

SEQ ID NO: 248572 - DNA, 16 bp, P. troglodytes
gccgagatcacactgc

SEQ ID NO: 248573 - DNA, 16 bp, P. troglodytes
gccgagatcgtgctgc

SEQ ID NO: 248574 - DNA, 16 bp, P. troglodytes
gccgagattgtaccac

SEQ ID NO: 248575 - DNA, 16 bp, P. troglodytes
gccgagcatggtggca

SEQ ID NO: 248576 - DNA, 16 bp, P. troglodytes
gccgagcatggtggtg

SEQ ID NO: 248577 - DNA, 16 bp, P. troglodytes
gccgagcgtggtggct

SEQ ID NO: 248578 - DNA, 16 bp, P. troglodytes
gccgaggaaggcagat

SEQ ID NO: 248579 - DNA, 16 bp, P. troglodytes
gccgaggagggaggat

SEQ ID NO: 248580 - DNA, 16 bp, P. troglodytes
gccgaggcagaaggat

SEQ ID NO: 248581 - DNA, 18 bp, P. troglodytes
gccgaggcaggcggatct

SEQ ID NO: 248582 - DNA, 16 bp, P. troglodytes
gccgaggcgtgtggat

SEQ ID NO: 248583 - DNA, 16 bp, P. troglodytes
gccgaggctggaagat

SEQ ID NO: 248584 - DNA, 16 bp, P. troglodytes
gccgaggtgggagaat

SEQ ID NO: 248585 - DNA, 16 bp, P. troglodytes
gccgaggtgggaggat

SEQ ID NO: 248586 - DNA, 16 bp, P. troglodytes
gccgaggtgggcaaat

SEQ ID NO: 248587 - DNA, 16 bp, P. troglodytes
gccgaggtgggcaggt

SEQ ID NO: 248588 - DNA, 20 bp, P. troglodytes
gccgaggtgggcggatcact

SEQ ID NO: 248589 - DNA, 16 bp, P. troglodytes
gccgaggtgggtagat

SEQ ID NO: 248590 - DNA, 16 bp, P. troglodytes
gccgaggtgggtgtat

SEQ ID NO: 248591 - DNA, 16 bp, P. troglodytes
gccgcacaggagccca

SEQ ID NO: 248592 - DNA, 16 bp, P. troglodytes
gccgccacgcccagct

SEQ ID NO: 248593 - DNA, 16 bp, P. troglodytes
gccgcccaggctggaa

SEQ ID NO: 248594 - DNA, 16 bp, P. troglodytes
gccgccccctgctcca

SEQ ID NO: 248595 - DNA, 16 bp, P. troglodytes
gccgcccgagcctccc

SEQ ID NO: 248596 - DNA, 19 bp, P. troglodytes
gccgcgaccccgtctggga

SEQ ID NO: 248597 - DNA, 16 bp, P. troglodytes
gccgcgcaggagccca

SEQ ID NO: 248598 - DNA, 16 bp, P. troglodytes
gccgctgcaccccagc

SEQ ID NO: 248599 - DNA, 16 bp, P. troglodytes
gccgctgcacctggct

SEQ ID NO: 248600 - DNA, 16 bp, P. troglodytes
gccgctgcgcctggcc

SEQ ID NO: 248601 - DNA, 16 bp, P. troglodytes
gccgctgctgctgctg

SEQ ID NO: 248602 - DNA, 16 bp, P. troglodytes
gccggacgcggtggct

SEQ ID NO: 248603 - DNA, 16 bp, P. troglodytes
gccggactggtctcca

SEQ ID NO: 248604 - DNA, 16 bp, P. troglodytes
gccggagtgcagtggt

SEQ ID NO: 248605 - DNA, 16 bp, P. troglodytes
gccggatgtggtggta

SEQ ID NO: 248606 - DNA, 17 bp, P. troglodytes
gccggccggccctgctg

SEQ ID NO: 248607 - DNA, 16 bp, P. troglodytes
gccgggaggcagaggt

SEQ ID NO: 248608 - DNA, 16 bp, P. troglodytes
gccgggcaaggtggtg

SEQ ID NO: 248609 - DNA, 16 bp, P. troglodytes
gccgggcacagtggcc

SEQ ID NO: 248610 - DNA, 17 bp, P. troglodytes
gccgggcacggtggctt

SEQ ID NO: 248611 - DNA, 16 bp, P. troglodytes
gccgggcacgttggct

SEQ ID NO: 248612 - DNA, 17 bp, P. troglodytes
gccgggcagaggcgctc

SEQ ID NO: 248613 - DNA, 16 bp, P. troglodytes
gccgggcatggcagtg

SEQ ID NO: 248614 - DNA, 16 bp, P. troglodytes
gccgggcatggtgttg

SEQ ID NO: 248615 - DNA, 16 bp, P. troglodytes
gccgggcctggtggtg

SEQ ID NO: 248616 - DNA, 16 bp, P. troglodytes
gccgggcgaggtggca

SEQ ID NO: 248617 - DNA, 16 bp, P. troglodytes
gccgggcgcaggggct

SEQ ID NO: 248618 - DNA, 18 bp, P. troglodytes
gccgggcgccgtggctca

SEQ ID NO: 248619 - DNA, 16 bp, P. troglodytes
gccgggcgtgctggca

SEQ ID NO: 248620 - DNA, 16 bp, P. troglodytes
gccgggcgtgggggca

SEQ ID NO: 248621 - DNA, 16 bp, P. troglodytes
gccgggcgtggtagct

SEQ ID NO: 248622 - DNA, 16 bp, P. troglodytes
gccgggcgtggtggtt

SEQ ID NO: 248623 - DNA, 16 bp, P. troglodytes
gccgggcgtggtgtcg

SEQ ID NO: 248624 - DNA, 16 bp, P. troglodytes
gccgggcgtggttgca

SEQ ID NO: 248625 - DNA, 16 bp, P. troglodytes
gccggggtgcagtggc

SEQ ID NO: 248626 - DNA, 16 bp, P. troglodytes
gccgggtatggtggca

SEQ ID NO: 248627 - DNA, 16 bp, P. troglodytes
gccgggtgcactggct

SEQ ID NO: 248628 - DNA, 16 bp, P. troglodytes
gccgggtgcagtggtg

SEQ ID NO: 248629 - DNA, 17 bp, P. troglodytes
gccgggtgcggtggctc

SEQ ID NO: 248630 - DNA, 16 bp, P. troglodytes
gccgggtgtagtggca

SEQ ID NO: 248631 - DNA, 16 bp, P. troglodytes
gccgggtgtggtggcc

SEQ ID NO: 248632 - DNA, 16 bp, P. troglodytes
gccgtaatcccagcta

SEQ ID NO: 248633 - DNA, 16 bp, P. troglodytes
gccgtggctcacacct

SEQ ID NO: 248634 - DNA, 16 bp, P. troglodytes
gccgtggtgcaatctc

SEQ ID NO: 248635 - DNA, 16 bp, P. troglodytes
gccgtggtggcaggtg

SEQ ID NO: 248636 - DNA, 16 bp, P. troglodytes
gcctacaagaaataca

SEQ ID NO: 248637 - DNA, 16 bp, P. troglodytes
gcctacaccacaaggg

SEQ ID NO: 248638 - DNA, 16 bp, P. troglodytes
gcctaccaaagtgttg

SEQ ID NO: 248639 - DNA, 16 bp, P. troglodytes
gcctaccttggtctcc

SEQ ID NO: 248640 - DNA, 16 bp, P. troglodytes
gcctactaaaaataca

SEQ ID NO: 248641 - DNA, 16 bp, P. troglodytes
gcctactaaagtgctg

SEQ ID NO: 248642 - DNA, 16 bp, P. troglodytes
gcctactcactaaaat

SEQ ID NO: 248643 - DNA, 16 bp, P. troglodytes
gcctactgaatcagaa

SEQ ID NO: 248644 - DNA, 16 bp, P. troglodytes
gcctactgcaacctcc

SEQ ID NO: 248645 - DNA, 16 bp, P. troglodytes
gcctactgtgtgctag

SEQ ID NO: 248646 - DNA, 16 bp, P. troglodytes
gcctacttgagggtga

SEQ ID NO: 248647 - DNA, 16 bp, P. troglodytes
gcctagatgggtggat

SEQ ID NO: 248648 - DNA, 16 bp, P. troglodytes
gcctagcttttttttt

SEQ ID NO: 248649 - DNA, 16 bp, P. troglodytes
gcctaggaaccagacc

SEQ ID NO: 248650 - DNA, 21 bp, P. troglodytes
gcctaggcctcccaaagtgct

SEQ ID NO: 248651 - DNA, 16 bp, P. troglodytes
gcctaggctggagcgc

SEQ ID NO: 248652 - DNA, 16 bp, P. troglodytes
gcctagtggagctttg

SEQ ID NO: 248653 - DNA, 16 bp, P. troglodytes
gcctataatcccaggc

SEQ ID NO: 248654 - DNA, 16 bp, P. troglodytes
gcctataatcctggca

SEQ ID NO: 248655 - DNA, 16 bp, P. troglodytes
gcctataatctcagcc

SEQ ID NO: 248656 - DNA, 16 bp, P. troglodytes
gcctataattccagct

SEQ ID NO: 248657 - DNA, 16 bp, P. troglodytes
gcctatagtcctaact

SEQ ID NO: 248658 - DNA, 16 bp, P. troglodytes
gcctatagtctcagct

SEQ ID NO: 248659 - DNA, 16 bp, P. troglodytes
gcctatatctttctcc

SEQ ID NO: 248660 - DNA, 16 bp, P. troglodytes
gcctatcaacccatca

SEQ ID NO: 248661 - DNA, 16 bp, P. troglodytes
gcctatggttccagct

SEQ ID NO: 248662 - DNA, 16 bp, P. troglodytes
gcctatgtgtgttttt

SEQ ID NO: 248663 - DNA, 16 bp, P. troglodytes
gcctcaaaaaagaaaa

SEQ ID NO: 248664 - DNA, 16 bp, P. troglodytes
gcctcaacctcccaag

SEQ ID NO: 248665 - DNA, 16 bp, P. troglodytes
gcctcaacctccccag

SEQ ID NO: 248666 - DNA, 16 bp, P. troglodytes
gcctcaacctccgaag

SEQ ID NO: 248667 - DNA, 16 bp, P. troglodytes
gcctcaacctctcagg

SEQ ID NO: 248668 - DNA, 16 bp, P. troglodytes
gcctcaacctctccag

SEQ ID NO: 248669 - DNA, 16 bp, P. troglodytes
gcctcaactgatcctc

SEQ ID NO: 248670 - DNA, 16 bp, P. troglodytes
gcctcaactgcctggg

SEQ ID NO: 248671 - DNA, 16 bp, P. troglodytes
gcctcaagcaatcctc

SEQ ID NO: 248672 - DNA, 16 bp, P. troglodytes
gcctcaagcaattctc

SEQ ID NO: 248673 - DNA, 16 bp, P. troglodytes
gcctcaagtgatctcc

SEQ ID NO: 248674 - DNA, 18 bp, P. troglodytes
gcctcaagtgatctgcct

SEQ ID NO: 248675 - DNA, 16 bp, P. troglodytes
gcctcaagttcctggg

SEQ ID NO: 248676 - DNA, 16 bp, P. troglodytes
gcctcaatctccctgg

SEQ ID NO: 248677 - DNA, 16 bp, P. troglodytes
gcctcaatttctccat

SEQ ID NO: 248678 - DNA, 16 bp, P. troglodytes
gcctcacccagctccc

SEQ ID NO: 248679 - DNA, 16 bp, P. troglodytes
gcctcacccagctcct

SEQ ID NO: 248680 - DNA, 16 bp, P. troglodytes
gcctcaccctcctggg

SEQ ID NO: 248681 - DNA, 16 bp, P. troglodytes
gcctcacgcctgtaat

SEQ ID NO: 248682 - DNA, 16 bp, P. troglodytes
gcctcacgggttcaag

SEQ ID NO: 248683 - DNA, 16 bp, P. troglodytes
gcctcactttgtcacc

SEQ ID NO: 248684 - DNA, 16 bp, P. troglodytes
gcctcagaactgtgag

SEQ ID NO: 248685 - DNA, 16 bp, P. troglodytes
gcctcagatatttctt

SEQ ID NO: 248686 - DNA, 16 bp, P. troglodytes
gcctcagccacccagg

SEQ ID NO: 248687 - DNA, 16 bp, P. troglodytes
gcctcagccccagccc

SEQ ID NO: 248688 - DNA, 16 bp, P. troglodytes
gcctcagcccccaaag

SEQ ID NO: 248689 - DNA, 16 bp, P. troglodytes
gcctcagccccctctg

SEQ ID NO: 248690 - DNA, 16 bp, P. troglodytes
gcctcagcctcagcct

SEQ ID NO: 248691 - DNA, 16 bp, P. troglodytes
gcctcagcctcagctg

SEQ ID NO: 248692 - DNA, 16 bp, P. troglodytes
gcctcagcctccaaaa

SEQ ID NO: 248693 - DNA, 16 bp, P. troglodytes
gcctcagcctccacag

SEQ ID NO: 248694 - DNA, 16 bp, P. troglodytes
gcctcagcctccagga

SEQ ID NO: 248695 - DNA, 17 bp, P. troglodytes
gcctcagcctcccaaaa

SEQ ID NO: 248696 - DNA, 20 bp, P. troglodytes
gcctcagcctcccaaagtgg

SEQ ID NO: 248697 - DNA, 18 bp, P. troglodytes
gcctcagcctcccaaggt

SEQ ID NO: 248698 - DNA, 16 bp, P. troglodytes
gcctcagcctcccaat

SEQ ID NO: 248699 - DNA, 16 bp, P. troglodytes
gcctcagcctcccacc

SEQ ID NO: 248700 - DNA, 16 bp, P. troglodytes
gcctcagcctccccaa

SEQ ID NO: 248701 - DNA, 16 bp, P. troglodytes
gcctcagcctccgagt

SEQ ID NO: 248702 - DNA, 16 bp, P. troglodytes
gcctcagcctcctaga

SEQ ID NO: 248703 - DNA, 16 bp, P. troglodytes
gcctcagcctcctgaa

SEQ ID NO: 248704 - DNA, 16 bp, P. troglodytes
gcctcagcctcctgat

SEQ ID NO: 248705 - DNA, 16 bp, P. troglodytes
gcctcagcctcctggg

SEQ ID NO: 248706 - DNA, 16 bp, P. troglodytes
gcctcagcctccttag

SEQ ID NO: 248707 - DNA, 16 bp, P. troglodytes
gcctcagcctctccca

SEQ ID NO: 248708 - DNA, 16 bp, P. troglodytes
gcctcagctccctgag

SEQ ID NO: 248709 - DNA, 16 bp, P. troglodytes
gcctcagctgcctgag

SEQ ID NO: 248710 - DNA, 16 bp, P. troglodytes
gcctcagcttccaaag

SEQ ID NO: 248711 - DNA, 16 bp, P. troglodytes
gcctcagcttctcaaa

SEQ ID NO: 248712 - DNA, 16 bp, P. troglodytes
gcctcaggaagtttcc

SEQ ID NO: 248713 - DNA, 16 bp, P. troglodytes
gcctcaggcaggccct

SEQ ID NO: 248714 - DNA, 16 bp, P. troglodytes
gcctcaggcagtcctc

SEQ ID NO: 248715 - DNA, 16 bp, P. troglodytes
gcctcaggctccctag

SEQ ID NO: 248716 - DNA, 16 bp, P. troglodytes
gcctcagggcccttgc

SEQ ID NO: 248717 - DNA, 18 bp, P. troglodytes
gcctcaggtgatccaccc

SEQ ID NO: 248718 - DNA, 22 bp, P. troglodytes
gcctcaggtgatccacccgcct

SEQ ID NO: 248719 - DNA, 17 bp, P. troglodytes
gcctcaggtgatccgcc

SEQ ID NO: 248720 - DNA, 16 bp, P. troglodytes
gcctcagtgttctcat

SEQ ID NO: 248721 - DNA, 16 bp, P. troglodytes
gcctcagttccctcat

SEQ ID NO: 248722 - DNA, 16 bp, P. troglodytes
gcctcagttccctcct

SEQ ID NO: 248723 - DNA, 16 bp, P. troglodytes
gcctcagtttccacat

SEQ ID NO: 248724 - DNA, 16 bp, P. troglodytes
gcctcagtttccacct

SEQ ID NO: 248725 - DNA, 16 bp, P. troglodytes
gcctcagtttccctgt

SEQ ID NO: 248726 - DNA, 16 bp, P. troglodytes
gcctcagtttcctcac

SEQ ID NO: 248727 - DNA, 16 bp, P. troglodytes
gcctcagtttcctttt

SEQ ID NO: 248728 - DNA, 16 bp, P. troglodytes
gcctcagtttctccat

SEQ ID NO: 248729 - DNA, 16 bp, P. troglodytes
gcctcagtttctcctc

SEQ ID NO: 248730 - DNA, 16 bp, P. troglodytes
gcctcagtttctctat

SEQ ID NO: 248731 - DNA, 16 bp, P. troglodytes
gcctcagttttatcat

SEQ ID NO: 248732 - DNA, 16 bp, P. troglodytes
gcctcatcctccccag

SEQ ID NO: 248733 - DNA, 16 bp, P. troglodytes
gcctcattgctctggc

SEQ ID NO: 248734 - DNA, 16 bp, P. troglodytes
gcctcatttatttatt

SEQ ID NO: 248735 - DNA, 16 bp, P. troglodytes
gcctcattttccacat

SEQ ID NO: 248736 - DNA, 16 bp, P. troglodytes
gcctccaaggttcaag

SEQ ID NO: 248737 - DNA, 16 bp, P. troglodytes
gcctccaccacccagg

SEQ ID NO: 248738 - DNA, 16 bp, P. troglodytes
gcctccaccatgtcca

SEQ ID NO: 248739 - DNA, 16 bp, P. troglodytes
gcctccaccctcaagt

SEQ ID NO: 248740 - DNA, 16 bp, P. troglodytes
gcctccacctcccaga

SEQ ID NO: 248741 - DNA, 16 bp, P. troglodytes
gcctccacgcccagct

SEQ ID NO: 248742 - DNA, 16 bp, P. troglodytes
gcctccagaactgtga

SEQ ID NO: 248743 - DNA, 16 bp, P. troglodytes
gcctccagaagctgga

SEQ ID NO: 248744 - DNA, 16 bp, P. troglodytes
gcctccagagctgaga

SEQ ID NO: 248745 - DNA, 16 bp, P. troglodytes
gcctccagatttgctc

SEQ ID NO: 248746 - DNA, 16 bp, P. troglodytes
gcctccagcccggccc

SEQ ID NO: 248747 - DNA, 16 bp, P. troglodytes
gcctccagcctccagc

SEQ ID NO: 248748 - DNA, 16 bp, P. troglodytes
gcctccagctccacct

SEQ ID NO: 248749 - DNA, 16 bp, P. troglodytes
gcctccatctcaaaaa

SEQ ID NO: 248750 - DNA, 16 bp, P. troglodytes
gcctccatctccctgg

SEQ ID NO: 248751 - DNA, 16 bp, P. troglodytes
gcctccatctcctgga

SEQ ID NO: 248752 - DNA, 16 bp, P. troglodytes
gcctcccaaaacgctg

SEQ ID NO: 248753 - DNA, 16 bp, P. troglodytes
gcctcccaaactactg

SEQ ID NO: 248754 - DNA, 16 bp, P. troglodytes
gcctcccaaagagctg

SEQ ID NO: 248755 - DNA, 16 bp, P. troglodytes
gcctcccaaagcactg

SEQ ID NO: 248756 - DNA, 16 bp, P. troglodytes
gcctcccaaagcgctg

SEQ ID NO: 248757 - DNA, 16 bp, P. troglodytes
gcctcccaaagtattg

SEQ ID NO: 248758 - DNA, 16 bp, P. troglodytes
gcctcccaaagtgaaa

SEQ ID NO: 248759 - DNA, 16 bp, P. troglodytes
gcctcccaaagtgagc

SEQ ID NO: 248760 - DNA, 16 bp, P. troglodytes
gcctcccaaagtgagg

SEQ ID NO: 248761 - DNA, 16 bp, P. troglodytes
gcctcccaaagtgcag

SEQ ID NO: 248762 - DNA, 16 bp, P. troglodytes
gcctcccaaagtgcta

SEQ ID NO: 248763 - DNA, 16 bp, P. troglodytes
gcctcccaaagtgctc

SEQ ID NO: 248764 - DNA, 16 bp, P. troglodytes
gcctcccaaagtggtg

SEQ ID NO: 248765 - DNA, 16 bp, P. troglodytes
gcctcccaaagtgtgg

SEQ ID NO: 248766 - DNA, 16 bp, P. troglodytes
gcctcccaaagttttg

SEQ ID NO: 248767 - DNA, 16 bp, P. troglodytes
gcctcccaaattgctg

SEQ ID NO: 248768 - DNA, 16 bp, P. troglodytes
gcctcccaacatgttg

SEQ ID NO: 248769 - DNA, 16 bp, P. troglodytes
gcctcccaagaggctg

SEQ ID NO: 248770 - DNA, 16 bp, P. troglodytes
gcctcccaagcagccg

SEQ ID NO: 248771 - DNA, 16 bp, P. troglodytes
gcctcccaagttcaag

SEQ ID NO: 248772 - DNA, 16 bp, P. troglodytes
gcctcccacactgctg

SEQ ID NO: 248773 - DNA, 16 bp, P. troglodytes
gcctcccacagtcctg

SEQ ID NO: 248774 - DNA, 16 bp, P. troglodytes
gcctcccacattcaag

SEQ ID NO: 248775 - DNA, 16 bp, P. troglodytes
gcctcccaccatgccc

SEQ ID NO: 248776 - DNA, 16 bp, P. troglodytes
gcctcccacgttcaag

SEQ ID NO: 248777 - DNA, 16 bp, P. troglodytes
gcctcccagagggctg

SEQ ID NO: 248778 - DNA, 16 bp, P. troglodytes
gcctcccagagtgttg

SEQ ID NO: 248779 - DNA, 16 bp, P. troglodytes
gcctcccagattcaag

SEQ ID NO: 248780 - DNA, 16 bp, P. troglodytes
gcctcccagattcagg

SEQ ID NO: 248781 - DNA, 16 bp, P. troglodytes
gcctcccagcactttg

SEQ ID NO: 248782 - DNA, 16 bp, P. troglodytes
gcctcccagcctccca

SEQ ID NO: 248783 - DNA, 16 bp, P. troglodytes
gcctcccagcctgcat

SEQ ID NO: 248784 - DNA, 16 bp, P. troglodytes
gcctcccaggatcaag

SEQ ID NO: 248785 - DNA, 16 bp, P. troglodytes
gcctcccaggctcaag

SEQ ID NO: 248786 - DNA, 16 bp, P. troglodytes
gcctcccaggctcatg

SEQ ID NO: 248787 - DNA, 16 bp, P. troglodytes
gcctcccaggtacaag

SEQ ID NO: 248788 - DNA, 16 bp, P. troglodytes
gcctcccaggttaagc

SEQ ID NO: 248789 - DNA, 16 bp, P. troglodytes
gcctcccaggttcaaa

SEQ ID NO: 248790 - DNA, 16 bp, P. troglodytes
gcctcccaggttcaag

SEQ ID NO: 248791 - DNA, 16 bp, P. troglodytes
gcctcccaggttcagg

SEQ ID NO: 248792 - DNA, 16 bp, P. troglodytes
gcctcccaggttccag

SEQ ID NO: 248793 - DNA, 16 bp, P. troglodytes
gcctcccaggttctca

SEQ ID NO: 248794 - DNA, 16 bp, P. troglodytes
gcctcccaggttgaag

SEQ ID NO: 248795 - DNA, 16 bp, P. troglodytes
gcctcccaggtttaag

SEQ ID NO: 248796 - DNA, 16 bp, P. troglodytes
gcctcccagtttcaag

SEQ ID NO: 248797 - DNA, 16 bp, P. troglodytes
gcctcccatgtagctg

SEQ ID NO: 248798 - DNA, 16 bp, P. troglodytes
gcctccccaagtggtg

SEQ ID NO: 248799 - DNA, 16 bp, P. troglodytes
gcctccccagcagctg

SEQ ID NO: 248800 - DNA, 16 bp, P. troglodytes
gcctccccagccacgc

SEQ ID NO: 248801 - DNA, 16 bp, P. troglodytes
gcctccccagccttgc

SEQ ID NO: 248802 - DNA, 16 bp, P. troglodytes
gcctccccaggagctg

SEQ ID NO: 248803 - DNA, 16 bp, P. troglodytes
gcctccccagtaactg

SEQ ID NO: 248804 - DNA, 16 bp, P. troglodytes
gcctccccagttcaag

SEQ ID NO: 248805 - DNA, 16 bp, P. troglodytes
gcctcccccaaagtgc

SEQ ID NO: 248806 - DNA, 16 bp, P. troglodytes
gcctccccggttcaag

SEQ ID NO: 248807 - DNA, 16 bp, P. troglodytes
gcctcccctgctgcag

SEQ ID NO: 248808 - DNA, 16 bp, P. troglodytes
gcctcccgaagtcctg

SEQ ID NO: 248809 - DNA, 16 bp, P. troglodytes
gcctcccgaagtgatg

SEQ ID NO: 248810 - DNA, 16 bp, P. troglodytes
gcctcccgaattcaag

SEQ ID NO: 248811 - DNA, 34 bp, P. troglodytes
gcctcccgaggtgccgggattgcagacggagtct

SEQ ID NO: 248812 - DNA, 16 bp, P. troglodytes
gcctcccgagttcaaa

SEQ ID NO: 248813 - DNA, 16 bp, P. troglodytes
gcctcccgagttcaag

SEQ ID NO: 248814 - DNA, 16 bp, P. troglodytes
gcctcccgagttccag

SEQ ID NO: 248815 - DNA, 16 bp, P. troglodytes
gcctcccgcgttcaag

SEQ ID NO: 248816 - DNA, 16 bp, P. troglodytes
gcctcccggattcaag

SEQ ID NO: 248817 - DNA, 16 bp, P. troglodytes
gcctcccggcttcaag

SEQ ID NO: 248818 - DNA, 16 bp, P. troglodytes
gcctcccgggatcaag

SEQ ID NO: 248819 - DNA, 16 bp, P. troglodytes
gcctcccggggtcaag

SEQ ID NO: 248820 - DNA, 16 bp, P. troglodytes
gcctcccgggtccaag

SEQ ID NO: 248821 - DNA, 16 bp, P. troglodytes
gcctcccgggttcaaa

SEQ ID NO: 248822 - DNA, 16 bp, P. troglodytes
gcctcccgggttcaag

SEQ ID NO: 248823 - DNA, 16 bp, P. troglodytes
gcctcccgggttcagg

SEQ ID NO: 248824 - DNA, 16 bp, P. troglodytes
gcctcccgggttccag

SEQ ID NO: 248825 - DNA, 16 bp, P. troglodytes
gcctcccgggttcgag

SEQ ID NO: 248826 - DNA, 16 bp, P. troglodytes
gcctcccgggtttaag

SEQ ID NO: 248827 - DNA, 16 bp, P. troglodytes
gcctcccgggtttgag

SEQ ID NO: 248828 - DNA, 16 bp, P. troglodytes
gcctcccggtttcaag

SEQ ID NO: 248829 - DNA, 16 bp, P. troglodytes
gcctcccgtattcaag

SEQ ID NO: 248830 - DNA, 16 bp, P. troglodytes
gcctccctatagctcc

SEQ ID NO: 248831 - DNA, 16 bp, P. troglodytes
gcctccctatgttgcc

SEQ ID NO: 248832 - DNA, 16 bp, P. troglodytes
gcctccctgcaggaat

SEQ ID NO: 248833 - DNA, 16 bp, P. troglodytes
gcctccctgcctccac

SEQ ID NO: 248834 - DNA, 16 bp, P. troglodytes
gcctccctgctgagaa

SEQ ID NO: 248835 - DNA, 16 bp, P. troglodytes
gcctccctgctgcagc

SEQ ID NO: 248836 - DNA, 16 bp, P. troglodytes
gcctccctggttcaag

SEQ ID NO: 248837 - DNA, 16 bp, P. troglodytes
gcctcccttccagctg

SEQ ID NO: 248838 - DNA, 16 bp, P. troglodytes
gcctccgcctccagag

SEQ ID NO: 248839 - DNA, 16 bp, P. troglodytes
gcctccgcctcccagg

SEQ ID NO: 248840 - DNA, 16 bp, P. troglodytes
gcctccggggttcaag

SEQ ID NO: 248841 - DNA, 16 bp, P. troglodytes
gcctccgtttcctcat

SEQ ID NO: 248842 - DNA, 16 bp, P. troglodytes
gcctcctaggttcaag

SEQ ID NO: 248843 - DNA, 16 bp, P. troglodytes
gcctcctcagaagaaa

SEQ ID NO: 248844 - DNA, 16 bp, P. troglodytes
gcctcctcagcctccc

SEQ ID NO: 248845 - DNA, 16 bp, P. troglodytes
gcctcctcagcctcgg

SEQ ID NO: 248846 - DNA, 16 bp, P. troglodytes
gcctcctcagttcaag

SEQ ID NO: 248847 - DNA, 16 bp, P. troglodytes
gcctcctcctcctcag

SEQ ID NO: 248848 - DNA, 16 bp, P. troglodytes
gcctcctctgcctggg

SEQ ID NO: 248849 - DNA, 16 bp, P. troglodytes
gcctcctgaagtagct

SEQ ID NO: 248850 - DNA, 16 bp, P. troglodytes
gcctcctgaattcaag

SEQ ID NO: 248851 - DNA, 16 bp, P. troglodytes
gcctcctgagaagttg

SEQ ID NO: 248852 - DNA, 16 bp, P. troglodytes
gcctcctgagtagcca

SEQ ID NO: 248853 - DNA, 16 bp, P. troglodytes
gcctcctgagttcaaa

SEQ ID NO: 248854 - DNA, 16 bp, P. troglodytes
gcctcctgagttcaag

SEQ ID NO: 248855 - DNA, 16 bp, P. troglodytes
gcctcctgagttcagg

SEQ ID NO: 248856 - DNA, 16 bp, P. troglodytes
gcctcctgcattcaag

SEQ ID NO: 248857 - DNA, 16 bp, P. troglodytes
gcctcctgctccatcc

SEQ ID NO: 248858 - DNA, 16 bp, P. troglodytes
gcctcctggaatcaag

SEQ ID NO: 248859 - DNA, 16 bp, P. troglodytes
gcctcctggagctgtg

SEQ ID NO: 248860 - DNA, 16 bp, P. troglodytes
gcctcctggattcaaa

SEQ ID NO: 248861 - DNA, 16 bp, P. troglodytes
gcctcctgggatcaag

SEQ ID NO: 248862 - DNA, 16 bp, P. troglodytes
gcctcctgggctcaac

SEQ ID NO: 248863 - DNA, 16 bp, P. troglodytes
gcctcctgggctcaag

SEQ ID NO: 248864 - DNA, 16 bp, P. troglodytes
gcctcctgggtacaag

SEQ ID NO: 248865 - DNA, 16 bp, P. troglodytes
gcctcctgggttcaaa

SEQ ID NO: 248866 - DNA, 16 bp, P. troglodytes
gcctcctgggttcaag

SEQ ID NO: 248867 - DNA, 16 bp, P. troglodytes
gcctcctgggttcaat

SEQ ID NO: 248868 - DNA, 16 bp, P. troglodytes
gcctcctgggttcagg

SEQ ID NO: 248869 - DNA, 16 bp, P. troglodytes
gcctcctgggtttaag

SEQ ID NO: 248870 - DNA, 16 bp, P. troglodytes
gcctcctggttcaagc

SEQ ID NO: 248871 - DNA, 16 bp, P. troglodytes
gcctcctgtcagatga

SEQ ID NO: 248872 - DNA, 16 bp, P. troglodytes
gcctccttggcctcgg

SEQ ID NO: 248873 - DNA, 16 bp, P. troglodytes
gcctcgacctcctagg

SEQ ID NO: 248874 - DNA, 16 bp, P. troglodytes
gcctcgccctgcttca

SEQ ID NO: 248875 - DNA, 16 bp, P. troglodytes
gcctcggcctaccaaa

SEQ ID NO: 248876 - DNA, 16 bp, P. troglodytes
gcctcggcctccgaaa

SEQ ID NO: 248877 - DNA, 16 bp, P. troglodytes
gcctcggcctgccaaa

SEQ ID NO: 248878 - DNA, 16 bp, P. troglodytes
gcctcggtctcctaaa

SEQ ID NO: 248879 - DNA, 16 bp, P. troglodytes
gcctcggtttccccat

SEQ ID NO: 248880 - DNA, 16 bp, P. troglodytes
gcctctaaaactgtga

SEQ ID NO: 248881 - DNA, 16 bp, P. troglodytes
gcctctaagaaatatg

SEQ ID NO: 248882 - DNA, 16 bp, P. troglodytes
gcctctacccactaga

SEQ ID NO: 248883 - DNA, 16 bp, P. troglodytes
gcctctacctcctgga

SEQ ID NO: 248884 - DNA, 16 bp, P. troglodytes
gcctctacttcctggg

SEQ ID NO: 248885 - DNA, 16 bp, P. troglodytes
gcctctatagattcca

SEQ ID NO: 248886 - DNA, 16 bp, P. troglodytes
gcctctcaaagggctg

SEQ ID NO: 248887 - DNA, 16 bp, P. troglodytes
gcctctcagagtgctg

SEQ ID NO: 248888 - DNA, 16 bp, P. troglodytes
gcctctccagaagctg

SEQ ID NO: 248889 - DNA, 16 bp, P. troglodytes
gcctctccaggcccag

SEQ ID NO: 248890 - DNA, 16 bp, P. troglodytes
gcctctccctcctggg

SEQ ID NO: 248891 - DNA, 16 bp, P. troglodytes
gcctctcgggaggctg

SEQ ID NO: 248892 - DNA, 16 bp, P. troglodytes
gcctctcgggttcaag

SEQ ID NO: 248893 - DNA, 16 bp, P. troglodytes
gcctctcgggttccag

SEQ ID NO: 248894 - DNA, 16 bp, P. troglodytes
gcctctctcaccactc

SEQ ID NO: 248895 - DNA, 16 bp, P. troglodytes
gcctctctgggcctca

SEQ ID NO: 248896 - DNA, 16 bp, P. troglodytes
gcctctgagctgctgc

SEQ ID NO: 248897 - DNA, 16 bp, P. troglodytes
gcctctgaggaggaaa

SEQ ID NO: 248898 - DNA, 16 bp, P. troglodytes
gcctctgagttccctt

SEQ ID NO: 248899 - DNA, 16 bp, P. troglodytes
gcctctgatcccagct

SEQ ID NO: 248900 - DNA, 16 bp, P. troglodytes
gcctctgccactcctg

SEQ ID NO: 248901 - DNA, 16 bp, P. troglodytes
gcctctgcccggccac

SEQ ID NO: 248902 - DNA, 16 bp, P. troglodytes
gcctctgcccggccgt

SEQ ID NO: 248903 - DNA, 16 bp, P. troglodytes
gcctctgcctccaaag

SEQ ID NO: 248904 - DNA, 16 bp, P. troglodytes
gcctctgcctcccaga

SEQ ID NO: 248905 - DNA, 16 bp, P. troglodytes
gcctctgcctccccaa

SEQ ID NO: 248906 - DNA, 16 bp, P. troglodytes
gcctctgcctcctaaa

SEQ ID NO: 248907 - DNA, 16 bp, P. troglodytes
gcctctgcctcctagg

SEQ ID NO: 248908 - DNA, 16 bp, P. troglodytes
gcctctgcctctgccc

SEQ ID NO: 248909 - DNA, 16 bp, P. troglodytes
gcctctgcctctgcct

SEQ ID NO: 248910 - DNA, 16 bp, P. troglodytes
gcctctgcctgctggg

SEQ ID NO: 248911 - DNA, 16 bp, P. troglodytes
gcctctgcctggcagc

SEQ ID NO: 248912 - DNA, 16 bp, P. troglodytes
gcctctgcttcccaag

SEQ ID NO: 248913 - DNA, 16 bp, P. troglodytes
gcctctggacctgtga

SEQ ID NO: 248914 - DNA, 16 bp, P. troglodytes
gcctctggagtggctg

SEQ ID NO: 248915 - DNA, 16 bp, P. troglodytes
gcctctgggcctttgc

SEQ ID NO: 248916 - DNA, 16 bp, P. troglodytes
gcctctggtaatcatt

SEQ ID NO: 248917 - DNA, 16 bp, P. troglodytes
gcctctggttcccatt

SEQ ID NO: 248918 - DNA, 16 bp, P. troglodytes
gcctctgtttccccat

SEQ ID NO: 248919 - DNA, 16 bp, P. troglodytes
gcctcttctcctacaa

SEQ ID NO: 248920 - DNA, 17 bp, P. troglodytes
gcctcttgcagttgaga

SEQ ID NO: 248921 - DNA, 16 bp, P. troglodytes
gcctcttgggttcaag

SEQ ID NO: 248922 - DNA, 16 bp, P. troglodytes
gcctcttttaaaaagt

SEQ ID NO: 248923 - DNA, 16 bp, P. troglodytes
gcctgaaaatggacta

SEQ ID NO: 248924 - DNA, 16 bp, P. troglodytes
gcctgaaagccctgct

SEQ ID NO: 248925 - DNA, 16 bp, P. troglodytes
gcctgaacccaggaag

SEQ ID NO: 248926 - DNA, 16 bp, P. troglodytes
gcctgaacccgggaag

SEQ ID NO: 248927 - DNA, 16 bp, P. troglodytes
gcctgaacccgggagg

SEQ ID NO: 248928 - DNA, 16 bp, P. troglodytes
gcctgaagaacttcct

SEQ ID NO: 248929 - DNA, 16 bp, P. troglodytes
gcctgacatcagtcag

SEQ ID NO: 248930 - DNA, 16 bp, P. troglodytes
gcctgaccaccttggg

SEQ ID NO: 248931 - DNA, 16 bp, P. troglodytes
gcctgaccccgcaggc

SEQ ID NO: 248932 - DNA, 16 bp, P. troglodytes
gcctgacctcaggtga

SEQ ID NO: 248933 - DNA, 16 bp, P. troglodytes
gcctgacctcatgatc

SEQ ID NO: 248934 - DNA, 16 bp, P. troglodytes
gcctgagaaacagccc

SEQ ID NO: 248935 - DNA, 16 bp, P. troglodytes
gcctgagaaactgctt

SEQ ID NO: 248936 - DNA, 16 bp, P. troglodytes
gcctgagcaagagagc

SEQ ID NO: 248937 - DNA, 16 bp, P. troglodytes
gcctgagccaccatgc

SEQ ID NO: 248938 - DNA, 16 bp, P. troglodytes
gcctgagcccaggaag

SEQ ID NO: 248939 - DNA, 16 bp, P. troglodytes
gcctgagcccaggagg

SEQ ID NO: 248940 - DNA, 16 bp, P. troglodytes
gcctgagcctccccaa

SEQ ID NO: 248941 - DNA, 16 bp, P. troglodytes
gcctgagcctcccgag

SEQ ID NO: 248942 - DNA, 16 bp, P. troglodytes
gcctgagctcaagcaa

SEQ ID NO: 248943 - DNA, 16 bp, P. troglodytes
gcctgagctccacctc

SEQ ID NO: 248944 - DNA, 16 bp, P. troglodytes
gcctgagctctggagt

SEQ ID NO: 248945 - DNA, 16 bp, P. troglodytes
gcctgaggagagggag

SEQ ID NO: 248946 - DNA, 16 bp, P. troglodytes
gcctgaggagggagga

SEQ ID NO: 248947 - DNA, 16 bp, P. troglodytes
gcctgaggccaggaat

SEQ ID NO: 248948 - DNA, 16 bp, P. troglodytes
gcctgaggctggagga

SEQ ID NO: 248949 - DNA, 17 bp, P. troglodytes
gcctgaggtcagaagtt

SEQ ID NO: 248950 - DNA, 17 bp, P. troglodytes
gcctgaggtcaggaatt

SEQ ID NO: 248951 - DNA, 17 bp, P. troglodytes
gcctgaggtcaggagtt

SEQ ID NO: 248952 - DNA, 17 bp, P. troglodytes
gcctgaggtcgggagtt

SEQ ID NO: 248953 - DNA, 16 bp, P. troglodytes
gcctgaggtgggcaga

SEQ ID NO: 248954 - DNA, 16 bp, P. troglodytes
gcctgaggtgggtgga

SEQ ID NO: 248955 - DNA, 16 bp, P. troglodytes
gcctgagtgcagtggc

SEQ ID NO: 248956 - DNA, 16 bp, P. troglodytes
gcctgagttccacctc

SEQ ID NO: 248957 - DNA, 16 bp, P. troglodytes
gcctgagtttcctcat

SEQ ID NO: 248958 - DNA, 16 bp, P. troglodytes
gcctgatgacctgagg

SEQ ID NO: 248959 - DNA, 16 bp, P. troglodytes
gcctgatgtggtggca

SEQ ID NO: 248960 - DNA, 16 bp, P. troglodytes
gcctgattgacctggc

SEQ ID NO: 248961 - DNA, 16 bp, P. troglodytes
gcctgcaatcccatca

SEQ ID NO: 248962 - DNA, 16 bp, P. troglodytes
gcctgcaatgccagca

SEQ ID NO: 248963 - DNA, 16 bp, P. troglodytes
gcctgcaattgcaggc

SEQ ID NO: 248964 - DNA, 16 bp, P. troglodytes
gcctgcagatggccta

SEQ ID NO: 248965 - DNA, 16 bp, P. troglodytes
gcctgcagccccagct

SEQ ID NO: 248966 - DNA, 16 bp, P. troglodytes
gcctgcagctgcagaa

SEQ ID NO: 248967 - DNA, 16 bp, P. troglodytes
gcctgcagctgcagga

SEQ ID NO: 248968 - DNA, 16 bp, P. troglodytes
gcctgcaggactgtga

SEQ ID NO: 248969 - DNA, 16 bp, P. troglodytes
gcctgcaggccgactc

SEQ ID NO: 248970 - DNA, 16 bp, P. troglodytes
gcctgcagttccagct

SEQ ID NO: 248971 - DNA, 16 bp, P. troglodytes
gcctgcatcaccaagt

SEQ ID NO: 248972 - DNA, 16 bp, P. troglodytes
gcctgcatgtgtgtgt

SEQ ID NO: 248973 - DNA, 16 bp, P. troglodytes
gcctgccaccctgccc

SEQ ID NO: 248974 - DNA, 16 bp, P. troglodytes
gcctgccactgcaccc

SEQ ID NO: 248975 - DNA, 16 bp, P. troglodytes
gcctgccactgcactg

SEQ ID NO: 248976 - DNA, 16 bp, P. troglodytes
gcctgccactgtgccc

SEQ ID NO: 248977 - DNA, 16 bp, P. troglodytes
gcctgccagcacgccc

SEQ ID NO: 248978 - DNA, 16 bp, P. troglodytes
gcctgccagcatgcct

SEQ ID NO: 248979 - DNA, 16 bp, P. troglodytes
gcctgccagcctgccc

SEQ ID NO: 248980 - DNA, 16 bp, P. troglodytes
gcctgccccagcctcc

SEQ ID NO: 248981 - DNA, 16 bp, P. troglodytes
gcctgccctgcctgcc

SEQ ID NO: 248982 - DNA, 16 bp, P. troglodytes
gcctgccctggcctcc

SEQ ID NO: 248983 - DNA, 20 bp, P. troglodytes
gcctgccctgtggagcatcc

SEQ ID NO: 248984 - DNA, 16 bp, P. troglodytes
gcctgcctcagcctca

SEQ ID NO: 248985 - DNA, 16 bp, P. troglodytes
gcctgcctccacctcc

SEQ ID NO: 248986 - DNA, 16 bp, P. troglodytes
gcctgcctctgcttcc

SEQ ID NO: 248987 - DNA, 16 bp, P. troglodytes
gcctgcctgcctctgc

SEQ ID NO: 248988 - DNA, 16 bp, P. troglodytes
gcctgcctgcctgccc

SEQ ID NO: 248989 - DNA, 16 bp, P. troglodytes
gcctgcctgcctgcct

SEQ ID NO: 248990 - DNA, 16 bp, P. troglodytes
gcctgcctgccttctt

SEQ ID NO: 248991 - DNA, 16 bp, P. troglodytes
gcctgcctggttcaag

SEQ ID NO: 248992 - DNA, 16 bp, P. troglodytes
gcctgccttagcctcc

SEQ ID NO: 248993 - DNA, 16 bp, P. troglodytes
gcctgccttccttcct

SEQ ID NO: 248994 - DNA, 16 bp, P. troglodytes
gcctgccttggcctcc

SEQ ID NO: 248995 - DNA, 20 bp, P. troglodytes
gcctgccttggcctcccaag

SEQ ID NO: 248996 - DNA, 16 bp, P. troglodytes
gcctgccttggccttc

SEQ ID NO: 248997 - DNA, 19 bp, P. troglodytes
gcctgccttggtctcccaa

SEQ ID NO: 248998 - DNA, 16 bp, P. troglodytes
gcctgcgcaacacagc

SEQ ID NO: 248999 - DNA, 16 bp, P. troglodytes
gcctgctacctgaagg

SEQ ID NO: 249000 - DNA, 16 bp, P. troglodytes
gcctgctacctggagg

SEQ ID NO: 249001 - DNA, 17 bp, P. troglodytes
gcctgctagcccatgct

SEQ ID NO: 249002 - DNA, 16 bp, P. troglodytes
gcctgctcccactctg

SEQ ID NO: 249003 - DNA, 16 bp, P. troglodytes
gcctgctggaggatga

SEQ ID NO: 249004 - DNA, 16 bp, P. troglodytes
gcctgctggcctgtgg

SEQ ID NO: 249005 - DNA, 16 bp, P. troglodytes
gcctgctgggaggtgt

SEQ ID NO: 249006 - DNA, 16 bp, P. troglodytes
gcctgctgggttcaag

SEQ ID NO: 249007 - DNA, 16 bp, P. troglodytes
gcctgctgtgtgccag

SEQ ID NO: 249008 - DNA, 16 bp, P. troglodytes
gcctgcttcctcttca

SEQ ID NO: 249009 - DNA, 16 bp, P. troglodytes
gcctgcttcctggttc

SEQ ID NO: 249010 - DNA, 18 bp, P. troglodytes
gcctgcttcggcctccca

SEQ ID NO: 249011 - DNA, 16 bp, P. troglodytes
gcctgcttgaatttct

SEQ ID NO: 249012 - DNA, 16 bp, P. troglodytes
gcctggaaatagactc

SEQ ID NO: 249013 - DNA, 16 bp, P. troglodytes
gcctggaactcctgac

SEQ ID NO: 249014 - DNA, 16 bp, P. troglodytes
gcctggaagacagaga

SEQ ID NO: 249015 - DNA, 16 bp, P. troglodytes
gcctggaatgcccttt

SEQ ID NO: 249016 - DNA, 16 bp, P. troglodytes
gcctggacaacagtga

SEQ ID NO: 249017 - DNA, 16 bp, P. troglodytes
gcctggacaacatgat

SEQ ID NO: 249018 - DNA, 16 bp, P. troglodytes
gcctggacaatatggc

SEQ ID NO: 249019 - DNA, 16 bp, P. troglodytes
gcctggactgcagtgg

SEQ ID NO: 249020 - DNA, 16 bp, P. troglodytes
gcctggagacattttc

SEQ ID NO: 249021 - DNA, 16 bp, P. troglodytes
gcctggagagcagtgg

SEQ ID NO: 249022 - DNA, 16 bp, P. troglodytes
gcctggagcagtggct

SEQ ID NO: 249023 - DNA, 16 bp, P. troglodytes
gcctggagcccagtag

SEQ ID NO: 249024 - DNA, 16 bp, P. troglodytes
gcctggagctcctggg

SEQ ID NO: 249025 - DNA, 16 bp, P. troglodytes
gcctggagtctcagct

SEQ ID NO: 249026 - DNA, 16 bp, P. troglodytes
gcctggagtttgagac

SEQ ID NO: 249027 - DNA, 16 bp, P. troglodytes
gcctggatccctgaat

SEQ ID NO: 249028 - DNA, 16 bp, P. troglodytes
gcctggatgaaagagc

SEQ ID NO: 249029 - DNA, 16 bp, P. troglodytes
gcctggatttcagagg

SEQ ID NO: 249030 - DNA, 16 bp, P. troglodytes
gcctggcaacaagagc

SEQ ID NO: 249031 - DNA, 16 bp, P. troglodytes
gcctggcacagagcaa

SEQ ID NO: 249032 - DNA, 16 bp, P. troglodytes
gcctggcacagggcag

SEQ ID NO: 249033 - DNA, 16 bp, P. troglodytes
gcctggcacagtgtct

SEQ ID NO: 249034 - DNA, 16 bp, P. troglodytes
gcctggcagccacccc

SEQ ID NO: 249035 - DNA, 16 bp, P. troglodytes
gcctggcagggggagg

SEQ ID NO: 249036 - DNA, 16 bp, P. troglodytes
gcctggcatagagtag

SEQ ID NO: 249037 - DNA, 16 bp, P. troglodytes
gcctggcatgcagtgg

SEQ ID NO: 249038 - DNA, 16 bp, P. troglodytes
gcctggcattcaaggc

SEQ ID NO: 249039 - DNA, 16 bp, P. troglodytes
gcctggccaaaataat

SEQ ID NO: 249040 - DNA, 16 bp, P. troglodytes
gcctggccaagaaatt

SEQ ID NO: 249041 - DNA, 16 bp, P. troglodytes
gcctggccaagagacc

SEQ ID NO: 249042 - DNA, 16 bp, P. troglodytes
gcctggccagccgccc

SEQ ID NO: 249043 - DNA, 16 bp, P. troglodytes
gcctggccagcctggt

SEQ ID NO: 249044 - DNA, 16 bp, P. troglodytes
gcctggccaggttttt

SEQ ID NO: 249045 - DNA, 16 bp, P. troglodytes
gcctggcccacagcag

SEQ ID NO: 249046 - DNA, 16 bp, P. troglodytes
gcctggccctggccca

SEQ ID NO: 249047 - DNA, 16 bp, P. troglodytes
gcctggccctggccct

SEQ ID NO: 249048 - DNA, 16 bp, P. troglodytes
gcctggccctgtgctg

SEQ ID NO: 249049 - DNA, 16 bp, P. troglodytes
gcctggccgccacccc

SEQ ID NO: 249050 - DNA, 16 bp, P. troglodytes
gcctggcctacatttt

SEQ ID NO: 249051 - DNA, 16 bp, P. troglodytes
gcctggcctcaagtaa

SEQ ID NO: 249052 - DNA, 16 bp, P. troglodytes
gcctggcctccttcct

SEQ ID NO: 249053 - DNA, 16 bp, P. troglodytes
gcctggcctggccaac

SEQ ID NO: 249054 - DNA, 16 bp, P. troglodytes
gcctggcctggtggct

SEQ ID NO: 249055 - DNA, 16 bp, P. troglodytes
gcctggcctgttttat

SEQ ID NO: 249056 - DNA, 17 bp, P. troglodytes
gcctggcgacaaagcaa

SEQ ID NO: 249057 - DNA, 16 bp, P. troglodytes
gcctggctaatatttt

SEQ ID NO: 249058 - DNA, 16 bp, P. troglodytes
gcctggctaatttctt

SEQ ID NO: 249059 - DNA, 16 bp, P. troglodytes
gcctggctaattttta

SEQ ID NO: 249060 - DNA, 17 bp, P. troglodytes
gcctggctaatttttaa

SEQ ID NO: 249061 - DNA, 16 bp, P. troglodytes
gcctggctaatttttt

SEQ ID NO: 249062 - DNA, 17 bp, P. troglodytes
gcctggctagtttttgt

SEQ ID NO: 249063 - DNA, 16 bp, P. troglodytes
gcctggctcagtggct

SEQ ID NO: 249064 - DNA, 16 bp, P. troglodytes
gcctggctgccgcctt

SEQ ID NO: 249065 - DNA, 16 bp, P. troglodytes
gcctggctggggaggc

SEQ ID NO: 249066 - DNA, 16 bp, P. troglodytes
gcctggcttattttgc

SEQ ID NO: 249067 - DNA, 16 bp, P. troglodytes
gcctggcttatttttt

SEQ ID NO: 249068 - DNA, 16 bp, P. troglodytes
gcctgggaagttcaag

SEQ ID NO: 249069 - DNA, 16 bp, P. troglodytes
gcctgggactcctggg

SEQ ID NO: 249070 - DNA, 16 bp, P. troglodytes
gcctgggagaaaatat

SEQ ID NO: 249071 - DNA, 16 bp, P. troglodytes
gcctgggagacagagt

SEQ ID NO: 249072 - DNA, 16 bp, P. troglodytes
gcctgggagatcaagg

SEQ ID NO: 249073 - DNA, 16 bp, P. troglodytes
gcctgggaggatgagg

SEQ ID NO: 249074 - DNA, 16 bp, P. troglodytes
gcctgggaggcagatg

SEQ ID NO: 249075 - DNA, 16 bp, P. troglodytes
gcctgggagggcaagg

SEQ ID NO: 249076 - DNA, 16 bp, P. troglodytes
gcctgggaggtgaagg

SEQ ID NO: 249077 - DNA, 16 bp, P. troglodytes
gcctgggagtttgaag

SEQ ID NO: 249078 - DNA, 16 bp, P. troglodytes
gcctgggcaacaagtg

SEQ ID NO: 249079 - DNA, 16 bp, P. troglodytes
gcctgggcaacatggg

SEQ ID NO: 249080 - DNA, 16 bp, P. troglodytes
gcctgggcaacccagt

SEQ ID NO: 249081 - DNA, 16 bp, P. troglodytes
gcctgggcaacggagt

SEQ ID NO: 249082 - DNA, 16 bp, P. troglodytes
gcctgggcaactgagc

SEQ ID NO: 249083 - DNA, 16 bp, P. troglodytes
gcctgggcaacttagc

SEQ ID NO: 249084 - DNA, 16 bp, P. troglodytes
gcctgggcaccatgga

SEQ ID NO: 249085 - DNA, 16 bp, P. troglodytes
gcctgggcagcagaat

SEQ ID NO: 249086 - DNA, 16 bp, P. troglodytes
gcctgggcagcatgat

SEQ ID NO: 249087 - DNA, 16 bp, P. troglodytes
gcctgggcatggtggc

SEQ ID NO: 249088 - DNA, 16 bp, P. troglodytes
gcctgggccacagtga

SEQ ID NO: 249089 - DNA, 16 bp, P. troglodytes
gcctgggccacatagt

SEQ ID NO: 249090 - DNA, 16 bp, P. troglodytes
gcctgggccctgccca

SEQ ID NO: 249091 - DNA, 16 bp, P. troglodytes
gcctgggcctccagcc

SEQ ID NO: 249092 - DNA, 16 bp, P. troglodytes
gcctgggcctgggcct

SEQ ID NO: 249093 - DNA, 16 bp, P. troglodytes
gcctgggcctgggctg

SEQ ID NO: 249094 - DNA, 16 bp, P. troglodytes
gcctgggcggcagagc

SEQ ID NO: 249095 - DNA, 16 bp, P. troglodytes
gcctgggctcaagcaa

SEQ ID NO: 249096 - DNA, 17 bp, P. troglodytes
gcctgggctcaagtgat

SEQ ID NO: 249097 - DNA, 16 bp, P. troglodytes
gcctgggctcccactt

SEQ ID NO: 249098 - DNA, 16 bp, P. troglodytes
gcctgggctggccttg

SEQ ID NO: 249099 - DNA, 16 bp, P. troglodytes
gcctggggaacagggc

SEQ ID NO: 249100 - DNA, 16 bp, P. troglodytes
gcctggggaacccctg

SEQ ID NO: 249101 - DNA, 16 bp, P. troglodytes
gcctggggattgggga

SEQ ID NO: 249102 - DNA, 16 bp, P. troglodytes
gcctggggcaggagaa

SEQ ID NO: 249103 - DNA, 16 bp, P. troglodytes
gcctggggcaggggtg

SEQ ID NO: 249104 - DNA, 16 bp, P. troglodytes
gcctggggctccctcc

SEQ ID NO: 249105 - DNA, 16 bp, P. troglodytes
gcctggggctggggct

SEQ ID NO: 249106 - DNA, 16 bp, P. troglodytes
gcctgggggctgggct

SEQ ID NO: 249107 - DNA, 16 bp, P. troglodytes
gcctggggttgcccag

SEQ ID NO: 249108 - DNA, 16 bp, P. troglodytes
gcctggggttggggga

SEQ ID NO: 249109 - DNA, 16 bp, P. troglodytes
gcctgggtaatttttt

SEQ ID NO: 249110 - DNA, 16 bp, P. troglodytes
gcctgggtccacagcc

SEQ ID NO: 249111 - DNA, 16 bp, P. troglodytes
gcctgggtgaaggagt

SEQ ID NO: 249112 - DNA, 16 bp, P. troglodytes
gcctgggtgacagaag

SEQ ID NO: 249113 - DNA, 16 bp, P. troglodytes
gcctgggtgacagagc

SEQ ID NO: 249114 - DNA, 16 bp, P. troglodytes
gcctgggtgacagagg

SEQ ID NO: 249115 - DNA, 16 bp, P. troglodytes
gcctgggtgacagatg

SEQ ID NO: 249116 - DNA, 16 bp, P. troglodytes
gcctgggtgacagcac

SEQ ID NO: 249117 - DNA, 16 bp, P. troglodytes
gcctgggtgagagagg

SEQ ID NO: 249118 - DNA, 16 bp, P. troglodytes
gcctgggtgagtgaga

SEQ ID NO: 249119 - DNA, 16 bp, P. troglodytes
gcctgggtgcccaggc

SEQ ID NO: 249120 - DNA, 16 bp, P. troglodytes
gcctgggtggcagagg

SEQ ID NO: 249121 - DNA, 16 bp, P. troglodytes
gcctgggtggcttgcc

SEQ ID NO: 249122 - DNA, 16 bp, P. troglodytes
gcctgggttcaagtcc

SEQ ID NO: 249123 - DNA, 16 bp, P. troglodytes
gcctgggtttgaattc

SEQ ID NO: 249124 - DNA, 16 bp, P. troglodytes
gcctggtgacagagaa

SEQ ID NO: 249125 - DNA, 16 bp, P. troglodytes
gcctggtgcagtggca

SEQ ID NO: 249126 - DNA, 16 bp, P. troglodytes
gcctggtgcagtggct

SEQ ID NO: 249127 - DNA, 16 bp, P. troglodytes
gcctggtggctcacat

SEQ ID NO: 249128 - DNA, 16 bp, P. troglodytes
gcctggtgggaggtgt

SEQ ID NO: 249129 - DNA, 16 bp, P. troglodytes
gcctggtgtggtggtt

SEQ ID NO: 249130 - DNA, 16 bp, P. troglodytes
gcctggttaatttatt

SEQ ID NO: 249131 - DNA, 16 bp, P. troglodytes
gcctggtttttcctag

SEQ ID NO: 249132 - DNA, 16 bp, P. troglodytes
gcctgtaaggtttcca

SEQ ID NO: 249133 - DNA, 16 bp, P. troglodytes
gcctgtaataccaaca

SEQ ID NO: 249134 - DNA, 16 bp, P. troglodytes
gcctgtaatcccagcg

SEQ ID NO: 249135 - DNA, 16 bp, P. troglodytes
gcctgtaatcccagta

SEQ ID NO: 249136 - DNA, 16 bp, P. troglodytes
gcctgtaatcctagaa

SEQ ID NO: 249137 - DNA, 16 bp, P. troglodytes
gcctgtaatcctcagc

SEQ ID NO: 249138 - DNA, 16 bp, P. troglodytes
gcctgtaatctcagcc

SEQ ID NO: 249139 - DNA, 16 bp, P. troglodytes
gcctgtaattccagcc

SEQ ID NO: 249140 - DNA, 17 bp, P. troglodytes
gcctgtagtcccagcaa

SEQ ID NO: 249141 - DNA, 16 bp, P. troglodytes
gcctgtagtcccaggt

SEQ ID NO: 249142 - DNA, 16 bp, P. troglodytes
gcctgtagtcccagtg

SEQ ID NO: 249143 - DNA, 16 bp, P. troglodytes
gcctgtagtccctact

SEQ ID NO: 249144 - DNA, 16 bp, P. troglodytes
gcctgtatagccaaga

SEQ ID NO: 249145 - DNA, 16 bp, P. troglodytes
gcctgtcaaagtgctg

SEQ ID NO: 249146 - DNA, 16 bp, P. troglodytes
gcctgtcagggagtgg

SEQ ID NO: 249147 - DNA, 16 bp, P. troglodytes
gcctgtcctggggtgg

SEQ ID NO: 249148 - DNA, 20 bp, P. troglodytes
gcctgtctcggcctcccaaa

SEQ ID NO: 249149 - DNA, 16 bp, P. troglodytes
gcctgtctctgcctcc

SEQ ID NO: 249150 - DNA, 16 bp, P. troglodytes
gcctgtctgggggtgg

SEQ ID NO: 249151 - DNA, 16 bp, P. troglodytes
gcctgtcttggcctcc

SEQ ID NO: 249152 - DNA, 16 bp, P. troglodytes
gcctgtctttactaaa

SEQ ID NO: 249153 - DNA, 16 bp, P. troglodytes
gcctgtctttactgca

SEQ ID NO: 249154 - DNA, 16 bp, P. troglodytes
gcctgtgatcccagct

SEQ ID NO: 249155 - DNA, 16 bp, P. troglodytes
gcctgtgcaacaagag

SEQ ID NO: 249156 - DNA, 16 bp, P. troglodytes
gcctgtgcctatagtc

SEQ ID NO: 249157 - DNA, 16 bp, P. troglodytes
gcctgtgggcccagct

SEQ ID NO: 249158 - DNA, 16 bp, P. troglodytes
gcctgtgggctgtggg

SEQ ID NO: 249159 - DNA, 16 bp, P. troglodytes
gcctgtggtaccagct

SEQ ID NO: 249160 - DNA, 16 bp, P. troglodytes
gcctgtgtaacagagc

SEQ ID NO: 249161 - DNA, 16 bp, P. troglodytes
gcctgtgtcctcatct

SEQ ID NO: 249162 - DNA, 16 bp, P. troglodytes
gcctgtgtgccctgtg

SEQ ID NO: 249163 - DNA, 16 bp, P. troglodytes
gcctgtgttcccagct

SEQ ID NO: 249164 - DNA, 16 bp, P. troglodytes
gcctgtgttctgttcc

SEQ ID NO: 249165 - DNA, 16 bp, P. troglodytes
gcctgttcatatcctt

SEQ ID NO: 249166 - DNA, 16 bp, P. troglodytes
gcctgttgggggctgg

SEQ ID NO: 249167 - DNA, 16 bp, P. troglodytes
gcctgtttcctcattt

SEQ ID NO: 249168 - DNA, 16 bp, P. troglodytes
gcctgtttcctcttct

SEQ ID NO: 249169 - DNA, 16 bp, P. troglodytes
gccttaaaaaggaaaa

SEQ ID NO: 249170 - DNA, 16 bp, P. troglodytes
gccttaaaaaggaaga

SEQ ID NO: 249171 - DNA, 16 bp, P. troglodytes
gccttaaccttctggg

SEQ ID NO: 249172 - DNA, 16 bp, P. troglodytes
gccttaagatttaatg

SEQ ID NO: 249173 - DNA, 16 bp, P. troglodytes
gccttaatttgcattt

SEQ ID NO: 249174 - DNA, 16 bp, P. troglodytes
gccttaatttttaaaa

SEQ ID NO: 249175 - DNA, 16 bp, P. troglodytes
gccttagctgccttcc

SEQ ID NO: 249176 - DNA, 16 bp, P. troglodytes
gccttagtttccccat

SEQ ID NO: 249177 - DNA, 16 bp, P. troglodytes
gccttatggagaaaat

SEQ ID NO: 249178 - DNA, 16 bp, P. troglodytes
gccttcaactttgttc

SEQ ID NO: 249179 - DNA, 16 bp, P. troglodytes
gccttcacttcctgct

SEQ ID NO: 249180 - DNA, 16 bp, P. troglodytes
gccttcagaactgtga

SEQ ID NO: 249181 - DNA, 16 bp, P. troglodytes
gccttcagagggagca

SEQ ID NO: 249182 - DNA, 16 bp, P. troglodytes
gccttccaaaatgctg

SEQ ID NO: 249183 - DNA, 16 bp, P. troglodytes
gccttccaaaattctg

SEQ ID NO: 249184 - DNA, 16 bp, P. troglodytes
gccttccaaagagctg

SEQ ID NO: 249185 - DNA, 16 bp, P. troglodytes
gccttccaagtgctgg

SEQ ID NO: 249186 - DNA, 16 bp, P. troglodytes
gccttccaagttcaag

SEQ ID NO: 249187 - DNA, 16 bp, P. troglodytes
gccttccagctgtgcc

SEQ ID NO: 249188 - DNA, 16 bp, P. troglodytes
gccttccaggttcaag

SEQ ID NO: 249189 - DNA, 16 bp, P. troglodytes
gccttccaggttccag

SEQ ID NO: 249190 - DNA, 16 bp, P. troglodytes
gccttccatcatgatt

SEQ ID NO: 249191 - DNA, 16 bp, P. troglodytes
gccttcccacaggaca

SEQ ID NO: 249192 - DNA, 16 bp, P. troglodytes
gccttcccagcagctg

SEQ ID NO: 249193 - DNA, 16 bp, P. troglodytes
gccttccgggttcaag

SEQ ID NO: 249194 - DNA, 16 bp, P. troglodytes
gccttccgggttccag

SEQ ID NO: 249195 - DNA, 16 bp, P. troglodytes
gccttcctggaggagg

SEQ ID NO: 249196 - DNA, 16 bp, P. troglodytes
gccttccttggcctcc

SEQ ID NO: 249197 - DNA, 16 bp, P. troglodytes
gccttctactggaaga

SEQ ID NO: 249198 - DNA, 16 bp, P. troglodytes
gccttctctcagatga

SEQ ID NO: 249199 - DNA, 16 bp, P. troglodytes
gccttctctctcccag

SEQ ID NO: 249200 - DNA, 16 bp, P. troglodytes
gccttctgaggagctg

SEQ ID NO: 249201 - DNA, 16 bp, P. troglodytes
gccttctgagttcaag

SEQ ID NO: 249202 - DNA, 16 bp, P. troglodytes
gccttctgccatgatt

SEQ ID NO: 249203 - DNA, 16 bp, P. troglodytes
gccttctgggttcaag

SEQ ID NO: 249204 - DNA, 16 bp, P. troglodytes
gccttctggtttcaag

SEQ ID NO: 249205 - DNA, 16 bp, P. troglodytes
gccttcttcctggctt

SEQ ID NO: 249206 - DNA, 16 bp, P. troglodytes
gccttcttcctgtgtc

SEQ ID NO: 249207 - DNA, 16 bp, P. troglodytes
gccttgaacttctgga

SEQ ID NO: 249208 - DNA, 16 bp, P. troglodytes
gccttgaagtcctggg

SEQ ID NO: 249209 - DNA, 16 bp, P. troglodytes
gccttgaatctataaa

SEQ ID NO: 249210 - DNA, 16 bp, P. troglodytes
gccttgactgcctggg

SEQ ID NO: 249211 - DNA, 16 bp, P. troglodytes
gccttgagtgaacatt

SEQ ID NO: 249212 - DNA, 16 bp, P. troglodytes
gccttgattttggact

SEQ ID NO: 249213 - DNA, 16 bp, P. troglodytes
gccttgcccaaggtca

SEQ ID NO: 249214 - DNA, 16 bp, P. troglodytes
gccttgccctcctggg

SEQ ID NO: 249215 - DNA, 16 bp, P. troglodytes
gccttgctcattgcta

SEQ ID NO: 249216 - DNA, 16 bp, P. troglodytes
gccttgctctggatta

SEQ ID NO: 249217 - DNA, 16 bp, P. troglodytes
gccttgctctgtcacc

SEQ ID NO: 249218 - DNA, 16 bp, P. troglodytes
gccttgctgccgcctt

SEQ ID NO: 249219 - DNA, 16 bp, P. troglodytes
gccttgctgggtttca

SEQ ID NO: 249220 - DNA, 16 bp, P. troglodytes
gccttgctttcccttc

SEQ ID NO: 249221 - DNA, 16 bp, P. troglodytes
gccttggaggtggagg

SEQ ID NO: 249222 - DNA, 16 bp, P. troglodytes
gccttggcaacaaagc

SEQ ID NO: 249223 - DNA, 16 bp, P. troglodytes
gccttggcaacttcca

SEQ ID NO: 249224 - DNA, 17 bp, P. troglodytes
gccttggccagcccaga

SEQ ID NO: 249225 - DNA, 16 bp, P. troglodytes
gccttggccccccaga

SEQ ID NO: 249226 - DNA, 16 bp, P. troglodytes
gccttggccccctgaa

SEQ ID NO: 249227 - DNA, 16 bp, P. troglodytes
gccttggcctcccaaa

SEQ ID NO: 249228 - DNA, 18 bp, P. troglodytes
gccttggcctcccaaact

SEQ ID NO: 249229 - DNA, 19 bp, P. troglodytes
gccttggcctcccaaagta

SEQ ID NO: 249230 - DNA, 16 bp, P. troglodytes
gccttggcctcccatg

SEQ ID NO: 249231 - DNA, 16 bp, P. troglodytes
gccttggcctcctgaa

SEQ ID NO: 249232 - DNA, 16 bp, P. troglodytes
gccttggcctcctgga

SEQ ID NO: 249233 - DNA, 16 bp, P. troglodytes
gccttggccttggcct

SEQ ID NO: 249234 - DNA, 16 bp, P. troglodytes
gccttggctgccttcc

SEQ ID NO: 249235 - DNA, 16 bp, P. troglodytes
gccttgggcctcccaa

SEQ ID NO: 249236 - DNA, 16 bp, P. troglodytes
gccttgtaatatattt

SEQ ID NO: 249237 - DNA, 16 bp, P. troglodytes
gccttgtagagtttct

SEQ ID NO: 249238 - DNA, 16 bp, P. troglodytes
gccttgtgatctttgc

SEQ ID NO: 249239 - DNA, 16 bp, P. troglodytes
gccttgttctgtcacc

SEQ ID NO: 249240 - DNA, 16 bp, P. troglodytes
gcctttaaagaggtga

SEQ ID NO: 249241 - DNA, 16 bp, P. troglodytes
gcctttatttcttcaa

SEQ ID NO: 249242 - DNA, 16 bp, P. troglodytes
gcctttcaccttcctc

SEQ ID NO: 249243 - DNA, 16 bp, P. troglodytes
gcctttctgcaggtgt

SEQ ID NO: 249244 - DNA, 16 bp, P. troglodytes
gcctttctggaccaaa

SEQ ID NO: 249245 - DNA, 16 bp, P. troglodytes
gcctttctggagagac

SEQ ID NO: 249246 - DNA, 16 bp, P. troglodytes
gcctttgcacgtgctg

SEQ ID NO: 249247 - DNA, 16 bp, P. troglodytes
gcctttgcttttggtg

SEQ ID NO: 249248 - DNA, 16 bp, P. troglodytes
gcctttggaaagtgat

SEQ ID NO: 249249 - DNA, 16 bp, P. troglodytes
gcctttggccatgatt

SEQ ID NO: 249250 - DNA, 16 bp, P. troglodytes
gcctttgtgtgtgtgt

SEQ ID NO: 249251 - DNA, 16 bp, P. troglodytes
gccttttaaaaatata

SEQ ID NO: 249252 - DNA, 16 bp, P. troglodytes
gccttttcaaattggc

SEQ ID NO: 249253 - DNA, 16 bp, P. troglodytes
gccttttctcctatta

SEQ ID NO: 249254 - DNA, 16 bp, P. troglodytes
gccttttgcctcccac

SEQ ID NO: 249255 - DNA, 16 bp, P. troglodytes
gccttttggctaagat

SEQ ID NO: 249256 - DNA, 16 bp, P. troglodytes
gccttttgtggtttta

SEQ ID NO: 249257 - DNA, 16 bp, P. troglodytes
gcgaaaccccgcctct

SEQ ID NO: 249258 - DNA, 16 bp, P. troglodytes
gcgaaagagcaagact

SEQ ID NO: 249259 - DNA, 16 bp, P. troglodytes
gcgaacccgggaggca

SEQ ID NO: 249260 - DNA, 16 bp, P. troglodytes
gcgaaggtttcagtga

SEQ ID NO: 249261 - DNA, 16 bp, P. troglodytes
gcgacagtttgctcag

SEQ ID NO: 249262 - DNA, 17 bp, P. troglodytes
gcgaccagcctggccaa

SEQ ID NO: 249263 - DNA, 16 bp, P. troglodytes
gcgagactccatctca

SEQ ID NO: 249264 - DNA, 16 bp, P. troglodytes
gcgagagagagagaca

SEQ ID NO: 249265 - DNA, 16 bp, P. troglodytes
gcgagagagtgagacc

SEQ ID NO: 249266 - DNA, 16 bp, P. troglodytes
gcgagagccaccgcac

SEQ ID NO: 249267 - DNA, 16 bp, P. troglodytes
gcgagatcaacacaga

SEQ ID NO: 249268 - DNA, 19 bp, P. troglodytes
gcgagctgagatcacgcca

SEQ ID NO: 249269 - DNA, 16 bp, P. troglodytes
gcgagtgagttctcac

SEQ ID NO: 249270 - DNA, 16 bp, P. troglodytes
gcgatcacagcttact

SEQ ID NO: 249271 - DNA, 16 bp, P. troglodytes
gcgatccacctgcttt

SEQ ID NO: 249272 - DNA, 16 bp, P. troglodytes
gcgatccgcccgcctc

SEQ ID NO: 249273 - DNA, 16 bp, P. troglodytes
gcgatccgcctgcctc

SEQ ID NO: 249274 - DNA, 16 bp, P. troglodytes
gcgatcctggctcact

SEQ ID NO: 249275 - DNA, 16 bp, P. troglodytes
gcgatctcggctcacc

SEQ ID NO: 249276 - DNA, 19 bp, P. troglodytes
gcgatctcggctgactgca

SEQ ID NO: 249277 - DNA, 16 bp, P. troglodytes
gcgatctgccctcctc

SEQ ID NO: 249278 - DNA, 16 bp, P. troglodytes
gcgatcttggcttacc

SEQ ID NO: 249279 - DNA, 16 bp, P. troglodytes
gcgatgggggtcctaa

SEQ ID NO: 249280 - DNA, 16 bp, P. troglodytes
gcgcacacgcacacac

SEQ ID NO: 249281 - DNA, 16 bp, P. troglodytes
gcgcacgcgcacacac

SEQ ID NO: 249282 - DNA, 16 bp, P. troglodytes
gcgcagtggcgggcac

SEQ ID NO: 249283 - DNA, 16 bp, P. troglodytes
gcgcagtggctcatcc

SEQ ID NO: 249284 - DNA, 16 bp, P. troglodytes
gcgcagtggctcccac

SEQ ID NO: 249285 - DNA, 16 bp, P. troglodytes
gcgcagtggctcgtgc

SEQ ID NO: 249286 - DNA, 16 bp, P. troglodytes
gcgcataccaccatgc

SEQ ID NO: 249287 - DNA, 16 bp, P. troglodytes
gcgcatgccaccatgc

SEQ ID NO: 249288 - DNA, 16 bp, P. troglodytes
gcgccaccacacccgg

SEQ ID NO: 249289 - DNA, 16 bp, P. troglodytes
gcgccaccacagccag

SEQ ID NO: 249290 - DNA, 20 bp, P. troglodytes
gcgccaccacgcctggctaa

SEQ ID NO: 249291 - DNA, 16 bp, P. troglodytes
gcgccactacgcctgg

SEQ ID NO: 249292 - DNA, 16 bp, P. troglodytes
gcgccactgcactccg

SEQ ID NO: 249293 - DNA, 16 bp, P. troglodytes
gcgccactgcagtcca

SEQ ID NO: 249294 - DNA, 18 bp, P. troglodytes
gcgcccaccaccatgcct

SEQ ID NO: 249295 - DNA, 16 bp, P. troglodytes
gcgcccagccaatgtt

SEQ ID NO: 249296 - DNA, 16 bp, P. troglodytes
gcgcccagcccacatt

SEQ ID NO: 249297 - DNA, 16 bp, P. troglodytes
gcgcccagcctatttt

SEQ ID NO: 249298 - DNA, 16 bp, P. troglodytes
gcgcccgccactgcgc

SEQ ID NO: 249299 - DNA, 16 bp, P. troglodytes
gcgcccggctaatttt

SEQ ID NO: 249300 - DNA, 16 bp, P. troglodytes
gcgccctctgctggcc

SEQ ID NO: 249301 - DNA, 16 bp, P. troglodytes
gcgcctctgcactcca

SEQ ID NO: 249302 - DNA, 16 bp, P. troglodytes
gcgcctctgccctgcc

SEQ ID NO: 249303 - DNA, 16 bp, P. troglodytes
gcgcctgttgtcccag

SEQ ID NO: 249304 - DNA, 16 bp, P. troglodytes
gcgcgatctcagctcc

SEQ ID NO: 249305 - DNA, 16 bp, P. troglodytes
gcgcgcctgtagtccc

SEQ ID NO: 249306 - DNA, 16 bp, P. troglodytes
gcgcgcgcgcgcacac

SEQ ID NO: 249307 - DNA, 16 bp, P. troglodytes
gcgcgtgcctgtagtc

SEQ ID NO: 249308 - DNA, 16 bp, P. troglodytes
gcgctactgcactcca

SEQ ID NO: 249309 - DNA, 16 bp, P. troglodytes
gcgctatctgggctca

SEQ ID NO: 249310 - DNA, 16 bp, P. troglodytes
gcgctccagcctggac

SEQ ID NO: 249311 - DNA, 18 bp, P. troglodytes
gcgctgtgctcgatttct

SEQ ID NO: 249312 - DNA, 16 bp, P. troglodytes
gcgctttgggaggctg

SEQ ID NO: 249313 - DNA, 16 bp, P. troglodytes
gcggaagcaggagaat

SEQ ID NO: 249314 - DNA, 16 bp, P. troglodytes
gcggaagtgggaaagg

SEQ ID NO: 249315 - DNA, 16 bp, P. troglodytes
gcggacccttgcggtg

SEQ ID NO: 249316 - DNA, 16 bp, P. troglodytes
gcggagctgcccaagg

SEQ ID NO: 249317 - DNA, 16 bp, P. troglodytes
gcggagcttgcagtgg

SEQ ID NO: 249318 - DNA, 16 bp, P. troglodytes
gcggaggcaggtggat

SEQ ID NO: 249319 - DNA, 16 bp, P. troglodytes
gcggaggctgcaggga

SEQ ID NO: 249320 - DNA, 16 bp, P. troglodytes
gcggaggttgcggtga

SEQ ID NO: 249321 - DNA, 16 bp, P. troglodytes
gcggataacctgaggt

SEQ ID NO: 249322 - DNA, 16 bp, P. troglodytes
gcggatcacccgaggt

SEQ ID NO: 249323 - DNA, 16 bp, P. troglodytes
gcggcagcccctccca

SEQ ID NO: 249324 - DNA, 16 bp, P. troglodytes
gcggccacctgtagtc

SEQ ID NO: 249325 - DNA, 16 bp, P. troglodytes
gcggcggctcacacct

SEQ ID NO: 249326 - DNA, 16 bp, P. troglodytes
gcggctcacacctgta

SEQ ID NO: 249327 - DNA, 16 bp, P. troglodytes
gcggctgcagagggtg

SEQ ID NO: 249328 - DNA, 16 bp, P. troglodytes
gcggctttccgcagtg

SEQ ID NO: 249329 - DNA, 16 bp, P. troglodytes
gcgggaaccggggctg

SEQ ID NO: 249330 - DNA, 16 bp, P. troglodytes
gcgggagaatggcgtg

SEQ ID NO: 249331 - DNA, 16 bp, P. troglodytes
gcgggaggctgaggca

SEQ ID NO: 249332 - DNA, 16 bp, P. troglodytes
gcgggcagatgacttg

SEQ ID NO: 249333 - DNA, 16 bp, P. troglodytes
gcgggcggatcaactg

SEQ ID NO: 249334 - DNA, 16 bp, P. troglodytes
gcggggaggagcctgg

SEQ ID NO: 249335 - DNA, 16 bp, P. troglodytes
gcggggcatcgcctca

SEQ ID NO: 249336 - DNA, 16 bp, P. troglodytes
gcgggggctgcagtga

SEQ ID NO: 249337 - DNA, 20 bp, P. troglodytes
gcgggtggatcacttgaggg

SEQ ID NO: 249338 - DNA, 16 bp, P. troglodytes
gcggtagctcacgcct

SEQ ID NO: 249339 - DNA, 16 bp, P. troglodytes
gcggtgacccccctgg

SEQ ID NO: 249340 - DNA, 16 bp, P. troglodytes
gcggtgagtgttacag

SEQ ID NO: 249341 - DNA, 16 bp, P. troglodytes
gcggtggcccacgcct

SEQ ID NO: 249342 - DNA, 16 bp, P. troglodytes
gcggtggctcatacct

SEQ ID NO: 249343 - DNA, 16 bp, P. troglodytes
gcggtggctcctgcct

SEQ ID NO: 249344 - DNA, 16 bp, P. troglodytes
gcgtagtggcacatgc

SEQ ID NO: 249345 - DNA, 16 bp, P. troglodytes
gcgtcagagcgagact

SEQ ID NO: 249346 - DNA, 16 bp, P. troglodytes
gcgtccttgtcttgtg

SEQ ID NO: 249347 - DNA, 16 bp, P. troglodytes
gcgtctgccaccacgc

SEQ ID NO: 249348 - DNA, 16 bp, P. troglodytes
gcgtctgtgtgaagag

SEQ ID NO: 249349 - DNA, 16 bp, P. troglodytes
gcgtgaaccaccacac

SEQ ID NO: 249350 - DNA, 16 bp, P. troglodytes
gcgtgaacttgggagg

SEQ ID NO: 249351 - DNA, 16 bp, P. troglodytes
gcgtgatcatggctca

SEQ ID NO: 249352 - DNA, 16 bp, P. troglodytes
gcgtgccaccaggccc

SEQ ID NO: 249353 - DNA, 16 bp, P. troglodytes
gcgtgcgccaccacac

SEQ ID NO: 249354 - DNA, 16 bp, P. troglodytes
gcgtgcgcgtgtgtgt

SEQ ID NO: 249355 - DNA, 16 bp, P. troglodytes
gcgtgcgtgtgtgtgc

SEQ ID NO: 249356 - DNA, 16 bp, P. troglodytes
gcgtggctggggaggc

SEQ ID NO: 249357 - DNA, 16 bp, P. troglodytes
gcgtgggcaacatagc

SEQ ID NO: 249358 - DNA, 17 bp, P. troglodytes
gcgtggtagcgggtgcc

SEQ ID NO: 249359 - DNA, 23 bp, P. troglodytes
gcgtggtggcgggcacctgtaat

SEQ ID NO: 249360 - DNA, 16 bp, P. troglodytes
gcgtggtggtgaacac

SEQ ID NO: 249361 - DNA, 16 bp, P. troglodytes
gcgtggtggtgctcgc

SEQ ID NO: 249362 - DNA, 16 bp, P. troglodytes
gcgtgtacacacacac

SEQ ID NO: 249363 - DNA, 16 bp, P. troglodytes
gcgtgtgcctgtgtgt

SEQ ID NO: 249364 - DNA, 16 bp, P. troglodytes
gcgtgtgcgtgtgtgt

SEQ ID NO: 249365 - DNA, 16 bp, P. troglodytes
gcgtgtgtgtatgtgt

SEQ ID NO: 249366 - DNA, 16 bp, P. troglodytes
gcgttatttctgaggg

SEQ ID NO: 249367 - DNA, 16 bp, P. troglodytes
gctaaaaatacaaaag

SEQ ID NO: 249368 - DNA, 16 bp, P. troglodytes
gctaaaattaaaaaga

SEQ ID NO: 249369 - DNA, 16 bp, P. troglodytes
gctaaaatttttaaat

SEQ ID NO: 249370 - DNA, 16 bp, P. troglodytes
gctaaacattgggcac

SEQ ID NO: 249371 - DNA, 16 bp, P. troglodytes
gctaaactaagaaaaa

SEQ ID NO: 249372 - DNA, 16 bp, P. troglodytes
gctaaactaatttaca

SEQ ID NO: 249373 - DNA, 16 bp, P. troglodytes
gctaaataatattcca

SEQ ID NO: 249374 - DNA, 16 bp, P. troglodytes
gctaaatgccccactt

SEQ ID NO: 249375 - DNA, 16 bp, P. troglodytes
gctaacacaatatcca

SEQ ID NO: 249376 - DNA, 16 bp, P. troglodytes
gctaacatagtgaaat

SEQ ID NO: 249377 - DNA, 17 bp, P. troglodytes
gctaactagaataatca

SEQ ID NO: 249378 - DNA, 16 bp, P. troglodytes
gctaactgggcactgg

SEQ ID NO: 249379 - DNA, 16 bp, P. troglodytes
gctaagaaaggagaga

SEQ ID NO: 249380 - DNA, 16 bp, P. troglodytes
gctaagaactttgaaa

SEQ ID NO: 249381 - DNA, 16 bp, P. troglodytes
gctaagatcatgccat

SEQ ID NO: 249382 - DNA, 16 bp, P. troglodytes
gctaagatgggaggat

SEQ ID NO: 249383 - DNA, 16 bp, P. troglodytes
gctaagattacaggtg

SEQ ID NO: 249384 - DNA, 18 bp, P. troglodytes
gctaagcccctcattgcc

SEQ ID NO: 249385 - DNA, 16 bp, P. troglodytes
gctaaggcaagagaat

SEQ ID NO: 249386 - DNA, 16 bp, P. troglodytes
gctaaggcacgagaat

SEQ ID NO: 249387 - DNA, 16 bp, P. troglodytes
gctaaggcatgagaat

SEQ ID NO: 249388 - DNA, 16 bp, P. troglodytes
gctaaggcgggaggat

SEQ ID NO: 249389 - DNA, 16 bp, P. troglodytes
gctaaggcgggtggat

SEQ ID NO: 249390 - DNA, 17 bp, P. troglodytes
gctaaggtgggtggatt

SEQ ID NO: 249391 - DNA, 16 bp, P. troglodytes
gctaagtgtggtggtg

SEQ ID NO: 249392 - DNA, 16 bp, P. troglodytes
gctaataaaggcatac

SEQ ID NO: 249393 - DNA, 16 bp, P. troglodytes
gctaatattgtatttt

SEQ ID NO: 249394 - DNA, 16 bp, P. troglodytes
gctaatgtttttgttt

SEQ ID NO: 249395 - DNA, 16 bp, P. troglodytes
gctaattattttaatt

SEQ ID NO: 249396 - DNA, 16 bp, P. troglodytes
gctaatttaaattttt

SEQ ID NO: 249397 - DNA, 16 bp, P. troglodytes
gctaattttaaaaaat

SEQ ID NO: 249398 - DNA, 16 bp, P. troglodytes
gctaattttgtagttt

SEQ ID NO: 249399 - DNA, 16 bp, P. troglodytes
gctaatttttaaatat

SEQ ID NO: 249400 - DNA, 16 bp, P. troglodytes
gctaatttttaatatt

SEQ ID NO: 249401 - DNA, 16 bp, P. troglodytes
gctaatttttaattta

SEQ ID NO: 249402 - DNA, 16 bp, P. troglodytes
gctaatttttctatgt

SEQ ID NO: 249403 - DNA, 16 bp, P. troglodytes
gctaatttttggcatt

SEQ ID NO: 249404 - DNA, 16 bp, P. troglodytes
gctacaaacctgtaca

SEQ ID NO: 249405 - DNA, 16 bp, P. troglodytes
gctacaaataaaataa

SEQ ID NO: 249406 - DNA, 16 bp, P. troglodytes
gctacaatgagctatg

SEQ ID NO: 249407 - DNA, 16 bp, P. troglodytes
gctacacactttcaaa

SEQ ID NO: 249408 - DNA, 16 bp, P. troglodytes
gctacagaaaccaaaa

SEQ ID NO: 249409 - DNA, 16 bp, P. troglodytes
gctacagagaggagct

SEQ ID NO: 249410 - DNA, 16 bp, P. troglodytes
gctacagtgagccata

SEQ ID NO: 249411 - DNA, 16 bp, P. troglodytes
gctacattaaatttat

SEQ ID NO: 249412 - DNA, 16 bp, P. troglodytes
gctaccaacatgatgt

SEQ ID NO: 249413 - DNA, 16 bp, P. troglodytes
gctaccaccaccacca

SEQ ID NO: 249414 - DNA, 21 bp, P. troglodytes
gctaccacgcccggctaattt

SEQ ID NO: 249415 - DNA, 16 bp, P. troglodytes
gctaccagcctcccag

SEQ ID NO: 249416 - DNA, 16 bp, P. troglodytes
gctaccagggaagctg

SEQ ID NO: 249417 - DNA, 16 bp, P. troglodytes
gctactatgcctggcc

SEQ ID NO: 249418 - DNA, 16 bp, P. troglodytes
gctactcaaaggctga

SEQ ID NO: 249419 - DNA, 16 bp, P. troglodytes
gctactcaggagcttg

SEQ ID NO: 249420 - DNA, 16 bp, P. troglodytes
gctactcaggggcctg

SEQ ID NO: 249421 - DNA, 16 bp, P. troglodytes
gctactcgggacgctg

SEQ ID NO: 249422 - DNA, 19 bp, P. troglodytes
gctactgaagcttgtgcat

SEQ ID NO: 249423 - DNA, 16 bp, P. troglodytes
gctactgatttttgtg

SEQ ID NO: 249424 - DNA, 16 bp, P. troglodytes
gctactgcacagcaaa

SEQ ID NO: 249425 - DNA, 16 bp, P. troglodytes
gctactgcacttggcc

SEQ ID NO: 249426 - DNA, 16 bp, P. troglodytes
gctactgctgctactg

SEQ ID NO: 249427 - DNA, 16 bp, P. troglodytes
gctactgctttatcaa

SEQ ID NO: 249428 - DNA, 16 bp, P. troglodytes
gctactggcatccagt

SEQ ID NO: 249429 - DNA, 16 bp, P. troglodytes
gctactggggaaactg

SEQ ID NO: 249430 - DNA, 16 bp, P. troglodytes
gctactgtgttggaca

SEQ ID NO: 249431 - DNA, 16 bp, P. troglodytes
gctacttgagataatg

SEQ ID NO: 249432 - DNA, 16 bp, P. troglodytes
gctacttttaaaattt

SEQ ID NO: 249433 - DNA, 16 bp, P. troglodytes
gctagaaatgcagatt

SEQ ID NO: 249434 - DNA, 16 bp, P. troglodytes
gctagaacccgggagg

SEQ ID NO: 249435 - DNA, 16 bp, P. troglodytes
gctagaacctgggagg

SEQ ID NO: 249436 - DNA, 16 bp, P. troglodytes
gctagaagtttgaaat

SEQ ID NO: 249437 - DNA, 16 bp, P. troglodytes
gctagaattacaggca

SEQ ID NO: 249438 - DNA, 16 bp, P. troglodytes
gctagagaaaggaaaa

SEQ ID NO: 249439 - DNA, 16 bp, P. troglodytes
gctagagaaggaaaag

SEQ ID NO: 249440 - DNA, 16 bp, P. troglodytes
gctagagtgcaatggc

SEQ ID NO: 249441 - DNA, 16 bp, P. troglodytes
gctagagtgcagtggc

SEQ ID NO: 249442 - DNA, 16 bp, P. troglodytes
gctagatctttttctt

SEQ ID NO: 249443 - DNA, 16 bp, P. troglodytes
gctagcaaatggcaga

SEQ ID NO: 249444 - DNA, 33 bp, P. troglodytes
gctagcacagcagtctgagatcaaactgcaagg

SEQ ID NO: 249445 - DNA, 16 bp, P. troglodytes
gctagcagaagccaag

SEQ ID NO: 249446 - DNA, 26 bp, P. troglodytes
gctagccatatgtagaaagctgaaaa

SEQ ID NO: 249447 - DNA, 16 bp, P. troglodytes
gctagcctgggcaaca

SEQ ID NO: 249448 - DNA, 16 bp, P. troglodytes
gctaggacatccagta

SEQ ID NO: 249449 - DNA, 16 bp, P. troglodytes
gctaggatcacaggca

SEQ ID NO: 249450 - DNA, 16 bp, P. troglodytes
gctaggattacagaca

SEQ ID NO: 249451 - DNA, 16 bp, P. troglodytes
gctaggattactggca

SEQ ID NO: 249452 - DNA, 16 bp, P. troglodytes
gctaggattgcaggca

SEQ ID NO: 249453 - DNA, 16 bp, P. troglodytes
gctaggcgcagtggct

SEQ ID NO: 249454 - DNA, 16 bp, P. troglodytes
gctaggctgggctggg

SEQ ID NO: 249455 - DNA, 16 bp, P. troglodytes
gctagggcctggaaca

SEQ ID NO: 249456 - DNA, 16 bp, P. troglodytes
gctagtaagtagtaga

SEQ ID NO: 249457 - DNA, 16 bp, P. troglodytes
gctagtttcttttgct

SEQ ID NO: 249458 - DNA, 16 bp, P. troglodytes
gctagtttgtatttct

SEQ ID NO: 249459 - DNA, 16 bp, P. troglodytes
gctataacaaagtact

SEQ ID NO: 249460 - DNA, 17 bp, P. troglodytes
gctataatcccagcact

SEQ ID NO: 249461 - DNA, 16 bp, P. troglodytes
gctatagtgcaatggt

SEQ ID NO: 249462 - DNA, 16 bp, P. troglodytes
gctatatatagtatat

SEQ ID NO: 249463 - DNA, 16 bp, P. troglodytes
gctatattttgtattt

SEQ ID NO: 249464 - DNA, 16 bp, P. troglodytes
gctatcattgactttc

SEQ ID NO: 249465 - DNA, 16 bp, P. troglodytes
gctatccccatcaaac

SEQ ID NO: 249466 - DNA, 16 bp, P. troglodytes
gctatctgcactccca

SEQ ID NO: 249467 - DNA, 16 bp, P. troglodytes
gctatctgtgaaattg

SEQ ID NO: 249468 - DNA, 16 bp, P. troglodytes
gctatgaaaaaatacc

SEQ ID NO: 249469 - DNA, 16 bp, P. troglodytes
gctatgaatattcatg

SEQ ID NO: 249470 - DNA, 16 bp, P. troglodytes
gctatgaccacaccac

SEQ ID NO: 249471 - DNA, 16 bp, P. troglodytes
gctatgatcatggcac

SEQ ID NO: 249472 - DNA, 16 bp, P. troglodytes
gctatgattgtgcctg

SEQ ID NO: 249473 - DNA, 16 bp, P. troglodytes
gctatggagaaaataa

SEQ ID NO: 249474 - DNA, 16 bp, P. troglodytes
gctatgggagactggg

SEQ ID NO: 249475 - DNA, 16 bp, P. troglodytes
gctatggtggctatgg

SEQ ID NO: 249476 - DNA, 17 bp, P. troglodytes
gctatgttgtccaggct

SEQ ID NO: 249477 - DNA, 18 bp, P. troglodytes
gctattaattattgcctc

SEQ ID NO: 249478 - DNA, 16 bp, P. troglodytes
gctattacaaataaag

SEQ ID NO: 249479 - DNA, 16 bp, P. troglodytes
gctattacaaatagtg

SEQ ID NO: 249480 - DNA, 16 bp, P. troglodytes
gctattattaaaaagt

SEQ ID NO: 249481 - DNA, 16 bp, P. troglodytes
gctattattcttagca

SEQ ID NO: 249482 - DNA, 16 bp, P. troglodytes
gctattcctcccctag

SEQ ID NO: 249483 - DNA, 16 bp, P. troglodytes
gctattctagtgatag

SEQ ID NO: 249484 - DNA, 16 bp, P. troglodytes
gctattctttctgatg

SEQ ID NO: 249485 - DNA, 16 bp, P. troglodytes
gctattgaaataaaat

SEQ ID NO: 249486 - DNA, 16 bp, P. troglodytes
gctattgatttttgta

SEQ ID NO: 249487 - DNA, 16 bp, P. troglodytes
gctattgtgaatggaa

SEQ ID NO: 249488 - DNA, 19 bp, P. troglodytes
gctatttaggtgagactat

SEQ ID NO: 249489 - DNA, 16 bp, P. troglodytes
gctatttatggcaaac

SEQ ID NO: 249490 - DNA, 16 bp, P. troglodytes
gctatttatttattta

SEQ ID NO: 249491 - DNA, 16 bp, P. troglodytes
gctatttggagtcttt

SEQ ID NO: 249492 - DNA, 16 bp, P. troglodytes
gctatttgggaggcag

SEQ ID NO: 249493 - DNA, 16 bp, P. troglodytes
gctatttgtacatctt

SEQ ID NO: 249494 - DNA, 16 bp, P. troglodytes
gctatttttaaatata

SEQ ID NO: 249495 - DNA, 16 bp, P. troglodytes
gctattttttaaaaaa

SEQ ID NO: 249496 - DNA, 16 bp, P. troglodytes
gctcaaaaataaataa

SEQ ID NO: 249497 - DNA, 16 bp, P. troglodytes
gctcaaaagaaaacaa

SEQ ID NO: 249498 - DNA, 16 bp, P. troglodytes
gctcaaacaactctat

SEQ ID NO: 249499 - DNA, 16 bp, P. troglodytes
gctcaaagaactaaag

SEQ ID NO: 249500 - DNA, 16 bp, P. troglodytes
gctcaagaaatcctct

SEQ ID NO: 249501 - DNA, 16 bp, P. troglodytes
gctcaagaaatctgcc

SEQ ID NO: 249502 - DNA, 16 bp, P. troglodytes
gctcaagacatcctcc

SEQ ID NO: 249503 - DNA, 16 bp, P. troglodytes
gctcaagaccagcctg

SEQ ID NO: 249504 - DNA, 16 bp, P. troglodytes
gctcaagcaatctgcc

SEQ ID NO: 249505 - DNA, 16 bp, P. troglodytes
gctcaagcaggtcctg

SEQ ID NO: 249506 - DNA, 16 bp, P. troglodytes
gctcaagcagtcgtcc

SEQ ID NO: 249507 - DNA, 16 bp, P. troglodytes
gctcaagcagttcacc

SEQ ID NO: 249508 - DNA, 16 bp, P. troglodytes
gctcaagcagttcttc

SEQ ID NO: 249509 - DNA, 16 bp, P. troglodytes
gctcaagcccaggagg

SEQ ID NO: 249510 - DNA, 16 bp, P. troglodytes
gctcaagcctctaatc

SEQ ID NO: 249511 - DNA, 16 bp, P. troglodytes
gctcaagcctgaaatc

SEQ ID NO: 249512 - DNA, 16 bp, P. troglodytes
gctcaagcctgggagg

SEQ ID NO: 249513 - DNA, 16 bp, P. troglodytes
gctcaagcgatccgcc

SEQ ID NO: 249514 - DNA, 16 bp, P. troglodytes
gctcaagcggtcctcc

SEQ ID NO: 249515 - DNA, 16 bp, P. troglodytes
gctcaagctatcctcc

SEQ ID NO: 249516 - DNA, 16 bp, P. troglodytes
gctcaagctatctgcc

SEQ ID NO: 249517 - DNA, 16 bp, P. troglodytes
gctcaaggaatcctct

SEQ ID NO: 249518 - DNA, 16 bp, P. troglodytes
gctcaaggccaggagt

SEQ ID NO: 249519 - DNA, 16 bp, P. troglodytes
gctcaagtgatctacc

SEQ ID NO: 249520 - DNA, 16 bp, P. troglodytes
gctcaagtgatctgcc

SEQ ID NO: 249521 - DNA, 17 bp, P. troglodytes
gctcaagtgatcttccc

SEQ ID NO: 249522 - DNA, 16 bp, P. troglodytes
gctcaagtgtttctcc

SEQ ID NO: 249523 - DNA, 16 bp, P. troglodytes
gctcaataaaattctt

SEQ ID NO: 249524 - DNA, 16 bp, P. troglodytes
gctcaataaatacttg

SEQ ID NO: 249525 - DNA, 16 bp, P. troglodytes
gctcaatgcagcctcg

SEQ ID NO: 249526 - DNA, 16 bp, P. troglodytes
gctcacaggaagccac

SEQ ID NO: 249527 - DNA, 16 bp, P. troglodytes
gctcaccaccacctcc

SEQ ID NO: 249528 - DNA, 16 bp, P. troglodytes
gctcacctcagcctcc

SEQ ID NO: 249529 - DNA, 16 bp, P. troglodytes
gctcacctccacctcc

SEQ ID NO: 249530 - DNA, 16 bp, P. troglodytes
gctcacctcctactgt

SEQ ID NO: 249531 - DNA, 16 bp, P. troglodytes
gctcacctgctgctca

SEQ ID NO: 249532 - DNA, 16 bp, P. troglodytes
gctcacctgctgctgt

SEQ ID NO: 249533 - DNA, 16 bp, P. troglodytes
gctcacggcaacctcc

SEQ ID NO: 249534 - DNA, 16 bp, P. troglodytes
gctcactacaacctcc

SEQ ID NO: 249535 - DNA, 16 bp, P. troglodytes
gctcactacagcctca

SEQ ID NO: 249536 - DNA, 16 bp, P. troglodytes
gctcactacagcctgg

SEQ ID NO: 249537 - DNA, 16 bp, P. troglodytes
gctcactacagccttg

SEQ ID NO: 249538 - DNA, 16 bp, P. troglodytes
gctcactataagctcc

SEQ ID NO: 249539 - DNA, 16 bp, P. troglodytes
gctcactccaacctcc

SEQ ID NO: 249540 - DNA, 16 bp, P. troglodytes
gctcactgaaagctcc

SEQ ID NO: 249541 - DNA, 16 bp, P. troglodytes
gctcactgcaacccct

SEQ ID NO: 249542 - DNA, 16 bp, P. troglodytes
gctcactgcaaccttc

SEQ ID NO: 249543 - DNA, 16 bp, P. troglodytes
gctcactgcaagctcc

SEQ ID NO: 249544 - DNA, 16 bp, P. troglodytes
gctcactgcaccctca

SEQ ID NO: 249545 - DNA, 16 bp, P. troglodytes
gctcactgcagcctca

SEQ ID NO: 249546 - DNA, 16 bp, P. troglodytes
gctcactgcagcctgt

SEQ ID NO: 249547 - DNA, 16 bp, P. troglodytes
gctcactgcagctctg

SEQ ID NO: 249548 - DNA, 16 bp, P. troglodytes
gctcactgcagttttg

SEQ ID NO: 249549 - DNA, 16 bp, P. troglodytes
gctcactgcatccttg

SEQ ID NO: 249550 - DNA, 16 bp, P. troglodytes
gctcactgccacctcc

SEQ ID NO: 249551 - DNA, 16 bp, P. troglodytes
gctcactgctgcctca

SEQ ID NO: 249552 - DNA, 16 bp, P. troglodytes
gctcactggcttcccc

SEQ ID NO: 249553 - DNA, 16 bp, P. troglodytes
gctcactgtagcctca

SEQ ID NO: 249554 - DNA, 16 bp, P. troglodytes
gctcactgtagcctcc

SEQ ID NO: 249555 - DNA, 16 bp, P. troglodytes
gctcacttcaacctct

SEQ ID NO: 249556 - DNA, 16 bp, P. troglodytes
gctcagaaaagttaaa

SEQ ID NO: 249557 - DNA, 16 bp, P. troglodytes
gctcagaagaaaagat

SEQ ID NO: 249558 - DNA, 16 bp, P. troglodytes
gctcagaagaagaaag

SEQ ID NO: 249559 - DNA, 16 bp, P. troglodytes
gctcagagaagtttgt

SEQ ID NO: 249560 - DNA, 16 bp, P. troglodytes
gctcagagagggcagg

SEQ ID NO: 249561 - DNA, 16 bp, P. troglodytes
gctcagagaggttaag

SEQ ID NO: 249562 - DNA, 16 bp, P. troglodytes
gctcagaggaatttgt

SEQ ID NO: 249563 - DNA, 16 bp, P. troglodytes
gctcagcaaggcctac

SEQ ID NO: 249564 - DNA, 16 bp, P. troglodytes
gctcagccacagcaag

SEQ ID NO: 249565 - DNA, 16 bp, P. troglodytes
gctcagcctcagcctc

SEQ ID NO: 249566 - DNA, 16 bp, P. troglodytes
gctcagccttctgagt

SEQ ID NO: 249567 - DNA, 16 bp, P. troglodytes
gctcagctcagcactc

SEQ ID NO: 249568 - DNA, 16 bp, P. troglodytes
gctcagctcagctcag

SEQ ID NO: 249569 - DNA, 16 bp, P. troglodytes
gctcagctctcaggaa

SEQ ID NO: 249570 - DNA, 16 bp, P. troglodytes
gctcaggaaagctgcc

SEQ ID NO: 249571 - DNA, 16 bp, P. troglodytes
gctcaggaatttgaaa

SEQ ID NO: 249572 - DNA, 16 bp, P. troglodytes
gctcaggacagctttg

SEQ ID NO: 249573 - DNA, 16 bp, P. troglodytes
gctcaggacctgcagc

SEQ ID NO: 249574 - DNA, 16 bp, P. troglodytes
gctcaggacttcaaga

SEQ ID NO: 249575 - DNA, 16 bp, P. troglodytes
gctcaggagctcaagg

SEQ ID NO: 249576 - DNA, 16 bp, P. troglodytes
gctcaggaggcagagg

SEQ ID NO: 249577 - DNA, 16 bp, P. troglodytes
gctcaggaggcctcag

SEQ ID NO: 249578 - DNA, 16 bp, P. troglodytes
gctcaggaggtggagg

SEQ ID NO: 249579 - DNA, 16 bp, P. troglodytes
gctcaggagttaaaga

SEQ ID NO: 249580 - DNA, 16 bp, P. troglodytes
gctcaggcagtccttc

SEQ ID NO: 249581 - DNA, 16 bp, P. troglodytes
gctcaggctgaagtgc

SEQ ID NO: 249582 - DNA, 17 bp, P. troglodytes
gctcaggctggagtaca

SEQ ID NO: 249583 - DNA, 16 bp, P. troglodytes
gctcaggctgtggctt

SEQ ID NO: 249584 - DNA, 16 bp, P. troglodytes
gctcagggaggctgag

SEQ ID NO: 249585 - DNA, 16 bp, P. troglodytes
gctcagggaggttgag

SEQ ID NO: 249586 - DNA, 17 bp, P. troglodytes
gctcagggattgtaaac

SEQ ID NO: 249587 - DNA, 16 bp, P. troglodytes
gctcaggtaatttttg

SEQ ID NO: 249588 - DNA, 16 bp, P. troglodytes
gctcaggtgatcatcc

SEQ ID NO: 249589 - DNA, 17 bp, P. troglodytes
gctcaggtgatccacct

SEQ ID NO: 249590 - DNA, 16 bp, P. troglodytes
gctcaggtgatcctcc

SEQ ID NO: 249591 - DNA, 16 bp, P. troglodytes
gctcaggtggctgagg

SEQ ID NO: 249592 - DNA, 16 bp, P. troglodytes
gctcaggtgggcatca

SEQ ID NO: 249593 - DNA, 16 bp, P. troglodytes
gctcagtaaatgctgg

SEQ ID NO: 249594 - DNA, 16 bp, P. troglodytes
gctcagtctcagctca

SEQ ID NO: 249595 - DNA, 16 bp, P. troglodytes
gctcagtgatcctccc

SEQ ID NO: 249596 - DNA, 16 bp, P. troglodytes
gctcagtgcgctgcac

SEQ ID NO: 249597 - DNA, 16 bp, P. troglodytes
gctcagtgggcaggag

SEQ ID NO: 249598 - DNA, 16 bp, P. troglodytes
gctcagtgtggtggca

SEQ ID NO: 249599 - DNA, 16 bp, P. troglodytes
gctcagttttctcatc

SEQ ID NO: 249600 - DNA, 16 bp, P. troglodytes
gctcataaaagcagtg

SEQ ID NO: 249601 - DNA, 16 bp, P. troglodytes
gctcatcatcactgat

SEQ ID NO: 249602 - DNA, 16 bp, P. troglodytes
gctcatgcctgtgatc

SEQ ID NO: 249603 - DNA, 16 bp, P. troglodytes
gctcatgctggagtgc

SEQ ID NO: 249604 - DNA, 16 bp, P. troglodytes
gctcatggcaacctct

SEQ ID NO: 249605 - DNA, 16 bp, P. troglodytes
gctcatggttctgtgg

SEQ ID NO: 249606 - DNA, 16 bp, P. troglodytes
gctcatgtgattgtgg

SEQ ID NO: 249607 - DNA, 16 bp, P. troglodytes
gctcattgcaacctct

SEQ ID NO: 249608 - DNA, 16 bp, P. troglodytes
gctcattttgtatttt

SEQ ID NO: 249609 - DNA, 16 bp, P. troglodytes
gctccaaaatgatttc

SEQ ID NO: 249610 - DNA, 16 bp, P. troglodytes
gctccaaccatgttcc

SEQ ID NO: 249611 - DNA, 16 bp, P. troglodytes
gctccacagcgcccag

SEQ ID NO: 249612 - DNA, 16 bp, P. troglodytes
gctccacctcagatca

SEQ ID NO: 249613 - DNA, 16 bp, P. troglodytes
gctccacctctgggag

SEQ ID NO: 249614 - DNA, 16 bp, P. troglodytes
gctccagaactgtgag

SEQ ID NO: 249615 - DNA, 16 bp, P. troglodytes
gctccagaatttctgc

SEQ ID NO: 249616 - DNA, 16 bp, P. troglodytes
gctccagagatcctcc

SEQ ID NO: 249617 - DNA, 16 bp, P. troglodytes
gctccagagctccctg

SEQ ID NO: 249618 - DNA, 16 bp, P. troglodytes
gctccagccagtccct

SEQ ID NO: 249619 - DNA, 16 bp, P. troglodytes
gctccagcctgagtga

SEQ ID NO: 249620 - DNA, 16 bp, P. troglodytes
gctccagccttggcca

SEQ ID NO: 249621 - DNA, 16 bp, P. troglodytes
gctccagctccagctc

SEQ ID NO: 249622 - DNA, 16 bp, P. troglodytes
gctccagctccagctg

SEQ ID NO: 249623 - DNA, 16 bp, P. troglodytes
gctccagctgtgacta

SEQ ID NO: 249624 - DNA, 16 bp, P. troglodytes
gctccagctgtggcta

SEQ ID NO: 249625 - DNA, 16 bp, P. troglodytes
gctccaggatttctgt

SEQ ID NO: 249626 - DNA, 16 bp, P. troglodytes
gctccaggcaccagca

SEQ ID NO: 249627 - DNA, 16 bp, P. troglodytes
gctccagggaagaatc

SEQ ID NO: 249628 - DNA, 16 bp, P. troglodytes
gctccagttttctcat

SEQ ID NO: 249629 - DNA, 16 bp, P. troglodytes
gctccatatatatata

SEQ ID NO: 249630 - DNA, 16 bp, P. troglodytes
gctccatctcccaggc

SEQ ID NO: 249631 - DNA, 16 bp, P. troglodytes
gctccatgagggcaag

SEQ ID NO: 249632 - DNA, 16 bp, P. troglodytes
gctccatggagtgtgc

SEQ ID NO: 249633 - DNA, 16 bp, P. troglodytes
gctccatgggcatggg

SEQ ID NO: 249634 - DNA, 16 bp, P. troglodytes
gctccattgcccaggc

SEQ ID NO: 249635 - DNA, 16 bp, P. troglodytes
gctccatttgaagaac

SEQ ID NO: 249636 - DNA, 21 bp, P. troglodytes
gctcccaaagtgctgtgatta

SEQ ID NO: 249637 - DNA, 16 bp, P. troglodytes
gctcccactggccaaa

SEQ ID NO: 249638 - DNA, 16 bp, P. troglodytes
gctcccacttataaga

SEQ ID NO: 249639 - DNA, 18 bp, P. troglodytes
gctcccactttggcggca

SEQ ID NO: 249640 - DNA, 16 bp, P. troglodytes
gctcccagagcttggg

SEQ ID NO: 249641 - DNA, 16 bp, P. troglodytes
gctcccagaggaaggg

SEQ ID NO: 249642 - DNA, 16 bp, P. troglodytes
gctcccagaggtggag

SEQ ID NO: 249643 - DNA, 16 bp, P. troglodytes
gctcccagctcccagc

SEQ ID NO: 249644 - DNA, 16 bp, P. troglodytes
gctcccaggttcaagc

SEQ ID NO: 249645 - DNA, 16 bp, P. troglodytes
gctccccttcctgctg

SEQ ID NO: 249646 - DNA, 16 bp, P. troglodytes
gctccctcacccaggc

SEQ ID NO: 249647 - DNA, 16 bp, P. troglodytes
gctccctccagaggct

SEQ ID NO: 249648 - DNA, 16 bp, P. troglodytes
gctccctcccacaagg

SEQ ID NO: 249649 - DNA, 16 bp, P. troglodytes
gctccctcctgcaagg

SEQ ID NO: 249650 - DNA, 16 bp, P. troglodytes
gctccctctggaggct

SEQ ID NO: 249651 - DNA, 16 bp, P. troglodytes
gctccctgaggacagg

SEQ ID NO: 249652 - DNA, 16 bp, P. troglodytes
gctccctgagggcagg

SEQ ID NO: 249653 - DNA, 16 bp, P. troglodytes
gctccctgcaacctcc

SEQ ID NO: 249654 - DNA, 16 bp, P. troglodytes
gctccctgcaagctcc

SEQ ID NO: 249655 - DNA, 16 bp, P. troglodytes
gctccctgcagcctgg

SEQ ID NO: 249656 - DNA, 16 bp, P. troglodytes
gctccctggcttcagc

SEQ ID NO: 249657 - DNA, 16 bp, P. troglodytes
gctccctgggcagggg

SEQ ID NO: 249658 - DNA, 16 bp, P. troglodytes
gctccgcctcccagct

SEQ ID NO: 249659 - DNA, 16 bp, P. troglodytes
gctccgcctccccggt

SEQ ID NO: 249660 - DNA, 16 bp, P. troglodytes
gctccgcctcccggct

SEQ ID NO: 249661 - DNA, 16 bp, P. troglodytes
gctccggccttggcca

SEQ ID NO: 249662 - DNA, 16 bp, P. troglodytes
gctccgtggcccaggc

SEQ ID NO: 249663 - DNA, 16 bp, P. troglodytes
gctcctaggctacaaa

SEQ ID NO: 249664 - DNA, 16 bp, P. troglodytes
gctcctatgagaatct

SEQ ID NO: 249665 - DNA, 16 bp, P. troglodytes
gctcctcacttcccag

SEQ ID NO: 249666 - DNA, 16 bp, P. troglodytes
gctcctccacctcttg

SEQ ID NO: 249667 - DNA, 16 bp, P. troglodytes
gctcctccccgctgca

SEQ ID NO: 249668 - DNA, 16 bp, P. troglodytes
gctcctcctccctcag

SEQ ID NO: 249669 - DNA, 16 bp, P. troglodytes
gctcctcctttgcctt

SEQ ID NO: 249670 - DNA, 16 bp, P. troglodytes
gctcctgaaggaggca

SEQ ID NO: 249671 - DNA, 16 bp, P. troglodytes
gctcctgagtgactac

SEQ ID NO: 249672 - DNA, 16 bp, P. troglodytes
gctcctgcacctgctc

SEQ ID NO: 249673 - DNA, 16 bp, P. troglodytes
gctcctgcaggaccca

SEQ ID NO: 249674 - DNA, 19 bp, P. troglodytes
gctcctgcctcagcctccc

SEQ ID NO: 249675 - DNA, 16 bp, P. troglodytes
gctcctgcctcagctt

SEQ ID NO: 249676 - DNA, 16 bp, P. troglodytes
gctcctgctccctggc

SEQ ID NO: 249677 - DNA, 16 bp, P. troglodytes
gctcctgctcctgctg

SEQ ID NO: 249678 - DNA, 16 bp, P. troglodytes
gctcctgctgcagtta

SEQ ID NO: 249679 - DNA, 16 bp, P. troglodytes
gctcctggaaggcagg

SEQ ID NO: 249680 - DNA, 16 bp, P. troglodytes
gctcctggactcattg

SEQ ID NO: 249681 - DNA, 16 bp, P. troglodytes
gctcctggagggcagg

SEQ ID NO: 249682 - DNA, 16 bp, P. troglodytes
gctcctgggttcaagt

SEQ ID NO: 249683 - DNA, 16 bp, P. troglodytes
gctcctgtattggttg

SEQ ID NO: 249684 - DNA, 16 bp, P. troglodytes
gctccttgagggcagg

SEQ ID NO: 249685 - DNA, 16 bp, P. troglodytes
gctccttgcagagcag

SEQ ID NO: 249686 - DNA, 16 bp, P. troglodytes
gctcctttctagtttt

SEQ ID NO: 249687 - DNA, 16 bp, P. troglodytes
gctcgaacccgggagg

SEQ ID NO: 249688 - DNA, 16 bp, P. troglodytes
gctcgaactcaggagg

SEQ ID NO: 249689 - DNA, 16 bp, P. troglodytes
gctcgatttctcaccg

SEQ ID NO: 249690 - DNA, 16 bp, P. troglodytes
gctcgcgcacggtgcg

SEQ ID NO: 249691 - DNA, 16 bp, P. troglodytes
gctcgctcgctctctc

SEQ ID NO: 249692 - DNA, 16 bp, P. troglodytes
gctcgctctgggcgcc

SEQ ID NO: 249693 - DNA, 16 bp, P. troglodytes
gctcgctgcaacctcc

SEQ ID NO: 249694 - DNA, 16 bp, P. troglodytes
gctcgctgtagccttg

SEQ ID NO: 249695 - DNA, 16 bp, P. troglodytes
gctcgtgtgtgtgtgt

SEQ ID NO: 249696 - DNA, 16 bp, P. troglodytes
gctctacaaaaaataa

SEQ ID NO: 249697 - DNA, 16 bp, P. troglodytes
gctctaccattctggg

SEQ ID NO: 249698 - DNA, 18 bp, P. troglodytes
gctctacctcctgggttc

SEQ ID NO: 249699 - DNA, 16 bp, P. troglodytes
gctctatcacttacta

SEQ ID NO: 249700 - DNA, 16 bp, P. troglodytes
gctctatcgcccaggc

SEQ ID NO: 249701 - DNA, 16 bp, P. troglodytes
gctctcaaactcttgg

SEQ ID NO: 249702 - DNA, 16 bp, P. troglodytes
gctctcacccaggctg

SEQ ID NO: 249703 - DNA, 16 bp, P. troglodytes
gctctcagcaggaagg

SEQ ID NO: 249704 - DNA, 16 bp, P. troglodytes
gctctcaggagacctg

SEQ ID NO: 249705 - DNA, 16 bp, P. troglodytes
gctctcaggccttcag

SEQ ID NO: 249706 - DNA, 16 bp, P. troglodytes
gctctcataatcccca

SEQ ID NO: 249707 - DNA, 16 bp, P. troglodytes
gctctcattctcttct

SEQ ID NO: 249708 - DNA, 16 bp, P. troglodytes
gctctccagcctggca

SEQ ID NO: 249709 - DNA, 16 bp, P. troglodytes
gctctcctcggcctcc

SEQ ID NO: 249710 - DNA, 16 bp, P. troglodytes
gctctcctctgactgc

SEQ ID NO: 249711 - DNA, 16 bp, P. troglodytes
gctctcctggctctgc

SEQ ID NO: 249712 - DNA, 16 bp, P. troglodytes
gctctcgctctgttgc

SEQ ID NO: 249713 - DNA, 16 bp, P. troglodytes
gctctctgcagcctca

SEQ ID NO: 249714 - DNA, 16 bp, P. troglodytes
gctctctgcagcctcc

SEQ ID NO: 249715 - DNA, 16 bp, P. troglodytes
gctctctggcttcagc

SEQ ID NO: 249716 - DNA, 16 bp, P. troglodytes
gctctctgggacctct

SEQ ID NO: 249717 - DNA, 16 bp, P. troglodytes
gctctctgtttctctg

SEQ ID NO: 249718 - DNA, 16 bp, P. troglodytes
gctctgaagagaacag

SEQ ID NO: 249719 - DNA, 16 bp, P. troglodytes
gctctgaagagagaag

SEQ ID NO: 249720 - DNA, 16 bp, P. troglodytes
gctctgaagagagcag

SEQ ID NO: 249721 - DNA, 16 bp, P. troglodytes
gctctgagccactatt

SEQ ID NO: 249722 - DNA, 16 bp, P. troglodytes
gctctgaggatgcaaa

SEQ ID NO: 249723 - DNA, 16 bp, P. troglodytes
gctctgatttttgtta

SEQ ID NO: 249724 - DNA, 16 bp, P. troglodytes
gctctgcaacctccgc

SEQ ID NO: 249725 - DNA, 16 bp, P. troglodytes
gctctgcagaagctct

SEQ ID NO: 249726 - DNA, 16 bp, P. troglodytes
gctctgcagcctccac

SEQ ID NO: 249727 - DNA, 16 bp, P. troglodytes
gctctgccaccaggct

SEQ ID NO: 249728 - DNA, 16 bp, P. troglodytes
gctctgccacccaagc

SEQ ID NO: 249729 - DNA, 16 bp, P. troglodytes
gctctgccacccaggc

SEQ ID NO: 249730 - DNA, 16 bp, P. troglodytes
gctctgccacttccta

SEQ ID NO: 249731 - DNA, 16 bp, P. troglodytes
gctctgccacttgctg

SEQ ID NO: 249732 - DNA, 16 bp, P. troglodytes
gctctgccatctgcag

SEQ ID NO: 249733 - DNA, 16 bp, P. troglodytes
gctctgccatttacca

SEQ ID NO: 249734 - DNA, 16 bp, P. troglodytes
gctctgcccccagagg

SEQ ID NO: 249735 - DNA, 16 bp, P. troglodytes
gctctgcctcccaggc

SEQ ID NO: 249736 - DNA, 16 bp, P. troglodytes
gctctgcggcccaggc

SEQ ID NO: 249737 - DNA, 16 bp, P. troglodytes
gctctgctgcccaggc

SEQ ID NO: 249738 - DNA, 16 bp, P. troglodytes
gctctgcttcctcctg

SEQ ID NO: 249739 - DNA, 16 bp, P. troglodytes
gctctgcttttcagag

SEQ ID NO: 249740 - DNA, 16 bp, P. troglodytes
gctctggctagaattt

SEQ ID NO: 249741 - DNA, 16 bp, P. troglodytes
gctctggctggagtgc

SEQ ID NO: 249742 - DNA, 16 bp, P. troglodytes
gctctggctggcatct

SEQ ID NO: 249743 - DNA, 16 bp, P. troglodytes
gctctggtttttggaa

SEQ ID NO: 249744 - DNA, 16 bp, P. troglodytes
gctctgtaaaaacgca

SEQ ID NO: 249745 - DNA, 16 bp, P. troglodytes
gctctgtaaatatctg

SEQ ID NO: 249746 - DNA, 17 bp, P. troglodytes
gctctgtcactcaggct

SEQ ID NO: 249747 - DNA, 16 bp, P. troglodytes
gctctgtcatgcaggc

SEQ ID NO: 249748 - DNA, 16 bp, P. troglodytes
gctctgtccacagtcc

SEQ ID NO: 249749 - DNA, 16 bp, P. troglodytes
gctctgtccctgtggc

SEQ ID NO: 249750 - DNA, 17 bp, P. troglodytes
gctctgtcgccaaggct

SEQ ID NO: 249751 - DNA, 16 bp, P. troglodytes
gctctgtctcacccag

SEQ ID NO: 249752 - DNA, 17 bp, P. troglodytes
gctctgtctcccaggct

SEQ ID NO: 249753 - DNA, 17 bp, P. troglodytes
gctctgtctcctaggct

SEQ ID NO: 249754 - DNA, 16 bp, P. troglodytes
gctctgtgccccaggc

SEQ ID NO: 249755 - DNA, 16 bp, P. troglodytes
gctctgtggcccagcc

SEQ ID NO: 249756 - DNA, 16 bp, P. troglodytes
gctctgtggctcacac

SEQ ID NO: 249757 - DNA, 16 bp, P. troglodytes
gctctgtgggctgcac

SEQ ID NO: 249758 - DNA, 16 bp, P. troglodytes
gctctgtgtcccaggc

SEQ ID NO: 249759 - DNA, 16 bp, P. troglodytes
gctctgtgtttccacc

SEQ ID NO: 249760 - DNA, 16 bp, P. troglodytes
gctctgttctgcccgg

SEQ ID NO: 249761 - DNA, 16 bp, P. troglodytes
gctctgtttccccacc

SEQ ID NO: 249762 - DNA, 16 bp, P. troglodytes
gctctgttttggtacc

SEQ ID NO: 249763 - DNA, 16 bp, P. troglodytes
gctcttagaattcttt

SEQ ID NO: 249764 - DNA, 16 bp, P. troglodytes
gctcttagcagagagg

SEQ ID NO: 249765 - DNA, 16 bp, P. troglodytes
gctcttagttctattc

SEQ ID NO: 249766 - DNA, 16 bp, P. troglodytes
gctcttatcattttga

SEQ ID NO: 249767 - DNA, 16 bp, P. troglodytes
gctcttattattttga

SEQ ID NO: 249768 - DNA, 16 bp, P. troglodytes
gctcttcaggatatta

SEQ ID NO: 249769 - DNA, 16 bp, P. troglodytes
gctcttcagtcagctt

SEQ ID NO: 249770 - DNA, 16 bp, P. troglodytes
gctcttcctgctgctg

SEQ ID NO: 249771 - DNA, 16 bp, P. troglodytes
gctcttggacttccca

SEQ ID NO: 249772 - DNA, 16 bp, P. troglodytes
gctcttggtgttttag

SEQ ID NO: 249773 - DNA, 16 bp, P. troglodytes
gctcttgtcactcagg

SEQ ID NO: 249774 - DNA, 16 bp, P. troglodytes
gctcttgttgcccaag

SEQ ID NO: 249775 - DNA, 16 bp, P. troglodytes
gctctttaaaaaaaaa

SEQ ID NO: 249776 - DNA, 16 bp, P. troglodytes
gctctttattctgttc

SEQ ID NO: 249777 - DNA, 16 bp, P. troglodytes
gctctttgaaggcagg

SEQ ID NO: 249778 - DNA, 16 bp, P. troglodytes
gctcttttcagagcca

SEQ ID NO: 249779 - DNA, 16 bp, P. troglodytes
gctcttttgtccaggc

SEQ ID NO: 249780 - DNA, 16 bp, P. troglodytes
gctgaaaaagaaatca

SEQ ID NO: 249781 - DNA, 16 bp, P. troglodytes
gctgaaaactccccaa

SEQ ID NO: 249782 - DNA, 16 bp, P. troglodytes
gctgaaaactctaaaa

SEQ ID NO: 249783 - DNA, 16 bp, P. troglodytes
gctgaaaagtattcca

SEQ ID NO: 249784 - DNA, 16 bp, P. troglodytes
gctgaaaatgatggct

SEQ ID NO: 249785 - DNA, 16 bp, P. troglodytes
gctgaaaattcccaaa

SEQ ID NO: 249786 - DNA, 16 bp, P. troglodytes
gctgaaaatttcccaa

SEQ ID NO: 249787 - DNA, 16 bp, P. troglodytes
gctgaaacatgcccct

SEQ ID NO: 249788 - DNA, 16 bp, P. troglodytes
gctgaaagaaaaaaca

SEQ ID NO: 249789 - DNA, 16 bp, P. troglodytes
gctgaaagaaattaag

SEQ ID NO: 249790 - DNA, 16 bp, P. troglodytes
gctgaaagaaattaca

SEQ ID NO: 249791 - DNA, 16 bp, P. troglodytes
gctgaaagacaaaata

SEQ ID NO: 249792 - DNA, 16 bp, P. troglodytes
gctgaaagatctgctg

SEQ ID NO: 249793 - DNA, 16 bp, P. troglodytes
gctgaaatggcaccac

SEQ ID NO: 249794 - DNA, 16 bp, P. troglodytes
gctgaacatgtggagg

SEQ ID NO: 249795 - DNA, 16 bp, P. troglodytes
gctgaacgtggtggtg

SEQ ID NO: 249796 - DNA, 16 bp, P. troglodytes
gctgaagaacttggaa

SEQ ID NO: 249797 - DNA, 16 bp, P. troglodytes
gctgaagacaaaggac

SEQ ID NO: 249798 - DNA, 16 bp, P. troglodytes
gctgaagcaagaggat

SEQ ID NO: 249799 - DNA, 16 bp, P. troglodytes
gctgaagcagctggaa

SEQ ID NO: 249800 - DNA, 16 bp, P. troglodytes
gctgaagcaggagaac

SEQ ID NO: 249801 - DNA, 16 bp, P. troglodytes
gctgaagcaggaggtt

SEQ ID NO: 249802 - DNA, 16 bp, P. troglodytes
gctgaagcaggagtat

SEQ ID NO: 249803 - DNA, 16 bp, P. troglodytes
gctgaagcaggatgat

SEQ ID NO: 249804 - DNA, 16 bp, P. troglodytes
gctgaagcagggcaag

SEQ ID NO: 249805 - DNA, 17 bp, P. troglodytes
gctgaagcagggcgagg

SEQ ID NO: 249806 - DNA, 16 bp, P. troglodytes
gctgaagcatgagaat

SEQ ID NO: 249807 - DNA, 16 bp, P. troglodytes
gctgaagccagagagc

SEQ ID NO: 249808 - DNA, 16 bp, P. troglodytes
gctgaagctatcctcc

SEQ ID NO: 249809 - DNA, 16 bp, P. troglodytes
gctgaaggctcagatg

SEQ ID NO: 249810 - DNA, 16 bp, P. troglodytes
gctgaaggctgcagtg

SEQ ID NO: 249811 - DNA, 16 bp, P. troglodytes
gctgaagtaggaggat

SEQ ID NO: 249812 - DNA, 16 bp, P. troglodytes
gctgaagtatgagaat

SEQ ID NO: 249813 - DNA, 16 bp, P. troglodytes
gctgaagtgggcagat

SEQ ID NO: 249814 - DNA, 16 bp, P. troglodytes
gctgaagtgggtggat

SEQ ID NO: 249815 - DNA, 16 bp, P. troglodytes
gctgaatctttttttt

SEQ ID NO: 249816 - DNA, 16 bp, P. troglodytes
gctgaatgtaaagaaa

SEQ ID NO: 249817 - DNA, 16 bp, P. troglodytes
gctgaattccagtgtt

SEQ ID NO: 249818 - DNA, 16 bp, P. troglodytes
gctgaattcctgcctg

SEQ ID NO: 249819 - DNA, 16 bp, P. troglodytes
gctgacacaccagccc

SEQ ID NO: 249820 - DNA, 16 bp, P. troglodytes
gctgacaggcaacttc

SEQ ID NO: 249821 - DNA, 16 bp, P. troglodytes
gctgacatgggaggat

SEQ ID NO: 249822 - DNA, 16 bp, P. troglodytes
gctgaccctggaggga

SEQ ID NO: 249823 - DNA, 16 bp, P. troglodytes
gctgacctcaggtgat

SEQ ID NO: 249824 - DNA, 16 bp, P. troglodytes
gctgactgcaacctct

SEQ ID NO: 249825 - DNA, 16 bp, P. troglodytes
gctgagaaaaatcctg

SEQ ID NO: 249826 - DNA, 16 bp, P. troglodytes
gctgagaaaactggat

SEQ ID NO: 249827 - DNA, 16 bp, P. troglodytes
gctgagaaaattaaat

SEQ ID NO: 249828 - DNA, 16 bp, P. troglodytes
gctgagaaaccaaaga

SEQ ID NO: 249829 - DNA, 16 bp, P. troglodytes
gctgagaacaaaatca

SEQ ID NO: 249830 - DNA, 16 bp, P. troglodytes
gctgagaagcccaaga

SEQ ID NO: 249831 - DNA, 16 bp, P. troglodytes
gctgagacacaagaat

SEQ ID NO: 249832 - DNA, 16 bp, P. troglodytes
gctgagacacagggca

SEQ ID NO: 249833 - DNA, 16 bp, P. troglodytes
gctgagacacgagaat

SEQ ID NO: 249834 - DNA, 16 bp, P. troglodytes
gctgagacaggataat

SEQ ID NO: 249835 - DNA, 16 bp, P. troglodytes
gctgagacagggggat

SEQ ID NO: 249836 - DNA, 16 bp, P. troglodytes
gctgagacaggtagat

SEQ ID NO: 249837 - DNA, 16 bp, P. troglodytes
gctgagatagaagaat

SEQ ID NO: 249838 - DNA, 16 bp, P. troglodytes
gctgagatcccgccac

SEQ ID NO: 249839 - DNA, 16 bp, P. troglodytes
gctgagatggaagaat

SEQ ID NO: 249840 - DNA, 16 bp, P. troglodytes
gctgagatggcaggat

SEQ ID NO: 249841 - DNA, 18 bp, P. troglodytes
gctgagatgggagaatcg

SEQ ID NO: 249842 - DNA, 16 bp, P. troglodytes
gctgagatgggaggat

SEQ ID NO: 249843 - DNA, 16 bp, P. troglodytes
gctgagatggtgctac

SEQ ID NO: 249844 - DNA, 16 bp, P. troglodytes
gctgagattaaaggtg

SEQ ID NO: 249845 - DNA, 16 bp, P. troglodytes
gctgagattacagctg

SEQ ID NO: 249846 - DNA, 16 bp, P. troglodytes
gctgagattacaggca

SEQ ID NO: 249847 - DNA, 16 bp, P. troglodytes
gctgagattacgggtg

SEQ ID NO: 249848 - DNA, 16 bp, P. troglodytes
gctgagattatagatg

SEQ ID NO: 249849 - DNA, 16 bp, P. troglodytes
gctgagattgctgaaa

SEQ ID NO: 249850 - DNA, 16 bp, P. troglodytes
gctgagcaaaggggga

SEQ ID NO: 249851 - DNA, 16 bp, P. troglodytes
gctgagccacctggaa

SEQ ID NO: 249852 - DNA, 16 bp, P. troglodytes
gctgagcccaggcact

SEQ ID NO: 249853 - DNA, 16 bp, P. troglodytes
gctgagctcccagcca

SEQ ID NO: 249854 - DNA, 16 bp, P. troglodytes
gctgagctgggctgag

SEQ ID NO: 249855 - DNA, 16 bp, P. troglodytes
gctgaggaagaggaag

SEQ ID NO: 249856 - DNA, 16 bp, P. troglodytes
gctgaggaaggagaat

SEQ ID NO: 249857 - DNA, 16 bp, P. troglodytes
gctgaggaatttcatc

SEQ ID NO: 249858 - DNA, 16 bp, P. troglodytes
gctgaggacacagcag

SEQ ID NO: 249859 - DNA, 16 bp, P. troglodytes
gctgaggagaaaggag

SEQ ID NO: 249860 - DNA, 16 bp, P. troglodytes
gctgaggagaaggagg

SEQ ID NO: 249861 - DNA, 16 bp, P. troglodytes
gctgaggagcaagaaa

SEQ ID NO: 249862 - DNA, 16 bp, P. troglodytes
gctgaggaggagaatg

SEQ ID NO: 249863 - DNA, 16 bp, P. troglodytes
gctgaggaggaggaag

SEQ ID NO: 249864 - DNA, 17 bp, P. troglodytes
gctgaggatgatggttt

SEQ ID NO: 249865 - DNA, 16 bp, P. troglodytes
gctgaggcaagtggat

SEQ ID NO: 249866 - DNA, 16 bp, P. troglodytes
gctgaggcacaagaat

SEQ ID NO: 249867 - DNA, 16 bp, P. troglodytes
gctgaggcacgagaag

SEQ ID NO: 249868 - DNA, 16 bp, P. troglodytes
gctgaggcacgagaat

SEQ ID NO: 249869 - DNA, 16 bp, P. troglodytes
gctgaggcagaaggag

SEQ ID NO: 249870 - DNA, 17 bp, P. troglodytes
gctgaggcagaaggatc

SEQ ID NO: 249871 - DNA, 16 bp, P. troglodytes
gctgaggcagcagaac

SEQ ID NO: 249872 - DNA, 16 bp, P. troglodytes
gctgaggcaggaagaa

SEQ ID NO: 249873 - DNA, 16 bp, P. troglodytes
gctgaggcaggaagat

SEQ ID NO: 249874 - DNA, 16 bp, P. troglodytes
gctgaggcaggaagct

SEQ ID NO: 249875 - DNA, 16 bp, P. troglodytes
gctgaggcaggacgat

SEQ ID NO: 249876 - DNA, 16 bp, P. troglodytes
gctgaggcaggaggac

SEQ ID NO: 249877 - DNA, 16 bp, P. troglodytes
gctgaggcaggaggat

SEQ ID NO: 249878 - DNA, 16 bp, P. troglodytes
gctgaggcaggcaaat

SEQ ID NO: 249879 - DNA, 16 bp, P. troglodytes
gctgaggcagggggat

SEQ ID NO: 249880 - DNA, 17 bp, P. troglodytes
gctgaggcagtagaatg

SEQ ID NO: 249881 - DNA, 16 bp, P. troglodytes
gctgaggcatgaaaat

SEQ ID NO: 249882 - DNA, 16 bp, P. troglodytes
gctgaggcatgagaat

SEQ ID NO: 249883 - DNA, 16 bp, P. troglodytes
gctgaggcatgggaat

SEQ ID NO: 249884 - DNA, 16 bp, P. troglodytes
gctgaggccaggagtt

SEQ ID NO: 249885 - DNA, 16 bp, P. troglodytes
gctgaggccagtggat

SEQ ID NO: 249886 - DNA, 16 bp, P. troglodytes
gctgaggcctcaggaa

SEQ ID NO: 249887 - DNA, 16 bp, P. troglodytes
gctgaggcgagagaat

SEQ ID NO: 249888 - DNA, 16 bp, P. troglodytes
gctgaggcggaaggat

SEQ ID NO: 249889 - DNA, 16 bp, P. troglodytes
gctgaggcggatggat

SEQ ID NO: 249890 - DNA, 16 bp, P. troglodytes
gctgaggcgggagaat

SEQ ID NO: 249891 - DNA, 18 bp, P. troglodytes
gctgaggcgggcagatcg

SEQ ID NO: 249892 - DNA, 16 bp, P. troglodytes
gctgaggctagtggat

SEQ ID NO: 249893 - DNA, 16 bp, P. troglodytes
gctgaggctcagggag

SEQ ID NO: 249894 - DNA, 16 bp, P. troglodytes
gctgaggctgaggtgg

SEQ ID NO: 249895 - DNA, 16 bp, P. troglodytes
gctgaggctggagaat

SEQ ID NO: 249896 - DNA, 16 bp, P. troglodytes
gctgaggctggaggac

SEQ ID NO: 249897 - DNA, 16 bp, P. troglodytes
gctgaggcttagagag

SEQ ID NO: 249898 - DNA, 18 bp, P. troglodytes
gctgagggagccggctcc

SEQ ID NO: 249899 - DNA, 16 bp, P. troglodytes
gctgagggaggagaat

SEQ ID NO: 249900 - DNA, 16 bp, P. troglodytes
gctgagggaggggcgc

SEQ ID NO: 249901 - DNA, 16 bp, P. troglodytes
gctgaggtagacagat

SEQ ID NO: 249902 - DNA, 16 bp, P. troglodytes
gctgaggtcacaccac

SEQ ID NO: 249903 - DNA, 16 bp, P. troglodytes
gctgaggtcaggagtt

SEQ ID NO: 249904 - DNA, 16 bp, P. troglodytes
gctgaggtgagaagac

SEQ ID NO: 249905 - DNA, 16 bp, P. troglodytes
gctgaggtgcagtggt

SEQ ID NO: 249906 - DNA, 16 bp, P. troglodytes
gctgaggtggacagat

SEQ ID NO: 249907 - DNA, 16 bp, P. troglodytes
gctgaggtggcaggat

SEQ ID NO: 249908 - DNA, 16 bp, P. troglodytes
gctgaggtgggagaac

SEQ ID NO: 249909 - DNA, 16 bp, P. troglodytes
gctgaggtgggagaat

SEQ ID NO: 249910 - DNA, 16 bp, P. troglodytes
gctgaggtgggaggac

SEQ ID NO: 249911 - DNA, 16 bp, P. troglodytes
gctgaggtgggaggag

SEQ ID NO: 249912 - DNA, 16 bp, P. troglodytes
gctgaggtgggaggat

SEQ ID NO: 249913 - DNA, 16 bp, P. troglodytes
gctgaggttgagaaat

SEQ ID NO: 249914 - DNA, 16 bp, P. troglodytes
gctgaggttgcagtga

SEQ ID NO: 249915 - DNA, 16 bp, P. troglodytes
gctgaggttggaggat

SEQ ID NO: 249916 - DNA, 16 bp, P. troglodytes
gctgaggttttatttt

SEQ ID NO: 249917 - DNA, 16 bp, P. troglodytes
gctgagtagtattgca

SEQ ID NO: 249918 - DNA, 16 bp, P. troglodytes
gctgagtcacaagaat

SEQ ID NO: 249919 - DNA, 16 bp, P. troglodytes
gctgagtcaggaagat

SEQ ID NO: 249920 - DNA, 16 bp, P. troglodytes
gctgagtgaaggaagc

SEQ ID NO: 249921 - DNA, 16 bp, P. troglodytes
gctgagtgaccctggg

SEQ ID NO: 249922 - DNA, 16 bp, P. troglodytes
gctgagtgaggagaat

SEQ ID NO: 249923 - DNA, 16 bp, P. troglodytes
gctgagtgggcagaat

SEQ ID NO: 249924 - DNA, 16 bp, P. troglodytes
gctgatattacaggca

SEQ ID NO: 249925 - DNA, 16 bp, P. troglodytes
gctgatatttattgga

SEQ ID NO: 249926 - DNA, 16 bp, P. troglodytes
gctgatctccagctcc

SEQ ID NO: 249927 - DNA, 16 bp, P. troglodytes
gctgatctgaaactcc

SEQ ID NO: 249928 - DNA, 16 bp, P. troglodytes
gctgatctgcctgcct

SEQ ID NO: 249929 - DNA, 16 bp, P. troglodytes
gctgatgaaaagaatg

SEQ ID NO: 249930 - DNA, 16 bp, P. troglodytes
gctgatgcatgagaat

SEQ ID NO: 249931 - DNA, 16 bp, P. troglodytes
gctgatgctgctggtt

SEQ ID NO: 249932 - DNA, 16 bp, P. troglodytes
gctgatgggagtataa

SEQ ID NO: 249933 - DNA, 16 bp, P. troglodytes
gctgatggtggtggtg

SEQ ID NO: 249934 - DNA, 16 bp, P. troglodytes
gctgatggttttaaag

SEQ ID NO: 249935 - DNA, 16 bp, P. troglodytes
gctgatgtgggcagat

SEQ ID NO: 249936 - DNA, 16 bp, P. troglodytes
gctgatgtgggtggat

SEQ ID NO: 249937 - DNA, 16 bp, P. troglodytes
gctgattgcttgagcc

SEQ ID NO: 249938 - DNA, 16 bp, P. troglodytes
gctgattggtgcgttt

SEQ ID NO: 249939 - DNA, 16 bp, P. troglodytes
gctgattttctgtatt

SEQ ID NO: 249940 - DNA, 16 bp, P. troglodytes
gctgcaaaaaaataaa

SEQ ID NO: 249941 - DNA, 16 bp, P. troglodytes
gctgcaaaagaaaagg

SEQ ID NO: 249942 - DNA, 16 bp, P. troglodytes
gctgcaaaagaaaagt

SEQ ID NO: 249943 - DNA, 16 bp, P. troglodytes
gctgcaaaggccctga

SEQ ID NO: 249944 - DNA, 16 bp, P. troglodytes
gctgcaagtaacagaa

SEQ ID NO: 249945 - DNA, 16 bp, P. troglodytes
gctgcaagtgacagaa

SEQ ID NO: 249946 - DNA, 16 bp, P. troglodytes
gctgcaataacaaaca

SEQ ID NO: 249947 - DNA, 16 bp, P. troglodytes
gctgcaatcttggctc

SEQ ID NO: 249948 - DNA, 16 bp, P. troglodytes
gctgcaatgaatattc

SEQ ID NO: 249949 - DNA, 16 bp, P. troglodytes
gctgcaattacaggca

SEQ ID NO: 249950 - DNA, 16 bp, P. troglodytes
gctgcacaccagcctg

SEQ ID NO: 249951 - DNA, 16 bp, P. troglodytes
gctgcacagagcaggg

SEQ ID NO: 249952 - DNA, 16 bp, P. troglodytes
gctgcaccattttaca

SEQ ID NO: 249953 - DNA, 16 bp, P. troglodytes
gctgcacccactgtcc

SEQ ID NO: 249954 - DNA, 16 bp, P. troglodytes
gctgcacccatcagcc

SEQ ID NO: 249955 - DNA, 16 bp, P. troglodytes
gctgcacctgctgttc

SEQ ID NO: 249956 - DNA, 16 bp, P. troglodytes
gctgcagaaaggagct

SEQ ID NO: 249957 - DNA, 16 bp, P. troglodytes
gctgcagaaatttgca

SEQ ID NO: 249958 - DNA, 16 bp, P. troglodytes
gctgcagacaggagct

SEQ ID NO: 249959 - DNA, 16 bp, P. troglodytes
gctgcagacccaggcc

SEQ ID NO: 249960 - DNA, 16 bp, P. troglodytes
gctgcagaccttcctg

SEQ ID NO: 249961 - DNA, 16 bp, P. troglodytes
gctgcagactggagct

SEQ ID NO: 249962 - DNA, 16 bp, P. troglodytes
gctgcagaggctggaa

SEQ ID NO: 249963 - DNA, 18 bp, P. troglodytes
gctgcagagggtgtactg

SEQ ID NO: 249964 - DNA, 16 bp, P. troglodytes
gctgcagcaagaccca

SEQ ID NO: 249965 - DNA, 16 bp, P. troglodytes
gctgcagcagcagcag

SEQ ID NO: 249966 - DNA, 16 bp, P. troglodytes
gctgcagcagctccag

SEQ ID NO: 249967 - DNA, 16 bp, P. troglodytes
gctgcagcaggaggat

SEQ ID NO: 249968 - DNA, 16 bp, P. troglodytes
gctgcagccaaggaga

SEQ ID NO: 249969 - DNA, 16 bp, P. troglodytes
gctgcagccacccagc

SEQ ID NO: 249970 - DNA, 16 bp, P. troglodytes
gctgcagcctcccgag

SEQ ID NO: 249971 - DNA, 16 bp, P. troglodytes
gctgcagcctggcagg

SEQ ID NO: 249972 - DNA, 16 bp, P. troglodytes
gctgcagctaaagcca

SEQ ID NO: 249973 - DNA, 16 bp, P. troglodytes
gctgcagctgcaccca

SEQ ID NO: 249974 - DNA, 16 bp, P. troglodytes
gctgcagctggagaca

SEQ ID NO: 249975 - DNA, 16 bp, P. troglodytes
gctgcaggaaggagct

SEQ ID NO: 249976 - DNA, 16 bp, P. troglodytes
gctgcaggagcagggc

SEQ ID NO: 249977 - DNA, 16 bp, P. troglodytes
gctgcaggaggccagg

SEQ ID NO: 249978 - DNA, 16 bp, P. troglodytes
gctgcaggcagagctg

SEQ ID NO: 249979 - DNA, 16 bp, P. troglodytes
gctgcaggcttcatct

SEQ ID NO: 249980 - DNA, 16 bp, P. troglodytes
gctgcagggcagtggc

SEQ ID NO: 249981 - DNA, 16 bp, P. troglodytes
gctgcaggggcggggc

SEQ ID NO: 249982 - DNA, 16 bp, P. troglodytes
gctgcagggtcagggc

SEQ ID NO: 249983 - DNA, 16 bp, P. troglodytes
gctgcaggtcccaagc

SEQ ID NO: 249984 - DNA, 16 bp, P. troglodytes
gctgcaggtcttttgg

SEQ ID NO: 249985 - DNA, 16 bp, P. troglodytes
gctgcaggtgcagggc

SEQ ID NO: 249986 - DNA, 16 bp, P. troglodytes
gctgcaggtggagctg

SEQ ID NO: 249987 - DNA, 16 bp, P. troglodytes
gctgcagtacagtggt

SEQ ID NO: 249988 - DNA, 16 bp, P. troglodytes
gctgcagtccagcctg

SEQ ID NO: 249989 - DNA, 16 bp, P. troglodytes
gctgcagtgaacatgc

SEQ ID NO: 249990 - DNA, 16 bp, P. troglodytes
gctgcagtgagccctg

SEQ ID NO: 249991 - DNA, 16 bp, P. troglodytes
gctgcagtgagctgtg

SEQ ID NO: 249992 - DNA, 16 bp, P. troglodytes
gctgcagtgcagtggt

SEQ ID NO: 249993 - DNA, 16 bp, P. troglodytes
gctgcagtgggccgag

SEQ ID NO: 249994 - DNA, 17 bp, P. troglodytes
gctgcagtgggctccac

SEQ ID NO: 249995 - DNA, 16 bp, P. troglodytes
gctgcagtgtgccatg

SEQ ID NO: 249996 - DNA, 16 bp, P. troglodytes
gctgcatccatgtggc

SEQ ID NO: 249997 - DNA, 16 bp, P. troglodytes
gctgcatcccagaggt

SEQ ID NO: 249998 - DNA, 16 bp, P. troglodytes
gctgcatgcagtggct

SEQ ID NO: 249999 - DNA, 16 bp, P. troglodytes
gctgccaaggcttggg

SEQ ID NO: 250000 - DNA, 16 bp, P. troglodytes
gctgccactgcccagc

SEQ ID NO: 250001 - DNA, 16 bp, P. troglodytes
gctgccagaggaactg

SEQ ID NO: 250002 - DNA, 18 bp, P. troglodytes
gctgccaggcggaggggc

SEQ ID NO: 250003 - DNA, 16 bp, P. troglodytes
gctgccaggggctgga

SEQ ID NO: 250004 - DNA, 16 bp, P. troglodytes
gctgccagtgcagcca

SEQ ID NO: 250005 - DNA, 16 bp, P. troglodytes
gctgccataaaaaatg

SEQ ID NO: 250006 - DNA, 16 bp, P. troglodytes
gctgccataaacattt

SEQ ID NO: 250007 - DNA, 16 bp, P. troglodytes
gctgccatgtgaagac

SEQ ID NO: 250008 - DNA, 16 bp, P. troglodytes
gctgccatgtgaagag

SEQ ID NO: 250009 - DNA, 16 bp, P. troglodytes
gctgcccaaggctttg

SEQ ID NO: 250010 - DNA, 16 bp, P. troglodytes
gctgcccagcctggag

SEQ ID NO: 250011 - DNA, 16 bp, P. troglodytes
gctgcccagcctggtc

SEQ ID NO: 250012 - DNA, 16 bp, P. troglodytes
gctgcccagctgtggc

SEQ ID NO: 250013 - DNA, 16 bp, P. troglodytes
gctgcccaggctggcc

SEQ ID NO: 250014 - DNA, 16 bp, P. troglodytes
gctgccccagccagca

SEQ ID NO: 250015 - DNA, 16 bp, P. troglodytes
gctgcccccatgatcc

SEQ ID NO: 250016 - DNA, 16 bp, P. troglodytes
gctgcccggagacctg

SEQ ID NO: 250017 - DNA, 16 bp, P. troglodytes
gctgcccgggaggctg

SEQ ID NO: 250018 - DNA, 16 bp, P. troglodytes
gctgccgctgctgctg

SEQ ID NO: 250019 - DNA, 17 bp, P. troglodytes
gctgcctcccgggttca

SEQ ID NO: 250020 - DNA, 16 bp, P. troglodytes
gctgcctccctgcggg

SEQ ID NO: 250021 - DNA, 16 bp, P. troglodytes
gctgcctcctgtctct

SEQ ID NO: 250022 - DNA, 16 bp, P. troglodytes
gctgcctctgcctcct

SEQ ID NO: 250023 - DNA, 16 bp, P. troglodytes
gctgcctgcattcctt

SEQ ID NO: 250024 - DNA, 16 bp, P. troglodytes
gctgcctggaggagga

SEQ ID NO: 250025 - DNA, 16 bp, P. troglodytes
gctgcctgggaggctg

SEQ ID NO: 250026 - DNA, 16 bp, P. troglodytes
gctgcctggggctggg

SEQ ID NO: 250027 - DNA, 16 bp, P. troglodytes
gctgcctgggttcaaa

SEQ ID NO: 250028 - DNA, 16 bp, P. troglodytes
gctgcctgtgcttttg

SEQ ID NO: 250029 - DNA, 16 bp, P. troglodytes
gctgcctgtttcttcc

SEQ ID NO: 250030 - DNA, 16 bp, P. troglodytes
gctgcctgtttttata

SEQ ID NO: 250031 - DNA, 16 bp, P. troglodytes
gctgccttcccagtcc

SEQ ID NO: 250032 - DNA, 16 bp, P. troglodytes
gctgccttgaagacct

SEQ ID NO: 250033 - DNA, 16 bp, P. troglodytes
gctgccttttcatttt

SEQ ID NO: 250034 - DNA, 16 bp, P. troglodytes
gctgcgcaggagccca

SEQ ID NO: 250035 - DNA, 17 bp, P. troglodytes
gctgcgcgcggcgcttg

SEQ ID NO: 250036 - DNA, 16 bp, P. troglodytes
gctgcgctggcagctg

SEQ ID NO: 250037 - DNA, 18 bp, P. troglodytes
gctgcggagggtgtactg

SEQ ID NO: 250038 - DNA, 16 bp, P. troglodytes
gctgcggcaggcagat

SEQ ID NO: 250039 - DNA, 16 bp, P. troglodytes
gctgcggtgggcagat

SEQ ID NO: 250040 - DNA, 16 bp, P. troglodytes
gctgcgtgtgtgtgtg

SEQ ID NO: 250041 - DNA, 16 bp, P. troglodytes
gctgctaataaagata

SEQ ID NO: 250042 - DNA, 16 bp, P. troglodytes
gctgctaggaacattc

SEQ ID NO: 250043 - DNA, 16 bp, P. troglodytes
gctgctataaagaaat

SEQ ID NO: 250044 - DNA, 16 bp, P. troglodytes
gctgctataacaaaat

SEQ ID NO: 250045 - DNA, 16 bp, P. troglodytes
gctgctcaaagaaatc

SEQ ID NO: 250046 - DNA, 16 bp, P. troglodytes
gctgctcaagaggctg

SEQ ID NO: 250047 - DNA, 16 bp, P. troglodytes
gctgctcaaggccttg

SEQ ID NO: 250048 - DNA, 16 bp, P. troglodytes
gctgctcagagaggcc

SEQ ID NO: 250049 - DNA, 16 bp, P. troglodytes
gctgctcaggtggctg

SEQ ID NO: 250050 - DNA, 17 bp, P. troglodytes
gctgctccgagtgcggg

SEQ ID NO: 250051 - DNA, 16 bp, P. troglodytes
gctgctccggaggctg

SEQ ID NO: 250052 - DNA, 16 bp, P. troglodytes
gctgctcctgctgctg

SEQ ID NO: 250053 - DNA, 16 bp, P. troglodytes
gctgctcgggaagctg

SEQ ID NO: 250054 - DNA, 16 bp, P. troglodytes
gctgctcgggaggctg

SEQ ID NO: 250055 - DNA, 16 bp, P. troglodytes
gctgctctaacaaaat

SEQ ID NO: 250056 - DNA, 16 bp, P. troglodytes
gctgctctccagcctg

SEQ ID NO: 250057 - DNA, 16 bp, P. troglodytes
gctgctctcctctctc

SEQ ID NO: 250058 - DNA, 16 bp, P. troglodytes
gctgctgaggaggctg

SEQ ID NO: 250059 - DNA, 16 bp, P. troglodytes
gctgctgcaaaagaca

SEQ ID NO: 250060 - DNA, 16 bp, P. troglodytes
gctgctgcacctggcc

SEQ ID NO: 250061 - DNA, 16 bp, P. troglodytes
gctgctgcagctccag

SEQ ID NO: 250062 - DNA, 16 bp, P. troglodytes
gctgctgcattccagc

SEQ ID NO: 250063 - DNA, 16 bp, P. troglodytes
gctgctgccgctgctg

SEQ ID NO: 250064 - DNA, 16 bp, P. troglodytes
gctgctgcgcctggcc

SEQ ID NO: 250065 - DNA, 16 bp, P. troglodytes
gctgctgctactgcta

SEQ ID NO: 250066 - DNA, 16 bp, P. troglodytes
gctgctgctcctcctc

SEQ ID NO: 250067 - DNA, 16 bp, P. troglodytes
gctgctgctgcagctg

SEQ ID NO: 250068 - DNA, 16 bp, P. troglodytes
gctgctgctgctactg

SEQ ID NO: 250069 - DNA, 16 bp, P. troglodytes
gctgctgctgctcctg

SEQ ID NO: 250070 - DNA, 16 bp, P. troglodytes
gctgctgctgctgcaa

SEQ ID NO: 250071 - DNA, 16 bp, P. troglodytes
gctgctgctgctgcag

SEQ ID NO: 250072 - DNA, 16 bp, P. troglodytes
gctgctgctgctgcct

SEQ ID NO: 250073 - DNA, 16 bp, P. troglodytes
gctgctgctgctgctg

SEQ ID NO: 250074 - DNA, 16 bp, P. troglodytes
gctgctgctgctggca

SEQ ID NO: 250075 - DNA, 16 bp, P. troglodytes
gctgctgctgctggtc

SEQ ID NO: 250076 - DNA, 17 bp, P. troglodytes
gctgctgctgctggtgg

SEQ ID NO: 250077 - DNA, 16 bp, P. troglodytes
gctgctgctgctgttt

SEQ ID NO: 250078 - DNA, 16 bp, P. troglodytes
gctgctgctgcttctc

SEQ ID NO: 250079 - DNA, 16 bp, P. troglodytes
gctgctgctggcccag

SEQ ID NO: 250080 - DNA, 16 bp, P. troglodytes
gctgctgctggctctg

SEQ ID NO: 250081 - DNA, 16 bp, P. troglodytes
gctgctgctggctggg

SEQ ID NO: 250082 - DNA, 16 bp, P. troglodytes
gctgctgctggcttgg

SEQ ID NO: 250083 - DNA, 16 bp, P. troglodytes
gctgctgctggtctga

SEQ ID NO: 250084 - DNA, 16 bp, P. troglodytes
gctgctgctggtggtg

SEQ ID NO: 250085 - DNA, 16 bp, P. troglodytes
gctgctgctgttgttt

SEQ ID NO: 250086 - DNA, 16 bp, P. troglodytes
gctgctgcttctccag

SEQ ID NO: 250087 - DNA, 16 bp, P. troglodytes
gctgctgcttctgctg

SEQ ID NO: 250088 - DNA, 16 bp, P. troglodytes
gctgctgcttctttct

SEQ ID NO: 250089 - DNA, 16 bp, P. troglodytes
gctgctggagaggctg

SEQ ID NO: 250090 - DNA, 16 bp, P. troglodytes
gctgctggattcaatt

SEQ ID NO: 250091 - DNA, 16 bp, P. troglodytes
gctgctggggaggctg

SEQ ID NO: 250092 - DNA, 16 bp, P. troglodytes
gctgctgggggtgaca

SEQ ID NO: 250093 - DNA, 16 bp, P. troglodytes
gctgctggtacccagg

SEQ ID NO: 250094 - DNA, 16 bp, P. troglodytes
gctgctgtaataaaat

SEQ ID NO: 250095 - DNA, 16 bp, P. troglodytes
gctgctgtccaacctg

SEQ ID NO: 250096 - DNA, 16 bp, P. troglodytes
gctgctgtgagctgtg

SEQ ID NO: 250097 - DNA, 16 bp, P. troglodytes
gctgctgtgcccagct

SEQ ID NO: 250098 - DNA, 16 bp, P. troglodytes
gctgctgtggaggctg

SEQ ID NO: 250099 - DNA, 16 bp, P. troglodytes
gctgctgtggtatgct

SEQ ID NO: 250100 - DNA, 16 bp, P. troglodytes
gctgcttctcctcttc

SEQ ID NO: 250101 - DNA, 16 bp, P. troglodytes
gctgctttcatgggct

SEQ ID NO: 250102 - DNA, 16 bp, P. troglodytes
gctgctttgaagtctt

SEQ ID NO: 250103 - DNA, 16 bp, P. troglodytes
gctggaaaacacagca

SEQ ID NO: 250104 - DNA, 16 bp, P. troglodytes
gctggaaaggcaagga

SEQ ID NO: 250105 - DNA, 16 bp, P. troglodytes
gctggaacaggacctc

SEQ ID NO: 250106 - DNA, 16 bp, P. troglodytes
gctggaacgcagtggt

SEQ ID NO: 250107 - DNA, 16 bp, P. troglodytes
gctggaactacgggca

SEQ ID NO: 250108 - DNA, 16 bp, P. troglodytes
gctggaagaggcagga

SEQ ID NO: 250109 - DNA, 16 bp, P. troglodytes
gctggaagcattccac

SEQ ID NO: 250110 - DNA, 16 bp, P. troglodytes
gctggaagctgcagac

SEQ ID NO: 250111 - DNA, 16 bp, P. troglodytes
gctggaatgcaatggt

SEQ ID NO: 250112 - DNA, 16 bp, P. troglodytes
gctggaattacaggca

SEQ ID NO: 250113 - DNA, 16 bp, P. troglodytes
gctggaatttgaacct

SEQ ID NO: 250114 - DNA, 16 bp, P. troglodytes
gctggacagcagtggc

SEQ ID NO: 250115 - DNA, 16 bp, P. troglodytes
gctggacatggtggct

SEQ ID NO: 250116 - DNA, 16 bp, P. troglodytes
gctggacatggtggtt

SEQ ID NO: 250117 - DNA, 16 bp, P. troglodytes
gctggactacagtggt

SEQ ID NO: 250118 - DNA, 16 bp, P. troglodytes
gctggactccagcctg

SEQ ID NO: 250119 - DNA, 16 bp, P. troglodytes
gctggagaaagaggct

SEQ ID NO: 250120 - DNA, 16 bp, P. troglodytes
gctggagaaccaggaa

SEQ ID NO: 250121 - DNA, 16 bp, P. troglodytes
gctggagacccaggag

SEQ ID NO: 250122 - DNA, 16 bp, P. troglodytes
gctggagacccaggga

SEQ ID NO: 250123 - DNA, 16 bp, P. troglodytes
gctggagacttcaaca

SEQ ID NO: 250124 - DNA, 16 bp, P. troglodytes
gctggagagagagaga

SEQ ID NO: 250125 - DNA, 16 bp, P. troglodytes
gctggagagcagcggc

SEQ ID NO: 250126 - DNA, 16 bp, P. troglodytes
gctggagaggacatgg

SEQ ID NO: 250127 - DNA, 16 bp, P. troglodytes
gctggagaggagctgc

SEQ ID NO: 250128 - DNA, 16 bp, P. troglodytes
gctggagaggcctcag

SEQ ID NO: 250129 - DNA, 16 bp, P. troglodytes
gctggagatgtggctg

SEQ ID NO: 250130 - DNA, 16 bp, P. troglodytes
gctggagcaagaggaa

SEQ ID NO: 250131 - DNA, 16 bp, P. troglodytes
gctggagcaggagaaa

SEQ ID NO: 250132 - DNA, 16 bp, P. troglodytes
gctggagcaggagaat

SEQ ID NO: 250133 - DNA, 16 bp, P. troglodytes
gctggagcaggaggaa

SEQ ID NO: 250134 - DNA, 16 bp, P. troglodytes
gctggagccacagcag

SEQ ID NO: 250135 - DNA, 16 bp, P. troglodytes
gctggagctgcagcag

SEQ ID NO: 250136 - DNA, 16 bp, P. troglodytes
gctggagctgctggga

SEQ ID NO: 250137 - DNA, 16 bp, P. troglodytes
gctggagctggagcag

SEQ ID NO: 250138 - DNA, 16 bp, P. troglodytes
gctggagctggagctg

SEQ ID NO: 250139 - DNA, 16 bp, P. troglodytes
gctggagctggggctg

SEQ ID NO: 250140 - DNA, 16 bp, P. troglodytes
gctggaggacagtggt

SEQ ID NO: 250141 - DNA, 16 bp, P. troglodytes
gctggaggaggaggag

SEQ ID NO: 250142 - DNA, 16 bp, P. troglodytes
gctggaggaggcaagg

SEQ ID NO: 250143 - DNA, 16 bp, P. troglodytes
gctggaggaggcagga

SEQ ID NO: 250144 - DNA, 16 bp, P. troglodytes
gctggaggaggcagtg

SEQ ID NO: 250145 - DNA, 16 bp, P. troglodytes
gctggaggaggtggtg

SEQ ID NO: 250146 - DNA, 16 bp, P. troglodytes
gctggaggattgcttg

SEQ ID NO: 250147 - DNA, 16 bp, P. troglodytes
gctggaggctgcagtg

SEQ ID NO: 250148 - DNA, 16 bp, P. troglodytes
gctggagggcaatggc

SEQ ID NO: 250149 - DNA, 16 bp, P. troglodytes
gctggagggcagcggc

SEQ ID NO: 250150 - DNA, 16 bp, P. troglodytes
gctggagggcagtgcc

SEQ ID NO: 250151 - DNA, 16 bp, P. troglodytes
gctggagggcagtggc

SEQ ID NO: 250152 - DNA, 16 bp, P. troglodytes
gctggaggtgcagtgg

SEQ ID NO: 250153 - DNA, 16 bp, P. troglodytes
gctggagtacagtggt

SEQ ID NO: 250154 - DNA, 16 bp, P. troglodytes
gctggagtacagtgtg

SEQ ID NO: 250155 - DNA, 16 bp, P. troglodytes
gctggagtatagtggt

SEQ ID NO: 250156 - DNA, 16 bp, P. troglodytes
gctggagtgaagtggt

SEQ ID NO: 250157 - DNA, 16 bp, P. troglodytes
gctggagtgagctgag

SEQ ID NO: 250158 - DNA, 16 bp, P. troglodytes
gctggagtgcaggagt

SEQ ID NO: 250159 - DNA, 16 bp, P. troglodytes
gctggagtgcagtaga

SEQ ID NO: 250160 - DNA, 16 bp, P. troglodytes
gctggagtgcagtgac

SEQ ID NO: 250161 - DNA, 16 bp, P. troglodytes
gctggagtgcagtgcg

SEQ ID NO: 250162 - DNA, 16 bp, P. troglodytes
gctggagtgcagtgta

SEQ ID NO: 250163 - DNA, 16 bp, P. troglodytes
gctggagtgcggtgat

SEQ ID NO: 250164 - DNA, 16 bp, P. troglodytes
gctggagtggctggga

SEQ ID NO: 250165 - DNA, 16 bp, P. troglodytes
gctggagtgtgatggc

SEQ ID NO: 250166 - DNA, 16 bp, P. troglodytes
gctggagtgtggtggc

SEQ ID NO: 250167 - DNA, 16 bp, P. troglodytes
gctggagtttgctaga

SEQ ID NO: 250168 - DNA, 16 bp, P. troglodytes
gctggatcacctgagg

SEQ ID NO: 250169 - DNA, 16 bp, P. troglodytes
gctggatgctccctgc

SEQ ID NO: 250170 - DNA, 16 bp, P. troglodytes
gctggatggccaaact

SEQ ID NO: 250171 - DNA, 17 bp, P. troglodytes
gctggattacaggcatg

SEQ ID NO: 250172 - DNA, 16 bp, P. troglodytes
gctggattgatagaat

SEQ ID NO: 250173 - DNA, 16 bp, P. troglodytes
gctggattttcttcat

SEQ ID NO: 250174 - DNA, 16 bp, P. troglodytes
gctggcaaagagaagg

SEQ ID NO: 250175 - DNA, 16 bp, P. troglodytes
gctggcacacagtagg

SEQ ID NO: 250176 - DNA, 16 bp, P. troglodytes
gctggcacagtggctc

SEQ ID NO: 250177 - DNA, 16 bp, P. troglodytes
gctggcactgagtgcc

SEQ ID NO: 250178 - DNA, 16 bp, P. troglodytes
gctggcagactttgca

SEQ ID NO: 250179 - DNA, 16 bp, P. troglodytes
gctggcaggccactga

SEQ ID NO: 250180 - DNA, 16 bp, P. troglodytes
gctggcatctgctggg

SEQ ID NO: 250181 - DNA, 16 bp, P. troglodytes
gctggcatctggcggg

SEQ ID NO: 250182 - DNA, 16 bp, P. troglodytes
gctggccaccccaccc

SEQ ID NO: 250183 - DNA, 16 bp, P. troglodytes
gctggccagggtggtc

SEQ ID NO: 250184 - DNA, 16 bp, P. troglodytes
gctggccatggtggtg

SEQ ID NO: 250185 - DNA, 16 bp, P. troglodytes
gctggccgggctggtc

SEQ ID NO: 250186 - DNA, 16 bp, P. troglodytes
gctggcctcaggagtg

SEQ ID NO: 250187 - DNA, 16 bp, P. troglodytes
gctggcctcggcctcc

SEQ ID NO: 250188 - DNA, 16 bp, P. troglodytes
gctggccttgaacttc

SEQ ID NO: 250189 - DNA, 16 bp, P. troglodytes
gctggcgaggagctgc

SEQ ID NO: 250190 - DNA, 16 bp, P. troglodytes
gctggctccagcagcc

SEQ ID NO: 250191 - DNA, 16 bp, P. troglodytes
gctggctccccctttg

SEQ ID NO: 250192 - DNA, 16 bp, P. troglodytes
gctggctccctcagct

SEQ ID NO: 250193 - DNA, 16 bp, P. troglodytes
gctggctctcagtccc

SEQ ID NO: 250194 - DNA, 16 bp, P. troglodytes
gctggctctgaagatg

SEQ ID NO: 250195 - DNA, 16 bp, P. troglodytes
gctggctctggtggcc

SEQ ID NO: 250196 - DNA, 16 bp, P. troglodytes
gctggctcttactccc

SEQ ID NO: 250197 - DNA, 16 bp, P. troglodytes
gctggctgcagtggct

SEQ ID NO: 250198 - DNA, 16 bp, P. troglodytes
gctggctgcagtgggg

SEQ ID NO: 250199 - DNA, 16 bp, P. troglodytes
gctggctgctggctgg

SEQ ID NO: 250200 - DNA, 16 bp, P. troglodytes
gctggctggctgctcc

SEQ ID NO: 250201 - DNA, 16 bp, P. troglodytes
gctggctggggtggcc

SEQ ID NO: 250202 - DNA, 16 bp, P. troglodytes
gctggctgtggtggca

SEQ ID NO: 250203 - DNA, 16 bp, P. troglodytes
gctggctgttggctgg

SEQ ID NO: 250204 - DNA, 16 bp, P. troglodytes
gctggcttcaggagtg

SEQ ID NO: 250205 - DNA, 16 bp, P. troglodytes
gctggcttcctgggct

SEQ ID NO: 250206 - DNA, 16 bp, P. troglodytes
gctggctttgaagata

SEQ ID NO: 250207 - DNA, 16 bp, P. troglodytes
gctgggaaaactagct

SEQ ID NO: 250208 - DNA, 16 bp, P. troglodytes
gctgggaaaactggca

SEQ ID NO: 250209 - DNA, 16 bp, P. troglodytes
gctgggaactgcagac

SEQ ID NO: 250210 - DNA, 16 bp, P. troglodytes
gctgggaagacaggca

SEQ ID NO: 250211 - DNA, 16 bp, P. troglodytes
gctgggaaggccaaga

SEQ ID NO: 250212 - DNA, 16 bp, P. troglodytes
gctgggaaggctgagg

SEQ ID NO: 250213 - DNA, 16 bp, P. troglodytes
gctgggaagggaaggg

SEQ ID NO: 250214 - DNA, 16 bp, P. troglodytes
gctgggacacaggaca

SEQ ID NO: 250215 - DNA, 16 bp, P. troglodytes
gctgggacagcaggtg

SEQ ID NO: 250216 - DNA, 16 bp, P. troglodytes
gctgggaccacagggg

SEQ ID NO: 250217 - DNA, 16 bp, P. troglodytes
gctgggaccataggcg

SEQ ID NO: 250218 - DNA, 16 bp, P. troglodytes
gctgggactacaagag

SEQ ID NO: 250219 - DNA, 16 bp, P. troglodytes
gctgggactacaggta

SEQ ID NO: 250220 - DNA, 16 bp, P. troglodytes
gctgggactgcaggag

SEQ ID NO: 250221 - DNA, 17 bp, P. troglodytes
gctgggactgcaggcat

SEQ ID NO: 250222 - DNA, 16 bp, P. troglodytes
gctgggagctcagctg

SEQ ID NO: 250223 - DNA, 16 bp, P. troglodytes
gctgggagctgcagac

SEQ ID NO: 250224 - DNA, 16 bp, P. troglodytes
gctgggagctgcagat

SEQ ID NO: 250225 - DNA, 16 bp, P. troglodytes
gctgggagctgggagc

SEQ ID NO: 250226 - DNA, 16 bp, P. troglodytes
gctgggagctgtagac

SEQ ID NO: 250227 - DNA, 16 bp, P. troglodytes
gctgggagctgtggac

SEQ ID NO: 250228 - DNA, 16 bp, P. troglodytes
gctgggaggcagaggt

SEQ ID NO: 250229 - DNA, 16 bp, P. troglodytes
gctgggaggcggaggt

SEQ ID NO: 250230 - DNA, 16 bp, P. troglodytes
gctgggagtggggctg

SEQ ID NO: 250231 - DNA, 16 bp, P. troglodytes
gctgggagttggagac

SEQ ID NO: 250232 - DNA, 16 bp, P. troglodytes
gctgggataacaggca

SEQ ID NO: 250233 - DNA, 16 bp, P. troglodytes
gctgggataactagct

SEQ ID NO: 250234 - DNA, 16 bp, P. troglodytes
gctgggatcacaggtg

SEQ ID NO: 250235 - DNA, 16 bp, P. troglodytes
gctgggatcgcaggca

SEQ ID NO: 250236 - DNA, 16 bp, P. troglodytes
gctgggatgaagggtg

SEQ ID NO: 250237 - DNA, 16 bp, P. troglodytes
gctgggatgacagcca

SEQ ID NO: 250238 - DNA, 16 bp, P. troglodytes
gctgggatgacaggcg

SEQ ID NO: 250239 - DNA, 16 bp, P. troglodytes
gctgggattaaaggca

SEQ ID NO: 250240 - DNA, 16 bp, P. troglodytes
gctgggattacaagca

SEQ ID NO: 250241 - DNA, 16 bp, P. troglodytes
gctgggattacaagtg

SEQ ID NO: 250242 - DNA, 16 bp, P. troglodytes
gctgggattacaggcc

SEQ ID NO: 250243 - DNA, 16 bp, P. troglodytes
gctgggattacaggct

SEQ ID NO: 250244 - DNA, 25 bp, P. troglodytes
gctgggattacaggtgtgggccacc

SEQ ID NO: 250245 - DNA, 16 bp, P. troglodytes
gctgggattacagtcg

SEQ ID NO: 250246 - DNA, 16 bp, P. troglodytes
gctgggattacagttg

SEQ ID NO: 250247 - DNA, 16 bp, P. troglodytes
gctgggattacataca

SEQ ID NO: 250248 - DNA, 16 bp, P. troglodytes
gctgggattacatgca

SEQ ID NO: 250249 - DNA, 16 bp, P. troglodytes
gctgggattaccagca

SEQ ID NO: 250250 - DNA, 16 bp, P. troglodytes
gctgggattataggca

SEQ ID NO: 250251 - DNA, 16 bp, P. troglodytes
gctgggattccaggca

SEQ ID NO: 250252 - DNA, 16 bp, P. troglodytes
gctgggattgcaggca

SEQ ID NO: 250253 - DNA, 16 bp, P. troglodytes
gctgggatttgaacca

SEQ ID NO: 250254 - DNA, 16 bp, P. troglodytes
gctgggcaacatagtg

SEQ ID NO: 250255 - DNA, 17 bp, P. troglodytes
gctgggcaacatggtga

SEQ ID NO: 250256 - DNA, 16 bp, P. troglodytes
gctgggcaaggtggct

SEQ ID NO: 250257 - DNA, 16 bp, P. troglodytes
gctgggcaaggtggtg

SEQ ID NO: 250258 - DNA, 16 bp, P. troglodytes
gctgggcaccatggct

SEQ ID NO: 250259 - DNA, 16 bp, P. troglodytes
gctgggcacggtggtg

SEQ ID NO: 250260 - DNA, 16 bp, P. troglodytes
gctgggcactgtggtg

SEQ ID NO: 250261 - DNA, 16 bp, P. troglodytes
gctgggcagagtggct

SEQ ID NO: 250262 - DNA, 16 bp, P. troglodytes
gctgggcagcagagca

SEQ ID NO: 250263 - DNA, 16 bp, P. troglodytes
gctgggcaggctgggc

SEQ ID NO: 250264 - DNA, 16 bp, P. troglodytes
gctgggcagggctggg

SEQ ID NO: 250265 - DNA, 16 bp, P. troglodytes
gctgggcatcatggcg

SEQ ID NO: 250266 - DNA, 16 bp, P. troglodytes
gctgggcatgatggtg

SEQ ID NO: 250267 - DNA, 16 bp, P. troglodytes
gctgggcatgctggcg

SEQ ID NO: 250268 - DNA, 16 bp, P. troglodytes
gctgggcatggaggcg

SEQ ID NO: 250269 - DNA, 16 bp, P. troglodytes
gctgggcatggcagca

SEQ ID NO: 250270 - DNA, 16 bp, P. troglodytes
gctgggcatgggggtg

SEQ ID NO: 250271 - DNA, 16 bp, P. troglodytes
gctgggcatggtgact

SEQ ID NO: 250272 - DNA, 16 bp, P. troglodytes
gctgggcatggtggca

SEQ ID NO: 250273 - DNA, 16 bp, P. troglodytes
gctgggcatggtggct

SEQ ID NO: 250274 - DNA, 20 bp, P. troglodytes
gctgggcatggtggctcact

SEQ ID NO: 250275 - DNA, 16 bp, P. troglodytes
gctgggccacagagca

SEQ ID NO: 250276 - DNA, 16 bp, P. troglodytes
gctgggccaggccagg

SEQ ID NO: 250277 - DNA, 16 bp, P. troglodytes
gctgggcccagggccc

SEQ ID NO: 250278 - DNA, 16 bp, P. troglodytes
gctgggcccagtggct

SEQ ID NO: 250279 - DNA, 16 bp, P. troglodytes
gctgggccccaccccc

SEQ ID NO: 250280 - DNA, 16 bp, P. troglodytes
gctgggccccacctcc

SEQ ID NO: 250281 - DNA, 16 bp, P. troglodytes
gctgggccgggcgcag

SEQ ID NO: 250282 - DNA, 16 bp, P. troglodytes
gctgggcctcccaaag

SEQ ID NO: 250283 - DNA, 16 bp, P. troglodytes
gctgggcctgcaggtg

SEQ ID NO: 250284 - DNA, 16 bp, P. troglodytes
gctgggcctggactcc

SEQ ID NO: 250285 - DNA, 16 bp, P. troglodytes
gctgggcctggagagg

SEQ ID NO: 250286 - DNA, 16 bp, P. troglodytes
gctgggcctgggctgg

SEQ ID NO: 250287 - DNA, 16 bp, P. troglodytes
gctgggcctggggctg

SEQ ID NO: 250288 - DNA, 16 bp, P. troglodytes
gctgggcctgggggac

SEQ ID NO: 250289 - DNA, 16 bp, P. troglodytes
gctgggcctggtgatg

SEQ ID NO: 250290 - DNA, 16 bp, P. troglodytes
gctgggcgctgtggct

SEQ ID NO: 250291 - DNA, 16 bp, P. troglodytes
gctgggcggagacgct

SEQ ID NO: 250292 - DNA, 16 bp, P. troglodytes
gctgggcgtgctggca

SEQ ID NO: 250293 - DNA, 16 bp, P. troglodytes
gctgggcgtggaggtg

SEQ ID NO: 250294 - DNA, 16 bp, P. troglodytes
gctgggctcagctggg

SEQ ID NO: 250295 - DNA, 16 bp, P. troglodytes
gctgggctccatggga

SEQ ID NO: 250296 - DNA, 16 bp, P. troglodytes
gctgggctcctgagtg

SEQ ID NO: 250297 - DNA, 16 bp, P. troglodytes
gctgggctgggcctgg

SEQ ID NO: 250298 - DNA, 16 bp, P. troglodytes
gctgggctgggctgag

SEQ ID NO: 250299 - DNA, 16 bp, P. troglodytes
gctgggctggtggctc

SEQ ID NO: 250300 - DNA, 16 bp, P. troglodytes
gctgggcttataggtg

SEQ ID NO: 250301 - DNA, 16 bp, P. troglodytes
gctgggcttggcttta

SEQ ID NO: 250302 - DNA, 16 bp, P. troglodytes
gctgggcttggtggct

SEQ ID NO: 250303 - DNA, 16 bp, P. troglodytes
gctggggagacctcag

SEQ ID NO: 250304 - DNA, 16 bp, P. troglodytes
gctggggagagaggga

SEQ ID NO: 250305 - DNA, 16 bp, P. troglodytes
gctggggaggaggcag

SEQ ID NO: 250306 - DNA, 16 bp, P. troglodytes
gctggggaggccacag

SEQ ID NO: 250307 - DNA, 16 bp, P. troglodytes
gctggggaggctgaag

SEQ ID NO: 250308 - DNA, 16 bp, P. troglodytes
gctggggagggaagga

SEQ ID NO: 250309 - DNA, 16 bp, P. troglodytes
gctggggatggtggtg

SEQ ID NO: 250310 - DNA, 16 bp, P. troglodytes
gctggggattacaggg

SEQ ID NO: 250311 - DNA, 16 bp, P. troglodytes
gctggggcacgagaat

SEQ ID NO: 250312 - DNA, 16 bp, P. troglodytes
gctggggcagaaggat

SEQ ID NO: 250313 - DNA, 16 bp, P. troglodytes
gctggggcaggagact

SEQ ID NO: 250314 - DNA, 16 bp, P. troglodytes
gctggggcaggcagat

SEQ ID NO: 250315 - DNA, 16 bp, P. troglodytes
gctggggccaggcatg

SEQ ID NO: 250316 - DNA, 16 bp, P. troglodytes
gctggggctgcatgct

SEQ ID NO: 250317 - DNA, 16 bp, P. troglodytes
gctggggctggaggag

SEQ ID NO: 250318 - DNA, 16 bp, P. troglodytes
gctggggctggggaag

SEQ ID NO: 250319 - DNA, 16 bp, P. troglodytes
gctggggctggggcag

SEQ ID NO: 250320 - DNA, 16 bp, P. troglodytes
gctgggggacctggtg

SEQ ID NO: 250321 - DNA, 16 bp, P. troglodytes
gctgggggaggaggaa

SEQ ID NO: 250322 - DNA, 16 bp, P. troglodytes
gctgggggagggataa

SEQ ID NO: 250323 - DNA, 16 bp, P. troglodytes
gctgggggccaggctg

SEQ ID NO: 250324 - DNA, 16 bp, P. troglodytes
gctggggggcagtggc

SEQ ID NO: 250325 - DNA, 16 bp, P. troglodytes
gctggggtgggaggat

SEQ ID NO: 250326 - DNA, 16 bp, P. troglodytes
gctgggtatggtgact

SEQ ID NO: 250327 - DNA, 16 bp, P. troglodytes
gctgggtatggtggcg

SEQ ID NO: 250328 - DNA, 16 bp, P. troglodytes
gctgggtctggtggcg

SEQ ID NO: 250329 - DNA, 16 bp, P. troglodytes
gctgggtgacagagcc

SEQ ID NO: 250330 - DNA, 16 bp, P. troglodytes
gctgggtgactttggg

SEQ ID NO: 250331 - DNA, 16 bp, P. troglodytes
gctgggtgcagaggct

SEQ ID NO: 250332 - DNA, 16 bp, P. troglodytes
gctgggtgcagtagct

SEQ ID NO: 250333 - DNA, 16 bp, P. troglodytes
gctgggtgcagtgact

SEQ ID NO: 250334 - DNA, 16 bp, P. troglodytes
gctgggtgcctgtaat

SEQ ID NO: 250335 - DNA, 16 bp, P. troglodytes
gctgggtgcggcggct

SEQ ID NO: 250336 - DNA, 16 bp, P. troglodytes
gctgggtggagaatga

SEQ ID NO: 250337 - DNA, 16 bp, P. troglodytes
gctgggtggagtggct

SEQ ID NO: 250338 - DNA, 16 bp, P. troglodytes
gctgggtggctgcagc

SEQ ID NO: 250339 - DNA, 16 bp, P. troglodytes
gctgggtgtcatggtg

SEQ ID NO: 250340 - DNA, 16 bp, P. troglodytes
gctgggtgtgctggct

SEQ ID NO: 250341 - DNA, 16 bp, P. troglodytes
gctggtattgatgact

SEQ ID NO: 250342 - DNA, 16 bp, P. troglodytes
gctggtcagtggcaga

SEQ ID NO: 250343 - DNA, 16 bp, P. troglodytes
gctggtcatggtggcg

SEQ ID NO: 250344 - DNA, 16 bp, P. troglodytes
gctggtcccctgggcc

SEQ ID NO: 250345 - DNA, 16 bp, P. troglodytes
gctggtctcaaactca

SEQ ID NO: 250346 - DNA, 20 bp, P. troglodytes
gctggtctcaagctcctggc

SEQ ID NO: 250347 - DNA, 16 bp, P. troglodytes
gctggtctccaatttc

SEQ ID NO: 250348 - DNA, 16 bp, P. troglodytes
gctggtcttgaccttc

SEQ ID NO: 250349 - DNA, 16 bp, P. troglodytes
gctggtcttgcactcc

SEQ ID NO: 250350 - DNA, 16 bp, P. troglodytes
gctggtcttggactcc

SEQ ID NO: 250351 - DNA, 16 bp, P. troglodytes
gctggtcttgggctcc

SEQ ID NO: 250352 - DNA, 16 bp, P. troglodytes
gctggtgactttaaat

SEQ ID NO: 250353 - DNA, 16 bp, P. troglodytes
gctggtgagattgcag

SEQ ID NO: 250354 - DNA, 16 bp, P. troglodytes
gctggtgaggctgcag

SEQ ID NO: 250355 - DNA, 16 bp, P. troglodytes
gctggtgcccctctgg

SEQ ID NO: 250356 - DNA, 16 bp, P. troglodytes
gctggtgggtgtgtaa

SEQ ID NO: 250357 - DNA, 16 bp, P. troglodytes
gctggtgttgagtgtc

SEQ ID NO: 250358 - DNA, 16 bp, P. troglodytes
gctggttcaagtgatt

SEQ ID NO: 250359 - DNA, 16 bp, P. troglodytes
gctggttgcagtggct

SEQ ID NO: 250360 - DNA, 16 bp, P. troglodytes
gctgtaaagaaatgcc

SEQ ID NO: 250361 - DNA, 16 bp, P. troglodytes
gctgtaacaaaacacc

SEQ ID NO: 250362 - DNA, 16 bp, P. troglodytes
gctgtaagtataaaat

SEQ ID NO: 250363 - DNA, 16 bp, P. troglodytes
gctgtaattttgtatc

SEQ ID NO: 250364 - DNA, 20 bp, P. troglodytes
gctgtacaggaagcatggca

SEQ ID NO: 250365 - DNA, 16 bp, P. troglodytes
gctgtaccttggctcc

SEQ ID NO: 250366 - DNA, 16 bp, P. troglodytes
gctgtagctcacacct

SEQ ID NO: 250367 - DNA, 16 bp, P. troglodytes
gctgtaggactgaggt

SEQ ID NO: 250368 - DNA, 16 bp, P. troglodytes
gctgtagtgcagtggt

SEQ ID NO: 250369 - DNA, 16 bp, P. troglodytes
gctgtcagagagggac

SEQ ID NO: 250370 - DNA, 17 bp, P. troglodytes
gctgtcaggcctctgag

SEQ ID NO: 250371 - DNA, 16 bp, P. troglodytes
gctgtccagcctccct

SEQ ID NO: 250372 - DNA, 16 bp, P. troglodytes
gctgtcctgggccaca

SEQ ID NO: 250373 - DNA, 16 bp, P. troglodytes
gctgtctcaaaaaaaa

SEQ ID NO: 250374 - DNA, 16 bp, P. troglodytes
gctgtctcagcctccc

SEQ ID NO: 250375 - DNA, 16 bp, P. troglodytes
gctgtctctacaaaaa

SEQ ID NO: 250376 - DNA, 16 bp, P. troglodytes
gctgtctctgatctgg

SEQ ID NO: 250377 - DNA, 16 bp, P. troglodytes
gctgtctgcaagctaa

SEQ ID NO: 250378 - DNA, 16 bp, P. troglodytes
gctgtctgtctgtctg

SEQ ID NO: 250379 - DNA, 16 bp, P. troglodytes
gctgtcttctccctgt

SEQ ID NO: 250380 - DNA, 16 bp, P. troglodytes
gctgtgaagaagctct

SEQ ID NO: 250381 - DNA, 16 bp, P. troglodytes
gctgtgaatacatctg

SEQ ID NO: 250382 - DNA, 16 bp, P. troglodytes
gctgtgaatccaactg

SEQ ID NO: 250383 - DNA, 23 bp, P. troglodytes
gctgtgaatccatctggtcctgg

SEQ ID NO: 250384 - DNA, 16 bp, P. troglodytes
gctgtgaatttgtcat

SEQ ID NO: 250385 - DNA, 16 bp, P. troglodytes
gctgtgacagacagca

SEQ ID NO: 250386 - DNA, 16 bp, P. troglodytes
gctgtgaccatgccac

SEQ ID NO: 250387 - DNA, 16 bp, P. troglodytes
gctgtgagcccagatc

SEQ ID NO: 250388 - DNA, 16 bp, P. troglodytes
gctgtgagtgttacag

SEQ ID NO: 250389 - DNA, 16 bp, P. troglodytes
gctgtgataaacatgt

SEQ ID NO: 250390 - DNA, 16 bp, P. troglodytes
gctgtgatggagccac

SEQ ID NO: 250391 - DNA, 16 bp, P. troglodytes
gctgtgattacagatg

SEQ ID NO: 250392 - DNA, 16 bp, P. troglodytes
gctgtgcactgcacaa

SEQ ID NO: 250393 - DNA, 16 bp, P. troglodytes
gctgtgcagaaactct

SEQ ID NO: 250394 - DNA, 16 bp, P. troglodytes
gctgtgcagaagctgt

SEQ ID NO: 250395 - DNA, 16 bp, P. troglodytes
gctgtgcagcccagtt

SEQ ID NO: 250396 - DNA, 16 bp, P. troglodytes
gctgtgcccccaccca

SEQ ID NO: 250397 - DNA, 16 bp, P. troglodytes
gctgtgctcaatttct

SEQ ID NO: 250398 - DNA, 16 bp, P. troglodytes
gctgtgctggcagctg

SEQ ID NO: 250399 - DNA, 16 bp, P. troglodytes
gctgtgctgggaggtc

SEQ ID NO: 250400 - DNA, 16 bp, P. troglodytes
gctgtgctgggctggg

SEQ ID NO: 250401 - DNA, 16 bp, P. troglodytes
gctgtgctgggtgctg

SEQ ID NO: 250402 - DNA, 16 bp, P. troglodytes
gctgtgctgtgctgtg

SEQ ID NO: 250403 - DNA, 16 bp, P. troglodytes
gctgtgcttcctgtac

SEQ ID NO: 250404 - DNA, 16 bp, P. troglodytes
gctgtggacctgggca

SEQ ID NO: 250405 - DNA, 16 bp, P. troglodytes
gctgtggagaagctct

SEQ ID NO: 250406 - DNA, 16 bp, P. troglodytes
gctgtggaggctgagg

SEQ ID NO: 250407 - DNA, 16 bp, P. troglodytes
gctgtggagggtgtac

SEQ ID NO: 250408 - DNA, 16 bp, P. troglodytes
gctgtggagtgcagtg

SEQ ID NO: 250409 - DNA, 16 bp, P. troglodytes
gctgtggcagtggcag

SEQ ID NO: 250410 - DNA, 16 bp, P. troglodytes
gctgtggcagtttctt

SEQ ID NO: 250411 - DNA, 16 bp, P. troglodytes
gctgtggcccttcagg

SEQ ID NO: 250412 - DNA, 16 bp, P. troglodytes
gctgtggctcacacct

SEQ ID NO: 250413 - DNA, 16 bp, P. troglodytes
gctgtggctccagctg

SEQ ID NO: 250414 - DNA, 16 bp, P. troglodytes
gctgtggctcctgcct

SEQ ID NO: 250415 - DNA, 16 bp, P. troglodytes
gctgtggctgctgctg

SEQ ID NO: 250416 - DNA, 16 bp, P. troglodytes
gctgtggctgctgtgg

SEQ ID NO: 250417 - DNA, 16 bp, P. troglodytes
gctgtggctgtggctg

SEQ ID NO: 250418 - DNA, 16 bp, P. troglodytes
gctgtgggaggccaag

SEQ ID NO: 250419 - DNA, 16 bp, P. troglodytes
gctgtgggctgtgggc

SEQ ID NO: 250420 - DNA, 16 bp, P. troglodytes
gctgtggtggcaggcg

SEQ ID NO: 250421 - DNA, 16 bp, P. troglodytes
gctgtggtggccatgg

SEQ ID NO: 250422 - DNA, 16 bp, P. troglodytes
gctgtggtgggcagat

SEQ ID NO: 250423 - DNA, 16 bp, P. troglodytes
gctgtggtttcagagg

SEQ ID NO: 250424 - DNA, 16 bp, P. troglodytes
gctgtgtaatattcca

SEQ ID NO: 250425 - DNA, 16 bp, P. troglodytes
gctgtgtcacctaggc

SEQ ID NO: 250426 - DNA, 16 bp, P. troglodytes
gctgtgtccccaccga

SEQ ID NO: 250427 - DNA, 16 bp, P. troglodytes
gctgtgtcctcacatg

SEQ ID NO: 250428 - DNA, 16 bp, P. troglodytes
gctgtgtgacattggg

SEQ ID NO: 250429 - DNA, 16 bp, P. troglodytes
gctgtgtgaccctgag

SEQ ID NO: 250430 - DNA, 16 bp, P. troglodytes
gctgtgtgacctcaga

SEQ ID NO: 250431 - DNA, 16 bp, P. troglodytes
gctgtgtgacctgggg

SEQ ID NO: 250432 - DNA, 16 bp, P. troglodytes
gctgtgtgaccttagg

SEQ ID NO: 250433 - DNA, 16 bp, P. troglodytes
gctgtgtgaccttgga

SEQ ID NO: 250434 - DNA, 16 bp, P. troglodytes
gctgtgtgactctggg

SEQ ID NO: 250435 - DNA, 16 bp, P. troglodytes
gctgtgtgacttcagg

SEQ ID NO: 250436 - DNA, 16 bp, P. troglodytes
gctgtgtgactttgag

SEQ ID NO: 250437 - DNA, 16 bp, P. troglodytes
gctgtgtgactttgga

SEQ ID NO: 250438 - DNA, 16 bp, P. troglodytes
gctgtgtgatcctgga

SEQ ID NO: 250439 - DNA, 16 bp, P. troglodytes
gctgtgtgattttggg

SEQ ID NO: 250440 - DNA, 16 bp, P. troglodytes
gctgtgtgcagtggct

SEQ ID NO: 250441 - DNA, 16 bp, P. troglodytes
gctgtgtgccaggcac

SEQ ID NO: 250442 - DNA, 16 bp, P. troglodytes
gctgtgtgctgggcac

SEQ ID NO: 250443 - DNA, 16 bp, P. troglodytes
gctgtgtgctgtgtgc

SEQ ID NO: 250444 - DNA, 16 bp, P. troglodytes
gctgtgtggaactgtg

SEQ ID NO: 250445 - DNA, 16 bp, P. troglodytes
gctgtgtggagaatgg

SEQ ID NO: 250446 - DNA, 16 bp, P. troglodytes
gctgtgtggccctggg

SEQ ID NO: 250447 - DNA, 16 bp, P. troglodytes
gctgtgtggcctcaga

SEQ ID NO: 250448 - DNA, 16 bp, P. troglodytes
gctgtgtgggaggctg

SEQ ID NO: 250449 - DNA, 16 bp, P. troglodytes
gctgtgtgtccctggg

SEQ ID NO: 250450 - DNA, 16 bp, P. troglodytes
gctgtgttccaacaaa

SEQ ID NO: 250451 - DNA, 16 bp, P. troglodytes
gctgtgttgcacaggc

SEQ ID NO: 250452 - DNA, 16 bp, P. troglodytes
gctgtgttgccagggc

SEQ ID NO: 250453 - DNA, 16 bp, P. troglodytes
gctgttatgaagaaat

SEQ ID NO: 250454 - DNA, 16 bp, P. troglodytes
gctgttattttaaaaa

SEQ ID NO: 250455 - DNA, 16 bp, P. troglodytes
gctgttccctttgcct

SEQ ID NO: 250456 - DNA, 16 bp, P. troglodytes
gctgttctcaagctcc

SEQ ID NO: 250457 - DNA, 16 bp, P. troglodytes
gctgttctgcagtctc

SEQ ID NO: 250458 - DNA, 16 bp, P. troglodytes
gctgttgaattttgtt

SEQ ID NO: 250459 - DNA, 16 bp, P. troglodytes
gctgttgtagtgtgaa

SEQ ID NO: 250460 - DNA, 16 bp, P. troglodytes
gctgttgtgcagcctc

SEQ ID NO: 250461 - DNA, 16 bp, P. troglodytes
gctgttgttgctgctg

SEQ ID NO: 250462 - DNA, 16 bp, P. troglodytes
gctgtttattcacttg

SEQ ID NO: 250463 - DNA, 25 bp, P. troglodytes
gctgtttatttcacctgggtgcagg

SEQ ID NO: 250464 - DNA, 16 bp, P. troglodytes
gctgtttcctctgcct

SEQ ID NO: 250465 - DNA, 16 bp, P. troglodytes
gctgtttcctcttcct

SEQ ID NO: 250466 - DNA, 16 bp, P. troglodytes
gctgtttctacttttt

SEQ ID NO: 250467 - DNA, 16 bp, P. troglodytes
gctgttttatcagcaa

SEQ ID NO: 250468 - DNA, 16 bp, P. troglodytes
gctgttttttttgaaa

SEQ ID NO: 250469 - DNA, 16 bp, P. troglodytes
gcttaaaacagcagaa

SEQ ID NO: 250470 - DNA, 16 bp, P. troglodytes
gcttaaaatattcaat

SEQ ID NO: 250471 - DNA, 16 bp, P. troglodytes
gcttaaacaagataga

SEQ ID NO: 250472 - DNA, 17 bp, P. troglodytes
gcttaaacccaggaggt

SEQ ID NO: 250473 - DNA, 16 bp, P. troglodytes
gcttaaacctgggaga

SEQ ID NO: 250474 - DNA, 16 bp, P. troglodytes
gcttaaacctgggagg

SEQ ID NO: 250475 - DNA, 17 bp, P. troglodytes
gcttaaacctgggaggt

SEQ ID NO: 250476 - DNA, 16 bp, P. troglodytes
gcttaaactcgggagg

SEQ ID NO: 250477 - DNA, 16 bp, P. troglodytes
gcttaacttttccctt

SEQ ID NO: 250478 - DNA, 16 bp, P. troglodytes
gcttaagcccaggagg

SEQ ID NO: 250479 - DNA, 16 bp, P. troglodytes
gcttaaggagaggaga

SEQ ID NO: 250480 - DNA, 16 bp, P. troglodytes
gcttaataaatattta

SEQ ID NO: 250481 - DNA, 16 bp, P. troglodytes
gcttaatttttttaaa

SEQ ID NO: 250482 - DNA, 16 bp, P. troglodytes
gcttaccaactaaaaa

SEQ ID NO: 250483 - DNA, 16 bp, P. troglodytes
gcttactacaacctct

SEQ ID NO: 250484 - DNA, 16 bp, P. troglodytes
gcttactgcaacccct

SEQ ID NO: 250485 - DNA, 16 bp, P. troglodytes
gcttactgcagccctg

SEQ ID NO: 250486 - DNA, 16 bp, P. troglodytes
gcttagaaattttttc

SEQ ID NO: 250487 - DNA, 16 bp, P. troglodytes
gcttagagaaaaaaga

SEQ ID NO: 250488 - DNA, 16 bp, P. troglodytes
gcttaggcatgagaat

SEQ ID NO: 250489 - DNA, 16 bp, P. troglodytes
gcttagggaatgagtc

SEQ ID NO: 250490 - DNA, 16 bp, P. troglodytes
gcttaggttttcttct

SEQ ID NO: 250491 - DNA, 16 bp, P. troglodytes
gcttatggagattttg

SEQ ID NO: 250492 - DNA, 16 bp, P. troglodytes
gcttattctctgctct

SEQ ID NO: 250493 - DNA, 16 bp, P. troglodytes
gcttattggccatttg

SEQ ID NO: 250494 - DNA, 16 bp, P. troglodytes
gcttatttttttaaaa

SEQ ID NO: 250495 - DNA, 16 bp, P. troglodytes
gcttcaaagcttcaaa

SEQ ID NO: 250496 - DNA, 16 bp, P. troglodytes
gcttcaaagtttcaaa

SEQ ID NO: 250497 - DNA, 16 bp, P. troglodytes
gcttcaacccgggagg

SEQ ID NO: 250498 - DNA, 16 bp, P. troglodytes
gcttcaacctgggagg

SEQ ID NO: 250499 - DNA, 16 bp, P. troglodytes
gcttcaagcaattctc

SEQ ID NO: 250500 - DNA, 16 bp, P. troglodytes
gcttcaaggcccagga

SEQ ID NO: 250501 - DNA, 17 bp, P. troglodytes
gcttcacccatgtccct

SEQ ID NO: 250502 - DNA, 16 bp, P. troglodytes
gcttcactcaggaaag

SEQ ID NO: 250503 - DNA, 16 bp, P. troglodytes
gcttcagagggtgcaa

SEQ ID NO: 250504 - DNA, 16 bp, P. troglodytes
gcttcagcccaggagg

SEQ ID NO: 250505 - DNA, 16 bp, P. troglodytes
gcttcagccccctgag

SEQ ID NO: 250506 - DNA, 16 bp, P. troglodytes
gcttcagcctcccaaa

SEQ ID NO: 250507 - DNA, 16 bp, P. troglodytes
gcttcagcctccccag

SEQ ID NO: 250508 - DNA, 16 bp, P. troglodytes
gcttcagcctctccag

SEQ ID NO: 250509 - DNA, 16 bp, P. troglodytes
gcttcagcctgggagg

SEQ ID NO: 250510 - DNA, 16 bp, P. troglodytes
gcttcaggtatttctt

SEQ ID NO: 250511 - DNA, 16 bp, P. troglodytes
gcttcagtgtcttcat

SEQ ID NO: 250512 - DNA, 16 bp, P. troglodytes
gcttcagttttctctt

SEQ ID NO: 250513 - DNA, 16 bp, P. troglodytes
gcttcataaaatgatt

SEQ ID NO: 250514 - DNA, 31 bp, P. troglodytes; identical to SEQ ID NO: 111168

SEQ ID NO: 250515 - DNA, 17 bp, P. troglodytes
gcttcatctatgtccct

SEQ ID NO: 250516 - DNA, 16 bp, P. troglodytes
gcttcatgaagttctc

SEQ ID NO: 250517 - DNA, 19 bp, P. troglodytes
gcttcattcttgaagtcag

SEQ ID NO: 250518 - DNA, 16 bp, P. troglodytes
gcttcattgttgaagt

SEQ ID NO: 250519 - DNA, 16 bp, P. troglodytes
gcttcattttaactta

SEQ ID NO: 250520 - DNA, 16 bp, P. troglodytes
gcttccaatttttggc

SEQ ID NO: 250521 - DNA, 16 bp, P. troglodytes
gcttccacctccatcc

SEQ ID NO: 250522 - DNA, 16 bp, P. troglodytes
gcttccacctcccagg

SEQ ID NO: 250523 - DNA, 16 bp, P. troglodytes
gcttccacctcctggg

SEQ ID NO: 250524 - DNA, 16 bp, P. troglodytes
gcttccaccttaagaa

SEQ ID NO: 250525 - DNA, 16 bp, P. troglodytes
gcttccacttggtgtt

SEQ ID NO: 250526 - DNA, 16 bp, P. troglodytes
gcttccagaggaaaga

SEQ ID NO: 250527 - DNA, 16 bp, P. troglodytes
gcttccatgtgatgtt

SEQ ID NO: 250528 - DNA, 16 bp, P. troglodytes
gcttccatgtggtgtt

SEQ ID NO: 250529 - DNA, 16 bp, P. troglodytes
gcttccatttataagt

SEQ ID NO: 250530 - DNA, 16 bp, P. troglodytes
gcttccatttccaaca

SEQ ID NO: 250531 - DNA, 16 bp, P. troglodytes
gcttcccaaagtgttg

SEQ ID NO: 250532 - DNA, 16 bp, P. troglodytes
gcttcccacagtggct

SEQ ID NO: 250533 - DNA, 16 bp, P. troglodytes
gcttcccagcctccag

SEQ ID NO: 250534 - DNA, 16 bp, P. troglodytes
gcttcccattctattc

SEQ ID NO: 250535 - DNA, 16 bp, P. troglodytes
gcttccccagccctgc

SEQ ID NO: 250536 - DNA, 16 bp, P. troglodytes
gcttccccttcagcca

SEQ ID NO: 250537 - DNA, 16 bp, P. troglodytes
gcttccccttctacca

SEQ ID NO: 250538 - DNA, 16 bp, P. troglodytes
gcttcccctttgactt

SEQ ID NO: 250539 - DNA, 16 bp, P. troglodytes
gcttccccttttgcca

SEQ ID NO: 250540 - DNA, 16 bp, P. troglodytes
gcttcccgagttcaag

SEQ ID NO: 250541 - DNA, 16 bp, P. troglodytes
gcttcccggattcaag

SEQ ID NO: 250542 - DNA, 16 bp, P. troglodytes
gcttcccgggtgaggc

SEQ ID NO: 250543 - DNA, 16 bp, P. troglodytes
gcttcccgggttcaag

SEQ ID NO: 250544 - DNA, 16 bp, P. troglodytes
gcttcccttggctagg

SEQ ID NO: 250545 - DNA, 16 bp, P. troglodytes
gcttccctttaaggaa

SEQ ID NO: 250546 - DNA, 16 bp, P. troglodytes
gcttcctaaagtgttg

SEQ ID NO: 250547 - DNA, 16 bp, P. troglodytes
gcttcctattgctgct

SEQ ID NO: 250548 - DNA, 16 bp, P. troglodytes
gcttcctccaggagct

SEQ ID NO: 250549 - DNA, 16 bp, P. troglodytes
gcttcctgccctggaa

SEQ ID NO: 250550 - DNA, 16 bp, P. troglodytes
gcttcctgctgttgct

SEQ ID NO: 250551 - DNA, 16 bp, P. troglodytes
gcttcctggagaaagt

SEQ ID NO: 250552 - DNA, 16 bp, P. troglodytes
gcttcctggccacttt

SEQ ID NO: 250553 - DNA, 16 bp, P. troglodytes
gcttcctgggctcaag

SEQ ID NO: 250554 - DNA, 16 bp, P. troglodytes
gcttcctgggtgaggt

SEQ ID NO: 250555 - DNA, 16 bp, P. troglodytes
gcttcctgggttcaaa

SEQ ID NO: 250556 - DNA, 16 bp, P. troglodytes
gcttcctgggttcaag

SEQ ID NO: 250557 - DNA, 16 bp, P. troglodytes
gcttcctgtacatcct

SEQ ID NO: 250558 - DNA, 16 bp, P. troglodytes
gcttccttcaggagtt

SEQ ID NO: 250559 - DNA, 16 bp, P. troglodytes
gcttccttgaggagct

SEQ ID NO: 250560 - DNA, 16 bp, P. troglodytes
gcttcctttaaaaaaa

SEQ ID NO: 250561 - DNA, 16 bp, P. troglodytes
gcttctacactgttgg

SEQ ID NO: 250562 - DNA, 16 bp, P. troglodytes
gcttctaggaatttat

SEQ ID NO: 250563 - DNA, 16 bp, P. troglodytes
gcttctagtgtaccca

SEQ ID NO: 250564 - DNA, 16 bp, P. troglodytes
gcttctataaacattt

SEQ ID NO: 250565 - DNA, 16 bp, P. troglodytes
gcttctatgtggtgtt

SEQ ID NO: 250566 - DNA, 16 bp, P. troglodytes
gcttctcagaattcag

SEQ ID NO: 250567 - DNA, 16 bp, P. troglodytes
gcttctcagaggaggt

SEQ ID NO: 250568 - DNA, 16 bp, P. troglodytes
gcttctcctcctccaa

SEQ ID NO: 250569 - DNA, 16 bp, P. troglodytes
gcttctcctctgcctt

SEQ ID NO: 250570 - DNA, 16 bp, P. troglodytes
gcttctctgaggaggt

SEQ ID NO: 250571 - DNA, 16 bp, P. troglodytes
gcttctgcctcctgag

SEQ ID NO: 250572 - DNA, 16 bp, P. troglodytes
gcttctgctgctgctg

SEQ ID NO: 250573 - DNA, 16 bp, P. troglodytes
gcttctgctggcagct

SEQ ID NO: 250574 - DNA, 16 bp, P. troglodytes
gcttctgcttctggag

SEQ ID NO: 250575 - DNA, 16 bp, P. troglodytes
gcttctggggaggctg

SEQ ID NO: 250576 - DNA, 16 bp, P. troglodytes
gcttctgggtggggcc

SEQ ID NO: 250577 - DNA, 16 bp, P. troglodytes
gcttctgggttccctt

SEQ ID NO: 250578 - DNA, 16 bp, P. troglodytes
gcttctgtctagtttt

SEQ ID NO: 250579 - DNA, 16 bp, P. troglodytes
gcttctgtctggtttt

SEQ ID NO: 250580 - DNA, 16 bp, P. troglodytes
gcttctgtttgtaagt

SEQ ID NO: 250581 - DNA, 16 bp, P. troglodytes
gcttcttaatcctgag

SEQ ID NO: 250582 - DNA, 16 bp, P. troglodytes
gcttcttcacagcaaa

SEQ ID NO: 250583 - DNA, 16 bp, P. troglodytes
gcttcttcatctataa

SEQ ID NO: 250584 - DNA, 16 bp, P. troglodytes
gcttctttcactcagt

SEQ ID NO: 250585 - DNA, 16 bp, P. troglodytes
gcttctttcccttagt

SEQ ID NO: 250586 - DNA, 16 bp, P. troglodytes
gcttctttttgtcagg

SEQ ID NO: 250587 - DNA, 16 bp, P. troglodytes
gcttgaaactaggagg

SEQ ID NO: 250588 - DNA, 16 bp, P. troglodytes
gcttgaaccaggaccc

SEQ ID NO: 250589 - DNA, 16 bp, P. troglodytes
gcttgaaccagggagg

SEQ ID NO: 250590 - DNA, 16 bp, P. troglodytes
gcttgaaccagggtgg

SEQ ID NO: 250591 - DNA, 16 bp, P. troglodytes
gcttgaacccaagaag

SEQ ID NO: 250592 - DNA, 16 bp, P. troglodytes
gcttgaacccagcggg

SEQ ID NO: 250593 - DNA, 16 bp, P. troglodytes
gcttgaacccaggaaa

SEQ ID NO: 250594 - DNA, 16 bp, P. troglodytes
gcttgaacccaggaat

SEQ ID NO: 250595 - DNA, 16 bp, P. troglodytes
gcttgaacccaggaga

SEQ ID NO: 250596 - DNA, 16 bp, P. troglodytes
gcttgaacccaggagg

SEQ ID NO: 250597 - DNA, 16 bp, P. troglodytes
gcttgaacccaggagt

SEQ ID NO: 250598 - DNA, 16 bp, P. troglodytes
gcttgaacccatgagg

SEQ ID NO: 250599 - DNA, 16 bp, P. troglodytes
gcttgaacccgggaag

SEQ ID NO: 250600 - DNA, 16 bp, P. troglodytes
gcttgaacccgggagt

SEQ ID NO: 250601 - DNA, 16 bp, P. troglodytes
gcttgaaccctggaga

SEQ ID NO: 250602 - DNA, 16 bp, P. troglodytes
gcttgaaccctggggg

SEQ ID NO: 250603 - DNA, 16 bp, P. troglodytes
gcttgaaccgggaggc

SEQ ID NO: 250604 - DNA, 16 bp, P. troglodytes
gcttgaacctaagagg

SEQ ID NO: 250605 - DNA, 16 bp, P. troglodytes
gcttgaacctcggagg

SEQ ID NO: 250606 - DNA, 16 bp, P. troglodytes
gcttgaacctgagaga

SEQ ID NO: 250607 - DNA, 16 bp, P. troglodytes
gcttgaacctggcagg

SEQ ID NO: 250608 - DNA, 16 bp, P. troglodytes
gcttgaacctgggaag

SEQ ID NO: 250609 - DNA, 16 bp, P. troglodytes
gcttgaacctgggaga

SEQ ID NO: 250610 - DNA, 16 bp, P. troglodytes
gcttgaacctgggagc

SEQ ID NO: 250611 - DNA, 16 bp, P. troglodytes
gcttgaacgcgggagg

SEQ ID NO: 250612 - DNA, 16 bp, P. troglodytes
gcttgaactcgggaga

SEQ ID NO: 250613 - DNA, 16 bp, P. troglodytes
gcttgaatccaggaag

SEQ ID NO: 250614 - DNA, 16 bp, P. troglodytes
gcttgaatctggaagg

SEQ ID NO: 250615 - DNA, 16 bp, P. troglodytes
gcttgaatctgggagt

SEQ ID NO: 250616 - DNA, 16 bp, P. troglodytes
gcttgacccaggaggc

SEQ ID NO: 250617 - DNA, 16 bp, P. troglodytes
gcttgacccgggaggc

SEQ ID NO: 250618 - DNA, 16 bp, P. troglodytes
gcttgactccaggagt

SEQ ID NO: 250619 - DNA, 16 bp, P. troglodytes
gcttgagaccaggagg

SEQ ID NO: 250620 - DNA, 16 bp, P. troglodytes
gcttgagaccgggagg

SEQ ID NO: 250621 - DNA, 16 bp, P. troglodytes
gcttgagactgggagg

SEQ ID NO: 250622 - DNA, 16 bp, P. troglodytes
gcttgagcccaggacg

SEQ ID NO: 250623 - DNA, 16 bp, P. troglodytes
gcttgagcccgggaag

SEQ ID NO: 250624 - DNA, 16 bp, P. troglodytes
gcttgagcccgggaga

SEQ ID NO: 250625 - DNA, 16 bp, P. troglodytes
gcttgagcccgggagg

SEQ ID NO: 250626 - DNA, 16 bp, P. troglodytes
gcttgagccctggagt

SEQ ID NO: 250627 - DNA, 16 bp, P. troglodytes
gcttgagtctgggagg

SEQ ID NO: 250628 - DNA, 16 bp, P. troglodytes
gcttgatcaattctgc

SEQ ID NO: 250629 - DNA, 16 bp, P. troglodytes
gcttgatcagattcag

SEQ ID NO: 250630 - DNA, 16 bp, P. troglodytes
gcttgatcccaggagg

SEQ ID NO: 250631 - DNA, 16 bp, P. troglodytes
gcttgatcctgggagg

SEQ ID NO: 250632 - DNA, 16 bp, P. troglodytes
gcttgcaaagtgacca

SEQ ID NO: 250633 - DNA, 16 bp, P. troglodytes
gcttgcacccaggagg

SEQ ID NO: 250634 - DNA, 16 bp, P. troglodytes
gcttgcagctgcatca

SEQ ID NO: 250635 - DNA, 16 bp, P. troglodytes
gcttgcagggagccga

SEQ ID NO: 250636 - DNA, 16 bp, P. troglodytes
gcttgcagtgagccgt

SEQ ID NO: 250637 - DNA, 17 bp, P. troglodytes
gcttgcatcccagggat

SEQ ID NO: 250638 - DNA, 16 bp, P. troglodytes
gcttgcccaaggccac

SEQ ID NO: 250639 - DNA, 16 bp, P. troglodytes
gcttgcccactgcctg

SEQ ID NO: 250640 - DNA, 16 bp, P. troglodytes
gcttgcctgaggtcac

SEQ ID NO: 250641 - DNA, 16 bp, P. troglodytes
gcttgctattctgtcc

SEQ ID NO: 250642 - DNA, 16 bp, P. troglodytes
gcttgctgcacagaaa

SEQ ID NO: 250643 - DNA, 16 bp, P. troglodytes
gcttgctgtgtgccag

SEQ ID NO: 250644 - DNA, 16 bp, P. troglodytes
gcttggcaggctgagg

SEQ ID NO: 250645 - DNA, 16 bp, P. troglodytes
gcttgggagaaagtaa

SEQ ID NO: 250646 - DNA, 16 bp, P. troglodytes
gcttgggatcagaagt

SEQ ID NO: 250647 - DNA, 16 bp, P. troglodytes
gcttgggcagaggtgg

SEQ ID NO: 250648 - DNA, 16 bp, P. troglodytes
gcttgggcccaggagg

SEQ ID NO: 250649 - DNA, 18 bp, P. troglodytes
gcttgggcccaggagttt

SEQ ID NO: 250650 - DNA, 16 bp, P. troglodytes
gcttgggcctaggagg

SEQ ID NO: 250651 - DNA, 22 bp, P. troglodytes
gcttgggctcagaggcctgaca

SEQ ID NO: 250652 - DNA, 16 bp, P. troglodytes
gcttggggacccagcg

SEQ ID NO: 250653 - DNA, 16 bp, P. troglodytes
gcttggggcttgaacc

SEQ ID NO: 250654 - DNA, 16 bp, P. troglodytes
gcttggtgtacagatt

SEQ ID NO: 250655 - DNA, 16 bp, P. troglodytes
gcttggtgtttgcctt

SEQ ID NO: 250656 - DNA, 16 bp, P. troglodytes
gcttgtaatcccaaca

SEQ ID NO: 250657 - DNA, 16 bp, P. troglodytes
gcttgtagtgagccga

SEQ ID NO: 250658 - DNA, 16 bp, P. troglodytes
gcttgtcctgctacaa

SEQ ID NO: 250659 - DNA, 16 bp, P. troglodytes
gcttgtctcaaactcc

SEQ ID NO: 250660 - DNA, 16 bp, P. troglodytes
gcttgtctgggaaata

SEQ ID NO: 250661 - DNA, 16 bp, P. troglodytes
gcttgtgatcccagca

SEQ ID NO: 250662 - DNA, 16 bp, P. troglodytes
gcttgtgctcaggagt

SEQ ID NO: 250663 - DNA, 16 bp, P. troglodytes
gcttgtggtcccagct

SEQ ID NO: 250664 - DNA, 16 bp, P. troglodytes
gcttgttatgcagcaa

SEQ ID NO: 250665 - DNA, 16 bp, P. troglodytes
gcttgtttaaattctt

SEQ ID NO: 250666 - DNA, 16 bp, P. troglodytes
gcttgttttctcattc

SEQ ID NO: 250667 - DNA, 16 bp, P. troglodytes
gctttaaaaaaataaa

SEQ ID NO: 250668 - DNA, 22 bp, P. troglodytes
gctttacttccaactatgtggt

SEQ ID NO: 250669 - DNA, 16 bp, P. troglodytes
gctttagattctcata

SEQ ID NO: 250670 - DNA, 16 bp, P. troglodytes
gctttagttttctcat

SEQ ID NO: 250671 - DNA, 16 bp, P. troglodytes
gctttatcatttttta

SEQ ID NO: 250672 - DNA, 16 bp, P. troglodytes
gctttattaaaaaaaa

SEQ ID NO: 250673 - DNA, 16 bp, P. troglodytes
gctttatttttcttca

SEQ ID NO: 250674 - DNA, 16 bp, P. troglodytes
gctttcaggcataatt

SEQ ID NO: 250675 - DNA, 16 bp, P. troglodytes
gctttcagttctttgg

SEQ ID NO: 250676 - DNA, 16 bp, P. troglodytes
gctttccaggttcaag

SEQ ID NO: 250677 - DNA, 16 bp, P. troglodytes
gctttcctatttctcc

SEQ ID NO: 250678 - DNA, 16 bp, P. troglodytes
gctttcctcctcagag

SEQ ID NO: 250679 - DNA, 16 bp, P. troglodytes
gctttctattctgcca

SEQ ID NO: 250680 - DNA, 16 bp, P. troglodytes
gctttctgtttgtctg

SEQ ID NO: 250681 - DNA, 16 bp, P. troglodytes
gctttctttctgggtt

SEQ ID NO: 250682 - DNA, 16 bp, P. troglodytes
gctttgaaactgggta

SEQ ID NO: 250683 - DNA, 16 bp, P. troglodytes
gctttgaagagagtaa

SEQ ID NO: 250684 - DNA, 17 bp, P. troglodytes
gctttgaatgtgtccca

SEQ ID NO: 250685 - DNA, 16 bp, P. troglodytes
gctttgactggaatga

SEQ ID NO: 250686 - DNA, 16 bp, P. troglodytes
gctttgattcctttct

SEQ ID NO: 250687 - DNA, 16 bp, P. troglodytes
gctttgcagaagcttt

SEQ ID NO: 250688 - DNA, 16 bp, P. troglodytes
gctttgcagagctgtg

SEQ ID NO: 250689 - DNA, 16 bp, P. troglodytes
gctttgcagggacatg

SEQ ID NO: 250690 - DNA, 16 bp, P. troglodytes
gctttgccaaagatca

SEQ ID NO: 250691 - DNA, 16 bp, P. troglodytes
gctttgccagcatctg

SEQ ID NO: 250692 - DNA, 16 bp, P. troglodytes
gctttgccctgagatg

SEQ ID NO: 250693 - DNA, 16 bp, P. troglodytes
gctttggaaggctgag

SEQ ID NO: 250694 - DNA, 16 bp, P. troglodytes
gctttggaatcagaca

SEQ ID NO: 250695 - DNA, 16 bp, P. troglodytes
gctttggagcccccct

SEQ ID NO: 250696 - DNA, 16 bp, P. troglodytes
gctttggcaaagaatt

SEQ ID NO: 250697 - DNA, 16 bp, P. troglodytes
gctttggccaatgaga

SEQ ID NO: 250698 - DNA, 16 bp, P. troglodytes
gctttggctatgaggg

SEQ ID NO: 250699 - DNA, 16 bp, P. troglodytes
gctttggcttaaggaa

SEQ ID NO: 250700 - DNA, 18 bp, P. troglodytes
gctttgggaggccaaggc

SEQ ID NO: 250701 - DNA, 16 bp, P. troglodytes
gctttggttgcctgtg

SEQ ID NO: 250702 - DNA, 16 bp, P. troglodytes
gctttgtaataaattt

SEQ ID NO: 250703 - DNA, 16 bp, P. troglodytes
gctttgtccaaaatgc

SEQ ID NO: 250704 - DNA, 16 bp, P. troglodytes
gctttgtcttcaggat

SEQ ID NO: 250705 - DNA, 16 bp, P. troglodytes
gctttgtgacttgctt

SEQ ID NO: 250706 - DNA, 16 bp, P. troglodytes
gctttgtgaggctgag

SEQ ID NO: 250707 - DNA, 16 bp, P. troglodytes
gctttgtgcagtactg

SEQ ID NO: 250708 - DNA, 16 bp, P. troglodytes
gctttgttccactgct

SEQ ID NO: 250709 - DNA, 16 bp, P. troglodytes
gctttgttgaaaatca

SEQ ID NO: 250710 - DNA, 20 bp, P. troglodytes
gctttgttgcccaggctggt

SEQ ID NO: 250711 - DNA, 16 bp, P. troglodytes
gctttgtttaaaaatt

SEQ ID NO: 250712 - DNA, 16 bp, P. troglodytes
gcttttaaaaaataca

SEQ ID NO: 250713 - DNA, 16 bp, P. troglodytes
gcttttaaaaattgtt

SEQ ID NO: 250714 - DNA, 16 bp, P. troglodytes
gcttttaaaatttaaa

SEQ ID NO: 250715 - DNA, 16 bp, P. troglodytes
gcttttaaaattttct

SEQ ID NO: 250716 - DNA, 16 bp, P. troglodytes
gcttttaaataaattt

SEQ ID NO: 250717 - DNA, 16 bp, P. troglodytes
gcttttaaattttaaa

SEQ ID NO: 250718 - DNA, 16 bp, P. troglodytes
gcttttatcaaaaaga

SEQ ID NO: 250719 - DNA, 16 bp, P. troglodytes
gcttttattaccttaa

SEQ ID NO: 250720 - DNA, 16 bp, P. troglodytes
gcttttattatgttga

SEQ ID NO: 250721 - DNA, 16 bp, P. troglodytes
gcttttattcccttat

SEQ ID NO: 250722 - DNA, 16 bp, P. troglodytes
gcttttcctctgagat

SEQ ID NO: 250723 - DNA, 16 bp, P. troglodytes
gcttttctatatacca

SEQ ID NO: 250724 - DNA, 16 bp, P. troglodytes
gcttttctcctgcctc

SEQ ID NO: 250725 - DNA, 16 bp, P. troglodytes
gcttttctgtccttgt

SEQ ID NO: 250726 - DNA, 16 bp, P. troglodytes
gcttttgaaaatgttt

SEQ ID NO: 250727 - DNA, 16 bp, P. troglodytes
gcttttgaatgtgttc

SEQ ID NO: 250728 - DNA, 16 bp, P. troglodytes
gcttttgaatttcttt

SEQ ID NO: 250729 - DNA, 16 bp, P. troglodytes
gcttttgcttttctag

SEQ ID NO: 250730 - DNA, 16 bp, P. troglodytes
gcttttggtgtcttat

SEQ ID NO: 250731 - DNA, 16 bp, P. troglodytes
gcttttggtgtttgag

SEQ ID NO: 250732 - DNA, 16 bp, P. troglodytes
gcttttgtaaataaag

SEQ ID NO: 250733 - DNA, 16 bp, P. troglodytes
gcttttgtacagcaaa

SEQ ID NO: 250734 - DNA, 16 bp, P. troglodytes
gctttttaaaagaaaa

SEQ ID NO: 250735 - DNA, 16 bp, P. troglodytes
gctttttaaaagaaat

SEQ ID NO: 250736 - DNA, 16 bp, P. troglodytes
gctttttaaaatatat

SEQ ID NO: 250737 - DNA, 16 bp, P. troglodytes
gctttttaaaatgaaa

SEQ ID NO: 250738 - DNA, 16 bp, P. troglodytes
gctttttaattttaat

SEQ ID NO: 250739 - DNA, 16 bp, P. troglodytes
gctttttagtttaatg

SEQ ID NO: 250740 - DNA, 16 bp, P. troglodytes
gctttttcatttctct

SEQ ID NO: 250741 - DNA, 16 bp, P. troglodytes
gctttttccaaagagg

SEQ ID NO: 250742 - DNA, 16 bp, P. troglodytes
gctttttgtatttgga

SEQ ID NO: 250743 - DNA, 16 bp, P. troglodytes
gctttttttcctatgt

SEQ ID NO: 250744 - DNA, 16 bp, P. troglodytes
gcttttttttaaaaaa

SEQ ID NO: 250745 - DNA, 16 bp, P. troglodytes
gcttttttttgagatg

SEQ ID NO: 250746 - DNA, 16 bp, P. troglodytes
gcttttttttttaaag

SEQ ID NO: 250747 - DNA, 16 bp, P. troglodytes
ggaaaaaaaaatcact

SEQ ID NO: 250748 - DNA, 16 bp, P. troglodytes
ggaaaaaaaaatcttt

SEQ ID NO: 250749 - DNA, 16 bp, P. troglodytes
ggaaaaaaacatttaa

SEQ ID NO: 250750 - DNA, 16 bp, P. troglodytes
ggaaaaaaatcaacag

SEQ ID NO: 250751 - DNA, 16 bp, P. troglodytes
ggaaaaaaatcacttt

SEQ ID NO: 250752 - DNA, 16 bp, P. troglodytes
ggaaaaaaatcattct

SEQ ID NO: 250753 - DNA, 16 bp, P. troglodytes
ggaaaaaactaaagtt

SEQ ID NO: 250754 - DNA, 16 bp, P. troglodytes
ggaaaaaagttttttt

SEQ ID NO: 250755 - DNA, 16 bp, P. troglodytes
ggaaaaaatatatatg

SEQ ID NO: 250756 - DNA, 16 bp, P. troglodytes
ggaaaaaatattttca

SEQ ID NO: 250757 - DNA, 16 bp, P. troglodytes
ggaaaaaatattttta

SEQ ID NO: 250758 - DNA, 16 bp, P. troglodytes
ggaaaaacaggacact

SEQ ID NO: 250759 - DNA, 16 bp, P. troglodytes
ggaaaaacatttttaa

SEQ ID NO: 250760 - DNA, 16 bp, P. troglodytes
ggaaaaactaaaagcc

SEQ ID NO: 250761 - DNA, 16 bp, P. troglodytes
ggaaaaagaaatattt

SEQ ID NO: 250762 - DNA, 16 bp, P. troglodytes
ggaaaaagacagtctc

SEQ ID NO: 250763 - DNA, 16 bp, P. troglodytes
ggaaaaagatatccca

SEQ ID NO: 250764 - DNA, 16 bp, P. troglodytes
ggaaaaagattccatg

SEQ ID NO: 250765 - DNA, 16 bp, P. troglodytes
ggaaaaataaagtctt

SEQ ID NO: 250766 - DNA, 16 bp, P. troglodytes
ggaaaaatacttttgc

SEQ ID NO: 250767 - DNA, 16 bp, P. troglodytes
ggaaaaatatttgtaa

SEQ ID NO: 250768 - DNA, 16 bp, P. troglodytes
ggaaaaattatttgca

SEQ ID NO: 250769 - DNA, 16 bp, P. troglodytes
ggaaaaattcaaagtg

SEQ ID NO: 250770 - DNA, 16 bp, P. troglodytes
ggaaaacacaaattaa

SEQ ID NO: 250771 - DNA, 16 bp, P. troglodytes
ggaaaacagtgtgatg

SEQ ID NO: 250772 - DNA, 16 bp, P. troglodytes
ggaaaacattgctttt

SEQ ID NO: 250773 - DNA, 16 bp, P. troglodytes
ggaaaaccaggaaagc

SEQ ID NO: 250774 - DNA, 16 bp, P. troglodytes
ggaaaaccgccttagg

SEQ ID NO: 250775 - DNA, 16 bp, P. troglodytes
ggaaaacctagagaaa

SEQ ID NO: 250776 - DNA, 16 bp, P. troglodytes
ggaaaactatttggca

SEQ ID NO: 250777 - DNA, 16 bp, P. troglodytes
ggaaaactgaaaaatt

SEQ ID NO: 250778 - DNA, 16 bp, P. troglodytes
ggaaaactgaatatcc

SEQ ID NO: 250779 - DNA, 16 bp, P. troglodytes
ggaaaactggcacaag

SEQ ID NO: 250780 - DNA, 50 bp, P. troglodytes
ggaaaactggctagccatatgtagaaagctgaaactggatcccttcctta

SEQ ID NO: 250781 - DNA, 16 bp, P. troglodytes
ggaaaacttctctggc

SEQ ID NO: 250782 - DNA, 16 bp, P. troglodytes
ggaaaagaacagagcc

SEQ ID NO: 250783 - DNA, 16 bp, P. troglodytes
ggaaaagacaatctct

SEQ ID NO: 250784 - DNA, 16 bp, P. troglodytes
ggaaaagacctggaaa

SEQ ID NO: 250785 - DNA, 16 bp, P. troglodytes
ggaaaagagaaagtca

SEQ ID NO: 250786 - DNA, 16 bp, P. troglodytes
ggaaaagatcaggaaa

SEQ ID NO: 250787 - DNA, 16 bp, P. troglodytes
ggaaaagcagaagctg

SEQ ID NO: 250788 - DNA, 16 bp, P. troglodytes
ggaaaagcctcaggca

SEQ ID NO: 250789 - DNA, 16 bp, P. troglodytes
ggaaaagctccagtct

SEQ ID NO: 250790 - DNA, 16 bp, P. troglodytes
ggaaaagctgaccagc

SEQ ID NO: 250791 - DNA, 16 bp, P. troglodytes
ggaaaagctttcagtc

SEQ ID NO: 250792 - DNA, 16 bp, P. troglodytes
ggaaaaggccttgaag

SEQ ID NO: 250793 - DNA, 16 bp, P. troglodytes
ggaaaaggctacctgg

SEQ ID NO: 250794 - DNA, 16 bp, P. troglodytes
ggaaaaggctcaaatg

SEQ ID NO: 250795 - DNA, 16 bp, P. troglodytes
ggaaaaggggttctgg

SEQ ID NO: 250796 - DNA, 16 bp, P. troglodytes
ggaaaagtcaagctgg

SEQ ID NO: 250797 - DNA, 16 bp, P. troglodytes
ggaaaagtgcaatatt

SEQ ID NO: 250798 - DNA, 16 bp, P. troglodytes
ggaaaagtggaagctg

SEQ ID NO: 250799 - DNA, 16 bp, P. troglodytes
ggaaaatacatttctg

SEQ ID NO: 250800 - DNA, 16 bp, P. troglodytes
ggaaaatatattttta

SEQ ID NO: 250801 - DNA, 16 bp, P. troglodytes
ggaaaatctcagcaat

SEQ ID NO: 250802 - DNA, 16 bp, P. troglodytes
ggaaaatctgttgttt

SEQ ID NO: 250803 - DNA, 16 bp, P. troglodytes
ggaaaatcttggactt

SEQ ID NO: 250804 - DNA, 16 bp, P. troglodytes
ggaaaatgaaatgaat

SEQ ID NO: 250805 - DNA, 16 bp, P. troglodytes
ggaaaatgcctcaaag

SEQ ID NO: 250806 - DNA, 16 bp, P. troglodytes
ggaaaatgcctccagg

SEQ ID NO: 250807 - DNA, 16 bp, P. troglodytes
ggaaaatgttataatt

SEQ ID NO: 250808 - DNA, 16 bp, P. troglodytes
ggaaaattattgtgtt

SEQ ID NO: 250809 - DNA, 16 bp, P. troglodytes
ggaaaatttgcagtct

SEQ ID NO: 250810 - DNA, 16 bp, P. troglodytes
ggaaacaaatgagaaa

SEQ ID NO: 250811 - DNA, 16 bp, P. troglodytes
ggaaacaacagatgtt

SEQ ID NO: 250812 - DNA, 16 bp, P. troglodytes
ggaaacacagagaatg

SEQ ID NO: 250813 - DNA, 16 bp, P. troglodytes
ggaaacagagcaagat

SEQ ID NO: 250814 - DNA, 16 bp, P. troglodytes
ggaaacagagccaaac

SEQ ID NO: 250815 - DNA, 16 bp, P. troglodytes
ggaaacagaggcccag

SEQ ID NO: 250816 - DNA, 16 bp, P. troglodytes
ggaaacagtcaacaaa

SEQ ID NO: 250817 - DNA, 16 bp, P. troglodytes
ggaaacatttttattt

SEQ ID NO: 250818 - DNA, 16 bp, P. troglodytes
ggaaaccaaggcccag

SEQ ID NO: 250819 - DNA, 17 bp, P. troglodytes
ggaaaccgcccccatga

SEQ ID NO: 250820 - DNA, 16 bp, P. troglodytes
ggaaactaaacaactt

SEQ ID NO: 250821 - DNA, 16 bp, P. troglodytes
ggaaactaaggcagga

SEQ ID NO: 250822 - DNA, 17 bp, P. troglodytes
ggaaactccatctcaaa

SEQ ID NO: 250823 - DNA, 16 bp, P. troglodytes
ggaaactgaagctctg

SEQ ID NO: 250824 - DNA, 16 bp, P. troglodytes
ggaaactgagcctcag

SEQ ID NO: 250825 - DNA, 16 bp, P. troglodytes
ggaaactgaggaagag

SEQ ID NO: 250826 - DNA, 16 bp, P. troglodytes
ggaaactgaggcacgg

SEQ ID NO: 250827 - DNA, 16 bp, P. troglodytes
ggaaactgaggcagag

SEQ ID NO: 250828 - DNA, 16 bp, P. troglodytes
ggaaactgaggcccag

SEQ ID NO: 250829 - DNA, 16 bp, P. troglodytes
ggaaactgaggcctgg

SEQ ID NO: 250830 - DNA, 16 bp, P. troglodytes
ggaaactgaggctcaa

SEQ ID NO: 250831 - DNA, 16 bp, P. troglodytes
ggaaactgaggctcag

SEQ ID NO: 250832 - DNA, 16 bp, P. troglodytes
ggaaactgaggctcat

SEQ ID NO: 250833 - DNA, 16 bp, P. troglodytes
ggaaactgaggctcgg

SEQ ID NO: 250834 - DNA, 16 bp, P. troglodytes
ggaaactgaggcttaa

SEQ ID NO: 250835 - DNA, 16 bp, P. troglodytes
ggaaactgagtcacag

SEQ ID NO: 250836 - DNA, 16 bp, P. troglodytes
ggaaactgcccctgtg

SEQ ID NO: 250837 - DNA, 16 bp, P. troglodytes
ggaaactgggtgaagg

SEQ ID NO: 250838 - DNA, 16 bp, P. troglodytes
ggaaacttctcccaca

SEQ ID NO: 250839 - DNA, 16 bp, P. troglodytes
ggaaacttctttgtga

SEQ ID NO: 250840 - DNA, 16 bp, P. troglodytes
ggaaacttgttagaaa

SEQ ID NO: 250841 - DNA, 16 bp, P. troglodytes
ggaaactttttttttt

SEQ ID NO: 250842 - DNA, 16 bp, P. troglodytes
ggaaagaaaacatttt

SEQ ID NO: 250843 - DNA, 16 bp, P. troglodytes
ggaaagaaacaactgg

SEQ ID NO: 250844 - DNA, 16 bp, P. troglodytes
ggaaagaaattatttt

SEQ ID NO: 250845 - DNA, 16 bp, P. troglodytes
ggaaagaaggcaggca

SEQ ID NO: 250846 - DNA, 16 bp, P. troglodytes
ggaaagaatgtatatt

SEQ ID NO: 250847 - DNA, 16 bp, P. troglodytes
ggaaagaattcagtga

SEQ ID NO: 250848 - DNA, 16 bp, P. troglodytes
ggaaagactccctatt

SEQ ID NO: 250849 - DNA, 16 bp, P. troglodytes
ggaaagagacagacag

SEQ ID NO: 250850 - DNA, 16 bp, P. troglodytes
ggaaagatctaaaatc

SEQ ID NO: 250851 - DNA, 16 bp, P. troglodytes
ggaaagatctcaaatt

SEQ ID NO: 250852 - DNA, 16 bp, P. troglodytes
ggaaagatttttttaa

SEQ ID NO: 250853 - DNA, 16 bp, P. troglodytes
ggaaagcatcaggaaa

SEQ ID NO: 250854 - DNA, 16 bp, P. troglodytes
ggaaagccaatggtgt

SEQ ID NO: 250855 - DNA, 16 bp, P. troglodytes
ggaaagcctttccaag

SEQ ID NO: 250856 - DNA, 16 bp, P. troglodytes
ggaaagctggtggtgt

SEQ ID NO: 250857 - DNA, 16 bp, P. troglodytes
ggaaagcttcctggag

SEQ ID NO: 250858 - DNA, 16 bp, P. troglodytes
ggaaaggagaaagtca

SEQ ID NO: 250859 - DNA, 16 bp, P. troglodytes
ggaaaggaggctgaag

SEQ ID NO: 250860 - DNA, 16 bp, P. troglodytes
ggaaaggatccagttt

SEQ ID NO: 250861 - DNA, 16 bp, P. troglodytes
ggaaaggcaaaggaac

SEQ ID NO: 250862 - DNA, 16 bp, P. troglodytes
ggaaaggcctctacct

SEQ ID NO: 250863 - DNA, 16 bp, P. troglodytes
ggaaagtctttgaaga

SEQ ID NO: 250864 - DNA, 16 bp, P. troglodytes
ggaaagtgaaaccaca

SEQ ID NO: 250865 - DNA, 16 bp, P. troglodytes
ggaaagtgaacaacct

SEQ ID NO: 250866 - DNA, 16 bp, P. troglodytes
ggaaagtgggtgcagc

SEQ ID NO: 250867 - DNA, 16 bp, P. troglodytes
ggaaagtgggtgcagg

SEQ ID NO: 250868 - DNA, 16 bp, P. troglodytes
ggaaagttctcctgga

SEQ ID NO: 250869 - DNA, 16 bp, P. troglodytes
ggaaagtttcaacaat

SEQ ID NO: 250870 - DNA, 16 bp, P. troglodytes
ggaaagtttgaaactt

SEQ ID NO: 250871 - DNA, 16 bp, P. troglodytes
ggaaagttttcagcca

SEQ ID NO: 250872 - DNA, 16 bp, P. troglodytes
ggaaataaagcgtatt

SEQ ID NO: 250873 - DNA, 16 bp, P. troglodytes
ggaaataaatttctgt

SEQ ID NO: 250874 - DNA, 16 bp, P. troglodytes
ggaaatacaagtcaaa

SEQ ID NO: 250875 - DNA, 16 bp, P. troglodytes
ggaaatacagggttag

SEQ ID NO: 250876 - DNA, 16 bp, P. troglodytes
ggaaatatattttcat

SEQ ID NO: 250877 - DNA, 16 bp, P. troglodytes
ggaaatattttgtaaa

SEQ ID NO: 250878 - DNA, 16 bp, P. troglodytes
ggaaatcagaaaatat

SEQ ID NO: 250879 - DNA, 16 bp, P. troglodytes
ggaaatgaagaaatca

SEQ ID NO: 250880 - DNA, 16 bp, P. troglodytes
ggaaatgcaaatccaa

SEQ ID NO: 250881 - DNA, 16 bp, P. troglodytes
ggaaatgcaaattaaa

SEQ ID NO: 250882 - DNA, 16 bp, P. troglodytes
ggaaatgccccagttt

SEQ ID NO: 250883 - DNA, 16 bp, P. troglodytes
ggaaatggaaaataat

SEQ ID NO: 250884 - DNA, 16 bp, P. troglodytes
ggaaatggaaaccaaa

SEQ ID NO: 250885 - DNA, 16 bp, P. troglodytes
ggaaatggaaattaaa

SEQ ID NO: 250886 - DNA, 16 bp, P. troglodytes
ggaaatggagaaatca

SEQ ID NO: 250887 - DNA, 16 bp, P. troglodytes
ggaaatggaggtcatt

SEQ ID NO: 250888 - DNA, 16 bp, P. troglodytes
ggaaatggagtgaatg

SEQ ID NO: 250889 - DNA, 16 bp, P. troglodytes
ggaaatggcagagctg

SEQ ID NO: 250890 - DNA, 16 bp, P. troglodytes
ggaaatgtaaaatagt

SEQ ID NO: 250891 - DNA, 16 bp, P. troglodytes
ggaaatgtaaattaaa

SEQ ID NO: 250892 - DNA, 16 bp, P. troglodytes
ggaaatgtaaattagt

SEQ ID NO: 250893 - DNA, 16 bp, P. troglodytes
ggaaatgtggacacag

SEQ ID NO: 250894 - DNA, 16 bp, P. troglodytes
ggaaatgttctgaaat

SEQ ID NO: 250895 - DNA, 16 bp, P. troglodytes
ggaaattaaaaagcaa

SEQ ID NO: 250896 - DNA, 16 bp, P. troglodytes
ggaaattatttcaaaa

SEQ ID NO: 250897 - DNA, 16 bp, P. troglodytes
ggaaattccagcctgg

SEQ ID NO: 250898 - DNA, 16 bp, P. troglodytes
ggaaattgaggctgag

SEQ ID NO: 250899 - DNA, 16 bp, P. troglodytes
ggaaatttgttagaaa

SEQ ID NO: 250900 - DNA, 16 bp, P. troglodytes
ggaaattttctaaaat

SEQ ID NO: 250901 - DNA, 16 bp, P. troglodytes
ggaacaaagctggagg

SEQ ID NO: 250902 - DNA, 16 bp, P. troglodytes
ggaacaactggtacca

SEQ ID NO: 250903 - DNA, 16 bp, P. troglodytes
ggaacaagagacactg

SEQ ID NO: 250904 - DNA, 16 bp, P. troglodytes
ggaacaagataaggat

SEQ ID NO: 250905 - DNA, 16 bp, P. troglodytes
ggaacaagtcaaggat

SEQ ID NO: 250906 - DNA, 19 bp, P. troglodytes
ggaacacaacagagccctc

SEQ ID NO: 250907 - DNA, 16 bp, P. troglodytes
ggaacacagccacgcc

SEQ ID NO: 250908 - DNA, 16 bp, P. troglodytes
ggaacacagtggtgcc

SEQ ID NO: 250909 - DNA, 16 bp, P. troglodytes
ggaacagaaaatcaaa

SEQ ID NO: 250910 - DNA, 16 bp, P. troglodytes
ggaacagaaatcattc

SEQ ID NO: 250911 - DNA, 16 bp, P. troglodytes
ggaacagaagaaatat

SEQ ID NO: 250912 - DNA, 16 bp, P. troglodytes
ggaacagaatggaaaa

SEQ ID NO: 250913 - DNA, 17 bp, P. troglodytes
ggaacagagccctcaga

SEQ ID NO: 250914 - DNA, 16 bp, P. troglodytes
ggaacagatttttttt

SEQ ID NO: 250915 - DNA, 16 bp, P. troglodytes
ggaacagtgcattcca

SEQ ID NO: 250916 - DNA, 16 bp, P. troglodytes
ggaacatatctgaaaa

SEQ ID NO: 250917 - DNA, 17 bp, P. troglodytes
ggaacatccctgagaaa

SEQ ID NO: 250918 - DNA, 16 bp, P. troglodytes
ggaacatctcaccaat

SEQ ID NO: 250919 - DNA, 16 bp, P. troglodytes
ggaaccacaaaagact

SEQ ID NO: 250920 - DNA, 16 bp, P. troglodytes
ggaaccacccccatga

SEQ ID NO: 250921 - DNA, 16 bp, P. troglodytes
ggaaccagaaaaccaa

SEQ ID NO: 250922 - DNA, 16 bp, P. troglodytes
ggaaccagagaaacaa

SEQ ID NO: 250923 - DNA, 16 bp, P. troglodytes
ggaaccagcaaaggag

SEQ ID NO: 250924 - DNA, 16 bp, P. troglodytes
ggaacccagcaaggcc

SEQ ID NO: 250925 - DNA, 17 bp, P. troglodytes
ggaacccaggaggtgga

SEQ ID NO: 250926 - DNA, 17 bp, P. troglodytes
ggaacccgggaggcaga

SEQ ID NO: 250927 - DNA, 16 bp, P. troglodytes
ggaaccctgtctctac

SEQ ID NO: 250928 - DNA, 16 bp, P. troglodytes
ggaacctccacctcct

SEQ ID NO: 250929 - DNA, 16 bp, P. troglodytes
ggaacctgctgccttg

SEQ ID NO: 250930 - DNA, 16 bp, P. troglodytes
ggaacctgggaggcag

SEQ ID NO: 250931 - DNA, 16 bp, P. troglodytes
ggaacgcttttacatt

SEQ ID NO: 250932 - DNA, 16 bp, P. troglodytes
ggaactaatagagtga

SEQ ID NO: 250933 - DNA, 16 bp, P. troglodytes
ggaactacaggtgcac

SEQ ID NO: 250934 - DNA, 16 bp, P. troglodytes
ggaactcctaacctca

SEQ ID NO: 250935 - DNA, 16 bp, P. troglodytes
ggaactcctctttata

SEQ ID NO: 250936 - DNA, 16 bp, P. troglodytes
ggaactggaggccact

SEQ ID NO: 250937 - DNA, 16 bp, P. troglodytes
ggaactggaggttatt

SEQ ID NO: 250938 - DNA, 16 bp, P. troglodytes
ggaactggagtaaaga

SEQ ID NO: 250939 - DNA, 16 bp, P. troglodytes
ggaactggcagcccag

SEQ ID NO: 250940 - DNA, 16 bp, P. troglodytes
ggaactgtgcaaccca

SEQ ID NO: 250941 - DNA, 16 bp, P. troglodytes
ggaacttcctagagaa

SEQ ID NO: 250942 - DNA, 16 bp, P. troglodytes
ggaacttgttggaaat

SEQ ID NO: 250943 - DNA, 16 bp, P. troglodytes
ggaacttttttctttt

SEQ ID NO: 250944 - DNA, 16 bp, P. troglodytes
ggaagaaaaaacattt

SEQ ID NO: 250945 - DNA, 16 bp, P. troglodytes
ggaagaaacaggcagc

SEQ ID NO: 250946 - DNA, 16 bp, P. troglodytes
ggaagaaactccaaac

SEQ ID NO: 250947 - DNA, 16 bp, P. troglodytes
ggaagaaagaattcag

SEQ ID NO: 250948 - DNA, 16 bp, P. troglodytes
ggaagaaagggtgtca

SEQ ID NO: 250949 - DNA, 16 bp, P. troglodytes
ggaagaaataaaaact

SEQ ID NO: 250950 - DNA, 16 bp, P. troglodytes
ggaagaaatgactgca

SEQ ID NO: 250951 - DNA, 16 bp, P. troglodytes
ggaagaacattccagg

SEQ ID NO: 250952 - DNA, 16 bp, P. troglodytes
ggaagaagacaagaat

SEQ ID NO: 250953 - DNA, 16 bp, P. troglodytes
ggaagaagatgccatg

SEQ ID NO: 250954 - DNA, 16 bp, P. troglodytes
ggaagaagcaggcagc

SEQ ID NO: 250955 - DNA, 16 bp, P. troglodytes
ggaagaagctgaatcc

SEQ ID NO: 250956 - DNA, 16 bp, P. troglodytes
ggaagaagtaaaactg

SEQ ID NO: 250957 - DNA, 16 bp, P. troglodytes
ggaagaatatcacagg

SEQ ID NO: 250958 - DNA, 16 bp, P. troglodytes
ggaagaatctgttcca

SEQ ID NO: 250959 - DNA, 16 bp, P. troglodytes
ggaagaatctgtttcc

SEQ ID NO: 250960 - DNA, 16 bp, P. troglodytes
ggaagaattgacatct

SEQ ID NO: 250961 - DNA, 16 bp, P. troglodytes
ggaagacaacttttcc

SEQ ID NO: 250962 - DNA, 16 bp, P. troglodytes
ggaagacacaaacatt

SEQ ID NO: 250963 - DNA, 16 bp, P. troglodytes
ggaagacacaaggtcc

SEQ ID NO: 250964 - DNA, 16 bp, P. troglodytes
ggaagacagacaataa

SEQ ID NO: 250965 - DNA, 16 bp, P. troglodytes
ggaagacagcatggtg

SEQ ID NO: 250966 - DNA, 16 bp, P. troglodytes
ggaagacaggaagtca

SEQ ID NO: 250967 - DNA, 16 bp, P. troglodytes
ggaagaccacagaggt

SEQ ID NO: 250968 - DNA, 16 bp, P. troglodytes
ggaagaccctgtctca

SEQ ID NO: 250969 - DNA, 16 bp, P. troglodytes
ggaagagagaagctgg

SEQ ID NO: 250970 - DNA, 16 bp, P. troglodytes
ggaagagaggaaatca

SEQ ID NO: 250971 - DNA, 16 bp, P. troglodytes
ggaagagattagcatt

SEQ ID NO: 250972 - DNA, 16 bp, P. troglodytes
ggaagagattgcagtg

SEQ ID NO: 250973 - DNA, 16 bp, P. troglodytes
ggaagagcattccagg

SEQ ID NO: 250974 - DNA, 16 bp, P. troglodytes
ggaagagctttccagg

SEQ ID NO: 250975 - DNA, 16 bp, P. troglodytes
ggaagaggaggagctg

SEQ ID NO: 250976 - DNA, 16 bp, P. troglodytes
ggaagaggcgctcctc

SEQ ID NO: 250977 - DNA, 16 bp, P. troglodytes
ggaagaggggaagtca

SEQ ID NO: 250978 - DNA, 16 bp, P. troglodytes
ggaagatctacaaagc

SEQ ID NO: 250979 - DNA, 16 bp, P. troglodytes
ggaagatgaaaaaatt

SEQ ID NO: 250980 - DNA, 16 bp, P. troglodytes
ggaagatgggagtttt

SEQ ID NO: 250981 - DNA, 16 bp, P. troglodytes
ggaagatgttggtcaa

SEQ ID NO: 250982 - DNA, 16 bp, P. troglodytes
ggaagcaaacacgtcc

SEQ ID NO: 250983 - DNA, 16 bp, P. troglodytes
ggaagcaaaggttgca

SEQ ID NO: 250984 - DNA, 16 bp, P. troglodytes
ggaagcaatccctttg

SEQ ID NO: 250985 - DNA, 16 bp, P. troglodytes
ggaagcactgaatatg

SEQ ID NO: 250986 - DNA, 16 bp, P. troglodytes
ggaagcagacagcagc

SEQ ID NO: 250987 - DNA, 16 bp, P. troglodytes
ggaagcagagacagga

SEQ ID NO: 250988 - DNA, 16 bp, P. troglodytes
ggaagcagagactggg

SEQ ID NO: 250989 - DNA, 16 bp, P. troglodytes
ggaagcagagagcaga

SEQ ID NO: 250990 - DNA, 16 bp, P. troglodytes
ggaagcagagcctgag

SEQ ID NO: 250991 - DNA, 16 bp, P. troglodytes
ggaagcagaggtttca

SEQ ID NO: 250992 - DNA, 16 bp, P. troglodytes
ggaagcagagtataaa

SEQ ID NO: 250993 - DNA, 16 bp, P. troglodytes
ggaagcaggaagacca

SEQ ID NO: 250994 - DNA, 16 bp, P. troglodytes
ggaagcagtttggaga

SEQ ID NO: 250995 - DNA, 16 bp, P. troglodytes
ggaagcattccttttg

SEQ ID NO: 250996 - DNA, 16 bp, P. troglodytes
ggaagccaaggtggaa

SEQ ID NO: 250997 - DNA, 16 bp, P. troglodytes
ggaagccaaggtgggt

SEQ ID NO: 250998 - DNA, 16 bp, P. troglodytes
ggaagccaggagtttg

SEQ ID NO: 250999 - DNA, 16 bp, P. troglodytes
ggaagccccgtctcta

SEQ ID NO: 251000 - DNA, 16 bp, P. troglodytes
ggaagccttcctggag

SEQ ID NO: 251001 - DNA, 16 bp, P. troglodytes
ggaagctacaggttac

SEQ ID NO: 251002 - DNA, 16 bp, P. troglodytes
ggaagctcaacaaaat

SEQ ID NO: 251003 - DNA, 16 bp, P. troglodytes
ggaagctcaggtggga

SEQ ID NO: 251004 - DNA, 16 bp, P. troglodytes
ggaagctccaaactgt

SEQ ID NO: 251005 - DNA, 16 bp, P. troglodytes
ggaagctctctgaacc

SEQ ID NO: 251006 - DNA, 16 bp, P. troglodytes
ggaagctgaagtgaga

SEQ ID NO: 251007 - DNA, 16 bp, P. troglodytes
ggaagctgagacagga

SEQ ID NO: 251008 - DNA, 16 bp, P. troglodytes
ggaagctgaggcagaa

SEQ ID NO: 251009 - DNA, 16 bp, P. troglodytes
ggaagctgaggcggga

SEQ ID NO: 251010 - DNA, 16 bp, P. troglodytes
ggaagctgaggctggc

SEQ ID NO: 251011 - DNA, 16 bp, P. troglodytes
ggaagctgaggtgggc

SEQ ID NO: 251012 - DNA, 16 bp, P. troglodytes
ggaagctgcagagaaa

SEQ ID NO: 251013 - DNA, 16 bp, P. troglodytes
ggaagctgcagaggaa

SEQ ID NO: 251014 - DNA, 16 bp, P. troglodytes
ggaagctgggtgaagg

SEQ ID NO: 251015 - DNA, 16 bp, P. troglodytes
ggaagctttaaaaaat

SEQ ID NO: 251016 - DNA, 16 bp, P. troglodytes
ggaaggaaatatttgc

SEQ ID NO: 251017 - DNA, 17 bp, P. troglodytes
ggaaggaactggcactt

SEQ ID NO: 251018 - DNA, 16 bp, P. troglodytes
ggaaggaatgcattcc

SEQ ID NO: 251019 - DNA, 16 bp, P. troglodytes
ggaaggacaaggcagg

SEQ ID NO: 251020 - DNA, 16 bp, P. troglodytes
ggaaggacagggagat

SEQ ID NO: 251021 - DNA, 16 bp, P. troglodytes
ggaaggagaaatgctg

SEQ ID NO: 251022 - DNA, 16 bp, P. troglodytes
ggaaggagaatggcat

SEQ ID NO: 251023 - DNA, 16 bp, P. troglodytes
ggaaggagagcatcag

SEQ ID NO: 251024 - DNA, 16 bp, P. troglodytes
ggaaggagcaaggcag

SEQ ID NO: 251025 - DNA, 16 bp, P. troglodytes
ggaaggagctggaggc

SEQ ID NO: 251026 - DNA, 16 bp, P. troglodytes
ggaaggagtcagagag

SEQ ID NO: 251027 - DNA, 16 bp, P. troglodytes
ggaaggatcacctgag

SEQ ID NO: 251028 - DNA, 16 bp, P. troglodytes
ggaaggatcatctgag

SEQ ID NO: 251029 - DNA, 16 bp, P. troglodytes
ggaaggcagctaaggc

SEQ ID NO: 251030 - DNA, 16 bp, P. troglodytes
ggaaggcagctatgct

SEQ ID NO: 251031 - DNA, 16 bp, P. troglodytes
ggaaggccaaggtggg

SEQ ID NO: 251032 - DNA, 16 bp, P. troglodytes
ggaaggccatgaagag

SEQ ID NO: 251033 - DNA, 16 bp, P. troglodytes
ggaaggccatgtgaag

SEQ ID NO: 251034 - DNA, 16 bp, P. troglodytes
ggaaggcccccacaag

SEQ ID NO: 251035 - DNA, 17 bp, P. troglodytes
ggaaggccgaggcagga

SEQ ID NO: 251036 - DNA, 16 bp, P. troglodytes
ggaaggctgaggagga

SEQ ID NO: 251037 - DNA, 16 bp, P. troglodytes
ggaaggcttcctagag

SEQ ID NO: 251038 - DNA, 16 bp, P. troglodytes
ggaaggcttctcagag

SEQ ID NO: 251039 - DNA, 16 bp, P. troglodytes
ggaagggccaggggca

SEQ ID NO: 251040 - DNA, 16 bp, P. troglodytes
ggaaggggaaactgag

SEQ ID NO: 251041 - DNA, 16 bp, P. troglodytes
ggaaggggaccccagc

SEQ ID NO: 251042 - DNA, 16 bp, P. troglodytes
ggaaggggagctggaa

SEQ ID NO: 251043 - DNA, 16 bp, P. troglodytes
ggaaggggcaaacaag

SEQ ID NO: 251044 - DNA, 16 bp, P. troglodytes
ggaaggggcctggtgg

SEQ ID NO: 251045 - DNA, 16 bp, P. troglodytes
ggaaggggctgccatg

SEQ ID NO: 251046 - DNA, 16 bp, P. troglodytes
ggaaggggtcctgttt

SEQ ID NO: 251047 - DNA, 16 bp, P. troglodytes
ggaagtaactaacttg

SEQ ID NO: 251048 - DNA, 16 bp, P. troglodytes
ggaagtaactttggaa

SEQ ID NO: 251049 - DNA, 16 bp, P. troglodytes
ggaagtaggcttcaga

SEQ ID NO: 251050 - DNA, 16 bp, P. troglodytes
ggaagtataaattata

SEQ ID NO: 251051 - DNA, 16 bp, P. troglodytes
ggaagtattcccttct

SEQ ID NO: 251052 - DNA, 16 bp, P. troglodytes
ggaagtcaaagggaaa

SEQ ID NO: 251053 - DNA, 16 bp, P. troglodytes
ggaagtcaggaacccc

SEQ ID NO: 251054 - DNA, 16 bp, P. troglodytes
ggaagtccaagataaa

SEQ ID NO: 251055 - DNA, 16 bp, P. troglodytes
ggaagtgaaggctaag

SEQ ID NO: 251056 - DNA, 16 bp, P. troglodytes
ggaagtgactttgaaa

SEQ ID NO: 251057 - DNA, 19 bp, P. troglodytes
ggaagtgaggagcgcctct

SEQ ID NO: 251058 - DNA, 16 bp, P. troglodytes
ggaagtggagtttgca

SEQ ID NO: 251059 - DNA, 16 bp, P. troglodytes
ggaagtgtgatgcttc

SEQ ID NO: 251060 - DNA, 16 bp, P. troglodytes
ggaagttcaagggcat

SEQ ID NO: 251061 - DNA, 16 bp, P. troglodytes
ggaagttcattcatga

SEQ ID NO: 251062 - DNA, 16 bp, P. troglodytes
ggaagttgccctgggt

SEQ ID NO: 251063 - DNA, 16 bp, P. troglodytes
ggaagttgctctggat

SEQ ID NO: 251064 - DNA, 16 bp, P. troglodytes
ggaagtttgagaccag

SEQ ID NO: 251065 - DNA, 16 bp, P. troglodytes
ggaataaaagacaaga

SEQ ID NO: 251066 - DNA, 16 bp, P. troglodytes
ggaataaactactgat

SEQ ID NO: 251067 - DNA, 16 bp, P. troglodytes
ggaataaagatgttct

SEQ ID NO: 251068 - DNA, 16 bp, P. troglodytes
ggaataaatgtttgca

SEQ ID NO: 251069 - DNA, 16 bp, P. troglodytes
ggaataaccagtttag

SEQ ID NO: 251070 - DNA, 16 bp, P. troglodytes
ggaataatttttttaa

SEQ ID NO: 251071 - DNA, 16 bp, P. troglodytes
ggaatactacacagca

SEQ ID NO: 251072 - DNA, 16 bp, P. troglodytes
ggaatactgctcagca

SEQ ID NO: 251073 - DNA, 16 bp, P. troglodytes
ggaatagtttcaggag

SEQ ID NO: 251074 - DNA, 16 bp, P. troglodytes
ggaatatacctcaaca

SEQ ID NO: 251075 - DNA, 16 bp, P. troglodytes
ggaatattatttggcc

SEQ ID NO: 251076 - DNA, 16 bp, P. troglodytes
ggaatatttgcattta

SEQ ID NO: 251077 - DNA, 16 bp, P. troglodytes
ggaatcaacctcagtg

SEQ ID NO: 251078 - DNA, 16 bp, P. troglodytes
ggaatcacagctcact

SEQ ID NO: 251079 - DNA, 16 bp, P. troglodytes
ggaatctagagaagca

SEQ ID NO: 251080 - DNA, 16 bp, P. troglodytes
ggaatctcactcttgt

SEQ ID NO: 251081 - DNA, 16 bp, P. troglodytes
ggaatctccatactat

SEQ ID NO: 251082 - DNA, 16 bp, P. troglodytes
ggaatctgcattttaa

SEQ ID NO: 251083 - DNA, 16 bp, P. troglodytes
ggaatctttaaaaaaa

SEQ ID NO: 251084 - DNA, 16 bp, P. troglodytes
ggaatgaaactgtaag

SEQ ID NO: 251085 - DNA, 16 bp, P. troglodytes
ggaatgaagctgcaga

SEQ ID NO: 251086 - DNA, 16 bp, P. troglodytes
ggaatgagaaattact

SEQ ID NO: 251087 - DNA, 16 bp, P. troglodytes
ggaatgatatggtttg

SEQ ID NO: 251088 - DNA, 16 bp, P. troglodytes
ggaatgcagcccagca

SEQ ID NO: 251089 - DNA, 16 bp, P. troglodytes
ggaatgcagtagcatg

SEQ ID NO: 251090 - DNA, 16 bp, P. troglodytes
ggaatgcagtggtgca

SEQ ID NO: 251091 - DNA, 16 bp, P. troglodytes
ggaatgcagtggtgcc

SEQ ID NO: 251092 - DNA, 16 bp, P. troglodytes
ggaatgcagtggtgtc

SEQ ID NO: 251093 - DNA, 16 bp, P. troglodytes
ggaatgctgtggctgg

SEQ ID NO: 251094 - DNA, 16 bp, P. troglodytes
ggaatgctgtgtcctc

SEQ ID NO: 251095 - DNA, 16 bp, P. troglodytes
ggaatgcttatatact

SEQ ID NO: 251096 - DNA, 16 bp, P. troglodytes
ggaatggaaagccaaa

SEQ ID NO: 251097 - DNA, 16 bp, P. troglodytes
ggaatgggagaaaaca

SEQ ID NO: 251098 - DNA, 16 bp, P. troglodytes
ggaatggtaccacctc

SEQ ID NO: 251099 - DNA, 16 bp, P. troglodytes
ggaatgtaaaatggta

SEQ ID NO: 251100 - DNA, 16 bp, P. troglodytes
ggaatgtttttccatc

SEQ ID NO: 251101 - DNA, 16 bp, P. troglodytes
ggaattaaagtagaaa

SEQ ID NO: 251102 - DNA, 16 bp, P. troglodytes
ggaattacaggcacca

SEQ ID NO: 251103 - DNA, 17 bp, P. troglodytes
ggaattacaggcgccca

SEQ ID NO: 251104 - DNA, 16 bp, P. troglodytes
ggaattcaaattgtcc

SEQ ID NO: 251105 - DNA, 16 bp, P. troglodytes
ggaattccagaagaag

SEQ ID NO: 251106 - DNA, 16 bp, P. troglodytes
ggaattcgagaccagc

SEQ ID NO: 251107 - DNA, 16 bp, P. troglodytes
ggaattctggaagata

SEQ ID NO: 251108 - DNA, 16 bp, P. troglodytes
ggaattctgggagcta

SEQ ID NO: 251109 - DNA, 16 bp, P. troglodytes
ggaattcttccagttt

SEQ ID NO: 251110 - DNA, 16 bp, P. troglodytes
ggaattctttgtacta

SEQ ID NO: 251111 - DNA, 16 bp, P. troglodytes
ggaattgctaggtcat

SEQ ID NO: 251112 - DNA, 16 bp, P. troglodytes
ggaattgctgagtcac

SEQ ID NO: 251113 - DNA, 16 bp, P. troglodytes
ggaattgtgtgtgtgt

SEQ ID NO: 251114 - DNA, 16 bp, P. troglodytes
ggaatttatccacttc

SEQ ID NO: 251115 - DNA, 16 bp, P. troglodytes
ggaatttatccattta

SEQ ID NO: 251116 - DNA, 16 bp, P. troglodytes
ggaatttcactcttgt

SEQ ID NO: 251117 - DNA, 16 bp, P. troglodytes
ggaatttctttctttc

SEQ ID NO: 251118 - DNA, 16 bp, P. troglodytes
ggaatttgaactcagg

SEQ ID NO: 251119 - DNA, 16 bp, P. troglodytes
ggaatttggaagaagt

SEQ ID NO: 251120 - DNA, 16 bp, P. troglodytes
ggaatttgggcaagat

SEQ ID NO: 251121 - DNA, 16 bp, P. troglodytes
ggaattttaaaaagtt

SEQ ID NO: 251122 - DNA, 16 bp, P. troglodytes
ggaattttagaccagc

SEQ ID NO: 251123 - DNA, 16 bp, P. troglodytes
ggaattttcttccttt

SEQ ID NO: 251124 - DNA, 16 bp, P. troglodytes
ggaattttctttcttt

SEQ ID NO: 251125 - DNA, 16 bp, P. troglodytes
ggaattttcttttctt

SEQ ID NO: 251126 - DNA, 16 bp, P. troglodytes
ggaattttgcagatgt

SEQ ID NO: 251127 - DNA, 16 bp, P. troglodytes
ggacaaatactatatg

SEQ ID NO: 251128 - DNA, 16 bp, P. troglodytes
ggacaactggaagcag

SEQ ID NO: 251129 - DNA, 16 bp, P. troglodytes
ggacaataagggaata

SEQ ID NO: 251130 - DNA, 45 bp, P. troglodytes
ggacaatagtggagggaaggtcagcagataaacaagtgaacaaag

SEQ ID NO: 251131 - DNA, 16 bp, P. troglodytes
ggacacaaacaaacag

SEQ ID NO: 251132 - DNA, 16 bp, P. troglodytes
ggacacacagagggga

SEQ ID NO: 251133 - DNA, 16 bp, P. troglodytes
ggacacagagacaaat

SEQ ID NO: 251134 - DNA, 16 bp, P. troglodytes
ggacacagagacatgc

SEQ ID NO: 251135 - DNA, 16 bp, P. troglodytes
ggacacagatccaaac

SEQ ID NO: 251136 - DNA, 16 bp, P. troglodytes
ggacacagccctcctc

SEQ ID NO: 251137 - DNA, 16 bp, P. troglodytes
ggacacagtgagaagg

SEQ ID NO: 251138 - DNA, 16 bp, P. troglodytes
ggacacatacagggga

SEQ ID NO: 251139 - DNA, 16 bp, P. troglodytes
ggacacattcaaacca

SEQ ID NO: 251140 - DNA, 16 bp, P. troglodytes
ggacaccagcctggcc

SEQ ID NO: 251141 - DNA, 16 bp, P. troglodytes
ggacaccagcctgggc

SEQ ID NO: 251142 - DNA, 16 bp, P. troglodytes
ggacacccaggctttt

SEQ ID NO: 251143 - DNA, 16 bp, P. troglodytes
ggacactggacaagaa

SEQ ID NO: 251144 - DNA, 16 bp, P. troglodytes
ggacagaatgagaccc

SEQ ID NO: 251145 - DNA, 16 bp, P. troglodytes
ggacagactgcctctt

SEQ ID NO: 251146 - DNA, 17 bp, P. troglodytes
ggacagagcgagactct

SEQ ID NO: 251147 - DNA, 16 bp, P. troglodytes
ggacagagctgcccaa

SEQ ID NO: 251148 - DNA, 16 bp, P. troglodytes
ggacagagggacagag

SEQ ID NO: 251149 - DNA, 16 bp, P. troglodytes
ggacagagtctcactc

SEQ ID NO: 251150 - DNA, 16 bp, P. troglodytes
ggacagatgaggggac

SEQ ID NO: 251151 - DNA, 16 bp, P. troglodytes
ggacagcaccaagaca

SEQ ID NO: 251152 - DNA, 16 bp, P. troglodytes
ggacagcaccaagcca

SEQ ID NO: 251153 - DNA, 16 bp, P. troglodytes
ggacagcatcatcctg

SEQ ID NO: 251154 - DNA, 18 bp, P. troglodytes
ggacaggaattgctcact

SEQ ID NO: 251155 - DNA, 16 bp, P. troglodytes
ggacaggagttccaga

SEQ ID NO: 251156 - DNA, 16 bp, P. troglodytes
ggacaggctggtctca

SEQ ID NO: 251157 - DNA, 16 bp, P. troglodytes
ggacagggcagggcag

SEQ ID NO: 251158 - DNA, 16 bp, P. troglodytes
ggacagggcggctggc

SEQ ID NO: 251159 - DNA, 16 bp, P. troglodytes
ggacagggtggctggc

SEQ ID NO: 251160 - DNA, 16 bp, P. troglodytes
ggacagtgctggtcta

SEQ ID NO: 251161 - DNA, 16 bp, P. troglodytes
ggacataaaaatggaa

SEQ ID NO: 251162 - DNA, 16 bp, P. troglodytes
ggacatatgttttcag

SEQ ID NO: 251163 - DNA, 16 bp, P. troglodytes
ggacatgaagagacac

SEQ ID NO: 251164 - DNA, 16 bp, P. troglodytes
ggacatgcctgtgaca

SEQ ID NO: 251165 - DNA, 16 bp, P. troglodytes
ggacatgctggcagca

SEQ ID NO: 251166 - DNA, 16 bp, P. troglodytes
ggacatggatggagct

SEQ ID NO: 251167 - DNA, 16 bp, P. troglodytes
ggacatgtggtatttg

SEQ ID NO: 251168 - DNA, 18 bp, P. troglodytes
ggacatttattagttccc

SEQ ID NO: 251169 - DNA, 16 bp, P. troglodytes
ggacattttacaaaat

SEQ ID NO: 251170 - DNA, 16 bp, P. troglodytes
ggaccaaacagattca

SEQ ID NO: 251171 - DNA, 17 bp, P. troglodytes
ggaccaacatggtgaaa

SEQ ID NO: 251172 - DNA, 16 bp, P. troglodytes
ggaccaatcagcaccc

SEQ ID NO: 251173 - DNA, 16 bp, P. troglodytes
ggaccacaggcacgca

SEQ ID NO: 251174 - DNA, 16 bp, P. troglodytes
ggaccacaggtgtgag

SEQ ID NO: 251175 - DNA, 16 bp, P. troglodytes
ggaccacaggtgtgcc

SEQ ID NO: 251176 - DNA, 16 bp, P. troglodytes
ggaccacagtggaata

SEQ ID NO: 251177 - DNA, 16 bp, P. troglodytes
ggaccagacagattta

SEQ ID NO: 251178 - DNA, 16 bp, P. troglodytes
ggaccagccccacagg

SEQ ID NO: 251179 - DNA, 16 bp, P. troglodytes
ggaccagcctggccaa

SEQ ID NO: 251180 - DNA, 17 bp, P. troglodytes
ggaccagcctgggcaac

SEQ ID NO: 251181 - DNA, 16 bp, P. troglodytes
ggaccagctggagctg

SEQ ID NO: 251182 - DNA, 16 bp, P. troglodytes
ggaccaggcccagggc

SEQ ID NO: 251183 - DNA, 16 bp, P. troglodytes
ggaccagggccctcag

SEQ ID NO: 251184 - DNA, 16 bp, P. troglodytes
ggaccaggtgggaggt

SEQ ID NO: 251185 - DNA, 18 bp, P. troglodytes
ggaccatcctggctaaca

SEQ ID NO: 251186 - DNA, 16 bp, P. troglodytes
ggacccaaagagtgag

SEQ ID NO: 251187 - DNA, 16 bp, P. troglodytes
ggacccagatggaagg

SEQ ID NO: 251188 - DNA, 16 bp, P. troglodytes
ggacccagggagggga

SEQ ID NO: 251189 - DNA, 16 bp, P. troglodytes
ggacccagggggaggt

SEQ ID NO: 251190 - DNA, 16 bp, P. troglodytes
ggacccagtggaagat

SEQ ID NO: 251191 - DNA, 16 bp, P. troglodytes
ggaccccacactcact

SEQ ID NO: 251192 - DNA, 16 bp, P. troglodytes
ggacccccagcaaacc

SEQ ID NO: 251193 - DNA, 16 bp, P. troglodytes
ggacccgggaggcaga

SEQ ID NO: 251194 - DNA, 16 bp, P. troglodytes
ggaccctaaatccaat

SEQ ID NO: 251195 - DNA, 17 bp, P. troglodytes
ggaccctgaacagaggg

SEQ ID NO: 251196 - DNA, 16 bp, P. troglodytes
ggaccctgaggccttc

SEQ ID NO: 251197 - DNA, 16 bp, P. troglodytes
ggaccctggacccagc

SEQ ID NO: 251198 - DNA, 16 bp, P. troglodytes
ggaccctgggcccagc

SEQ ID NO: 251199 - DNA, 16 bp, P. troglodytes
ggaccggctggagctg

SEQ ID NO: 251200 - DNA, 16 bp, P. troglodytes
ggacctagttaaacta

SEQ ID NO: 251201 - DNA, 16 bp, P. troglodytes
ggacctcaggtgatcc

SEQ ID NO: 251202 - DNA, 16 bp, P. troglodytes
ggacctctcagcagaa

SEQ ID NO: 251203 - DNA, 16 bp, P. troglodytes
ggacctcttcaagaag

SEQ ID NO: 251204 - DNA, 16 bp, P. troglodytes
ggacctgatgacttca

SEQ ID NO: 251205 - DNA, 16 bp, P. troglodytes
ggacctgcccccttct

SEQ ID NO: 251206 - DNA, 16 bp, P. troglodytes
ggacctggcgggaggt

SEQ ID NO: 251207 - DNA, 16 bp, P. troglodytes
ggacctggtggaagat

SEQ ID NO: 251208 - DNA, 16 bp, P. troglodytes
ggacctgttagaagga

SEQ ID NO: 251209 - DNA, 16 bp, P. troglodytes
ggacggatggatggat

SEQ ID NO: 251210 - DNA, 16 bp, P. troglodytes
ggacgtgatggctcac

SEQ ID NO: 251211 - DNA, 16 bp, P. troglodytes
ggacgtgtttgcttcc

SEQ ID NO: 251212 - DNA, 16 bp, P. troglodytes
ggactaaatgttccaa

SEQ ID NO: 251213 - DNA, 21 bp, P. troglodytes
ggactacaggcgtgtgccact

SEQ ID NO: 251214 - DNA, 16 bp, P. troglodytes
ggactacaggtgggca

SEQ ID NO: 251215 - DNA, 16 bp, P. troglodytes
ggactacaggttcatg

SEQ ID NO: 251216 - DNA, 16 bp, P. troglodytes
ggactacagttgcatg

SEQ ID NO: 251217 - DNA, 16 bp, P. troglodytes
ggactagatgatctct

SEQ ID NO: 251218 - DNA, 18 bp, P. troglodytes
ggactataggcgcctgcc

SEQ ID NO: 251219 - DNA, 16 bp, P. troglodytes
ggactcaagccatcct

SEQ ID NO: 251220 - DNA, 16 bp, P. troglodytes
ggactcagaagaagat

SEQ ID NO: 251221 - DNA, 16 bp, P. troglodytes
ggactcaggaggaaag

SEQ ID NO: 251222 - DNA, 16 bp, P. troglodytes
ggactcagttccacat

SEQ ID NO: 251223 - DNA, 16 bp, P. troglodytes
ggactccttggagaaa

SEQ ID NO: 251224 - DNA, 16 bp, P. troglodytes
ggactctcgctctgtc

SEQ ID NO: 251225 - DNA, 16 bp, P. troglodytes
ggactctgaagccaga

SEQ ID NO: 251226 - DNA, 16 bp, P. troglodytes
ggactctgtgtgtggg

SEQ ID NO: 251227 - DNA, 16 bp, P. troglodytes
ggactgaattaagaag

SEQ ID NO: 251228 - DNA, 16 bp, P. troglodytes
ggactgcaggcacgca

SEQ ID NO: 251229 - DNA, 16 bp, P. troglodytes
ggactgcagtggtgtg

SEQ ID NO: 251230 - DNA, 16 bp, P. troglodytes
ggactgctgcatttcc

SEQ ID NO: 251231 - DNA, 16 bp, P. troglodytes
ggactgctggagccca

SEQ ID NO: 251232 - DNA, 16 bp, P. troglodytes
ggactgcttgagtcca

SEQ ID NO: 251233 - DNA, 23 bp, P. troglodytes
ggactggcaggcagctccacctg

SEQ ID NO: 251234 - DNA, 16 bp, P. troglodytes
ggactggctggagcca

SEQ ID NO: 251235 - DNA, 16 bp, P. troglodytes
ggactggctggagctg

SEQ ID NO: 251236 - DNA, 16 bp, P. troglodytes
ggactgggcagaggga

SEQ ID NO: 251237 - DNA, 16 bp, P. troglodytes
ggactgggcgtggtgg

SEQ ID NO: 251238 - DNA, 16 bp, P. troglodytes
ggactggttgagccca

SEQ ID NO: 251239 - DNA, 16 bp, P. troglodytes
ggactgtactgctgcc

SEQ ID NO: 251240 - DNA, 16 bp, P. troglodytes
ggacttcaccttgtga

SEQ ID NO: 251241 - DNA, 16 bp, P. troglodytes
ggacttcaggcatgca

SEQ ID NO: 251242 - DNA, 17 bp, P. troglodytes
ggacttccagcctccag

SEQ ID NO: 251243 - DNA, 16 bp, P. troglodytes
ggacttccctgcctcc

SEQ ID NO: 251244 - DNA, 16 bp, P. troglodytes
ggacttcctgggtcga

SEQ ID NO: 251245 - DNA, 16 bp, P. troglodytes
ggacttctcagcttct

SEQ ID NO: 251246 - DNA, 16 bp, P. troglodytes
ggacttctctgcattg

SEQ ID NO: 251247 - DNA, 16 bp, P. troglodytes
ggacttcttgagccca

SEQ ID NO: 251248 - DNA, 16 bp, P. troglodytes
ggacttcttggcctcc

SEQ ID NO: 251249 - DNA, 16 bp, P. troglodytes
ggacttgacagcacca

SEQ ID NO: 251250 - DNA, 16 bp, P. troglodytes
ggacttgctttgtgaa

SEQ ID NO: 251251 - DNA, 16 bp, P. troglodytes
ggacttgggaggaaga

SEQ ID NO: 251252 - DNA, 16 bp, P. troglodytes
ggacttgggggaaaga

SEQ ID NO: 251253 - DNA, 16 bp, P. troglodytes
ggactttgcagtgagc

SEQ ID NO: 251254 - DNA, 16 bp, P. troglodytes
ggactttggggactta

SEQ ID NO: 251255 - DNA, 16 bp, P. troglodytes
ggactttttttggtgg

SEQ ID NO: 251256 - DNA, 16 bp, P. troglodytes
ggagaaaaactggaaa

SEQ ID NO: 251257 - DNA, 16 bp, P. troglodytes
ggagaaaagctgagtg

SEQ ID NO: 251258 - DNA, 16 bp, P. troglodytes
ggagaaaagggaatcc

SEQ ID NO: 251259 - DNA, 16 bp, P. troglodytes
ggagaaaataattgca

SEQ ID NO: 251260 - DNA, 16 bp, P. troglodytes
ggagaaaatacctgca

SEQ ID NO: 251261 - DNA, 16 bp, P. troglodytes
ggagaaacaaaatcct

SEQ ID NO: 251262 - DNA, 17 bp, P. troglodytes
ggagaaacaggaacact

SEQ ID NO: 251263 - DNA, 16 bp, P. troglodytes
ggagaaaccccacctc

SEQ ID NO: 251264 - DNA, 16 bp, P. troglodytes
ggagaaaccctacaag

SEQ ID NO: 251265 - DNA, 16 bp, P. troglodytes
ggagaaactctacaag

SEQ ID NO: 251266 - DNA, 16 bp, P. troglodytes
ggagaaactgaggcac

SEQ ID NO: 251267 - DNA, 16 bp, P. troglodytes
ggagaaacttccctgg

SEQ ID NO: 251268 - DNA, 16 bp, P. troglodytes
ggagaaagaacagtct

SEQ ID NO: 251269 - DNA, 16 bp, P. troglodytes
ggagaaagaggagctg

SEQ ID NO: 251270 - DNA, 16 bp, P. troglodytes
ggagaaaggcctggaa

SEQ ID NO: 251271 - DNA, 16 bp, P. troglodytes
ggagaaagtggcatga

SEQ ID NO: 251272 - DNA, 16 bp, P. troglodytes
ggagaaataactaatg

SEQ ID NO: 251273 - DNA, 16 bp, P. troglodytes
ggagaaatacaatcct

SEQ ID NO: 251274 - DNA, 16 bp, P. troglodytes
ggagaaatacttgaac

SEQ ID NO: 251275 - DNA, 16 bp, P. troglodytes
ggagaaatgaaatcct

SEQ ID NO: 251276 - DNA, 16 bp, P. troglodytes
ggagaaatgcctaatg

SEQ ID NO: 251277 - DNA, 16 bp, P. troglodytes
ggagaaattcaagcca

SEQ ID NO: 251278 - DNA, 16 bp, P. troglodytes
ggagaaattgaagctg

SEQ ID NO: 251279 - DNA, 16 bp, P. troglodytes
ggagaaattggaaacc

SEQ ID NO: 251280 - DNA, 16 bp, P. troglodytes
ggagaaatttaagcca

SEQ ID NO: 251281 - DNA, 16 bp, P. troglodytes
ggagaacaggtggtgt

SEQ ID NO: 251282 - DNA, 16 bp, P. troglodytes
ggagaacagtgtggag

SEQ ID NO: 251283 - DNA, 16 bp, P. troglodytes
ggagaacatcctggcc

SEQ ID NO: 251284 - DNA, 16 bp, P. troglodytes
ggagaaccacaaacca

SEQ ID NO: 251285 - DNA, 16 bp, P. troglodytes
ggagaacgactttgac

SEQ ID NO: 251286 - DNA, 16 bp, P. troglodytes
ggagaactgctggaac

SEQ ID NO: 251287 - DNA, 16 bp, P. troglodytes
ggagaactgtttgaac

SEQ ID NO: 251288 - DNA, 16 bp, P. troglodytes
ggagaagaatgagcaa

SEQ ID NO: 251289 - DNA, 16 bp, P. troglodytes
ggagaagacaagaaat

SEQ ID NO: 251290 - DNA, 16 bp, P. troglodytes
ggagaagacagccatc

SEQ ID NO: 251291 - DNA, 16 bp, P. troglodytes
ggagaagatgaatgtc

SEQ ID NO: 251292 - DNA, 16 bp, P. troglodytes
ggagaagatgtggaga

SEQ ID NO: 251293 - DNA, 16 bp, P. troglodytes
ggagaagccacagaca

SEQ ID NO: 251294 - DNA, 16 bp, P. troglodytes
ggagaagccaggcagc

SEQ ID NO: 251295 - DNA, 16 bp, P. troglodytes
ggagaagcctggcaga

SEQ ID NO: 251296 - DNA, 16 bp, P. troglodytes
ggagaagctgggaagg

SEQ ID NO: 251297 - DNA, 16 bp, P. troglodytes
ggagaaggaattctct

SEQ ID NO: 251298 - DNA, 16 bp, P. troglodytes
ggagaaggaggttgca

SEQ ID NO: 251299 - DNA, 16 bp, P. troglodytes
ggagaaggcagccatc

SEQ ID NO: 251300 - DNA, 16 bp, P. troglodytes
ggagaaggtcagcagg

SEQ ID NO: 251301 - DNA, 16 bp, P. troglodytes
ggagaatagcttgagg

SEQ ID NO: 251302 - DNA, 16 bp, P. troglodytes
ggagaatcacttgacc

SEQ ID NO: 251303 - DNA, 16 bp, P. troglodytes
ggagaatccctgtctc

SEQ ID NO: 251304 - DNA, 16 bp, P. troglodytes
ggagaatctgcaaagg

SEQ ID NO: 251305 - DNA, 16 bp, P. troglodytes
ggagaatgaaaagaca

SEQ ID NO: 251306 - DNA, 16 bp, P. troglodytes
ggagaatgagaccatc

SEQ ID NO: 251307 - DNA, 16 bp, P. troglodytes
ggagaatggaatggaa

SEQ ID NO: 251308 - DNA, 16 bp, P. troglodytes
ggagaatggcttaaac

SEQ ID NO: 251309 - DNA, 16 bp, P. troglodytes
ggagaatggggtatct

SEQ ID NO: 251310 - DNA, 16 bp, P. troglodytes
ggagaatggtggccct

SEQ ID NO: 251311 - DNA, 16 bp, P. troglodytes
ggagaatggtgtgaaa

SEQ ID NO: 251312 - DNA, 16 bp, P. troglodytes
ggagaatgtgtgtgtg

SEQ ID NO: 251313 - DNA, 16 bp, P. troglodytes
ggagaattgacatctt

SEQ ID NO: 251314 - DNA, 16 bp, P. troglodytes
ggagaatttcttgaat

SEQ ID NO: 251315 - DNA, 16 bp, P. troglodytes
ggagaattttttgaac

SEQ ID NO: 251316 - DNA, 16 bp, P. troglodytes
ggagaatttttttaaa

SEQ ID NO: 251317 - DNA, 16 bp, P. troglodytes
ggagacacagagacaa

SEQ ID NO: 251318 - DNA, 16 bp, P. troglodytes
ggagacagagactcca

SEQ ID NO: 251319 - DNA, 16 bp, P. troglodytes
ggagacagcccaaata

SEQ ID NO: 251320 - DNA, 16 bp, P. troglodytes
ggagacaggagaattg

SEQ ID NO: 251321 - DNA, 16 bp, P. troglodytes
ggagacagtgacagat

SEQ ID NO: 251322 - DNA, 16 bp, P. troglodytes
ggagacattggagaag

SEQ ID NO: 251323 - DNA, 16 bp, P. troglodytes
ggagacattttccctg

SEQ ID NO: 251324 - DNA, 16 bp, P. troglodytes
ggagaccaaagtggga

SEQ ID NO: 251325 - DNA, 16 bp, P. troglodytes
ggagaccaacctgggc

SEQ ID NO: 251326 - DNA, 16 bp, P. troglodytes
ggagaccagccaggcc

SEQ ID NO: 251327 - DNA, 16 bp, P. troglodytes
ggagaccagcctggga

SEQ ID NO: 251328 - DNA, 16 bp, P. troglodytes
ggagacccaaagtggg

SEQ ID NO: 251329 - DNA, 16 bp, P. troglodytes
ggagacccagagggca

SEQ ID NO: 251330 - DNA, 16 bp, P. troglodytes
ggagacccaggagagc

SEQ ID NO: 251331 - DNA, 16 bp, P. troglodytes
ggagacccaggcagga

SEQ ID NO: 251332 - DNA, 16 bp, P. troglodytes
ggagaccctaacccag

SEQ ID NO: 251333 - DNA, 16 bp, P. troglodytes
ggagaccctggagtgg

SEQ ID NO: 251334 - DNA, 16 bp, P. troglodytes
ggagaccctgtctcaa

SEQ ID NO: 251335 - DNA, 17 bp, P. troglodytes
ggagaccctgtctctac

SEQ ID NO: 251336 - DNA, 16 bp, P. troglodytes
ggagaccgagaccatc

SEQ ID NO: 251337 - DNA, 16 bp, P. troglodytes
ggagacctcacaatca

SEQ ID NO: 251338 - DNA, 16 bp, P. troglodytes
ggagacctcagaaaac

SEQ ID NO: 251339 - DNA, 16 bp, P. troglodytes
ggagacctgggttcta

SEQ ID NO: 251340 - DNA, 16 bp, P. troglodytes
ggagacggaggttgtg

SEQ ID NO: 251341 - DNA, 17 bp, P. troglodytes
ggagacggggtttcact

SEQ ID NO: 251342 - DNA, 16 bp, P. troglodytes
ggagactaaggagaca

SEQ ID NO: 251343 - DNA, 16 bp, P. troglodytes
ggagactaaggcagga

SEQ ID NO: 251344 - DNA, 16 bp, P. troglodytes
ggagactgagacagga

SEQ ID NO: 251345 - DNA, 16 bp, P. troglodytes
ggagactgagatggaa

SEQ ID NO: 251346 - DNA, 16 bp, P. troglodytes
ggagactgaggcaggt

SEQ ID NO: 251347 - DNA, 16 bp, P. troglodytes
ggagactgggaaatcc

SEQ ID NO: 251348 - DNA, 16 bp, P. troglodytes
ggagactgggaagtct

SEQ ID NO: 251349 - DNA, 16 bp, P. troglodytes
ggagagaaaaatcaaa

SEQ ID NO: 251350 - DNA, 16 bp, P. troglodytes
ggagagaaaccctatg

SEQ ID NO: 251351 - DNA, 16 bp, P. troglodytes
ggagagaaattcaagc

SEQ ID NO: 251352 - DNA, 16 bp, P. troglodytes
ggagagaagctgaggc

SEQ ID NO: 251353 - DNA, 16 bp, P. troglodytes
ggagagaatatttgca

SEQ ID NO: 251354 - DNA, 16 bp, P. troglodytes
ggagagaatcaccttg

SEQ ID NO: 251355 - DNA, 16 bp, P. troglodytes
ggagagaatgatatta

SEQ ID NO: 251356 - DNA, 16 bp, P. troglodytes
ggagagaccaggtgga

SEQ ID NO: 251357 - DNA, 16 bp, P. troglodytes
ggagagacctggtggg

SEQ ID NO: 251358 - DNA, 16 bp, P. troglodytes
ggagagaggacacagg

SEQ ID NO: 251359 - DNA, 23 bp, P. troglodytes
ggagagataaggctcactagcca

SEQ ID NO: 251360 - DNA, 16 bp, P. troglodytes
ggagagcaatggcacg

SEQ ID NO: 251361 - DNA, 16 bp, P. troglodytes
ggagagcagcctggcc

SEQ ID NO: 251362 - DNA, 16 bp, P. troglodytes
ggagagcatcaggaag

SEQ ID NO: 251363 - DNA, 16 bp, P. troglodytes
ggagagctctggctgg

SEQ ID NO: 251364 - DNA, 16 bp, P. troglodytes
ggagaggaggctggag

SEQ ID NO: 251365 - DNA, 16 bp, P. troglodytes
ggagaggagggtctcc

SEQ ID NO: 251366 - DNA, 16 bp, P. troglodytes
ggagaggatcaagaaa

SEQ ID NO: 251367 - DNA, 16 bp, P. troglodytes
ggagaggatgcggaga

SEQ ID NO: 251368 - DNA, 16 bp, P. troglodytes
ggagaggcccatgtgg

SEQ ID NO: 251369 - DNA, 16 bp, P. troglodytes
ggagaggcctggtggg

SEQ ID NO: 251370 - DNA, 16 bp, P. troglodytes
ggagaggctgagacag

SEQ ID NO: 251371 - DNA, 16 bp, P. troglodytes
ggagaggtgggcagag

SEQ ID NO: 251372 - DNA, 16 bp, P. troglodytes
ggagataaagaccatc

SEQ ID NO: 251373 - DNA, 16 bp, P. troglodytes
ggagataattgaatca

SEQ ID NO: 251374 - DNA, 16 bp, P. troglodytes
ggagatactggtcaaa

SEQ ID NO: 251375 - DNA, 16 bp, P. troglodytes
ggagatatacctaatg

SEQ ID NO: 251376 - DNA, 16 bp, P. troglodytes
ggagatattggtcaaa

SEQ ID NO: 251377 - DNA, 16 bp, P. troglodytes
ggagatcacgccactg

SEQ ID NO: 251378 - DNA, 16 bp, P. troglodytes
ggagatcatttcggag

SEQ ID NO: 251379 - DNA, 16 bp, P. troglodytes
ggagatccaagaaccc

SEQ ID NO: 251380 - DNA, 16 bp, P. troglodytes
ggagatcctgccactg

SEQ ID NO: 251381 - DNA, 16 bp, P. troglodytes
ggagatgaaatcacag

SEQ ID NO: 251382 - DNA, 16 bp, P. troglodytes
ggagatgaagaaactg

SEQ ID NO: 251383 - DNA, 16 bp, P. troglodytes
ggagatgaagaccatc

SEQ ID NO: 251384 - DNA, 16 bp, P. troglodytes
ggagatgaatttgaga

SEQ ID NO: 251385 - DNA, 16 bp, P. troglodytes
ggagatgacatttgag

SEQ ID NO: 251386 - DNA, 16 bp, P. troglodytes
ggagatgagaccatcc

SEQ ID NO: 251387 - DNA, 16 bp, P. troglodytes
ggagatgaggcaggag

SEQ ID NO: 251388 - DNA, 16 bp, P. troglodytes
ggagatgatttttttt

SEQ ID NO: 251389 - DNA, 20 bp, P. troglodytes
ggagatgctcctcacttccc

SEQ ID NO: 251390 - DNA, 16 bp, P. troglodytes
ggagatggaagctgca

SEQ ID NO: 251391 - DNA, 16 bp, P. troglodytes
ggagatggagaccatt

SEQ ID NO: 251392 - DNA, 16 bp, P. troglodytes
ggagatggaggatgca

SEQ ID NO: 251393 - DNA, 16 bp, P. troglodytes
ggagatggaggcagag

SEQ ID NO: 251394 - DNA, 16 bp, P. troglodytes
ggagatggaggctcag

SEQ ID NO: 251395 - DNA, 16 bp, P. troglodytes
ggagatgggagtttta

SEQ ID NO: 251396 - DNA, 16 bp, P. troglodytes
ggagatggggttttgc

SEQ ID NO: 251397 - DNA, 16 bp, P. troglodytes
ggagatggtgccactg

SEQ ID NO: 251398 - DNA, 16 bp, P. troglodytes
ggagattgagatcatc

SEQ ID NO: 251399 - DNA, 16 bp, P. troglodytes
ggagattgcaatgagc

SEQ ID NO: 251400 - DNA, 16 bp, P. troglodytes
ggagattgtgtgtgtg

SEQ ID NO: 251401 - DNA, 16 bp, P. troglodytes
ggagatttctgaaaga

SEQ ID NO: 251402 - DNA, 16 bp, P. troglodytes
ggagatttctgcattt

SEQ ID NO: 251403 - DNA, 16 bp, P. troglodytes
ggagcaaaacttagaa

SEQ ID NO: 251404 - DNA, 16 bp, P. troglodytes
ggagcaaagacatgtc

SEQ ID NO: 251405 - DNA, 16 bp, P. troglodytes
ggagcacagtggcgcg

SEQ ID NO: 251406 - DNA, 16 bp, P. troglodytes
ggagcacccagattcc

SEQ ID NO: 251407 - DNA, 16 bp, P. troglodytes
ggagcacttcagattt

SEQ ID NO: 251408 - DNA, 16 bp, P. troglodytes
ggagcactttgtggcc

SEQ ID NO: 251409 - DNA, 16 bp, P. troglodytes
ggagcagagatgggag

SEQ ID NO: 251410 - DNA, 16 bp, P. troglodytes
ggagcagagtcttctc

SEQ ID NO: 251411 - DNA, 19 bp, P. troglodytes
ggagcagagtcttctctaa

SEQ ID NO: 251412 - DNA, 16 bp, P. troglodytes
ggagcagccagccggc

SEQ ID NO: 251413 - DNA, 16 bp, P. troglodytes
ggagcagctggggcag

SEQ ID NO: 251414 - DNA, 16 bp, P. troglodytes
ggagcaggaaaaataa

SEQ ID NO: 251415 - DNA, 16 bp, P. troglodytes
ggagcaggagcaagag

SEQ ID NO: 251416 - DNA, 16 bp, P. troglodytes
ggagcaggaggaagtg

SEQ ID NO: 251417 - DNA, 16 bp, P. troglodytes
ggagcaggaggccatt

SEQ ID NO: 251418 - DNA, 16 bp, P. troglodytes
ggagcaggaggcctgg

SEQ ID NO: 251419 - DNA, 16 bp, P. troglodytes
ggagcaggcatcttac

SEQ ID NO: 251420 - DNA, 16 bp, P. troglodytes
ggagcaggctctgtgc

SEQ ID NO: 251421 - DNA, 16 bp, P. troglodytes
ggagcaggctgttcag

SEQ ID NO: 251422 - DNA, 16 bp, P. troglodytes
ggagcagggggtggca

SEQ ID NO: 251423 - DNA, 16 bp, P. troglodytes
ggagcaggtgctggta

SEQ ID NO: 251424 - DNA, 16 bp, P. troglodytes
ggagcagtcacagagc

SEQ ID NO: 251425 - DNA, 16 bp, P. troglodytes
ggagcagtggctcatg

SEQ ID NO: 251426 - DNA, 16 bp, P. troglodytes
ggagcatctttgtggt

SEQ ID NO: 251427 - DNA, 16 bp, P. troglodytes
ggagcatttcaggttt

SEQ ID NO: 251428 - DNA, 18 bp, P. troglodytes
ggagccaagattgcgcca

SEQ ID NO: 251429 - DNA, 16 bp, P. troglodytes
ggagccaaggcaggag

SEQ ID NO: 251430 - DNA, 16 bp, P. troglodytes
ggagccaccacaccca

SEQ ID NO: 251431 - DNA, 16 bp, P. troglodytes
ggagccacctcagctc

SEQ ID NO: 251432 - DNA, 16 bp, P. troglodytes
ggagccactgtgccca

SEQ ID NO: 251433 - DNA, 16 bp, P. troglodytes
ggagccactgtgcctg

SEQ ID NO: 251434 - DNA, 16 bp, P. troglodytes
ggagccagaggccatt

SEQ ID NO: 251435 - DNA, 16 bp, P. troglodytes
ggagccagaggctgca

SEQ ID NO: 251436 - DNA, 16 bp, P. troglodytes
ggagccagctccctct

SEQ ID NO: 251437 - DNA, 16 bp, P. troglodytes
ggagccaggaagccag

SEQ ID NO: 251438 - DNA, 16 bp, P. troglodytes
ggagccaggagccagg

SEQ ID NO: 251439 - DNA, 16 bp, P. troglodytes
ggagccaggcacagtg

SEQ ID NO: 251440 - DNA, 16 bp, P. troglodytes
ggagccagggagcaga

SEQ ID NO: 251441 - DNA, 16 bp, P. troglodytes
ggagccagggtgggca

SEQ ID NO: 251442 - DNA, 16 bp, P. troglodytes
ggagcccaaggtgggc

SEQ ID NO: 251443 - DNA, 16 bp, P. troglodytes
ggagcccactgtcctg

SEQ ID NO: 251444 - DNA, 16 bp, P. troglodytes
ggagcccaggaggtgg

SEQ ID NO: 251445 - DNA, 16 bp, P. troglodytes
ggagcccaggcagaag

SEQ ID NO: 251446 - DNA, 16 bp, P. troglodytes
ggagcccagtgggagg

SEQ ID NO: 251447 - DNA, 16 bp, P. troglodytes
ggagcccattgaggcc

SEQ ID NO: 251448 - DNA, 16 bp, P. troglodytes
ggagccccacagcctg

SEQ ID NO: 251449 - DNA, 16 bp, P. troglodytes
ggagccccagatgcag

SEQ ID NO: 251450 - DNA, 16 bp, P. troglodytes
ggagcccctccgcctg

SEQ ID NO: 251451 - DNA, 17 bp, P. troglodytes
ggagcccctctgcccag

SEQ ID NO: 251452 - DNA, 16 bp, P. troglodytes
ggagccccttcctggg

SEQ ID NO: 251453 - DNA, 16 bp, P. troglodytes
ggagcccgccaccatg

SEQ ID NO: 251454 - DNA, 16 bp, P. troglodytes
ggagcccttatgaatg

SEQ ID NO: 251455 - DNA, 16 bp, P. troglodytes
ggagccgtggcagagg

SEQ ID NO: 251456 - DNA, 16 bp, P. troglodytes
ggagcctgaggcagaa

SEQ ID NO: 251457 - DNA, 16 bp, P. troglodytes
ggagcctgaggcagga

SEQ ID NO: 251458 - DNA, 16 bp, P. troglodytes
ggagcctgagtcagga

SEQ ID NO: 251459 - DNA, 17 bp, P. troglodytes
ggagcctgccaccatgc

SEQ ID NO: 251460 - DNA, 16 bp, P. troglodytes
ggagcctggagcccag

SEQ ID NO: 251461 - DNA, 16 bp, P. troglodytes
ggagcctggggtttgg

SEQ ID NO: 251462 - DNA, 16 bp, P. troglodytes
ggagcctgggtccctg

SEQ ID NO: 251463 - DNA, 16 bp, P. troglodytes
ggagcctggtgggaag

SEQ ID NO: 251464 - DNA, 16 bp, P. troglodytes
ggagcgcattgaggcc

SEQ ID NO: 251465 - DNA, 16 bp, P. troglodytes
ggagctcagaagcatc

SEQ ID NO: 251466 - DNA, 16 bp, P. troglodytes
ggagctcccagaggaa

SEQ ID NO: 251467 - DNA, 16 bp, P. troglodytes
ggagctccccaggtgc

SEQ ID NO: 251468 - DNA, 16 bp, P. troglodytes
ggagctcctgaaggaa

SEQ ID NO: 251469 - DNA, 16 bp, P. troglodytes
ggagctcgagaccaac

SEQ ID NO: 251470 - DNA, 16 bp, P. troglodytes
ggagctcgaggctgca

SEQ ID NO: 251471 - DNA, 16 bp, P. troglodytes
ggagctctatggcccc

SEQ ID NO: 251472 - DNA, 16 bp, P. troglodytes
ggagctgaaaaatttc

SEQ ID NO: 251473 - DNA, 18 bp, P. troglodytes
ggagctgaaaaccaaggc

SEQ ID NO: 251474 - DNA, 17 bp, P. troglodytes
ggagctgaaaaccacgg

SEQ ID NO: 251475 - DNA, 16 bp, P. troglodytes
ggagctgaaaaccatg

SEQ ID NO: 251476 - DNA, 16 bp, P. troglodytes
ggagctgaaagacaaa

SEQ ID NO: 251477 - DNA, 16 bp, P. troglodytes
ggagctgaacagtgag

SEQ ID NO: 251478 - DNA, 16 bp, P. troglodytes
ggagctgaagcagctg

SEQ ID NO: 251479 - DNA, 16 bp, P. troglodytes
ggagctgaggaaggag

SEQ ID NO: 251480 - DNA, 16 bp, P. troglodytes
ggagctgaggagggag

SEQ ID NO: 251481 - DNA, 16 bp, P. troglodytes
ggagctgaggcgggag

SEQ ID NO: 251482 - DNA, 16 bp, P. troglodytes
ggagctgaggctggag

SEQ ID NO: 251483 - DNA, 16 bp, P. troglodytes
ggagctgagggcagct

SEQ ID NO: 251484 - DNA, 16 bp, P. troglodytes
ggagctgaggtgggtg

SEQ ID NO: 251485 - DNA, 16 bp, P. troglodytes
ggagctgagtgaggcc

SEQ ID NO: 251486 - DNA, 16 bp, P. troglodytes
ggagctgatgttctag

SEQ ID NO: 251487 - DNA, 16 bp, P. troglodytes
ggagctgcaattcaag

SEQ ID NO: 251488 - DNA, 16 bp, P. troglodytes
ggagctgcccaagacc

SEQ ID NO: 251489 - DNA, 16 bp, P. troglodytes
ggagctgcctgcccca

SEQ ID NO: 251490 - DNA, 16 bp, P. troglodytes
ggagctgcctggagac

SEQ ID NO: 251491 - DNA, 16 bp, P. troglodytes
ggagctgctgctgctg

SEQ ID NO: 251492 - DNA, 16 bp, P. troglodytes
ggagctggaagccatc

SEQ ID NO: 251493 - DNA, 16 bp, P. troglodytes
ggagctggagacccag

SEQ ID NO: 251494 - DNA, 16 bp, P. troglodytes
ggagctggagactagc

SEQ ID NO: 251495 - DNA, 16 bp, P. troglodytes
ggagctggagctggag

SEQ ID NO: 251496 - DNA, 16 bp, P. troglodytes
ggagctggaggccact

SEQ ID NO: 251497 - DNA, 16 bp, P. troglodytes
ggagctggaggccttt

SEQ ID NO: 251498 - DNA, 16 bp, P. troglodytes
ggagctggaggttatt

SEQ ID NO: 251499 - DNA, 16 bp, P. troglodytes
ggagctggagtgcaag

SEQ ID NO: 251500 - DNA, 16 bp, P. troglodytes
ggagctggcaccattc

SEQ ID NO: 251501 - DNA, 16 bp, P. troglodytes
ggagctgggaagtcca

SEQ ID NO: 251502 - DNA, 16 bp, P. troglodytes
ggagctgggagaggag

SEQ ID NO: 251503 - DNA, 16 bp, P. troglodytes
ggagctgggagaggcc

SEQ ID NO: 251504 - DNA, 16 bp, P. troglodytes
ggagctgggagctggg

SEQ ID NO: 251505 - DNA, 16 bp, P. troglodytes
ggagctgggatttgaa

SEQ ID NO: 251506 - DNA, 16 bp, P. troglodytes
ggagctgggcctggag

SEQ ID NO: 251507 - DNA, 16 bp, P. troglodytes
ggagctggggtttgaa

SEQ ID NO: 251508 - DNA, 16 bp, P. troglodytes
ggagctggtttttttg

SEQ ID NO: 251509 - DNA, 16 bp, P. troglodytes
ggagctgtcacctcct

SEQ ID NO: 251510 - DNA, 16 bp, P. troglodytes
ggagcttacaatcatg

SEQ ID NO: 251511 - DNA, 16 bp, P. troglodytes
ggagcttatattccag

SEQ ID NO: 251512 - DNA, 16 bp, P. troglodytes
ggagcttctgagccag

SEQ ID NO: 251513 - DNA, 16 bp, P. troglodytes
ggagcttgcagtgagc

SEQ ID NO: 251514 - DNA, 16 bp, P. troglodytes
ggagcttgcagtgagt

SEQ ID NO: 251515 - DNA, 16 bp, P. troglodytes
ggagcttgcggtgagc

SEQ ID NO: 251516 - DNA, 16 bp, P. troglodytes
ggagctttatgctgaa

SEQ ID NO: 251517 - DNA, 16 bp, P. troglodytes
ggagcttttaaaaata

SEQ ID NO: 251518 - DNA, 16 bp, P. troglodytes
ggaggaaaataaaaca

SEQ ID NO: 251519 - DNA, 16 bp, P. troglodytes
ggaggaactttggaaa

SEQ ID NO: 251520 - DNA, 16 bp, P. troglodytes
ggaggaagccagctgc

SEQ ID NO: 251521 - DNA, 16 bp, P. troglodytes
ggaggaaggaaggctg

SEQ ID NO: 251522 - DNA, 16 bp, P. troglodytes
ggaggaaggagagcat

SEQ ID NO: 251523 - DNA, 16 bp, P. troglodytes
ggaggaaggagagcca

SEQ ID NO: 251524 - DNA, 16 bp, P. troglodytes
ggaggaattccagaag

SEQ ID NO: 251525 - DNA, 16 bp, P. troglodytes
ggaggacagcaccaag

SEQ ID NO: 251526 - DNA, 16 bp, P. troglodytes
ggaggacagcttgagg

SEQ ID NO: 251527 - DNA, 16 bp, P. troglodytes
ggaggacagtggctct

SEQ ID NO: 251528 - DNA, 16 bp, P. troglodytes
ggaggactcagaagaa

SEQ ID NO: 251529 - DNA, 16 bp, P. troglodytes
ggaggagaacatcaca

SEQ ID NO: 251530 - DNA, 16 bp, P. troglodytes
ggaggagaagaggctt

SEQ ID NO: 251531 - DNA, 16 bp, P. troglodytes
ggaggagacattcaaa

SEQ ID NO: 251532 - DNA, 16 bp, P. troglodytes
ggaggagcagcagcag

SEQ ID NO: 251533 - DNA, 16 bp, P. troglodytes
ggaggagcagggctgg

SEQ ID NO: 251534 - DNA, 16 bp, P. troglodytes
ggaggagcaggtggaa

SEQ ID NO: 251535 - DNA, 16 bp, P. troglodytes
ggaggagccaggggtg

SEQ ID NO: 251536 - DNA, 16 bp, P. troglodytes
ggaggagctgcccaag

SEQ ID NO: 251537 - DNA, 16 bp, P. troglodytes
ggaggagctggaggag

SEQ ID NO: 251538 - DNA, 16 bp, P. troglodytes
ggaggagctggatgga

SEQ ID NO: 251539 - DNA, 16 bp, P. troglodytes
ggaggagctgggcctg

SEQ ID NO: 251540 - DNA, 16 bp, P. troglodytes
ggaggaggaaaggcac

SEQ ID NO: 251541 - DNA, 16 bp, P. troglodytes
ggaggaggagaggctc

SEQ ID NO: 251542 - DNA, 16 bp, P. troglodytes
ggaggaggagattgca

SEQ ID NO: 251543 - DNA, 16 bp, P. troglodytes
ggaggaggaggcctgg

SEQ ID NO: 251544 - DNA, 16 bp, P. troglodytes
ggaggaggcagagctg

SEQ ID NO: 251545 - DNA, 16 bp, P. troglodytes
ggaggaggctgcagtg

SEQ ID NO: 251546 - DNA, 16 bp, P. troglodytes
ggaggagggacaggat

SEQ ID NO: 251547 - DNA, 16 bp, P. troglodytes
ggaggagggacttctc

SEQ ID NO: 251548 - DNA, 16 bp, P. troglodytes
ggaggaggggcagcca

SEQ ID NO: 251549 - DNA, 16 bp, P. troglodytes
ggaggaggtcagagag

SEQ ID NO: 251550 - DNA, 16 bp, P. troglodytes
ggaggaggtgccacac

SEQ ID NO: 251551 - DNA, 16 bp, P. troglodytes
ggaggaggtggcagtg

SEQ ID NO: 251552 - DNA, 16 bp, P. troglodytes
ggaggagtctctcctc

SEQ ID NO: 251553 - DNA, 16 bp, P. troglodytes
ggaggatatcttgagc

SEQ ID NO: 251554 - DNA, 16 bp, P. troglodytes
ggaggatcacttgagc

SEQ ID NO: 251555 - DNA, 16 bp, P. troglodytes
ggaggatccacttcca

SEQ ID NO: 251556 - DNA, 16 bp, P. troglodytes
ggaggatcgcttgatc

SEQ ID NO: 251557 - DNA, 16 bp, P. troglodytes
ggaggatctcttgagt

SEQ ID NO: 251558 - DNA, 16 bp, P. troglodytes
ggaggatgaggaacct

SEQ ID NO: 251559 - DNA, 16 bp, P. troglodytes
ggaggatgaggcaggg

SEQ ID NO: 251560 - DNA, 16 bp, P. troglodytes
ggaggatgcagtgaac

SEQ ID NO: 251561 - DNA, 16 bp, P. troglodytes
ggaggatgccttgagc

SEQ ID NO: 251562 - DNA, 16 bp, P. troglodytes
ggaggatggcttgaac

SEQ ID NO: 251563 - DNA, 16 bp, P. troglodytes
ggaggatggcttgaag

SEQ ID NO: 251564 - DNA, 16 bp, P. troglodytes
ggaggatgttgataat

SEQ ID NO: 251565 - DNA, 16 bp, P. troglodytes
ggaggattacttcagc

SEQ ID NO: 251566 - DNA, 16 bp, P. troglodytes
ggaggattccctgagc

SEQ ID NO: 251567 - DNA, 16 bp, P. troglodytes
ggaggattgtttcagc

SEQ ID NO: 251568 - DNA, 16 bp, P. troglodytes
ggaggcagaagcagga

SEQ ID NO: 251569 - DNA, 16 bp, P. troglodytes
ggaggcagaagtggca

SEQ ID NO: 251570 - DNA, 16 bp, P. troglodytes
ggaggcagaagttcca

SEQ ID NO: 251571 - DNA, 16 bp, P. troglodytes
ggaggcagagattgtg

SEQ ID NO: 251572 - DNA, 16 bp, P. troglodytes
ggaggcagagccagga

SEQ ID NO: 251573 - DNA, 16 bp, P. troglodytes
ggaggcagagcccagg

SEQ ID NO: 251574 - DNA, 16 bp, P. troglodytes
ggaggcagagctcaag

SEQ ID NO: 251575 - DNA, 16 bp, P. troglodytes
ggaggcagagctcaca

SEQ ID NO: 251576 - DNA, 16 bp, P. troglodytes
ggaggcagagctgcag

SEQ ID NO: 251577 - DNA, 16 bp, P. troglodytes
ggaggcagaggtgaga

SEQ ID NO: 251578 - DNA, 16 bp, P. troglodytes
ggaggcagaggtgcag

SEQ ID NO: 251579 - DNA, 16 bp, P. troglodytes
ggaggcagaggtggca

SEQ ID NO: 251580 - DNA, 16 bp, P. troglodytes
ggaggcagaggtgggc

SEQ ID NO: 251581 - DNA, 16 bp, P. troglodytes
ggaggcagaggtgggt

SEQ ID NO: 251582 - DNA, 16 bp, P. troglodytes
ggaggcagagttgcag

SEQ ID NO: 251583 - DNA, 16 bp, P. troglodytes
ggaggcagctggaggc

SEQ ID NO: 251584 - DNA, 16 bp, P. troglodytes
ggaggcaggaggatgg

SEQ ID NO: 251585 - DNA, 16 bp, P. troglodytes
ggaggcagggaggctg

SEQ ID NO: 251586 - DNA, 16 bp, P. troglodytes
ggaggcagggctggga

SEQ ID NO: 251587 - DNA, 16 bp, P. troglodytes
ggaggcaggtgcctgt

SEQ ID NO: 251588 - DNA, 16 bp, P. troglodytes
ggaggcaggtttgcct

SEQ ID NO: 251589 - DNA, 16 bp, P. troglodytes
ggaggcagtctgtcag

SEQ ID NO: 251590 - DNA, 16 bp, P. troglodytes
ggaggcagtggctcac

SEQ ID NO: 251591 - DNA, 16 bp, P. troglodytes
ggaggcatcaggctac

SEQ ID NO: 251592 - DNA, 16 bp, P. troglodytes
ggaggccaagaagggt

SEQ ID NO: 251593 - DNA, 16 bp, P. troglodytes
ggaggccaagacaggc

SEQ ID NO: 251594 - DNA, 16 bp, P. troglodytes
ggaggccaagcaggtg

SEQ ID NO: 251595 - DNA, 16 bp, P. troglodytes
ggaggccaaggagggc

SEQ ID NO: 251596 - DNA, 24 bp, P. troglodytes
ggaggccaaggcaggcggatcaca

SEQ ID NO: 251597 - DNA, 16 bp, P. troglodytes
ggaggccaaggcaggg

SEQ ID NO: 251598 - DNA, 16 bp, P. troglodytes
ggaggccaaggcagtc

SEQ ID NO: 251599 - DNA, 16 bp, P. troglodytes
ggaggccaaggccaag

SEQ ID NO: 251600 - DNA, 16 bp, P. troglodytes
ggaggccaaggccagc

SEQ ID NO: 251601 - DNA, 16 bp, P. troglodytes
ggaggccaaggccggg

SEQ ID NO: 251602 - DNA, 16 bp, P. troglodytes
ggaggccaaggcgggc

SEQ ID NO: 251603 - DNA, 16 bp, P. troglodytes
ggaggccaagggaaga

SEQ ID NO: 251604 - DNA, 16 bp, P. troglodytes
ggaggccaagggcagg

SEQ ID NO: 251605 - DNA, 16 bp, P. troglodytes
ggaggccaaggggggt

SEQ ID NO: 251606 - DNA, 16 bp, P. troglodytes
ggaggccaaggtgagc

SEQ ID NO: 251607 - DNA, 16 bp, P. troglodytes
ggaggccaaggtgcaa

SEQ ID NO: 251608 - DNA, 16 bp, P. troglodytes
ggaggccaaggtggat

SEQ ID NO: 251609 - DNA, 16 bp, P. troglodytes
ggaggccaaggtggcg

SEQ ID NO: 251610 - DNA, 16 bp, P. troglodytes
ggaggccaaggtgggc

SEQ ID NO: 251611 - DNA, 16 bp, P. troglodytes
ggaggccaaggtggtt

SEQ ID NO: 251612 - DNA, 16 bp, P. troglodytes
ggaggccacagtgagc

SEQ ID NO: 251613 - DNA, 16 bp, P. troglodytes
ggaggccagaagtttg

SEQ ID NO: 251614 - DNA, 16 bp, P. troglodytes
ggaggccagcctggcc

SEQ ID NO: 251615 - DNA, 16 bp, P. troglodytes
ggaggccaggaggctg

SEQ ID NO: 251616 - DNA, 16 bp, P. troglodytes
ggaggccaggcactgt

SEQ ID NO: 251617 - DNA, 16 bp, P. troglodytes
ggaggccaggcaggag

SEQ ID NO: 251618 - DNA, 16 bp, P. troglodytes
ggaggccagggtgggc

SEQ ID NO: 251619 - DNA, 16 bp, P. troglodytes
ggaggccagtgtggcc

SEQ ID NO: 251620 - DNA, 16 bp, P. troglodytes
ggaggcccaaggcagg

SEQ ID NO: 251621 - DNA, 16 bp, P. troglodytes
ggaggcccagatgggc

SEQ ID NO: 251622 - DNA, 16 bp, P. troglodytes
ggaggcccaggaggga

SEQ ID NO: 251623 - DNA, 16 bp, P. troglodytes
ggaggcccaggagggc

SEQ ID NO: 251624 - DNA, 16 bp, P. troglodytes
ggaggcccaggcaggc

SEQ ID NO: 251625 - DNA, 16 bp, P. troglodytes
ggaggcccaggtctgc

SEQ ID NO: 251626 - DNA, 16 bp, P. troglodytes
ggaggcccaggtggga

SEQ ID NO: 251627 - DNA, 16 bp, P. troglodytes
ggaggcccaggtgggc

SEQ ID NO: 251628 - DNA, 16 bp, P. troglodytes
ggaggccctggagagg

SEQ ID NO: 251629 - DNA, 16 bp, P. troglodytes
ggaggccgaaggtggg

SEQ ID NO: 251630 - DNA, 16 bp, P. troglodytes
ggaggccgagaagggt

SEQ ID NO: 251631 - DNA, 16 bp, P. troglodytes
ggaggccgagaagtcc

SEQ ID NO: 251632 - DNA, 16 bp, P. troglodytes
ggaggccgagaccggc

SEQ ID NO: 251633 - DNA, 16 bp, P. troglodytes
ggaggccgagacgggc

SEQ ID NO: 251634 - DNA, 16 bp, P. troglodytes
ggaggccgagctgggc

SEQ ID NO: 251635 - DNA, 16 bp, P. troglodytes
ggaggccgaggagagt

SEQ ID NO: 251636 - DNA, 16 bp, P. troglodytes
ggaggccgaggaggac

SEQ ID NO: 251637 - DNA, 16 bp, P. troglodytes
ggaggccgaggaggcc

SEQ ID NO: 251638 - DNA, 16 bp, P. troglodytes
ggaggccgaggcaaga

SEQ ID NO: 251639 - DNA, 16 bp, P. troglodytes
ggaggccgaggcagac

SEQ ID NO: 251640 - DNA, 16 bp, P. troglodytes
ggaggccgaggcgagc

SEQ ID NO: 251641 - DNA, 16 bp, P. troglodytes
ggaggccgaggcggtg

SEQ ID NO: 251642 - DNA, 16 bp, P. troglodytes
ggaggccgaggctggc

SEQ ID NO: 251643 - DNA, 16 bp, P. troglodytes
ggaggccgaggtgaga

SEQ ID NO: 251644 - DNA, 16 bp, P. troglodytes
ggaggccgaggtggaa

SEQ ID NO: 251645 - DNA, 16 bp, P. troglodytes
ggaggccgaggtggac

SEQ ID NO: 251646 - DNA, 16 bp, P. troglodytes
ggaggccgaggtggat

SEQ ID NO: 251647 - DNA, 16 bp, P. troglodytes
ggaggccgaggtggtc

SEQ ID NO: 251648 - DNA, 16 bp, P. troglodytes
ggaggccgaggtggtg

SEQ ID NO: 251649 - DNA, 16 bp, P. troglodytes
ggaggcctaggcggga

SEQ ID NO: 251650 - DNA, 16 bp, P. troglodytes
ggaggcctcaagaaac

SEQ ID NO: 251651 - DNA, 16 bp, P. troglodytes
ggaggcctcagagtca

SEQ ID NO: 251652 - DNA, 16 bp, P. troglodytes
ggaggcctgcctacct

SEQ ID NO: 251653 - DNA, 16 bp, P. troglodytes
ggaggcctgcctgctt

SEQ ID NO: 251654 - DNA, 16 bp, P. troglodytes
ggaggcctggcctggg

SEQ ID NO: 251655 - DNA, 16 bp, P. troglodytes
ggaggccttcctggag

SEQ ID NO: 251656 - DNA, 16 bp, P. troglodytes
ggaggcgagacatgtt

SEQ ID NO: 251657 - DNA, 17 bp, P. troglodytes
ggaggcggagattgcag

SEQ ID NO: 251658 - DNA, 20 bp, P. troglodytes
ggaggcggagcttgcagtga

SEQ ID NO: 251659 - DNA, 16 bp, P. troglodytes
ggaggcggaggcacaa

SEQ ID NO: 251660 - DNA, 16 bp, P. troglodytes
ggaggcggaggtgcag

SEQ ID NO: 251661 - DNA, 16 bp, P. troglodytes
ggaggcggaggttgca

SEQ ID NO: 251662 - DNA, 16 bp, P. troglodytes
ggaggcgggggctgca

SEQ ID NO: 251663 - DNA, 16 bp, P. troglodytes
ggaggcggtgagtgag

SEQ ID NO: 251664 - DNA, 16 bp, P. troglodytes
ggaggctaagaagtcc

SEQ ID NO: 251665 - DNA, 16 bp, P. troglodytes
ggaggctaagatagga

SEQ ID NO: 251666 - DNA, 16 bp, P. troglodytes
ggaggctaaggcagga

SEQ ID NO: 251667 - DNA, 16 bp, P. troglodytes
ggaggctaaggcaggg

SEQ ID NO: 251668 - DNA, 16 bp, P. troglodytes
ggaggctaaggtagga

SEQ ID NO: 251669 - DNA, 16 bp, P. troglodytes
ggaggctaatgtggga

SEQ ID NO: 251670 - DNA, 16 bp, P. troglodytes
ggaggctcaggcgggt

SEQ ID NO: 251671 - DNA, 16 bp, P. troglodytes
ggaggctccaggggag

SEQ ID NO: 251672 - DNA, 16 bp, P. troglodytes
ggaggctctggggaga

SEQ ID NO: 251673 - DNA, 16 bp, P. troglodytes
ggaggctgaagacagg

SEQ ID NO: 251674 - DNA, 16 bp, P. troglodytes
ggaggctgaagagggc

SEQ ID NO: 251675 - DNA, 16 bp, P. troglodytes
ggaggctgaagcagaa

SEQ ID NO: 251676 - DNA, 16 bp, P. troglodytes
ggaggctgaagcagga

SEQ ID NO: 251677 - DNA, 16 bp, P. troglodytes
ggaggctgaagcaggc

SEQ ID NO: 251678 - DNA, 16 bp, P. troglodytes
ggaggctgaaggcggg

SEQ ID NO: 251679 - DNA, 16 bp, P. troglodytes
ggaggctgaagttgga

SEQ ID NO: 251680 - DNA, 16 bp, P. troglodytes
ggaggctgacccagga

SEQ ID NO: 251681 - DNA, 16 bp, P. troglodytes
ggaggctgacgcacga

SEQ ID NO: 251682 - DNA, 16 bp, P. troglodytes
ggaggctgacgcagga

SEQ ID NO: 251683 - DNA, 16 bp, P. troglodytes
ggaggctgagaaggaa

SEQ ID NO: 251684 - DNA, 16 bp, P. troglodytes
ggaggctgagacaaga

SEQ ID NO: 251685 - DNA, 16 bp, P. troglodytes
ggaggctgagacagaa

SEQ ID NO: 251686 - DNA, 16 bp, P. troglodytes
ggaggctgagacagag

SEQ ID NO: 251687 - DNA, 16 bp, P. troglodytes
ggaggctgagacaggg

SEQ ID NO: 251688 - DNA, 16 bp, P. troglodytes
ggaggctgagagagaa

SEQ ID NO: 251689 - DNA, 16 bp, P. troglodytes
ggaggctgagaggctg

SEQ ID NO: 251690 - DNA, 16 bp, P. troglodytes
ggaggctgagatgaaa

SEQ ID NO: 251691 - DNA, 16 bp, P. troglodytes
ggaggctgagattgca

SEQ ID NO: 251692 - DNA, 16 bp, P. troglodytes
ggaggctgagcaagag

SEQ ID NO: 251693 - DNA, 16 bp, P. troglodytes
ggaggctgagcaggag

SEQ ID NO: 251694 - DNA, 16 bp, P. troglodytes
ggaggctgagccagga

SEQ ID NO: 251695 - DNA, 16 bp, P. troglodytes
ggaggctgagccaggc

SEQ ID NO: 251696 - DNA, 16 bp, P. troglodytes
ggaggctgaggaaggg

SEQ ID NO: 251697 - DNA, 16 bp, P. troglodytes
ggaggctgaggagaat

SEQ ID NO: 251698 - DNA, 16 bp, P. troglodytes
ggaggctgaggagaga

SEQ ID NO: 251699 - DNA, 16 bp, P. troglodytes
ggaggctgaggaggaa

SEQ ID NO: 251700 - DNA, 16 bp, P. troglodytes
ggaggctgaggaggag

SEQ ID NO: 251701 - DNA, 16 bp, P. troglodytes
ggaggctgaggagggc

SEQ ID NO: 251702 - DNA, 16 bp, P. troglodytes
ggaggctgaggcaaaa

SEQ ID NO: 251703 - DNA, 16 bp, P. troglodytes
ggaggctgaggcacag

SEQ ID NO: 251704 - DNA, 16 bp, P. troglodytes
ggaggctgaggcacca

SEQ ID NO: 251705 - DNA, 16 bp, P. troglodytes
ggaggctgaggcagaa

SEQ ID NO: 251706 - DNA, 16 bp, P. troglodytes
ggaggctgaggcagag

SEQ ID NO: 251707 - DNA, 16 bp, P. troglodytes
ggaggctgaggcagca

SEQ ID NO: 251708 - DNA, 20 bp, P. troglodytes
ggaggctgaggcaggagaag

SEQ ID NO: 251709 - DNA, 17 bp, P. troglodytes
ggaggctgaggcaggcg

SEQ ID NO: 251710 - DNA, 16 bp, P. troglodytes
ggaggctgaggcaggg

SEQ ID NO: 251711 - DNA, 16 bp, P. troglodytes
ggaggctgaggcagta

SEQ ID NO: 251712 - DNA, 16 bp, P. troglodytes
ggaggctgaggcagtg

SEQ ID NO: 251713 - DNA, 16 bp, P. troglodytes
ggaggctgaggccaag

SEQ ID NO: 251714 - DNA, 16 bp, P. troglodytes
ggaggctgaggccagc

SEQ ID NO: 251715 - DNA, 16 bp, P. troglodytes
ggaggctgaggcccag

SEQ ID NO: 251716 - DNA, 16 bp, P. troglodytes
ggaggctgaggctgag

SEQ ID NO: 251717 - DNA, 16 bp, P. troglodytes
ggaggctgaggctggt

SEQ ID NO: 251718 - DNA, 16 bp, P. troglodytes
ggaggctgaggtagaa

SEQ ID NO: 251719 - DNA, 16 bp, P. troglodytes
ggaggctgaggtcagt

SEQ ID NO: 251720 - DNA, 16 bp, P. troglodytes
ggaggctgaggtggcc

SEQ ID NO: 251721 - DNA, 16 bp, P. troglodytes
ggaggctgaggttgga

SEQ ID NO: 251722 - DNA, 16 bp, P. troglodytes
ggaggctgagtgggga

SEQ ID NO: 251723 - DNA, 16 bp, P. troglodytes
ggaggctgatgaagga

SEQ ID NO: 251724 - DNA, 16 bp, P. troglodytes
ggaggctgcagcagga

SEQ ID NO: 251725 - DNA, 16 bp, P. troglodytes
ggaggctgcggcgggc

SEQ ID NO: 251726 - DNA, 16 bp, P. troglodytes
ggaggctgctgcagtg

SEQ ID NO: 251727 - DNA, 16 bp, P. troglodytes
ggaggctggaggagga

SEQ ID NO: 251728 - DNA, 16 bp, P. troglodytes
ggaggctggaggaggc

SEQ ID NO: 251729 - DNA, 16 bp, P. troglodytes
ggaggctggaggcagg

SEQ ID NO: 251730 - DNA, 16 bp, P. troglodytes
ggaggctggaggtctg

SEQ ID NO: 251731 - DNA, 16 bp, P. troglodytes
ggaggctggagtggga

SEQ ID NO: 251732 - DNA, 16 bp, P. troglodytes
ggaggctggatggctt

SEQ ID NO: 251733 - DNA, 16 bp, P. troglodytes
ggaggctgggagtctg

SEQ ID NO: 251734 - DNA, 16 bp, P. troglodytes
ggaggctgggccagga

SEQ ID NO: 251735 - DNA, 16 bp, P. troglodytes
ggaggctgggctgggc

SEQ ID NO: 251736 - DNA, 16 bp, P. troglodytes
ggaggctggggcagga

SEQ ID NO: 251737 - DNA, 16 bp, P. troglodytes
ggaggctggggctgga

SEQ ID NO: 251738 - DNA, 16 bp, P. troglodytes
ggaggctggtgcagga

SEQ ID NO: 251739 - DNA, 16 bp, P. troglodytes
ggaggctgtaccctgt

SEQ ID NO: 251740 - DNA, 16 bp, P. troglodytes
ggaggctgtagtgaac

SEQ ID NO: 251741 - DNA, 16 bp, P. troglodytes
ggaggctgtggagaaa

SEQ ID NO: 251742 - DNA, 16 bp, P. troglodytes
ggaggctgtggcagga

SEQ ID NO: 251743 - DNA, 16 bp, P. troglodytes
ggaggctgtggtgaga

SEQ ID NO: 251744 - DNA, 16 bp, P. troglodytes
ggaggctgtggtggga

SEQ ID NO: 251745 - DNA, 16 bp, P. troglodytes
ggaggcttcagggagc

SEQ ID NO: 251746 - DNA, 16 bp, P. troglodytes
ggaggcttctattcag

SEQ ID NO: 251747 - DNA, 16 bp, P. troglodytes
ggagggaaactgaggc

SEQ ID NO: 251748 - DNA, 16 bp, P. troglodytes
ggagggaagctgtacc

SEQ ID NO: 251749 - DNA, 16 bp, P. troglodytes
ggagggacctgctggg

SEQ ID NO: 251750 - DNA, 16 bp, P. troglodytes
ggagggagaggctgca

SEQ ID NO: 251751 - DNA, 16 bp, P. troglodytes
ggagggagcacatgag

SEQ ID NO: 251752 - DNA, 16 bp, P. troglodytes
ggagggagccaggcag

SEQ ID NO: 251753 - DNA, 16 bp, P. troglodytes
ggagggaggattgctt

SEQ ID NO: 251754 - DNA, 16 bp, P. troglodytes
ggagggcaccaagcca

SEQ ID NO: 251755 - DNA, 16 bp, P. troglodytes
ggagggcagcctggag

SEQ ID NO: 251756 - DNA, 16 bp, P. troglodytes
ggagggccaaggtggg

SEQ ID NO: 251757 - DNA, 16 bp, P. troglodytes
ggaggggaacaataca

SEQ ID NO: 251758 - DNA, 16 bp, P. troglodytes
ggaggggaacagcaca

SEQ ID NO: 251759 - DNA, 16 bp, P. troglodytes
ggaggggagaggtcag

SEQ ID NO: 251760 - DNA, 16 bp, P. troglodytes
ggaggggaggttgcag

SEQ ID NO: 251761 - DNA, 16 bp, P. troglodytes
ggaggggcacctgcca

SEQ ID NO: 251762 - DNA, 16 bp, P. troglodytes
ggaggggcagggcctg

SEQ ID NO: 251763 - DNA, 16 bp, P. troglodytes
ggaggggctgccgtga

SEQ ID NO: 251764 - DNA, 16 bp, P. troglodytes
ggaggggctggccccc

SEQ ID NO: 251765 - DNA, 16 bp, P. troglodytes
ggagggggagcacaca

SEQ ID NO: 251766 - DNA, 16 bp, P. troglodytes
ggagggggtttcacca

SEQ ID NO: 251767 - DNA, 16 bp, P. troglodytes
ggaggggtgggccacc

SEQ ID NO: 251768 - DNA, 16 bp, P. troglodytes
ggagggtgaggcagag

SEQ ID NO: 251769 - DNA, 16 bp, P. troglodytes
ggagggtgaggctgga

SEQ ID NO: 251770 - DNA, 16 bp, P. troglodytes
ggagggtggtgcaccc

SEQ ID NO: 251771 - DNA, 16 bp, P. troglodytes
ggaggtagagctcagg

SEQ ID NO: 251772 - DNA, 16 bp, P. troglodytes
ggaggtcaagacagga

SEQ ID NO: 251773 - DNA, 16 bp, P. troglodytes
ggaggtcaaggtagga

SEQ ID NO: 251774 - DNA, 16 bp, P. troglodytes
ggaggtcactgaatca

SEQ ID NO: 251775 - DNA, 16 bp, P. troglodytes
ggaggtcactggtgac

SEQ ID NO: 251776 - DNA, 16 bp, P. troglodytes
ggaggtcatgcctgat

SEQ ID NO: 251777 - DNA, 16 bp, P. troglodytes
ggaggtcgagactgca

SEQ ID NO: 251778 - DNA, 16 bp, P. troglodytes
ggaggtcgaggcagga

SEQ ID NO: 251779 - DNA, 16 bp, P. troglodytes
ggaggtgaaagatgtc

SEQ ID NO: 251780 - DNA, 16 bp, P. troglodytes
ggaggtgacatttgaa

SEQ ID NO: 251781 - DNA, 16 bp, P. troglodytes
ggaggtgagcagaggg

SEQ ID NO: 251782 - DNA, 16 bp, P. troglodytes
ggaggtgaggctgcag

SEQ ID NO: 251783 - DNA, 16 bp, P. troglodytes
ggaggtgaggctggag

SEQ ID NO: 251784 - DNA, 16 bp, P. troglodytes
ggaggtgaggggcacc

SEQ ID NO: 251785 - DNA, 16 bp, P. troglodytes
ggaggtgatggatatg

SEQ ID NO: 251786 - DNA, 16 bp, P. troglodytes
ggaggtgattggatca

SEQ ID NO: 251787 - DNA, 16 bp, P. troglodytes
ggaggtgcagtggcac

SEQ ID NO: 251788 - DNA, 16 bp, P. troglodytes
ggaggtgccacacact

SEQ ID NO: 251789 - DNA, 16 bp, P. troglodytes
ggaggtgccacactct

SEQ ID NO: 251790 - DNA, 16 bp, P. troglodytes
ggaggtggaagacaat

SEQ ID NO: 251791 - DNA, 16 bp, P. troglodytes
ggaggtggaagttgaa

SEQ ID NO: 251792 - DNA, 16 bp, P. troglodytes
ggaggtggacattgca

SEQ ID NO: 251793 - DNA, 16 bp, P. troglodytes
ggaggtggagcccagg

SEQ ID NO: 251794 - DNA, 16 bp, P. troglodytes
ggaggtggagctcaag

SEQ ID NO: 251795 - DNA, 17 bp, P. troglodytes
ggaggtggagcttgcac

SEQ ID NO: 251796 - DNA, 16 bp, P. troglodytes
ggaggtggaggcaggc

SEQ ID NO: 251797 - DNA, 16 bp, P. troglodytes
ggaggtggaggctgtg

SEQ ID NO: 251798 - DNA, 16 bp, P. troglodytes
ggaggtggaggtgcag

SEQ ID NO: 251799 - DNA, 16 bp, P. troglodytes
ggaggtggaggtttgc

SEQ ID NO: 251800 - DNA, 16 bp, P. troglodytes
ggaggtggagtctgca

SEQ ID NO: 251801 - DNA, 16 bp, P. troglodytes
ggaggtggcagagggt

SEQ ID NO: 251802 - DNA, 16 bp, P. troglodytes
ggaggtggctgaggcc

SEQ ID NO: 251803 - DNA, 16 bp, P. troglodytes
ggaggtgggagaatca

SEQ ID NO: 251804 - DNA, 16 bp, P. troglodytes
ggaggtgggaggcaga

SEQ ID NO: 251805 - DNA, 16 bp, P. troglodytes
ggaggtggggccctgg

SEQ ID NO: 251806 - DNA, 16 bp, P. troglodytes
ggaggtggggcctggc

SEQ ID NO: 251807 - DNA, 16 bp, P. troglodytes
ggaggtggggcctgtg

SEQ ID NO: 251808 - DNA, 16 bp, P. troglodytes
ggaggtggggttgcag

SEQ ID NO: 251809 - DNA, 16 bp, P. troglodytes
ggaggtggtgattgca

SEQ ID NO: 251810 - DNA, 16 bp, P. troglodytes
ggaggttgaagcttca

SEQ ID NO: 251811 - DNA, 16 bp, P. troglodytes
ggaggttgagccagga

SEQ ID NO: 251812 - DNA, 16 bp, P. troglodytes
ggaggttgaggctgaa

SEQ ID NO: 251813 - DNA, 16 bp, P. troglodytes
ggaggttgaggtgagc

SEQ ID NO: 251814 - DNA, 16 bp, P. troglodytes
ggaggttgagtgagcc

SEQ ID NO: 251815 - DNA, 16 bp, P. troglodytes
ggaggttgcaataagc

SEQ ID NO: 251816 - DNA, 16 bp, P. troglodytes
ggaggttgcagggagc

SEQ ID NO: 251817 - DNA, 16 bp, P. troglodytes
ggaggttgcagtaagc

SEQ ID NO: 251818 - DNA, 16 bp, P. troglodytes
ggaggttgcagtgaga

SEQ ID NO: 251819 - DNA, 20 bp, P. troglodytes
ggaggttgcagtgagctgat

SEQ ID NO: 251820 - DNA, 16 bp, P. troglodytes
ggaggttgcagtgagg

SEQ ID NO: 251821 - DNA, 16 bp, P. troglodytes
ggaggttgcagtgagt

SEQ ID NO: 251822 - DNA, 16 bp, P. troglodytes
ggaggttgccctgagc

SEQ ID NO: 251823 - DNA, 16 bp, P. troglodytes
ggaggttgccgtgagt

SEQ ID NO: 251824 - DNA, 16 bp, P. troglodytes
ggaggttgctgtgagc

SEQ ID NO: 251825 - DNA, 16 bp, P. troglodytes
ggaggttgtagtgagg

SEQ ID NO: 251826 - DNA, 16 bp, P. troglodytes
ggaggttgtgctgagc

SEQ ID NO: 251827 - DNA, 16 bp, P. troglodytes
ggaggtttggccttta

SEQ ID NO: 251828 - DNA, 16 bp, P. troglodytes
ggagtaaaggtgactc

SEQ ID NO: 251829 - DNA, 16 bp, P. troglodytes
ggagtaaatgaatgaa

SEQ ID NO: 251830 - DNA, 16 bp, P. troglodytes
ggagtacaggtgcgca

SEQ ID NO: 251831 - DNA, 16 bp, P. troglodytes
ggagtacaggtgtgag

SEQ ID NO: 251832 - DNA, 16 bp, P. troglodytes
ggagtacagtggtacg

SEQ ID NO: 251833 - DNA, 16 bp, P. troglodytes
ggagtacccggctgtg

SEQ ID NO: 251834 - DNA, 16 bp, P. troglodytes
ggagtatttacaccat

SEQ ID NO: 251835 - DNA, 16 bp, P. troglodytes
ggagtcacagccctgg

SEQ ID NO: 251836 - DNA, 16 bp, P. troglodytes
ggagtcagagagagag

SEQ ID NO: 251837 - DNA, 16 bp, P. troglodytes
ggagtcagggcagagc

SEQ ID NO: 251838 - DNA, 16 bp, P. troglodytes
ggagtcatgctctgtt

SEQ ID NO: 251839 - DNA, 16 bp, P. troglodytes
ggagtcattcttgact

SEQ ID NO: 251840 - DNA, 16 bp, P. troglodytes
ggagtccccagtgtct

SEQ ID NO: 251841 - DNA, 16 bp, P. troglodytes
ggagtcctggaaccaa

SEQ ID NO: 251842 - DNA, 16 bp, P. troglodytes
ggagtctagctctgtc

SEQ ID NO: 251843 - DNA, 16 bp, P. troglodytes
ggagtctcactccgtc

SEQ ID NO: 251844 - DNA, 16 bp, P. troglodytes
ggagtctcactctctt

SEQ ID NO: 251845 - DNA, 16 bp, P. troglodytes
ggagtctcactctgta

SEQ ID NO: 251846 - DNA, 16 bp, P. troglodytes
ggagtctcactctgtc

SEQ ID NO: 251847 - DNA, 16 bp, P. troglodytes
ggagtctcactctgtt

SEQ ID NO: 251848 - DNA, 16 bp, P. troglodytes
ggagtctcactcttgt

SEQ ID NO: 251849 - DNA, 16 bp, P. troglodytes
ggagtctcactttgtc

SEQ ID NO: 251850 - DNA, 16 bp, P. troglodytes
ggagtctcattctgtc

SEQ ID NO: 251851 - DNA, 16 bp, P. troglodytes
ggagtctcccactgtc

SEQ ID NO: 251852 - DNA, 16 bp, P. troglodytes
ggagtctccctctgtc

SEQ ID NO: 251853 - DNA, 16 bp, P. troglodytes
ggagtctcgccctgtc

SEQ ID NO: 251854 - DNA, 16 bp, P. troglodytes
ggagtctcgctctatc

SEQ ID NO: 251855 - DNA, 16 bp, P. troglodytes
ggagtctcgctctgtc

SEQ ID NO: 251856 - DNA, 16 bp, P. troglodytes
ggagtctcgctctgtt

SEQ ID NO: 251857 - DNA, 16 bp, P. troglodytes
ggagtctcgctgtgtt

SEQ ID NO: 251858 - DNA, 16 bp, P. troglodytes
ggagtctcggtctgtc

SEQ ID NO: 251859 - DNA, 16 bp, P. troglodytes
ggagtctcgttctgtc

SEQ ID NO: 251860 - DNA, 16 bp, P. troglodytes
ggagtctctcactgtc

SEQ ID NO: 251861 - DNA, 16 bp, P. troglodytes
ggagtctgagactagc

SEQ ID NO: 251862 - DNA, 16 bp, P. troglodytes
ggagtctggctctgtc

SEQ ID NO: 251863 - DNA, 16 bp, P. troglodytes
ggagtctgtgtgtgtg

SEQ ID NO: 251864 - DNA, 16 bp, P. troglodytes
ggagtcttgcactgtc

SEQ ID NO: 251865 - DNA, 16 bp, P. troglodytes
ggagtcttgctccgtc

SEQ ID NO: 251866 - DNA, 16 bp, P. troglodytes
ggagtcttgctctgtc

SEQ ID NO: 251867 - DNA, 16 bp, P. troglodytes
ggagtcttgctctgtt

SEQ ID NO: 251868 - DNA, 16 bp, P. troglodytes
ggagtcttgctcttgt

SEQ ID NO: 251869 - DNA, 16 bp, P. troglodytes
ggagtcttgctgtgtt

SEQ ID NO: 251870 - DNA, 16 bp, P. troglodytes
ggagtcttggtctgtc

SEQ ID NO: 251871 - DNA, 16 bp, P. troglodytes
ggagtgaagccacaga

SEQ ID NO: 251872 - DNA, 16 bp, P. troglodytes
ggagtgactgctaatg

SEQ ID NO: 251873 - DNA, 16 bp, P. troglodytes
ggagtgactgcttaat

SEQ ID NO: 251874 - DNA, 16 bp, P. troglodytes
ggagtgagactccatc

SEQ ID NO: 251875 - DNA, 17 bp, P. troglodytes
ggagtgagactccgtct

SEQ ID NO: 251876 - DNA, 16 bp, P. troglodytes
ggagtgaggctctgtc

SEQ ID NO: 251877 - DNA, 16 bp, P. troglodytes
ggagtgatatggtttg

SEQ ID NO: 251878 - DNA, 16 bp, P. troglodytes
ggagtgcaggggtgtg

SEQ ID NO: 251879 - DNA, 16 bp, P. troglodytes
ggagtgcaggtgcaca

SEQ ID NO: 251880 - DNA, 16 bp, P. troglodytes
ggagtgcagtgctgct

SEQ ID NO: 251881 - DNA, 16 bp, P. troglodytes
ggagtgcagtggggag

SEQ ID NO: 251882 - DNA, 16 bp, P. troglodytes
ggagtgcagtggtgga

SEQ ID NO: 251883 - DNA, 18 bp, P. troglodytes
ggagtgccgtggcgcaat

SEQ ID NO: 251884 - DNA, 16 bp, P. troglodytes
ggagtggagtgcagtg

SEQ ID NO: 251885 - DNA, 16 bp, P. troglodytes
ggagtggctgtaaata

SEQ ID NO: 251886 - DNA, 16 bp, P. troglodytes
ggagtgggttcctgat

SEQ ID NO: 251887 - DNA, 16 bp, P. troglodytes
ggagtggtgagagtga

SEQ ID NO: 251888 - DNA, 21 bp, P. troglodytes
ggagtggtgatgactcttaac

SEQ ID NO: 251889 - DNA, 17 bp, P. troglodytes
ggagtgtagtggcacca

SEQ ID NO: 251890 - DNA, 16 bp, P. troglodytes
ggagtgtgaggctgca

SEQ ID NO: 251891 - DNA, 16 bp, P. troglodytes
ggagtgtgatggtgca

SEQ ID NO: 251892 - DNA, 16 bp, P. troglodytes
ggagtgtggtggcaca

SEQ ID NO: 251893 - DNA, 17 bp, P. troglodytes
ggagtgttttccaactt

SEQ ID NO: 251894 - DNA, 16 bp, P. troglodytes
ggagttacaggcaaag

SEQ ID NO: 251895 - DNA, 16 bp, P. troglodytes
ggagttagaggctgta

SEQ ID NO: 251896 - DNA, 16 bp, P. troglodytes
ggagttcaagaccatg

SEQ ID NO: 251897 - DNA, 16 bp, P. troglodytes
ggagttcaagactgcc

SEQ ID NO: 251898 - DNA, 16 bp, P. troglodytes
ggagttcaagatcaag

SEQ ID NO: 251899 - DNA, 16 bp, P. troglodytes
ggagttcaaggatgca

SEQ ID NO: 251900 - DNA, 16 bp, P. troglodytes
ggagttcatggctgca

SEQ ID NO: 251901 - DNA, 16 bp, P. troglodytes
ggagttccaggccagc

SEQ ID NO: 251902 - DNA, 16 bp, P. troglodytes
ggagttccgagaccag

SEQ ID NO: 251903 - DNA, 16 bp, P. troglodytes
ggagttctgggctgca

SEQ ID NO: 251904 - DNA, 16 bp, P. troglodytes
ggagttgaaaaatgca

SEQ ID NO: 251905 - DNA, 16 bp, P. troglodytes
ggagttggagagcagc

SEQ ID NO: 251906 - DNA, 16 bp, P. troglodytes
ggagttgttcattcct

SEQ ID NO: 251907 - DNA, 25 bp, P. troglodytes
ggagtttcaccatgttggccaggct

SEQ ID NO: 251908 - DNA, 16 bp, P. troglodytes
ggagtttcactctgtg

SEQ ID NO: 251909 - DNA, 16 bp, P. troglodytes
ggagtttcagaccagt

SEQ ID NO: 251910 - DNA, 16 bp, P. troglodytes
ggagtttcagagcagc

SEQ ID NO: 251911 - DNA, 16 bp, P. troglodytes
ggagtttccctgcaca

SEQ ID NO: 251912 - DNA, 16 bp, P. troglodytes
ggagtttctttcttct

SEQ ID NO: 251913 - DNA, 16 bp, P. troglodytes
ggagtttgacaccagc

SEQ ID NO: 251914 - DNA, 16 bp, P. troglodytes
ggagtttgagaaccag

SEQ ID NO: 251915 - DNA, 16 bp, P. troglodytes
ggagtttgaggccagc

SEQ ID NO: 251916 - DNA, 16 bp, P. troglodytes
ggagtttgcagccagc

SEQ ID NO: 251917 - DNA, 16 bp, P. troglodytes
ggagttttcactcttg

SEQ ID NO: 251918 - DNA, 16 bp, P. troglodytes
ggagttttgctctgtc

SEQ ID NO: 251919 - DNA, 16 bp, P. troglodytes
ggagtttttatttctg

SEQ ID NO: 251920 - DNA, 16 bp, P. troglodytes
ggataaaacactacaa

SEQ ID NO: 251921 - DNA, 16 bp, P. troglodytes
ggataaaattggaaat

SEQ ID NO: 251922 - DNA, 16 bp, P. troglodytes
ggataaacaaaatgtg

SEQ ID NO: 251923 - DNA, 16 bp, P. troglodytes
ggataaattactggaa

SEQ ID NO: 251924 - DNA, 23 bp, P. troglodytes
ggataaattcctcgacacataca

SEQ ID NO: 251925 - DNA, 16 bp, P. troglodytes
ggataaattcttagaa

SEQ ID NO: 251926 - DNA, 16 bp, P. troglodytes
ggataatcacttgaat

SEQ ID NO: 251927 - DNA, 16 bp, P. troglodytes
ggataatggcatccag

SEQ ID NO: 251928 - DNA, 16 bp, P. troglodytes
ggataatttatagaga

SEQ ID NO: 251929 - DNA, 16 bp, P. troglodytes
ggataatttttgtatt

SEQ ID NO: 251930 - DNA, 16 bp, P. troglodytes
ggatacaaagaaggga

SEQ ID NO: 251931 - DNA, 16 bp, P. troglodytes
ggatacagggtctcac

SEQ ID NO: 251932 - DNA, 16 bp, P. troglodytes
ggatagaactggagga

SEQ ID NO: 251933 - DNA, 18 bp, P. troglodytes
ggatagaggaagatctac

SEQ ID NO: 251934 - DNA, 16 bp, P. troglodytes
ggataggataggatag

SEQ ID NO: 251935 - DNA, 16 bp, P. troglodytes
ggatatcaacactgat

SEQ ID NO: 251936 - DNA, 16 bp, P. troglodytes
ggatatccaggagttg

SEQ ID NO: 251937 - DNA, 16 bp, P. troglodytes
ggatatcttgaagtgg

SEQ ID NO: 251938 - DNA, 16 bp, P. troglodytes
ggatatgccatatttt

SEQ ID NO: 251939 - DNA, 16 bp, P. troglodytes
ggatatggcaaaaaaa

SEQ ID NO: 251940 - DNA, 16 bp, P. troglodytes
ggatatgtgtgtgtgt

SEQ ID NO: 251941 - DNA, 20 bp, P. troglodytes
ggatattggtctaaaattct

SEQ ID NO: 251942 - DNA, 17 bp, P. troglodytes
ggatcaactgaggtcag

SEQ ID NO: 251943 - DNA, 16 bp, P. troglodytes
ggatcaatattttgca

SEQ ID NO: 251944 - DNA, 16 bp, P. troglodytes
ggatcaattgagccca

SEQ ID NO: 251945 - DNA, 16 bp, P. troglodytes
ggatcacaactcctca

SEQ ID NO: 251946 - DNA, 16 bp, P. troglodytes
ggatcacaaggccagg

SEQ ID NO: 251947 - DNA, 16 bp, P. troglodytes
ggatcacagctcactg

SEQ ID NO: 251948 - DNA, 16 bp, P. troglodytes
ggatcacaggcctgag

SEQ ID NO: 251949 - DNA, 16 bp, P. troglodytes
ggatcacaggtgcgtg

SEQ ID NO: 251950 - DNA, 16 bp, P. troglodytes
ggatcacatcacagga

SEQ ID NO: 251951 - DNA, 16 bp, P. troglodytes
ggatcacctgacgtca

SEQ ID NO: 251952 - DNA, 16 bp, P. troglodytes
ggatcacctgaggtcc

SEQ ID NO: 251953 - DNA, 16 bp, P. troglodytes
ggatcacgaggtcaac

SEQ ID NO: 251954 - DNA, 16 bp, P. troglodytes
ggatcacgaggtcaga

SEQ ID NO: 251955 - DNA, 18 bp, P. troglodytes
ggatcacgaggttaggag

SEQ ID NO: 251956 - DNA, 16 bp, P. troglodytes
ggatcactacaacctc

SEQ ID NO: 251957 - DNA, 16 bp, P. troglodytes
ggatcactgcaacctc

SEQ ID NO: 251958 - DNA, 16 bp, P. troglodytes
ggatcacttgagctca

SEQ ID NO: 251959 - DNA, 16 bp, P. troglodytes
ggatcagtcaagggaa

SEQ ID NO: 251960 - DNA, 16 bp, P. troglodytes
ggatcataggggtgga

SEQ ID NO: 251961 - DNA, 16 bp, P. troglodytes
ggatcatgcttttgat

SEQ ID NO: 251962 - DNA, 16 bp, P. troglodytes
ggatcattctttgttg

SEQ ID NO: 251963 - DNA, 16 bp, P. troglodytes
ggatccacccgccttg

SEQ ID NO: 251964 - DNA, 16 bp, P. troglodytes
ggatccactgggtgaa

SEQ ID NO: 251965 - DNA, 16 bp, P. troglodytes
ggatccagcttcattc

SEQ ID NO: 251966 - DNA, 35 bp, P. troglodytes
ggatccagtttcagctttctacatatggctagcca

SEQ ID NO: 251967 - DNA, 16 bp, P. troglodytes
ggatccatactgggga

SEQ ID NO: 251968 - DNA, 16 bp, P. troglodytes
ggatcccttccttatg

SEQ ID NO: 251969 - DNA, 16 bp, P. troglodytes
ggatcccttgagcctg

SEQ ID NO: 251970 - DNA, 26 bp, P. troglodytes
ggatcctccatatgctgaacgctggt

SEQ ID NO: 251971 - DNA, 16 bp, P. troglodytes
ggatcctgcaccaggg

SEQ ID NO: 251972 - DNA, 16 bp, P. troglodytes
ggatcctgttgatctg

SEQ ID NO: 251973 - DNA, 18 bp, P. troglodytes
ggatcctgttgatctgtg

SEQ ID NO: 251974 - DNA, 16 bp, P. troglodytes
ggatcctttaagccca

SEQ ID NO: 251975 - DNA, 16 bp, P. troglodytes
ggatcctttccccatt

SEQ ID NO: 251976 - DNA, 16 bp, P. troglodytes
ggatctaccatcctgg

SEQ ID NO: 251977 - DNA, 16 bp, P. troglodytes
ggatctcactctgtca

SEQ ID NO: 251978 - DNA, 16 bp, P. troglodytes
ggatctcactctgttg

SEQ ID NO: 251979 - DNA, 16 bp, P. troglodytes
ggatctccagcaaact

SEQ ID NO: 251980 - DNA, 16 bp, P. troglodytes
ggatctcggttcactg

SEQ ID NO: 251981 - DNA, 16 bp, P. troglodytes
ggatctctccgcagaa

SEQ ID NO: 251982 - DNA, 16 bp, P. troglodytes
ggatctcttgagcctg

SEQ ID NO: 251983 - DNA, 16 bp, P. troglodytes
ggatctgcctgcctca

SEQ ID NO: 251984 - DNA, 16 bp, P. troglodytes
ggatctgggaaaagta

SEQ ID NO: 251985 - DNA, 17 bp, P. troglodytes
ggatcttcagttgcttc

SEQ ID NO: 251986 - DNA, 16 bp, P. troglodytes
ggatcttgctctgtta

SEQ ID NO: 251987 - DNA, 16 bp, P. troglodytes
ggatcttgctgtattg

SEQ ID NO: 251988 - DNA, 16 bp, P. troglodytes
ggatcttggagaaatt

SEQ ID NO: 251989 - DNA, 16 bp, P. troglodytes
ggatctttcatgaatg

SEQ ID NO: 251990 - DNA, 16 bp, P. troglodytes
ggatgaaaaagcaaga

SEQ ID NO: 251991 - DNA, 16 bp, P. troglodytes
ggatgaaactggaagc

SEQ ID NO: 251992 - DNA, 16 bp, P. troglodytes
ggatgaaattggaaag

SEQ ID NO: 251993 - DNA, 17 bp, P. troglodytes
ggatgaacaagggctga

SEQ ID NO: 251994 - DNA, 16 bp, P. troglodytes
ggatgaagaaaatgtg

SEQ ID NO: 251995 - DNA, 16 bp, P. troglodytes
ggatgaagccaacctg

SEQ ID NO: 251996 - DNA, 16 bp, P. troglodytes
ggatgaagctggaagt

SEQ ID NO: 251997 - DNA, 16 bp, P. troglodytes
ggatgaagctggaggt

SEQ ID NO: 251998 - DNA, 16 bp, P. troglodytes
ggatgaaggtggaaac

SEQ ID NO: 251999 - DNA, 16 bp, P. troglodytes
ggatgaagttaaagtg

SEQ ID NO: 252000 - DNA, 16 bp, P. troglodytes
ggatgaatctggaaac

SEQ ID NO: 252001 - DNA, 16 bp, P. troglodytes
ggatgaatttcaaaat

SEQ ID NO: 252002 - DNA, 16 bp, P. troglodytes
ggatgaatttttaaaa

SEQ ID NO: 252003 - DNA, 16 bp, P. troglodytes
ggatgacaggcatgag

SEQ ID NO: 252004 - DNA, 16 bp, P. troglodytes
ggatgagaaggacctc

SEQ ID NO: 252005 - DNA, 16 bp, P. troglodytes
ggatgagcaaaatgtg

SEQ ID NO: 252006 - DNA, 16 bp, P. troglodytes
ggatgagcttggagga

SEQ ID NO: 252007 - DNA, 16 bp, P. troglodytes
ggatgaggcagaagga

SEQ ID NO: 252008 - DNA, 16 bp, P. troglodytes
ggatgaggcaggagga

SEQ ID NO: 252009 - DNA, 16 bp, P. troglodytes
ggatgatagagcaaga

SEQ ID NO: 252010 - DNA, 16 bp, P. troglodytes
ggatgatctcaatctc

SEQ ID NO: 252011 - DNA, 16 bp, P. troglodytes
ggatgatgctggcttc

SEQ ID NO: 252012 - DNA, 16 bp, P. troglodytes
ggatgatgctgtcctc

SEQ ID NO: 252013 - DNA, 16 bp, P. troglodytes
ggatgatgggatcatt

SEQ ID NO: 252014 - DNA, 16 bp, P. troglodytes
ggatgattcacatccc

SEQ ID NO: 252015 - DNA, 16 bp, P. troglodytes
ggatgattgcttgagc

SEQ ID NO: 252016 - DNA, 16 bp, P. troglodytes
ggatgcaaagatgaat

SEQ ID NO: 252017 - DNA, 16 bp, P. troglodytes
ggatgcagagcaactg

SEQ ID NO: 252018 - DNA, 16 bp, P. troglodytes
ggatgcagcccacaga

SEQ ID NO: 252019 - DNA, 16 bp, P. troglodytes
ggatgcagtgatctgg

SEQ ID NO: 252020 - DNA, 16 bp, P. troglodytes
ggatgcatctcaaaat

SEQ ID NO: 252021 - DNA, 16 bp, P. troglodytes
ggatgcccagatttca

SEQ ID NO: 252022 - DNA, 16 bp, P. troglodytes
ggatgcggtgagggag

SEQ ID NO: 252023 - DNA, 16 bp, P. troglodytes
ggatgctataacaaaa

SEQ ID NO: 252024 - DNA, 16 bp, P. troglodytes
ggatgctcaagtctct

SEQ ID NO: 252025 - DNA, 16 bp, P. troglodytes
ggatggaaaaagacat

SEQ ID NO: 252026 - DNA, 16 bp, P. troglodytes
ggatggaactgaagga

SEQ ID NO: 252027 - DNA, 16 bp, P. troglodytes
ggatggaattagagac

SEQ ID NO: 252028 - DNA, 16 bp, P. troglodytes
ggatggagctgaaagc

SEQ ID NO: 252029 - DNA, 16 bp, P. troglodytes
ggatggagctggatgc

SEQ ID NO: 252030 - DNA, 16 bp, P. troglodytes
ggatggagtacagtgg

SEQ ID NO: 252031 - DNA, 17 bp, P. troglodytes
ggatggagtctcactct

SEQ ID NO: 252032 - DNA, 16 bp, P. troglodytes
ggatggagtgcaatgg

SEQ ID NO: 252033 - DNA, 16 bp, P. troglodytes
ggatggagtgcagtgg

SEQ ID NO: 252034 - DNA, 16 bp, P. troglodytes
ggatggataccccatt

SEQ ID NO: 252035 - DNA, 16 bp, P. troglodytes
ggatggatgaatgaag

SEQ ID NO: 252036 - DNA, 16 bp, P. troglodytes
ggatggatggaatgga

SEQ ID NO: 252037 - DNA, 16 bp, P. troglodytes
ggatggcagcagacaa

SEQ ID NO: 252038 - DNA, 16 bp, P. troglodytes
ggatggctcacgcctg

SEQ ID NO: 252039 - DNA, 16 bp, P. troglodytes
ggatggctcatgcctg

SEQ ID NO: 252040 - DNA, 16 bp, P. troglodytes
ggatggctggttcaaa

SEQ ID NO: 252041 - DNA, 16 bp, P. troglodytes
ggatggcttaagcctg

SEQ ID NO: 252042 - DNA, 16 bp, P. troglodytes
ggatggcttccctggg

SEQ ID NO: 252043 - DNA, 16 bp, P. troglodytes
ggatgggagaaatagg

SEQ ID NO: 252044 - DNA, 16 bp, P. troglodytes
ggatggggtggctgcc

SEQ ID NO: 252045 - DNA, 21 bp, P. troglodytes
ggatggggttttgccatgttg

SEQ ID NO: 252046 - DNA, 16 bp, P. troglodytes
ggatggtaccagctcc

SEQ ID NO: 252047 - DNA, 16 bp, P. troglodytes
ggatggtattgaatct

SEQ ID NO: 252048 - DNA, 16 bp, P. troglodytes
ggatggtattgatctc

SEQ ID NO: 252049 - DNA, 16 bp, P. troglodytes
ggatggtgctggcctc

SEQ ID NO: 252050 - DNA, 16 bp, P. troglodytes
ggatgtagagaaaaag

SEQ ID NO: 252051 - DNA, 16 bp, P. troglodytes
ggatgtcacttctgag

SEQ ID NO: 252052 - DNA, 16 bp, P. troglodytes
ggatgtcattgaatct

SEQ ID NO: 252053 - DNA, 16 bp, P. troglodytes
ggatgtgaaggaccct

SEQ ID NO: 252054 - DNA, 16 bp, P. troglodytes
ggatgtggaaaaaagg

SEQ ID NO: 252055 - DNA, 16 bp, P. troglodytes
ggatgtggagaaatat

SEQ ID NO: 252056 - DNA, 16 bp, P. troglodytes
ggatgtggagcagcag

SEQ ID NO: 252057 - DNA, 16 bp, P. troglodytes
ggatgtggaggttgca

SEQ ID NO: 252058 - DNA, 16 bp, P. troglodytes
ggatgtggatgaagct

SEQ ID NO: 252059 - DNA, 16 bp, P. troglodytes
ggatgtggctgtgttc

SEQ ID NO: 252060 - DNA, 16 bp, P. troglodytes
ggatgtggtgaaaaga

SEQ ID NO: 252061 - DNA, 16 bp, P. troglodytes
ggatgttcaagtccct

SEQ ID NO: 252062 - DNA, 16 bp, P. troglodytes
ggatgttgattttaga

SEQ ID NO: 252063 - DNA, 16 bp, P. troglodytes
ggatgttggattttgt

SEQ ID NO: 252064 - DNA, 16 bp, P. troglodytes
ggatgtttctggaaga

SEQ ID NO: 252065 - DNA, 16 bp, P. troglodytes
ggattaaaaaaacaag

SEQ ID NO: 252066 - DNA, 16 bp, P. troglodytes
ggattaaaaacctaaa

SEQ ID NO: 252067 - DNA, 16 bp, P. troglodytes
ggattaaagaagaaat

SEQ ID NO: 252068 - DNA, 16 bp, P. troglodytes
ggattaaagatttaaa

SEQ ID NO: 252069 - DNA, 16 bp, P. troglodytes
ggattaagtgagatga

SEQ ID NO: 252070 - DNA, 16 bp, P. troglodytes
ggattacaattcagat

SEQ ID NO: 252071 - DNA, 16 bp, P. troglodytes
ggattacagaaatgag

SEQ ID NO: 252072 - DNA, 16 bp, P. troglodytes
ggattacagccactgc

SEQ ID NO: 252073 - DNA, 16 bp, P. troglodytes
ggattacaggcaccag

SEQ ID NO: 252074 - DNA, 16 bp, P. troglodytes
ggattacaggcactgt

SEQ ID NO: 252075 - DNA, 16 bp, P. troglodytes
ggattacaggcataag

SEQ ID NO: 252076 - DNA, 16 bp, P. troglodytes
ggattacaggcattga

SEQ ID NO: 252077 - DNA, 16 bp, P. troglodytes
ggattacagtcacctg

SEQ ID NO: 252078 - DNA, 16 bp, P. troglodytes
ggattacagtgagcca

SEQ ID NO: 252079 - DNA, 16 bp, P. troglodytes
ggattacatgcacgtg

SEQ ID NO: 252080 - DNA, 16 bp, P. troglodytes
ggattaccaggcagaa

SEQ ID NO: 252081 - DNA, 19 bp, P. troglodytes
ggattatcattagttctta

SEQ ID NO: 252082 - DNA, 16 bp, P. troglodytes
ggattatcttggctat

SEQ ID NO: 252083 - DNA, 16 bp, P. troglodytes
ggattatgggaactat

SEQ ID NO: 252084 - DNA, 16 bp, P. troglodytes
ggattattacaattta

SEQ ID NO: 252085 - DNA, 16 bp, P. troglodytes
ggattattgtgaggat

SEQ ID NO: 252086 - DNA, 16 bp, P. troglodytes
ggattattttatcttt

SEQ ID NO: 252087 - DNA, 16 bp, P. troglodytes
ggattcaaatccaggc

SEQ ID NO: 252088 - DNA, 16 bp, P. troglodytes
ggattcaagttcttcc

SEQ ID NO: 252089 - DNA, 16 bp, P. troglodytes
ggattcaggacctcct

SEQ ID NO: 252090 - DNA, 16 bp, P. troglodytes
ggattcattcattcat

SEQ ID NO: 252091 - DNA, 16 bp, P. troglodytes
ggattctccatgttgg

SEQ ID NO: 252092 - DNA, 16 bp, P. troglodytes
ggattctcctctagag

SEQ ID NO: 252093 - DNA, 16 bp, P. troglodytes
ggattctccttcaatg

SEQ ID NO: 252094 - DNA, 16 bp, P. troglodytes
ggattctgcatttcta

SEQ ID NO: 252095 - DNA, 16 bp, P. troglodytes
ggattctgggaagatg

SEQ ID NO: 252096 - DNA, 16 bp, P. troglodytes
ggattcttccctagaa

SEQ ID NO: 252097 - DNA, 16 bp, P. troglodytes
ggattgaataaagaaa

SEQ ID NO: 252098 - DNA, 16 bp, P. troglodytes
ggattgaggtttggga

SEQ ID NO: 252099 - DNA, 16 bp, P. troglodytes
ggattgcaggcatgca

SEQ ID NO: 252100 - DNA, 16 bp, P. troglodytes
ggattgcaggtgcctg

SEQ ID NO: 252101 - DNA, 16 bp, P. troglodytes
ggattgcagtggcaca

SEQ ID NO: 252102 - DNA, 16 bp, P. troglodytes
ggattgctgggtcata

SEQ ID NO: 252103 - DNA, 16 bp, P. troglodytes
ggattggaagaatcaa

SEQ ID NO: 252104 - DNA, 16 bp, P. troglodytes
ggattggaatcaactt

SEQ ID NO: 252105 - DNA, 16 bp, P. troglodytes
ggattggctccaggac

SEQ ID NO: 252106 - DNA, 16 bp, P. troglodytes
ggattgtaaaatgcac

SEQ ID NO: 252107 - DNA, 16 bp, P. troglodytes
ggattgtaaaatggtg

SEQ ID NO: 252108 - DNA, 16 bp, P. troglodytes
ggattgtcttggctat

SEQ ID NO: 252109 - DNA, 16 bp, P. troglodytes
ggattgtgatattttc

SEQ ID NO: 252110 - DNA, 16 bp, P. troglodytes
ggattgtttgcttttt

SEQ ID NO: 252111 - DNA, 16 bp, P. troglodytes
ggatttaaacatattt

SEQ ID NO: 252112 - DNA, 16 bp, P. troglodytes
ggatttaattaaacta

SEQ ID NO: 252113 - DNA, 16 bp, P. troglodytes
ggatttcaccatgtta

SEQ ID NO: 252114 - DNA, 16 bp, P. troglodytes
ggatttccagtactgt

SEQ ID NO: 252115 - DNA, 16 bp, P. troglodytes
ggatttcccttcacca

SEQ ID NO: 252116 - DNA, 16 bp, P. troglodytes
ggatttctaaaattct

SEQ ID NO: 252117 - DNA, 16 bp, P. troglodytes
ggatttctcagcaagg

SEQ ID NO: 252118 - DNA, 16 bp, P. troglodytes
ggatttgaacccagct

SEQ ID NO: 252119 - DNA, 16 bp, P. troglodytes
ggatttgaacccaggt

SEQ ID NO: 252120 - DNA, 16 bp, P. troglodytes
ggatttgaagccaggt

SEQ ID NO: 252121 - DNA, 16 bp, P. troglodytes
ggatttgaatccaagc

SEQ ID NO: 252122 - DNA, 16 bp, P. troglodytes
ggatttgagaaatatt

SEQ ID NO: 252123 - DNA, 16 bp, P. troglodytes
ggatttggctgaaggc

SEQ ID NO: 252124 - DNA, 16 bp, P. troglodytes
ggatttgtgtatctaa

SEQ ID NO: 252125 - DNA, 16 bp, P. troglodytes
ggattttattgccaat

SEQ ID NO: 252126 - DNA, 16 bp, P. troglodytes
ggattttcttggcaat

SEQ ID NO: 252127 - DNA, 16 bp, P. troglodytes
ggattttcttttctat

SEQ ID NO: 252128 - DNA, 16 bp, P. troglodytes
ggattttgagtcatag

SEQ ID NO: 252129 - DNA, 16 bp, P. troglodytes
ggattttggaatattt

SEQ ID NO: 252130 - DNA, 16 bp, P. troglodytes
ggattttgggaggcca

SEQ ID NO: 252131 - DNA, 16 bp, P. troglodytes
ggatttttaaaaatta

SEQ ID NO: 252132 - DNA, 16 bp, P. troglodytes
ggatttttagcagaga

SEQ ID NO: 252133 - DNA, 16 bp, P. troglodytes
ggatttttccaatgtt

SEQ ID NO: 252134 - DNA, 16 bp, P. troglodytes
ggatttttgcatcagt

SEQ ID NO: 252135 - DNA, 16 bp, P. troglodytes
ggatttttgcatgtat

SEQ ID NO: 252136 - DNA, 16 bp, P. troglodytes
ggattttttttccatt

SEQ ID NO: 252137 - DNA, 16 bp, P. troglodytes
ggcaaaaacaggaagc

SEQ ID NO: 252138 - DNA, 16 bp, P. troglodytes
ggcaaaaacttaaaaa

SEQ ID NO: 252139 - DNA, 16 bp, P. troglodytes
ggcaaaaccatggaga

SEQ ID NO: 252140 - DNA, 16 bp, P. troglodytes
ggcaaaattgccccca

SEQ ID NO: 252141 - DNA, 16 bp, P. troglodytes
ggcaaaccaggacagt

SEQ ID NO: 252142 - DNA, 16 bp, P. troglodytes
ggcaaagaatctgaat

SEQ ID NO: 252143 - DNA, 16 bp, P. troglodytes
ggcaaagacttcatga

SEQ ID NO: 252144 - DNA, 16 bp, P. troglodytes
ggcaaagatttcatga

SEQ ID NO: 252145 - DNA, 16 bp, P. troglodytes
ggcaaagattttatga

SEQ ID NO: 252146 - DNA, 16 bp, P. troglodytes
ggcaaagcagaagcag

SEQ ID NO: 252147 - DNA, 16 bp, P. troglodytes
ggcaaagcagaatatc

SEQ ID NO: 252148 - DNA, 16 bp, P. troglodytes
ggcaaagcagcaatca

SEQ ID NO: 252149 - DNA, 16 bp, P. troglodytes
ggcaaagctggaagca

SEQ ID NO: 252150 - DNA, 16 bp, P. troglodytes
ggcaaaggaactagaa

SEQ ID NO: 252151 - DNA, 16 bp, P. troglodytes
ggcaaaggagaagtaa

SEQ ID NO: 252152 - DNA, 16 bp, P. troglodytes
ggcaaaggtgggagga

SEQ ID NO: 252153 - DNA, 16 bp, P. troglodytes
ggcaaaggtgggcaga

SEQ ID NO: 252154 - DNA, 16 bp, P. troglodytes
ggcaaagtctcaggat

SEQ ID NO: 252155 - DNA, 16 bp, P. troglodytes
ggcaaagtcttcatga

SEQ ID NO: 252156 - DNA, 16 bp, P. troglodytes
ggcaaataaataaata

SEQ ID NO: 252157 - DNA, 16 bp, P. troglodytes
ggcaaatacttcatga

SEQ ID NO: 252158 - DNA, 16 bp, P. troglodytes
ggcaaatatatatata

SEQ ID NO: 252159 - DNA, 16 bp, P. troglodytes
ggcaaatatccagaat

SEQ ID NO: 252160 - DNA, 16 bp, P. troglodytes
ggcaaatatttaggct

SEQ ID NO: 252161 - DNA, 24 bp, P. troglodytes
ggcaaatggagtgaagtgccatat

SEQ ID NO: 252162 - DNA, 16 bp, P. troglodytes
ggcaacaaaagccaga

SEQ ID NO: 252163 - DNA, 16 bp, P. troglodytes
ggcaacaaaagcgaaa

SEQ ID NO: 252164 - DNA, 16 bp, P. troglodytes
ggcaacacagagagat

SEQ ID NO: 252165 - DNA, 16 bp, P. troglodytes
ggcaacacagcaagac

SEQ ID NO: 252166 - DNA, 16 bp, P. troglodytes
ggcaacacagtacact

SEQ ID NO: 252167 - DNA, 16 bp, P. troglodytes
ggcaacacagtgagat

SEQ ID NO: 252168 - DNA, 16 bp, P. troglodytes
ggcaacagagccagac

SEQ ID NO: 252169 - DNA, 17 bp, P. troglodytes
ggcaacagagcgagact

SEQ ID NO: 252170 - DNA, 16 bp, P. troglodytes
ggcaacagagtgagaa

SEQ ID NO: 252171 - DNA, 16 bp, P. troglodytes
ggcaacagagtgagat

SEQ ID NO: 252172 - DNA, 16 bp, P. troglodytes
ggcaacagatcaagac

SEQ ID NO: 252173 - DNA, 16 bp, P. troglodytes
ggcaacaggagcgaaa

SEQ ID NO: 252174 - DNA, 16 bp, P. troglodytes
ggcaacagggagagac

SEQ ID NO: 252175 - DNA, 16 bp, P. troglodytes
ggcaacagggcgagac

SEQ ID NO: 252176 - DNA, 16 bp, P. troglodytes
ggcaacataatgaaat

SEQ ID NO: 252177 - DNA, 16 bp, P. troglodytes
ggcaacataatgagat

SEQ ID NO: 252178 - DNA, 16 bp, P. troglodytes
ggcaacatagagaccc

SEQ ID NO: 252179 - DNA, 16 bp, P. troglodytes
ggcaacatagcaagaa

SEQ ID NO: 252180 - DNA, 16 bp, P. troglodytes
ggcaacatctggagac

SEQ ID NO: 252181 - DNA, 16 bp, P. troglodytes
ggcaaccaccaatctg

SEQ ID NO: 252182 - DNA, 16 bp, P. troglodytes
ggcaaccagcagccct

SEQ ID NO: 252183 - DNA, 16 bp, P. troglodytes
ggcaacccactggggt

SEQ ID NO: 252184 - DNA, 16 bp, P. troglodytes
ggcaagaaaaagaagt

SEQ ID NO: 252185 - DNA, 16 bp, P. troglodytes
ggcaagaaatagctaa

SEQ ID NO: 252186 - DNA, 16 bp, P. troglodytes
ggcaagaattgaggct

SEQ ID NO: 252187 - DNA, 16 bp, P. troglodytes
ggcaagactcagtctc

SEQ ID NO: 252188 - DNA, 16 bp, P. troglodytes
ggcaagagcagctaaa

SEQ ID NO: 252189 - DNA, 16 bp, P. troglodytes
ggcaagagtgcaatgg

SEQ ID NO: 252190 - DNA, 16 bp, P. troglodytes
ggcaagatggctgact

SEQ ID NO: 252191 - DNA, 16 bp, P. troglodytes
ggcaagccacccaggt

SEQ ID NO: 252192 - DNA, 16 bp, P. troglodytes
ggcaagcctggtggtg

SEQ ID NO: 252193 - DNA, 16 bp, P. troglodytes
ggcaagctgaagcagg

SEQ ID NO: 252194 - DNA, 16 bp, P. troglodytes
ggcaaggatgtggagt

SEQ ID NO: 252195 - DNA, 16 bp, P. troglodytes
ggcaaggcagctccct

SEQ ID NO: 252196 - DNA, 16 bp, P. troglodytes
ggcaaggcgggcagat

SEQ ID NO: 252197 - DNA, 16 bp, P. troglodytes
ggcaagggcaagaaga

SEQ ID NO: 252198 - DNA, 16 bp, P. troglodytes
ggcaagggcaagaagg

SEQ ID NO: 252199 - DNA, 16 bp, P. troglodytes
ggcaaggtgccccctg

SEQ ID NO: 252200 - DNA, 16 bp, P. troglodytes
ggcaaggtggcacaca

SEQ ID NO: 252201 - DNA, 16 bp, P. troglodytes
ggcaaggtggtgtgca

SEQ ID NO: 252202 - DNA, 16 bp, P. troglodytes
ggcaagtctgaaattt

SEQ ID NO: 252203 - DNA, 16 bp, P. troglodytes
ggcaagtgaaagaaat

SEQ ID NO: 252204 - DNA, 16 bp, P. troglodytes
ggcaagttggtgctgg

SEQ ID NO: 252205 - DNA, 16 bp, P. troglodytes
ggcaatagagccagac

SEQ ID NO: 252206 - DNA, 16 bp, P. troglodytes
ggcaatcagacaagag

SEQ ID NO: 252207 - DNA, 16 bp, P. troglodytes
ggcaatctggctacag

SEQ ID NO: 252208 - DNA, 16 bp, P. troglodytes
ggcaatcttggctcac

SEQ ID NO: 252209 - DNA, 16 bp, P. troglodytes
ggcaatgatgatgatg

SEQ ID NO: 252210 - DNA, 16 bp, P. troglodytes
ggcaatgccattcagg

SEQ ID NO: 252211 - DNA, 16 bp, P. troglodytes
ggcaattataaataaa

SEQ ID NO: 252212 - DNA, 16 bp, P. troglodytes
ggcaattctcctgcct

SEQ ID NO: 252213 - DNA, 16 bp, P. troglodytes
ggcaatttcatcattg

SEQ ID NO: 252214 - DNA, 16 bp, P. troglodytes
ggcaatttcttaaaat

SEQ ID NO: 252215 - DNA, 16 bp, P. troglodytes
ggcaatttgtatatct

SEQ ID NO: 252216 - DNA, 16 bp, P. troglodytes
ggcacaaactgtttca

SEQ ID NO: 252217 - DNA, 16 bp, P. troglodytes
ggcacacacacacaca

SEQ ID NO: 252218 - DNA, 16 bp, P. troglodytes
ggcacacacagacaca

SEQ ID NO: 252219 - DNA, 16 bp, P. troglodytes
ggcacacaggaggcac

SEQ ID NO: 252220 - DNA, 16 bp, P. troglodytes
ggcacagagaggtgag

SEQ ID NO: 252221 - DNA, 16 bp, P. troglodytes
ggcacagcagctcacg

SEQ ID NO: 252222 - DNA, 16 bp, P. troglodytes
ggcacagccactgtgg

SEQ ID NO: 252223 - DNA, 16 bp, P. troglodytes
ggcacagtgctcacgc

SEQ ID NO: 252224 - DNA, 16 bp, P. troglodytes
ggcacagtggcgggca

SEQ ID NO: 252225 - DNA, 16 bp, P. troglodytes
ggcacagtggctcacc

SEQ ID NO: 252226 - DNA, 16 bp, P. troglodytes
ggcacagtggctcact

SEQ ID NO: 252227 - DNA, 16 bp, P. troglodytes
ggcacagtggctcagg

SEQ ID NO: 252228 - DNA, 16 bp, P. troglodytes
ggcacagtgtctcatg

SEQ ID NO: 252229 - DNA, 16 bp, P. troglodytes
ggcacatgacaccaca

SEQ ID NO: 252230 - DNA, 17 bp, P. troglodytes
ggcacatgcctgtaata

SEQ ID NO: 252231 - DNA, 16 bp, P. troglodytes
ggcaccagagaaaggc

SEQ ID NO: 252232 - DNA, 16 bp, P. troglodytes
ggcaccagcaggttca

SEQ ID NO: 252233 - DNA, 16 bp, P. troglodytes
ggcaccatctcagctc

SEQ ID NO: 252234 - DNA, 16 bp, P. troglodytes
ggcacccactctggcc

SEQ ID NO: 252235 - DNA, 16 bp, P. troglodytes
ggcacccagcaccatg

SEQ ID NO: 252236 - DNA, 16 bp, P. troglodytes
ggcacccatttttctt

SEQ ID NO: 252237 - DNA, 16 bp, P. troglodytes
ggcacccctcccccag

SEQ ID NO: 252238 - DNA, 16 bp, P. troglodytes
ggcacccgccaccacg

SEQ ID NO: 252239 - DNA, 16 bp, P. troglodytes
ggcaccgcacctggcc

SEQ ID NO: 252240 - DNA, 16 bp, P. troglodytes
ggcacctctgcccagc

SEQ ID NO: 252241 - DNA, 16 bp, P. troglodytes
ggcacctgccaacatg

SEQ ID NO: 252242 - DNA, 16 bp, P. troglodytes
ggcacctgccacaacg

SEQ ID NO: 252243 - DNA, 16 bp, P. troglodytes
ggcacctgccaccaag

SEQ ID NO: 252244 - DNA, 16 bp, P. troglodytes
ggcacctgccaccctg

SEQ ID NO: 252245 - DNA, 16 bp, P. troglodytes
ggcacctgccactgtg

SEQ ID NO: 252246 - DNA, 20 bp, P. troglodytes
ggcacctgtaatcccagctg

SEQ ID NO: 252247 - DNA, 19 bp, P. troglodytes
ggcacctgtagttccagct

SEQ ID NO: 252248 - DNA, 16 bp, P. troglodytes
ggcacggtgactcatg

SEQ ID NO: 252249 - DNA, 19 bp, P. troglodytes
ggcacggtggctcacgcct

SEQ ID NO: 252250 - DNA, 16 bp, P. troglodytes
ggcacggtggctcact

SEQ ID NO: 252251 - DNA, 16 bp, P. troglodytes
ggcacggtggcttatg

SEQ ID NO: 252252 - DNA, 16 bp, P. troglodytes
ggcacggtggcttgca

SEQ ID NO: 252253 - DNA, 16 bp, P. troglodytes
ggcacggtggtgggcg

SEQ ID NO: 252254 - DNA, 16 bp, P. troglodytes
ggcacgtgctaccaca

SEQ ID NO: 252255 - DNA, 16 bp, P. troglodytes
ggcactccaacctggg

SEQ ID NO: 252256 - DNA, 16 bp, P. troglodytes
ggcactccagcctggg

SEQ ID NO: 252257 - DNA, 16 bp, P. troglodytes
ggcactgaagaagcaa

SEQ ID NO: 252258 - DNA, 16 bp, P. troglodytes
ggcactgacctgatgc

SEQ ID NO: 252259 - DNA, 16 bp, P. troglodytes
ggcactgcctagtgga

SEQ ID NO: 252260 - DNA, 16 bp, P. troglodytes
ggcactggcctgatgc

SEQ ID NO: 252261 - DNA, 16 bp, P. troglodytes
ggcactgggattacag

SEQ ID NO: 252262 - DNA, 16 bp, P. troglodytes
ggcactgtcctaggtg

SEQ ID NO: 252263 - DNA, 16 bp, P. troglodytes
ggcactgtgccaagca

SEQ ID NO: 252264 - DNA, 16 bp, P. troglodytes
ggcactgtgctgggtg

SEQ ID NO: 252265 - DNA, 16 bp, P. troglodytes
ggcactgttctaagtg

SEQ ID NO: 252266 - DNA, 16 bp, P. troglodytes
ggcactgttctaggct

SEQ ID NO: 252267 - DNA, 16 bp, P. troglodytes
ggcactttacctctgt

SEQ ID NO: 252268 - DNA, 16 bp, P. troglodytes
ggcactttgggaggac

SEQ ID NO: 252269 - DNA, 16 bp, P. troglodytes
ggcactttgggaggcc

SEQ ID NO: 252270 - DNA, 16 bp, P. troglodytes
ggcagaaaaggccttt

SEQ ID NO: 252271 - DNA, 16 bp, P. troglodytes
ggcagaaaatcagcaa

SEQ ID NO: 252272 - DNA, 16 bp, P. troglodytes
ggcagaaacagccttc

SEQ ID NO: 252273 - DNA, 16 bp, P. troglodytes
ggcagaaaccctacaa

SEQ ID NO: 252274 - DNA, 16 bp, P. troglodytes
ggcagaaactctacaa

SEQ ID NO: 252275 - DNA, 16 bp, P. troglodytes
ggcagaaagaacagca

SEQ ID NO: 252276 - DNA, 16 bp, P. troglodytes
ggcagaaaggcaagag

SEQ ID NO: 252277 - DNA, 16 bp, P. troglodytes
ggcagaaagggaagca

SEQ ID NO: 252278 - DNA, 16 bp, P. troglodytes
ggcagaaagtgaaggg

SEQ ID NO: 252279 - DNA, 16 bp, P. troglodytes
ggcagaaataaagatc

SEQ ID NO: 252280 - DNA, 16 bp, P. troglodytes
ggcagaaatacagatg

SEQ ID NO: 252281 - DNA, 16 bp, P. troglodytes
ggcagaaatgaagatg

SEQ ID NO: 252282 - DNA, 16 bp, P. troglodytes
ggcagaactgggattt

SEQ ID NO: 252283 - DNA, 16 bp, P. troglodytes
ggcagaagaattactt

SEQ ID NO: 252284 - DNA, 16 bp, P. troglodytes
ggcagaagacagaagg

SEQ ID NO: 252285 - DNA, 16 bp, P. troglodytes
ggcagaagaggaagca

SEQ ID NO: 252286 - DNA, 16 bp, P. troglodytes
ggcagaagagggtggg

SEQ ID NO: 252287 - DNA, 16 bp, P. troglodytes
ggcagaagaggtggag

SEQ ID NO: 252288 - DNA, 16 bp, P. troglodytes
ggcagaagagtggaag

SEQ ID NO: 252289 - DNA, 16 bp, P. troglodytes
ggcagaagatgaagga

SEQ ID NO: 252290 - DNA, 16 bp, P. troglodytes
ggcagaagcagcagca

SEQ ID NO: 252291 - DNA, 16 bp, P. troglodytes
ggcagaagcaggagaa

SEQ ID NO: 252292 - DNA, 16 bp, P. troglodytes
ggcagaagcaggagga

SEQ ID NO: 252293 - DNA, 16 bp, P. troglodytes
ggcagaaggattgctt

SEQ ID NO: 252294 - DNA, 16 bp, P. troglodytes
ggcagaaggtgaaagg

SEQ ID NO: 252295 - DNA, 16 bp, P. troglodytes
ggcagaaggttgcagt

SEQ ID NO: 252296 - DNA, 16 bp, P. troglodytes
ggcagaagtggaagca

SEQ ID NO: 252297 - DNA, 16 bp, P. troglodytes
ggcagaagtgggcaga

SEQ ID NO: 252298 - DNA, 16 bp, P. troglodytes
ggcagaagttggaaca

SEQ ID NO: 252299 - DNA, 16 bp, P. troglodytes
ggcagaatgagcccag

SEQ ID NO: 252300 - DNA, 16 bp, P. troglodytes
ggcagaatggaaccaa

SEQ ID NO: 252301 - DNA, 16 bp, P. troglodytes
ggcagaatggtgtgaa

SEQ ID NO: 252302 - DNA, 16 bp, P. troglodytes
ggcagacagacacctc

SEQ ID NO: 252303 - DNA, 16 bp, P. troglodytes
ggcagacagattcctg

SEQ ID NO: 252304 - DNA, 16 bp, P. troglodytes
ggcagacatccaggcc

SEQ ID NO: 252305 - DNA, 16 bp, P. troglodytes
ggcagacattgctaat

SEQ ID NO: 252306 - DNA, 16 bp, P. troglodytes
ggcagagacagaagaa

SEQ ID NO: 252307 - DNA, 16 bp, P. troglodytes
ggcagagactggaatg

SEQ ID NO: 252308 - DNA, 16 bp, P. troglodytes
ggcagagatgggattt

SEQ ID NO: 252309 - DNA, 16 bp, P. troglodytes
ggcagagatggggttt

SEQ ID NO: 252310 - DNA, 16 bp, P. troglodytes
ggcagagattggaatg

SEQ ID NO: 252311 - DNA, 16 bp, P. troglodytes
ggcagagcaggaggaa

SEQ ID NO: 252312 - DNA, 16 bp, P. troglodytes
ggcagagcaggcagac

SEQ ID NO: 252313 - DNA, 16 bp, P. troglodytes
ggcagagccagactcc

SEQ ID NO: 252314 - DNA, 16 bp, P. troglodytes
ggcagagccaggagga

SEQ ID NO: 252315 - DNA, 16 bp, P. troglodytes
ggcagagccaggattt

SEQ ID NO: 252316 - DNA, 16 bp, P. troglodytes
ggcagagcgagactcc

SEQ ID NO: 252317 - DNA, 16 bp, P. troglodytes
ggcagagctcaggcag

SEQ ID NO: 252318 - DNA, 16 bp, P. troglodytes
ggcagagctgcccaag

SEQ ID NO: 252319 - DNA, 16 bp, P. troglodytes
ggcagagctgcccagg

SEQ ID NO: 252320 - DNA, 16 bp, P. troglodytes
ggcagagctgggatgt

SEQ ID NO: 252321 - DNA, 16 bp, P. troglodytes
ggcagagctgggcctg

SEQ ID NO: 252322 - DNA, 16 bp, P. troglodytes
ggcagagctggggcca

SEQ ID NO: 252323 - DNA, 16 bp, P. troglodytes
ggcagagctggttcct

SEQ ID NO: 252324 - DNA, 16 bp, P. troglodytes
ggcagagctgtccaag

SEQ ID NO: 252325 - DNA, 16 bp, P. troglodytes
ggcagaggaaaaatgc

SEQ ID NO: 252326 - DNA, 16 bp, P. troglodytes
ggcagaggaagggtga

SEQ ID NO: 252327 - DNA, 16 bp, P. troglodytes
ggcagaggagcctcac

SEQ ID NO: 252328 - DNA, 16 bp, P. troglodytes
ggcagaggatgcagtg

SEQ ID NO: 252329 - DNA, 16 bp, P. troglodytes
ggcagaggatgtagtg

SEQ ID NO: 252330 - DNA, 16 bp, P. troglodytes
ggcagaggcagaagag

SEQ ID NO: 252331 - DNA, 16 bp, P. troglodytes
ggcagaggcagaggaa

SEQ ID NO: 252332 - DNA, 16 bp, P. troglodytes
ggcagaggcagcagaa

SEQ ID NO: 252333 - DNA, 16 bp, P. troglodytes
ggcagaggcaggaaaa

SEQ ID NO: 252334 - DNA, 16 bp, P. troglodytes
ggcagaggcaggataa

SEQ ID NO: 252335 - DNA, 16 bp, P. troglodytes
ggcagaggcaggcaga

SEQ ID NO: 252336 - DNA, 16 bp, P. troglodytes
ggcagaggccagcaga

SEQ ID NO: 252337 - DNA, 17 bp, P. troglodytes
ggcagaggcgggtggat

SEQ ID NO: 252338 - DNA, 17 bp, P. troglodytes
ggcagaggctgcaatct

SEQ ID NO: 252339 - DNA, 16 bp, P. troglodytes
ggcagaggcttcagtg

SEQ ID NO: 252340 - DNA, 16 bp, P. troglodytes
ggcagagggaacagcc

SEQ ID NO: 252341 - DNA, 16 bp, P. troglodytes
ggcagagggagcagca

SEQ ID NO: 252342 - DNA, 18 bp, P. troglodytes
ggcagaggggctcctcac

SEQ ID NO: 252343 - DNA, 16 bp, P. troglodytes
ggcagaggtcccagcc

SEQ ID NO: 252344 - DNA, 16 bp, P. troglodytes
ggcagaggtgggagga

SEQ ID NO: 252345 - DNA, 16 bp, P. troglodytes
ggcagaggttagaaca

SEQ ID NO: 252346 - DNA, 16 bp, P. troglodytes
ggcagaggttgcagat

SEQ ID NO: 252347 - DNA, 16 bp, P. troglodytes
ggcagaggttgctgta

SEQ ID NO: 252348 - DNA, 16 bp, P. troglodytes
ggcagagtcctcatga

SEQ ID NO: 252349 - DNA, 16 bp, P. troglodytes
ggcagagtcctgaggc

SEQ ID NO: 252350 - DNA, 16 bp, P. troglodytes
ggcagagtgtggtggc

SEQ ID NO: 252351 - DNA, 16 bp, P. troglodytes
ggcagataggggtggg

SEQ ID NO: 252352 - DNA, 16 bp, P. troglodytes
ggcagatcacctgaga

SEQ ID NO: 252353 - DNA, 16 bp, P. troglodytes
ggcagatcacctgagc

SEQ ID NO: 252354 - DNA, 17 bp, P. troglodytes
ggcagatcacctgaggt

SEQ ID NO: 252355 - DNA, 16 bp, P. troglodytes
ggcagatcacctgggg

SEQ ID NO: 252356 - DNA, 16 bp, P. troglodytes
ggcagatcacttgaag

SEQ ID NO: 252357 - DNA, 16 bp, P. troglodytes
ggcagatcacttgagt

SEQ ID NO: 252358 - DNA, 16 bp, P. troglodytes
ggcagatcgcttgagc

SEQ ID NO: 252359 - DNA, 16 bp, P. troglodytes
ggcagatgacctgagg

SEQ ID NO: 252360 - DNA, 16 bp, P. troglodytes
ggcagatgaggcaaaa

SEQ ID NO: 252361 - DNA, 16 bp, P. troglodytes
ggcagatgcacctgac

SEQ ID NO: 252362 - DNA, 16 bp, P. troglodytes
ggcagatgctgaggcc

SEQ ID NO: 252363 - DNA, 16 bp, P. troglodytes
ggcagcaatactgctc

SEQ ID NO: 252364 - DNA, 66 bp, P. troglodytes
ggcagcaatactgctttgtaaagcattgagatgtttatgtgtatgcatatctaaaagcacagcact

SEQ ID NO: 252365 - DNA, 16 bp, P. troglodytes
ggcagcagaaaggaga

SEQ ID NO: 252366 - DNA, 16 bp, P. troglodytes
ggcagcagaacgagac

SEQ ID NO: 252367 - DNA, 16 bp, P. troglodytes
ggcagcagagcaagat

SEQ ID NO: 252368 - DNA, 16 bp, P. troglodytes
ggcagcagcagcagca

SEQ ID NO: 252369 - DNA, 16 bp, P. troglodytes
ggcagcagcagcagct

SEQ ID NO: 252370 - DNA, 16 bp, P. troglodytes
ggcagcagccccagcc

SEQ ID NO: 252371 - DNA, 16 bp, P. troglodytes
ggcagcaggaacagca

SEQ ID NO: 252372 - DNA, 16 bp, P. troglodytes
ggcagcaggaggctgg

SEQ ID NO: 252373 - DNA, 16 bp, P. troglodytes
ggcagcaggcagcagg

SEQ ID NO: 252374 - DNA, 16 bp, P. troglodytes
ggcagcaggctggaca

SEQ ID NO: 252375 - DNA, 16 bp, P. troglodytes
ggcagcagggcagagg

SEQ ID NO: 252376 - DNA, 16 bp, P. troglodytes
ggcagcagggccctgg

SEQ ID NO: 252377 - DNA, 16 bp, P. troglodytes
ggcagcatccctggcc

SEQ ID NO: 252378 - DNA, 16 bp, P. troglodytes
ggcagcattcaccata

SEQ ID NO: 252379 - DNA, 16 bp, P. troglodytes
ggcagccaccccgtcc

SEQ ID NO: 252380 - DNA, 16 bp, P. troglodytes
ggcagcccagagggag

SEQ ID NO: 252381 - DNA, 16 bp, P. troglodytes
ggcagccccagccctg

SEQ ID NO: 252382 - DNA, 16 bp, P. troglodytes
ggcagccccttcctca

SEQ ID NO: 252383 - DNA, 16 bp, P. troglodytes
ggcagccctgcccctg

SEQ ID NO: 252384 - DNA, 16 bp, P. troglodytes
ggcagccctgggaaac

SEQ ID NO: 252385 - DNA, 16 bp, P. troglodytes
ggcagcctcaggaaac

SEQ ID NO: 252386 - DNA, 16 bp, P. troglodytes
ggcagcctgcccctcc

SEQ ID NO: 252387 - DNA, 16 bp, P. troglodytes
ggcagcctggccccca

SEQ ID NO: 252388 - DNA, 16 bp, P. troglodytes
ggcagcgtgtgcctgt

SEQ ID NO: 252389 - DNA, 16 bp, P. troglodytes
ggcagctcattttttt

SEQ ID NO: 252390 - DNA, 16 bp, P. troglodytes
ggcagctccactcctg

SEQ ID NO: 252391 - DNA, 16 bp, P. troglodytes
ggcagctctgctcctg

SEQ ID NO: 252392 - DNA, 16 bp, P. troglodytes
ggcagctctggccctg

SEQ ID NO: 252393 - DNA, 16 bp, P. troglodytes
ggcagctgaggcagag

SEQ ID NO: 252394 - DNA, 16 bp, P. troglodytes
ggcagctgcagctgca

SEQ ID NO: 252395 - DNA, 16 bp, P. troglodytes
ggcagctgcagctgtg

SEQ ID NO: 252396 - DNA, 16 bp, P. troglodytes
ggcagctgcatctggt

SEQ ID NO: 252397 - DNA, 16 bp, P. troglodytes
ggcagctggccgggcg

SEQ ID NO: 252398 - DNA, 16 bp, P. troglodytes
ggcagctggtgaccag

SEQ ID NO: 252399 - DNA, 16 bp, P. troglodytes
ggcaggaaatgtacaa

SEQ ID NO: 252400 - DNA, 16 bp, P. troglodytes
ggcaggaacctgggag

SEQ ID NO: 252401 - DNA, 16 bp, P. troglodytes
ggcaggagaagatgga

SEQ ID NO: 252402 - DNA, 16 bp, P. troglodytes
ggcaggagaaggaaac

SEQ ID NO: 252403 - DNA, 16 bp, P. troglodytes
ggcaggagaatcacta

SEQ ID NO: 252404 - DNA, 16 bp, P. troglodytes
ggcaggagagagagca

SEQ ID NO: 252405 - DNA, 16 bp, P. troglodytes
ggcaggagccactgcg

SEQ ID NO: 252406 - DNA, 16 bp, P. troglodytes
ggcaggagccactgtg

SEQ ID NO: 252407 - DNA, 16 bp, P. troglodytes
ggcaggagccccgccc

SEQ ID NO: 252408 - DNA, 16 bp, P. troglodytes
ggcaggagctgggcct

SEQ ID NO: 252409 - DNA, 16 bp, P. troglodytes
ggcaggaggactactt

SEQ ID NO: 252410 - DNA, 16 bp, P. troglodytes
ggcaggaggagctggg

SEQ ID NO: 252411 - DNA, 16 bp, P. troglodytes
ggcaggaggataatgg

SEQ ID NO: 252412 - DNA, 16 bp, P. troglodytes
ggcaggaggatcactg

SEQ ID NO: 252413 - DNA, 16 bp, P. troglodytes
ggcaggaggcaaagag

SEQ ID NO: 252414 - DNA, 16 bp, P. troglodytes
ggcaggaggctgggag

SEQ ID NO: 252415 - DNA, 16 bp, P. troglodytes
ggcaggaggcttgctt

SEQ ID NO: 252416 - DNA, 16 bp, P. troglodytes
ggcaggagggcagtgg

SEQ ID NO: 252417 - DNA, 16 bp, P. troglodytes
ggcaggaggttgcagt

SEQ ID NO: 252418 - DNA, 16 bp, P. troglodytes
ggcaggatctcggctc

SEQ ID NO: 252419 - DNA, 16 bp, P. troglodytes
ggcaggatggtctcca

SEQ ID NO: 252420 - DNA, 16 bp, P. troglodytes
ggcaggattttttttt

SEQ ID NO: 252421 - DNA, 16 bp, P. troglodytes
ggcaggcaaagagaga

SEQ ID NO: 252422 - DNA, 16 bp, P. troglodytes
ggcaggcaagacagca

SEQ ID NO: 252423 - DNA, 16 bp, P. troglodytes
ggcaggcaagagagag

SEQ ID NO: 252424 - DNA, 16 bp, P. troglodytes
ggcaggcagaggctgc

SEQ ID NO: 252425 - DNA, 16 bp, P. troglodytes
ggcaggcagaggtggg

SEQ ID NO: 252426 - DNA, 16 bp, P. troglodytes
ggcaggcagcagctgt

SEQ ID NO: 252427 - DNA, 16 bp, P. troglodytes
ggcaggcagctccagg

SEQ ID NO: 252428 - DNA, 16 bp, P. troglodytes
ggcaggcagctccatc

SEQ ID NO: 252429 - DNA, 16 bp, P. troglodytes
ggcaggcagctgggag

SEQ ID NO: 252430 - DNA, 16 bp, P. troglodytes
ggcaggcagctgtgca

SEQ ID NO: 252431 - DNA, 16 bp, P. troglodytes
ggcaggcaggagcagg

SEQ ID NO: 252432 - DNA, 16 bp, P. troglodytes
ggcaggcaggcaggct

SEQ ID NO: 252433 - DNA, 16 bp, P. troglodytes
ggcaggcaggcagggc

SEQ ID NO: 252434 - DNA, 16 bp, P. troglodytes
ggcaggcagggaggca

SEQ ID NO: 252435 - DNA, 16 bp, P. troglodytes
ggcaggccccggtgtg

SEQ ID NO: 252436 - DNA, 16 bp, P. troglodytes
ggcaggccgaggcagg

SEQ ID NO: 252437 - DNA, 16 bp, P. troglodytes
ggcaggccgatcacct

SEQ ID NO: 252438 - DNA, 19 bp, P. troglodytes
ggcaggcctggtggtgaca

SEQ ID NO: 252439 - DNA, 16 bp, P. troglodytes
ggcaggcggagcttgc

SEQ ID NO: 252440 - DNA, 16 bp, P. troglodytes
ggcaggcggaggctgc

SEQ ID NO: 252441 - DNA, 16 bp, P. troglodytes
ggcaggctgggcatgg

SEQ ID NO: 252442 - DNA, 16 bp, P. troglodytes
ggcagggactgtgtct

SEQ ID NO: 252443 - DNA, 16 bp, P. troglodytes
ggcagggaggctgcag

SEQ ID NO: 252444 - DNA, 16 bp, P. troglodytes
ggcagggcacaggcag

SEQ ID NO: 252445 - DNA, 16 bp, P. troglodytes
ggcagggcacggtggc

SEQ ID NO: 252446 - DNA, 16 bp, P. troglodytes
ggcagggcagggccag

SEQ ID NO: 252447 - DNA, 16 bp, P. troglodytes
ggcagggccaggctgg

SEQ ID NO: 252448 - DNA, 16 bp, P. troglodytes
ggcagggcccaggcag

SEQ ID NO: 252449 - DNA, 16 bp, P. troglodytes
ggcagggcccagggtc

SEQ ID NO: 252450 - DNA, 23 bp, P. troglodytes
ggcagggctcgggacctgcagcc

SEQ ID NO: 252451 - DNA, 16 bp, P. troglodytes
ggcagggctgggcctc

SEQ ID NO: 252452 - DNA, 16 bp, P. troglodytes
ggcagggctgggcctg

SEQ ID NO: 252453 - DNA, 16 bp, P. troglodytes
ggcagggctggggctg

SEQ ID NO: 252454 - DNA, 16 bp, P. troglodytes
ggcagggctggtggtg

SEQ ID NO: 252455 - DNA, 16 bp, P. troglodytes
ggcagggcttgctgtg

SEQ ID NO: 252456 - DNA, 16 bp, P. troglodytes
ggcaggggaatggctt

SEQ ID NO: 252457 - DNA, 16 bp, P. troglodytes
ggcaggggctgcagtg

SEQ ID NO: 252458 - DNA, 16 bp, P. troglodytes
ggcaggggctgggctg

SEQ ID NO: 252459 - DNA, 16 bp, P. troglodytes
ggcagggggctggcat

SEQ ID NO: 252460 - DNA, 16 bp, P. troglodytes
ggcaggggtgtccaat

SEQ ID NO: 252461 - DNA, 16 bp, P. troglodytes
ggcagggtgcagtggc

SEQ ID NO: 252462 - DNA, 16 bp, P. troglodytes
ggcagggtgggcagct

SEQ ID NO: 252463 - DNA, 16 bp, P. troglodytes
ggcagggtggtgtgca

SEQ ID NO: 252464 - DNA, 16 bp, P. troglodytes
ggcagggtttgcagtg

SEQ ID NO: 252465 - DNA, 16 bp, P. troglodytes
ggcaggtggaggctgc

SEQ ID NO: 252466 - DNA, 16 bp, P. troglodytes
ggcaggtggatcacat

SEQ ID NO: 252467 - DNA, 16 bp, P. troglodytes
ggcaggtgtgtgtgtg

SEQ ID NO: 252468 - DNA, 16 bp, P. troglodytes
ggcagtaacttctggg

SEQ ID NO: 252469 - DNA, 16 bp, P. troglodytes
ggcagtaggcaaagag

SEQ ID NO: 252470 - DNA, 16 bp, P. troglodytes
ggcagtctgactccag

SEQ ID NO: 252471 - DNA, 16 bp, P. troglodytes
ggcagtctgcccacct

SEQ ID NO: 252472 - DNA, 16 bp, P. troglodytes
ggcagtgacatgatca

SEQ ID NO: 252473 - DNA, 16 bp, P. troglodytes
ggcagtgagccaagat

SEQ ID NO: 252474 - DNA, 17 bp, P. troglodytes
ggcagtgaggggcttag

SEQ ID NO: 252475 - DNA, 16 bp, P. troglodytes
ggcagtgatgatgagc

SEQ ID NO: 252476 - DNA, 16 bp, P. troglodytes
ggcagtgccccactgg

SEQ ID NO: 252477 - DNA, 16 bp, P. troglodytes
ggcagtgccccagtga

SEQ ID NO: 252478 - DNA, 16 bp, P. troglodytes
ggcagtgctccagtgg

SEQ ID NO: 252479 - DNA, 16 bp, P. troglodytes
ggcagtggcacgatct

SEQ ID NO: 252480 - DNA, 16 bp, P. troglodytes
ggcagtggcagagggg

SEQ ID NO: 252481 - DNA, 16 bp, P. troglodytes
ggcagtggcagcagga

SEQ ID NO: 252482 - DNA, 16 bp, P. troglodytes
ggcagtggcagtgggg

SEQ ID NO: 252483 - DNA, 16 bp, P. troglodytes
ggcagtgggaacagca

SEQ ID NO: 252484 - DNA, 16 bp, P. troglodytes
ggcagtgggcagggcc

SEQ ID NO: 252485 - DNA, 16 bp, P. troglodytes
ggcagtggggccctgg

SEQ ID NO: 252486 - DNA, 16 bp, P. troglodytes
ggcagtgtcccagtgg

SEQ ID NO: 252487 - DNA, 16 bp, P. troglodytes
ggcagtgtccccaccc

SEQ ID NO: 252488 - DNA, 16 bp, P. troglodytes
ggcagtgtgctgagag

SEQ ID NO: 252489 - DNA, 16 bp, P. troglodytes
ggcagtgtggaaggaa

SEQ ID NO: 252490 - DNA, 16 bp, P. troglodytes
ggcagttccccagcaa

SEQ ID NO: 252491 - DNA, 16 bp, P. troglodytes
ggcagtttctcaaaag

SEQ ID NO: 252492 - DNA, 16 bp, P. troglodytes
ggcataaaagtttgga

SEQ ID NO: 252493 - DNA, 16 bp, P. troglodytes
ggcataggaggaaaaa

SEQ ID NO: 252494 - DNA, 16 bp, P. troglodytes
ggcatcaatatggtga

SEQ ID NO: 252495 - DNA, 16 bp, P. troglodytes
ggcatcacccctcccc

SEQ ID NO: 252496 - DNA, 16 bp, P. troglodytes
ggcatcacctgggagc

SEQ ID NO: 252497 - DNA, 16 bp, P. troglodytes
ggcatcagagggagac

SEQ ID NO: 252498 - DNA, 16 bp, P. troglodytes
ggcatccctgtgctct

SEQ ID NO: 252499 - DNA, 16 bp, P. troglodytes
ggcatccttgtcttgt

SEQ ID NO: 252500 - DNA, 16 bp, P. troglodytes
ggcatcgtggcaggca

SEQ ID NO: 252501 - DNA, 16 bp, P. troglodytes
ggcatctggcaagggc

SEQ ID NO: 252502 - DNA, 16 bp, P. troglodytes
ggcatgaaccactgcg

SEQ ID NO: 252503 - DNA, 16 bp, P. troglodytes
ggcatgaactactgtg

SEQ ID NO: 252504 - DNA, 16 bp, P. troglodytes
ggcatgagaaccactt

SEQ ID NO: 252505 - DNA, 16 bp, P. troglodytes
ggcatgagccacagct

SEQ ID NO: 252506 - DNA, 16 bp, P. troglodytes
ggcatgagccaccaga

SEQ ID NO: 252507 - DNA, 16 bp, P. troglodytes
ggcatgagccacctca

SEQ ID NO: 252508 - DNA, 16 bp, P. troglodytes
ggcatgagccacctgc

SEQ ID NO: 252509 - DNA, 16 bp, P. troglodytes
ggcatgagccactctg

SEQ ID NO: 252510 - DNA, 16 bp, P. troglodytes
ggcatgagccactgca

SEQ ID NO: 252511 - DNA, 16 bp, P. troglodytes
ggcatgagctactgta

SEQ ID NO: 252512 - DNA, 16 bp, P. troglodytes
ggcatgatggctcaca

SEQ ID NO: 252513 - DNA, 16 bp, P. troglodytes
ggcatgcaccaacatg

SEQ ID NO: 252514 - DNA, 16 bp, P. troglodytes
ggcatgcaccaccacc

SEQ ID NO: 252515 - DNA, 16 bp, P. troglodytes
ggcatgctggcgggtg

SEQ ID NO: 252516 - DNA, 16 bp, P. troglodytes
ggcatggctgtgtttc

SEQ ID NO: 252517 - DNA, 17 bp, P. troglodytes
ggcatggtcaaagactt

SEQ ID NO: 252518 - DNA, 16 bp, P. troglodytes
ggcatggtcgtgggtg

SEQ ID NO: 252519 - DNA, 16 bp, P. troglodytes
ggcatggtggagcaca

SEQ ID NO: 252520 - DNA, 16 bp, P. troglodytes
ggcatggtggcacaca

SEQ ID NO: 252521 - DNA, 16 bp, P. troglodytes
ggcatggtggcacgca

SEQ ID NO: 252522 - DNA, 16 bp, P. troglodytes
ggcatggtggcagctg

SEQ ID NO: 252523 - DNA, 16 bp, P. troglodytes
ggcatggtggcctgta

SEQ ID NO: 252524 - DNA, 16 bp, P. troglodytes
ggcatggtggcgggct

SEQ ID NO: 252525 - DNA, 19 bp, P. troglodytes
ggcatggtggctcacgcct

SEQ ID NO: 252526 - DNA, 16 bp, P. troglodytes
ggcatggtggggtgca

SEQ ID NO: 252527 - DNA, 16 bp, P. troglodytes
ggcatggtggtgctca

SEQ ID NO: 252528 - DNA, 22 bp, P. troglodytes
ggcatgtgaaggacctcttcaa

SEQ ID NO: 252529 - DNA, 16 bp, P. troglodytes
ggcatgtgccaccacc

SEQ ID NO: 252530 - DNA, 16 bp, P. troglodytes
ggcatgtggcaccaca

SEQ ID NO: 252531 - DNA, 16 bp, P. troglodytes
ggcatgttggtcaggc

SEQ ID NO: 252532 - DNA, 16 bp, P. troglodytes
ggcatgttggtgggtg

SEQ ID NO: 252533 - DNA, 16 bp, P. troglodytes
ggcattaatccattca

SEQ ID NO: 252534 - DNA, 16 bp, P. troglodytes
ggcattatttctgagg

SEQ ID NO: 252535 - DNA, 16 bp, P. troglodytes
ggcattcagtaaatgt

SEQ ID NO: 252536 - DNA, 16 bp, P. troglodytes
ggcattcctgagaaag

SEQ ID NO: 252537 - DNA, 16 bp, P. troglodytes
ggcattctggttttgg

SEQ ID NO: 252538 - DNA, 16 bp, P. troglodytes
ggcattgctggatcat

SEQ ID NO: 252539 - DNA, 16 bp, P. troglodytes
ggcattgtaattgtga

SEQ ID NO: 252540 - DNA, 16 bp, P. troglodytes
ggcattgtggctcacg

SEQ ID NO: 252541 - DNA, 16 bp, P. troglodytes
ggcattgtggtgggtg

SEQ ID NO: 252542 - DNA, 16 bp, P. troglodytes
ggcattgttgtaaaca

SEQ ID NO: 252543 - DNA, 16 bp, P. troglodytes
ggcatttcagagatct

SEQ ID NO: 252544 - DNA, 16 bp, P. troglodytes
ggcatttccaaacatc

SEQ ID NO: 252545 - DNA, 16 bp, P. troglodytes
ggcatttcttcaaaga

SEQ ID NO: 252546 - DNA, 16 bp, P. troglodytes
ggcatttgccttattt

SEQ ID NO: 252547 - DNA, 16 bp, P. troglodytes
ggcattttaagcagat

SEQ ID NO: 252548 - DNA, 16 bp, P. troglodytes
ggcattttattttatt

SEQ ID NO: 252549 - DNA, 16 bp, P. troglodytes
ggcattttgtttgttt

SEQ ID NO: 252550 - DNA, 16 bp, P. troglodytes
ggcatttttcacagaa

SEQ ID NO: 252551 - DNA, 16 bp, P. troglodytes
ggccaaaaagcatatg

SEQ ID NO: 252552 - DNA, 16 bp, P. troglodytes
ggccaaagcaggcaga

SEQ ID NO: 252553 - DNA, 16 bp, P. troglodytes
ggccaaagcgggagga

SEQ ID NO: 252554 - DNA, 16 bp, P. troglodytes
ggccaacaaacgtatg

SEQ ID NO: 252555 - DNA, 16 bp, P. troglodytes
ggccaacaggcatatg

SEQ ID NO: 252556 - DNA, 16 bp, P. troglodytes
ggccaacatcatgaaa

SEQ ID NO: 252557 - DNA, 17 bp, P. troglodytes
ggccaacgcgggtggat

SEQ ID NO: 252558 - DNA, 16 bp, P. troglodytes
ggccaacgtgatgaaa

SEQ ID NO: 252559 - DNA, 16 bp, P. troglodytes
ggccaagaaggcagtg

SEQ ID NO: 252560 - DNA, 16 bp, P. troglodytes
ggccaagacagatgga

SEQ ID NO: 252561 - DNA, 16 bp, P. troglodytes
ggccaagacaggcgga

SEQ ID NO: 252562 - DNA, 16 bp, P. troglodytes
ggccaagacgggagga

SEQ ID NO: 252563 - DNA, 16 bp, P. troglodytes
ggccaagataggtgga

SEQ ID NO: 252564 - DNA, 16 bp, P. troglodytes
ggccaagatgatgaaa

SEQ ID NO: 252565 - DNA, 16 bp, P. troglodytes
ggccaagatgggaggg

SEQ ID NO: 252566 - DNA, 16 bp, P. troglodytes
ggccaagcatggtggt

SEQ ID NO: 252567 - DNA, 16 bp, P. troglodytes
ggccaagctggtcttg

SEQ ID NO: 252568 - DNA, 16 bp, P. troglodytes
ggccaaggagggtggg

SEQ ID NO: 252569 - DNA, 16 bp, P. troglodytes
ggccaaggcagaggga

SEQ ID NO: 252570 - DNA, 16 bp, P. troglodytes
ggccaaggcaggaagg

SEQ ID NO: 252571 - DNA, 22 bp, P. troglodytes
ggccaaggcaggcagatcacga

SEQ ID NO: 252572 - DNA, 16 bp, P. troglodytes
ggccaaggcaggcagc

SEQ ID NO: 252573 - DNA, 16 bp, P. troglodytes
ggccaaggcaggcagg

SEQ ID NO: 252574 - DNA, 21 bp, P. troglodytes
ggccaaggcaggcggatcact

SEQ ID NO: 252575 - DNA, 16 bp, P. troglodytes
ggccaaggcagggagg

SEQ ID NO: 252576 - DNA, 16 bp, P. troglodytes
ggccaaggccagagct

SEQ ID NO: 252577 - DNA, 16 bp, P. troglodytes
ggccaaggcggacaga

SEQ ID NO: 252578 - DNA, 16 bp, P. troglodytes
ggccaaggcggctgga

SEQ ID NO: 252579 - DNA, 17 bp, P. troglodytes
ggccaaggcgtgtggat

SEQ ID NO: 252580 - DNA, 16 bp, P. troglodytes
ggccaaggtgaaagga

SEQ ID NO: 252581 - DNA, 16 bp, P. troglodytes
ggccaaggtgggcaca

SEQ ID NO: 252582 - DNA, 16 bp, P. troglodytes
ggccaaggtgggcagg

SEQ ID NO: 252583 - DNA, 17 bp, P. troglodytes
ggccaaggtgggcggat

SEQ ID NO: 252584 - DNA, 16 bp, P. troglodytes
ggccaaggtgggcggg

SEQ ID NO: 252585 - DNA, 16 bp, P. troglodytes
ggccaaggtggggcag

SEQ ID NO: 252586 - DNA, 16 bp, P. troglodytes
ggccaaggtggggtgg

SEQ ID NO: 252587 - DNA, 16 bp, P. troglodytes
ggccaaggtgggtggg

SEQ ID NO: 252588 - DNA, 16 bp, P. troglodytes
ggccacaagggtgctt

SEQ ID NO: 252589 - DNA, 16 bp, P. troglodytes
ggccacacagcaggag

SEQ ID NO: 252590 - DNA, 16 bp, P. troglodytes
ggccacacagccagga

SEQ ID NO: 252591 - DNA, 16 bp, P. troglodytes
ggccacactggaagaa

SEQ ID NO: 252592 - DNA, 16 bp, P. troglodytes
ggccacagaccagtac

SEQ ID NO: 252593 - DNA, 16 bp, P. troglodytes
ggccacagacctgtac

SEQ ID NO: 252594 - DNA, 16 bp, P. troglodytes
ggccacagagcaggag

SEQ ID NO: 252595 - DNA, 16 bp, P. troglodytes
ggccacagagtgaaac

SEQ ID NO: 252596 - DNA, 16 bp, P. troglodytes
ggccacagcaatcagg

SEQ ID NO: 252597 - DNA, 16 bp, P. troglodytes
ggccacagtgagctga

SEQ ID NO: 252598 - DNA, 16 bp, P. troglodytes
ggccacagtggaagaa

SEQ ID NO: 252599 - DNA, 16 bp, P. troglodytes
ggccacagtgtctgtt

SEQ ID NO: 252600 - DNA, 16 bp, P. troglodytes
ggccacagtgtgtgat

SEQ ID NO: 252601 - DNA, 16 bp, P. troglodytes
ggccacatgactcctg

SEQ ID NO: 252602 - DNA, 16 bp, P. troglodytes
ggccaccaccactggg

SEQ ID NO: 252603 - DNA, 16 bp, P. troglodytes
ggccaccactgccatc

SEQ ID NO: 252604 - DNA, 16 bp, P. troglodytes
ggccaccagagggcag

SEQ ID NO: 252605 - DNA, 16 bp, P. troglodytes
ggccaccatgcctggc

SEQ ID NO: 252606 - DNA, 16 bp, P. troglodytes
ggccaccgtgcccagc

SEQ ID NO: 252607 - DNA, 16 bp, P. troglodytes
ggccacctcggcctcc

SEQ ID NO: 252608 - DNA, 16 bp, P. troglodytes
ggccaccttggcctcc

SEQ ID NO: 252609 - DNA, 16 bp, P. troglodytes
ggccacgctggtctca

SEQ ID NO: 252610 - DNA, 16 bp, P. troglodytes
ggccactgcaacctcc

SEQ ID NO: 252611 - DNA, 16 bp, P. troglodytes
ggccactgtcctccag

SEQ ID NO: 252612 - DNA, 16 bp, P. troglodytes
ggccagaagactcagc

SEQ ID NO: 252613 - DNA, 16 bp, P. troglodytes
ggccagaagtggtggc

SEQ ID NO: 252614 - DNA, 16 bp, P. troglodytes
ggccagagcaggaaga

SEQ ID NO: 252615 - DNA, 16 bp, P. troglodytes
ggccagaggtgctggg

SEQ ID NO: 252616 - DNA, 16 bp, P. troglodytes
ggccagagtgcagtgg

SEQ ID NO: 252617 - DNA, 16 bp, P. troglodytes
ggccagagtggacgcc

SEQ ID NO: 252618 - DNA, 16 bp, P. troglodytes
ggccagagtgggcgcc

SEQ ID NO: 252619 - DNA, 16 bp, P. troglodytes
ggccagagttccaggg

SEQ ID NO: 252620 - DNA, 16 bp, P. troglodytes
ggccagataataaata

SEQ ID NO: 252621 - DNA, 16 bp, P. troglodytes
ggccagatgtgtgatt

SEQ ID NO: 252622 - DNA, 16 bp, P. troglodytes
ggccagcagagggcgc

SEQ ID NO: 252623 - DNA, 16 bp, P. troglodytes
ggccagcatcaacctg

SEQ ID NO: 252624 - DNA, 16 bp, P. troglodytes
ggccagcatcttcctg

SEQ ID NO: 252625 - DNA, 16 bp, P. troglodytes
ggccagcccaggagcc

SEQ ID NO: 252626 - DNA, 16 bp, P. troglodytes
ggccagcctgggcagc

SEQ ID NO: 252627 - DNA, 16 bp, P. troglodytes
ggccagcctgtccaac

SEQ ID NO: 252628 - DNA, 16 bp, P. troglodytes
ggccagcggctgcgga

SEQ ID NO: 252629 - DNA, 16 bp, P. troglodytes
ggccagcgtgagttcc

SEQ ID NO: 252630 - DNA, 16 bp, P. troglodytes
ggccagctggagttcc

SEQ ID NO: 252631 - DNA, 23 bp, P. troglodytes
ggccagctggagttccgggtggg

SEQ ID NO: 252632 - DNA, 16 bp, P. troglodytes
ggccaggaaagcatgc

SEQ ID NO: 252633 - DNA, 16 bp, P. troglodytes
ggccaggagaggtggc

SEQ ID NO: 252634 - DNA, 16 bp, P. troglodytes
ggccaggagctggaga

SEQ ID NO: 252635 - DNA, 16 bp, P. troglodytes
ggccaggaggtggaga

SEQ ID NO: 252636 - DNA, 16 bp, P. troglodytes
ggccaggatgatctca

SEQ ID NO: 252637 - DNA, 16 bp, P. troglodytes
ggccaggatgggagga

SEQ ID NO: 252638 - DNA, 16 bp, P. troglodytes
ggccaggcaccgtggc

SEQ ID NO: 252639 - DNA, 16 bp, P. troglodytes
ggccaggcagaggctg

SEQ ID NO: 252640 - DNA, 16 bp, P. troglodytes
ggccaggcaggccagg

SEQ ID NO: 252641 - DNA, 16 bp, P. troglodytes
ggccaggcaggcccag

SEQ ID NO: 252642 - DNA, 16 bp, P. troglodytes
ggccaggcaggtcttg

SEQ ID NO: 252643 - DNA, 16 bp, P. troglodytes
ggccaggcatagtggc

SEQ ID NO: 252644 - DNA, 16 bp, P. troglodytes
ggccaggcatggtagc

SEQ ID NO: 252645 - DNA, 16 bp, P. troglodytes
ggccaggccagcccag

SEQ ID NO: 252646 - DNA, 16 bp, P. troglodytes
ggccaggccaggccag

SEQ ID NO: 252647 - DNA, 16 bp, P. troglodytes
ggccaggcccagggct

SEQ ID NO: 252648 - DNA, 16 bp, P. troglodytes
ggccaggccggtctcg

SEQ ID NO: 252649 - DNA, 16 bp, P. troglodytes
ggccaggcgcagaggc

SEQ ID NO: 252650 - DNA, 16 bp, P. troglodytes
ggccaggctaatcttg

SEQ ID NO: 252651 - DNA, 16 bp, P. troglodytes
ggccaggctcctcccc

SEQ ID NO: 252652 - DNA, 16 bp, P. troglodytes
ggccaggctggactcg

SEQ ID NO: 252653 - DNA, 16 bp, P. troglodytes
ggccaggctggccagg

SEQ ID NO: 252654 - DNA, 16 bp, P. troglodytes
ggccaggctggggcca

SEQ ID NO: 252655 - DNA, 16 bp, P. troglodytes
ggccaggctggtccct

SEQ ID NO: 252656 - DNA, 16 bp, P. troglodytes
ggccaggctggtcctg

SEQ ID NO: 252657 - DNA, 16 bp, P. troglodytes
ggccaggctggtctgc

SEQ ID NO: 252658 - DNA, 16 bp, P. troglodytes
ggccaggcttgtctcg

SEQ ID NO: 252659 - DNA, 16 bp, P. troglodytes
ggccagggaggcagag

SEQ ID NO: 252660 - DNA, 16 bp, P. troglodytes
ggccagggatactgct

SEQ ID NO: 252661 - DNA, 16 bp, P. troglodytes
ggccagggcagggcag

SEQ ID NO: 252662 - DNA, 16 bp, P. troglodytes
ggccagggcagtggct

SEQ ID NO: 252663 - DNA, 16 bp, P. troglodytes
ggccagggcgggcaga

SEQ ID NO: 252664 - DNA, 16 bp, P. troglodytes
ggccagggctgggctg

SEQ ID NO: 252665 - DNA, 16 bp, P. troglodytes
ggccaggggctgtggc

SEQ ID NO: 252666 - DNA, 16 bp, P. troglodytes
ggccagggtggaatga

SEQ ID NO: 252667 - DNA, 16 bp, P. troglodytes
ggccagggtgggagga

SEQ ID NO: 252668 - DNA, 16 bp, P. troglodytes
ggccaggtacagtggc

SEQ ID NO: 252669 - DNA, 16 bp, P. troglodytes
ggccaggtaccagaca

SEQ ID NO: 252670 - DNA, 16 bp, P. troglodytes
ggccaggtcacctaca

SEQ ID NO: 252671 - DNA, 16 bp, P. troglodytes
ggccaggtgcagcggc

SEQ ID NO: 252672 - DNA, 16 bp, P. troglodytes
ggccaggtgcggcggc

SEQ ID NO: 252673 - DNA, 16 bp, P. troglodytes
ggccaggtggggtggc

SEQ ID NO: 252674 - DNA, 24 bp, P. troglodytes
ggccaggtgttccttgccctcatt

SEQ ID NO: 252675 - DNA, 16 bp, P. troglodytes
ggccagtctctctttt

SEQ ID NO: 252676 - DNA, 16 bp, P. troglodytes
ggccagtgcaggagga

SEQ ID NO: 252677 - DNA, 16 bp, P. troglodytes
ggccagtgtggctaga

SEQ ID NO: 252678 - DNA, 16 bp, P. troglodytes
ggccatcagggaaatg

SEQ ID NO: 252679 - DNA, 16 bp, P. troglodytes
ggccatcatcctaagc

SEQ ID NO: 252680 - DNA, 16 bp, P. troglodytes
ggccatctgcaagcca

SEQ ID NO: 252681 - DNA, 16 bp, P. troglodytes
ggccatctgtaagcca

SEQ ID NO: 252682 - DNA, 19 bp, P. troglodytes
ggccatcttggctcctcca

SEQ ID NO: 252683 - DNA, 16 bp, P. troglodytes
ggccatggcgggtgga

SEQ ID NO: 252684 - DNA, 16 bp, P. troglodytes
ggccatggcttcagag

SEQ ID NO: 252685 - DNA, 16 bp, P. troglodytes
ggccattatggaaaac

SEQ ID NO: 252686 - DNA, 16 bp, P. troglodytes
ggccattcttctgcct

SEQ ID NO: 252687 - DNA, 16 bp, P. troglodytes
ggccatttgggcagac

SEQ ID NO: 252688 - DNA, 16 bp, P. troglodytes
ggcccaaatagaacaa

SEQ ID NO: 252689 - DNA, 16 bp, P. troglodytes
ggcccaagacaattct

SEQ ID NO: 252690 - DNA, 16 bp, P. troglodytes
ggcccaagagatcctc

SEQ ID NO: 252691 - DNA, 16 bp, P. troglodytes
ggcccaaggactcttc

SEQ ID NO: 252692 - DNA, 16 bp, P. troglodytes
ggcccaaggtcacaca

SEQ ID NO: 252693 - DNA, 16 bp, P. troglodytes
ggcccacaccaccatg

SEQ ID NO: 252694 - DNA, 16 bp, P. troglodytes
ggcccacccagattat

SEQ ID NO: 252695 - DNA, 16 bp, P. troglodytes
ggcccacctggataat

SEQ ID NO: 252696 - DNA, 16 bp, P. troglodytes
ggcccactgcaacctc

SEQ ID NO: 252697 - DNA, 16 bp, P. troglodytes
ggcccagagaggggca

SEQ ID NO: 252698 - DNA, 16 bp, P. troglodytes
ggcccagaggcccagg

SEQ ID NO: 252699 - DNA, 16 bp, P. troglodytes
ggcccagatggcttca

SEQ ID NO: 252700 - DNA, 16 bp, P. troglodytes
ggcccagcccctcctc

SEQ ID NO: 252701 - DNA, 16 bp, P. troglodytes
ggcccagcctggcccc

SEQ ID NO: 252702 - DNA, 16 bp, P. troglodytes
ggcccagctcctgcct

SEQ ID NO: 252703 - DNA, 16 bp, P. troglodytes
ggcccaggaaaccact

SEQ ID NO: 252704 - DNA, 17 bp, P. troglodytes
ggcccaggaactgctaa

SEQ ID NO: 252705 - DNA, 16 bp, P. troglodytes
ggcccaggagggagga

SEQ ID NO: 252706 - DNA, 16 bp, P. troglodytes
ggcccaggagttccag

SEQ ID NO: 252707 - DNA, 16 bp, P. troglodytes
ggcccaggcagaagga

SEQ ID NO: 252708 - DNA, 16 bp, P. troglodytes
ggcccaggcaggagga

SEQ ID NO: 252709 - DNA, 16 bp, P. troglodytes
ggcccaggcaggggga

SEQ ID NO: 252710 - DNA, 16 bp, P. troglodytes
ggcccagggctcactt

SEQ ID NO: 252711 - DNA, 16 bp, P. troglodytes
ggcccaggggctgggg

SEQ ID NO: 252712 - DNA, 16 bp, P. troglodytes
ggcccagggtgtggtg

SEQ ID NO: 252713 - DNA, 16 bp, P. troglodytes
ggcccaggtaggtgga

SEQ ID NO: 252714 - DNA, 16 bp, P. troglodytes
ggcccaggtcaccagg

SEQ ID NO: 252715 - DNA, 16 bp, P. troglodytes
ggccccacagtctggg

SEQ ID NO: 252716 - DNA, 16 bp, P. troglodytes
ggccccacccatcacc

SEQ ID NO: 252717 - DNA, 16 bp, P. troglodytes
ggccccaccctcaagc

SEQ ID NO: 252718 - DNA, 16 bp, P. troglodytes
ggccccacctccaaca

SEQ ID NO: 252719 - DNA, 16 bp, P. troglodytes
ggccccactccagacc

SEQ ID NO: 252720 - DNA, 16 bp, P. troglodytes
ggccccacttccaaca

SEQ ID NO: 252721 - DNA, 16 bp, P. troglodytes
ggccccagcccagacc

SEQ ID NO: 252722 - DNA, 16 bp, P. troglodytes
ggccccagcccctcct

SEQ ID NO: 252723 - DNA, 16 bp, P. troglodytes
ggccccagcctggcca

SEQ ID NO: 252724 - DNA, 16 bp, P. troglodytes
ggccccagctactcgg

SEQ ID NO: 252725 - DNA, 16 bp, P. troglodytes
ggccccaggagaggcc

SEQ ID NO: 252726 - DNA, 16 bp, P. troglodytes
ggccccaggcaagtcc

SEQ ID NO: 252727 - DNA, 16 bp, P. troglodytes
ggcccccacagcgcag

SEQ ID NO: 252728 - DNA, 16 bp, P. troglodytes
ggcccccagccttcag

SEQ ID NO: 252729 - DNA, 16 bp, P. troglodytes
ggccccgcactcggag

SEQ ID NO: 252730 - DNA, 21 bp, P. troglodytes
ggccccgcactcggagcagcc

SEQ ID NO: 252731 - DNA, 16 bp, P. troglodytes
ggcccctcagctgcag

SEQ ID NO: 252732 - DNA, 16 bp, P. troglodytes
ggcccctcctccctca

SEQ ID NO: 252733 - DNA, 16 bp, P. troglodytes
ggccccttccagctct

SEQ ID NO: 252734 - DNA, 16 bp, P. troglodytes
ggcccgcaccaccaca

SEQ ID NO: 252735 - DNA, 18 bp, P. troglodytes
ggcccggctaattttttt

SEQ ID NO: 252736 - DNA, 16 bp, P. troglodytes
ggcccgggaggcagag

SEQ ID NO: 252737 - DNA, 16 bp, P. troglodytes
ggcccgggcatggtgg

SEQ ID NO: 252738 - DNA, 16 bp, P. troglodytes
ggccctcaccagaggc

SEQ ID NO: 252739 - DNA, 16 bp, P. troglodytes
ggccctcagctgcagg

SEQ ID NO: 252740 - DNA, 16 bp, P. troglodytes
ggccctcagtccaaca

SEQ ID NO: 252741 - DNA, 16 bp, P. troglodytes
ggccctgaggcagaaa

SEQ ID NO: 252742 - DNA, 16 bp, P. troglodytes
ggccctgaggcaggaa

SEQ ID NO: 252743 - DNA, 16 bp, P. troglodytes
ggccctgaggcaggac

SEQ ID NO: 252744 - DNA, 16 bp, P. troglodytes
ggccctgcccacacct

SEQ ID NO: 252745 - DNA, 16 bp, P. troglodytes
ggccctgcccaccacc

SEQ ID NO: 252746 - DNA, 16 bp, P. troglodytes
ggccctgcccatcacc

SEQ ID NO: 252747 - DNA, 16 bp, P. troglodytes
ggccctgccctcaggg

SEQ ID NO: 252748 - DNA, 16 bp, P. troglodytes
ggccctgccctgcctt

SEQ ID NO: 252749 - DNA, 16 bp, P. troglodytes
ggccctgccggccctg

SEQ ID NO: 252750 - DNA, 16 bp, P. troglodytes
ggccctgctggccctg

SEQ ID NO: 252751 - DNA, 16 bp, P. troglodytes
ggccctggacctggcc

SEQ ID NO: 252752 - DNA, 16 bp, P. troglodytes
ggccctggcacctcca

SEQ ID NO: 252753 - DNA, 16 bp, P. troglodytes
ggccctggccctggcc

SEQ ID NO: 252754 - DNA, 16 bp, P. troglodytes
ggccctgggagcttgc

SEQ ID NO: 252755 - DNA, 16 bp, P. troglodytes
ggccctgggccaggcc

SEQ ID NO: 252756 - DNA, 16 bp, P. troglodytes
ggccctgggccctggg

SEQ ID NO: 252757 - DNA, 16 bp, P. troglodytes
ggccctggtgtgtgct

SEQ ID NO: 252758 - DNA, 16 bp, P. troglodytes
ggccctgtctgggcat

SEQ ID NO: 252759 - DNA, 16 bp, P. troglodytes
ggcccttcagggagcc

SEQ ID NO: 252760 - DNA, 16 bp, P. troglodytes
ggccgaggaaggagaa

SEQ ID NO: 252761 - DNA, 17 bp, P. troglodytes
ggccgaggagggcagat

SEQ ID NO: 252762 - DNA, 16 bp, P. troglodytes
ggccgaggcagctgga

SEQ ID NO: 252763 - DNA, 17 bp, P. troglodytes
ggccgaggcaggagaat

SEQ ID NO: 252764 - DNA, 16 bp, P. troglodytes
ggccgaggcaggagac

SEQ ID NO: 252765 - DNA, 16 bp, P. troglodytes
ggccgaggcaggagga

SEQ ID NO: 252766 - DNA, 18 bp, P. troglodytes
ggccgaggcaggcggatt

SEQ ID NO: 252767 - DNA, 17 bp, P. troglodytes
ggccgaggcaggtgaat

SEQ ID NO: 252768 - DNA, 17 bp, P. troglodytes
ggccgaggcagttggat

SEQ ID NO: 252769 - DNA, 17 bp, P. troglodytes
ggccgaggcgggtgaat

SEQ ID NO: 252770 - DNA, 16 bp, P. troglodytes
ggccgaggcgggtgat

SEQ ID NO: 252771 - DNA, 22 bp, P. troglodytes
ggccgaggcgggtggatcatct

SEQ ID NO: 252772 - DNA, 17 bp, P. troglodytes
ggccgaggctggtggat

SEQ ID NO: 252773 - DNA, 16 bp, P. troglodytes
ggccgaggtggctgga

SEQ ID NO: 252774 - DNA, 22 bp, P. troglodytes
ggccgaggtgggcagatcacga

SEQ ID NO: 252775 - DNA, 18 bp, P. troglodytes
ggccgaggtgggcagatt

SEQ ID NO: 252776 - DNA, 17 bp, P. troglodytes
ggccgaggtgggcgaat

SEQ ID NO: 252777 - DNA, 17 bp, P. troglodytes
ggccgaggtgtgcagat

SEQ ID NO: 252778 - DNA, 16 bp, P. troglodytes
ggccgcagctcttctc

SEQ ID NO: 252779 - DNA, 16 bp, P. troglodytes
ggccggacgcggtggc

SEQ ID NO: 252780 - DNA, 16 bp, P. troglodytes
ggccggctaatttttt

SEQ ID NO: 252781 - DNA, 16 bp, P. troglodytes
ggccgggcaccgtggc

SEQ ID NO: 252782 - DNA, 18 bp, P. troglodytes
ggccgggcatggtggcac

SEQ ID NO: 252783 - DNA, 16 bp, P. troglodytes
ggccggggtgcagtgg

SEQ ID NO: 252784 - DNA, 19 bp, P. troglodytes
ggccgggtgcggtagctca

SEQ ID NO: 252785 - DNA, 16 bp, P. troglodytes
ggccgtctgcaagctg

SEQ ID NO: 252786 - DNA, 16 bp, P. troglodytes
ggcctacacagagtca

SEQ ID NO: 252787 - DNA, 16 bp, P. troglodytes
ggcctactgggaggtg

SEQ ID NO: 252788 - DNA, 17 bp, P. troglodytes
ggcctaggcaggtggat

SEQ ID NO: 252789 - DNA, 16 bp, P. troglodytes
ggcctaggtgggcaga

SEQ ID NO: 252790 - DNA, 16 bp, P. troglodytes
ggcctatgatggaaaa

SEQ ID NO: 252791 - DNA, 16 bp, P. troglodytes
ggcctatgcctgtaat

SEQ ID NO: 252792 - DNA, 16 bp, P. troglodytes
ggcctcaagcagtccc

SEQ ID NO: 252793 - DNA, 16 bp, P. troglodytes
ggcctcaaggaatcct

SEQ ID NO: 252794 - DNA, 16 bp, P. troglodytes
ggcctcaatgagctcc

SEQ ID NO: 252795 - DNA, 16 bp, P. troglodytes
ggcctcacagtcatgg

SEQ ID NO: 252796 - DNA, 16 bp, P. troglodytes
ggcctcaccatcatgg

SEQ ID NO: 252797 - DNA, 16 bp, P. troglodytes
ggcctcagaggaaacc

SEQ ID NO: 252798 - DNA, 16 bp, P. troglodytes
ggcctcagaggggagg

SEQ ID NO: 252799 - DNA, 16 bp, P. troglodytes
ggcctcagcagcagcc

SEQ ID NO: 252800 - DNA, 16 bp, P. troglodytes
ggcctcaggaagcttc

SEQ ID NO: 252801 - DNA, 16 bp, P. troglodytes
ggcctcaggtgattca

SEQ ID NO: 252802 - DNA, 16 bp, P. troglodytes
ggcctcagtttcctca

SEQ ID NO: 252803 - DNA, 16 bp, P. troglodytes
ggcctcattctgttgc

SEQ ID NO: 252804 - DNA, 16 bp, P. troglodytes
ggcctccaaaatgctg

SEQ ID NO: 252805 - DNA, 16 bp, P. troglodytes
ggcctccagcctccag

SEQ ID NO: 252806 - DNA, 16 bp, P. troglodytes
ggcctccagctccagc

SEQ ID NO: 252807 - DNA, 16 bp, P. troglodytes
ggcctccagctgcacc

SEQ ID NO: 252808 - DNA, 16 bp, P. troglodytes
ggcctcccaaaatgtt

SEQ ID NO: 252809 - DNA, 16 bp, P. troglodytes
ggcctcccaaagcttt

SEQ ID NO: 252810 - DNA, 16 bp, P. troglodytes
ggcctcccaaagtcct

SEQ ID NO: 252811 - DNA, 16 bp, P. troglodytes
ggcctcccaaagtgcc

SEQ ID NO: 252812 - DNA, 22 bp, P. troglodytes
ggcctcccaaagtgctggaatt

SEQ ID NO: 252813 - DNA, 17 bp, P. troglodytes
ggcctcccaaagtgctt

SEQ ID NO: 252814 - DNA, 16 bp, P. troglodytes
ggcctcccaaagtgtc

SEQ ID NO: 252815 - DNA, 16 bp, P. troglodytes
ggcctcccaaggtgct

SEQ ID NO: 252816 - DNA, 16 bp, P. troglodytes
ggcctcccactgtgct

SEQ ID NO: 252817 - DNA, 16 bp, P. troglodytes
ggcctcccagaagtgc

SEQ ID NO: 252818 - DNA, 16 bp, P. troglodytes
ggcctcccagagtgct

SEQ ID NO: 252819 - DNA, 16 bp, P. troglodytes
ggcctccccagccacc

SEQ ID NO: 252820 - DNA, 16 bp, P. troglodytes
ggcctccccagccagg

SEQ ID NO: 252821 - DNA, 16 bp, P. troglodytes
ggcctccccagccatg

SEQ ID NO: 252822 - DNA, 16 bp, P. troglodytes
ggcctccccagccctg

SEQ ID NO: 252823 - DNA, 16 bp, P. troglodytes
ggcctccccagcctca

SEQ ID NO: 252824 - DNA, 16 bp, P. troglodytes
ggcctccccaggcatg

SEQ ID NO: 252825 - DNA, 16 bp, P. troglodytes
ggcctccctgcctcca

SEQ ID NO: 252826 - DNA, 16 bp, P. troglodytes
ggcctccgcctcctgg

SEQ ID NO: 252827 - DNA, 16 bp, P. troglodytes
ggcctcctcggcctcc

SEQ ID NO: 252828 - DNA, 16 bp, P. troglodytes
ggcctcctgaagtact

SEQ ID NO: 252829 - DNA, 16 bp, P. troglodytes
ggcctcctggaggagg

SEQ ID NO: 252830 - DNA, 16 bp, P. troglodytes
ggcctccttagccatg

SEQ ID NO: 252831 - DNA, 16 bp, P. troglodytes
ggcctcggccagcccc

SEQ ID NO: 252832 - DNA, 16 bp, P. troglodytes
ggcctctcaaagtgtt

SEQ ID NO: 252833 - DNA, 16 bp, P. troglodytes
ggcctctcagaggagg

SEQ ID NO: 252834 - DNA, 16 bp, P. troglodytes
ggcctctccagccacg

SEQ ID NO: 252835 - DNA, 16 bp, P. troglodytes
ggcctctccctgctcc

SEQ ID NO: 252836 - DNA, 16 bp, P. troglodytes
ggcctctcctggggcc

SEQ ID NO: 252837 - DNA, 16 bp, P. troglodytes
ggcctctccttggctt

SEQ ID NO: 252838 - DNA, 16 bp, P. troglodytes
ggcctctctctctctc

SEQ ID NO: 252839 - DNA, 16 bp, P. troglodytes
ggcctctctctgctcc

SEQ ID NO: 252840 - DNA, 16 bp, P. troglodytes
ggcctctctgtgcagc

SEQ ID NO: 252841 - DNA, 16 bp, P. troglodytes
ggcctctgagctcaag

SEQ ID NO: 252842 - DNA, 16 bp, P. troglodytes
ggcctctggaacttct

SEQ ID NO: 252843 - DNA, 16 bp, P. troglodytes
ggcctctggccaacag

SEQ ID NO: 252844 - DNA, 16 bp, P. troglodytes
ggcctctggctccatc

SEQ ID NO: 252845 - DNA, 16 bp, P. troglodytes
ggcctctgggcctgtg

SEQ ID NO: 252846 - DNA, 16 bp, P. troglodytes
ggcctctgggggtgac

SEQ ID NO: 252847 - DNA, 16 bp, P. troglodytes
ggcctctgtccttggc

SEQ ID NO: 252848 - DNA, 16 bp, P. troglodytes
ggcctctgtgtcccta

SEQ ID NO: 252849 - DNA, 16 bp, P. troglodytes
ggcctgaagcctgggg

SEQ ID NO: 252850 - DNA, 16 bp, P. troglodytes
ggcctgactgatgtca

SEQ ID NO: 252851 - DNA, 16 bp, P. troglodytes
ggcctgagaaccagga

SEQ ID NO: 252852 - DNA, 16 bp, P. troglodytes
ggcctgagaaccaggg

SEQ ID NO: 252853 - DNA, 16 bp, P. troglodytes
ggcctgagccaccacc

SEQ ID NO: 252854 - DNA, 16 bp, P. troglodytes
ggcctgagcccctagg

SEQ ID NO: 252855 - DNA, 16 bp, P. troglodytes
ggcctgagctactgca

SEQ ID NO: 252856 - DNA, 16 bp, P. troglodytes
ggcctgagctctgcct

SEQ ID NO: 252857 - DNA, 16 bp, P. troglodytes
ggcctgaggcaggaga

SEQ ID NO: 252858 - DNA, 16 bp, P. troglodytes
ggcctgatcatggctc

SEQ ID NO: 252859 - DNA, 16 bp, P. troglodytes
ggcctgcaaagcctaa

SEQ ID NO: 252860 - DNA, 16 bp, P. troglodytes
ggcctgcaccaccatg

SEQ ID NO: 252861 - DNA, 16 bp, P. troglodytes
ggcctgcccctccaca

SEQ ID NO: 252862 - DNA, 16 bp, P. troglodytes
ggcctgcgccaccaca

SEQ ID NO: 252863 - DNA, 16 bp, P. troglodytes
ggcctgctgctcacct

SEQ ID NO: 252864 - DNA, 16 bp, P. troglodytes
ggcctggaaaaagcac

SEQ ID NO: 252865 - DNA, 16 bp, P. troglodytes
ggcctggaggcccagg

SEQ ID NO: 252866 - DNA, 16 bp, P. troglodytes
ggcctggaggcctagg

SEQ ID NO: 252867 - DNA, 16 bp, P. troglodytes
ggcctggaggcctggg

SEQ ID NO: 252868 - DNA, 16 bp, P. troglodytes
ggcctggagtgcagtg

SEQ ID NO: 252869 - DNA, 16 bp, P. troglodytes
ggcctggagttcaaga

SEQ ID NO: 252870 - DNA, 16 bp, P. troglodytes
ggcctggatatggttt

SEQ ID NO: 252871 - DNA, 16 bp, P. troglodytes
ggcctggcacacagca

SEQ ID NO: 252872 - DNA, 16 bp, P. troglodytes
ggcctggcagaggggc

SEQ ID NO: 252873 - DNA, 16 bp, P. troglodytes
ggcctggcaggggctg

SEQ ID NO: 252874 - DNA, 16 bp, P. troglodytes
ggcctggccaacatgg

SEQ ID NO: 252875 - DNA, 16 bp, P. troglodytes
ggcctggccaacgtgg

SEQ ID NO: 252876 - DNA, 16 bp, P. troglodytes
ggcctggccaatcaga

SEQ ID NO: 252877 - DNA, 16 bp, P. troglodytes
ggcctggcccagtggc

SEQ ID NO: 252878 - DNA, 16 bp, P. troglodytes
ggcctggcccataaaa

SEQ ID NO: 252879 - DNA, 16 bp, P. troglodytes
ggcctggcctgggctc

SEQ ID NO: 252880 - DNA, 16 bp, P. troglodytes
ggcctggctggggctg

SEQ ID NO: 252881 - DNA, 16 bp, P. troglodytes
ggcctgggcaaaagag

SEQ ID NO: 252882 - DNA, 16 bp, P. troglodytes
ggcctgggcctggccc

SEQ ID NO: 252883 - DNA, 16 bp, P. troglodytes
ggcctgggctcagagg

SEQ ID NO: 252884 - DNA, 16 bp, P. troglodytes
ggcctgggtgacagaa

SEQ ID NO: 252885 - DNA, 16 bp, P. troglodytes
ggcctgggtgcagtgg

SEQ ID NO: 252886 - DNA, 17 bp, P. troglodytes
ggcctggtgcagtggct

SEQ ID NO: 252887 - DNA, 16 bp, P. troglodytes
ggcctggtggcacacg

SEQ ID NO: 252888 - DNA, 17 bp, P. troglodytes
ggcctggtggtgacaaa

SEQ ID NO: 252889 - DNA, 16 bp, P. troglodytes
ggcctggtggtgacag

SEQ ID NO: 252890 - DNA, 17 bp, P. troglodytes
ggcctggtggtgagaaa

SEQ ID NO: 252891 - DNA, 16 bp, P. troglodytes
ggcctgtaaccccagc

SEQ ID NO: 252892 - DNA, 18 bp, P. troglodytes
ggcctgtaatcccagctc

SEQ ID NO: 252893 - DNA, 16 bp, P. troglodytes
ggcctgtaatcgcagc

SEQ ID NO: 252894 - DNA, 16 bp, P. troglodytes
ggcctgtaatctcagc

SEQ ID NO: 252895 - DNA, 16 bp, P. troglodytes
ggcctgtctccttggc

SEQ ID NO: 252896 - DNA, 16 bp, P. troglodytes
ggcctgtgatgggagg

SEQ ID NO: 252897 - DNA, 16 bp, P. troglodytes
ggcctgtggctgccag

SEQ ID NO: 252898 - DNA, 16 bp, P. troglodytes
ggccttagctgcctcc

SEQ ID NO: 252899 - DNA, 16 bp, P. troglodytes
ggccttcacagcctcc

SEQ ID NO: 252900 - DNA, 16 bp, P. troglodytes
ggccttcatctttctc

SEQ ID NO: 252901 - DNA, 16 bp, P. troglodytes
ggccttcccagccctg

SEQ ID NO: 252902 - DNA, 16 bp, P. troglodytes
ggccttcccaggcccc

SEQ ID NO: 252903 - DNA, 16 bp, P. troglodytes
ggccttccttgaccac

SEQ ID NO: 252904 - DNA, 16 bp, P. troglodytes
ggccttctcagtctta

SEQ ID NO: 252905 - DNA, 16 bp, P. troglodytes
ggccttgctctgtcac

SEQ ID NO: 252906 - DNA, 16 bp, P. troglodytes
ggccttgctgagctgc

SEQ ID NO: 252907 - DNA, 16 bp, P. troglodytes
ggccttggcagcttcc

SEQ ID NO: 252908 - DNA, 16 bp, P. troglodytes
ggccttggctgccttc

SEQ ID NO: 252909 - DNA, 16 bp, P. troglodytes
ggccttgggagcccat

SEQ ID NO: 252910 - DNA, 16 bp, P. troglodytes
ggccttggttttctca

SEQ ID NO: 252911 - DNA, 16 bp, P. troglodytes
ggcctttgcatctgct

SEQ ID NO: 252912 - DNA, 16 bp, P. troglodytes
ggcctttgcccttgct

SEQ ID NO: 252913 - DNA, 16 bp, P. troglodytes
ggcgaaacctcgtctc

SEQ ID NO: 252914 - DNA, 16 bp, P. troglodytes
ggcgaatcacctgagg

SEQ ID NO: 252915 - DNA, 17 bp, P. troglodytes
ggcgacaagagtgaaat

SEQ ID NO: 252916 - DNA, 16 bp, P. troglodytes
ggcgacagagcaagaa

SEQ ID NO: 252917 - DNA, 16 bp, P. troglodytes
ggcgacagagcaagac

SEQ ID NO: 252918 - DNA, 17 bp, P. troglodytes
ggcgacagagtaagacc

SEQ ID NO: 252919 - DNA, 16 bp, P. troglodytes
ggcgacagtgcaagac

SEQ ID NO: 252920 - DNA, 16 bp, P. troglodytes
ggcgacatagtgagac

SEQ ID NO: 252921 - DNA, 16 bp, P. troglodytes
ggcgaggtgcagtggc

SEQ ID NO: 252922 - DNA, 18 bp, P. troglodytes
ggcgcagtggcaggtgcc

SEQ ID NO: 252923 - DNA, 19 bp, P. troglodytes
ggcgcagtggctcacgcct

SEQ ID NO: 252924 - DNA, 17 bp, P. troglodytes
ggcgcagtggctcgcgc

SEQ ID NO: 252925 - DNA, 16 bp, P. troglodytes
ggcgcagttgctcaca

SEQ ID NO: 252926 - DNA, 16 bp, P. troglodytes
ggcgccatggctcacg

SEQ ID NO: 252927 - DNA, 18 bp, P. troglodytes
ggcgcctatagtcccagc

SEQ ID NO: 252928 - DNA, 16 bp, P. troglodytes
ggcgcctgccaccaaa

SEQ ID NO: 252929 - DNA, 16 bp, P. troglodytes
ggcgcctgccactgtg

SEQ ID NO: 252930 - DNA, 16 bp, P. troglodytes
ggcgcgcaccaccacg

SEQ ID NO: 252931 - DNA, 17 bp, P. troglodytes
ggcgcggcggctcacgc

SEQ ID NO: 252932 - DNA, 19 bp, P. troglodytes
ggcgcggtggctcacgcct

SEQ ID NO: 252933 - DNA, 19 bp, P. troglodytes
ggcgcggtggttcacgcct

SEQ ID NO: 252934 - DNA, 16 bp, P. troglodytes
ggcgctacctcggctc

SEQ ID NO: 252935 - DNA, 16 bp, P. troglodytes
ggcgctgtggagcagg

SEQ ID NO: 252936 - DNA, 16 bp, P. troglodytes
ggcggaagcaggagaa

SEQ ID NO: 252937 - DNA, 16 bp, P. troglodytes
ggcggaggcaggtgga

SEQ ID NO: 252938 - DNA, 16 bp, P. troglodytes
ggcggaggctgccgtg

SEQ ID NO: 252939 - DNA, 16 bp, P. troglodytes
ggcggaggctgcggtg

SEQ ID NO: 252940 - DNA, 16 bp, P. troglodytes
ggcggaggtggcagtg

SEQ ID NO: 252941 - DNA, 17 bp, P. troglodytes
ggcggatcacaaagtca

SEQ ID NO: 252942 - DNA, 16 bp, P. troglodytes
ggcggatcaccggagg

SEQ ID NO: 252943 - DNA, 16 bp, P. troglodytes
ggcggatcacctgagt

SEQ ID NO: 252944 - DNA, 16 bp, P. troglodytes
ggcggatcacttgagt

SEQ ID NO: 252945 - DNA, 16 bp, P. troglodytes
ggcggatcgcttgagg

SEQ ID NO: 252946 - DNA, 16 bp, P. troglodytes
ggcggcagacaagaga

SEQ ID NO: 252947 - DNA, 16 bp, P. troglodytes
ggcggcagagagagac

SEQ ID NO: 252948 - DNA, 16 bp, P. troglodytes
ggcggcagccaggctg

SEQ ID NO: 252949 - DNA, 16 bp, P. troglodytes
ggcggcaggtgcctgt

SEQ ID NO: 252950 - DNA, 16 bp, P. troglodytes
ggcggccaggcagagg

SEQ ID NO: 252951 - DNA, 16 bp, P. troglodytes
ggcggcgcgtctggag

SEQ ID NO: 252952 - DNA, 18 bp, P. troglodytes
ggcgggatctcggctcac

SEQ ID NO: 252953 - DNA, 16 bp, P. troglodytes
ggcgggcagctccacc

SEQ ID NO: 252954 - DNA, 17 bp, P. troglodytes
ggcgggtcacgaggtca

SEQ ID NO: 252955 - DNA, 16 bp, P. troglodytes
ggcgggtggatagctt

SEQ ID NO: 252956 - DNA, 17 bp, P. troglodytes
ggcggtggctcacgcct

SEQ ID NO: 252957 - DNA, 16 bp, P. troglodytes
ggcggttgcagtgagc

SEQ ID NO: 252958 - DNA, 17 bp, P. troglodytes
ggcgtaaacccgggagg

SEQ ID NO: 252959 - DNA, 16 bp, P. troglodytes
ggcgtagtggtgcatg

SEQ ID NO: 252960 - DNA, 16 bp, P. troglodytes
ggcgtctcgctctgtc

SEQ ID NO: 252961 - DNA, 16 bp, P. troglodytes
ggcgtcttgctctgtt

SEQ ID NO: 252962 - DNA, 17 bp, P. troglodytes
ggcgtgaacccaggagg

SEQ ID NO: 252963 - DNA, 17 bp, P. troglodytes
ggcgtgaacccgggagg

SEQ ID NO: 252964 - DNA, 17 bp, P. troglodytes
ggcgtgaacctgggagg

SEQ ID NO: 252965 - DNA, 17 bp, P. troglodytes
ggcgtgaactcgggagg

SEQ ID NO: 252966 - DNA, 16 bp, P. troglodytes
ggcgtgagccaccatt

SEQ ID NO: 252967 - DNA, 23 bp, P. troglodytes
ggcgtgatcttggctcactgcag

SEQ ID NO: 252968 - DNA, 16 bp, P. troglodytes
ggcgtgatcttggttc

SEQ ID NO: 252969 - DNA, 16 bp, P. troglodytes
ggcgtgccccaccacg

SEQ ID NO: 252970 - DNA, 16 bp, P. troglodytes
ggcgtggcagcgtgtg

SEQ ID NO: 252971 - DNA, 16 bp, P. troglodytes
ggcgtggcggcgggca

SEQ ID NO: 252972 - DNA, 16 bp, P. troglodytes
ggcgtggtagtgcaca

SEQ ID NO: 252973 - DNA, 16 bp, P. troglodytes
ggcgtggtggcacact

SEQ ID NO: 252974 - DNA, 16 bp, P. troglodytes
ggctaaacagaaacca

SEQ ID NO: 252975 - DNA, 16 bp, P. troglodytes
ggctaaattttttttt

SEQ ID NO: 252976 - DNA, 16 bp, P. troglodytes
ggctaactgcaacctc

SEQ ID NO: 252977 - DNA, 16 bp, P. troglodytes
ggctaactgcagcctc

SEQ ID NO: 252978 - DNA, 16 bp, P. troglodytes
ggctaacttttgtgtt

SEQ ID NO: 252979 - DNA, 16 bp, P. troglodytes
ggctaacttttttttt

SEQ ID NO: 252980 - DNA, 16 bp, P. troglodytes
ggctaaggaaggagga

SEQ ID NO: 252981 - DNA, 16 bp, P. troglodytes
ggctaaggcaagagaa

SEQ ID NO: 252982 - DNA, 16 bp, P. troglodytes
ggctaaggctggtgga

SEQ ID NO: 252983 - DNA, 16 bp, P. troglodytes
ggctaagttttgtatt

SEQ ID NO: 252984 - DNA, 16 bp, P. troglodytes
ggctaataaaggactc

SEQ ID NO: 252985 - DNA, 16 bp, P. troglodytes
ggctaatgttttttat

SEQ ID NO: 252986 - DNA, 16 bp, P. troglodytes
ggctaattaaaaaaat

SEQ ID NO: 252987 - DNA, 16 bp, P. troglodytes
ggctaattttttgtag

SEQ ID NO: 252988 - DNA, 16 bp, P. troglodytes
ggctacagccacacct

SEQ ID NO: 252989 - DNA, 16 bp, P. troglodytes
ggctacagcggctttg

SEQ ID NO: 252990 - DNA, 16 bp, P. troglodytes
ggctacatgtgcagaa

SEQ ID NO: 252991 - DNA, 16 bp, P. troglodytes
ggctacccaggaggct

SEQ ID NO: 252992 - DNA, 16 bp, P. troglodytes
ggctacctgggggcca

SEQ ID NO: 252993 - DNA, 16 bp, P. troglodytes
ggctagagcaggagga

SEQ ID NO: 252994 - DNA, 16 bp, P. troglodytes
ggctagagtgtagtga

SEQ ID NO: 252995 - DNA, 16 bp, P. troglodytes
ggctagccagttctct

SEQ ID NO: 252996 - DNA, 16 bp, P. troglodytes
ggctaggaaaggaaaa

SEQ ID NO: 252997 - DNA, 16 bp, P. troglodytes
ggctaggattacaggc

SEQ ID NO: 252998 - DNA, 16 bp, P. troglodytes
ggctatagtgagccaa

SEQ ID NO: 252999 - DNA, 16 bp, P. troglodytes
ggctatccaggagccc

SEQ ID NO: 253000 - DNA, 16 bp, P. troglodytes
ggctatctgcaagcca

SEQ ID NO: 253001 - DNA, 16 bp, P. troglodytes
ggctatgtgggctcct

SEQ ID NO: 253002 - DNA, 16 bp, P. troglodytes
ggctattattgaaaag

SEQ ID NO: 253003 - DNA, 16 bp, P. troglodytes
ggctcaaacaattctc

SEQ ID NO: 253004 - DNA, 16 bp, P. troglodytes
ggctcaagacccagga

SEQ ID NO: 253005 - DNA, 16 bp, P. troglodytes
ggctcaagcaatccac

SEQ ID NO: 253006 - DNA, 16 bp, P. troglodytes
ggctcaagcaatcctt

SEQ ID NO: 253007 - DNA, 16 bp, P. troglodytes
ggctcaagcaatcttc

SEQ ID NO: 253008 - DNA, 16 bp, P. troglodytes
ggctcaagcagtcttc

SEQ ID NO: 253009 - DNA, 16 bp, P. troglodytes
ggctcaagcgattctc

SEQ ID NO: 253010 - DNA, 16 bp, P. troglodytes
ggctcaagtaatcctc

SEQ ID NO: 253011 - DNA, 16 bp, P. troglodytes
ggctcaagtctgggaa

SEQ ID NO: 253012 - DNA, 16 bp, P. troglodytes
ggctcaagtgaccctc

SEQ ID NO: 253013 - DNA, 16 bp, P. troglodytes
ggctcaagtgatcctt

SEQ ID NO: 253014 - DNA, 16 bp, P. troglodytes
ggctcaagtgattctc

SEQ ID NO: 253015 - DNA, 16 bp, P. troglodytes
ggctcaatgcaacctc

SEQ ID NO: 253016 - DNA, 16 bp, P. troglodytes
ggctcaatgtaacctc

SEQ ID NO: 253017 - DNA, 16 bp, P. troglodytes
ggctcacagcaacctc

SEQ ID NO: 253018 - DNA, 16 bp, P. troglodytes
ggctcacagcaacctt

SEQ ID NO: 253019 - DNA, 16 bp, P. troglodytes
ggctcaccacaacctc

SEQ ID NO: 253020 - DNA, 16 bp, P. troglodytes
ggctcaccacaatctc

SEQ ID NO: 253021 - DNA, 16 bp, P. troglodytes
ggctcaccacatcctc

SEQ ID NO: 253022 - DNA, 16 bp, P. troglodytes
ggctcacccagataat

SEQ ID NO: 253023 - DNA, 16 bp, P. troglodytes
ggctcaccgcaacctc

SEQ ID NO: 253024 - DNA, 16 bp, P. troglodytes
ggctcaccgcaagctc

SEQ ID NO: 253025 - DNA, 16 bp, P. troglodytes
ggctcaccgcagcctc

SEQ ID NO: 253026 - DNA, 16 bp, P. troglodytes
ggctcacctcaacctc

SEQ ID NO: 253027 - DNA, 16 bp, P. troglodytes
ggctcactacaacctc

SEQ ID NO: 253028 - DNA, 16 bp, P. troglodytes
ggctcactacaacctt

SEQ ID NO: 253029 - DNA, 16 bp, P. troglodytes
ggctcactacaagctc

SEQ ID NO: 253030 - DNA, 16 bp, P. troglodytes
ggctcactataacctc

SEQ ID NO: 253031 - DNA, 16 bp, P. troglodytes
ggctcactccagcctc

SEQ ID NO: 253032 - DNA, 16 bp, P. troglodytes
ggctcactgaaacctc

SEQ ID NO: 253033 - DNA, 16 bp, P. troglodytes
ggctcactgaagtctt

SEQ ID NO: 253034 - DNA, 16 bp, P. troglodytes
ggctcactgcaaaatc

SEQ ID NO: 253035 - DNA, 16 bp, P. troglodytes
ggctcactgcaaactc

SEQ ID NO: 253036 - DNA, 16 bp, P. troglodytes
ggctcactgcaacatc

SEQ ID NO: 253037 - DNA, 16 bp, P. troglodytes
ggctcactgcaaccac

SEQ ID NO: 253038 - DNA, 16 bp, P. troglodytes
ggctcactgcaaccct

SEQ ID NO: 253039 - DNA, 16 bp, P. troglodytes
ggctcactgcaacctc

SEQ ID NO: 253040 - DNA, 16 bp, P. troglodytes
ggctcactgcaacctg

SEQ ID NO: 253041 - DNA, 16 bp, P. troglodytes
ggctcactgcaacctt

SEQ ID NO: 253042 - DNA, 16 bp, P. troglodytes
ggctcactgcaacttc

SEQ ID NO: 253043 - DNA, 16 bp, P. troglodytes
ggctcactgcaagctc

SEQ ID NO: 253044 - DNA, 18 bp, P. troglodytes
ggctcactgcaagctctg

SEQ ID NO: 253045 - DNA, 16 bp, P. troglodytes
ggctcactgcaatctc

SEQ ID NO: 253046 - DNA, 16 bp, P. troglodytes
ggctcactgcaatgtc

SEQ ID NO: 253047 - DNA, 16 bp, P. troglodytes
ggctcactgcaccctc

SEQ ID NO: 253048 - DNA, 16 bp, P. troglodytes
ggctcactgcacctcc

SEQ ID NO: 253049 - DNA, 16 bp, P. troglodytes
ggctcactgcagcctc

SEQ ID NO: 253050 - DNA, 16 bp, P. troglodytes
ggctcactgcagcctt

SEQ ID NO: 253051 - DNA, 16 bp, P. troglodytes
ggctcactgcagcttc

SEQ ID NO: 253052 - DNA, 16 bp, P. troglodytes
ggctcactgcaggctc

SEQ ID NO: 253053 - DNA, 16 bp, P. troglodytes
ggctcactgcagtctc

SEQ ID NO: 253054 - DNA, 16 bp, P. troglodytes
ggctcactgcatcctc

SEQ ID NO: 253055 - DNA, 16 bp, P. troglodytes
ggctcactgcatgctc

SEQ ID NO: 253056 - DNA, 16 bp, P. troglodytes
ggctcactgccacctc

SEQ ID NO: 253057 - DNA, 16 bp, P. troglodytes
ggctcactgcctcctg

SEQ ID NO: 253058 - DNA, 16 bp, P. troglodytes
ggctcactgcgacctc

SEQ ID NO: 253059 - DNA, 16 bp, P. troglodytes
ggctcactgctacctc

SEQ ID NO: 253060 - DNA, 16 bp, P. troglodytes
ggctcactgtaacctc

SEQ ID NO: 253061 - DNA, 16 bp, P. troglodytes
ggctcactgtaacttc

SEQ ID NO: 253062 - DNA, 16 bp, P. troglodytes
ggctcactgtagcctc

SEQ ID NO: 253063 - DNA, 16 bp, P. troglodytes
ggctcactgtagtctc

SEQ ID NO: 253064 - DNA, 16 bp, P. troglodytes
ggctcactgtgacctc

SEQ ID NO: 253065 - DNA, 16 bp, P. troglodytes
ggctcagaacagagag

SEQ ID NO: 253066 - DNA, 16 bp, P. troglodytes
ggctcagagagggaag

SEQ ID NO: 253067 - DNA, 16 bp, P. troglodytes
ggctcagagcatggcc

SEQ ID NO: 253068 - DNA, 16 bp, P. troglodytes
ggctcagaggagcctg

SEQ ID NO: 253069 - DNA, 16 bp, P. troglodytes
ggctcagagggtccca

SEQ ID NO: 253070 - DNA, 16 bp, P. troglodytes
ggctcagcctccccag

SEQ ID NO: 253071 - DNA, 16 bp, P. troglodytes
ggctcaggcaggagga

SEQ ID NO: 253072 - DNA, 16 bp, P. troglodytes
ggctcaggcgatcctc

SEQ ID NO: 253073 - DNA, 16 bp, P. troglodytes
ggctcaggtgggtgga

SEQ ID NO: 253074 - DNA, 16 bp, P. troglodytes
ggctcagtgcaacctc

SEQ ID NO: 253075 - DNA, 16 bp, P. troglodytes
ggctcatacctacaat

SEQ ID NO: 253076 - DNA, 16 bp, P. troglodytes
ggctcatgcacggtgc

SEQ ID NO: 253077 - DNA, 16 bp, P. troglodytes
ggctcatggcaacctc

SEQ ID NO: 253078 - DNA, 16 bp, P. troglodytes
ggctcattgcaacctc

SEQ ID NO: 253079 - DNA, 16 bp, P. troglodytes
ggctcattgcaatctc

SEQ ID NO: 253080 - DNA, 16 bp, P. troglodytes
ggctcattgcagcctc

SEQ ID NO: 253081 - DNA, 16 bp, P. troglodytes
ggctccaccctcatga

SEQ ID NO: 253082 - DNA, 16 bp, P. troglodytes
ggctccacctcctggg

SEQ ID NO: 253083 - DNA, 16 bp, P. troglodytes
ggctccaggctccagg

SEQ ID NO: 253084 - DNA, 16 bp, P. troglodytes
ggctccatcaaaaaaa

SEQ ID NO: 253085 - DNA, 16 bp, P. troglodytes
ggctccatgtctcaca

SEQ ID NO: 253086 - DNA, 16 bp, P. troglodytes
ggctcccaaactgctg

SEQ ID NO: 253087 - DNA, 16 bp, P. troglodytes
ggctcccaccaccaca

SEQ ID NO: 253088 - DNA, 16 bp, P. troglodytes
ggctcccacctcacag

SEQ ID NO: 253089 - DNA, 16 bp, P. troglodytes
ggctcccacctgttcc

SEQ ID NO: 253090 - DNA, 16 bp, P. troglodytes
ggctcccaggaggagg

SEQ ID NO: 253091 - DNA, 16 bp, P. troglodytes
ggctcccaggctggag

SEQ ID NO: 253092 - DNA, 16 bp, P. troglodytes
ggctcccaggtagctg

SEQ ID NO: 253093 - DNA, 16 bp, P. troglodytes
ggctccctcagcttgc

SEQ ID NO: 253094 - DNA, 16 bp, P. troglodytes
ggctccctgaggacag

SEQ ID NO: 253095 - DNA, 16 bp, P. troglodytes
ggctccctgcaacctc

SEQ ID NO: 253096 - DNA, 16 bp, P. troglodytes
ggctccctggaggagg

SEQ ID NO: 253097 - DNA, 17 bp, P. troglodytes
ggctcctcacatcccag

SEQ ID NO: 253098 - DNA, 16 bp, P. troglodytes
ggctcctgaaggaagc

SEQ ID NO: 253099 - DNA, 16 bp, P. troglodytes
ggctcctgaagtgctg

SEQ ID NO: 253100 - DNA, 16 bp, P. troglodytes
ggctcctgcctgctcc

SEQ ID NO: 253101 - DNA, 16 bp, P. troglodytes
ggctccttgaagttat

SEQ ID NO: 253102 - DNA, 16 bp, P. troglodytes
ggctccttgatcttgg

SEQ ID NO: 253103 - DNA, 16 bp, P. troglodytes
ggctcgagcaattctc

SEQ ID NO: 253104 - DNA, 19 bp, P. troglodytes
ggctcgccatgcctgctgg

SEQ ID NO: 253105 - DNA, 16 bp, P. troglodytes
ggctcgctgcaacctc

SEQ ID NO: 253106 - DNA, 16 bp, P. troglodytes
ggctcgggcatggcgg

SEQ ID NO: 253107 - DNA, 16 bp, P. troglodytes
ggctcgtcctgctaca

SEQ ID NO: 253108 - DNA, 16 bp, P. troglodytes
ggctcgttgcagcctc

SEQ ID NO: 253109 - DNA, 16 bp, P. troglodytes
ggctctaccctcatga

SEQ ID NO: 253110 - DNA, 16 bp, P. troglodytes
ggctctagaggagaat

SEQ ID NO: 253111 - DNA, 16 bp, P. troglodytes
ggctctcagcttgaat

SEQ ID NO: 253112 - DNA, 16 bp, P. troglodytes
ggctctcattttctct

SEQ ID NO: 253113 - DNA, 16 bp, P. troglodytes
ggctctcctgccctgc

SEQ ID NO: 253114 - DNA, 16 bp, P. troglodytes
ggctctccttgctcct

SEQ ID NO: 253115 - DNA, 16 bp, P. troglodytes
ggctctcgctctgttg

SEQ ID NO: 253116 - DNA, 16 bp, P. troglodytes
ggctctctccttggct

SEQ ID NO: 253117 - DNA, 16 bp, P. troglodytes
ggctctctgcaacctc

SEQ ID NO: 253118 - DNA, 16 bp, P. troglodytes
ggctctctttttgtct

SEQ ID NO: 253119 - DNA, 16 bp, P. troglodytes
ggctctgaaatgtccc

SEQ ID NO: 253120 - DNA, 16 bp, P. troglodytes
ggctctgaggactgcc

SEQ ID NO: 253121 - DNA, 16 bp, P. troglodytes
ggctctgccccccggg

SEQ ID NO: 253122 - DNA, 16 bp, P. troglodytes
ggctctgcctcccggg

SEQ ID NO: 253123 - DNA, 16 bp, P. troglodytes
ggctctgcttctgggg

SEQ ID NO: 253124 - DNA, 16 bp, P. troglodytes
ggctctggagccagac

SEQ ID NO: 253125 - DNA, 16 bp, P. troglodytes
ggctctggcctcggcc

SEQ ID NO: 253126 - DNA, 16 bp, P. troglodytes
ggctctgtcctcatga

SEQ ID NO: 253127 - DNA, 16 bp, P. troglodytes
ggctctgtggctcctg

SEQ ID NO: 253128 - DNA, 16 bp, P. troglodytes
ggctctgtgggcatgg

SEQ ID NO: 253129 - DNA, 16 bp, P. troglodytes
ggctctgttctgtttc

SEQ ID NO: 253130 - DNA, 16 bp, P. troglodytes
ggctcttcctgctgct

SEQ ID NO: 253131 - DNA, 16 bp, P. troglodytes
ggctcttgagacagga

SEQ ID NO: 253132 - DNA, 16 bp, P. troglodytes
ggctctttccccttca

SEQ ID NO: 253133 - DNA, 16 bp, P. troglodytes
ggctcttttttggttc

SEQ ID NO: 253134 - DNA, 16 bp, P. troglodytes
ggctgaaaaactacct

SEQ ID NO: 253135 - DNA, 16 bp, P. troglodytes
ggctgaaagaggccaa

SEQ ID NO: 253136 - DNA, 16 bp, P. troglodytes
ggctgaaaggggccaa

SEQ ID NO: 253137 - DNA, 16 bp, P. troglodytes
ggctgaacttgaactc

SEQ ID NO: 253138 - DNA, 16 bp, P. troglodytes
ggctgaagagggaaga

SEQ ID NO: 253139 - DNA, 16 bp, P. troglodytes
ggctgaagcagcagaa

SEQ ID NO: 253140 - DNA, 16 bp, P. troglodytes
ggctgaagcagcagga

SEQ ID NO: 253141 - DNA, 16 bp, P. troglodytes
ggctgaagcaggagat

SEQ ID NO: 253142 - DNA, 16 bp, P. troglodytes
ggctgaagcaggagga

SEQ ID NO: 253143 - DNA, 16 bp, P. troglodytes
ggctgaagccatcctc

SEQ ID NO: 253144 - DNA, 16 bp, P. troglodytes
ggctgaagcgggagaa

SEQ ID NO: 253145 - DNA, 16 bp, P. troglodytes
ggctgaagcgggagga

SEQ ID NO: 253146 - DNA, 16 bp, P. troglodytes
ggctgaagcgggtgga

SEQ ID NO: 253147 - DNA, 16 bp, P. troglodytes
ggctgaagctggagaa

SEQ ID NO: 253148 - DNA, 16 bp, P. troglodytes
ggctgaagctggagga

SEQ ID NO: 253149 - DNA, 16 bp, P. troglodytes
ggctgaaggaggagga

SEQ ID NO: 253150 - DNA, 16 bp, P. troglodytes
ggctgaagggctcctc

SEQ ID NO: 253151 - DNA, 18 bp, P. troglodytes
ggctgaagggctcctcaa

SEQ ID NO: 253152 - DNA, 16 bp, P. troglodytes
ggctgaaggtgaaggg

SEQ ID NO: 253153 - DNA, 20 bp, P. troglodytes
ggctgaagtgcagtggtgcg

SEQ ID NO: 253154 - DNA, 16 bp, P. troglodytes
ggctgaagtgctctgg

SEQ ID NO: 253155 - DNA, 16 bp, P. troglodytes
ggctgaagttggagga

SEQ ID NO: 253156 - DNA, 16 bp, P. troglodytes
ggctgaatggggagga

SEQ ID NO: 253157 - DNA, 16 bp, P. troglodytes
ggctgacatgggagga

SEQ ID NO: 253158 - DNA, 17 bp, P. troglodytes
ggctgacccccacctcc

SEQ ID NO: 253159 - DNA, 16 bp, P. troglodytes
ggctgactgcaacctc

SEQ ID NO: 253160 - DNA, 16 bp, P. troglodytes
ggctgagaaaccctgg

SEQ ID NO: 253161 - DNA, 16 bp, P. troglodytes
ggctgagaagggaagg

SEQ ID NO: 253162 - DNA, 16 bp, P. troglodytes
ggctgagaagggtgga

SEQ ID NO: 253163 - DNA, 16 bp, P. troglodytes
ggctgagaagttcaag

SEQ ID NO: 253164 - DNA, 17 bp, P. troglodytes
ggctgagacaggcagat

SEQ ID NO: 253165 - DNA, 16 bp, P. troglodytes
ggctgagaggggcaga

SEQ ID NO: 253166 - DNA, 16 bp, P. troglodytes
ggctgagaggtgggag

SEQ ID NO: 253167 - DNA, 16 bp, P. troglodytes
ggctgagatgatggag

SEQ ID NO: 253168 - DNA, 16 bp, P. troglodytes
ggctgagatgcagggc

SEQ ID NO: 253169 - DNA, 16 bp, P. troglodytes
ggctgagatggacaga

SEQ ID NO: 253170 - DNA, 17 bp, P. troglodytes
ggctgagccgggtggat

SEQ ID NO: 253171 - DNA, 16 bp, P. troglodytes
ggctgagcgcggtggc

SEQ ID NO: 253172 - DNA, 16 bp, P. troglodytes
ggctgagcgtggtggc

SEQ ID NO: 253173 - DNA, 16 bp, P. troglodytes
ggctgagctcagctgg

SEQ ID NO: 253174 - DNA, 16 bp, P. troglodytes
ggctgagctgcgggag

SEQ ID NO: 253175 - DNA, 16 bp, P. troglodytes
ggctgagcttggtgag

SEQ ID NO: 253176 - DNA, 16 bp, P. troglodytes
ggctgaggaaggaggg

SEQ ID NO: 253177 - DNA, 16 bp, P. troglodytes
ggctgaggaaggggaa

SEQ ID NO: 253178 - DNA, 16 bp, P. troglodytes
ggctgaggaaggtgga

SEQ ID NO: 253179 - DNA, 16 bp, P. troglodytes
ggctgaggagagagaa

SEQ ID NO: 253180 - DNA, 16 bp, P. troglodytes
ggctgaggagagagga

SEQ ID NO: 253181 - DNA, 16 bp, P. troglodytes
ggctgaggagagggag

SEQ ID NO: 253182 - DNA, 16 bp, P. troglodytes
ggctgaggaggaagag

SEQ ID NO: 253183 - DNA, 16 bp, P. troglodytes
ggctgaggaggaagga

SEQ ID NO: 253184 - DNA, 16 bp, P. troglodytes
ggctgaggaggaggag

SEQ ID NO: 253185 - DNA, 16 bp, P. troglodytes
ggctgaggaggctgag

SEQ ID NO: 253186 - DNA, 16 bp, P. troglodytes
ggctgaggagggagga

SEQ ID NO: 253187 - DNA, 16 bp, P. troglodytes
ggctgaggagggcgga

SEQ ID NO: 253188 - DNA, 16 bp, P. troglodytes
ggctgaggagtgtggg

SEQ ID NO: 253189 - DNA, 16 bp, P. troglodytes
ggctgaggcacgagat

SEQ ID NO: 253190 - DNA, 16 bp, P. troglodytes
ggctgaggcagaactg

SEQ ID NO: 253191 - DNA, 16 bp, P. troglodytes
ggctgaggcagaggag

SEQ ID NO: 253192 - DNA, 16 bp, P. troglodytes
ggctgaggcagctgga

SEQ ID NO: 253193 - DNA, 16 bp, P. troglodytes
ggctgaggcaggaaat

SEQ ID NO: 253194 - DNA, 16 bp, P. troglodytes
ggctgaggcaggaaca

SEQ ID NO: 253195 - DNA, 16 bp, P. troglodytes
ggctgaggcaggaagc

SEQ ID NO: 253196 - DNA, 16 bp, P. troglodytes
ggctgaggcaggaagg

SEQ ID NO: 253197 - DNA, 25 bp, P. troglodytes
ggctgaggcaggagaatggtgtgaa

SEQ ID NO: 253198 - DNA, 16 bp, P. troglodytes
ggctgaggcaggagat

SEQ ID NO: 253199 - DNA, 16 bp, P. troglodytes
ggctgaggcaggaggc

SEQ ID NO: 253200 - DNA, 16 bp, P. troglodytes
ggctgaggcaggaggg

SEQ ID NO: 253201 - DNA, 16 bp, P. troglodytes
ggctgaggcaggagtt

SEQ ID NO: 253202 - DNA, 16 bp, P. troglodytes
ggctgaggcaggctga

SEQ ID NO: 253203 - DNA, 16 bp, P. troglodytes
ggctgaggcagggagg

SEQ ID NO: 253204 - DNA, 16 bp, P. troglodytes
ggctgaggcaggggag

SEQ ID NO: 253205 - DNA, 16 bp, P. troglodytes
ggctgaggcaggtggc

SEQ ID NO: 253206 - DNA, 16 bp, P. troglodytes
ggctgaggcatgggaa

SEQ ID NO: 253207 - DNA, 16 bp, P. troglodytes
ggctgaggccagagga

SEQ ID NO: 253208 - DNA, 16 bp, P. troglodytes
ggctgaggcggaaaga

SEQ ID NO: 253209 - DNA, 16 bp, P. troglodytes
ggctgaggcgggagac

SEQ ID NO: 253210 - DNA, 16 bp, P. troglodytes
ggctgaggcgggcgga

SEQ ID NO: 253211 - DNA, 19 bp, P. troglodytes
ggctgaggcgggcggatca

SEQ ID NO: 253212 - DNA, 21 bp, P. troglodytes
ggctgaggcgggcggatcaca

SEQ ID NO: 253213 - DNA, 17 bp, P. troglodytes
ggctgaggcgggtgaat

SEQ ID NO: 253214 - DNA, 16 bp, P. troglodytes
ggctgaggcggttgga

SEQ ID NO: 253215 - DNA, 16 bp, P. troglodytes
ggctgaggctggagaa

SEQ ID NO: 253216 - DNA, 17 bp, P. troglodytes
ggctgaggctggcagat

SEQ ID NO: 253217 - DNA, 16 bp, P. troglodytes
ggctgaggctgggagg

SEQ ID NO: 253218 - DNA, 16 bp, P. troglodytes
ggctgaggctggtgga

SEQ ID NO: 253219 - DNA, 16 bp, P. troglodytes
ggctgagggaacagca

SEQ ID NO: 253220 - DNA, 16 bp, P. troglodytes
ggctgagggaagagaa

SEQ ID NO: 253221 - DNA, 16 bp, P. troglodytes
ggctgagggaggagga

SEQ ID NO: 253222 - DNA, 16 bp, P. troglodytes
ggctgagggaggtgaa

SEQ ID NO: 253223 - DNA, 16 bp, P. troglodytes
ggctgagggaggtgga

SEQ ID NO: 253224 - DNA, 16 bp, P. troglodytes
ggctgaggggagagga

SEQ ID NO: 253225 - DNA, 16 bp, P. troglodytes
ggctgaggtagaaaga

SEQ ID NO: 253226 - DNA, 16 bp, P. troglodytes
ggctgaggtggaagaa

SEQ ID NO: 253227 - DNA, 16 bp, P. troglodytes
ggctgaggtggagaat

SEQ ID NO: 253228 - DNA, 16 bp, P. troglodytes
ggctgaggtggatggg

SEQ ID NO: 253229 - DNA, 16 bp, P. troglodytes
ggctgaggtgggcagg

SEQ ID NO: 253230 - DNA, 17 bp, P. troglodytes
ggctgaggtgggcgaat

SEQ ID NO: 253231 - DNA, 20 bp, P. troglodytes
ggctgaggtgggcggatcat

SEQ ID NO: 253232 - DNA, 16 bp, P. troglodytes
ggctgaggttggagga

SEQ ID NO: 253233 - DNA, 16 bp, P. troglodytes
ggctgagtgaggagaa

SEQ ID NO: 253234 - DNA, 16 bp, P. troglodytes
ggctgagtgcaatggc

SEQ ID NO: 253235 - DNA, 17 bp, P. troglodytes
ggctgatcccgaactcc

SEQ ID NO: 253236 - DNA, 16 bp, P. troglodytes
ggctgatcttgagctc

SEQ ID NO: 253237 - DNA, 16 bp, P. troglodytes
ggctgatgcaggagaa

SEQ ID NO: 253238 - DNA, 16 bp, P. troglodytes
ggctgatggcagcatg

SEQ ID NO: 253239 - DNA, 16 bp, P. troglodytes
ggctgatgtgggaaga

SEQ ID NO: 253240 - DNA, 16 bp, P. troglodytes
ggctgatgtgggagga

SEQ ID NO: 253241 - DNA, 16 bp, P. troglodytes
ggctgatttttttatt

SEQ ID NO: 253242 - DNA, 16 bp, P. troglodytes
ggctgcaagacctgaa

SEQ ID NO: 253243 - DNA, 17 bp, P. troglodytes
ggctgcagaacagcaaa

SEQ ID NO: 253244 - DNA, 16 bp, P. troglodytes
ggctgcagaacagtgg

SEQ ID NO: 253245 - DNA, 16 bp, P. troglodytes
ggctgcagagcgagac

SEQ ID NO: 253246 - DNA, 16 bp, P. troglodytes
ggctgcagcaaaccac

SEQ ID NO: 253247 - DNA, 16 bp, P. troglodytes
ggctgcagcaggagga

SEQ ID NO: 253248 - DNA, 16 bp, P. troglodytes
ggctgcagcaggggag

SEQ ID NO: 253249 - DNA, 16 bp, P. troglodytes
ggctgcagcctggcag

SEQ ID NO: 253250 - DNA, 16 bp, P. troglodytes
ggctgcaggaaggaga

SEQ ID NO: 253251 - DNA, 16 bp, P. troglodytes
ggctgcaggagagaga

SEQ ID NO: 253252 - DNA, 16 bp, P. troglodytes
ggctgcaggtccccag

SEQ ID NO: 253253 - DNA, 16 bp, P. troglodytes
ggctgcaggtcctgag

SEQ ID NO: 253254 - DNA, 16 bp, P. troglodytes
ggctgcagtacagtgg

SEQ ID NO: 253255 - DNA, 16 bp, P. troglodytes
ggctgcagtgagcttt

SEQ ID NO: 253256 - DNA, 38 bp, P. troglodytes
ggctgcatagtattccatggtgtatatgtgccacattc

SEQ ID NO: 253257 - DNA, 16 bp, P. troglodytes
ggctgcatgatattcc

SEQ ID NO: 253258 - DNA, 16 bp, P. troglodytes
ggctgcattcccaaga

SEQ ID NO: 253259 - DNA, 16 bp, P. troglodytes
ggctgccactgccatc

SEQ ID NO: 253260 - DNA, 16 bp, P. troglodytes
ggctgccagcattcct

SEQ ID NO: 253261 - DNA, 16 bp, P. troglodytes
ggctgccagttttgag

SEQ ID NO: 253262 - DNA, 16 bp, P. troglodytes
ggctgcccagattcct

SEQ ID NO: 253263 - DNA, 16 bp, P. troglodytes
ggctgccccccacctc

SEQ ID NO: 253264 - DNA, 16 bp, P. troglodytes
ggctgccgtgagctga

SEQ ID NO: 253265 - DNA, 16 bp, P. troglodytes
ggctgcctctgctgca

SEQ ID NO: 253266 - DNA, 16 bp, P. troglodytes
ggctgcctctgctgct

SEQ ID NO: 253267 - DNA, 16 bp, P. troglodytes
ggctgcctggaggaag

SEQ ID NO: 253268 - DNA, 16 bp, P. troglodytes
ggctgcctggaggagg

SEQ ID NO: 253269 - DNA, 16 bp, P. troglodytes
ggctgccttcatgggc

SEQ ID NO: 253270 - DNA, 16 bp, P. troglodytes
ggctgccttccccaag

SEQ ID NO: 253271 - DNA, 16 bp, P. troglodytes
ggctgccttctctctg

SEQ ID NO: 253272 - DNA, 18 bp, P. troglodytes
ggctgcgctgggaggcgg

SEQ ID NO: 253273 - DNA, 16 bp, P. troglodytes
ggctgcggcaggagaa

SEQ ID NO: 253274 - DNA, 17 bp, P. troglodytes
ggctgcggcaggagaat

SEQ ID NO: 253275 - DNA, 16 bp, P. troglodytes
ggctgcggtgcagtgg

SEQ ID NO: 253276 - DNA, 16 bp, P. troglodytes
ggctgcggtgggagga

SEQ ID NO: 253277 - DNA, 16 bp, P. troglodytes
ggctgctccagctcca

SEQ ID NO: 253278 - DNA, 16 bp, P. troglodytes
ggctgctccatagaca

SEQ ID NO: 253279 - DNA, 16 bp, P. troglodytes
ggctgctccttctcag

SEQ ID NO: 253280 - DNA, 16 bp, P. troglodytes
ggctgctctaacaaaa

SEQ ID NO: 253281 - DNA, 16 bp, P. troglodytes
ggctgctctagaactc

SEQ ID NO: 253282 - DNA, 16 bp, P. troglodytes
ggctgctctcaaactg

SEQ ID NO: 253283 - DNA, 16 bp, P. troglodytes
ggctgctctgcctatg

SEQ ID NO: 253284 - DNA, 16 bp, P. troglodytes
ggctgctgctgctgct

SEQ ID NO: 253285 - DNA, 16 bp, P. troglodytes
ggctgctggagccagc

SEQ ID NO: 253286 - DNA, 16 bp, P. troglodytes
ggctgctgggctgctg

SEQ ID NO: 253287 - DNA, 16 bp, P. troglodytes
ggctgctgggtggaga

SEQ ID NO: 253288 - DNA, 16 bp, P. troglodytes
ggctgctgtgagaatt

SEQ ID NO: 253289 - DNA, 16 bp, P. troglodytes
ggctggaacaggagga

SEQ ID NO: 253290 - DNA, 16 bp, P. troglodytes
ggctggaacctgggag

SEQ ID NO: 253291 - DNA, 16 bp, P. troglodytes
ggctggaactcctgac

SEQ ID NO: 253292 - DNA, 16 bp, P. troglodytes
ggctggaagtgcaatg

SEQ ID NO: 253293 - DNA, 16 bp, P. troglodytes
ggctggaatgcagtgg

SEQ ID NO: 253294 - DNA, 16 bp, P. troglodytes
ggctggaatggctgag

SEQ ID NO: 253295 - DNA, 16 bp, P. troglodytes
ggctggagaaggagga

SEQ ID NO: 253296 - DNA, 16 bp, P. troglodytes
ggctggagacccaggg

SEQ ID NO: 253297 - DNA, 16 bp, P. troglodytes
ggctggagaggctggg

SEQ ID NO: 253298 - DNA, 16 bp, P. troglodytes
ggctggagcagctgag

SEQ ID NO: 253299 - DNA, 16 bp, P. troglodytes
ggctggagcagctgga

SEQ ID NO: 253300 - DNA, 16 bp, P. troglodytes
ggctggagcagctggg

SEQ ID NO: 253301 - DNA, 16 bp, P. troglodytes
ggctggagcaggaaga

SEQ ID NO: 253302 - DNA, 16 bp, P. troglodytes
ggctggagcaggagga

SEQ ID NO: 253303 - DNA, 16 bp, P. troglodytes
ggctggagcccaggag

SEQ ID NO: 253304 - DNA, 16 bp, P. troglodytes
ggctggagccgtggca

SEQ ID NO: 253305 - DNA, 16 bp, P. troglodytes
ggctggagctgagctt

SEQ ID NO: 253306 - DNA, 16 bp, P. troglodytes
ggctggagctggaggc

SEQ ID NO: 253307 - DNA, 16 bp, P. troglodytes
ggctggaggaggcagg

SEQ ID NO: 253308 - DNA, 16 bp, P. troglodytes
ggctggaggagggaga

SEQ ID NO: 253309 - DNA, 16 bp, P. troglodytes
ggctggaggaggtggt

SEQ ID NO: 253310 - DNA, 16 bp, P. troglodytes
ggctggaggcaggagg

SEQ ID NO: 253311 - DNA, 16 bp, P. troglodytes
ggctggaggccaacca

SEQ ID NO: 253312 - DNA, 16 bp, P. troglodytes
ggctggaggcccaggc

SEQ ID NO: 253313 - DNA, 16 bp, P. troglodytes
ggctggagggaactag

SEQ ID NO: 253314 - DNA, 16 bp, P. troglodytes
ggctggagggagctgg

SEQ ID NO: 253315 - DNA, 16 bp, P. troglodytes
ggctggagtacagagg

SEQ ID NO: 253316 - DNA, 16 bp, P. troglodytes
ggctggagtaccgtgg

SEQ ID NO: 253317 - DNA, 16 bp, P. troglodytes
ggctggagtgaaatgg

SEQ ID NO: 253318 - DNA, 16 bp, P. troglodytes
ggctggagtgcggtgc

SEQ ID NO: 253319 - DNA, 16 bp, P. troglodytes
ggctggagtgcggtgg

SEQ ID NO: 253320 - DNA, 16 bp, P. troglodytes
ggctggagtgggagga

SEQ ID NO: 253321 - DNA, 16 bp, P. troglodytes
ggctggagtggtgcag

SEQ ID NO: 253322 - DNA, 16 bp, P. troglodytes
ggctggagtgtgcaat

SEQ ID NO: 253323 - DNA, 16 bp, P. troglodytes
ggctggatgcagtggc

SEQ ID NO: 253324 - DNA, 16 bp, P. troglodytes
ggctggatgcagtggt

SEQ ID NO: 253325 - DNA, 16 bp, P. troglodytes
ggctggattacagtgg

SEQ ID NO: 253326 - DNA, 16 bp, P. troglodytes
ggctggatttcagccc

SEQ ID NO: 253327 - DNA, 16 bp, P. troglodytes
ggctggcagatcatct

SEQ ID NO: 253328 - DNA, 16 bp, P. troglodytes
ggctggcagggctggc

SEQ ID NO: 253329 - DNA, 16 bp, P. troglodytes
ggctggccactgggta

SEQ ID NO: 253330 - DNA, 16 bp, P. troglodytes
ggctggccaggcacgg

SEQ ID NO: 253331 - DNA, 16 bp, P. troglodytes
ggctggccaggcaggg

SEQ ID NO: 253332 - DNA, 16 bp, P. troglodytes
ggctggccaggtgcag

SEQ ID NO: 253333 - DNA, 16 bp, P. troglodytes
ggctggccgaggccag

SEQ ID NO: 253334 - DNA, 16 bp, P. troglodytes
ggctggcctcagactc

SEQ ID NO: 253335 - DNA, 16 bp, P. troglodytes
ggctggcctggtggtg

SEQ ID NO: 253336 - DNA, 16 bp, P. troglodytes
ggctggctgaggctgg

SEQ ID NO: 253337 - DNA, 16 bp, P. troglodytes
ggctggctggctggct

SEQ ID NO: 253338 - DNA, 16 bp, P. troglodytes
ggctggctgggcaggg

SEQ ID NO: 253339 - DNA, 16 bp, P. troglodytes
ggctggctgggcatgg

SEQ ID NO: 253340 - DNA, 16 bp, P. troglodytes
ggctggcttcaaactc

SEQ ID NO: 253341 - DNA, 16 bp, P. troglodytes
ggctggcttcatgggc

SEQ ID NO: 253342 - DNA, 16 bp, P. troglodytes
ggctgggaagggaagg

SEQ ID NO: 253343 - DNA, 16 bp, P. troglodytes
ggctgggaagggcagt

SEQ ID NO: 253344 - DNA, 17 bp, P. troglodytes
ggctgggactacaggca

SEQ ID NO: 253345 - DNA, 16 bp, P. troglodytes
ggctgggagctgggag

SEQ ID NO: 253346 - DNA, 16 bp, P. troglodytes
ggctgggaggagagag

SEQ ID NO: 253347 - DNA, 16 bp, P. troglodytes
ggctgggaggaggaag

SEQ ID NO: 253348 - DNA, 16 bp, P. troglodytes
ggctgggaggagggaa

SEQ ID NO: 253349 - DNA, 16 bp, P. troglodytes
ggctgggaggctgggc

SEQ ID NO: 253350 - DNA, 16 bp, P. troglodytes
ggctgggaggggctgc

SEQ ID NO: 253351 - DNA, 16 bp, P. troglodytes
ggctgggatgcagggc

SEQ ID NO: 253352 - DNA, 16 bp, P. troglodytes
ggctgggattacaggc

SEQ ID NO: 253353 - DNA, 16 bp, P. troglodytes
ggctgggattacaggg

SEQ ID NO: 253354 - DNA, 16 bp, P. troglodytes
ggctgggattataggc

SEQ ID NO: 253355 - DNA, 16 bp, P. troglodytes
ggctgggcacagcggc

SEQ ID NO: 253356 - DNA, 16 bp, P. troglodytes
ggctgggcacggtggc

SEQ ID NO: 253357 - DNA, 16 bp, P. troglodytes
ggctgggcacgtggct

SEQ ID NO: 253358 - DNA, 16 bp, P. troglodytes
ggctgggcagaggcac

SEQ ID NO: 253359 - DNA, 16 bp, P. troglodytes
ggctgggcaggcaggg

SEQ ID NO: 253360 - DNA, 16 bp, P. troglodytes
ggctgggcagggctgg

SEQ ID NO: 253361 - DNA, 16 bp, P. troglodytes
ggctgggcaggggctg

SEQ ID NO: 253362 - DNA, 16 bp, P. troglodytes
ggctgggcatgctggc

SEQ ID NO: 253363 - DNA, 18 bp, P. troglodytes
ggctgggcatggtggcgc

SEQ ID NO: 253364 - DNA, 20 bp, P. troglodytes
ggctgggcatggtggctcat

SEQ ID NO: 253365 - DNA, 16 bp, P. troglodytes
ggctgggcattgtggc

SEQ ID NO: 253366 - DNA, 16 bp, P. troglodytes
ggctgggccaggctgg

SEQ ID NO: 253367 - DNA, 16 bp, P. troglodytes
ggctgggcccagggtc

SEQ ID NO: 253368 - DNA, 16 bp, P. troglodytes
ggctgggcgcagtggc

SEQ ID NO: 253369 - DNA, 16 bp, P. troglodytes
ggctgggcgtgatggc

SEQ ID NO: 253370 - DNA, 16 bp, P. troglodytes
ggctggggagaggaag

SEQ ID NO: 253371 - DNA, 16 bp, P. troglodytes
ggctggggaggcctca

SEQ ID NO: 253372 - DNA, 16 bp, P. troglodytes
ggctggggaggcctcg

SEQ ID NO: 253373 - DNA, 16 bp, P. troglodytes
ggctggggagtcctca

SEQ ID NO: 253374 - DNA, 16 bp, P. troglodytes
ggctggggcagaatga

SEQ ID NO: 253375 - DNA, 16 bp, P. troglodytes
ggctggggcaggaaaa

SEQ ID NO: 253376 - DNA, 16 bp, P. troglodytes
ggctggggcaggacaa

SEQ ID NO: 253377 - DNA, 16 bp, P. troglodytes
ggctggggcaggggaa

SEQ ID NO: 253378 - DNA, 16 bp, P. troglodytes
ggctggggctgcagcc

SEQ ID NO: 253379 - DNA, 16 bp, P. troglodytes
ggctggggctgctgcc

SEQ ID NO: 253380 - DNA, 16 bp, P. troglodytes
ggctggggctggagaa

SEQ ID NO: 253381 - DNA, 16 bp, P. troglodytes
ggctggggctggagga

SEQ ID NO: 253382 - DNA, 16 bp, P. troglodytes
ggctggggctggcagg

SEQ ID NO: 253383 - DNA, 16 bp, P. troglodytes
ggctggggctgggcag

SEQ ID NO: 253384 - DNA, 16 bp, P. troglodytes
ggctgggggcagtggc

SEQ ID NO: 253385 - DNA, 16 bp, P. troglodytes
ggctgggggcctggac

SEQ ID NO: 253386 - DNA, 16 bp, P. troglodytes
ggctggggtaggagga

SEQ ID NO: 253387 - DNA, 16 bp, P. troglodytes
ggctggggtgggaaga

SEQ ID NO: 253388 - DNA, 17 bp, P. troglodytes
ggctgggtacagtggct

SEQ ID NO: 253389 - DNA, 16 bp, P. troglodytes
ggctgggtccagggcc

SEQ ID NO: 253390 - DNA, 16 bp, P. troglodytes
ggctgggtgcgctggc

SEQ ID NO: 253391 - DNA, 16 bp, P. troglodytes
ggctggtcccgaactt

SEQ ID NO: 253392 - DNA, 16 bp, P. troglodytes
ggctggtccttgcctt

SEQ ID NO: 253393 - DNA, 16 bp, P. troglodytes
ggctggtcttgaaatc

SEQ ID NO: 253394 - DNA, 16 bp, P. troglodytes
ggctggtggattactt

SEQ ID NO: 253395 - DNA, 16 bp, P. troglodytes
ggctggtggctgccat

SEQ ID NO: 253396 - DNA, 16 bp, P. troglodytes
ggctggtgggcagtgg

SEQ ID NO: 253397 - DNA, 16 bp, P. troglodytes
ggctggtgtgcagtag

SEQ ID NO: 253398 - DNA, 16 bp, P. troglodytes
ggctggttatgaactc

SEQ ID NO: 253399 - DNA, 16 bp, P. troglodytes
ggctggttttgaactt

SEQ ID NO: 253400 - DNA, 16 bp, P. troglodytes
ggctgtaatcccagtt

SEQ ID NO: 253401 - DNA, 16 bp, P. troglodytes
ggctgtacaaacatgg

SEQ ID NO: 253402 - DNA, 16 bp, P. troglodytes
ggctgtctgtctgtta

SEQ ID NO: 253403 - DNA, 17 bp, P. troglodytes
ggctgtgaaggccctga

SEQ ID NO: 253404 - DNA, 16 bp, P. troglodytes
ggctgtgaagtccaag

SEQ ID NO: 253405 - DNA, 16 bp, P. troglodytes
ggctgtgaatttgtct

SEQ ID NO: 253406 - DNA, 16 bp, P. troglodytes
ggctgtgacttcagag

SEQ ID NO: 253407 - DNA, 16 bp, P. troglodytes
ggctgtgaggactgcc

SEQ ID NO: 253408 - DNA, 16 bp, P. troglodytes
ggctgtgatgggagga

SEQ ID NO: 253409 - DNA, 16 bp, P. troglodytes
ggctgtgcaagatgtg

SEQ ID NO: 253410 - DNA, 16 bp, P. troglodytes
ggctgtgcgtttgtca

SEQ ID NO: 253411 - DNA, 16 bp, P. troglodytes
ggctgtgctggagtct

SEQ ID NO: 253412 - DNA, 16 bp, P. troglodytes
ggctgtggcaggagga

SEQ ID NO: 253413 - DNA, 16 bp, P. troglodytes
ggctgtggcaggcgga

SEQ ID NO: 253414 - DNA, 16 bp, P. troglodytes
ggctgtggctgtggct

SEQ ID NO: 253415 - DNA, 16 bp, P. troglodytes
ggctgtggcttcagag

SEQ ID NO: 253416 - DNA, 16 bp, P. troglodytes
ggctgtgggcaggagg

SEQ ID NO: 253417 - DNA, 16 bp, P. troglodytes
ggctgtgtcatgggtg

SEQ ID NO: 253418 - DNA, 16 bp, P. troglodytes
ggctgtgtcccccacc

SEQ ID NO: 253419 - DNA, 16 bp, P. troglodytes
ggctgtgtgaccttgg

SEQ ID NO: 253420 - DNA, 16 bp, P. troglodytes
ggctgtgtgccaataa

SEQ ID NO: 253421 - DNA, 16 bp, P. troglodytes
ggctgtgtggccctgg

SEQ ID NO: 253422 - DNA, 16 bp, P. troglodytes
ggctgtgtggctttgg

SEQ ID NO: 253423 - DNA, 16 bp, P. troglodytes
ggctgttctagaactc

SEQ ID NO: 253424 - DNA, 16 bp, P. troglodytes
ggctgttgtgaggact

SEQ ID NO: 253425 - DNA, 16 bp, P. troglodytes
ggcttaaataacagaa

SEQ ID NO: 253426 - DNA, 16 bp, P. troglodytes
ggcttaagcccaggag

SEQ ID NO: 253427 - DNA, 16 bp, P. troglodytes
ggcttaatacctatgt

SEQ ID NO: 253428 - DNA, 16 bp, P. troglodytes
ggcttaatacctgggt

SEQ ID NO: 253429 - DNA, 16 bp, P. troglodytes
ggcttacacctgaaat

SEQ ID NO: 253430 - DNA, 16 bp, P. troglodytes
ggcttacacctgtaat

SEQ ID NO: 253431 - DNA, 16 bp, P. troglodytes
ggcttactgcaacctc

SEQ ID NO: 253432 - DNA, 17 bp, P. troglodytes
ggcttactgcagcctca

SEQ ID NO: 253433 - DNA, 16 bp, P. troglodytes
ggcttagaaaagttaa

SEQ ID NO: 253434 - DNA, 18 bp, P. troglodytes
ggcttaggattgacttgg

SEQ ID NO: 253435 - DNA, 16 bp, P. troglodytes
ggcttcaaatcttcaa

SEQ ID NO: 253436 - DNA, 16 bp, P. troglodytes
ggcttcaacatgaatt

SEQ ID NO: 253437 - DNA, 16 bp, P. troglodytes
ggcttcaagcgattct

SEQ ID NO: 253438 - DNA, 16 bp, P. troglodytes
ggcttcacagaggagg

SEQ ID NO: 253439 - DNA, 16 bp, P. troglodytes
ggcttcacctctcaat

SEQ ID NO: 253440 - DNA, 16 bp, P. troglodytes
ggcttcactggggacc

SEQ ID NO: 253441 - DNA, 16 bp, P. troglodytes
ggcttcaggaatgaag

SEQ ID NO: 253442 - DNA, 16 bp, P. troglodytes
ggcttcaggcacagct

SEQ ID NO: 253443 - DNA, 16 bp, P. troglodytes
ggcttcagggaaagat

SEQ ID NO: 253444 - DNA, 16 bp, P. troglodytes
ggcttcagggagcttc

SEQ ID NO: 253445 - DNA, 16 bp, P. troglodytes
ggcttcagtgcagtgg

SEQ ID NO: 253446 - DNA, 16 bp, P. troglodytes
ggcttcatccctgtga

SEQ ID NO: 253447 - DNA, 16 bp, P. troglodytes
ggcttcatcttcaaca

SEQ ID NO: 253448 - DNA, 16 bp, P. troglodytes
ggcttccaggaggagg

SEQ ID NO: 253449 - DNA, 16 bp, P. troglodytes
ggcttcccagaggaag

SEQ ID NO: 253450 - DNA, 16 bp, P. troglodytes
ggcttcccagagtgct

SEQ ID NO: 253451 - DNA, 16 bp, P. troglodytes
ggcttccccagaagcc

SEQ ID NO: 253452 - DNA, 16 bp, P. troglodytes
ggcttccccagccagg

SEQ ID NO: 253453 - DNA, 16 bp, P. troglodytes
ggcttcctgaaggagg

SEQ ID NO: 253454 - DNA, 16 bp, P. troglodytes
ggcttcctggaagaag

SEQ ID NO: 253455 - DNA, 16 bp, P. troglodytes
ggcttcctggaagagg

SEQ ID NO: 253456 - DNA, 16 bp, P. troglodytes
ggcttcctggagaagg

SEQ ID NO: 253457 - DNA, 16 bp, P. troglodytes
ggcttcctggaggagg

SEQ ID NO: 253458 - DNA, 16 bp, P. troglodytes
ggcttcctgggggagg

SEQ ID NO: 253459 - DNA, 16 bp, P. troglodytes
ggcttctcagaggagg

SEQ ID NO: 253460 - DNA, 16 bp, P. troglodytes
ggcttctccagagaaa

SEQ ID NO: 253461 - DNA, 16 bp, P. troglodytes
ggcttctcctgcctca

SEQ ID NO: 253462 - DNA, 16 bp, P. troglodytes
ggcttctctgaggaag

SEQ ID NO: 253463 - DNA, 16 bp, P. troglodytes
ggcttctctgaggagg

SEQ ID NO: 253464 - DNA, 16 bp, P. troglodytes
ggcttctgaggagaat

SEQ ID NO: 253465 - DNA, 16 bp, P. troglodytes
ggcttgaaaccaggag

SEQ ID NO: 253466 - DNA, 16 bp, P. troglodytes
ggcttgactgttgttg

SEQ ID NO: 253467 - DNA, 16 bp, P. troglodytes
ggcttgagccacagtg

SEQ ID NO: 253468 - DNA, 16 bp, P. troglodytes
ggcttgagccaccaca

SEQ ID NO: 253469 - DNA, 16 bp, P. troglodytes
ggcttgatacctgggt

SEQ ID NO: 253470 - DNA, 16 bp, P. troglodytes
ggcttgcagatgactg

SEQ ID NO: 253471 - DNA, 16 bp, P. troglodytes
ggcttgcccaaggcca

SEQ ID NO: 253472 - DNA, 16 bp, P. troglodytes
ggcttgctgcaacctc

SEQ ID NO: 253473 - DNA, 16 bp, P. troglodytes
ggcttggctttggtta

SEQ ID NO: 253474 - DNA, 16 bp, P. troglodytes
ggcttggtggcttaca

SEQ ID NO: 253475 - DNA, 16 bp, P. troglodytes
ggcttggtggcttatg

SEQ ID NO: 253476 - DNA, 16 bp, P. troglodytes
ggctttctctgaggcc

SEQ ID NO: 253477 - DNA, 16 bp, P. troglodytes
ggctttgaagatggaa

SEQ ID NO: 253478 - DNA, 16 bp, P. troglodytes
ggctttgaggatggag

SEQ ID NO: 253479 - DNA, 16 bp, P. troglodytes
ggctttgcaggccatg

SEQ ID NO: 253480 - DNA, 16 bp, P. troglodytes
ggctttggagacagac

SEQ ID NO: 253481 - DNA, 16 bp, P. troglodytes
ggctttggagcccccc

SEQ ID NO: 253482 - DNA, 16 bp, P. troglodytes
ggctttgggtttgtca

SEQ ID NO: 253483 - DNA, 16 bp, P. troglodytes
ggcttttaaaaattca

SEQ ID NO: 253484 - DNA, 16 bp, P. troglodytes
ggcttttaaaagtcta

SEQ ID NO: 253485 - DNA, 16 bp, P. troglodytes
ggcttttatttattta

SEQ ID NO: 253486 - DNA, 16 bp, P. troglodytes
ggcttttccaagtgca

SEQ ID NO: 253487 - DNA, 16 bp, P. troglodytes
ggcttttccaggtgca

SEQ ID NO: 253488 - DNA, 16 bp, P. troglodytes
ggcttttctttgtggg

SEQ ID NO: 253489 - DNA, 16 bp, P. troglodytes
ggcttttgaatttttt

SEQ ID NO: 253490 - DNA, 16 bp, P. troglodytes
gggaaaaaaaagcata

SEQ ID NO: 253491 - DNA, 16 bp, P. troglodytes
gggaaaaaaattgcaa

SEQ ID NO: 253492 - DNA, 16 bp, P. troglodytes
gggaaaaaatacatat

SEQ ID NO: 253493 - DNA, 16 bp, P. troglodytes
gggaaaaaatatttac

SEQ ID NO: 253494 - DNA, 16 bp, P. troglodytes
gggaaaaagaaataca

SEQ ID NO: 253495 - DNA, 16 bp, P. troglodytes
gggaaaacacacacac

SEQ ID NO: 253496 - DNA, 16 bp, P. troglodytes
gggaaaactgaggctc

SEQ ID NO: 253497 - DNA, 16 bp, P. troglodytes
gggaaaagccccttat

SEQ ID NO: 253498 - DNA, 16 bp, P. troglodytes
gggaaaaggcctcaaa

SEQ ID NO: 253499 - DNA, 16 bp, P. troglodytes
gggaaaattacttaac

SEQ ID NO: 253500 - DNA, 16 bp, P. troglodytes
gggaaacacaattcag

SEQ ID NO: 253501 - DNA, 16 bp, P. troglodytes
gggaaacatggtgaga

SEQ ID NO: 253502 - DNA, 16 bp, P. troglodytes
gggaaacccctcagtc

SEQ ID NO: 253503 - DNA, 16 bp, P. troglodytes
gggaaaccgaggcagg

SEQ ID NO: 253504 - DNA, 16 bp, P. troglodytes
gggaaacctcatctct

SEQ ID NO: 253505 - DNA, 16 bp, P. troglodytes
gggaaactgaagcagg

SEQ ID NO: 253506 - DNA, 16 bp, P. troglodytes
gggaaactgaagccca

SEQ ID NO: 253507 - DNA, 16 bp, P. troglodytes
gggaaactgaggcaca

SEQ ID NO: 253508 - DNA, 16 bp, P. troglodytes
gggaaactgaggccca

SEQ ID NO: 253509 - DNA, 16 bp, P. troglodytes
gggaaactgaggcccc

SEQ ID NO: 253510 - DNA, 18 bp, P. troglodytes
gggaaactgaggctcagg

SEQ ID NO: 253511 - DNA, 16 bp, P. troglodytes
gggaaactgaggtcca

SEQ ID NO: 253512 - DNA, 16 bp, P. troglodytes
gggaaactgagtcaca

SEQ ID NO: 253513 - DNA, 16 bp, P. troglodytes
gggaaagacagaccca

SEQ ID NO: 253514 - DNA, 16 bp, P. troglodytes
gggaaagatcaccttc

SEQ ID NO: 253515 - DNA, 16 bp, P. troglodytes
gggaaagcattcagtc

SEQ ID NO: 253516 - DNA, 16 bp, P. troglodytes
gggaaagcattcagtt

SEQ ID NO: 253517 - DNA, 16 bp, P. troglodytes
gggaaagctttcagtc

SEQ ID NO: 253518 - DNA, 16 bp, P. troglodytes
gggaaaggaatgtgct

SEQ ID NO: 253519 - DNA, 16 bp, P. troglodytes
gggaaaggacactcta

SEQ ID NO: 253520 - DNA, 16 bp, P. troglodytes
gggaaaggcagtctct

SEQ ID NO: 253521 - DNA, 16 bp, P. troglodytes
gggaaaggcattccag

SEQ ID NO: 253522 - DNA, 16 bp, P. troglodytes
gggaaaggggattctc

SEQ ID NO: 253523 - DNA, 16 bp, P. troglodytes
gggaaatacaaatgaa

SEQ ID NO: 253524 - DNA, 16 bp, P. troglodytes
gggaaatacacacaca

SEQ ID NO: 253525 - DNA, 16 bp, P. troglodytes
gggaaatgaggagtta

SEQ ID NO: 253526 - DNA, 16 bp, P. troglodytes
gggaaatgcaaattaa

SEQ ID NO: 253527 - DNA, 16 bp, P. troglodytes
gggaaatgcagaaatc

SEQ ID NO: 253528 - DNA, 16 bp, P. troglodytes
gggaaatgtgggtttg

SEQ ID NO: 253529 - DNA, 16 bp, P. troglodytes
gggaacacaggcatga

SEQ ID NO: 253530 - DNA, 16 bp, P. troglodytes
gggaacagagagagac

SEQ ID NO: 253531 - DNA, 16 bp, P. troglodytes
gggaacatcacacacc

SEQ ID NO: 253532 - DNA, 16 bp, P. troglodytes
gggaacctgaaaatcc

SEQ ID NO: 253533 - DNA, 16 bp, P. troglodytes
gggaactcactgcctt

SEQ ID NO: 253534 - DNA, 16 bp, P. troglodytes
gggaactcagagacca

SEQ ID NO: 253535 - DNA, 16 bp, P. troglodytes
gggaactggggctcag

SEQ ID NO: 253536 - DNA, 16 bp, P. troglodytes
gggaacttcctcaact

SEQ ID NO: 253537 - DNA, 16 bp, P. troglodytes
gggaacttgcacaggg

SEQ ID NO: 253538 - DNA, 16 bp, P. troglodytes
gggaagaaaacacatc

SEQ ID NO: 253539 - DNA, 16 bp, P. troglodytes
gggaagaaaagaggtt

SEQ ID NO: 253540 - DNA, 16 bp, P. troglodytes
gggaagaacctggtgg

SEQ ID NO: 253541 - DNA, 16 bp, P. troglodytes
gggaagaatccttcct

SEQ ID NO: 253542 - DNA, 16 bp, P. troglodytes
gggaagaatctgcttc

SEQ ID NO: 253543 - DNA, 16 bp, P. troglodytes
gggaagaatggaacca

SEQ ID NO: 253544 - DNA, 16 bp, P. troglodytes
gggaagattatcttcc

SEQ ID NO: 253545 - DNA, 16 bp, P. troglodytes
gggaagcaagcacttt

SEQ ID NO: 253546 - DNA, 16 bp, P. troglodytes
gggaagcaagtacctt

SEQ ID NO: 253547 - DNA, 16 bp, P. troglodytes
gggaagcagagacagg

SEQ ID NO: 253548 - DNA, 16 bp, P. troglodytes
gggaagcagagtgaga

SEQ ID NO: 253549 - DNA, 16 bp, P. troglodytes
gggaagccaagacagg

SEQ ID NO: 253550 - DNA, 16 bp, P. troglodytes
gggaagccaaggtagg

SEQ ID NO: 253551 - DNA, 16 bp, P. troglodytes
gggaagccaagtcagg

SEQ ID NO: 253552 - DNA, 16 bp, P. troglodytes
gggaagccactgaaga

SEQ ID NO: 253553 - DNA, 16 bp, P. troglodytes
gggaagcccaggcggg

SEQ ID NO: 253554 - DNA, 16 bp, P. troglodytes
gggaagcccatcaaac

SEQ ID NO: 253555 - DNA, 16 bp, P. troglodytes
gggaagccgagacggg

SEQ ID NO: 253556 - DNA, 16 bp, P. troglodytes
gggaagcctttcctga

SEQ ID NO: 253557 - DNA, 16 bp, P. troglodytes
gggaagcggaggctgc

SEQ ID NO: 253558 - DNA, 16 bp, P. troglodytes
gggaagctgagatgga

SEQ ID NO: 253559 - DNA, 16 bp, P. troglodytes
gggaagctgaggaggg

SEQ ID NO: 253560 - DNA, 16 bp, P. troglodytes
gggaagctgaggccag

SEQ ID NO: 253561 - DNA, 16 bp, P. troglodytes
gggaagctgaggccca

SEQ ID NO: 253562 - DNA, 16 bp, P. troglodytes
gggaagctgaggcgga

SEQ ID NO: 253563 - DNA, 16 bp, P. troglodytes
gggaagctgaggctca

SEQ ID NO: 253564 - DNA, 16 bp, P. troglodytes
gggaagctgtgacaga

SEQ ID NO: 253565 - DNA, 16 bp, P. troglodytes
gggaaggaggtgattg

SEQ ID NO: 253566 - DNA, 16 bp, P. troglodytes
gggaaggcaagactgg

SEQ ID NO: 253567 - DNA, 16 bp, P. troglodytes
gggaaggcagccttcc

SEQ ID NO: 253568 - DNA, 16 bp, P. troglodytes
gggaaggcctcaggga

SEQ ID NO: 253569 - DNA, 16 bp, P. troglodytes
gggaaggcctctttga

SEQ ID NO: 253570 - DNA, 16 bp, P. troglodytes
gggaagttcaagacca

SEQ ID NO: 253571 - DNA, 16 bp, P. troglodytes
gggaagttttcctcga

SEQ ID NO: 253572 - DNA, 16 bp, P. troglodytes
gggaatacaagtgtga

SEQ ID NO: 253573 - DNA, 16 bp, P. troglodytes
gggaatacaggcatga

SEQ ID NO: 253574 - DNA, 16 bp, P. troglodytes
gggaatccaacttaca

SEQ ID NO: 253575 - DNA, 16 bp, P. troglodytes
gggaatctcgctctgt

SEQ ID NO: 253576 - DNA, 16 bp, P. troglodytes
gggaatgctcccagct

SEQ ID NO: 253577 - DNA, 16 bp, P. troglodytes
gggaatgggacccaag

SEQ ID NO: 253578 - DNA, 16 bp, P. troglodytes
gggaattaagtttcaa

SEQ ID NO: 253579 - DNA, 16 bp, P. troglodytes
gggaattataatttga

SEQ ID NO: 253580 - DNA, 16 bp, P. troglodytes
gggaattatgggaact

SEQ ID NO: 253581 - DNA, 16 bp, P. troglodytes
gggaattatgggggct

SEQ ID NO: 253582 - DNA, 16 bp, P. troglodytes
gggaattgcctgaacc

SEQ ID NO: 253583 - DNA, 16 bp, P. troglodytes
gggacaaaaatgtgtc

SEQ ID NO: 253584 - DNA, 16 bp, P. troglodytes
gggacaaagaaggcca

SEQ ID NO: 253585 - DNA, 16 bp, P. troglodytes
gggacaaaggacagaa

SEQ ID NO: 253586 - DNA, 16 bp, P. troglodytes
gggacaagcaggagac

SEQ ID NO: 253587 - DNA, 16 bp, P. troglodytes
gggacacagccctcct

SEQ ID NO: 253588 - DNA, 16 bp, P. troglodytes
gggacacatacattca

SEQ ID NO: 253589 - DNA, 16 bp, P. troglodytes
gggacaccatcaagca

SEQ ID NO: 253590 - DNA, 16 bp, P. troglodytes
gggacagaagctcctg

SEQ ID NO: 253591 - DNA, 16 bp, P. troglodytes
gggacagaattaatag

SEQ ID NO: 253592 - DNA, 16 bp, P. troglodytes
gggacagagctgccca

SEQ ID NO: 253593 - DNA, 16 bp, P. troglodytes
gggacagagctgggct

SEQ ID NO: 253594 - DNA, 16 bp, P. troglodytes
gggacagagtcttgct

SEQ ID NO: 253595 - DNA, 16 bp, P. troglodytes
gggacagatgagggga

SEQ ID NO: 253596 - DNA, 16 bp, P. troglodytes
gggacaggaggatcac

SEQ ID NO: 253597 - DNA, 16 bp, P. troglodytes
gggacaggcacagtgg

SEQ ID NO: 253598 - DNA, 16 bp, P. troglodytes
gggacagtttgacttc

SEQ ID NO: 253599 - DNA, 16 bp, P. troglodytes
gggacatgaatgaagc

SEQ ID NO: 253600 - DNA, 16 bp, P. troglodytes
gggacatgcctgtgag

SEQ ID NO: 253601 - DNA, 16 bp, P. troglodytes
gggacatggataaagc

SEQ ID NO: 253602 - DNA, 16 bp, P. troglodytes
gggacattgatgaagc

SEQ ID NO: 253603 - DNA, 16 bp, P. troglodytes
gggacatttggaaatg

SEQ ID NO: 253604 - DNA, 16 bp, P. troglodytes
gggaccacagacacgt

SEQ ID NO: 253605 - DNA, 16 bp, P. troglodytes
gggaccacaggcatac

SEQ ID NO: 253606 - DNA, 16 bp, P. troglodytes
gggaccacaggctcac

SEQ ID NO: 253607 - DNA, 16 bp, P. troglodytes
gggaccacgccctcct

SEQ ID NO: 253608 - DNA, 16 bp, P. troglodytes
gggaccaggtggagat

SEQ ID NO: 253609 - DNA, 16 bp, P. troglodytes
gggaccatcctggcca

SEQ ID NO: 253610 - DNA, 16 bp, P. troglodytes
gggacccaggaggagg

SEQ ID NO: 253611 - DNA, 16 bp, P. troglodytes
gggacccccatctcta

SEQ ID NO: 253612 - DNA, 16 bp, P. troglodytes
gggacccctttcctgt

SEQ ID NO: 253613 - DNA, 16 bp, P. troglodytes
gggaccctgcctcaaa

SEQ ID NO: 253614 - DNA, 16 bp, P. troglodytes
gggaccctgggcccag

SEQ ID NO: 253615 - DNA, 16 bp, P. troglodytes
gggaccggctgaagcc

SEQ ID NO: 253616 - DNA, 25 bp, P. troglodytes
gggacctcccttgggagatcaatcc

SEQ ID NO: 253617 - DNA, 16 bp, P. troglodytes
gggacctgagcaggtt

SEQ ID NO: 253618 - DNA, 16 bp, P. troglodytes
gggacctgcagcctgc

SEQ ID NO: 253619 - DNA, 16 bp, P. troglodytes
gggacctgcccctttc

SEQ ID NO: 253620 - DNA, 16 bp, P. troglodytes
gggacctgctgggagg

SEQ ID NO: 253621 - DNA, 16 bp, P. troglodytes
gggacctggagggagg

SEQ ID NO: 253622 - DNA, 16 bp, P. troglodytes
gggacctggtgggaga

SEQ ID NO: 253623 - DNA, 16 bp, P. troglodytes
gggaccttgtgggagg

SEQ ID NO: 253624 - DNA, 16 bp, P. troglodytes
gggacgctgaggcagg

SEQ ID NO: 253625 - DNA, 46 bp, P. troglodytes
gggacggagagccgagcagccccggctctgggctacggactatggg

SEQ ID NO: 253626 - DNA, 16 bp, P. troglodytes
gggactacaggcacac

SEQ ID NO: 253627 - DNA, 16 bp, P. troglodytes
gggactacaggtgtcc

SEQ ID NO: 253628 - DNA, 16 bp, P. troglodytes
gggactacgggcaccc

SEQ ID NO: 253629 - DNA, 16 bp, P. troglodytes
gggactcagactggct

SEQ ID NO: 253630 - DNA, 16 bp, P. troglodytes
gggactcagtttcccc

SEQ ID NO: 253631 - DNA, 16 bp, P. troglodytes
gggactccaggcaccc

SEQ ID NO: 253632 - DNA, 16 bp, P. troglodytes
gggactcctgggctca

SEQ ID NO: 253633 - DNA, 16 bp, P. troglodytes
gggactctgtgtgagg

SEQ ID NO: 253634 - DNA, 16 bp, P. troglodytes
gggactctgtgtgggg

SEQ ID NO: 253635 - DNA, 16 bp, P. troglodytes
gggactgaggcaagag

SEQ ID NO: 253636 - DNA, 16 bp, P. troglodytes
gggactgagtccttaa

SEQ ID NO: 253637 - DNA, 16 bp, P. troglodytes
gggactgcaggcatcc

SEQ ID NO: 253638 - DNA, 18 bp, P. troglodytes
gggactggcaggcagctc

SEQ ID NO: 253639 - DNA, 16 bp, P. troglodytes
gggactggttccagga

SEQ ID NO: 253640 - DNA, 16 bp, P. troglodytes
gggactgttaggaagg

SEQ ID NO: 253641 - DNA, 16 bp, P. troglodytes
gggactgttttggggt

SEQ ID NO: 253642 - DNA, 16 bp, P. troglodytes
gggacttgagcatttg

SEQ ID NO: 253643 - DNA, 16 bp, P. troglodytes
gggacttggaaaactt

SEQ ID NO: 253644 - DNA, 16 bp, P. troglodytes
gggacttggaagaagc

SEQ ID NO: 253645 - DNA, 16 bp, P. troglodytes
gggacttggactggct

SEQ ID NO: 253646 - DNA, 16 bp, P. troglodytes
gggacttggtgcccta

SEQ ID NO: 253647 - DNA, 16 bp, P. troglodytes
gggacttggtgccctg

SEQ ID NO: 253648 - DNA, 16 bp, P. troglodytes
gggacttggtgtcctg

SEQ ID NO: 253649 - DNA, 16 bp, P. troglodytes
gggagaaaaagaggtt

SEQ ID NO: 253650 - DNA, 16 bp, P. troglodytes
gggagaaagcaagcaa

SEQ ID NO: 253651 - DNA, 16 bp, P. troglodytes
gggagaagatgatatt

SEQ ID NO: 253652 - DNA, 16 bp, P. troglodytes
gggagaagccaggcag

SEQ ID NO: 253653 - DNA, 16 bp, P. troglodytes
gggagaaggggacatg

SEQ ID NO: 253654 - DNA, 16 bp, P. troglodytes
gggagaatttgacttc

SEQ ID NO: 253655 - DNA, 16 bp, P. troglodytes
gggagacagaccaaga

SEQ ID NO: 253656 - DNA, 16 bp, P. troglodytes
gggagacagactggcc

SEQ ID NO: 253657 - DNA, 16 bp, P. troglodytes
gggagacagaggtggg

SEQ ID NO: 253658 - DNA, 16 bp, P. troglodytes
gggagacatctcccag

SEQ ID NO: 253659 - DNA, 16 bp, P. troglodytes
gggagacatgaaacat

SEQ ID NO: 253660 - DNA, 16 bp, P. troglodytes
gggagacccccatctc

SEQ ID NO: 253661 - DNA, 16 bp, P. troglodytes
gggagaccccttctct

SEQ ID NO: 253662 - DNA, 16 bp, P. troglodytes
gggagaccgaggtggg

SEQ ID NO: 253663 - DNA, 16 bp, P. troglodytes
gggagacctaggcagg

SEQ ID NO: 253664 - DNA, 16 bp, P. troglodytes
gggagactgaggaagg

SEQ ID NO: 253665 - DNA, 16 bp, P. troglodytes
gggagactgatgcagg

SEQ ID NO: 253666 - DNA, 16 bp, P. troglodytes
gggagactggggctta

SEQ ID NO: 253667 - DNA, 16 bp, P. troglodytes
gggagactttttatta

SEQ ID NO: 253668 - DNA, 16 bp, P. troglodytes
gggagagacagaccca

SEQ ID NO: 253669 - DNA, 16 bp, P. troglodytes
gggagagagcgagact

SEQ ID NO: 253670 - DNA, 16 bp, P. troglodytes
gggagaggaagaagct

SEQ ID NO: 253671 - DNA, 16 bp, P. troglodytes
gggagaggagcccaca

SEQ ID NO: 253672 - DNA, 16 bp, P. troglodytes
gggagaggtcagatgg

SEQ ID NO: 253673 - DNA, 16 bp, P. troglodytes
gggagataaaattcaa

SEQ ID NO: 253674 - DNA, 16 bp, P. troglodytes
gggagatctcaggaaa

SEQ ID NO: 253675 - DNA, 16 bp, P. troglodytes
gggagatggaagtttt

SEQ ID NO: 253676 - DNA, 16 bp, P. troglodytes
gggagattctgtctca

SEQ ID NO: 253677 - DNA, 16 bp, P. troglodytes
gggagcaggcacatca

SEQ ID NO: 253678 - DNA, 16 bp, P. troglodytes
gggagcaggctctgtg

SEQ ID NO: 253679 - DNA, 16 bp, P. troglodytes
gggagcatttacccaa

SEQ ID NO: 253680 - DNA, 16 bp, P. troglodytes
gggagccagcatgtca

SEQ ID NO: 253681 - DNA, 16 bp, P. troglodytes
gggagccaggcacagt

SEQ ID NO: 253682 - DNA, 16 bp, P. troglodytes
gggagccagggcctgg

SEQ ID NO: 253683 - DNA, 16 bp, P. troglodytes
gggagcccaaggcagg

SEQ ID NO: 253684 - DNA, 28 bp, P. troglodytes
gggagcccctttctgggctggccaaggc

SEQ ID NO: 253685 - DNA, 16 bp, P. troglodytes
gggagccgaggtgggc

SEQ ID NO: 253686 - DNA, 16 bp, P. troglodytes
gggagcctgaggaggg

SEQ ID NO: 253687 - DNA, 16 bp, P. troglodytes
gggagctaaaaaagtt

SEQ ID NO: 253688 - DNA, 16 bp, P. troglodytes
gggagctaagccatga

SEQ ID NO: 253689 - DNA, 16 bp, P. troglodytes
gggagctcactacctc

SEQ ID NO: 253690 - DNA, 16 bp, P. troglodytes
gggagctccaccccag

SEQ ID NO: 253691 - DNA, 16 bp, P. troglodytes
gggagctgaagtggga

SEQ ID NO: 253692 - DNA, 16 bp, P. troglodytes
gggagctggaagaaca

SEQ ID NO: 253693 - DNA, 16 bp, P. troglodytes
gggagctggagaggga

SEQ ID NO: 253694 - DNA, 16 bp, P. troglodytes
gggagctgggtgaggc

SEQ ID NO: 253695 - DNA, 18 bp, P. troglodytes
gggagcttgaggctgcag

SEQ ID NO: 253696 - DNA, 16 bp, P. troglodytes
gggaggaaactggagt

SEQ ID NO: 253697 - DNA, 16 bp, P. troglodytes
gggaggaagaggctgc

SEQ ID NO: 253698 - DNA, 16 bp, P. troglodytes
gggaggacccaggaca

SEQ ID NO: 253699 - DNA, 16 bp, P. troglodytes
gggaggactgcttgag

SEQ ID NO: 253700 - DNA, 16 bp, P. troglodytes
gggaggacttcctgga

SEQ ID NO: 253701 - DNA, 16 bp, P. troglodytes
gggaggagccaagatg

SEQ ID NO: 253702 - DNA, 16 bp, P. troglodytes
gggaggagctgctgtg

SEQ ID NO: 253703 - DNA, 17 bp, P. troglodytes
gggaggatcacctgagg

SEQ ID NO: 253704 - DNA, 16 bp, P. troglodytes
gggaggatcacttaag

SEQ ID NO: 253705 - DNA, 18 bp, P. troglodytes
gggaggatcacttgaggt

SEQ ID NO: 253706 - DNA, 16 bp, P. troglodytes
gggaggatcattggag

SEQ ID NO: 253707 - DNA, 16 bp, P. troglodytes
gggaggatgaggcatg

SEQ ID NO: 253708 - DNA, 16 bp, P. troglodytes
gggaggattgaaaaaa

SEQ ID NO: 253709 - DNA, 18 bp, P. troglodytes
gggaggattgcctgagcc

SEQ ID NO: 253710 - DNA, 16 bp, P. troglodytes
gggaggattgcttgag

SEQ ID NO: 253711 - DNA, 16 bp, P. troglodytes
gggaggcaccacccag

SEQ ID NO: 253712 - DNA, 16 bp, P. troglodytes
gggaggcacctcccag

SEQ ID NO: 253713 - DNA, 16 bp, P. troglodytes
gggaggcagaagcaga

SEQ ID NO: 253714 - DNA, 16 bp, P. troglodytes
gggaggcagaagctgc

SEQ ID NO: 253715 - DNA, 16 bp, P. troglodytes
gggaggcagagactgg

SEQ ID NO: 253716 - DNA, 16 bp, P. troglodytes
gggaggcagagctgag

SEQ ID NO: 253717 - DNA, 16 bp, P. troglodytes
gggaggcagaggccag

SEQ ID NO: 253718 - DNA, 16 bp, P. troglodytes
gggaggcagaggctgt

SEQ ID NO: 253719 - DNA, 16 bp, P. troglodytes
gggaggcagagggttg

SEQ ID NO: 253720 - DNA, 16 bp, P. troglodytes
gggaggcagaggtggc

SEQ ID NO: 253721 - DNA, 24 bp, P. troglodytes
gggaggcagaggttgcaatgagct

SEQ ID NO: 253722 - DNA, 16 bp, P. troglodytes
gggaggcagcccccag

SEQ ID NO: 253723 - DNA, 16 bp, P. troglodytes
gggaggcagggcctgg

SEQ ID NO: 253724 - DNA, 16 bp, P. troglodytes
gggaggcatcaggaaa

SEQ ID NO: 253725 - DNA, 16 bp, P. troglodytes
gggaggccaacgtggg

SEQ ID NO: 253726 - DNA, 16 bp, P. troglodytes
gggaggccaaggtgga

SEQ ID NO: 253727 - DNA, 16 bp, P. troglodytes
gggaggccacagcagg

SEQ ID NO: 253728 - DNA, 16 bp, P. troglodytes
gggaggccaggcagga

SEQ ID NO: 253729 - DNA, 16 bp, P. troglodytes
gggaggccaggcaggc

SEQ ID NO: 253730 - DNA, 16 bp, P. troglodytes
gggaggccaggctggg

SEQ ID NO: 253731 - DNA, 16 bp, P. troglodytes
gggaggccaggtggga

SEQ ID NO: 253732 - DNA, 16 bp, P. troglodytes
gggaggcccaaggaga

SEQ ID NO: 253733 - DNA, 16 bp, P. troglodytes
gggaggcccaggaagg

SEQ ID NO: 253734 - DNA, 16 bp, P. troglodytes
gggaggcccaggcgga

SEQ ID NO: 253735 - DNA, 16 bp, P. troglodytes
gggaggcccaggtctg

SEQ ID NO: 253736 - DNA, 16 bp, P. troglodytes
gggaggcccaggtgga

SEQ ID NO: 253737 - DNA, 16 bp, P. troglodytes
gggaggccctgcccag

SEQ ID NO: 253738 - DNA, 16 bp, P. troglodytes
gggaggccgagacgga

SEQ ID NO: 253739 - DNA, 16 bp, P. troglodytes
gggaggccgagcaggc

SEQ ID NO: 253740 - DNA, 16 bp, P. troglodytes
gggaggccgcagtggg

SEQ ID NO: 253741 - DNA, 16 bp, P. troglodytes
gggaggcctaggaggg

SEQ ID NO: 253742 - DNA, 16 bp, P. troglodytes
gggaggcctcagggaa

SEQ ID NO: 253743 - DNA, 16 bp, P. troglodytes
gggaggcctggtggtg

SEQ ID NO: 253744 - DNA, 16 bp, P. troglodytes
gggaggccttgggaaa

SEQ ID NO: 253745 - DNA, 16 bp, P. troglodytes
gggaggcggagatcgc

SEQ ID NO: 253746 - DNA, 16 bp, P. troglodytes
gggaggcggaggctgt

SEQ ID NO: 253747 - DNA, 16 bp, P. troglodytes
gggaggctaaggcgag

SEQ ID NO: 253748 - DNA, 16 bp, P. troglodytes
gggaggctaaggcggg

SEQ ID NO: 253749 - DNA, 16 bp, P. troglodytes
gggaggctaaggctgg

SEQ ID NO: 253750 - DNA, 17 bp, P. troglodytes
gggaggctcaggcatgg

SEQ ID NO: 253751 - DNA, 16 bp, P. troglodytes
gggaggctcaggctgc

SEQ ID NO: 253752 - DNA, 16 bp, P. troglodytes
gggaggctcaggtggg

SEQ ID NO: 253753 - DNA, 16 bp, P. troglodytes
gggaggctcgggccac

SEQ ID NO: 253754 - DNA, 16 bp, P. troglodytes
gggaggctgaaatggg

SEQ ID NO: 253755 - DNA, 16 bp, P. troglodytes
gggaggctgaaggcag

SEQ ID NO: 253756 - DNA, 16 bp, P. troglodytes
gggaggctgaagtgga

SEQ ID NO: 253757 - DNA, 17 bp, P. troglodytes
gggaggctgagaaggag

SEQ ID NO: 253758 - DNA, 16 bp, P. troglodytes
gggaggctgagacgga

SEQ ID NO: 253759 - DNA, 16 bp, P. troglodytes
gggaggctgagatagg

SEQ ID NO: 253760 - DNA, 16 bp, P. troglodytes
gggaggctgagcagga

SEQ ID NO: 253761 - DNA, 16 bp, P. troglodytes
gggaggctgagcaggg

SEQ ID NO: 253762 - DNA, 16 bp, P. troglodytes
gggaggctgaggagaa

SEQ ID NO: 253763 - DNA, 16 bp, P. troglodytes
gggaggctgaggaggc

SEQ ID NO: 253764 - DNA, 16 bp, P. troglodytes
gggaggctgaggcaga

SEQ ID NO: 253765 - DNA, 17 bp, P. troglodytes
gggaggctgaggccgga

SEQ ID NO: 253766 - DNA, 16 bp, P. troglodytes
gggaggctgaggcgag

SEQ ID NO: 253767 - DNA, 16 bp, P. troglodytes
gggaggctgaggctgc

SEQ ID NO: 253768 - DNA, 16 bp, P. troglodytes
gggaggctgagggcag

SEQ ID NO: 253769 - DNA, 16 bp, P. troglodytes
gggaggctgagggtgc

SEQ ID NO: 253770 - DNA, 16 bp, P. troglodytes
gggaggctgaggtatg

SEQ ID NO: 253771 - DNA, 16 bp, P. troglodytes
gggaggctgaggtcgg

SEQ ID NO: 253772 - DNA, 16 bp, P. troglodytes
gggaggctgaggtgga

SEQ ID NO: 253773 - DNA, 16 bp, P. troglodytes
gggaggctgagtgagg

SEQ ID NO: 253774 - DNA, 16 bp, P. troglodytes
gggaggctgagttggg

SEQ ID NO: 253775 - DNA, 16 bp, P. troglodytes
gggaggctgcagcagg

SEQ ID NO: 253776 - DNA, 16 bp, P. troglodytes
gggaggctgcagtggg

SEQ ID NO: 253777 - DNA, 16 bp, P. troglodytes
gggaggctgcggcagg

SEQ ID NO: 253778 - DNA, 16 bp, P. troglodytes
gggaggctggggccag

SEQ ID NO: 253779 - DNA, 16 bp, P. troglodytes
gggaggctggggctgc

SEQ ID NO: 253780 - DNA, 16 bp, P. troglodytes
gggaggcttaggcagg

SEQ ID NO: 253781 - DNA, 16 bp, P. troglodytes
gggaggcttaggtggg

SEQ ID NO: 253782 - DNA, 16 bp, P. troglodytes
gggagggaccagagaa

SEQ ID NO: 253783 - DNA, 16 bp, P. troglodytes
gggagggacccaggtg

SEQ ID NO: 253784 - DNA, 16 bp, P. troglodytes
gggagggaggctgcag

SEQ ID NO: 253785 - DNA, 16 bp, P. troglodytes
gggagggcttcctgga

SEQ ID NO: 253786 - DNA, 16 bp, P. troglodytes
gggaggggctgccaca

SEQ ID NO: 253787 - DNA, 16 bp, P. troglodytes
gggaggggctgccctg

SEQ ID NO: 253788 - DNA, 16 bp, P. troglodytes
gggaggggctgcctca

SEQ ID NO: 253789 - DNA, 16 bp, P. troglodytes
gggaggggctgctgag

SEQ ID NO: 253790 - DNA, 16 bp, P. troglodytes
gggaggggtggccaca

SEQ ID NO: 253791 - DNA, 16 bp, P. troglodytes
gggagggtaaattagt

SEQ ID NO: 253792 - DNA, 16 bp, P. troglodytes
gggaggtaactgaatt

SEQ ID NO: 253793 - DNA, 16 bp, P. troglodytes
gggaggtagaggcagg

SEQ ID NO: 253794 - DNA, 16 bp, P. troglodytes
gggaggtcaaggtgag

SEQ ID NO: 253795 - DNA, 16 bp, P. troglodytes
gggaggtgaaggacct

SEQ ID NO: 253796 - DNA, 16 bp, P. troglodytes
gggaggtggagctggc

SEQ ID NO: 253797 - DNA, 16 bp, P. troglodytes
gggaggtggaggtgca

SEQ ID NO: 253798 - DNA, 16 bp, P. troglodytes
gggaggttgaggcagc

SEQ ID NO: 253799 - DNA, 16 bp, P. troglodytes
gggaggttgaggccag

SEQ ID NO: 253800 - DNA, 16 bp, P. troglodytes
gggaggttgaggctgc

SEQ ID NO: 253801 - DNA, 16 bp, P. troglodytes
gggagtattgcttgag

SEQ ID NO: 253802 - DNA, 16 bp, P. troglodytes
gggagtctcactctgt

SEQ ID NO: 253803 - DNA, 16 bp, P. troglodytes
gggagtcttgctctgt

SEQ ID NO: 253804 - DNA, 16 bp, P. troglodytes
gggagtgcagatagct

SEQ ID NO: 253805 - DNA, 16 bp, P. troglodytes
gggagtgcagtggcac

SEQ ID NO: 253806 - DNA, 16 bp, P. troglodytes
gggagtgcagtggtgc

SEQ ID NO: 253807 - DNA, 16 bp, P. troglodytes
gggagtgcttgtgcca

SEQ ID NO: 253808 - DNA, 16 bp, P. troglodytes
gggagtgctttgaggc

SEQ ID NO: 253809 - DNA, 16 bp, P. troglodytes
gggagttcactcatta

SEQ ID NO: 253810 - DNA, 16 bp, P. troglodytes
gggagttccagaccag

SEQ ID NO: 253811 - DNA, 17 bp, P. troglodytes
gggagttcgagaccaga

SEQ ID NO: 253812 - DNA, 16 bp, P. troglodytes
gggagtttaaaaaaaa

SEQ ID NO: 253813 - DNA, 16 bp, P. troglodytes
gggagtttgagaccaa

SEQ ID NO: 253814 - DNA, 16 bp, P. troglodytes
gggatacagagatgaa

SEQ ID NO: 253815 - DNA, 16 bp, P. troglodytes
gggatacatgtgcagg

SEQ ID NO: 253816 - DNA, 16 bp, P. troglodytes
gggatagctgggtcaa

SEQ ID NO: 253817 - DNA, 16 bp, P. troglodytes
gggatataatctcctg

SEQ ID NO: 253818 - DNA, 16 bp, P. troglodytes
gggatatagcagtgaa

SEQ ID NO: 253819 - DNA, 16 bp, P. troglodytes
gggatatgatggctta

SEQ ID NO: 253820 - DNA, 16 bp, P. troglodytes
gggatatgttctgaga

SEQ ID NO: 253821 - DNA, 16 bp, P. troglodytes
gggatattaccactga

SEQ ID NO: 253822 - DNA, 16 bp, P. troglodytes
gggatattatgaataa

SEQ ID NO: 253823 - DNA, 16 bp, P. troglodytes
gggatattcatcacct

SEQ ID NO: 253824 - DNA, 16 bp, P. troglodytes
gggatcaggtgatcct

SEQ ID NO: 253825 - DNA, 16 bp, P. troglodytes
gggatcattagaagcc

SEQ ID NO: 253826 - DNA, 16 bp, P. troglodytes
gggatcctcctgcccc

SEQ ID NO: 253827 - DNA, 17 bp, P. troglodytes
gggatcctctagagtcg

SEQ ID NO: 253828 - DNA, 16 bp, P. troglodytes
gggatctgccccatga

SEQ ID NO: 253829 - DNA, 17 bp, P. troglodytes
gggatgaaactgttcca

SEQ ID NO: 253830 - DNA, 16 bp, P. troglodytes
gggatgaagcccagtt

SEQ ID NO: 253831 - DNA, 16 bp, P. troglodytes
gggatgacaggcacac

SEQ ID NO: 253832 - DNA, 16 bp, P. troglodytes
gggatgagggataaaa

SEQ ID NO: 253833 - DNA, 16 bp, P. troglodytes
gggatgatgatgatga

SEQ ID NO: 253834 - DNA, 16 bp, P. troglodytes
gggatgcaactaaagc

SEQ ID NO: 253835 - DNA, 16 bp, P. troglodytes
gggatgcagaggcagg

SEQ ID NO: 253836 - DNA, 16 bp, P. troglodytes
gggatgcagctaaagt

SEQ ID NO: 253837 - DNA, 16 bp, P. troglodytes
gggatgcatgtgcaga

SEQ ID NO: 253838 - DNA, 16 bp, P. troglodytes
gggatgccaagacagg

SEQ ID NO: 253839 - DNA, 16 bp, P. troglodytes
gggatgctccagcttg

SEQ ID NO: 253840 - DNA, 16 bp, P. troglodytes
gggatgctgagacagg

SEQ ID NO: 253841 - DNA, 16 bp, P. troglodytes
gggatgctgaggaggg

SEQ ID NO: 253842 - DNA, 16 bp, P. troglodytes
gggatgctgaggcaga

SEQ ID NO: 253843 - DNA, 16 bp, P. troglodytes
gggatgctgaggcatg

SEQ ID NO: 253844 - DNA, 16 bp, P. troglodytes
gggatgctgtttggag

SEQ ID NO: 253845 - DNA, 16 bp, P. troglodytes
gggatggaggaagatc

SEQ ID NO: 253846 - DNA, 16 bp, P. troglodytes
gggatggggcttcctg

SEQ ID NO: 253847 - DNA, 16 bp, P. troglodytes
gggatggtggtgggca

SEQ ID NO: 253848 - DNA, 26 bp, P. troglodytes
gggatgtgtcagggtcacaagacaat

SEQ ID NO: 253849 - DNA, 16 bp, P. troglodytes
gggatgttaccactga

SEQ ID NO: 253850 - DNA, 16 bp, P. troglodytes
gggatgttcaacctgt

SEQ ID NO: 253851 - DNA, 16 bp, P. troglodytes
gggattaaaggcaccc

SEQ ID NO: 253852 - DNA, 16 bp, P. troglodytes
gggattacagccgtgt

SEQ ID NO: 253853 - DNA, 16 bp, P. troglodytes
gggattacagctgtaa

SEQ ID NO: 253854 - DNA, 16 bp, P. troglodytes
gggattacaggtgcct

SEQ ID NO: 253855 - DNA, 16 bp, P. troglodytes
gggattagaggcaccc

SEQ ID NO: 253856 - DNA, 16 bp, P. troglodytes
gggattagggcatgga

SEQ ID NO: 253857 - DNA, 16 bp, P. troglodytes
gggattataaatcatt

SEQ ID NO: 253858 - DNA, 16 bp, P. troglodytes
gggattcaaacccagg

SEQ ID NO: 253859 - DNA, 16 bp, P. troglodytes
gggattcaccatgttg

SEQ ID NO: 253860 - DNA, 16 bp, P. troglodytes
gggattcactgtgtta

SEQ ID NO: 253861 - DNA, 16 bp, P. troglodytes
gggattcagcttcttc

SEQ ID NO: 253862 - DNA, 16 bp, P. troglodytes
gggattctccagcctc

SEQ ID NO: 253863 - DNA, 16 bp, P. troglodytes
gggattgggcttctag

SEQ ID NO: 253864 - DNA, 16 bp, P. troglodytes
gggattggttccagga

SEQ ID NO: 253865 - DNA, 17 bp, P. troglodytes
gggatttctccatgttg

SEQ ID NO: 253866 - DNA, 16 bp, P. troglodytes
gggatttgaacccagg

SEQ ID NO: 253867 - DNA, 16 bp, P. troglodytes
gggatttgccttgtct

SEQ ID NO: 253868 - DNA, 16 bp, P. troglodytes
gggatttgttccagga

SEQ ID NO: 253869 - DNA, 16 bp, P. troglodytes
gggattttcttttctg

SEQ ID NO: 253870 - DNA, 16 bp, P. troglodytes
gggcaaagagcaagac

SEQ ID NO: 253871 - DNA, 16 bp, P. troglodytes
gggcaaaggacattaa

SEQ ID NO: 253872 - DNA, 16 bp, P. troglodytes
gggcaacacggcgaaa

SEQ ID NO: 253873 - DNA, 16 bp, P. troglodytes
gggcaacagaagaaga

SEQ ID NO: 253874 - DNA, 16 bp, P. troglodytes
gggcaacagagacaga

SEQ ID NO: 253875 - DNA, 16 bp, P. troglodytes
gggcaaccagcagctc

SEQ ID NO: 253876 - DNA, 16 bp, P. troglodytes
gggcaaccatcaccac

SEQ ID NO: 253877 - DNA, 16 bp, P. troglodytes
gggcaagaccctgtct

SEQ ID NO: 253878 - DNA, 16 bp, P. troglodytes
gggcaagacttttctt

SEQ ID NO: 253879 - DNA, 16 bp, P. troglodytes
gggcaaggtggctcac

SEQ ID NO: 253880 - DNA, 16 bp, P. troglodytes
gggcaagttacttaac

SEQ ID NO: 253881 - DNA, 16 bp, P. troglodytes
gggcaatataaggaga

SEQ ID NO: 253882 - DNA, 16 bp, P. troglodytes
gggcacagaaaaacaa

SEQ ID NO: 253883 - DNA, 17 bp, P. troglodytes
gggcacagtggctcaca

SEQ ID NO: 253884 - DNA, 16 bp, P. troglodytes
gggcacagtggtgtgt

SEQ ID NO: 253885 - DNA, 16 bp, P. troglodytes
gggcacagttgctcac

SEQ ID NO: 253886 - DNA, 16 bp, P. troglodytes
gggcaccctgtggccc

SEQ ID NO: 253887 - DNA, 16 bp, P. troglodytes
gggcacgccaccatgc

SEQ ID NO: 253888 - DNA, 16 bp, P. troglodytes
gggcacggtagctcac

SEQ ID NO: 253889 - DNA, 16 bp, P. troglodytes
gggcacggtggcatgc

SEQ ID NO: 253890 - DNA, 16 bp, P. troglodytes
gggcacggtggcgcac

SEQ ID NO: 253891 - DNA, 16 bp, P. troglodytes
gggcactgcctggtgg

SEQ ID NO: 253892 - DNA, 16 bp, P. troglodytes
gggcacttttttggtt

SEQ ID NO: 253893 - DNA, 16 bp, P. troglodytes
gggcactttttttttt

SEQ ID NO: 253894 - DNA, 16 bp, P. troglodytes
gggcagaaagatcaca

SEQ ID NO: 253895 - DNA, 16 bp, P. troglodytes
gggcagaaagcatcca

SEQ ID NO: 253896 - DNA, 16 bp, P. troglodytes
gggcagagcagggcag

SEQ ID NO: 253897 - DNA, 18 bp, P. troglodytes
gggcagagcaggtagcag

SEQ ID NO: 253898 - DNA, 16 bp, P. troglodytes
gggcagagcatctctg

SEQ ID NO: 253899 - DNA, 16 bp, P. troglodytes
gggcagagcgagactc

SEQ ID NO: 253900 - DNA, 16 bp, P. troglodytes
gggcagaggcaccccc

SEQ ID NO: 253901 - DNA, 16 bp, P. troglodytes
gggcagaggctgcact

SEQ ID NO: 253902 - DNA, 18 bp, P. troglodytes
gggcagaggggctcctca

SEQ ID NO: 253903 - DNA, 16 bp, P. troglodytes
gggcagaggtccctgc

SEQ ID NO: 253904 - DNA, 16 bp, P. troglodytes
gggcagaggtgggaga

SEQ ID NO: 253905 - DNA, 17 bp, P. troglodytes
gggcagatcacccgagg

SEQ ID NO: 253906 - DNA, 16 bp, P. troglodytes
gggcagatcaccggag

SEQ ID NO: 253907 - DNA, 16 bp, P. troglodytes
gggcagatcacttggg

SEQ ID NO: 253908 - DNA, 16 bp, P. troglodytes
gggcagcagagcgaga

SEQ ID NO: 253909 - DNA, 16 bp, P. troglodytes
gggcagcagccatcac

SEQ ID NO: 253910 - DNA, 16 bp, P. troglodytes
gggcagcataacaaga

SEQ ID NO: 253911 - DNA, 16 bp, P. troglodytes
gggcagccaaggcagg

SEQ ID NO: 253912 - DNA, 16 bp, P. troglodytes
gggcagccaccccaca

SEQ ID NO: 253913 - DNA, 16 bp, P. troglodytes
gggcagccagagaaaa

SEQ ID NO: 253914 - DNA, 16 bp, P. troglodytes
gggcagccaggcagag

SEQ ID NO: 253915 - DNA, 16 bp, P. troglodytes
gggcagctctgcccct

SEQ ID NO: 253916 - DNA, 16 bp, P. troglodytes
gggcagctgggcagag

SEQ ID NO: 253917 - DNA, 16 bp, P. troglodytes
gggcaggaagcatcca

SEQ ID NO: 253918 - DNA, 16 bp, P. troglodytes
gggcaggagcagctgg

SEQ ID NO: 253919 - DNA, 16 bp, P. troglodytes
gggcaggatggtctcg

SEQ ID NO: 253920 - DNA, 16 bp, P. troglodytes
gggcagggcagggctg

SEQ ID NO: 253921 - DNA, 16 bp, P. troglodytes
gggcagggcctggtgg

SEQ ID NO: 253922 - DNA, 16 bp, P. troglodytes
gggcagggctaggtgt

SEQ ID NO: 253923 - DNA, 16 bp, P. troglodytes
gggcagggctcccacc

SEQ ID NO: 253924 - DNA, 16 bp, P. troglodytes
gggcagggctgggcag

SEQ ID NO: 253925 - DNA, 16 bp, P. troglodytes
gggcagggctggggac

SEQ ID NO: 253926 - DNA, 16 bp, P. troglodytes
gggcagggggctgacc

SEQ ID NO: 253927 - DNA, 16 bp, P. troglodytes
gggcagggtccctggc

SEQ ID NO: 253928 - DNA, 16 bp, P. troglodytes
gggcaggtgcagaggc

SEQ ID NO: 253929 - DNA, 16 bp, P. troglodytes
gggcagtgctgacatg

SEQ ID NO: 253930 - DNA, 16 bp, P. troglodytes
gggcagtggcagcagg

SEQ ID NO: 253931 - DNA, 16 bp, P. troglodytes
gggcagtgggcagagg

SEQ ID NO: 253932 - DNA, 16 bp, P. troglodytes
gggcatgatggtgggc

SEQ ID NO: 253933 - DNA, 16 bp, P. troglodytes
gggcatgatggtgtgt

SEQ ID NO: 253934 - DNA, 16 bp, P. troglodytes
gggcatggccctggct

SEQ ID NO: 253935 - DNA, 16 bp, P. troglodytes
gggcatggtgacacat

SEQ ID NO: 253936 - DNA, 16 bp, P. troglodytes
gggcatggtgacgggc

SEQ ID NO: 253937 - DNA, 16 bp, P. troglodytes
gggcatggtgctgggc

SEQ ID NO: 253938 - DNA, 18 bp, P. troglodytes
gggcatggtggcacacac

SEQ ID NO: 253939 - DNA, 16 bp, P. troglodytes
gggcatggtggcaggc

SEQ ID NO: 253940 - DNA, 16 bp, P. troglodytes
gggcatggtggcagtt

SEQ ID NO: 253941 - DNA, 16 bp, P. troglodytes
gggcatggtggcgtgc

SEQ ID NO: 253942 - DNA, 16 bp, P. troglodytes
gggcatggtggctcaa

SEQ ID NO: 253943 - DNA, 17 bp, P. troglodytes
gggcatggtggcttacg

SEQ ID NO: 253944 - DNA, 16 bp, P. troglodytes
gggcatggtggtggca

SEQ ID NO: 253945 - DNA, 16 bp, P. troglodytes
gggcatggtggtggcg

SEQ ID NO: 253946 - DNA, 16 bp, P. troglodytes
gggcatggtggtgggc

SEQ ID NO: 253947 - DNA, 17 bp, P. troglodytes
gggcatggtggtgggtg

SEQ ID NO: 253948 - DNA, 16 bp, P. troglodytes
gggcatggttgcaggc

SEQ ID NO: 253949 - DNA, 16 bp, P. troglodytes
gggcatggttgctcac

SEQ ID NO: 253950 - DNA, 16 bp, P. troglodytes
gggcatgttggtgcat

SEQ ID NO: 253951 - DNA, 16 bp, P. troglodytes
gggcattgtggtgggc

SEQ ID NO: 253952 - DNA, 16 bp, P. troglodytes
gggcatttgggaggtg

SEQ ID NO: 253953 - DNA, 16 bp, P. troglodytes
gggcattttctggaat

SEQ ID NO: 253954 - DNA, 16 bp, P. troglodytes
gggccaaatgcagcaa

SEQ ID NO: 253955 - DNA, 16 bp, P. troglodytes
gggccaacagacacct

SEQ ID NO: 253956 - DNA, 16 bp, P. troglodytes
gggccaactgagctgc

SEQ ID NO: 253957 - DNA, 16 bp, P. troglodytes
gggccaagcaggtgac

SEQ ID NO: 253958 - DNA, 16 bp, P. troglodytes
gggccaaggcagcagg

SEQ ID NO: 253959 - DNA, 16 bp, P. troglodytes
gggccaaggtacagct

SEQ ID NO: 253960 - DNA, 16 bp, P. troglodytes
gggccaattttttttt

SEQ ID NO: 253961 - DNA, 16 bp, P. troglodytes
gggccacacaggagcc

SEQ ID NO: 253962 - DNA, 16 bp, P. troglodytes
gggccacagagtgaca

SEQ ID NO: 253963 - DNA, 16 bp, P. troglodytes
gggccacatggggaag

SEQ ID NO: 253964 - DNA, 16 bp, P. troglodytes
gggccacccaaagtgc

SEQ ID NO: 253965 - DNA, 17 bp, P. troglodytes
gggccactactggtctc

SEQ ID NO: 253966 - DNA, 16 bp, P. troglodytes
gggccagcagctgtgg

SEQ ID NO: 253967 - DNA, 16 bp, P. troglodytes
gggccagcagggctgg

SEQ ID NO: 253968 - DNA, 16 bp, P. troglodytes
gggccagccggctgct

SEQ ID NO: 253969 - DNA, 16 bp, P. troglodytes
gggccagcggctgcgg

SEQ ID NO: 253970 - DNA, 16 bp, P. troglodytes
gggccaggcacggtgg

SEQ ID NO: 253971 - DNA, 18 bp, P. troglodytes
gggccaggcacggtggct

SEQ ID NO: 253972 - DNA, 16 bp, P. troglodytes
gggccaggcagaacag

SEQ ID NO: 253973 - DNA, 16 bp, P. troglodytes
gggccaggcccaggac

SEQ ID NO: 253974 - DNA, 16 bp, P. troglodytes
gggccaggcccaggcc

SEQ ID NO: 253975 - DNA, 16 bp, P. troglodytes
gggccaggcccagggc

SEQ ID NO: 253976 - DNA, 16 bp, P. troglodytes
gggccaggctgcctgg

SEQ ID NO: 253977 - DNA, 16 bp, P. troglodytes
gggccagggccaggcc

SEQ ID NO: 253978 - DNA, 16 bp, P. troglodytes
gggccaggggcagaat

SEQ ID NO: 253979 - DNA, 16 bp, P. troglodytes
gggccaggtgccatgg

SEQ ID NO: 253980 - DNA, 16 bp, P. troglodytes
gggccatggtggtttg

SEQ ID NO: 253981 - DNA, 16 bp, P. troglodytes
gggcccaagggctctt

SEQ ID NO: 253982 - DNA, 16 bp, P. troglodytes
gggcccaagtgatcct

SEQ ID NO: 253983 - DNA, 16 bp, P. troglodytes
gggcccaatataatca

SEQ ID NO: 253984 - DNA, 16 bp, P. troglodytes
gggcccaggaatctgt

SEQ ID NO: 253985 - DNA, 16 bp, P. troglodytes
gggcccaggaggcgga

SEQ ID NO: 253986 - DNA, 16 bp, P. troglodytes
gggcccagggcccagg

SEQ ID NO: 253987 - DNA, 16 bp, P. troglodytes
gggcccagggccctgc

SEQ ID NO: 253988 - DNA, 16 bp, P. troglodytes
gggcccaggggaccag

SEQ ID NO: 253989 - DNA, 16 bp, P. troglodytes
gggcccaggggactgg

SEQ ID NO: 253990 - DNA, 16 bp, P. troglodytes
gggccccagtgtctgt

SEQ ID NO: 253991 - DNA, 16 bp, P. troglodytes
gggcccggcatggtgg

SEQ ID NO: 253992 - DNA, 16 bp, P. troglodytes
gggccctctctgctcc

SEQ ID NO: 253993 - DNA, 16 bp, P. troglodytes
gggccctcttcctggt

SEQ ID NO: 253994 - DNA, 16 bp, P. troglodytes
gggccctgggcccagc

SEQ ID NO: 253995 - DNA, 16 bp, P. troglodytes
gggccctgggcctggc

SEQ ID NO: 253996 - DNA, 16 bp, P. troglodytes
gggcccttagtctgag

SEQ ID NO: 253997 - DNA, 16 bp, P. troglodytes
gggccggacacagtgg

SEQ ID NO: 253998 - DNA, 22 bp, P. troglodytes
gggccgggcacagtggctcacg

SEQ ID NO: 253999 - DNA, 18 bp, P. troglodytes
gggccgggcgcagtggct

SEQ ID NO: 254000 - DNA, 16 bp, P. troglodytes
gggccgggtatggtgg

SEQ ID NO: 254001 - DNA, 16 bp, P. troglodytes
gggcctagcacagtgc

SEQ ID NO: 254002 - DNA, 16 bp, P. troglodytes
gggcctatggtgaaaa

SEQ ID NO: 254003 - DNA, 16 bp, P. troglodytes
gggcctcaccagacac

SEQ ID NO: 254004 - DNA, 16 bp, P. troglodytes
gggcctcactctgttg

SEQ ID NO: 254005 - DNA, 16 bp, P. troglodytes
gggcctcagcctccca

SEQ ID NO: 254006 - DNA, 16 bp, P. troglodytes
gggcctcagcctcctg

SEQ ID NO: 254007 - DNA, 16 bp, P. troglodytes
gggcctcagctgcctc

SEQ ID NO: 254008 - DNA, 16 bp, P. troglodytes
gggcctcagtgtcctc

SEQ ID NO: 254009 - DNA, 16 bp, P. troglodytes
gggcctcagtttcctc

SEQ ID NO: 254010 - DNA, 16 bp, P. troglodytes
gggcctcagtttcctt

SEQ ID NO: 254011 - DNA, 16 bp, P. troglodytes
gggcctccagccaccc

SEQ ID NO: 254012 - DNA, 16 bp, P. troglodytes
gggcctccctgtggga

SEQ ID NO: 254013 - DNA, 16 bp, P. troglodytes
gggcctctgcactcca

SEQ ID NO: 254014 - DNA, 16 bp, P. troglodytes
gggcctgatgggaggt

SEQ ID NO: 254015 - DNA, 16 bp, P. troglodytes
gggcctgccaccacac

SEQ ID NO: 254016 - DNA, 16 bp, P. troglodytes
gggcctgcctttccca

SEQ ID NO: 254017 - DNA, 16 bp, P. troglodytes
gggcctgctgggactt

SEQ ID NO: 254018 - DNA, 16 bp, P. troglodytes
gggcctggaaaggggg

SEQ ID NO: 254019 - DNA, 16 bp, P. troglodytes
gggcctggaagaaaaa

SEQ ID NO: 254020 - DNA, 16 bp, P. troglodytes
gggcctggacccctgg

SEQ ID NO: 254021 - DNA, 16 bp, P. troglodytes
gggcctggaggcaggg

SEQ ID NO: 254022 - DNA, 16 bp, P. troglodytes
gggcctggcacagagc

SEQ ID NO: 254023 - DNA, 16 bp, P. troglodytes
gggcctggcatggtgg

SEQ ID NO: 254024 - DNA, 16 bp, P. troglodytes
gggcctggcccaggaa

SEQ ID NO: 254025 - DNA, 16 bp, P. troglodytes
gggcctggcccagggc

SEQ ID NO: 254026 - DNA, 16 bp, P. troglodytes
gggcctgggcctggcc

SEQ ID NO: 254027 - DNA, 16 bp, P. troglodytes
gggcctgtaatcccag

SEQ ID NO: 254028 - DNA, 16 bp, P. troglodytes
gggcctgtagttccag

SEQ ID NO: 254029 - DNA, 16 bp, P. troglodytes
gggcctgtcacggggt

SEQ ID NO: 254030 - DNA, 16 bp, P. troglodytes
gggcctgtcatggggt

SEQ ID NO: 254031 - DNA, 16 bp, P. troglodytes
gggccttcctgggccc

SEQ ID NO: 254032 - DNA, 16 bp, P. troglodytes
gggccttgctctgtct

SEQ ID NO: 254033 - DNA, 16 bp, P. troglodytes
gggccttgggcaagac

SEQ ID NO: 254034 - DNA, 16 bp, P. troglodytes
gggcctttgagcccct

SEQ ID NO: 254035 - DNA, 16 bp, P. troglodytes
gggcctttgcactggc

SEQ ID NO: 254036 - DNA, 16 bp, P. troglodytes
gggcgactctagagga

SEQ ID NO: 254037 - DNA, 16 bp, P. troglodytes
gggcgcagtggatcac

SEQ ID NO: 254038 - DNA, 16 bp, P. troglodytes
gggcgcagtggctgac

SEQ ID NO: 254039 - DNA, 16 bp, P. troglodytes
gggcgccgtggagcag

SEQ ID NO: 254040 - DNA, 16 bp, P. troglodytes
gggcggattgcttgag

SEQ ID NO: 254041 - DNA, 16 bp, P. troglodytes
gggcgggcagcagctg

SEQ ID NO: 254042 - DNA, 16 bp, P. troglodytes
gggcggggtggctcac

SEQ ID NO: 254043 - DNA, 17 bp, P. troglodytes
gggcgggtggatcacga

SEQ ID NO: 254044 - DNA, 16 bp, P. troglodytes
gggcggtttcccccat

SEQ ID NO: 254045 - DNA, 16 bp, P. troglodytes
gggcgtgatggtgggc

SEQ ID NO: 254046 - DNA, 16 bp, P. troglodytes
gggcgtggcagcaggc

SEQ ID NO: 254047 - DNA, 16 bp, P. troglodytes
gggcgtggtgacaggc

SEQ ID NO: 254048 - DNA, 20 bp, P. troglodytes
gggcgtggtggcacgtgcct

SEQ ID NO: 254049 - DNA, 16 bp, P. troglodytes
gggcgtggtggcggat

SEQ ID NO: 254050 - DNA, 16 bp, P. troglodytes
gggcgtggtggctcac

SEQ ID NO: 254051 - DNA, 16 bp, P. troglodytes
gggcgtggtggtggac

SEQ ID NO: 254052 - DNA, 16 bp, P. troglodytes
gggcgtggtggtggca

SEQ ID NO: 254053 - DNA, 16 bp, P. troglodytes
gggcgtggtggtgtac

SEQ ID NO: 254054 - DNA, 16 bp, P. troglodytes
gggctacagagcaaga

SEQ ID NO: 254055 - DNA, 16 bp, P. troglodytes
gggctacagagctaga

SEQ ID NO: 254056 - DNA, 16 bp, P. troglodytes
gggctacagagtgaga

SEQ ID NO: 254057 - DNA, 16 bp, P. troglodytes
gggctactatccagaa

SEQ ID NO: 254058 - DNA, 16 bp, P. troglodytes
gggctagcctgctgga

SEQ ID NO: 254059 - DNA, 16 bp, P. troglodytes
gggctcaagggttcct

SEQ ID NO: 254060 - DNA, 16 bp, P. troglodytes
gggctcaagtgatccc

SEQ ID NO: 254061 - DNA, 16 bp, P. troglodytes
gggctcactgcaggct

SEQ ID NO: 254062 - DNA, 16 bp, P. troglodytes
gggctcagagaggtga

SEQ ID NO: 254063 - DNA, 16 bp, P. troglodytes
gggctcagcctcctga

SEQ ID NO: 254064 - DNA, 16 bp, P. troglodytes
gggctcaggcccaggg

SEQ ID NO: 254065 - DNA, 16 bp, P. troglodytes
gggctcagggaatcct

SEQ ID NO: 254066 - DNA, 16 bp, P. troglodytes
gggctcagggctcagg

SEQ ID NO: 254067 - DNA, 16 bp, P. troglodytes
gggctcaggggagagg

SEQ ID NO: 254068 - DNA, 16 bp, P. troglodytes
gggctcaggggatcct

SEQ ID NO: 254069 - DNA, 16 bp, P. troglodytes
gggctcaggtgaccct

SEQ ID NO: 254070 - DNA, 16 bp, P. troglodytes
gggctcagtccccaag

SEQ ID NO: 254071 - DNA, 16 bp, P. troglodytes
gggctcagtgatcagg

SEQ ID NO: 254072 - DNA, 16 bp, P. troglodytes
gggctcagtttcctca

SEQ ID NO: 254073 - DNA, 16 bp, P. troglodytes
gggctcatccagaccg

SEQ ID NO: 254074 - DNA, 16 bp, P. troglodytes
gggctccacccccagg

SEQ ID NO: 254075 - DNA, 16 bp, P. troglodytes
gggctccagcagtcct

SEQ ID NO: 254076 - DNA, 16 bp, P. troglodytes
gggctcccccagccag

SEQ ID NO: 254077 - DNA, 16 bp, P. troglodytes
gggctcctcctgcctc

SEQ ID NO: 254078 - DNA, 25 bp, P. troglodytes
gggctcggtggctcacgcctgtaat

SEQ ID NO: 254079 - DNA, 16 bp, P. troglodytes
gggctcgtccgggatt

SEQ ID NO: 254080 - DNA, 16 bp, P. troglodytes
gggctctgaagtcaga

SEQ ID NO: 254081 - DNA, 16 bp, P. troglodytes
gggctctggagacaga

SEQ ID NO: 254082 - DNA, 16 bp, P. troglodytes
gggctctggagccaga

SEQ ID NO: 254083 - DNA, 16 bp, P. troglodytes
gggctctgggctctgg

SEQ ID NO: 254084 - DNA, 16 bp, P. troglodytes
gggctctgggctggta

SEQ ID NO: 254085 - DNA, 16 bp, P. troglodytes
gggctctgtgtgtgtg

SEQ ID NO: 254086 - DNA, 16 bp, P. troglodytes
gggctctgttttgttc

SEQ ID NO: 254087 - DNA, 16 bp, P. troglodytes
gggctcttcctgctgc

SEQ ID NO: 254088 - DNA, 16 bp, P. troglodytes
gggctgaagtgctctg

SEQ ID NO: 254089 - DNA, 16 bp, P. troglodytes
gggctgagctgggctg

SEQ ID NO: 254090 - DNA, 16 bp, P. troglodytes
gggctgaggaaggaga

SEQ ID NO: 254091 - DNA, 16 bp, P. troglodytes
gggctgaggagtgcaa

SEQ ID NO: 254092 - DNA, 16 bp, P. troglodytes
gggctgaggcagagaa

SEQ ID NO: 254093 - DNA, 18 bp, P. troglodytes
gggctgaggcaggagaat

SEQ ID NO: 254094 - DNA, 16 bp, P. troglodytes
gggctgaggtgggcag

SEQ ID NO: 254095 - DNA, 16 bp, P. troglodytes
gggctgagtctgaaaa

SEQ ID NO: 254096 - DNA, 16 bp, P. troglodytes
gggctgcacagcctgc

SEQ ID NO: 254097 - DNA, 16 bp, P. troglodytes
gggctgcacccactct

SEQ ID NO: 254098 - DNA, 16 bp, P. troglodytes
gggctgcaggaggagg

SEQ ID NO: 254099 - DNA, 16 bp, P. troglodytes
gggctgcagtgagcca

SEQ ID NO: 254100 - DNA, 16 bp, P. troglodytes
gggctgcattcccaag

SEQ ID NO: 254101 - DNA, 16 bp, P. troglodytes
gggctgccagccacca

SEQ ID NO: 254102 - DNA, 16 bp, P. troglodytes
gggctgccagggctgc

SEQ ID NO: 254103 - DNA, 16 bp, P. troglodytes
gggctgccgggcagag

SEQ ID NO: 254104 - DNA, 16 bp, P. troglodytes
gggctgccgtaacaaa

SEQ ID NO: 254105 - DNA, 16 bp, P. troglodytes
gggctgcgagggctgc

SEQ ID NO: 254106 - DNA, 16 bp, P. troglodytes
gggctgcgcaggagcc

SEQ ID NO: 254107 - DNA, 16 bp, P. troglodytes
gggctgctacaacaaa

SEQ ID NO: 254108 - DNA, 16 bp, P. troglodytes
gggctgctcggctctc

SEQ ID NO: 254109 - DNA, 16 bp, P. troglodytes
gggctgctgcagtttg

SEQ ID NO: 254110 - DNA, 16 bp, P. troglodytes
gggctgctggctgccc

SEQ ID NO: 254111 - DNA, 16 bp, P. troglodytes
gggctggagaaggcag

SEQ ID NO: 254112 - DNA, 16 bp, P. troglodytes
gggctggagtacagtg

SEQ ID NO: 254113 - DNA, 16 bp, P. troglodytes
gggctggagtgcaatg

SEQ ID NO: 254114 - DNA, 16 bp, P. troglodytes
gggctggagtgcagtg

SEQ ID NO: 254115 - DNA, 16 bp, P. troglodytes
gggctggattgcagtg

SEQ ID NO: 254116 - DNA, 16 bp, P. troglodytes
gggctggcagtgctgg

SEQ ID NO: 254117 - DNA, 20 bp, P. troglodytes
gggctggccaaggccagagc

SEQ ID NO: 254118 - DNA, 17 bp, P. troglodytes
gggctggccaaggccgg

SEQ ID NO: 254119 - DNA, 16 bp, P. troglodytes
gggctggccatggtgg

SEQ ID NO: 254120 - DNA, 16 bp, P. troglodytes
gggctggccgaggctg

SEQ ID NO: 254121 - DNA, 16 bp, P. troglodytes
gggctggctggctgct

SEQ ID NO: 254122 - DNA, 16 bp, P. troglodytes
gggctgggagcaggca

SEQ ID NO: 254123 - DNA, 16 bp, P. troglodytes
gggctgggcatggtgg

SEQ ID NO: 254124 - DNA, 16 bp, P. troglodytes
gggctgggccaggtgg

SEQ ID NO: 254125 - DNA, 16 bp, P. troglodytes
gggctgggcccagggc

SEQ ID NO: 254126 - DNA, 16 bp, P. troglodytes
gggctgggctggcctg

SEQ ID NO: 254127 - DNA, 16 bp, P. troglodytes
gggctgggctgggctc

SEQ ID NO: 254128 - DNA, 16 bp, P. troglodytes
gggctggggaagagga

SEQ ID NO: 254129 - DNA, 16 bp, P. troglodytes
gggctggggcagggaa

SEQ ID NO: 254130 - DNA, 16 bp, P. troglodytes
gggctggggctgacat

SEQ ID NO: 254131 - DNA, 16 bp, P. troglodytes
gggctgggggcctgga

SEQ ID NO: 254132 - DNA, 16 bp, P. troglodytes
gggctggtcatggtgg

SEQ ID NO: 254133 - DNA, 16 bp, P. troglodytes
gggctggtcctgaact

SEQ ID NO: 254134 - DNA, 16 bp, P. troglodytes
gggctggtctcgaact

SEQ ID NO: 254135 - DNA, 16 bp, P. troglodytes
gggctggtgttgagtg

SEQ ID NO: 254136 - DNA, 16 bp, P. troglodytes
gggctgttgtgaggac

SEQ ID NO: 254137 - DNA, 16 bp, P. troglodytes
gggcttcatcctcatg

SEQ ID NO: 254138 - DNA, 16 bp, P. troglodytes
gggcttcatggaggag

SEQ ID NO: 254139 - DNA, 16 bp, P. troglodytes
gggcttccagcctcca

SEQ ID NO: 254140 - DNA, 16 bp, P. troglodytes
gggcttccataacaaa

SEQ ID NO: 254141 - DNA, 16 bp, P. troglodytes
gggcttcccaggcccc

SEQ ID NO: 254142 - DNA, 16 bp, P. troglodytes
gggcttgaatcccagc

SEQ ID NO: 254143 - DNA, 16 bp, P. troglodytes
gggcttgcagtgagcc

SEQ ID NO: 254144 - DNA, 16 bp, P. troglodytes
gggcttgttatcagtg

SEQ ID NO: 254145 - DNA, 16 bp, P. troglodytes
gggctttgtttacact

SEQ ID NO: 254146 - DNA, 16 bp, P. troglodytes
ggggaaaaaaaaaatc

SEQ ID NO: 254147 - DNA, 16 bp, P. troglodytes
ggggaaaaaaatcaaa

SEQ ID NO: 254148 - DNA, 16 bp, P. troglodytes
ggggaaaaaaatctct

SEQ ID NO: 254149 - DNA, 16 bp, P. troglodytes
ggggaaaagacaatct

SEQ ID NO: 254150 - DNA, 16 bp, P. troglodytes
ggggaaaagcccttta

SEQ ID NO: 254151 - DNA, 16 bp, P. troglodytes
ggggaaaatatttgca

SEQ ID NO: 254152 - DNA, 16 bp, P. troglodytes
ggggaaaatctgtttc

SEQ ID NO: 254153 - DNA, 16 bp, P. troglodytes
ggggaaaatgtatcca

SEQ ID NO: 254154 - DNA, 16 bp, P. troglodytes
ggggaaactccgtctc

SEQ ID NO: 254155 - DNA, 16 bp, P. troglodytes
ggggaaactcttcagg

SEQ ID NO: 254156 - DNA, 16 bp, P. troglodytes
ggggaaactgaagctc

SEQ ID NO: 254157 - DNA, 16 bp, P. troglodytes
ggggaaactgaggcct

SEQ ID NO: 254158 - DNA, 16 bp, P. troglodytes
ggggaaactgaggctg

SEQ ID NO: 254159 - DNA, 16 bp, P. troglodytes
ggggaaactgagtccc

SEQ ID NO: 254160 - DNA, 16 bp, P. troglodytes
ggggaaactttttttt

SEQ ID NO: 254161 - DNA, 16 bp, P. troglodytes
ggggaaatgattccct

SEQ ID NO: 254162 - DNA, 16 bp, P. troglodytes
ggggaacatcacacac

SEQ ID NO: 254163 - DNA, 16 bp, P. troglodytes
ggggaacatcactcac

SEQ ID NO: 254164 - DNA, 16 bp, P. troglodytes
ggggaacatggtgaga

SEQ ID NO: 254165 - DNA, 16 bp, P. troglodytes
ggggaacctgaaggtc

SEQ ID NO: 254166 - DNA, 16 bp, P. troglodytes
ggggaacctgccccca

SEQ ID NO: 254167 - DNA, 16 bp, P. troglodytes
ggggaacgacacacac

SEQ ID NO: 254168 - DNA, 16 bp, P. troglodytes
ggggaactgccaaaca

SEQ ID NO: 254169 - DNA, 16 bp, P. troglodytes
ggggaactgcccttta

SEQ ID NO: 254170 - DNA, 16 bp, P. troglodytes
ggggaagatcaccttc

SEQ ID NO: 254171 - DNA, 16 bp, P. troglodytes
ggggaagccagtgagc

SEQ ID NO: 254172 - DNA, 16 bp, P. troglodytes
ggggaagcttcaggaa

SEQ ID NO: 254173 - DNA, 16 bp, P. troglodytes
ggggaaggaatgctga

SEQ ID NO: 254174 - DNA, 16 bp, P. troglodytes
ggggaatgcttccagc

SEQ ID NO: 254175 - DNA, 16 bp, P. troglodytes
ggggaattgcttgagc

SEQ ID NO: 254176 - DNA, 16 bp, P. troglodytes
ggggacaagggaacct

SEQ ID NO: 254177 - DNA, 16 bp, P. troglodytes
ggggacacaaacattc

SEQ ID NO: 254178 - DNA, 16 bp, P. troglodytes
ggggacacacacattc

SEQ ID NO: 254179 - DNA, 16 bp, P. troglodytes
ggggacacagacaaat

SEQ ID NO: 254180 - DNA, 16 bp, P. troglodytes
ggggacacagagcaaa

SEQ ID NO: 254181 - DNA, 18 bp, P. troglodytes
ggggaccactaccaccaa

SEQ ID NO: 254182 - DNA, 16 bp, P. troglodytes
ggggaccctgggccca

SEQ ID NO: 254183 - DNA, 16 bp, P. troglodytes
ggggacctgagcaggt

SEQ ID NO: 254184 - DNA, 16 bp, P. troglodytes
ggggacgttctcctgg

SEQ ID NO: 254185 - DNA, 16 bp, P. troglodytes
ggggactggttccagg

SEQ ID NO: 254186 - DNA, 16 bp, P. troglodytes
ggggactgttgtgagg

SEQ ID NO: 254187 - DNA, 16 bp, P. troglodytes
ggggactgtttggaag

SEQ ID NO: 254188 - DNA, 16 bp, P. troglodytes
ggggacttccaggtca

SEQ ID NO: 254189 - DNA, 16 bp, P. troglodytes
ggggacttggactggc

SEQ ID NO: 254190 - DNA, 16 bp, P. troglodytes
ggggacttggagaaca

SEQ ID NO: 254191 - DNA, 16 bp, P. troglodytes
ggggacttggagaacc

SEQ ID NO: 254192 - DNA, 16 bp, P. troglodytes
ggggagaaattggcca

SEQ ID NO: 254193 - DNA, 16 bp, P. troglodytes
ggggagaatggagcca

SEQ ID NO: 254194 - DNA, 16 bp, P. troglodytes
ggggagaccccatctc

SEQ ID NO: 254195 - DNA, 16 bp, P. troglodytes
ggggagactctgtctc

SEQ ID NO: 254196 - DNA, 16 bp, P. troglodytes
ggggagactgaggcag

SEQ ID NO: 254197 - DNA, 16 bp, P. troglodytes
ggggagaggattccct

SEQ ID NO: 254198 - DNA, 16 bp, P. troglodytes
ggggagcctcaggaaa

SEQ ID NO: 254199 - DNA, 16 bp, P. troglodytes
ggggagcttgcagtga

SEQ ID NO: 254200 - DNA, 16 bp, P. troglodytes
ggggaggactcacaat

SEQ ID NO: 254201 - DNA, 16 bp, P. troglodytes
ggggaggacttgctca

SEQ ID NO: 254202 - DNA, 16 bp, P. troglodytes
ggggaggagcctggcc

SEQ ID NO: 254203 - DNA, 16 bp, P. troglodytes
ggggaggaggctgcag

SEQ ID NO: 254204 - DNA, 16 bp, P. troglodytes
ggggaggcagatgttg

SEQ ID NO: 254205 - DNA, 16 bp, P. troglodytes
ggggaggcagctgagg

SEQ ID NO: 254206 - DNA, 16 bp, P. troglodytes
ggggaggccaaggcag

SEQ ID NO: 254207 - DNA, 16 bp, P. troglodytes
ggggaggccacaggaa

SEQ ID NO: 254208 - DNA, 16 bp, P. troglodytes
ggggaggcctcaaaat

SEQ ID NO: 254209 - DNA, 16 bp, P. troglodytes
ggggaggctgagccag

SEQ ID NO: 254210 - DNA, 17 bp, P. troglodytes
ggggaggctgaggcagc

SEQ ID NO: 254211 - DNA, 16 bp, P. troglodytes
ggggaggctgcagtga

SEQ ID NO: 254212 - DNA, 16 bp, P. troglodytes
ggggaggcttcaggaa

SEQ ID NO: 254213 - DNA, 16 bp, P. troglodytes
ggggagggagcttcca

SEQ ID NO: 254214 - DNA, 16 bp, P. troglodytes
ggggagggatagcatt

SEQ ID NO: 254215 - DNA, 16 bp, P. troglodytes
ggggagggcatggaag

SEQ ID NO: 254216 - DNA, 16 bp, P. troglodytes
ggggaggggcatctgc

SEQ ID NO: 254217 - DNA, 16 bp, P. troglodytes
ggggaggggcgcctgc

SEQ ID NO: 254218 - DNA, 16 bp, P. troglodytes
ggggaggggtgcctgc

SEQ ID NO: 254219 - DNA, 16 bp, P. troglodytes
ggggagtgccagacag

SEQ ID NO: 254220 - DNA, 19 bp, P. troglodytes
ggggagtttagagaagact

SEQ ID NO: 254221 - DNA, 16 bp, P. troglodytes
ggggagtttgcagtga

SEQ ID NO: 254222 - DNA, 16 bp, P. troglodytes
ggggatcacaaggtca

SEQ ID NO: 254223 - DNA, 16 bp, P. troglodytes
ggggatgccctctctc

SEQ ID NO: 254224 - DNA, 16 bp, P. troglodytes
ggggattacaactgaa

SEQ ID NO: 254225 - DNA, 16 bp, P. troglodytes
ggggattacagacatg

SEQ ID NO: 254226 - DNA, 16 bp, P. troglodytes
ggggattatggctgcc

SEQ ID NO: 254227 - DNA, 16 bp, P. troglodytes
ggggattgcagtgagc

SEQ ID NO: 254228 - DNA, 16 bp, P. troglodytes
ggggattgttgggaag

SEQ ID NO: 254229 - DNA, 16 bp, P. troglodytes
ggggcaacatagtgag

SEQ ID NO: 254230 - DNA, 16 bp, P. troglodytes
ggggcaagacttttct

SEQ ID NO: 254231 - DNA, 16 bp, P. troglodytes
ggggcaaggtggggaa

SEQ ID NO: 254232 - DNA, 16 bp, P. troglodytes
ggggcaattttgcccc

SEQ ID NO: 254233 - DNA, 16 bp, P. troglodytes
ggggcagagcctgcag

SEQ ID NO: 254234 - DNA, 16 bp, P. troglodytes
ggggcagagctgctca

SEQ ID NO: 254235 - DNA, 16 bp, P. troglodytes
ggggcagaggctgcag

SEQ ID NO: 254236 - DNA, 16 bp, P. troglodytes
ggggcagagggtgcag

SEQ ID NO: 254237 - DNA, 16 bp, P. troglodytes
ggggcagatctttcct

SEQ ID NO: 254238 - DNA, 16 bp, P. troglodytes
ggggcagctggctggg

SEQ ID NO: 254239 - DNA, 16 bp, P. troglodytes
ggggcaggagagggct

SEQ ID NO: 254240 - DNA, 16 bp, P. troglodytes
ggggcagggcacagcc

SEQ ID NO: 254241 - DNA, 16 bp, P. troglodytes
ggggcagggctcccac

SEQ ID NO: 254242 - DNA, 16 bp, P. troglodytes
ggggcagggctcggga

SEQ ID NO: 254243 - DNA, 16 bp, P. troglodytes
ggggcaggggaattgc

SEQ ID NO: 254244 - DNA, 16 bp, P. troglodytes
ggggcaggtgaaagga

SEQ ID NO: 254245 - DNA, 16 bp, P. troglodytes
ggggcatggtggctca

SEQ ID NO: 254246 - DNA, 17 bp, P. troglodytes
ggggcatggtggctcat

SEQ ID NO: 254247 - DNA, 16 bp, P. troglodytes
ggggccaagatggcca

SEQ ID NO: 254248 - DNA, 16 bp, P. troglodytes
ggggccagaggcagaa

SEQ ID NO: 254249 - DNA, 16 bp, P. troglodytes
ggggccaggagtggaa

SEQ ID NO: 254250 - DNA, 16 bp, P. troglodytes
ggggccaggcatggtg

SEQ ID NO: 254251 - DNA, 19 bp, P. troglodytes
ggggccaggcgcggtggct

SEQ ID NO: 254252 - DNA, 16 bp, P. troglodytes
ggggccaggctgggcc

SEQ ID NO: 254253 - DNA, 16 bp, P. troglodytes
ggggccagggatggaa

SEQ ID NO: 254254 - DNA, 16 bp, P. troglodytes
ggggccagtctttccc

SEQ ID NO: 254255 - DNA, 16 bp, P. troglodytes
ggggcccagaaatctg

SEQ ID NO: 254256 - DNA, 16 bp, P. troglodytes
ggggcccaggaagccc

SEQ ID NO: 254257 - DNA, 16 bp, P. troglodytes
ggggcccaggaaggcc

SEQ ID NO: 254258 - DNA, 16 bp, P. troglodytes
ggggccccaggagagg

SEQ ID NO: 254259 - DNA, 16 bp, P. troglodytes
ggggccccccacctcc

SEQ ID NO: 254260 - DNA, 16 bp, P. troglodytes
ggggccctcttgtatg

SEQ ID NO: 254261 - DNA, 16 bp, P. troglodytes
ggggccctggccaagg

SEQ ID NO: 254262 - DNA, 16 bp, P. troglodytes
ggggcctccagccacc

SEQ ID NO: 254263 - DNA, 16 bp, P. troglodytes
ggggcctccccagaag

SEQ ID NO: 254264 - DNA, 16 bp, P. troglodytes
ggggcctgagattctg

SEQ ID NO: 254265 - DNA, 16 bp, P. troglodytes
ggggcctggactcctg

SEQ ID NO: 254266 - DNA, 16 bp, P. troglodytes
ggggcctgtcgggagg

SEQ ID NO: 254267 - DNA, 16 bp, P. troglodytes
ggggccttcaggaggt

SEQ ID NO: 254268 - DNA, 16 bp, P. troglodytes
ggggccttgtgggagg

SEQ ID NO: 254269 - DNA, 16 bp, P. troglodytes
ggggcgcaccaccatg

SEQ ID NO: 254270 - DNA, 16 bp, P. troglodytes
ggggcgctgaggcagg

SEQ ID NO: 254271 - DNA, 16 bp, P. troglodytes
ggggcggagcctgcag

SEQ ID NO: 254272 - DNA, 16 bp, P. troglodytes
ggggcggctggccagg

SEQ ID NO: 254273 - DNA, 16 bp, P. troglodytes
ggggctaaggtgggag

SEQ ID NO: 254274 - DNA, 16 bp, P. troglodytes
ggggctacaggcatgc

SEQ ID NO: 254275 - DNA, 16 bp, P. troglodytes
ggggctagaggaggga

SEQ ID NO: 254276 - DNA, 16 bp, P. troglodytes
ggggctcagggacaga

SEQ ID NO: 254277 - DNA, 16 bp, P. troglodytes
ggggctcagtccccaa

SEQ ID NO: 254278 - DNA, 17 bp, P. troglodytes
ggggctcgaatccaggt

SEQ ID NO: 254279 - DNA, 16 bp, P. troglodytes
ggggctcgggcatggc

SEQ ID NO: 254280 - DNA, 16 bp, P. troglodytes
ggggctctgggagtgg

SEQ ID NO: 254281 - DNA, 16 bp, P. troglodytes
ggggctgaagccaggg

SEQ ID NO: 254282 - DNA, 16 bp, P. troglodytes
ggggctgagacaggag

SEQ ID NO: 254283 - DNA, 16 bp, P. troglodytes
ggggctgagcacagtg

SEQ ID NO: 254284 - DNA, 16 bp, P. troglodytes
ggggctgaggcaggag

SEQ ID NO: 254285 - DNA, 16 bp, P. troglodytes
ggggctgaggctggag

SEQ ID NO: 254286 - DNA, 16 bp, P. troglodytes
ggggctgagggtggct

SEQ ID NO: 254287 - DNA, 16 bp, P. troglodytes
ggggctgcaggcccca

SEQ ID NO: 254288 - DNA, 16 bp, P. troglodytes
ggggctgcagggctgg

SEQ ID NO: 254289 - DNA, 16 bp, P. troglodytes
ggggctgcaggggctg

SEQ ID NO: 254290 - DNA, 16 bp, P. troglodytes
ggggctgctttttatt

SEQ ID NO: 254291 - DNA, 16 bp, P. troglodytes
ggggctggacgtggtg

SEQ ID NO: 254292 - DNA, 16 bp, P. troglodytes
ggggctggagcccaaa

SEQ ID NO: 254293 - DNA, 16 bp, P. troglodytes
ggggctggcaagtctg

SEQ ID NO: 254294 - DNA, 16 bp, P. troglodytes
ggggctgggaagtcca

SEQ ID NO: 254295 - DNA, 16 bp, P. troglodytes
ggggctgggcatggtg

SEQ ID NO: 254296 - DNA, 16 bp, P. troglodytes
ggggctgggccagggc

SEQ ID NO: 254297 - DNA, 16 bp, P. troglodytes
ggggctgggctggcag

SEQ ID NO: 254298 - DNA, 16 bp, P. troglodytes
ggggctggttccccca

SEQ ID NO: 254299 - DNA, 16 bp, P. troglodytes
ggggctgtccagtccc

SEQ ID NO: 254300 - DNA, 16 bp, P. troglodytes
ggggctgtcctgtgtg

SEQ ID NO: 254301 - DNA, 16 bp, P. troglodytes
ggggcttccccagcca

SEQ ID NO: 254302 - DNA, 16 bp, P. troglodytes
ggggctttggggaggt

SEQ ID NO: 254303 - DNA, 16 bp, P. troglodytes
gggggaaactgaggca

SEQ ID NO: 254304 - DNA, 16 bp, P. troglodytes
gggggaaatttttaaa

SEQ ID NO: 254305 - DNA, 16 bp, P. troglodytes
gggggaatcctcccta

SEQ ID NO: 254306 - DNA, 16 bp, P. troglodytes
gggggacacaattcag

SEQ ID NO: 254307 - DNA, 16 bp, P. troglodytes
gggggacctggtggga

SEQ ID NO: 254308 - DNA, 16 bp, P. troglodytes
gggggagactgccccc

SEQ ID NO: 254309 - DNA, 16 bp, P. troglodytes
gggggagggaggtccc

SEQ ID NO: 254310 - DNA, 16 bp, P. troglodytes
gggggatacattcaaa

SEQ ID NO: 254311 - DNA, 16 bp, P. troglodytes
gggggatggagtctca

SEQ ID NO: 254312 - DNA, 16 bp, P. troglodytes
gggggattggttccag

SEQ ID NO: 254313 - DNA, 16 bp, P. troglodytes
gggggcagcccctgcc

SEQ ID NO: 254314 - DNA, 16 bp, P. troglodytes
gggggcaggcctttcc

SEQ ID NO: 254315 - DNA, 16 bp, P. troglodytes
gggggcagggcacaga

SEQ ID NO: 254316 - DNA, 19 bp, P. troglodytes
gggggccagttcagagacc

SEQ ID NO: 254317 - DNA, 16 bp, P. troglodytes
gggggcgggttccccc

SEQ ID NO: 254318 - DNA, 16 bp, P. troglodytes
gggggctcttgggcct

SEQ ID NO: 254319 - DNA, 16 bp, P. troglodytes
gggggctgaggcagaa

SEQ ID NO: 254320 - DNA, 16 bp, P. troglodytes
gggggctgcccaattc

SEQ ID NO: 254321 - DNA, 16 bp, P. troglodytes
gggggctgggaagtcc

SEQ ID NO: 254322 - DNA, 16 bp, P. troglodytes
gggggcttccaggtca

SEQ ID NO: 254323 - DNA, 16 bp, P. troglodytes
ggggggcctgttccca

SEQ ID NO: 254324 - DNA, 16 bp, P. troglodytes
ggggggcggatcacct

SEQ ID NO: 254325 - DNA, 16 bp, P. troglodytes
gggggtcacaaggtac

SEQ ID NO: 254326 - DNA, 16 bp, P. troglodytes
gggggtgctgcaggag

SEQ ID NO: 254327 - DNA, 16 bp, P. troglodytes
gggggtggaggctgca

SEQ ID NO: 254328 - DNA, 16 bp, P. troglodytes
gggggtggcagtgagc

SEQ ID NO: 254329 - DNA, 17 bp, P. troglodytes
gggggttcaagcaattc

SEQ ID NO: 254330 - DNA, 16 bp, P. troglodytes
gggggttgcctcccag

SEQ ID NO: 254331 - DNA, 16 bp, P. troglodytes
gggggtttcaccgtgt

SEQ ID NO: 254332 - DNA, 16 bp, P. troglodytes
ggggtacagagcaaga

SEQ ID NO: 254333 - DNA, 16 bp, P. troglodytes
ggggtacatgtgcaga

SEQ ID NO: 254334 - DNA, 16 bp, P. troglodytes
ggggtatgtgacaggg

SEQ ID NO: 254335 - DNA, 16 bp, P. troglodytes
ggggtatgtgtgcagg

SEQ ID NO: 254336 - DNA, 16 bp, P. troglodytes
ggggtattcaattagg

SEQ ID NO: 254337 - DNA, 16 bp, P. troglodytes
ggggtcagcaaactgt

SEQ ID NO: 254338 - DNA, 16 bp, P. troglodytes
ggggtcaggcagaata

SEQ ID NO: 254339 - DNA, 16 bp, P. troglodytes
ggggtcagggacccac

SEQ ID NO: 254340 - DNA, 16 bp, P. troglodytes
ggggtcccagctactc

SEQ ID NO: 254341 - DNA, 16 bp, P. troglodytes
ggggtccccaaccctc

SEQ ID NO: 254342 - DNA, 16 bp, P. troglodytes
ggggtccctgacttcc

SEQ ID NO: 254343 - DNA, 16 bp, P. troglodytes
ggggtcccttttataa

SEQ ID NO: 254344 - DNA, 16 bp, P. troglodytes
ggggtctagtgcaggt

SEQ ID NO: 254345 - DNA, 16 bp, P. troglodytes
ggggtctcaccatgtt

SEQ ID NO: 254346 - DNA, 16 bp, P. troglodytes
ggggtctcactaggtt

SEQ ID NO: 254347 - DNA, 16 bp, P. troglodytes
ggggtctcactctgtc

SEQ ID NO: 254348 - DNA, 16 bp, P. troglodytes
ggggtctcactctgtt

SEQ ID NO: 254349 - DNA, 16 bp, P. troglodytes
ggggtctcgctctgtc

SEQ ID NO: 254350 - DNA, 16 bp, P. troglodytes
ggggtctggctctgtc

SEQ ID NO: 254351 - DNA, 16 bp, P. troglodytes
ggggtcttgctatgtc

SEQ ID NO: 254352 - DNA, 17 bp, P. troglodytes
ggggtcttgctctgtca

SEQ ID NO: 254353 - DNA, 16 bp, P. troglodytes
ggggtctttaggtttt

SEQ ID NO: 254354 - DNA, 16 bp, P. troglodytes
ggggtctttgggaggt

SEQ ID NO: 254355 - DNA, 16 bp, P. troglodytes
ggggtgaagaaggggc

SEQ ID NO: 254356 - DNA, 16 bp, P. troglodytes
ggggtgagagagggca

SEQ ID NO: 254357 - DNA, 16 bp, P. troglodytes
ggggtgcagaagggta

SEQ ID NO: 254358 - DNA, 16 bp, P. troglodytes
ggggtgcagtggtatg

SEQ ID NO: 254359 - DNA, 16 bp, P. troglodytes
ggggtgcatgtgcaga

SEQ ID NO: 254360 - DNA, 16 bp, P. troglodytes
ggggtgctgaagtctc

SEQ ID NO: 254361 - DNA, 16 bp, P. troglodytes
ggggtgctgctggcat

SEQ ID NO: 254362 - DNA, 16 bp, P. troglodytes
ggggtggagcccccag

SEQ ID NO: 254363 - DNA, 16 bp, P. troglodytes
ggggtggagctctcat

SEQ ID NO: 254364 - DNA, 16 bp, P. troglodytes
ggggtggaggttgcag

SEQ ID NO: 254365 - DNA, 16 bp, P. troglodytes
ggggtggcagccgggc

SEQ ID NO: 254366 - DNA, 16 bp, P. troglodytes
ggggtggccagccttc

SEQ ID NO: 254367 - DNA, 16 bp, P. troglodytes
ggggtggctcaggctg

SEQ ID NO: 254368 - DNA, 16 bp, P. troglodytes
ggggtggctcctgagg

SEQ ID NO: 254369 - DNA, 16 bp, P. troglodytes
ggggtggctgccctcc

SEQ ID NO: 254370 - DNA, 16 bp, P. troglodytes
ggggtgggacccaggc

SEQ ID NO: 254371 - DNA, 16 bp, P. troglodytes
ggggtggtcagggaag

SEQ ID NO: 254372 - DNA, 16 bp, P. troglodytes
ggggtgtacacccccc

SEQ ID NO: 254373 - DNA, 16 bp, P. troglodytes
ggggtgtcaccatatt

SEQ ID NO: 254374 - DNA, 16 bp, P. troglodytes
ggggtgtcactgtgtt

SEQ ID NO: 254375 - DNA, 16 bp, P. troglodytes
ggggtgtggtggcaca

SEQ ID NO: 254376 - DNA, 16 bp, P. troglodytes
ggggttaggacttcaa

SEQ ID NO: 254377 - DNA, 16 bp, P. troglodytes
ggggttagggcttcaa

SEQ ID NO: 254378 - DNA, 17 bp, P. troglodytes
ggggttcaagcgattct

SEQ ID NO: 254379 - DNA, 16 bp, P. troglodytes
ggggttcaccatgttg

SEQ ID NO: 254380 - DNA, 16 bp, P. troglodytes
ggggttcctgggcctg

SEQ ID NO: 254381 - DNA, 16 bp, P. troglodytes
ggggttctccatgttg

SEQ ID NO: 254382 - DNA, 16 bp, P. troglodytes
ggggttgcagtgagcc

SEQ ID NO: 254383 - DNA, 16 bp, P. troglodytes
ggggttggagccccca

SEQ ID NO: 254384 - DNA, 19 bp, P. troglodytes
ggggttggttccaagtctt

SEQ ID NO: 254385 - DNA, 16 bp, P. troglodytes
ggggtttattgtacag

SEQ ID NO: 254386 - DNA, 16 bp, P. troglodytes
ggggtttcaccaagtt

SEQ ID NO: 254387 - DNA, 16 bp, P. troglodytes
ggggtttcaccatgtc

SEQ ID NO: 254388 - DNA, 27 bp, P. troglodytes
ggggtttcaccatgttggccaggatga

SEQ ID NO: 254389 - DNA, 26 bp, P. troglodytes
ggggtttcaccatgttggccaggctc

SEQ ID NO: 254390 - DNA, 20 bp, P. troglodytes
ggggtttcaccatgttggtt

SEQ ID NO: 254391 - DNA, 16 bp, P. troglodytes
ggggtttcaccgtatt

SEQ ID NO: 254392 - DNA, 16 bp, P. troglodytes
ggggtttcaccgtgat

SEQ ID NO: 254393 - DNA, 16 bp, P. troglodytes
ggggtttcaccgtgct

SEQ ID NO: 254394 - DNA, 16 bp, P. troglodytes
ggggtttcaccgtttt

SEQ ID NO: 254395 - DNA, 16 bp, P. troglodytes
ggggtttcactatgtt

SEQ ID NO: 254396 - DNA, 21 bp, P. troglodytes
ggggtttcactatgttgccca

SEQ ID NO: 254397 - DNA, 16 bp, P. troglodytes
ggggtttcatcatgtt

SEQ ID NO: 254398 - DNA, 16 bp, P. troglodytes
ggggtttcccatgttg

SEQ ID NO: 254399 - DNA, 18 bp, P. troglodytes
ggggtttcgccatgttga

SEQ ID NO: 254400 - DNA, 16 bp, P. troglodytes
ggggtttgttgcacag

SEQ ID NO: 254401 - DNA, 16 bp, P. troglodytes
ggggttttatatgttg

SEQ ID NO: 254402 - DNA, 16 bp, P. troglodytes
ggggttttctaaacat

SEQ ID NO: 254403 - DNA, 16 bp, P. troglodytes
ggggttttggcatgtt

SEQ ID NO: 254404 - DNA, 16 bp, P. troglodytes
gggtaaaagttttttt

SEQ ID NO: 254405 - DNA, 16 bp, P. troglodytes
gggtaaaatgctgtca

SEQ ID NO: 254406 - DNA, 16 bp, P. troglodytes
gggtaaatataaaaga

SEQ ID NO: 254407 - DNA, 16 bp, P. troglodytes
gggtaacagcaagacc

SEQ ID NO: 254408 - DNA, 16 bp, P. troglodytes
gggtaacctggggacc

SEQ ID NO: 254409 - DNA, 16 bp, P. troglodytes
gggtaacttgctgcag

SEQ ID NO: 254410 - DNA, 16 bp, P. troglodytes
gggtaaggcaggagga

SEQ ID NO: 254411 - DNA, 16 bp, P. troglodytes
gggtaagggataaaag

SEQ ID NO: 254412 - DNA, 16 bp, P. troglodytes
gggtaatagaatatca

SEQ ID NO: 254413 - DNA, 16 bp, P. troglodytes
gggtacatgtccacaa

SEQ ID NO: 254414 - DNA, 16 bp, P. troglodytes
gggtacctcatataag

SEQ ID NO: 254415 - DNA, 16 bp, P. troglodytes
gggtacggtggctcac

SEQ ID NO: 254416 - DNA, 16 bp, P. troglodytes
gggtagaggaagcagt

SEQ ID NO: 254417 - DNA, 18 bp, P. troglodytes
gggtagctgggattacag

SEQ ID NO: 254418 - DNA, 16 bp, P. troglodytes
gggtagggttacagat

SEQ ID NO: 254419 - DNA, 25 bp, P. troglodytes
gggtatatacccaaatgactataaa

SEQ ID NO: 254420 - DNA, 16 bp, P. troglodytes
gggtatatacctagca

SEQ ID NO: 254421 - DNA, 16 bp, P. troglodytes
gggtatatactcagaa

SEQ ID NO: 254422 - DNA, 16 bp, P. troglodytes
gggtattaaatgcatt

SEQ ID NO: 254423 - DNA, 16 bp, P. troglodytes
gggtattttattctct

SEQ ID NO: 254424 - DNA, 16 bp, P. troglodytes
gggtcacattggaaga

SEQ ID NO: 254425 - DNA, 16 bp, P. troglodytes
gggtcacctgagcctg

SEQ ID NO: 254426 - DNA, 16 bp, P. troglodytes
gggtcagggaaggctt

SEQ ID NO: 254427 - DNA, 16 bp, P. troglodytes
gggtcagggacctgct

SEQ ID NO: 254428 - DNA, 16 bp, P. troglodytes
gggtcaggggtcaggg

SEQ ID NO: 254429 - DNA, 16 bp, P. troglodytes
gggtcagggtcaggcc

SEQ ID NO: 254430 - DNA, 16 bp, P. troglodytes
gggtcatgcagcctct

SEQ ID NO: 254431 - DNA, 16 bp, P. troglodytes
gggtcccagctactcg

SEQ ID NO: 254432 - DNA, 16 bp, P. troglodytes
gggtcccagctctgcc

SEQ ID NO: 254433 - DNA, 16 bp, P. troglodytes
gggtccccagactcat

SEQ ID NO: 254434 - DNA, 16 bp, P. troglodytes
gggtccctcccactac

SEQ ID NO: 254435 - DNA, 16 bp, P. troglodytes
gggtccctggtgaaac

SEQ ID NO: 254436 - DNA, 16 bp, P. troglodytes
gggtccctgtagtccc

SEQ ID NO: 254437 - DNA, 16 bp, P. troglodytes
gggtcctgggcctggc

SEQ ID NO: 254438 - DNA, 16 bp, P. troglodytes
gggtctagagtggacc

SEQ ID NO: 254439 - DNA, 16 bp, P. troglodytes
gggtctcaaactcctg

SEQ ID NO: 254440 - DNA, 16 bp, P. troglodytes
gggtctcacactgtca

SEQ ID NO: 254441 - DNA, 16 bp, P. troglodytes
gggtctcactatgtgc

SEQ ID NO: 254442 - DNA, 16 bp, P. troglodytes
gggtctcactccgttg

SEQ ID NO: 254443 - DNA, 16 bp, P. troglodytes
gggtctcactctcttg

SEQ ID NO: 254444 - DNA, 16 bp, P. troglodytes
gggtctcactctgctg

SEQ ID NO: 254445 - DNA, 16 bp, P. troglodytes
gggtctcactctgtcg

SEQ ID NO: 254446 - DNA, 16 bp, P. troglodytes
gggtctcactgtcact

SEQ ID NO: 254447 - DNA, 16 bp, P. troglodytes
gggtctcactttgtca

SEQ ID NO: 254448 - DNA, 16 bp, P. troglodytes
gggtctccagccacct

SEQ ID NO: 254449 - DNA, 16 bp, P. troglodytes
gggtctgagggaggag

SEQ ID NO: 254450 - DNA, 16 bp, P. troglodytes
gggtctggaggactgt

SEQ ID NO: 254451 - DNA, 16 bp, P. troglodytes
gggtctggagtggaac

SEQ ID NO: 254452 - DNA, 16 bp, P. troglodytes
gggtctggttctgttg

SEQ ID NO: 254453 - DNA, 16 bp, P. troglodytes
gggtcttactctgtca

SEQ ID NO: 254454 - DNA, 16 bp, P. troglodytes
gggtcttcttgctgtg

SEQ ID NO: 254455 - DNA, 16 bp, P. troglodytes
gggtcttgctctattg

SEQ ID NO: 254456 - DNA, 16 bp, P. troglodytes
gggtcttgctctgtca

SEQ ID NO: 254457 - DNA, 16 bp, P. troglodytes
gggtcttgctctgtct

SEQ ID NO: 254458 - DNA, 16 bp, P. troglodytes
gggtcttgctctgtta

SEQ ID NO: 254459 - DNA, 16 bp, P. troglodytes
gggtcttgctctgttg

SEQ ID NO: 254460 - DNA, 16 bp, P. troglodytes
gggtctttctctgttg

SEQ ID NO: 254461 - DNA, 16 bp, P. troglodytes
gggtgaagcctgtgac

SEQ ID NO: 254462 - DNA, 16 bp, P. troglodytes
gggtgaattgtgtggt

SEQ ID NO: 254463 - DNA, 16 bp, P. troglodytes
gggtgacagagactcc

SEQ ID NO: 254464 - DNA, 16 bp, P. troglodytes
gggtgacagagccaaa

SEQ ID NO: 254465 - DNA, 20 bp, P. troglodytes
gggtgacagagcgagactca

SEQ ID NO: 254466 - DNA, 16 bp, P. troglodytes
gggtgacagaggagac

SEQ ID NO: 254467 - DNA, 16 bp, P. troglodytes
gggtgaccaactcatc

SEQ ID NO: 254468 - DNA, 16 bp, P. troglodytes
gggtgactacagtcaa

SEQ ID NO: 254469 - DNA, 16 bp, P. troglodytes
gggtgactgagcgaga

SEQ ID NO: 254470 - DNA, 16 bp, P. troglodytes
gggtgagactccatct

SEQ ID NO: 254471 - DNA, 16 bp, P. troglodytes
gggtgagattctgtct

SEQ ID NO: 254472 - DNA, 16 bp, P. troglodytes
gggtgaggcctgtggc

SEQ ID NO: 254473 - DNA, 16 bp, P. troglodytes
gggtgaggctggagag

SEQ ID NO: 254474 - DNA, 16 bp, P. troglodytes
gggtgaggctggagga

SEQ ID NO: 254475 - DNA, 16 bp, P. troglodytes
gggtgagggggcttat

SEQ ID NO: 254476 - DNA, 16 bp, P. troglodytes
gggtgatcccttgatg

SEQ ID NO: 254477 - DNA, 16 bp, P. troglodytes
gggtgatgaaagtgtt

SEQ ID NO: 254478 - DNA, 16 bp, P. troglodytes
gggtgatgaagtgaga

SEQ ID NO: 254479 - DNA, 16 bp, P. troglodytes
gggtgatgggattatt

SEQ ID NO: 254480 - DNA, 16 bp, P. troglodytes
gggtgcaggggctcac

SEQ ID NO: 254481 - DNA, 16 bp, P. troglodytes
gggtgcaggtatctct

SEQ ID NO: 254482 - DNA, 16 bp, P. troglodytes
gggtgcaggtgcaggt

SEQ ID NO: 254483 - DNA, 16 bp, P. troglodytes
gggtgcagtgagccag

SEQ ID NO: 254484 - DNA, 16 bp, P. troglodytes
gggtgcagtggctcct

SEQ ID NO: 254485 - DNA, 16 bp, P. troglodytes
gggtgcagtggctcgc

SEQ ID NO: 254486 - DNA, 16 bp, P. troglodytes
gggtgcccaccattgc

SEQ ID NO: 254487 - DNA, 16 bp, P. troglodytes
gggtgccctttcccca

SEQ ID NO: 254488 - DNA, 16 bp, P. troglodytes
gggtgcctgccattgc

SEQ ID NO: 254489 - DNA, 16 bp, P. troglodytes
gggtgcttgctgctga

SEQ ID NO: 254490 - DNA, 16 bp, P. troglodytes
gggtggagaggatgat

SEQ ID NO: 254491 - DNA, 16 bp, P. troglodytes
gggtggagagttctct

SEQ ID NO: 254492 - DNA, 16 bp, P. troglodytes
gggtggagagttcttt

SEQ ID NO: 254493 - DNA, 16 bp, P. troglodytes
gggtggagccctcatg

SEQ ID NO: 254494 - DNA, 16 bp, P. troglodytes
gggtggaggccaggga

SEQ ID NO: 254495 - DNA, 16 bp, P. troglodytes
gggtggatcacctgaa

SEQ ID NO: 254496 - DNA, 16 bp, P. troglodytes
gggtggatcacctgac

SEQ ID NO: 254497 - DNA, 18 bp, P. troglodytes
gggtggatcacgaggtca

SEQ ID NO: 254498 - DNA, 16 bp, P. troglodytes
gggtggatcacttgat

SEQ ID NO: 254499 - DNA, 16 bp, P. troglodytes
gggtggatccctcatg

SEQ ID NO: 254500 - DNA, 16 bp, P. troglodytes
gggtggatcgcttgag

SEQ ID NO: 254501 - DNA, 16 bp, P. troglodytes
gggtggatttctccct

SEQ ID NO: 254502 - DNA, 16 bp, P. troglodytes
gggtggcagagaaaga

SEQ ID NO: 254503 - DNA, 16 bp, P. troglodytes
gggtggcagagctaga

SEQ ID NO: 254504 - DNA, 16 bp, P. troglodytes
gggtggcaggacagag

SEQ ID NO: 254505 - DNA, 16 bp, P. troglodytes
gggtggcagggcagag

SEQ ID NO: 254506 - DNA, 16 bp, P. troglodytes
gggtggctcaagcctg

SEQ ID NO: 254507 - DNA, 20 bp, P. troglodytes
gggtggctcacacctgtaat

SEQ ID NO: 254508 - DNA, 17 bp, P. troglodytes
gggtggctcacgcctgt

SEQ ID NO: 254509 - DNA, 16 bp, P. troglodytes
gggtggctcatgcctg

SEQ ID NO: 254510 - DNA, 16 bp, P. troglodytes
gggtggctggaggccc

SEQ ID NO: 254511 - DNA, 16 bp, P. troglodytes
gggtggctgggcagag

SEQ ID NO: 254512 - DNA, 16 bp, P. troglodytes
gggtgggaccaggtgg

SEQ ID NO: 254513 - DNA, 16 bp, P. troglodytes
gggtgggcaattccca

SEQ ID NO: 254514 - DNA, 16 bp, P. troglodytes
gggtggggaaggcaga

SEQ ID NO: 254515 - DNA, 16 bp, P. troglodytes
gggtggggccctcatg

SEQ ID NO: 254516 - DNA, 16 bp, P. troglodytes
gggtgggggacacaga

SEQ ID NO: 254517 - DNA, 16 bp, P. troglodytes
gggtggggtggccagc

SEQ ID NO: 254518 - DNA, 16 bp, P. troglodytes
gggtggggtggctcac

SEQ ID NO: 254519 - DNA, 16 bp, P. troglodytes
gggtgggttcccaagg

SEQ ID NO: 254520 - DNA, 16 bp, P. troglodytes
gggtggtcttggggac

SEQ ID NO: 254521 - DNA, 16 bp, P. troglodytes
gggtggtggaggctgc

SEQ ID NO: 254522 - DNA, 16 bp, P. troglodytes
gggtggtggcgcacac

SEQ ID NO: 254523 - DNA, 16 bp, P. troglodytes
gggtggtggcgtgcac

SEQ ID NO: 254524 - DNA, 16 bp, P. troglodytes
gggtggtggtgcatgc

SEQ ID NO: 254525 - DNA, 16 bp, P. troglodytes
gggtgtagtggctcat

SEQ ID NO: 254526 - DNA, 16 bp, P. troglodytes
gggtgtcttagtccat

SEQ ID NO: 254527 - DNA, 16 bp, P. troglodytes
gggtgtgagccaccgt

SEQ ID NO: 254528 - DNA, 16 bp, P. troglodytes
gggtgtggtggagcac

SEQ ID NO: 254529 - DNA, 17 bp, P. troglodytes
gggtgtggtggcacgtg

SEQ ID NO: 254530 - DNA, 17 bp, P. troglodytes
gggtgtggtggcatgca

SEQ ID NO: 254531 - DNA, 22 bp, P. troglodytes
gggtgtggtggcatgtgcctgt

SEQ ID NO: 254532 - DNA, 16 bp, P. troglodytes
gggtgtggtggcgcac

SEQ ID NO: 254533 - DNA, 16 bp, P. troglodytes
gggtgtggtgtctcac

SEQ ID NO: 254534 - DNA, 16 bp, P. troglodytes
gggtgtgttggcacac

SEQ ID NO: 254535 - DNA, 16 bp, P. troglodytes
gggttaaagagaacat

SEQ ID NO: 254536 - DNA, 16 bp, P. troglodytes
gggttaaagtgattct

SEQ ID NO: 254537 - DNA, 16 bp, P. troglodytes
gggttaaatggtagtt

SEQ ID NO: 254538 - DNA, 16 bp, P. troglodytes
gggttatttgcttttt

SEQ ID NO: 254539 - DNA, 16 bp, P. troglodytes
gggttcaaccaattct

SEQ ID NO: 254540 - DNA, 17 bp, P. troglodytes
gggttcaagaccagcct

SEQ ID NO: 254541 - DNA, 16 bp, P. troglodytes
gggttcaagcgactct

SEQ ID NO: 254542 - DNA, 18 bp, P. troglodytes
gggttcaagcgattctct

SEQ ID NO: 254543 - DNA, 24 bp, P. troglodytes
gggttcaagtgattctcctgcctt

SEQ ID NO: 254544 - DNA, 16 bp, P. troglodytes
gggttcagagagcttc

SEQ ID NO: 254545 - DNA, 16 bp, P. troglodytes
gggttcaggtgattct

SEQ ID NO: 254546 - DNA, 16 bp, P. troglodytes
gggttcatctcactgg

SEQ ID NO: 254547 - DNA, 16 bp, P. troglodytes
gggttccaccatattg

SEQ ID NO: 254548 - DNA, 16 bp, P. troglodytes
gggttccaccatgttg

SEQ ID NO: 254549 - DNA, 16 bp, P. troglodytes
gggttcgaatcccagc

SEQ ID NO: 254550 - DNA, 16 bp, P. troglodytes
gggttctggaggacag

SEQ ID NO: 254551 - DNA, 19 bp, P. troglodytes
gggttgcagtgagccgaga

SEQ ID NO: 254552 - DNA, 16 bp, P. troglodytes
gggttgctcctctctg

SEQ ID NO: 254553 - DNA, 16 bp, P. troglodytes
gggttgggagttcaag

SEQ ID NO: 254554 - DNA, 16 bp, P. troglodytes
gggttggggaggcctc

SEQ ID NO: 254555 - DNA, 16 bp, P. troglodytes
gggttggtcttgctat

SEQ ID NO: 254556 - DNA, 16 bp, P. troglodytes
gggttggtcttgctgt

SEQ ID NO: 254557 - DNA, 16 bp, P. troglodytes
gggttggtttcctggg

SEQ ID NO: 254558 - DNA, 16 bp, P. troglodytes
gggttgtttccaagtc

SEQ ID NO: 254559 - DNA, 16 bp, P. troglodytes
gggtttattgggatgt

SEQ ID NO: 254560 - DNA, 16 bp, P. troglodytes
gggtttcaccatatta

SEQ ID NO: 254561 - DNA, 16 bp, P. troglodytes
gggtttcaccatattc

SEQ ID NO: 254562 - DNA, 16 bp, P. troglodytes
gggtttcaccatgatg

SEQ ID NO: 254563 - DNA, 16 bp, P. troglodytes
gggtttcaccatgctg

SEQ ID NO: 254564 - DNA, 16 bp, P. troglodytes
gggtttcaccatgtag

SEQ ID NO: 254565 - DNA, 16 bp, P. troglodytes
gggtttcaccatgttc

SEQ ID NO: 254566 - DNA, 22 bp, P. troglodytes
gggtttcaccatgttggccagc

SEQ ID NO: 254567 - DNA, 16 bp, P. troglodytes
gggtttcaccatgttt

SEQ ID NO: 254568 - DNA, 17 bp, P. troglodytes
gggtttcaccgtggtct

SEQ ID NO: 254569 - DNA, 17 bp, P. troglodytes
gggtttcaccgtgttac

SEQ ID NO: 254570 - DNA, 17 bp, P. troglodytes
gggtttcaccgtgttag

SEQ ID NO: 254571 - DNA, 16 bp, P. troglodytes
gggtttcaccgtgttc

SEQ ID NO: 254572 - DNA, 16 bp, P. troglodytes
gggtttcactatgttg

SEQ ID NO: 254573 - DNA, 19 bp, P. troglodytes
gggtttcactgtgttagca

SEQ ID NO: 254574 - DNA, 16 bp, P. troglodytes
gggtttccccatgttg

SEQ ID NO: 254575 - DNA, 16 bp, P. troglodytes
gggtttctccatgctg

SEQ ID NO: 254576 - DNA, 16 bp, P. troglodytes
gggtttctccatgttg

SEQ ID NO: 254577 - DNA, 16 bp, P. troglodytes
gggtttctccatgttt

SEQ ID NO: 254578 - DNA, 16 bp, P. troglodytes
gggtttctgaaaaaca

SEQ ID NO: 254579 - DNA, 16 bp, P. troglodytes
gggtttctttttgagg

SEQ ID NO: 254580 - DNA, 16 bp, P. troglodytes
gggtttctttttggag

SEQ ID NO: 254581 - DNA, 16 bp, P. troglodytes
gggtttgacatcaata

SEQ ID NO: 254582 - DNA, 17 bp, P. troglodytes
gggtttgtaaatgcacc

SEQ ID NO: 254583 - DNA, 16 bp, P. troglodytes
gggtttgtggatgcac

SEQ ID NO: 254584 - DNA, 16 bp, P. troglodytes
gggttttaccatgttg

SEQ ID NO: 254585 - DNA, 16 bp, P. troglodytes
gggttttcctgttgag

SEQ ID NO: 254586 - DNA, 16 bp, P. troglodytes
gggttttctgttactt

SEQ ID NO: 254587 - DNA, 16 bp, P. troglodytes
gggttttgacaaatgt

SEQ ID NO: 254588 - DNA, 16 bp, P. troglodytes
gggttttgatgtggat

SEQ ID NO: 254589 - DNA, 16 bp, P. troglodytes
gggttttgccacattg

SEQ ID NO: 254590 - DNA, 16 bp, P. troglodytes
gggttttgccatgttt

SEQ ID NO: 254591 - DNA, 16 bp, P. troglodytes
gggttttgccttgttg

SEQ ID NO: 254592 - DNA, 17 bp, P. troglodytes
gggttttgctatgttgc

SEQ ID NO: 254593 - DNA, 16 bp, P. troglodytes
gggttttgtcatgttg

SEQ ID NO: 254594 - DNA, 16 bp, P. troglodytes
gggtttttaaaatttt

SEQ ID NO: 254595 - DNA, 16 bp, P. troglodytes
ggtaaaataaccaatt

SEQ ID NO: 254596 - DNA, 16 bp, P. troglodytes
ggtaaaatacatataa

SEQ ID NO: 254597 - DNA, 16 bp, P. troglodytes
ggtaaaatgtgatgtt

SEQ ID NO: 254598 - DNA, 16 bp, P. troglodytes
ggtaaaattaatttta

SEQ ID NO: 254599 - DNA, 16 bp, P. troglodytes
ggtaaacaccattcta

SEQ ID NO: 254600 - DNA, 16 bp, P. troglodytes
ggtaaagaaaatgtag

SEQ ID NO: 254601 - DNA, 16 bp, P. troglodytes
ggtaaagaaagacaaa

SEQ ID NO: 254602 - DNA, 16 bp, P. troglodytes
ggtaaagtatactttt

SEQ ID NO: 254603 - DNA, 16 bp, P. troglodytes
ggtaaatatttgttga

SEQ ID NO: 254604 - DNA, 16 bp, P. troglodytes
ggtaaccacctttcta

SEQ ID NO: 254605 - DNA, 16 bp, P. troglodytes
ggtaaccactattctg

SEQ ID NO: 254606 - DNA, 16 bp, P. troglodytes
ggtaagaggactgctt

SEQ ID NO: 254607 - DNA, 16 bp, P. troglodytes
ggtaagccaagatcac

SEQ ID NO: 254608 - DNA, 16 bp, P. troglodytes
ggtaaggagtttgaga

SEQ ID NO: 254609 - DNA, 16 bp, P. troglodytes
ggtaaggatttcaaca

SEQ ID NO: 254610 - DNA, 16 bp, P. troglodytes
ggtaataaaatgtatt

SEQ ID NO: 254611 - DNA, 23 bp, P. troglodytes
ggtaatagaatatcacaaggcaa

SEQ ID NO: 254612 - DNA, 16 bp, P. troglodytes
ggtaatcccagctact

SEQ ID NO: 254613 - DNA, 16 bp, P. troglodytes
ggtaatgggatggctg

SEQ ID NO: 254614 - DNA, 16 bp, P. troglodytes
ggtaatgtgatgcctc

SEQ ID NO: 254615 - DNA, 16 bp, P. troglodytes
ggtaattttaaaaatt

SEQ ID NO: 254616 - DNA, 16 bp, P. troglodytes
ggtacaatcttggctc

SEQ ID NO: 254617 - DNA, 16 bp, P. troglodytes
ggtacacatataccat

SEQ ID NO: 254618 - DNA, 16 bp, P. troglodytes
ggtacagattatttca

SEQ ID NO: 254619 - DNA, 16 bp, P. troglodytes
ggtacagtaaaaatac

SEQ ID NO: 254620 - DNA, 16 bp, P. troglodytes
ggtacatacccaaagg

SEQ ID NO: 254621 - DNA, 16 bp, P. troglodytes
ggtacatagtaagtgt

SEQ ID NO: 254622 - DNA, 16 bp, P. troglodytes
ggtacatgtgcagaaa

SEQ ID NO: 254623 - DNA, 22 bp, P. troglodytes
ggtaccaaaacagagatataga

SEQ ID NO: 254624 - DNA, 16 bp, P. troglodytes
ggtaccaatcctactg

SEQ ID NO: 254625 - DNA, 16 bp, P. troglodytes
ggtaccagcaccagct

SEQ ID NO: 254626 - DNA, 16 bp, P. troglodytes
ggtaccagcagagtgg

SEQ ID NO: 254627 - DNA, 16 bp, P. troglodytes
ggtaccaggagtgagg

SEQ ID NO: 254628 - DNA, 16 bp, P. troglodytes
ggtactacaggtgcgt

SEQ ID NO: 254629 - DNA, 16 bp, P. troglodytes
ggtacttgcctgtagt

SEQ ID NO: 254630 - DNA, 16 bp, P. troglodytes
ggtagagaaagagatg

SEQ ID NO: 254631 - DNA, 30 bp, P. troglodytes
ggtagagacagggtttcaccatgttggcca

SEQ ID NO: 254632 - DNA, 16 bp, P. troglodytes
ggtagagatggagtct

SEQ ID NO: 254633 - DNA, 16 bp, P. troglodytes
ggtagataaaaccaaa

SEQ ID NO: 254634 - DNA, 16 bp, P. troglodytes
ggtagcacatgtctgt

SEQ ID NO: 254635 - DNA, 16 bp, P. troglodytes
ggtagcagctcctcct

SEQ ID NO: 254636 - DNA, 16 bp, P. troglodytes
ggtagcagttcctcct

SEQ ID NO: 254637 - DNA, 16 bp, P. troglodytes
ggtagctgggactaca

SEQ ID NO: 254638 - DNA, 16 bp, P. troglodytes
ggtagctgggactata

SEQ ID NO: 254639 - DNA, 22 bp, P. troglodytes
ggtagctgggattacaggcgcc

SEQ ID NO: 254640 - DNA, 16 bp, P. troglodytes
ggtagcttgcacctgt

SEQ ID NO: 254641 - DNA, 16 bp, P. troglodytes
ggtaggaaaacctgaa

SEQ ID NO: 254642 - DNA, 16 bp, P. troglodytes
ggtaggaagaaccaat

SEQ ID NO: 254643 - DNA, 16 bp, P. troglodytes
ggtagggtgagggcta

SEQ ID NO: 254644 - DNA, 16 bp, P. troglodytes
ggtaggttgaggctgc

SEQ ID NO: 254645 - DNA, 16 bp, P. troglodytes
ggtagtcccagctact

SEQ ID NO: 254646 - DNA, 16 bp, P. troglodytes
ggtagtgcacgcctgt

SEQ ID NO: 254647 - DNA, 16 bp, P. troglodytes
ggtagttcacacctgt

SEQ ID NO: 254648 - DNA, 16 bp, P. troglodytes
ggtagttcacgcctgt

SEQ ID NO: 254649 - DNA, 16 bp, P. troglodytes
ggtatacaggaactct

SEQ ID NO: 254650 - DNA, 16 bp, P. troglodytes
ggtatagcctgttgct

SEQ ID NO: 254651 - DNA, 16 bp, P. troglodytes
ggtatatatatatata

SEQ ID NO: 254652 - DNA, 16 bp, P. troglodytes
ggtatatgaattatat

SEQ ID NO: 254653 - DNA, 16 bp, P. troglodytes
ggtatctatccagagg

SEQ ID NO: 254654 - DNA, 16 bp, P. troglodytes
ggtatctggttcatct

SEQ ID NO: 254655 - DNA, 16 bp, P. troglodytes
ggtatgaaccaccaca

SEQ ID NO: 254656 - DNA, 16 bp, P. troglodytes
ggtatgaatgatcctg

SEQ ID NO: 254657 - DNA, 18 bp, P. troglodytes
ggtatgcttgaccattga

SEQ ID NO: 254658 - DNA, 16 bp, P. troglodytes
ggtatggtggtgcatg

SEQ ID NO: 254659 - DNA, 16 bp, P. troglodytes
ggtatggtggtgcctg

SEQ ID NO: 254660 - DNA, 16 bp, P. troglodytes
ggtatgtgccatcaca

SEQ ID NO: 254661 - DNA, 16 bp, P. troglodytes
ggtatgtgtgtatata

SEQ ID NO: 254662 - DNA, 16 bp, P. troglodytes
ggtatgttcctgcagt

SEQ ID NO: 254663 - DNA, 16 bp, P. troglodytes
ggtattaccagcagag

SEQ ID NO: 254664 - DNA, 16 bp, P. troglodytes
ggtattcagttatagc

SEQ ID NO: 254665 - DNA, 16 bp, P. troglodytes
ggtattggcaaaagaa

SEQ ID NO: 254666 - DNA, 47 bp, P. troglodytes; identical to SEQ ID NO: 117834

SEQ ID NO: 254667 - DNA, 16 bp, P. troglodytes
ggtatttgttctaatg

SEQ ID NO: 254668 - DNA, 16 bp, P. troglodytes
ggtattttactctttt

SEQ ID NO: 254669 - DNA, 16 bp, P. troglodytes
ggtattttatttcatt

SEQ ID NO: 254670 - DNA, 16 bp, P. troglodytes
ggtcaaaggacatgaa

SEQ ID NO: 254671 - DNA, 16 bp, P. troglodytes
ggtcaaagggtacaaa

SEQ ID NO: 254672 - DNA, 16 bp, P. troglodytes
ggtcaacatcactgat

SEQ ID NO: 254673 - DNA, 16 bp, P. troglodytes
ggtcaaggtgggagga

SEQ ID NO: 254674 - DNA, 16 bp, P. troglodytes
ggtcacagaagtgttc

SEQ ID NO: 254675 - DNA, 16 bp, P. troglodytes
ggtcacattgcctcct

SEQ ID NO: 254676 - DNA, 16 bp, P. troglodytes
ggtcacattgccttct

SEQ ID NO: 254677 - DNA, 16 bp, P. troglodytes
ggtcaccagaaagacc

SEQ ID NO: 254678 - DNA, 17 bp, P. troglodytes
ggtcacgaggtcaggag

SEQ ID NO: 254679 - DNA, 16 bp, P. troglodytes
ggtcactcttgctgtg

SEQ ID NO: 254680 - DNA, 16 bp, P. troglodytes
ggtcactgcaaactcc

SEQ ID NO: 254681 - DNA, 16 bp, P. troglodytes
ggtcactgccttctgg

SEQ ID NO: 254682 - DNA, 16 bp, P. troglodytes
ggtcacttatatttgg

SEQ ID NO: 254683 - DNA, 16 bp, P. troglodytes
ggtcagaagtttcaga

SEQ ID NO: 254684 - DNA, 16 bp, P. troglodytes
ggtcagagcaggagga

SEQ ID NO: 254685 - DNA, 16 bp, P. troglodytes
ggtcagcaaactatgg

SEQ ID NO: 254686 - DNA, 16 bp, P. troglodytes
ggtcagcaaactgtgg

SEQ ID NO: 254687 - DNA, 16 bp, P. troglodytes
ggtcagcattatcctg

SEQ ID NO: 254688 - DNA, 16 bp, P. troglodytes
ggtcagccccctgccc

SEQ ID NO: 254689 - DNA, 16 bp, P. troglodytes
ggtcagctggtcttga

SEQ ID NO: 254690 - DNA, 16 bp, P. troglodytes
ggtcaggaattcagaa

SEQ ID NO: 254691 - DNA, 16 bp, P. troglodytes
ggtcaggacttcaaga

SEQ ID NO: 254692 - DNA, 16 bp, P. troglodytes
ggtcaggagtcaagac

SEQ ID NO: 254693 - DNA, 16 bp, P. troglodytes
ggtcagggaaccaaga

SEQ ID NO: 254694 - DNA, 16 bp, P. troglodytes
ggtcagggctgcagtg

SEQ ID NO: 254695 - DNA, 16 bp, P. troglodytes
ggtcagtctttgttct

SEQ ID NO: 254696 - DNA, 16 bp, P. troglodytes
ggtcagtgattctcaa

SEQ ID NO: 254697 - DNA, 16 bp, P. troglodytes
ggtcatgaaaatgttc

SEQ ID NO: 254698 - DNA, 16 bp, P. troglodytes
ggtcatgagggcagag

SEQ ID NO: 254699 - DNA, 22 bp, P. troglodytes
ggtcatgagggtggagccctca

SEQ ID NO: 254700 - DNA, 16 bp, P. troglodytes
ggtcatggatgaagct

SEQ ID NO: 254701 - DNA, 16 bp, P. troglodytes
ggtcattagacaaatg

SEQ ID NO: 254702 - DNA, 16 bp, P. troglodytes
ggtcattagaggaatg

SEQ ID NO: 254703 - DNA, 16 bp, P. troglodytes
ggtcattcacatccct

SEQ ID NO: 254704 - DNA, 16 bp, P. troglodytes
ggtcatttataaagaa

SEQ ID NO: 254705 - DNA, 16 bp, P. troglodytes
ggtcatttggaaaata

SEQ ID NO: 254706 - DNA, 16 bp, P. troglodytes
ggtccaagggattctc

SEQ ID NO: 254707 - DNA, 16 bp, P. troglodytes
ggtccacccgcctcgg

SEQ ID NO: 254708 - DNA, 16 bp, P. troglodytes
ggtccagcatttgcca

SEQ ID NO: 254709 - DNA, 16 bp, P. troglodytes
ggtccaggcgtggtgg

SEQ ID NO: 254710 - DNA, 16 bp, P. troglodytes
ggtccagtttcagttt

SEQ ID NO: 254711 - DNA, 16 bp, P. troglodytes
ggtcccaatccagacc

SEQ ID NO: 254712 - DNA, 16 bp, P. troglodytes
ggtcccaccccagacc

SEQ ID NO: 254713 - DNA, 16 bp, P. troglodytes
ggtcccactgcactcc

SEQ ID NO: 254714 - DNA, 17 bp, P. troglodytes
ggtcccagcactttggg

SEQ ID NO: 254715 - DNA, 16 bp, P. troglodytes
ggtcccagctacttag

SEQ ID NO: 254716 - DNA, 16 bp, P. troglodytes
ggtccccagggaagcc

SEQ ID NO: 254717 - DNA, 16 bp, P. troglodytes
ggtcccccagcagtgc

SEQ ID NO: 254718 - DNA, 16 bp, P. troglodytes
ggtcccccaggcccag

SEQ ID NO: 254719 - DNA, 16 bp, P. troglodytes
ggtccctcccacaaca

SEQ ID NO: 254720 - DNA, 16 bp, P. troglodytes
ggtccctgattccagg

SEQ ID NO: 254721 - DNA, 16 bp, P. troglodytes
ggtccctggcgagggc

SEQ ID NO: 254722 - DNA, 16 bp, P. troglodytes
ggtccctggtgaagcc

SEQ ID NO: 254723 - DNA, 16 bp, P. troglodytes
ggtccctgtggccttc

SEQ ID NO: 254724 - DNA, 16 bp, P. troglodytes
ggtcccttcctctgct

SEQ ID NO: 254725 - DNA, 16 bp, P. troglodytes
ggtcctaaaagcctca

SEQ ID NO: 254726 - DNA, 16 bp, P. troglodytes
ggtcctcctgcttcag

SEQ ID NO: 254727 - DNA, 16 bp, P. troglodytes
ggtcctctttgtggtc

SEQ ID NO: 254728 - DNA, 16 bp, P. troglodytes
ggtcctgaggcaggaa

SEQ ID NO: 254729 - DNA, 16 bp, P. troglodytes
ggtcctgctgctcacc

SEQ ID NO: 254730 - DNA, 16 bp, P. troglodytes
ggtcctgctgcttgct

SEQ ID NO: 254731 - DNA, 16 bp, P. troglodytes
ggtcctggtgtctgtt

SEQ ID NO: 254732 - DNA, 16 bp, P. troglodytes
ggtcctgtttataatt

SEQ ID NO: 254733 - DNA, 16 bp, P. troglodytes
ggtcgtgatctcctga

SEQ ID NO: 254734 - DNA, 16 bp, P. troglodytes
ggtcgtggtggcaggc

SEQ ID NO: 254735 - DNA, 16 bp, P. troglodytes
ggtctattcttgagaa

SEQ ID NO: 254736 - DNA, 16 bp, P. troglodytes
ggtctcaaactcccta

SEQ ID NO: 254737 - DNA, 16 bp, P. troglodytes
ggtctcacgctgttgc

SEQ ID NO: 254738 - DNA, 16 bp, P. troglodytes
ggtctcactctctcac

SEQ ID NO: 254739 - DNA, 16 bp, P. troglodytes
ggtctcactctgtcac

SEQ ID NO: 254740 - DNA, 18 bp, P. troglodytes
ggtctcactctgtcacct

SEQ ID NO: 254741 - DNA, 19 bp, P. troglodytes
ggtctcactctgtcgccca

SEQ ID NO: 254742 - DNA, 16 bp, P. troglodytes
ggtctcactctgtctc

SEQ ID NO: 254743 - DNA, 16 bp, P. troglodytes
ggtctcactctgttgc

SEQ ID NO: 254744 - DNA, 16 bp, P. troglodytes
ggtctcactgcagcct

SEQ ID NO: 254745 - DNA, 16 bp, P. troglodytes
ggtctcactttgttac

SEQ ID NO: 254746 - DNA, 16 bp, P. troglodytes
ggtctcagctcattgc

SEQ ID NO: 254747 - DNA, 16 bp, P. troglodytes
ggtctcattctgtcgc

SEQ ID NO: 254748 - DNA, 16 bp, P. troglodytes
ggtctccagctccatc

SEQ ID NO: 254749 - DNA, 16 bp, P. troglodytes
ggtctcccaaaatgtt

SEQ ID NO: 254750 - DNA, 16 bp, P. troglodytes
ggtctcccgcacagcc

SEQ ID NO: 254751 - DNA, 16 bp, P. troglodytes
ggtctccctctcccca

SEQ ID NO: 254752 - DNA, 16 bp, P. troglodytes
ggtctcgctatgttgc

SEQ ID NO: 254753 - DNA, 16 bp, P. troglodytes
ggtctcgctgtgttgc

SEQ ID NO: 254754 - DNA, 16 bp, P. troglodytes
ggtctctatctcctgg

SEQ ID NO: 254755 - DNA, 16 bp, P. troglodytes
ggtctctctgattcct

SEQ ID NO: 254756 - DNA, 16 bp, P. troglodytes
ggtctctcttcctctt

SEQ ID NO: 254757 - DNA, 16 bp, P. troglodytes
ggtctctgatggagat

SEQ ID NO: 254758 - DNA, 16 bp, P. troglodytes
ggtctgagggaggaag

SEQ ID NO: 254759 - DNA, 16 bp, P. troglodytes
ggtctgagggaggagg

SEQ ID NO: 254760 - DNA, 16 bp, P. troglodytes
ggtctgcagcttcatt

SEQ ID NO: 254761 - DNA, 16 bp, P. troglodytes
ggtctgcatctcccag

SEQ ID NO: 254762 - DNA, 16 bp, P. troglodytes
ggtctgctggagtttt

SEQ ID NO: 254763 - DNA, 16 bp, P. troglodytes
ggtctggactcctggg

SEQ ID NO: 254764 - DNA, 16 bp, P. troglodytes
ggtctggaggacggtg

SEQ ID NO: 254765 - DNA, 16 bp, P. troglodytes
ggtctggctctgctgc

SEQ ID NO: 254766 - DNA, 16 bp, P. troglodytes
ggtctggctctgtcgc

SEQ ID NO: 254767 - DNA, 16 bp, P. troglodytes
ggtctggcttctttca

SEQ ID NO: 254768 - DNA, 16 bp, P. troglodytes
ggtctgggcaaaaatt

SEQ ID NO: 254769 - DNA, 16 bp, P. troglodytes
ggtctgggctcactgc

SEQ ID NO: 254770 - DNA, 16 bp, P. troglodytes
ggtctgtcctggagaa

SEQ ID NO: 254771 - DNA, 16 bp, P. troglodytes
ggtctgtgctgaggag

SEQ ID NO: 254772 - DNA, 16 bp, P. troglodytes
ggtctgtgggacagac

SEQ ID NO: 254773 - DNA, 16 bp, P. troglodytes
ggtctgtttctgggtt

SEQ ID NO: 254774 - DNA, 16 bp, P. troglodytes
ggtcttaaattcctga

SEQ ID NO: 254775 - DNA, 16 bp, P. troglodytes
ggtcttaagacccaca

SEQ ID NO: 254776 - DNA, 16 bp, P. troglodytes
ggtcttcctccccaaa

SEQ ID NO: 254777 - DNA, 16 bp, P. troglodytes
ggtcttctttgattcc

SEQ ID NO: 254778 - DNA, 16 bp, P. troglodytes
ggtcttctttggggaa

SEQ ID NO: 254779 - DNA, 16 bp, P. troglodytes
ggtcttgaagtcctga

SEQ ID NO: 254780 - DNA, 16 bp, P. troglodytes
ggtcttgaatacctgg

SEQ ID NO: 254781 - DNA, 24 bp, P. troglodytes
ggtcttgctctgtcacccaggcta

SEQ ID NO: 254782 - DNA, 16 bp, P. troglodytes
ggtcttgtgggactga

SEQ ID NO: 254783 - DNA, 16 bp, P. troglodytes
ggtctttatgacctgt

SEQ ID NO: 254784 - DNA, 16 bp, P. troglodytes
ggtctttgatcatggt

SEQ ID NO: 254785 - DNA, 16 bp, P. troglodytes
ggtctttgatccattt

SEQ ID NO: 254786 - DNA, 16 bp, P. troglodytes
ggtcttttcacatatt

SEQ ID NO: 254787 - DNA, 16 bp, P. troglodytes
ggtcttttggagtttg

SEQ ID NO: 254788 - DNA, 16 bp, P. troglodytes
ggtcttttgtgatttc

SEQ ID NO: 254789 - DNA, 16 bp, P. troglodytes
ggtgaaaaaggaaaca

SEQ ID NO: 254790 - DNA, 16 bp, P. troglodytes
ggtgaaaaaggaagta

SEQ ID NO: 254791 - DNA, 16 bp, P. troglodytes
ggtgaaacccatctct

SEQ ID NO: 254792 - DNA, 27 bp, P. troglodytes
ggtgaaaccccatctctactaaaaaag

SEQ ID NO: 254793 - DNA, 23 bp, P. troglodytes
ggtgaaaccccgcctctactaaa

SEQ ID NO: 254794 - DNA, 16 bp, P. troglodytes
ggtgaaaccccgtccc

SEQ ID NO: 254795 - DNA, 18 bp, P. troglodytes
ggtgaaaccccgtgtcta

SEQ ID NO: 254796 - DNA, 18 bp, P. troglodytes
ggtgaaaccctgtctcca

SEQ ID NO: 254797 - DNA, 18 bp, P. troglodytes
ggtgaaaccctgtctcta

SEQ ID NO: 254798 - DNA, 16 bp, P. troglodytes
ggtgaaactacgtctc

SEQ ID NO: 254799 - DNA, 16 bp, P. troglodytes
ggtgaaagacagtgat

SEQ ID NO: 254800 - DNA, 16 bp, P. troglodytes
ggtgaaagagagagac

SEQ ID NO: 254801 - DNA, 16 bp, P. troglodytes
ggtgaaagattgaatg

SEQ ID NO: 254802 - DNA, 16 bp, P. troglodytes
ggtgaaagctgcagtg

SEQ ID NO: 254803 - DNA, 16 bp, P. troglodytes
ggtgaaaggcaaaggg

SEQ ID NO: 254804 - DNA, 16 bp, P. troglodytes
ggtgaaatctgtctct

SEQ ID NO: 254805 - DNA, 16 bp, P. troglodytes
ggtgaacccaggaggt

SEQ ID NO: 254806 - DNA, 16 bp, P. troglodytes
ggtgaacctggaggac

SEQ ID NO: 254807 - DNA, 19 bp, P. troglodytes
ggtgaacctgggaggtgga

SEQ ID NO: 254808 - DNA, 16 bp, P. troglodytes
ggtgaagaaaatgttc

SEQ ID NO: 254809 - DNA, 16 bp, P. troglodytes
ggtgaagaagctgcag

SEQ ID NO: 254810 - DNA, 16 bp, P. troglodytes
ggtgaagcaggagaat

SEQ ID NO: 254811 - DNA, 18 bp, P. troglodytes
ggtgaagccagctgggct

SEQ ID NO: 254812 - DNA, 16 bp, P. troglodytes
ggtgaagccccacctc

SEQ ID NO: 254813 - DNA, 16 bp, P. troglodytes
ggtgaaggaggagcaa

SEQ ID NO: 254814 - DNA, 16 bp, P. troglodytes
ggtgaaggaggagcag

SEQ ID NO: 254815 - DNA, 16 bp, P. troglodytes
ggtgaaggataaaaga

SEQ ID NO: 254816 - DNA, 16 bp, P. troglodytes
ggtgaaggatgtgaac

SEQ ID NO: 254817 - DNA, 16 bp, P. troglodytes
ggtgaatgctgcctgg

SEQ ID NO: 254818 - DNA, 16 bp, P. troglodytes
ggtgaattctaccaaa

SEQ ID NO: 254819 - DNA, 16 bp, P. troglodytes
ggtgaatttggagctg

SEQ ID NO: 254820 - DNA, 16 bp, P. troglodytes
ggtgaattttaccaaa

SEQ ID NO: 254821 - DNA, 16 bp, P. troglodytes
ggtgaattttttgtat

SEQ ID NO: 254822 - DNA, 16 bp, P. troglodytes
ggtgacaaaatgagac

SEQ ID NO: 254823 - DNA, 16 bp, P. troglodytes
ggtgacaaagcgagac

SEQ ID NO: 254824 - DNA, 16 bp, P. troglodytes
ggtgacaacatgctgg

SEQ ID NO: 254825 - DNA, 16 bp, P. troglodytes
ggtgacaagagcgaga

SEQ ID NO: 254826 - DNA, 16 bp, P. troglodytes
ggtgacacagtgagaa

SEQ ID NO: 254827 - DNA, 16 bp, P. troglodytes
ggtgacagaagaagac

SEQ ID NO: 254828 - DNA, 16 bp, P. troglodytes
ggtgacagactgagat

SEQ ID NO: 254829 - DNA, 16 bp, P. troglodytes
ggtgacagagagaaac

SEQ ID NO: 254830 - DNA, 16 bp, P. troglodytes
ggtgacagagatcctg

SEQ ID NO: 254831 - DNA, 16 bp, P. troglodytes
ggtgacagagcaagac

SEQ ID NO: 254832 - DNA, 16 bp, P. troglodytes
ggtgacagaggagact

SEQ ID NO: 254833 - DNA, 16 bp, P. troglodytes
ggtgacagagggggac

SEQ ID NO: 254834 - DNA, 16 bp, P. troglodytes
ggtgacagcaagaccc

SEQ ID NO: 254835 - DNA, 19 bp, P. troglodytes
ggtgacagcgtgctggcag

SEQ ID NO: 254836 - DNA, 16 bp, P. troglodytes
ggtgacaggcatgagc

SEQ ID NO: 254837 - DNA, 16 bp, P. troglodytes
ggtgacagggaaagac

SEQ ID NO: 254838 - DNA, 16 bp, P. troglodytes
ggtgacaggtacacta

SEQ ID NO: 254839 - DNA, 16 bp, P. troglodytes
ggtgacagtgagacac

SEQ ID NO: 254840 - DNA, 16 bp, P. troglodytes
ggtgacagtgagaccc

SEQ ID NO: 254841 - DNA, 16 bp, P. troglodytes
ggtgacagtgcaagac

SEQ ID NO: 254842 - DNA, 17 bp, P. troglodytes
ggtgacatacagatggg

SEQ ID NO: 254843 - DNA, 16 bp, P. troglodytes
ggtgacatgtacctgt

SEQ ID NO: 254844 - DNA, 16 bp, P. troglodytes
ggtgacatttgagcca

SEQ ID NO: 254845 - DNA, 16 bp, P. troglodytes
ggtgaccagccttccc

SEQ ID NO: 254846 - DNA, 17 bp, P. troglodytes
ggtgaccttgggcaagt

SEQ ID NO: 254847 - DNA, 16 bp, P. troglodytes
ggtgactcaaattttt

SEQ ID NO: 254848 - DNA, 16 bp, P. troglodytes
ggtgactcacgcctgt

SEQ ID NO: 254849 - DNA, 16 bp, P. troglodytes
ggtgactcatgccttt

SEQ ID NO: 254850 - DNA, 16 bp, P. troglodytes
ggtgactttaatgaat

SEQ ID NO: 254851 - DNA, 16 bp, P. troglodytes
ggtgagaaagggcatc

SEQ ID NO: 254852 - DNA, 16 bp, P. troglodytes
ggtgagaaagtgagac

SEQ ID NO: 254853 - DNA, 16 bp, P. troglodytes
ggtgagaagaaacatc

SEQ ID NO: 254854 - DNA, 16 bp, P. troglodytes
ggtgagactgtggaga

SEQ ID NO: 254855 - DNA, 16 bp, P. troglodytes
ggtgagagagacagag

SEQ ID NO: 254856 - DNA, 16 bp, P. troglodytes
ggtgagagatggcatc

SEQ ID NO: 254857 - DNA, 16 bp, P. troglodytes
ggtgagcactcacagt

SEQ ID NO: 254858 - DNA, 16 bp, P. troglodytes
ggtgagcagggctgag

SEQ ID NO: 254859 - DNA, 17 bp, P. troglodytes
ggtgagccaagatcaca

SEQ ID NO: 254860 - DNA, 21 bp, P. troglodytes
ggtgagccaagatcgtgccat

SEQ ID NO: 254861 - DNA, 16 bp, P. troglodytes
ggtgagccaccacatc

SEQ ID NO: 254862 - DNA, 16 bp, P. troglodytes
ggtgagccactgcacc

SEQ ID NO: 254863 - DNA, 16 bp, P. troglodytes
ggtgagctgagatagc

SEQ ID NO: 254864 - DNA, 16 bp, P. troglodytes
ggtgaggaacttgttg

SEQ ID NO: 254865 - DNA, 16 bp, P. troglodytes
ggtgaggaagttgcag

SEQ ID NO: 254866 - DNA, 16 bp, P. troglodytes
ggtgaggaattcaaga

SEQ ID NO: 254867 - DNA, 16 bp, P. troglodytes
ggtgaggacactgagg

SEQ ID NO: 254868 - DNA, 16 bp, P. troglodytes
ggtgaggagttcgaga

SEQ ID NO: 254869 - DNA, 16 bp, P. troglodytes
ggtgaggcaggagaat

SEQ ID NO: 254870 - DNA, 16 bp, P. troglodytes
ggtgaggcaggaggat

SEQ ID NO: 254871 - DNA, 16 bp, P. troglodytes
ggtgaggcatgagaat

SEQ ID NO: 254872 - DNA, 16 bp, P. troglodytes
ggtgaggctgtggaga

SEQ ID NO: 254873 - DNA, 16 bp, P. troglodytes
ggtgagggcctcaggg

SEQ ID NO: 254874 - DNA, 16 bp, P. troglodytes
ggtgagggccttctta

SEQ ID NO: 254875 - DNA, 16 bp, P. troglodytes
ggtgagggctctctcc

SEQ ID NO: 254876 - DNA, 16 bp, P. troglodytes
ggtgagtcacctgagg

SEQ ID NO: 254877 - DNA, 16 bp, P. troglodytes
ggtgagtcctagagct

SEQ ID NO: 254878 - DNA, 16 bp, P. troglodytes
ggtgagtggatcattt

SEQ ID NO: 254879 - DNA, 16 bp, P. troglodytes
ggtgataaaaatgttc

SEQ ID NO: 254880 - DNA, 16 bp, P. troglodytes
ggtgatactggcttta

SEQ ID NO: 254881 - DNA, 16 bp, P. troglodytes
ggtgatatggcttggc

SEQ ID NO: 254882 - DNA, 23 bp, P. troglodytes
ggtgatccgcctgcctcggcctc

SEQ ID NO: 254883 - DNA, 28 bp, P. troglodytes
ggtgatccgcctgccttggcctcccaaa

SEQ ID NO: 254884 - DNA, 16 bp, P. troglodytes
ggtgatctgcatgcct

SEQ ID NO: 254885 - DNA, 16 bp, P. troglodytes
ggtgatctgcctggct

SEQ ID NO: 254886 - DNA, 16 bp, P. troglodytes
ggtgatgaaactgagg

SEQ ID NO: 254887 - DNA, 16 bp, P. troglodytes
ggtgatgagtgcctgt

SEQ ID NO: 254888 - DNA, 16 bp, P. troglodytes
ggtgatgatgatgaca

SEQ ID NO: 254889 - DNA, 16 bp, P. troglodytes
ggtgatgatgatgtgt

SEQ ID NO: 254890 - DNA, 16 bp, P. troglodytes
ggtgatgccagtgctg

SEQ ID NO: 254891 - DNA, 16 bp, P. troglodytes
ggtgatgccccaccct

SEQ ID NO: 254892 - DNA, 16 bp, P. troglodytes
ggtgatgccctggaca

SEQ ID NO: 254893 - DNA, 16 bp, P. troglodytes
ggtgatgcgtgcctgt

SEQ ID NO: 254894 - DNA, 16 bp, P. troglodytes
ggtgatgctgacgctg

SEQ ID NO: 254895 - DNA, 16 bp, P. troglodytes
ggtgatgctgttgctg

SEQ ID NO: 254896 - DNA, 16 bp, P. troglodytes
ggtgatggagaggatg

SEQ ID NO: 254897 - DNA, 16 bp, P. troglodytes
ggtgatggagggagac

SEQ ID NO: 254898 - DNA, 16 bp, P. troglodytes
ggtgatggatgcctgt

SEQ ID NO: 254899 - DNA, 16 bp, P. troglodytes
ggtgatggcctggatg

SEQ ID NO: 254900 - DNA, 16 bp, P. troglodytes
ggtgatgggtgcacca

SEQ ID NO: 254901 - DNA, 16 bp, P. troglodytes
ggtgatggttacacta

SEQ ID NO: 254902 - DNA, 16 bp, P. troglodytes
ggtgatggttgctgaa

SEQ ID NO: 254903 - DNA, 17 bp, P. troglodytes
ggtgatgtacatcctca

SEQ ID NO: 254904 - DNA, 16 bp, P. troglodytes
ggtgatgttggcttca

SEQ ID NO: 254905 - DNA, 16 bp, P. troglodytes
ggtgatgtttgagctg

SEQ ID NO: 254906 - DNA, 16 bp, P. troglodytes
ggtgattctcccacct

SEQ ID NO: 254907 - DNA, 16 bp, P. troglodytes
ggtgattctgatgcag

SEQ ID NO: 254908 - DNA, 16 bp, P. troglodytes
ggtgatttcgtcattg

SEQ ID NO: 254909 - DNA, 16 bp, P. troglodytes
ggtgatttcttcattt

SEQ ID NO: 254910 - DNA, 16 bp, P. troglodytes
ggtgatttgtgatcag

SEQ ID NO: 254911 - DNA, 16 bp, P. troglodytes
ggtgatttttattttc

SEQ ID NO: 254912 - DNA, 16 bp, P. troglodytes
ggtgattttttaaaaa

SEQ ID NO: 254913 - DNA, 16 bp, P. troglodytes
ggtgcaaaagtaatca

SEQ ID NO: 254914 - DNA, 16 bp, P. troglodytes
ggtgcaaccttggctc

SEQ ID NO: 254915 - DNA, 16 bp, P. troglodytes
ggtgcaagacccaagc

SEQ ID NO: 254916 - DNA, 16 bp, P. troglodytes
ggtgcaagccccaagc

SEQ ID NO: 254917 - DNA, 18 bp, P. troglodytes
ggtgcaatggcgcgatct

SEQ ID NO: 254918 - DNA, 16 bp, P. troglodytes
ggtgcaatggctcaag

SEQ ID NO: 254919 - DNA, 16 bp, P. troglodytes
ggtgcacacacacaca

SEQ ID NO: 254920 - DNA, 16 bp, P. troglodytes
ggtgcacacctgtatt

SEQ ID NO: 254921 - DNA, 16 bp, P. troglodytes
ggtgcacatctgtgat

SEQ ID NO: 254922 - DNA, 16 bp, P. troglodytes
ggtgcagacccaaaga

SEQ ID NO: 254923 - DNA, 17 bp, P. troglodytes
ggtgcagcaaaccaaca

SEQ ID NO: 254924 - DNA, 16 bp, P. troglodytes
ggtgcagcaaaccatc

SEQ ID NO: 254925 - DNA, 16 bp, P. troglodytes
ggtgcagcagaccacc

SEQ ID NO: 254926 - DNA, 16 bp, P. troglodytes
ggtgcagcagctcatg

SEQ ID NO: 254927 - DNA, 16 bp, P. troglodytes
ggtgcagctgcagcca

SEQ ID NO: 254928 - DNA, 16 bp, P. troglodytes
ggtgcagctgctgtgg

SEQ ID NO: 254929 - DNA, 16 bp, P. troglodytes
ggtgcagtcatagctc

SEQ ID NO: 254930 - DNA, 17 bp, P. troglodytes
ggtgcagtgcaccagca

SEQ ID NO: 254931 - DNA, 19 bp, P. troglodytes
ggtgcagtggcgcgatctc

SEQ ID NO: 254932 - DNA, 16 bp, P. troglodytes
ggtgcagtggctcaag

SEQ ID NO: 254933 - DNA, 16 bp, P. troglodytes
ggtgcagtggctcaca

SEQ ID NO: 254934 - DNA, 16 bp, P. troglodytes
ggtgcagtggctctcg

SEQ ID NO: 254935 - DNA, 16 bp, P. troglodytes
ggtgcagtggtgcaat

SEQ ID NO: 254936 - DNA, 16 bp, P. troglodytes
ggtgcagtggtggctc

SEQ ID NO: 254937 - DNA, 16 bp, P. troglodytes
ggtgcagtttccccca

SEQ ID NO: 254938 - DNA, 16 bp, P. troglodytes
ggtgcatatatatcta

SEQ ID NO: 254939 - DNA, 16 bp, P. troglodytes
ggtgcatgacaccatg

SEQ ID NO: 254940 - DNA, 16 bp, P. troglodytes
ggtgcatgccaccaca

SEQ ID NO: 254941 - DNA, 16 bp, P. troglodytes
ggtgcatgccaccacc

SEQ ID NO: 254942 - DNA, 16 bp, P. troglodytes
ggtgcatggcaccatg

SEQ ID NO: 254943 - DNA, 16 bp, P. troglodytes
ggtgccacatgcctgt

SEQ ID NO: 254944 - DNA, 16 bp, P. troglodytes
ggtgccacctcggctc

SEQ ID NO: 254945 - DNA, 16 bp, P. troglodytes
ggtgccaggggctggg

SEQ ID NO: 254946 - DNA, 16 bp, P. troglodytes
ggtgccaggtgcctgt

SEQ ID NO: 254947 - DNA, 16 bp, P. troglodytes
ggtgccatcttggctt

SEQ ID NO: 254948 - DNA, 16 bp, P. troglodytes
ggtgcccaccatgccc

SEQ ID NO: 254949 - DNA, 16 bp, P. troglodytes
ggtgccctgcattcca

SEQ ID NO: 254950 - DNA, 16 bp, P. troglodytes
ggtgcctatgccacca

SEQ ID NO: 254951 - DNA, 16 bp, P. troglodytes
ggtgcctgccaccacg

SEQ ID NO: 254952 - DNA, 16 bp, P. troglodytes
ggtgcctggcacacag

SEQ ID NO: 254953 - DNA, 16 bp, P. troglodytes
ggtgcctgtaatcaca

SEQ ID NO: 254954 - DNA, 16 bp, P. troglodytes
ggtgcctgtaatccaa

SEQ ID NO: 254955 - DNA, 16 bp, P. troglodytes
ggtgcctgtcatccca

SEQ ID NO: 254956 - DNA, 16 bp, P. troglodytes
ggtgcctgtgatccca

SEQ ID NO: 254957 - DNA, 16 bp, P. troglodytes
ggtgctcaaaaagttt

SEQ ID NO: 254958 - DNA, 16 bp, P. troglodytes
ggtgctcaccaccatg

SEQ ID NO: 254959 - DNA, 16 bp, P. troglodytes
ggtgctgctgatgctg

SEQ ID NO: 254960 - DNA, 16 bp, P. troglodytes
ggtgctggagaagatg

SEQ ID NO: 254961 - DNA, 16 bp, P. troglodytes
ggtgctggaggggatg

SEQ ID NO: 254962 - DNA, 16 bp, P. troglodytes
ggtgctgggaaacctg

SEQ ID NO: 254963 - DNA, 16 bp, P. troglodytes
ggtgctgggattacag

SEQ ID NO: 254964 - DNA, 16 bp, P. troglodytes
ggtgctgtggctcacg

SEQ ID NO: 254965 - DNA, 16 bp, P. troglodytes
ggtgctgtggctcatg

SEQ ID NO: 254966 - DNA, 16 bp, P. troglodytes
ggtgctgtgtgcctgt

SEQ ID NO: 254967 - DNA, 16 bp, P. troglodytes
ggtgctgttaaaagca

SEQ ID NO: 254968 - DNA, 16 bp, P. troglodytes
ggtgcttgtaatccca

SEQ ID NO: 254969 - DNA, 16 bp, P. troglodytes
ggtggaaatagcaaaa

SEQ ID NO: 254970 - DNA, 16 bp, P. troglodytes
ggtggaagacaaggag

SEQ ID NO: 254971 - DNA, 16 bp, P. troglodytes
ggtggaagagcaagag

SEQ ID NO: 254972 - DNA, 16 bp, P. troglodytes
ggtggaatgcagtggt

SEQ ID NO: 254973 - DNA, 16 bp, P. troglodytes
ggtggagaatggccag

SEQ ID NO: 254974 - DNA, 16 bp, P. troglodytes
ggtggagacacagagc

SEQ ID NO: 254975 - DNA, 16 bp, P. troglodytes
ggtggagacacagatc

SEQ ID NO: 254976 - DNA, 16 bp, P. troglodytes
ggtggagactttggga

SEQ ID NO: 254977 - DNA, 16 bp, P. troglodytes
ggtggagaggagcttc

SEQ ID NO: 254978 - DNA, 16 bp, P. troglodytes
ggtggagcaggctggc

SEQ ID NO: 254979 - DNA, 16 bp, P. troglodytes
ggtggagcctcgggaa

SEQ ID NO: 254980 - DNA, 16 bp, P. troglodytes
ggtggagccttgggaa

SEQ ID NO: 254981 - DNA, 16 bp, P. troglodytes
ggtggagctacccaag

SEQ ID NO: 254982 - DNA, 16 bp, P. troglodytes
ggtggagctgcctgct

SEQ ID NO: 254983 - DNA, 16 bp, P. troglodytes
ggtggagctggaagcc

SEQ ID NO: 254984 - DNA, 16 bp, P. troglodytes
ggtggaggactgcttg

SEQ ID NO: 254985 - DNA, 16 bp, P. troglodytes
ggtggaggagcagagt

SEQ ID NO: 254986 - DNA, 16 bp, P. troglodytes
ggtggaggctgctgtg

SEQ ID NO: 254987 - DNA, 16 bp, P. troglodytes
ggtggaggctgtggtg

SEQ ID NO: 254988 - DNA, 16 bp, P. troglodytes
ggtggagggtgtccag

SEQ ID NO: 254989 - DNA, 16 bp, P. troglodytes
ggtggaggtggcagtg

SEQ ID NO: 254990 - DNA, 16 bp, P. troglodytes
ggtggaggttgcatga

SEQ ID NO: 254991 - DNA, 16 bp, P. troglodytes
ggtggagtattctgta

SEQ ID NO: 254992 - DNA, 16 bp, P. troglodytes
ggtggagtgcggtggc

SEQ ID NO: 254993 - DNA, 17 bp, P. troglodytes
ggtggatcaccaggtca

SEQ ID NO: 254994 - DNA, 19 bp, P. troglodytes
ggtggatcacgaggtcagt

SEQ ID NO: 254995 - DNA, 17 bp, P. troglodytes
ggtggatcacggggtca

SEQ ID NO: 254996 - DNA, 16 bp, P. troglodytes
ggtggatcacttgaaa

SEQ ID NO: 254997 - DNA, 17 bp, P. troglodytes
ggtggatcacttgagcc

SEQ ID NO: 254998 - DNA, 16 bp, P. troglodytes
ggtggatcagctgagg

SEQ ID NO: 254999 - DNA, 16 bp, P. troglodytes
ggtggatgaatggatg

SEQ ID NO: 255000 - DNA, 16 bp, P. troglodytes
ggtggatggcctgagg

SEQ ID NO: 255001 - DNA, 16 bp, P. troglodytes
ggtggattacttgagg

SEQ ID NO: 255002 - DNA, 16 bp, P. troglodytes
ggtggcacagcaggag

SEQ ID NO: 255003 - DNA, 16 bp, P. troglodytes
ggtggcagcaagaagt

SEQ ID NO: 255004 - DNA, 16 bp, P. troglodytes
ggtggcagcagtgggc

SEQ ID NO: 255005 - DNA, 16 bp, P. troglodytes
ggtggcagctgggcag

SEQ ID NO: 255006 - DNA, 16 bp, P. troglodytes
ggtggcaggaatggag

SEQ ID NO: 255007 - DNA, 16 bp, P. troglodytes
ggtggcaggagagaga

SEQ ID NO: 255008 - DNA, 16 bp, P. troglodytes
ggtggcagggatggag

SEQ ID NO: 255009 - DNA, 16 bp, P. troglodytes
ggtggcaggggccaag

SEQ ID NO: 255010 - DNA, 16 bp, P. troglodytes
ggtggcaggttgatta

SEQ ID NO: 255011 - DNA, 16 bp, P. troglodytes
ggtggcagtggaggtg

SEQ ID NO: 255012 - DNA, 16 bp, P. troglodytes
ggtggcatgcatgtgt

SEQ ID NO: 255013 - DNA, 16 bp, P. troglodytes
ggtggcatggggagca

SEQ ID NO: 255014 - DNA, 16 bp, P. troglodytes
ggtggccaggggctgg

SEQ ID NO: 255015 - DNA, 16 bp, P. troglodytes
ggtggcccctgcctgt

SEQ ID NO: 255016 - DNA, 16 bp, P. troglodytes
ggtggccgaggtgggc

SEQ ID NO: 255017 - DNA, 16 bp, P. troglodytes
ggtggcctcaggaaac

SEQ ID NO: 255018 - DNA, 16 bp, P. troglodytes
ggtggccttgggcaag

SEQ ID NO: 255019 - DNA, 16 bp, P. troglodytes
ggtggcgggagcctgt

SEQ ID NO: 255020 - DNA, 16 bp, P. troglodytes
ggtggctcaagactgt

SEQ ID NO: 255021 - DNA, 19 bp, P. troglodytes
ggtggctcacatctgtaat

SEQ ID NO: 255022 - DNA, 16 bp, P. troglodytes
ggtggctcacccctgt

SEQ ID NO: 255023 - DNA, 20 bp, P. troglodytes
ggtggctcacgcctgtcatc

SEQ ID NO: 255024 - DNA, 19 bp, P. troglodytes
ggtggctcacgtctgtaat

SEQ ID NO: 255025 - DNA, 19 bp, P. troglodytes
ggtggctcatgccagtaat

SEQ ID NO: 255026 - DNA, 26 bp, P. troglodytes
ggtggctcatgcttgtaatcccagca

SEQ ID NO: 255027 - DNA, 16 bp, P. troglodytes
ggtggctgaggcgggc

SEQ ID NO: 255028 - DNA, 16 bp, P. troglodytes
ggtggctgcagctgca

SEQ ID NO: 255029 - DNA, 16 bp, P. troglodytes
ggtggctgccaggggc

SEQ ID NO: 255030 - DNA, 16 bp, P. troglodytes
ggtggctggctggctg

SEQ ID NO: 255031 - DNA, 16 bp, P. troglodytes
ggtggcttctagaagc

SEQ ID NO: 255032 - DNA, 16 bp, P. troglodytes
ggtggcttctgaggag

SEQ ID NO: 255033 - DNA, 16 bp, P. troglodytes
ggtgggaaaactggct

SEQ ID NO: 255034 - DNA, 16 bp, P. troglodytes
ggtgggaactggagtg

SEQ ID NO: 255035 - DNA, 16 bp, P. troglodytes
ggtgggaatgcagtgg

SEQ ID NO: 255036 - DNA, 16 bp, P. troglodytes
ggtgggagaatggttt

SEQ ID NO: 255037 - DNA, 16 bp, P. troglodytes
ggtgggagatgactgg

SEQ ID NO: 255038 - DNA, 16 bp, P. troglodytes
ggtgggagccaccaca

SEQ ID NO: 255039 - DNA, 16 bp, P. troglodytes
ggtgggaggaggcaga

SEQ ID NO: 255040 - DNA, 16 bp, P. troglodytes
ggtgggaggatcagct

SEQ ID NO: 255041 - DNA, 16 bp, P. troglodytes
ggtgggaggatggatt

SEQ ID NO: 255042 - DNA, 16 bp, P. troglodytes
ggtgggaggatggctc

SEQ ID NO: 255043 - DNA, 16 bp, P. troglodytes
ggtgggaggattgctc

SEQ ID NO: 255044 - DNA, 16 bp, P. troglodytes
ggtgggaggccaggag

SEQ ID NO: 255045 - DNA, 16 bp, P. troglodytes
ggtgggaggctctctt

SEQ ID NO: 255046 - DNA, 16 bp, P. troglodytes
ggtgggagggacctgg

SEQ ID NO: 255047 - DNA, 16 bp, P. troglodytes
ggtgggattacaggca

SEQ ID NO: 255048 - DNA, 16 bp, P. troglodytes
ggtgggattacaggta

SEQ ID NO: 255049 - DNA, 16 bp, P. troglodytes
ggtgggattacaggtg

SEQ ID NO: 255050 - DNA, 16 bp, P. troglodytes
ggtgggcacagtggct

SEQ ID NO: 255051 - DNA, 16 bp, P. troglodytes
ggtgggcacctgtggt

SEQ ID NO: 255052 - DNA, 16 bp, P. troglodytes
ggtgggcatcccggtg

SEQ ID NO: 255053 - DNA, 16 bp, P. troglodytes
ggtgggcatgtgagat

SEQ ID NO: 255054 - DNA, 16 bp, P. troglodytes
ggtgggcgccaccatg

SEQ ID NO: 255055 - DNA, 16 bp, P. troglodytes
ggtgggcggatcagga

SEQ ID NO: 255056 - DNA, 16 bp, P. troglodytes
ggtgggctcctcccag

SEQ ID NO: 255057 - DNA, 16 bp, P. troglodytes
ggtgggcttcacccag

SEQ ID NO: 255058 - DNA, 16 bp, P. troglodytes
ggtggggaacgtcaca

SEQ ID NO: 255059 - DNA, 16 bp, P. troglodytes
ggtggggacgcagagc

SEQ ID NO: 255060 - DNA, 16 bp, P. troglodytes
ggtggggagactgagg

SEQ ID NO: 255061 - DNA, 16 bp, P. troglodytes
ggtggggcagaggttg

SEQ ID NO: 255062 - DNA, 16 bp, P. troglodytes
ggtggggcctgagaat

SEQ ID NO: 255063 - DNA, 16 bp, P. troglodytes
ggtggggcctttgctg

SEQ ID NO: 255064 - DNA, 16 bp, P. troglodytes
ggtgggggctgtcctg

SEQ ID NO: 255065 - DNA, 16 bp, P. troglodytes
ggtggggtggctcagg

SEQ ID NO: 255066 - DNA, 16 bp, P. troglodytes
ggtggggtttcaccat

SEQ ID NO: 255067 - DNA, 16 bp, P. troglodytes
ggtgggtgcctgtgat

SEQ ID NO: 255068 - DNA, 16 bp, P. troglodytes
ggtgggtggctcacac

SEQ ID NO: 255069 - DNA, 16 bp, P. troglodytes
ggtgggtttttcccat

SEQ ID NO: 255070 - DNA, 16 bp, P. troglodytes
ggtggtacacgcttgt

SEQ ID NO: 255071 - DNA, 16 bp, P. troglodytes
ggtggtagtgatgatg

SEQ ID NO: 255072 - DNA, 16 bp, P. troglodytes
ggtggtcagggaaggc

SEQ ID NO: 255073 - DNA, 16 bp, P. troglodytes
ggtggtctcttcacac

SEQ ID NO: 255074 - DNA, 16 bp, P. troglodytes
ggtggtgataatgatg

SEQ ID NO: 255075 - DNA, 16 bp, P. troglodytes
ggtggtgcaaaagtaa

SEQ ID NO: 255076 - DNA, 16 bp, P. troglodytes
ggtggtgctgctgctg

SEQ ID NO: 255077 - DNA, 16 bp, P. troglodytes
ggtggtggaagctaca

SEQ ID NO: 255078 - DNA, 16 bp, P. troglodytes
ggtggtggaggctgca

SEQ ID NO: 255079 - DNA, 16 bp, P. troglodytes
ggtggtggcaggcacc

SEQ ID NO: 255080 - DNA, 16 bp, P. troglodytes
ggtggtggcagtggag

SEQ ID NO: 255081 - DNA, 16 bp, P. troglodytes
ggtggtggctgcagtg

SEQ ID NO: 255082 - DNA, 16 bp, P. troglodytes
ggtggtgggaacctgt

SEQ ID NO: 255083 - DNA, 16 bp, P. troglodytes
ggtggtgggctggatt

SEQ ID NO: 255084 - DNA, 16 bp, P. troglodytes
ggtggtggtggctgca

SEQ ID NO: 255085 - DNA, 16 bp, P. troglodytes
ggtggtggtggtgaca

SEQ ID NO: 255086 - DNA, 16 bp, P. troglodytes
ggtggtggttacacag

SEQ ID NO: 255087 - DNA, 16 bp, P. troglodytes
ggtggtgtgcacctac

SEQ ID NO: 255088 - DNA, 16 bp, P. troglodytes
ggtggtgtgcacctga

SEQ ID NO: 255089 - DNA, 16 bp, P. troglodytes
ggtggtgtgtacctgc

SEQ ID NO: 255090 - DNA, 16 bp, P. troglodytes
ggtggtgtgtacctgt

SEQ ID NO: 255091 - DNA, 16 bp, P. troglodytes
ggtggtgtgtgcctgt

SEQ ID NO: 255092 - DNA, 16 bp, P. troglodytes
ggtggttcacgcctct

SEQ ID NO: 255093 - DNA, 16 bp, P. troglodytes
ggtggttcatgtctgt

SEQ ID NO: 255094 - DNA, 16 bp, P. troglodytes
ggtggttccttaaaaa

SEQ ID NO: 255095 - DNA, 16 bp, P. troglodytes
ggtggttctggctcag

SEQ ID NO: 255096 - DNA, 16 bp, P. troglodytes
ggtggttgaggcagga

SEQ ID NO: 255097 - DNA, 16 bp, P. troglodytes
ggtggttgccaagggc

SEQ ID NO: 255098 - DNA, 16 bp, P. troglodytes
ggtggttgccaggggc

SEQ ID NO: 255099 - DNA, 16 bp, P. troglodytes
ggtgtaaagaaatgct

SEQ ID NO: 255100 - DNA, 16 bp, P. troglodytes
ggtgtaaatattccca

SEQ ID NO: 255101 - DNA, 16 bp, P. troglodytes
ggtgtatacatttatg

SEQ ID NO: 255102 - DNA, 16 bp, P. troglodytes
ggtgtatatatatata

SEQ ID NO: 255103 - DNA, 24 bp, P. troglodytes
ggtgtatatgtgccacattttctt

SEQ ID NO: 255104 - DNA, 16 bp, P. troglodytes
ggtgtatgtgtgcagg

SEQ ID NO: 255105 - DNA, 16 bp, P. troglodytes
ggtgtatgtttaactt

SEQ ID NO: 255106 - DNA, 16 bp, P. troglodytes
ggtgtattcagagatt

SEQ ID NO: 255107 - DNA, 16 bp, P. troglodytes
ggtgtcaacccgggag

SEQ ID NO: 255108 - DNA, 16 bp, P. troglodytes
ggtgtcagtgattgaa

SEQ ID NO: 255109 - DNA, 16 bp, P. troglodytes
ggtgtccaaccttttg

SEQ ID NO: 255110 - DNA, 16 bp, P. troglodytes
ggtgtctcacacaggg

SEQ ID NO: 255111 - DNA, 16 bp, P. troglodytes
ggtgtctctgtgtgtg

SEQ ID NO: 255112 - DNA, 16 bp, P. troglodytes
ggtgtgaaatggtatc

SEQ ID NO: 255113 - DNA, 17 bp, P. troglodytes
ggtgtgaacccaggagg

SEQ ID NO: 255114 - DNA, 16 bp, P. troglodytes
ggtgtgaacccggaag

SEQ ID NO: 255115 - DNA, 17 bp, P. troglodytes
ggtgtgaacccgggagg

SEQ ID NO: 255116 - DNA, 16 bp, P. troglodytes
ggtgtgagagaaagag

SEQ ID NO: 255117 - DNA, 16 bp, P. troglodytes
ggtgtgagccaccacc

SEQ ID NO: 255118 - DNA, 16 bp, P. troglodytes
ggtgtgagccatcaca

SEQ ID NO: 255119 - DNA, 16 bp, P. troglodytes
ggtgtgatgacagctc

SEQ ID NO: 255120 - DNA, 16 bp, P. troglodytes
ggtgtgatggcacaca

SEQ ID NO: 255121 - DNA, 16 bp, P. troglodytes
ggtgtgcaatggtgtg

SEQ ID NO: 255122 - DNA, 16 bp, P. troglodytes
ggtgtgcagaagcttt

SEQ ID NO: 255123 - DNA, 16 bp, P. troglodytes
ggtgtgcagtggcatg

SEQ ID NO: 255124 - DNA, 16 bp, P. troglodytes
ggtgtggaaagttggg

SEQ ID NO: 255125 - DNA, 16 bp, P. troglodytes
ggtgtggatgtggaga

SEQ ID NO: 255126 - DNA, 16 bp, P. troglodytes
ggtgtggcagtgggtg

SEQ ID NO: 255127 - DNA, 16 bp, P. troglodytes
ggtgtggctggagcag

SEQ ID NO: 255128 - DNA, 16 bp, P. troglodytes
ggtgtggtgacacatg

SEQ ID NO: 255129 - DNA, 16 bp, P. troglodytes
ggtgtggtgacatatg

SEQ ID NO: 255130 - DNA, 16 bp, P. troglodytes
ggtgtggtggcacatt

SEQ ID NO: 255131 - DNA, 16 bp, P. troglodytes
ggtgtggtggcagcca

SEQ ID NO: 255132 - DNA, 16 bp, P. troglodytes
ggtgtggtggccagtg

SEQ ID NO: 255133 - DNA, 16 bp, P. troglodytes
ggtgtggtggcgcacg

SEQ ID NO: 255134 - DNA, 16 bp, P. troglodytes
ggtgtggtgtctatta

SEQ ID NO: 255135 - DNA, 16 bp, P. troglodytes
ggtgtgtattttatac

SEQ ID NO: 255136 - DNA, 16 bp, P. troglodytes
ggtgtgtccggaattg

SEQ ID NO: 255137 - DNA, 16 bp, P. troglodytes
ggtgtgtgaaccagag

SEQ ID NO: 255138 - DNA, 16 bp, P. troglodytes
ggtgtgtgatgttccc

SEQ ID NO: 255139 - DNA, 16 bp, P. troglodytes
ggtgtgtgatgttcct

SEQ ID NO: 255140 - DNA, 16 bp, P. troglodytes
ggtgtgtgccactaca

SEQ ID NO: 255141 - DNA, 16 bp, P. troglodytes
ggtgtgtgccatcaca

SEQ ID NO: 255142 - DNA, 16 bp, P. troglodytes
ggtgtgtgctgccaca

SEQ ID NO: 255143 - DNA, 16 bp, P. troglodytes
ggtgtgtgtgcatgca

SEQ ID NO: 255144 - DNA, 16 bp, P. troglodytes
ggtgttaggtaagggt

SEQ ID NO: 255145 - DNA, 16 bp, P. troglodytes
ggtgttcagccactgc

SEQ ID NO: 255146 - DNA, 16 bp, P. troglodytes
ggtgttctgggctcag

SEQ ID NO: 255147 - DNA, 16 bp, P. troglodytes
ggtgttggcagggctg

SEQ ID NO: 255148 - DNA, 16 bp, P. troglodytes
ggtgttggcatctgct

SEQ ID NO: 255149 - DNA, 16 bp, P. troglodytes
ggtgtttctcgaagag

SEQ ID NO: 255150 - DNA, 16 bp, P. troglodytes
ggtgttttctaaatat

SEQ ID NO: 255151 - DNA, 16 bp, P. troglodytes
ggttaaatttgaattt

SEQ ID NO: 255152 - DNA, 16 bp, P. troglodytes
ggttaagtaacttgct

SEQ ID NO: 255153 - DNA, 16 bp, P. troglodytes
ggttaatgggtacaaa

SEQ ID NO: 255154 - DNA, 16 bp, P. troglodytes
ggttaatgtttgtatt

SEQ ID NO: 255155 - DNA, 16 bp, P. troglodytes
ggttaattgactcaca

SEQ ID NO: 255156 - DNA, 16 bp, P. troglodytes
ggttaatttccaaaat

SEQ ID NO: 255157 - DNA, 16 bp, P. troglodytes
ggttaatttctgtatt

SEQ ID NO: 255158 - DNA, 16 bp, P. troglodytes
ggttacagtcccacca

SEQ ID NO: 255159 - DNA, 16 bp, P. troglodytes
ggttacattttttaaa

SEQ ID NO: 255160 - DNA, 18 bp, P. troglodytes
ggttagccaggatggtct

SEQ ID NO: 255161 - DNA, 17 bp, P. troglodytes
ggttaggaagaatcaat

SEQ ID NO: 255162 - DNA, 21 bp, P. troglodytes
ggttaggcctccggataactg

SEQ ID NO: 255163 - DNA, 16 bp, P. troglodytes
ggttattcaggctctt

SEQ ID NO: 255164 - DNA, 16 bp, P. troglodytes
ggttcaaaatacacaa

SEQ ID NO: 255165 - DNA, 16 bp, P. troglodytes
ggttcaaacgattctc

SEQ ID NO: 255166 - DNA, 16 bp, P. troglodytes
ggttcaaatcccagat

SEQ ID NO: 255167 - DNA, 16 bp, P. troglodytes
ggttcaaattctagct

SEQ ID NO: 255168 - DNA, 16 bp, P. troglodytes
ggttcaactttgtgag

SEQ ID NO: 255169 - DNA, 16 bp, P. troglodytes
ggttcaagaccaccct

SEQ ID NO: 255170 - DNA, 16 bp, P. troglodytes
ggttcaagagattcta

SEQ ID NO: 255171 - DNA, 16 bp, P. troglodytes
ggttcaagcaattctg

SEQ ID NO: 255172 - DNA, 16 bp, P. troglodytes
ggttcaagccattctt

SEQ ID NO: 255173 - DNA, 16 bp, P. troglodytes
ggttcaagggattctc

SEQ ID NO: 255174 - DNA, 16 bp, P. troglodytes
ggttcaccacaacctc

SEQ ID NO: 255175 - DNA, 16 bp, P. troglodytes
ggttcacccatgttgt

SEQ ID NO: 255176 - DNA, 16 bp, P. troglodytes
ggttcacgccatcctc

SEQ ID NO: 255177 - DNA, 16 bp, P. troglodytes
ggttcactgcaacctc

SEQ ID NO: 255178 - DNA, 16 bp, P. troglodytes
ggttcactgcaacctt

SEQ ID NO: 255179 - DNA, 16 bp, P. troglodytes
ggttcaggagtttgag

SEQ ID NO: 255180 - DNA, 16 bp, P. troglodytes
ggttcaggatgcattt

SEQ ID NO: 255181 - DNA, 16 bp, P. troglodytes
ggttcaggctgcagtg

SEQ ID NO: 255182 - DNA, 16 bp, P. troglodytes
ggttcaggtgattgtc

SEQ ID NO: 255183 - DNA, 16 bp, P. troglodytes
ggttcatctatgttgc

SEQ ID NO: 255184 - DNA, 33 bp, P. troglodytes; identical to SEQ ID NO: 118642

SEQ ID NO: 255185 - DNA, 17 bp, P. troglodytes
ggttcatgccattctcc

SEQ ID NO: 255186 - DNA, 16 bp, P. troglodytes
ggttccagaccagcct

SEQ ID NO: 255187 - DNA, 16 bp, P. troglodytes
ggttccagctactcaa

SEQ ID NO: 255188 - DNA, 16 bp, P. troglodytes
ggttccagggattaag

SEQ ID NO: 255189 - DNA, 16 bp, P. troglodytes
ggttccaggtggacat

SEQ ID NO: 255190 - DNA, 16 bp, P. troglodytes
ggttcccttctggccc

SEQ ID NO: 255191 - DNA, 16 bp, P. troglodytes
ggttcctcagaaaatt

SEQ ID NO: 255192 - DNA, 16 bp, P. troglodytes
ggttcctcattactta

SEQ ID NO: 255193 - DNA, 16 bp, P. troglodytes
ggttctctattatgtt

SEQ ID NO: 255194 - DNA, 16 bp, P. troglodytes
ggttctctgcatttct

SEQ ID NO: 255195 - DNA, 16 bp, P. troglodytes
ggttctgcaggctgta

SEQ ID NO: 255196 - DNA, 16 bp, P. troglodytes
ggttctgttcattttt

SEQ ID NO: 255197 - DNA, 16 bp, P. troglodytes
ggttctgtttatatga

SEQ ID NO: 255198 - DNA, 16 bp, P. troglodytes
ggttcttggcttcctt

SEQ ID NO: 255199 - DNA, 16 bp, P. troglodytes
ggttctttccagtttt

SEQ ID NO: 255200 - DNA, 16 bp, P. troglodytes
ggttctttctattttc

SEQ ID NO: 255201 - DNA, 16 bp, P. troglodytes
ggttgaaactttcagc

SEQ ID NO: 255202 - DNA, 16 bp, P. troglodytes
ggttgaaagagttatt

SEQ ID NO: 255203 - DNA, 16 bp, P. troglodytes
ggttgaaatgaaagaa

SEQ ID NO: 255204 - DNA, 16 bp, P. troglodytes
ggttgaacccaggagg

SEQ ID NO: 255205 - DNA, 16 bp, P. troglodytes
ggttgaattgtgtccc

SEQ ID NO: 255206 - DNA, 16 bp, P. troglodytes
ggttgactctatgtct

SEQ ID NO: 255207 - DNA, 16 bp, P. troglodytes
ggttgagcccaggagg

SEQ ID NO: 255208 - DNA, 16 bp, P. troglodytes
ggttgaggaccactgc

SEQ ID NO: 255209 - DNA, 16 bp, P. troglodytes
ggttgaggaggcctca

SEQ ID NO: 255210 - DNA, 16 bp, P. troglodytes
ggttgaggcaagtgga

SEQ ID NO: 255211 - DNA, 18 bp, P. troglodytes
ggttgaggttgcagtgag

SEQ ID NO: 255212 - DNA, 16 bp, P. troglodytes
ggttgcaaagagccga

SEQ ID NO: 255213 - DNA, 16 bp, P. troglodytes
ggttgcaatgggctga

SEQ ID NO: 255214 - DNA, 16 bp, P. troglodytes
ggttgcagcagagaaa

SEQ ID NO: 255215 - DNA, 16 bp, P. troglodytes
ggttgcattattttga

SEQ ID NO: 255216 - DNA, 16 bp, P. troglodytes
ggttgcattgagctat

SEQ ID NO: 255217 - DNA, 16 bp, P. troglodytes
ggttgccagaagctgg

SEQ ID NO: 255218 - DNA, 16 bp, P. troglodytes
ggttgccaggcagagg

SEQ ID NO: 255219 - DNA, 16 bp, P. troglodytes
ggttgcccaggctagt

SEQ ID NO: 255220 - DNA, 16 bp, P. troglodytes
ggttgcctaggactgg

SEQ ID NO: 255221 - DNA, 16 bp, P. troglodytes
ggttgccttttcattt

SEQ ID NO: 255222 - DNA, 16 bp, P. troglodytes
ggttggaaagtccaag

SEQ ID NO: 255223 - DNA, 16 bp, P. troglodytes
ggttggacaagcttgc

SEQ ID NO: 255224 - DNA, 16 bp, P. troglodytes
ggttggagaccagcct

SEQ ID NO: 255225 - DNA, 18 bp, P. troglodytes
ggttggagtgcaatggca

SEQ ID NO: 255226 - DNA, 16 bp, P. troglodytes
ggttggtgaacacatc

SEQ ID NO: 255227 - DNA, 16 bp, P. troglodytes
ggttggtgcagaagta

SEQ ID NO: 255228 - DNA, 16 bp, P. troglodytes
ggttggttccaggacc

SEQ ID NO: 255229 - DNA, 16 bp, P. troglodytes
ggttgtagatgtgtgg

SEQ ID NO: 255230 - DNA, 16 bp, P. troglodytes
ggttgtctcttcactt

SEQ ID NO: 255231 - DNA, 16 bp, P. troglodytes
ggttgtggtgagccta

SEQ ID NO: 255232 - DNA, 16 bp, P. troglodytes
ggttgttgtaaggatt

SEQ ID NO: 255233 - DNA, 16 bp, P. troglodytes
ggttgttgtgaggact

SEQ ID NO: 255234 - DNA, 16 bp, P. troglodytes
ggttgtttccactttg

SEQ ID NO: 255235 - DNA, 16 bp, P. troglodytes
ggttgtttctactttt

SEQ ID NO: 255236 - DNA, 16 bp, P. troglodytes
ggtttaagtgattctc

SEQ ID NO: 255237 - DNA, 16 bp, P. troglodytes
ggtttaagtgattctt

SEQ ID NO: 255238 - DNA, 16 bp, P. troglodytes
ggtttaatgaaaatag

SEQ ID NO: 255239 - DNA, 16 bp, P. troglodytes
ggtttacaaatatttt

SEQ ID NO: 255240 - DNA, 16 bp, P. troglodytes
ggtttacctgatgctt

SEQ ID NO: 255241 - DNA, 16 bp, P. troglodytes
ggtttagcaccacccc

SEQ ID NO: 255242 - DNA, 16 bp, P. troglodytes
ggtttatctctgtgag

SEQ ID NO: 255243 - DNA, 16 bp, P. troglodytes
ggtttatgcagaaatt

SEQ ID NO: 255244 - DNA, 16 bp, P. troglodytes
ggtttattgagagttt

SEQ ID NO: 255245 - DNA, 16 bp, P. troglodytes
ggtttatttctcactc

SEQ ID NO: 255246 - DNA, 16 bp, P. troglodytes
ggtttattttgccaag

SEQ ID NO: 255247 - DNA, 16 bp, P. troglodytes
ggtttcaaacccctga

SEQ ID NO: 255248 - DNA, 16 bp, P. troglodytes
ggtttcaaagaacttg

SEQ ID NO: 255249 - DNA, 16 bp, P. troglodytes
ggtttcaacatataaa

SEQ ID NO: 255250 - DNA, 16 bp, P. troglodytes
ggtttcaccatactgg

SEQ ID NO: 255251 - DNA, 16 bp, P. troglodytes
ggtttcaccatattgt

SEQ ID NO: 255252 - DNA, 16 bp, P. troglodytes
ggtttcaccatgtcaa

SEQ ID NO: 255253 - DNA, 22 bp, P. troglodytes
ggtttcaccatgttggccaggt

SEQ ID NO: 255254 - DNA, 16 bp, P. troglodytes
ggtttcactgtgttaa

SEQ ID NO: 255255 - DNA, 21 bp, P. troglodytes
ggtttcactgtgttagccagc

SEQ ID NO: 255256 - DNA, 16 bp, P. troglodytes
ggtttcagctcactgc

SEQ ID NO: 255257 - DNA, 16 bp, P. troglodytes
ggtttcagttacctgc

SEQ ID NO: 255258 - DNA, 16 bp, P. troglodytes
ggtttcatcattttgg

SEQ ID NO: 255259 - DNA, 16 bp, P. troglodytes
ggtttcatttgctctt

SEQ ID NO: 255260 - DNA, 16 bp, P. troglodytes
ggtttccccatactgt

SEQ ID NO: 255261 - DNA, 16 bp, P. troglodytes
ggtttcccccatgctg

SEQ ID NO: 255262 - DNA, 16 bp, P. troglodytes
ggtttcctcatctgta

SEQ ID NO: 255263 - DNA, 16 bp, P. troglodytes
ggtttcctgggccagg

SEQ ID NO: 255264 - DNA, 16 bp, P. troglodytes
ggtttcctgttcttgt

SEQ ID NO: 255265 - DNA, 16 bp, P. troglodytes
ggtttcgccatgttgt

SEQ ID NO: 255266 - DNA, 16 bp, P. troglodytes
ggtttctcaacctcag

SEQ ID NO: 255267 - DNA, 16 bp, P. troglodytes
ggtttctgttacttgc

SEQ ID NO: 255268 - DNA, 16 bp, P. troglodytes
ggtttctttctgaggt

SEQ ID NO: 255269 - DNA, 16 bp, P. troglodytes
ggtttgaaaaaggaaa

SEQ ID NO: 255270 - DNA, 16 bp, P. troglodytes
ggtttgaatcctggct

SEQ ID NO: 255271 - DNA, 16 bp, P. troglodytes
ggtttgaatctcagct

SEQ ID NO: 255272 - DNA, 16 bp, P. troglodytes
ggtttgaatgccagct

SEQ ID NO: 255273 - DNA, 16 bp, P. troglodytes
ggtttgaatgtgtctc

SEQ ID NO: 255274 - DNA, 16 bp, P. troglodytes
ggtttgactatgtccc

SEQ ID NO: 255275 - DNA, 16 bp, P. troglodytes
ggtttgagaagttctc

SEQ ID NO: 255276 - DNA, 16 bp, P. troglodytes
ggtttgccatgttgcc

SEQ ID NO: 255277 - DNA, 16 bp, P. troglodytes
ggtttgctgcaacctc

SEQ ID NO: 255278 - DNA, 16 bp, P. troglodytes
ggtttggagtacaaat

SEQ ID NO: 255279 - DNA, 16 bp, P. troglodytes
ggtttggctgtatccc

SEQ ID NO: 255280 - DNA, 16 bp, P. troglodytes
ggtttggggacccctg

SEQ ID NO: 255281 - DNA, 16 bp, P. troglodytes
ggtttggggtacagat

SEQ ID NO: 255282 - DNA, 16 bp, P. troglodytes
ggtttggggttttaca

SEQ ID NO: 255283 - DNA, 16 bp, P. troglodytes
ggtttgtagttttctt

SEQ ID NO: 255284 - DNA, 16 bp, P. troglodytes
ggtttgtgccaccaca

SEQ ID NO: 255285 - DNA, 16 bp, P. troglodytes
ggtttgtggaagatca

SEQ ID NO: 255286 - DNA, 16 bp, P. troglodytes
ggtttgttgtgagaat

SEQ ID NO: 255287 - DNA, 16 bp, P. troglodytes
ggttttaaaaagagga

SEQ ID NO: 255288 - DNA, 16 bp, P. troglodytes
ggttttaaaaataatt

SEQ ID NO: 255289 - DNA, 16 bp, P. troglodytes
ggttttaaaatatatt

SEQ ID NO: 255290 - DNA, 16 bp, P. troglodytes
ggttttaaattgcatt

SEQ ID NO: 255291 - DNA, 17 bp, P. troglodytes
ggttttaagccccgcat

SEQ ID NO: 255292 - DNA, 16 bp, P. troglodytes
ggttttaatcataaaa

SEQ ID NO: 255293 - DNA, 16 bp, P. troglodytes
ggttttaccatgatgg

SEQ ID NO: 255294 - DNA, 17 bp, P. troglodytes
ggttttaggtctaacat

SEQ ID NO: 255295 - DNA, 16 bp, P. troglodytes
ggttttatacattcta

SEQ ID NO: 255296 - DNA, 20 bp, P. troglodytes
ggttttataccgagacattc

SEQ ID NO: 255297 - DNA, 16 bp, P. troglodytes
ggttttatgccctgag

SEQ ID NO: 255298 - DNA, 16 bp, P. troglodytes
ggttttcactgtgttg

SEQ ID NO: 255299 - DNA, 16 bp, P. troglodytes
ggttttcactttcttc

SEQ ID NO: 255300 - DNA, 16 bp, P. troglodytes
ggttttcataaagcca

SEQ ID NO: 255301 - DNA, 16 bp, P. troglodytes
ggttttcatgtctcta

SEQ ID NO: 255302 - DNA, 16 bp, P. troglodytes
ggttttccaaagtggt

SEQ ID NO: 255303 - DNA, 16 bp, P. troglodytes
ggttttccaatttatt

SEQ ID NO: 255304 - DNA, 16 bp, P. troglodytes
ggttttcccctcacag

SEQ ID NO: 255305 - DNA, 16 bp, P. troglodytes
ggttttctgtttactc

SEQ ID NO: 255306 - DNA, 16 bp, P. troglodytes
ggttttgctgtctcag

SEQ ID NO: 255307 - DNA, 16 bp, P. troglodytes
ggtttttaacatgaag

SEQ ID NO: 255308 - DNA, 16 bp, P. troglodytes
ggtttttcaacccttg

SEQ ID NO: 255309 - DNA, 16 bp, P. troglodytes
ggtttttcaaggatag

SEQ ID NO: 255310 - DNA, 16 bp, P. troglodytes
ggtttttctatttctg

SEQ ID NO: 255311 - DNA, 16 bp, P. troglodytes
ggtttttctttatagc

SEQ ID NO: 255312 - DNA, 16 bp, P. troglodytes
ggtttttgaaaggatc

SEQ ID NO: 255313 - DNA, 16 bp, P. troglodytes
ggtttttgtggggact

SEQ ID NO: 255314 - DNA, 16 bp, P. troglodytes
ggttttttaaataaaa

SEQ ID NO: 255315 - DNA, 16 bp, P. troglodytes
ggttttttgaaaagac

SEQ ID NO: 255316 - DNA, 16 bp, P. troglodytes
gtaaaaatgcagattc

SEQ ID NO: 255317 - DNA, 16 bp, P. troglodytes
gtaaaaatgttctccc

SEQ ID NO: 255318 - DNA, 16 bp, P. troglodytes
gtaaaacccatctcta

SEQ ID NO: 255319 - DNA, 16 bp, P. troglodytes
gtaaaactgtctttat

SEQ ID NO: 255320 - DNA, 16 bp, P. troglodytes
gtaaaagactggttaa

SEQ ID NO: 255321 - DNA, 16 bp, P. troglodytes
gtaaaataaggctgaa

SEQ ID NO: 255322 - DNA, 16 bp, P. troglodytes
gtaaaatacagtaaaa

SEQ ID NO: 255323 - DNA, 16 bp, P. troglodytes
gtaaaatatatacaac

SEQ ID NO: 255324 - DNA, 16 bp, P. troglodytes
gtaaaatattttgact

SEQ ID NO: 255325 - DNA, 16 bp, P. troglodytes
gtaaaatattttgatt

SEQ ID NO: 255326 - DNA, 16 bp, P. troglodytes
gtaaaatgcaaataaa

SEQ ID NO: 255327 - DNA, 16 bp, P. troglodytes
gtaaaatgctatcaaa

SEQ ID NO: 255328 - DNA, 28 bp, P. troglodytes
gtaaaatggaccaatcagcaggacatgg

SEQ ID NO: 255329 - DNA, 16 bp, P. troglodytes
gtaaaatggaccaatt

SEQ ID NO: 255330 - DNA, 16 bp, P. troglodytes
gtaaaatgggataatg

SEQ ID NO: 255331 - DNA, 16 bp, P. troglodytes
gtaaacattttgttaa

SEQ ID NO: 255332 - DNA, 16 bp, P. troglodytes
gtaaaccatatatctg

SEQ ID NO: 255333 - DNA, 16 bp, P. troglodytes
gtaaagacggggtttt

SEQ ID NO: 255334 - DNA, 16 bp, P. troglodytes
gtaaagctgttttctt

SEQ ID NO: 255335 - DNA, 16 bp, P. troglodytes
gtaaagggatggctgg

SEQ ID NO: 255336 - DNA, 16 bp, P. troglodytes
gtaaagggccagagag

SEQ ID NO: 255337 - DNA, 16 bp, P. troglodytes
gtaaatacatatataa

SEQ ID NO: 255338 - DNA, 16 bp, P. troglodytes
gtaaatacatttaaaa

SEQ ID NO: 255339 - DNA, 16 bp, P. troglodytes
gtaaataccaaagagt

SEQ ID NO: 255340 - DNA, 16 bp, P. troglodytes
gtaaatagttcaaaat

SEQ ID NO: 255341 - DNA, 16 bp, P. troglodytes
gtaaatagttgttatt

SEQ ID NO: 255342 - DNA, 16 bp, P. troglodytes
gtaaatatgtaaaatt

SEQ ID NO: 255343 - DNA, 16 bp, P. troglodytes
gtaaatattttacata

SEQ ID NO: 255344 - DNA, 16 bp, P. troglodytes
gtaaatattttaggct

SEQ ID NO: 255345 - DNA, 16 bp, P. troglodytes
gtaaatctaagagtta

SEQ ID NO: 255346 - DNA, 16 bp, P. troglodytes
gtaaatgatgaaatta

SEQ ID NO: 255347 - DNA, 16 bp, P. troglodytes
gtaaatgcatcaatca

SEQ ID NO: 255348 - DNA, 16 bp, P. troglodytes
gtaaatgccattattt

SEQ ID NO: 255349 - DNA, 16 bp, P. troglodytes
gtaaatgtatgtttaa

SEQ ID NO: 255350 - DNA, 16 bp, P. troglodytes
gtaaatgtttattgag

SEQ ID NO: 255351 - DNA, 16 bp, P. troglodytes
gtaaatgtttcttttc

SEQ ID NO: 255352 - DNA, 16 bp, P. troglodytes
gtaaattaaaaacctt

SEQ ID NO: 255353 - DNA, 16 bp, P. troglodytes
gtaaattatacatcaa

SEQ ID NO: 255354 - DNA, 16 bp, P. troglodytes
gtaaattgaaaatatt

SEQ ID NO: 255355 - DNA, 16 bp, P. troglodytes
gtaaattgaacaattt

SEQ ID NO: 255356 - DNA, 16 bp, P. troglodytes
gtaaattgcatgttgt

SEQ ID NO: 255357 - DNA, 16 bp, P. troglodytes
gtaaatttcaaatatt

SEQ ID NO: 255358 - DNA, 16 bp, P. troglodytes
gtaaatttgtttttct

SEQ ID NO: 255359 - DNA, 16 bp, P. troglodytes
gtaaattttacattat

SEQ ID NO: 255360 - DNA, 16 bp, P. troglodytes
gtaaattttagaattt

SEQ ID NO: 255361 - DNA, 16 bp, P. troglodytes
gtaaattttatgttaa

SEQ ID NO: 255362 - DNA, 16 bp, P. troglodytes
gtaaattttcttccat

SEQ ID NO: 255363 - DNA, 16 bp, P. troglodytes
gtaaatttttgttgaa

SEQ ID NO: 255364 - DNA, 16 bp, P. troglodytes
gtaacaaattaccaaa

SEQ ID NO: 255365 - DNA, 16 bp, P. troglodytes
gtaacaaattaccacc

SEQ ID NO: 255366 - DNA, 16 bp, P. troglodytes
gtaacacacacacaca

SEQ ID NO: 255367 - DNA, 16 bp, P. troglodytes
gtaacagaatatcaca

SEQ ID NO: 255368 - DNA, 16 bp, P. troglodytes
gtaacagagccagact

SEQ ID NO: 255369 - DNA, 16 bp, P. troglodytes
gtaacagatataataa

SEQ ID NO: 255370 - DNA, 16 bp, P. troglodytes
gtaacatcaaaggtca

SEQ ID NO: 255371 - DNA, 16 bp, P. troglodytes
gtaaccattttgaaat

SEQ ID NO: 255372 - DNA, 16 bp, P. troglodytes
gtaactgagacagtga

SEQ ID NO: 255373 - DNA, 16 bp, P. troglodytes
gtaactgagagtggtg

SEQ ID NO: 255374 - DNA, 16 bp, P. troglodytes
gtaacttataaacaaa

SEQ ID NO: 255375 - DNA, 16 bp, P. troglodytes
gtaacttgaatccaca

SEQ ID NO: 255376 - DNA, 16 bp, P. troglodytes
gtaactttagccccaa

SEQ ID NO: 255377 - DNA, 16 bp, P. troglodytes
gtaactttgctgaatt

SEQ ID NO: 255378 - DNA, 16 bp, P. troglodytes
gtaactttggaaaaca

SEQ ID NO: 255379 - DNA, 16 bp, P. troglodytes
gtaagaaaatattttc

SEQ ID NO: 255380 - DNA, 16 bp, P. troglodytes
gtaagaacaaaaaacc

SEQ ID NO: 255381 - DNA, 16 bp, P. troglodytes
gtaagaactcaataaa

SEQ ID NO: 255382 - DNA, 16 bp, P. troglodytes
gtaagaaggcaccaag

SEQ ID NO: 255383 - DNA, 16 bp, P. troglodytes
gtaagaatatagtata

SEQ ID NO: 255384 - DNA, 16 bp, P. troglodytes
gtaagacctcaaactg

SEQ ID NO: 255385 - DNA, 16 bp, P. troglodytes
gtaagagctcaataaa

SEQ ID NO: 255386 - DNA, 16 bp, P. troglodytes
gtaagatgcctgctcc

SEQ ID NO: 255387 - DNA, 16 bp, P. troglodytes
gtaagatttgggtggg

SEQ ID NO: 255388 - DNA, 16 bp, P. troglodytes
gtaagccaccacgccc

SEQ ID NO: 255389 - DNA, 16 bp, P. troglodytes
gtaagccaccgtgccc

SEQ ID NO: 255390 - DNA, 16 bp, P. troglodytes
gtaagccactgtgccc

SEQ ID NO: 255391 - DNA, 16 bp, P. troglodytes
gtaagccatgatcata

SEQ ID NO: 255392 - DNA, 16 bp, P. troglodytes
gtaagccatgatggca

SEQ ID NO: 255393 - DNA, 16 bp, P. troglodytes
gtaagctagagaaaaa

SEQ ID NO: 255394 - DNA, 16 bp, P. troglodytes
gtaagctctgcctcct

SEQ ID NO: 255395 - DNA, 16 bp, P. troglodytes
gtaaggaagagaagtg

SEQ ID NO: 255396 - DNA, 16 bp, P. troglodytes
gtaaggactttggctt

SEQ ID NO: 255397 - DNA, 16 bp, P. troglodytes
gtaagtaaagttttat

SEQ ID NO: 255398 - DNA, 16 bp, P. troglodytes
gtaagtaagtaagtaa

SEQ ID NO: 255399 - DNA, 16 bp, P. troglodytes
gtaagtccaaaatcca

SEQ ID NO: 255400 - DNA, 16 bp, P. troglodytes
gtaagtggtgaagcca

SEQ ID NO: 255401 - DNA, 16 bp, P. troglodytes
gtaagtgttctgagca

SEQ ID NO: 255402 - DNA, 16 bp, P. troglodytes
gtaagttctcacgaga

SEQ ID NO: 255403 - DNA, 16 bp, P. troglodytes
gtaataaaaaatctac

SEQ ID NO: 255404 - DNA, 16 bp, P. troglodytes
gtaataaatacatttt

SEQ ID NO: 255405 - DNA, 16 bp, P. troglodytes
gtaataaatctcttcc

SEQ ID NO: 255406 - DNA, 16 bp, P. troglodytes
gtaataacaaactctt

SEQ ID NO: 255407 - DNA, 16 bp, P. troglodytes
gtaataccagcacctt

SEQ ID NO: 255408 - DNA, 16 bp, P. troglodytes
gtaatagaaataaagt

SEQ ID NO: 255409 - DNA, 16 bp, P. troglodytes
gtaataggtgctcaat

SEQ ID NO: 255410 - DNA, 16 bp, P. troglodytes
gtaatatggtttggct

SEQ ID NO: 255411 - DNA, 16 bp, P. troglodytes
gtaatattccattgta

SEQ ID NO: 255412 - DNA, 16 bp, P. troglodytes
gtaatattttcctgtt

SEQ ID NO: 255413 - DNA, 16 bp, P. troglodytes
gtaatcaagacagtat

SEQ ID NO: 255414 - DNA, 17 bp, P. troglodytes
gtaatcccagcactcta

SEQ ID NO: 255415 - DNA, 16 bp, P. troglodytes
gtaatcccagcacttc

SEQ ID NO: 255416 - DNA, 16 bp, P. troglodytes
gtaatcccagttaccc

SEQ ID NO: 255417 - DNA, 16 bp, P. troglodytes
gtaatcctagaatttt

SEQ ID NO: 255418 - DNA, 16 bp, P. troglodytes
gtaatcctagctgctc

SEQ ID NO: 255419 - DNA, 16 bp, P. troglodytes
gtaatctttggtaaat

SEQ ID NO: 255420 - DNA, 16 bp, P. troglodytes
gtaatgaatgagagtt

SEQ ID NO: 255421 - DNA, 16 bp, P. troglodytes
gtaatgaatgtggcaa

SEQ ID NO: 255422 - DNA, 16 bp, P. troglodytes
gtaatgatggtgatga

SEQ ID NO: 255423 - DNA, 16 bp, P. troglodytes
gtaatgccagcatttt

SEQ ID NO: 255424 - DNA, 16 bp, P. troglodytes
gtaatgccagcgcttt

SEQ ID NO: 255425 - DNA, 16 bp, P. troglodytes
gtaatgctgacctcat

SEQ ID NO: 255426 - DNA, 16 bp, P. troglodytes
gtaatgtttcaggata

SEQ ID NO: 255427 - DNA, 19 bp, P. troglodytes
gtaattaatagcctaccaa

SEQ ID NO: 255428 - DNA, 16 bp, P. troglodytes
gtaattacattttaaa

SEQ ID NO: 255429 - DNA, 16 bp, P. troglodytes
gtaattaggccatgag

SEQ ID NO: 255430 - DNA, 16 bp, P. troglodytes
gtaattctaacacttt

SEQ ID NO: 255431 - DNA, 16 bp, P. troglodytes
gtaattctcattgcag

SEQ ID NO: 255432 - DNA, 16 bp, P. troglodytes
gtaattgaaccatggg

SEQ ID NO: 255433 - DNA, 16 bp, P. troglodytes
gtaattgaatcatgaa

SEQ ID NO: 255434 - DNA, 16 bp, P. troglodytes
gtaattgagactactg

SEQ ID NO: 255435 - DNA, 16 bp, P. troglodytes
gtaatttatagattca

SEQ ID NO: 255436 - DNA, 16 bp, P. troglodytes
gtaatttcagtttttg

SEQ ID NO: 255437 - DNA, 16 bp, P. troglodytes
gtaatttgttacagca

SEQ ID NO: 255438 - DNA, 16 bp, P. troglodytes
gtaattttacacaata

SEQ ID NO: 255439 - DNA, 16 bp, P. troglodytes
gtaatttttttcatat

SEQ ID NO: 255440 - DNA, 16 bp, P. troglodytes
gtaattttttttcaaa

SEQ ID NO: 255441 - DNA, 16 bp, P. troglodytes
gtacaaaaataaactc

SEQ ID NO: 255442 - DNA, 16 bp, P. troglodytes
gtacaaaaatcacaag

SEQ ID NO: 255443 - DNA, 16 bp, P. troglodytes
gtacaaaagtttttaa

SEQ ID NO: 255444 - DNA, 16 bp, P. troglodytes
gtacaaagaagagctg

SEQ ID NO: 255445 - DNA, 16 bp, P. troglodytes
gtacaaagtttcaatt

SEQ ID NO: 255446 - DNA, 16 bp, P. troglodytes
gtacaaagttttagtt

SEQ ID NO: 255447 - DNA, 16 bp, P. troglodytes
gtacaacaaaccctca

SEQ ID NO: 255448 - DNA, 16 bp, P. troglodytes
gtacaaggagaagctg

SEQ ID NO: 255449 - DNA, 16 bp, P. troglodytes
gtacaaggcaaggatg

SEQ ID NO: 255450 - DNA, 16 bp, P. troglodytes
gtacaatgtaatgttt

SEQ ID NO: 255451 - DNA, 16 bp, P. troglodytes
gtacaatgttagctgt

SEQ ID NO: 255452 - DNA, 16 bp, P. troglodytes
gtacacaatgtgcagg

SEQ ID NO: 255453 - DNA, 16 bp, P. troglodytes
gtacacacacatatat

SEQ ID NO: 255454 - DNA, 18 bp, P. troglodytes
gtacaccatggaatacta

SEQ ID NO: 255455 - DNA, 16 bp, P. troglodytes
gtacacctggctctgc

SEQ ID NO: 255456 - DNA, 16 bp, P. troglodytes
gtacactgttggtggg

SEQ ID NO: 255457 - DNA, 16 bp, P. troglodytes
gtacagaatttcagtt

SEQ ID NO: 255458 - DNA, 16 bp, P. troglodytes
gtacagagtttcagtt

SEQ ID NO: 255459 - DNA, 16 bp, P. troglodytes
gtacagcaaaaataca

SEQ ID NO: 255460 - DNA, 16 bp, P. troglodytes
gtacagcagcagcaga

SEQ ID NO: 255461 - DNA, 16 bp, P. troglodytes
gtacagcctgcaggac

SEQ ID NO: 255462 - DNA, 16 bp, P. troglodytes
gtacaggtgcctgcca

SEQ ID NO: 255463 - DNA, 16 bp, P. troglodytes
gtacagtaaaaatatg

SEQ ID NO: 255464 - DNA, 16 bp, P. troglodytes
gtacagtcatagctca

SEQ ID NO: 255465 - DNA, 16 bp, P. troglodytes
gtacagtcatcccttg

SEQ ID NO: 255466 - DNA, 16 bp, P. troglodytes
gtacagtcatgcactg

SEQ ID NO: 255467 - DNA, 16 bp, P. troglodytes
gtacagtggcaaaatc

SEQ ID NO: 255468 - DNA, 16 bp, P. troglodytes
gtacatagtaggcact

SEQ ID NO: 255469 - DNA, 16 bp, P. troglodytes
gtacatatatatatat

SEQ ID NO: 255470 - DNA, 16 bp, P. troglodytes
gtacatatcttaattt

SEQ ID NO: 255471 - DNA, 16 bp, P. troglodytes
gtacatatgtgtgtat

SEQ ID NO: 255472 - DNA, 16 bp, P. troglodytes
gtacatgaaacaaagt

SEQ ID NO: 255473 - DNA, 16 bp, P. troglodytes
gtacatgtgaagattt

SEQ ID NO: 255474 - DNA, 16 bp, P. troglodytes
gtacatgtgcacaaag

SEQ ID NO: 255475 - DNA, 16 bp, P. troglodytes
gtacattggttcagtc

SEQ ID NO: 255476 - DNA, 16 bp, P. troglodytes
gtacatttacattgtt

SEQ ID NO: 255477 - DNA, 19 bp, P. troglodytes
gtaccaaaacagaaatata

SEQ ID NO: 255478 - DNA, 16 bp, P. troglodytes
gtaccaatttaatgta

SEQ ID NO: 255479 - DNA, 16 bp, P. troglodytes
gtaccacaaaaacagt

SEQ ID NO: 255480 - DNA, 16 bp, P. troglodytes
gtaccacagtttatcc

SEQ ID NO: 255481 - DNA, 16 bp, P. troglodytes
gtaccacattttcttt

SEQ ID NO: 255482 - DNA, 16 bp, P. troglodytes
gtaccaccacacctgg

SEQ ID NO: 255483 - DNA, 16 bp, P. troglodytes
gtaccagaatctctgg

SEQ ID NO: 255484 - DNA, 16 bp, P. troglodytes
gtaccaggagtggggt

SEQ ID NO: 255485 - DNA, 16 bp, P. troglodytes
gtaccagttattcctt

SEQ ID NO: 255486 - DNA, 16 bp, P. troglodytes
gtacccagagacacaa

SEQ ID NO: 255487 - DNA, 16 bp, P. troglodytes
gtacccattaaccatc

SEQ ID NO: 255488 - DNA, 16 bp, P. troglodytes
gtacccctcaacccct

SEQ ID NO: 255489 - DNA, 16 bp, P. troglodytes
gtaccggtctgtggcc

SEQ ID NO: 255490 - DNA, 16 bp, P. troglodytes
gtacctacctcacagg

SEQ ID NO: 255491 - DNA, 16 bp, P. troglodytes
gtacctgtctgtggcc

SEQ ID NO: 255492 - DNA, 16 bp, P. troglodytes
gtacctgtgactttgt

SEQ ID NO: 255493 - DNA, 16 bp, P. troglodytes
gtacctttctctttgg

SEQ ID NO: 255494 - DNA, 16 bp, P. troglodytes
gtactcaggaggctga

SEQ ID NO: 255495 - DNA, 16 bp, P. troglodytes
gtactccagccttggt

SEQ ID NO: 255496 - DNA, 16 bp, P. troglodytes
gtactcctgcctgggc

SEQ ID NO: 255497 - DNA, 16 bp, P. troglodytes
gtactgaaagtgaaaa

SEQ ID NO: 255498 - DNA, 16 bp, P. troglodytes
gtactgctatgaacat

SEQ ID NO: 255499 - DNA, 16 bp, P. troglodytes
gtactgctgccatctc

SEQ ID NO: 255500 - DNA, 16 bp, P. troglodytes
gtactggtcagtggcc

SEQ ID NO: 255501 - DNA, 16 bp, P. troglodytes
gtactggtccgtggcc

SEQ ID NO: 255502 - DNA, 16 bp, P. troglodytes
gtacttctcaaacttt

SEQ ID NO: 255503 - DNA, 16 bp, P. troglodytes
gtactttaaggtttgg

SEQ ID NO: 255504 - DNA, 16 bp, P. troglodytes
gtacttttggtgtcat

SEQ ID NO: 255505 - DNA, 16 bp, P. troglodytes
gtacttttttctaatt

SEQ ID NO: 255506 - DNA, 16 bp, P. troglodytes
gtagaaaaatattttt

SEQ ID NO: 255507 - DNA, 16 bp, P. troglodytes
gtagaaaacagtttgg

SEQ ID NO: 255508 - DNA, 16 bp, P. troglodytes
gtagaaaagaaaagcc

SEQ ID NO: 255509 - DNA, 16 bp, P. troglodytes
gtagaaacagggtttc

SEQ ID NO: 255510 - DNA, 16 bp, P. troglodytes
gtagaaatggggtttt

SEQ ID NO: 255511 - DNA, 16 bp, P. troglodytes
gtagaaattgtgaatg

SEQ ID NO: 255512 - DNA, 16 bp, P. troglodytes
gtagaaatttggaaaa

SEQ ID NO: 255513 - DNA, 16 bp, P. troglodytes
gtagaaccaaaaaaga

SEQ ID NO: 255514 - DNA, 16 bp, P. troglodytes
gtagaactacaaaaca

SEQ ID NO: 255515 - DNA, 16 bp, P. troglodytes
gtagaagaaatgaata

SEQ ID NO: 255516 - DNA, 16 bp, P. troglodytes
gtagaagaaatggata

SEQ ID NO: 255517 - DNA, 16 bp, P. troglodytes
gtagaagatggggttt

SEQ ID NO: 255518 - DNA, 16 bp, P. troglodytes
gtagaaggaggagctg

SEQ ID NO: 255519 - DNA, 16 bp, P. troglodytes
gtagaatttagcagtg

SEQ ID NO: 255520 - DNA, 16 bp, P. troglodytes
gtagacacagggtttc

SEQ ID NO: 255521 - DNA, 16 bp, P. troglodytes
gtagacatgggagact

SEQ ID NO: 255522 - DNA, 16 bp, P. troglodytes
gtagactccagtgtct

SEQ ID NO: 255523 - DNA, 16 bp, P. troglodytes
gtagagacagggcttc

SEQ ID NO: 255524 - DNA, 16 bp, P. troglodytes
gtagagacaggggtct

SEQ ID NO: 255525 - DNA, 16 bp, P. troglodytes
gtagagacagggtttt

SEQ ID NO: 255526 - DNA, 16 bp, P. troglodytes
gtagagacatggtttt

SEQ ID NO: 255527 - DNA, 16 bp, P. troglodytes
gtagagaccgggtctt

SEQ ID NO: 255528 - DNA, 16 bp, P. troglodytes
gtagagacgaggtttt

SEQ ID NO: 255529 - DNA, 16 bp, P. troglodytes
gtagagacggcgtttc

SEQ ID NO: 255530 - DNA, 16 bp, P. troglodytes
gtagagacggggtttt

SEQ ID NO: 255531 - DNA, 16 bp, P. troglodytes
gtagagacggtgtttc

SEQ ID NO: 255532 - DNA, 16 bp, P. troglodytes
gtagagagagggtctt

SEQ ID NO: 255533 - DNA, 16 bp, P. troglodytes
gtagagagctgaaact

SEQ ID NO: 255534 - DNA, 16 bp, P. troglodytes
gtagagatagggtctt

SEQ ID NO: 255535 - DNA, 16 bp, P. troglodytes
gtagagatagggtttt

SEQ ID NO: 255536 - DNA, 21 bp, P. troglodytes
gtagagatggggtttcaccgt

SEQ ID NO: 255537 - DNA, 16 bp, P. troglodytes
gtagagattgggtttc

SEQ ID NO: 255538 - DNA, 16 bp, P. troglodytes
gtagagctgcccaaga

SEQ ID NO: 255539 - DNA, 16 bp, P. troglodytes
gtagagctggagtctc

SEQ ID NO: 255540 - DNA, 16 bp, P. troglodytes
gtagagctggggtctc

SEQ ID NO: 255541 - DNA, 16 bp, P. troglodytes
gtagaggaggagctgg

SEQ ID NO: 255542 - DNA, 16 bp, P. troglodytes
gtagaggatgcagtga

SEQ ID NO: 255543 - DNA, 16 bp, P. troglodytes
gtagaggcaaggtttc

SEQ ID NO: 255544 - DNA, 16 bp, P. troglodytes
gtagaggctgctgtga

SEQ ID NO: 255545 - DNA, 16 bp, P. troglodytes
gtagaggtgaggtttc

SEQ ID NO: 255546 - DNA, 16 bp, P. troglodytes
gtagagtcagggtttt

SEQ ID NO: 255547 - DNA, 23 bp, P. troglodytes
gtagataaaaccacaaagatggg

SEQ ID NO: 255548 - DNA, 16 bp, P. troglodytes
gtagatcatgaagtca

SEQ ID NO: 255549 - DNA, 16 bp, P. troglodytes
gtagatgcagaaaagg

SEQ ID NO: 255550 - DNA, 16 bp, P. troglodytes
gtagatgccctttatc

SEQ ID NO: 255551 - DNA, 16 bp, P. troglodytes
gtagatgttcttcagt

SEQ ID NO: 255552 - DNA, 16 bp, P. troglodytes
gtagattttataaaca

SEQ ID NO: 255553 - DNA, 16 bp, P. troglodytes
gtagcaaaatatcaca

SEQ ID NO: 255554 - DNA, 16 bp, P. troglodytes
gtagcacatgtctgta

SEQ ID NO: 255555 - DNA, 16 bp, P. troglodytes
gtagcactttgggagg

SEQ ID NO: 255556 - DNA, 16 bp, P. troglodytes
gtagcagcagcagcaa

SEQ ID NO: 255557 - DNA, 16 bp, P. troglodytes
gtagcaggcacctgta

SEQ ID NO: 255558 - DNA, 16 bp, P. troglodytes
gtagcagtgttctgga

SEQ ID NO: 255559 - DNA, 16 bp, P. troglodytes
gtagcatttacattgt

SEQ ID NO: 255560 - DNA, 16 bp, P. troglodytes
gtagccaggactacaa

SEQ ID NO: 255561 - DNA, 16 bp, P. troglodytes
gtagccaggcatggtg

SEQ ID NO: 255562 - DNA, 16 bp, P. troglodytes
gtagccaggcgtggtg

SEQ ID NO: 255563 - DNA, 16 bp, P. troglodytes
gtagcccagggtggag

SEQ ID NO: 255564 - DNA, 16 bp, P. troglodytes
gtagccgggcgtggtg

SEQ ID NO: 255565 - DNA, 16 bp, P. troglodytes
gtagcctctggtcctt

SEQ ID NO: 255566 - DNA, 16 bp, P. troglodytes
gtagctcacacctgta

SEQ ID NO: 255567 - DNA, 16 bp, P. troglodytes
gtagctcacgcctgta

SEQ ID NO: 255568 - DNA, 16 bp, P. troglodytes
gtagctcaggagagca

SEQ ID NO: 255569 - DNA, 16 bp, P. troglodytes
gtagctcctctctgct

SEQ ID NO: 255570 - DNA, 16 bp, P. troglodytes
gtagctctattttcag

SEQ ID NO: 255571 - DNA, 16 bp, P. troglodytes
gtagctgagaccacag

SEQ ID NO: 255572 - DNA, 16 bp, P. troglodytes
gtagctgagatgacag

SEQ ID NO: 255573 - DNA, 16 bp, P. troglodytes
gtagctgcgattacag

SEQ ID NO: 255574 - DNA, 16 bp, P. troglodytes
gtagctggaaccacag

SEQ ID NO: 255575 - DNA, 16 bp, P. troglodytes
gtagctggacatggtg

SEQ ID NO: 255576 - DNA, 16 bp, P. troglodytes
gtagctgggaacacag

SEQ ID NO: 255577 - DNA, 16 bp, P. troglodytes
gtagctgggaccacaa

SEQ ID NO: 255578 - DNA, 16 bp, P. troglodytes
gtagctgggaccacac

SEQ ID NO: 255579 - DNA, 16 bp, P. troglodytes
gtagctgggaccacag

SEQ ID NO: 255580 - DNA, 24 bp, P. troglodytes
gtagctgggactacaggcgcctgc

SEQ ID NO: 255581 - DNA, 16 bp, P. troglodytes
gtagctgggactaggg

SEQ ID NO: 255582 - DNA, 16 bp, P. troglodytes
gtagctgggattacat

SEQ ID NO: 255583 - DNA, 16 bp, P. troglodytes
gtagctgggtctacag

SEQ ID NO: 255584 - DNA, 16 bp, P. troglodytes
gtagctggtagctggg

SEQ ID NO: 255585 - DNA, 16 bp, P. troglodytes
gtagcttggactacag

SEQ ID NO: 255586 - DNA, 16 bp, P. troglodytes
gtagcttttctataca

SEQ ID NO: 255587 - DNA, 16 bp, P. troglodytes
gtaggagaaaatcttc

SEQ ID NO: 255588 - DNA, 16 bp, P. troglodytes
gtaggagagcagggtg

SEQ ID NO: 255589 - DNA, 16 bp, P. troglodytes
gtaggaggatcacttg

SEQ ID NO: 255590 - DNA, 16 bp, P. troglodytes
gtaggcacttacagct

SEQ ID NO: 255591 - DNA, 16 bp, P. troglodytes
gtagggatgaacctct

SEQ ID NO: 255592 - DNA, 16 bp, P. troglodytes
gtaggtacttaataaa

SEQ ID NO: 255593 - DNA, 16 bp, P. troglodytes
gtaggtagaggccagg

SEQ ID NO: 255594 - DNA, 16 bp, P. troglodytes
gtaggtaggtaggtag

SEQ ID NO: 255595 - DNA, 16 bp, P. troglodytes
gtaggtatgtggcttt

SEQ ID NO: 255596 - DNA, 16 bp, P. troglodytes
gtaggtgctcaataaa

SEQ ID NO: 255597 - DNA, 16 bp, P. troglodytes
gtaggtgggaccacag

SEQ ID NO: 255598 - DNA, 16 bp, P. troglodytes
gtaggtggttttcccc

SEQ ID NO: 255599 - DNA, 16 bp, P. troglodytes
gtaggtgtgtggcctt

SEQ ID NO: 255600 - DNA, 16 bp, P. troglodytes
gtagtagcagcagcag

SEQ ID NO: 255601 - DNA, 16 bp, P. troglodytes
gtagtagtagtagcag

SEQ ID NO: 255602 - DNA, 16 bp, P. troglodytes
gtagtattccatggtg

SEQ ID NO: 255603 - DNA, 16 bp, P. troglodytes
gtagtcccaggtacta

SEQ ID NO: 255604 - DNA, 16 bp, P. troglodytes
gtagtcccggctactt

SEQ ID NO: 255605 - DNA, 16 bp, P. troglodytes
gtagtgagctccccat

SEQ ID NO: 255606 - DNA, 16 bp, P. troglodytes
gtagtgatggagtttc

SEQ ID NO: 255607 - DNA, 16 bp, P. troglodytes
gtagtggcagcagtag

SEQ ID NO: 255608 - DNA, 16 bp, P. troglodytes
gtagtggcagtggtgg

SEQ ID NO: 255609 - DNA, 16 bp, P. troglodytes
gtagtggccccgaatg

SEQ ID NO: 255610 - DNA, 16 bp, P. troglodytes
gtagtggtgcaatcat

SEQ ID NO: 255611 - DNA, 16 bp, P. troglodytes
gtagtggtggccacag

SEQ ID NO: 255612 - DNA, 16 bp, P. troglodytes
gtagttaaaaatcaac

SEQ ID NO: 255613 - DNA, 16 bp, P. troglodytes
gtagttaataataatg

SEQ ID NO: 255614 - DNA, 16 bp, P. troglodytes
gtagttcattcttttt

SEQ ID NO: 255615 - DNA, 16 bp, P. troglodytes
gtagttccagtccaaa

SEQ ID NO: 255616 - DNA, 16 bp, P. troglodytes
gtagttctctttgaag

SEQ ID NO: 255617 - DNA, 16 bp, P. troglodytes
gtagttgggataacag

SEQ ID NO: 255618 - DNA, 16 bp, P. troglodytes
gtagtttcttaaaaag

SEQ ID NO: 255619 - DNA, 18 bp, P. troglodytes
gtataaaacccgattgta

SEQ ID NO: 255620 - DNA, 16 bp, P. troglodytes
gtataaagttttagtt

SEQ ID NO: 255621 - DNA, 16 bp, P. troglodytes
gtataaatgtgtatat

SEQ ID NO: 255622 - DNA, 16 bp, P. troglodytes
gtataaggaggagctg

SEQ ID NO: 255623 - DNA, 16 bp, P. troglodytes
gtataataaattattg

SEQ ID NO: 255624 - DNA, 16 bp, P. troglodytes
gtataatttaaagtca

SEQ ID NO: 255625 - DNA, 16 bp, P. troglodytes
gtatacacacatatat

SEQ ID NO: 255626 - DNA, 16 bp, P. troglodytes
gtatacatgtgccatg

SEQ ID NO: 255627 - DNA, 16 bp, P. troglodytes
gtatacatgtgtcatg

SEQ ID NO: 255628 - DNA, 19 bp, P. troglodytes
gtatacccagtaatgggat

SEQ ID NO: 255629 - DNA, 16 bp, P. troglodytes
gtatacctgtgtaaca

SEQ ID NO: 255630 - DNA, 16 bp, P. troglodytes
gtatactatatatact

SEQ ID NO: 255631 - DNA, 16 bp, P. troglodytes
gtatagatatatattt

SEQ ID NO: 255632 - DNA, 16 bp, P. troglodytes
gtatagtaatgcttgt

SEQ ID NO: 255633 - DNA, 16 bp, P. troglodytes
gtatataaaaatgcta

SEQ ID NO: 255634 - DNA, 16 bp, P. troglodytes
gtatataaagcaaata

SEQ ID NO: 255635 - DNA, 16 bp, P. troglodytes
gtatatacacacacaa

SEQ ID NO: 255636 - DNA, 16 bp, P. troglodytes
gtatatacacacatac

SEQ ID NO: 255637 - DNA, 16 bp, P. troglodytes
gtatatacacatatac

SEQ ID NO: 255638 - DNA, 17 bp, P. troglodytes
gtatatacatatatatg

SEQ ID NO: 255639 - DNA, 16 bp, P. troglodytes
gtatatacatatgtaa

SEQ ID NO: 255640 - DNA, 16 bp, P. troglodytes
gtatataccatatata

SEQ ID NO: 255641 - DNA, 16 bp, P. troglodytes
gtatatataagtatat

SEQ ID NO: 255642 - DNA, 16 bp, P. troglodytes
gtatatatacaatgga

SEQ ID NO: 255643 - DNA, 18 bp, P. troglodytes
gtatatatacacacacac

SEQ ID NO: 255644 - DNA, 16 bp, P. troglodytes
gtatatatacttatat

SEQ ID NO: 255645 - DNA, 16 bp, P. troglodytes
gtatatatagaaatat

SEQ ID NO: 255646 - DNA, 16 bp, P. troglodytes
gtatatataggaaaaa

SEQ ID NO: 255647 - DNA, 16 bp, P. troglodytes
gtatatatagtatata

SEQ ID NO: 255648 - DNA, 16 bp, P. troglodytes
gtatatatatacacat

SEQ ID NO: 255649 - DNA, 16 bp, P. troglodytes
gtatatatatatatgt

SEQ ID NO: 255650 - DNA, 16 bp, P. troglodytes
gtatatatatgccatg

SEQ ID NO: 255651 - DNA, 16 bp, P. troglodytes
gtatatatatgtacat

SEQ ID NO: 255652 - DNA, 16 bp, P. troglodytes
gtatatatgcatatat

SEQ ID NO: 255653 - DNA, 16 bp, P. troglodytes
gtatatatgcatattt

SEQ ID NO: 255654 - DNA, 16 bp, P. troglodytes
gtatatatgtatatta

SEQ ID NO: 255655 - DNA, 17 bp, P. troglodytes
gtatatatgtatgtatg

SEQ ID NO: 255656 - DNA, 16 bp, P. troglodytes
gtatatatttacattt

SEQ ID NO: 255657 - DNA, 16 bp, P. troglodytes
gtatatatttgtcaaa

SEQ ID NO: 255658 - DNA, 16 bp, P. troglodytes
gtatatcatatataca

SEQ ID NO: 255659 - DNA, 16 bp, P. troglodytes
gtatatcattgatggg

SEQ ID NO: 255660 - DNA, 16 bp, P. troglodytes
gtatatgaagaaaatc

SEQ ID NO: 255661 - DNA, 16 bp, P. troglodytes
gtatatgtatgtgtgt

SEQ ID NO: 255662 - DNA, 16 bp, P. troglodytes
gtatatgtgtgcatgt

SEQ ID NO: 255663 - DNA, 16 bp, P. troglodytes
gtatatgtgtgtctat

SEQ ID NO: 255664 - DNA, 16 bp, P. troglodytes
gtatatgtgtgtgtgt

SEQ ID NO: 255665 - DNA, 17 bp, P. troglodytes
gtatatgtgtgtgtgtg

SEQ ID NO: 255666 - DNA, 16 bp, P. troglodytes
gtatattctgttgatc

SEQ ID NO: 255667 - DNA, 16 bp, P. troglodytes
gtatattgactttgta

SEQ ID NO: 255668 - DNA, 16 bp, P. troglodytes
gtatatttatacaatg

SEQ ID NO: 255669 - DNA, 16 bp, P. troglodytes
gtatattttaaaaaga

SEQ ID NO: 255670 - DNA, 16 bp, P. troglodytes
gtatcaatatttcatt

SEQ ID NO: 255671 - DNA, 16 bp, P. troglodytes
gtatcacagaggtttt

SEQ ID NO: 255672 - DNA, 16 bp, P. troglodytes
gtatcacttgaggtca

SEQ ID NO: 255673 - DNA, 16 bp, P. troglodytes
gtatcagtacttcatt

SEQ ID NO: 255674 - DNA, 16 bp, P. troglodytes
gtatcagtatttcatt

SEQ ID NO: 255675 - DNA, 16 bp, P. troglodytes
gtatcatattttcttt

SEQ ID NO: 255676 - DNA, 16 bp, P. troglodytes
gtatcatgcaatatac

SEQ ID NO: 255677 - DNA, 16 bp, P. troglodytes
gtatccagtttcagct

SEQ ID NO: 255678 - DNA, 16 bp, P. troglodytes
gtatccatgtgttctc

SEQ ID NO: 255679 - DNA, 16 bp, P. troglodytes
gtatcctgcaagttta

SEQ ID NO: 255680 - DNA, 16 bp, P. troglodytes
gtatctaaacatacct

SEQ ID NO: 255681 - DNA, 16 bp, P. troglodytes
gtatctactatgtgcc

SEQ ID NO: 255682 - DNA, 16 bp, P. troglodytes
gtatcttattgccaca

SEQ ID NO: 255683 - DNA, 16 bp, P. troglodytes
gtatcttctcagacca

SEQ ID NO: 255684 - DNA, 16 bp, P. troglodytes
gtatctttatagcaat

SEQ ID NO: 255685 - DNA, 16 bp, P. troglodytes
gtatctttttaaaaaa

SEQ ID NO: 255686 - DNA, 16 bp, P. troglodytes
gtatgagccaccctgc

SEQ ID NO: 255687 - DNA, 16 bp, P. troglodytes
gtatgcaccaaacaac

SEQ ID NO: 255688 - DNA, 16 bp, P. troglodytes
gtatgcagaagtacag

SEQ ID NO: 255689 - DNA, 16 bp, P. troglodytes
gtatgcatgtgtatat

SEQ ID NO: 255690 - DNA, 16 bp, P. troglodytes
gtatgcatttatcaaa

SEQ ID NO: 255691 - DNA, 16 bp, P. troglodytes
gtatgggtcagaagga

SEQ ID NO: 255692 - DNA, 16 bp, P. troglodytes
gtatggtaattctatt

SEQ ID NO: 255693 - DNA, 16 bp, P. troglodytes
gtatggtatataaatt

SEQ ID NO: 255694 - DNA, 16 bp, P. troglodytes
gtatggtattttgtta

SEQ ID NO: 255695 - DNA, 16 bp, P. troglodytes
gtatggtggcgtgcgc

SEQ ID NO: 255696 - DNA, 18 bp, P. troglodytes
gtatggtggctcacgcct

SEQ ID NO: 255697 - DNA, 16 bp, P. troglodytes
gtatggtggtgcacac

SEQ ID NO: 255698 - DNA, 16 bp, P. troglodytes
gtatggtggtgggcgc

SEQ ID NO: 255699 - DNA, 16 bp, P. troglodytes
gtatgtaaattatatc

SEQ ID NO: 255700 - DNA, 16 bp, P. troglodytes
gtatgtaatacatata

SEQ ID NO: 255701 - DNA, 16 bp, P. troglodytes
gtatgtacccaaagaa

SEQ ID NO: 255702 - DNA, 34 bp, P. troglodytes
gtatgtagaaagctgaaactggatcccttcctta

SEQ ID NO: 255703 - DNA, 16 bp, P. troglodytes
gtatgtagagggaaat

SEQ ID NO: 255704 - DNA, 16 bp, P. troglodytes
gtatgtagtgatatct

SEQ ID NO: 255705 - DNA, 16 bp, P. troglodytes
gtatgtatccagtaat

SEQ ID NO: 255706 - DNA, 16 bp, P. troglodytes
gtatgtatgtatatac

SEQ ID NO: 255707 - DNA, 16 bp, P. troglodytes
gtatgtatgtatgtat

SEQ ID NO: 255708 - DNA, 16 bp, P. troglodytes
gtatgtatgtatgtgc

SEQ ID NO: 255709 - DNA, 19 bp, P. troglodytes
gtatgtatgtatgtgtata

SEQ ID NO: 255710 - DNA, 16 bp, P. troglodytes
gtatgtctcttcattt

SEQ ID NO: 255711 - DNA, 16 bp, P. troglodytes
gtatgtctgcttttga

SEQ ID NO: 255712 - DNA, 16 bp, P. troglodytes
gtatgtgtatacacac

SEQ ID NO: 255713 - DNA, 16 bp, P. troglodytes
gtatgtgtgtatattt

SEQ ID NO: 255714 - DNA, 16 bp, P. troglodytes
gtatgtgtgtatgtac

SEQ ID NO: 255715 - DNA, 16 bp, P. troglodytes
gtatgtgtgtgtatgc

SEQ ID NO: 255716 - DNA, 16 bp, P. troglodytes
gtatgttgcccaggct

SEQ ID NO: 255717 - DNA, 16 bp, P. troglodytes
gtatgttgtatctttt

SEQ ID NO: 255718 - DNA, 16 bp, P. troglodytes
gtattaaagatttaaa

SEQ ID NO: 255719 - DNA, 16 bp, P. troglodytes
gtattaaatacatttt

SEQ ID NO: 255720 - DNA, 16 bp, P. troglodytes
gtattaaccatcacaa

SEQ ID NO: 255721 - DNA, 16 bp, P. troglodytes
gtattacaaatatttt

SEQ ID NO: 255722 - DNA, 16 bp, P. troglodytes
gtattacaggtgtaag

SEQ ID NO: 255723 - DNA, 16 bp, P. troglodytes
gtattaggagatggga

SEQ ID NO: 255724 - DNA, 16 bp, P. troglodytes
gtattaggtcattctt

SEQ ID NO: 255725 - DNA, 16 bp, P. troglodytes
gtattagtgtatttta

SEQ ID NO: 255726 - DNA, 16 bp, P. troglodytes
gtattatatactgtac

SEQ ID NO: 255727 - DNA, 16 bp, P. troglodytes
gtattattaaaaagtc

SEQ ID NO: 255728 - DNA, 16 bp, P. troglodytes
gtattattattcccat

SEQ ID NO: 255729 - DNA, 16 bp, P. troglodytes
gtattattccattttt

SEQ ID NO: 255730 - DNA, 16 bp, P. troglodytes
gtattattttaagcca

SEQ ID NO: 255731 - DNA, 17 bp, P. troglodytes
gtattcaaataggaaga

SEQ ID NO: 255732 - DNA, 16 bp, P. troglodytes
gtattcaagagaccca

SEQ ID NO: 255733 - DNA, 16 bp, P. troglodytes
gtattcagggattcaa

SEQ ID NO: 255734 - DNA, 16 bp, P. troglodytes
gtattccatggtttat

SEQ ID NO: 255735 - DNA, 16 bp, P. troglodytes
gtattcccagtacttt

SEQ ID NO: 255736 - DNA, 16 bp, P. troglodytes
gtattctgaaattctt

SEQ ID NO: 255737 - DNA, 16 bp, P. troglodytes
gtattctgttatagca

SEQ ID NO: 255738 - DNA, 16 bp, P. troglodytes
gtattcttagtagaga

SEQ ID NO: 255739 - DNA, 16 bp, P. troglodytes
gtattgatccctttac

SEQ ID NO: 255740 - DNA, 16 bp, P. troglodytes
gtattgattgattgat

SEQ ID NO: 255741 - DNA, 16 bp, P. troglodytes
gtatttaccacatttt

SEQ ID NO: 255742 - DNA, 16 bp, P. troglodytes
gtatttacccagagga

SEQ ID NO: 255743 - DNA, 16 bp, P. troglodytes
gtatttaggccattta

SEQ ID NO: 255744 - DNA, 16 bp, P. troglodytes
gtatttatatgtatgt

SEQ ID NO: 255745 - DNA, 16 bp, P. troglodytes
gtatttatctgaagat

SEQ ID NO: 255746 - DNA, 16 bp, P. troglodytes
gtatttcaaaatagtt

SEQ ID NO: 255747 - DNA, 16 bp, P. troglodytes
gtatttcattgtatgt

SEQ ID NO: 255748 - DNA, 16 bp, P. troglodytes
gtatttccagaagaga

SEQ ID NO: 255749 - DNA, 16 bp, P. troglodytes
gtatttctaatagaga

SEQ ID NO: 255750 - DNA, 16 bp, P. troglodytes
gtatttcttcatagca

SEQ ID NO: 255751 - DNA, 16 bp, P. troglodytes
gtatttctttatagca

SEQ ID NO: 255752 - DNA, 16 bp, P. troglodytes
gtatttctttgatgat

SEQ ID NO: 255753 - DNA, 16 bp, P. troglodytes
gtatttgaagggactt

SEQ ID NO: 255754 - DNA, 16 bp, P. troglodytes
gtatttgcaaatcata

SEQ ID NO: 255755 - DNA, 16 bp, P. troglodytes
gtatttggagatgggg

SEQ ID NO: 255756 - DNA, 16 bp, P. troglodytes
gtattttaaaagcaaa

SEQ ID NO: 255757 - DNA, 16 bp, P. troglodytes
gtattttacatgcatt

SEQ ID NO: 255758 - DNA, 16 bp, P. troglodytes
gtattttagtagaaat

SEQ ID NO: 255759 - DNA, 16 bp, P. troglodytes
gtattttcaaatattt

SEQ ID NO: 255760 - DNA, 16 bp, P. troglodytes
gtattttcactgccct

SEQ ID NO: 255761 - DNA, 16 bp, P. troglodytes
gtattttcagtataga

SEQ ID NO: 255762 - DNA, 16 bp, P. troglodytes
gtattttcagttgaga

SEQ ID NO: 255763 - DNA, 16 bp, P. troglodytes
gtattttcattttcat

SEQ ID NO: 255764 - DNA, 16 bp, P. troglodytes
gtattttctagttctg

SEQ ID NO: 255765 - DNA, 16 bp, P. troglodytes
gtattttgaaaattaa

SEQ ID NO: 255766 - DNA, 16 bp, P. troglodytes
gtattttgatagagat

SEQ ID NO: 255767 - DNA, 16 bp, P. troglodytes
gtattttgttctggca

SEQ ID NO: 255768 - DNA, 16 bp, P. troglodytes
gtatttttaaatagag

SEQ ID NO: 255769 - DNA, 16 bp, P. troglodytes
gtatttttaacaaatg

SEQ ID NO: 255770 - DNA, 16 bp, P. troglodytes
gtatttttagcagaca

SEQ ID NO: 255771 - DNA, 16 bp, P. troglodytes
gtatttttagtagtgg

SEQ ID NO: 255772 - DNA, 16 bp, P. troglodytes
gtatttttattaaaga

SEQ ID NO: 255773 - DNA, 16 bp, P. troglodytes
gtatttttattagaaa

SEQ ID NO: 255774 - DNA, 16 bp, P. troglodytes
gtattttttctgatcc

SEQ ID NO: 255775 - DNA, 16 bp, P. troglodytes
gtattttttgaagaga

SEQ ID NO: 255776 - DNA, 16 bp, P. troglodytes
gtatttttttgcagag

SEQ ID NO: 255777 - DNA, 16 bp, P. troglodytes
gtatttttttgtaaag

SEQ ID NO: 255778 - DNA, 16 bp, P. troglodytes
gtcaaaaatcagttgg

SEQ ID NO: 255779 - DNA, 16 bp, P. troglodytes
gtcaaaagataacaag

SEQ ID NO: 255780 - DNA, 16 bp, P. troglodytes
gtcaaaagatacaaaa

SEQ ID NO: 255781 - DNA, 16 bp, P. troglodytes
gtcaaaatcacaatga

SEQ ID NO: 255782 - DNA, 16 bp, P. troglodytes
gtcaaagaccaaatat

SEQ ID NO: 255783 - DNA, 16 bp, P. troglodytes
gtcaaaggattgagaa

SEQ ID NO: 255784 - DNA, 16 bp, P. troglodytes
gtcaaataatgacaat

SEQ ID NO: 255785 - DNA, 16 bp, P. troglodytes
gtcaaatggtatttgt

SEQ ID NO: 255786 - DNA, 16 bp, P. troglodytes
gtcaaatggtattttt

SEQ ID NO: 255787 - DNA, 16 bp, P. troglodytes
gtcaaattttccctgt

SEQ ID NO: 255788 - DNA, 16 bp, P. troglodytes
gtcaacagatcaagac

SEQ ID NO: 255789 - DNA, 16 bp, P. troglodytes
gtcaaccaagaatact

SEQ ID NO: 255790 - DNA, 16 bp, P. troglodytes
gtcaaccaggctgcag

SEQ ID NO: 255791 - DNA, 16 bp, P. troglodytes
gtcaagagaaagaaaa

SEQ ID NO: 255792 - DNA, 16 bp, P. troglodytes
gtcaagagaatgaaaa

SEQ ID NO: 255793 - DNA, 16 bp, P. troglodytes
gtcaagatgaagaaaa

SEQ ID NO: 255794 - DNA, 16 bp, P. troglodytes
gtcaagattctccaga

SEQ ID NO: 255795 - DNA, 16 bp, P. troglodytes
gtcaagctgagagcca

SEQ ID NO: 255796 - DNA, 16 bp, P. troglodytes
gtcaagctgggaacta

SEQ ID NO: 255797 - DNA, 16 bp, P. troglodytes
gtcaagctggtctcca

SEQ ID NO: 255798 - DNA, 16 bp, P. troglodytes
gtcaaggacatgaaga

SEQ ID NO: 255799 - DNA, 16 bp, P. troglodytes
gtcaaggatgcagaga

SEQ ID NO: 255800 - DNA, 16 bp, P. troglodytes
gtcaaggcaggaggat

SEQ ID NO: 255801 - DNA, 16 bp, P. troglodytes
gtcaaggctgcagtga

SEQ ID NO: 255802 - DNA, 16 bp, P. troglodytes
gtcaaggtgggcagat

SEQ ID NO: 255803 - DNA, 16 bp, P. troglodytes
gtcaaggtgggtggat

SEQ ID NO: 255804 - DNA, 16 bp, P. troglodytes
gtcaataaatgtgatg

SEQ ID NO: 255805 - DNA, 16 bp, P. troglodytes
gtcaatctagctaaag

SEQ ID NO: 255806 - DNA, 16 bp, P. troglodytes
gtcaatctctgtcttt

SEQ ID NO: 255807 - DNA, 16 bp, P. troglodytes
gtcaatgaaatagaaa

SEQ ID NO: 255808 - DNA, 16 bp, P. troglodytes
gtcaattaaaaagaaa

SEQ ID NO: 255809 - DNA, 16 bp, P. troglodytes
gtcaatttcttaaaat

SEQ ID NO: 255810 - DNA, 16 bp, P. troglodytes
gtcaatttttgatttt

SEQ ID NO: 255811 - DNA, 16 bp, P. troglodytes
gtcacaaaacaagtct

SEQ ID NO: 255812 - DNA, 16 bp, P. troglodytes
gtcacaaaagaacaaa

SEQ ID NO: 255813 - DNA, 16 bp, P. troglodytes
gtcacacacacacaca

SEQ ID NO: 255814 - DNA, 16 bp, P. troglodytes
gtcacacacagacaca

SEQ ID NO: 255815 - DNA, 16 bp, P. troglodytes
gtcacacagctgctaa

SEQ ID NO: 255816 - DNA, 16 bp, P. troglodytes
gtcacacagcttataa

SEQ ID NO: 255817 - DNA, 16 bp, P. troglodytes
gtcacactgatgtaag

SEQ ID NO: 255818 - DNA, 16 bp, P. troglodytes
gtcacagaaggacaaa

SEQ ID NO: 255819 - DNA, 16 bp, P. troglodytes
gtcacagccaagagga

SEQ ID NO: 255820 - DNA, 16 bp, P. troglodytes
gtcacaggttccaggg

SEQ ID NO: 255821 - DNA, 16 bp, P. troglodytes
gtcacagtgctgcaga

SEQ ID NO: 255822 - DNA, 16 bp, P. troglodytes
gtcacataaaactttg

SEQ ID NO: 255823 - DNA, 16 bp, P. troglodytes
gtcacatgtatgtctt

SEQ ID NO: 255824 - DNA, 16 bp, P. troglodytes
gtcacattctgaggta

SEQ ID NO: 255825 - DNA, 16 bp, P. troglodytes
gtcacattttggcaat

SEQ ID NO: 255826 - DNA, 16 bp, P. troglodytes
gtcaccacacccagct

SEQ ID NO: 255827 - DNA, 16 bp, P. troglodytes
gtcaccacacttggct

SEQ ID NO: 255828 - DNA, 16 bp, P. troglodytes
gtcaccactcctcttc

SEQ ID NO: 255829 - DNA, 16 bp, P. troglodytes
gtcaccaggcctggct

SEQ ID NO: 255830 - DNA, 16 bp, P. troglodytes
gtcaccaggctggaga

SEQ ID NO: 255831 - DNA, 16 bp, P. troglodytes
gtcaccatcaccacca

SEQ ID NO: 255832 - DNA, 16 bp, P. troglodytes
gtcaccatcaccatca

SEQ ID NO: 255833 - DNA, 16 bp, P. troglodytes
gtcaccatcatcatca

SEQ ID NO: 255834 - DNA, 16 bp, P. troglodytes
gtcaccatcctccaga

SEQ ID NO: 255835 - DNA, 16 bp, P. troglodytes
gtcaccatgtccagct

SEQ ID NO: 255836 - DNA, 16 bp, P. troglodytes
gtcacccaagaactct

SEQ ID NO: 255837 - DNA, 16 bp, P. troglodytes
gtcacccctggaggcc

SEQ ID NO: 255838 - DNA, 16 bp, P. troglodytes
gtcacccgggctgcag

SEQ ID NO: 255839 - DNA, 16 bp, P. troglodytes
gtcaccctggctggaa

SEQ ID NO: 255840 - DNA, 16 bp, P. troglodytes
gtcacctaggctgcag

SEQ ID NO: 255841 - DNA, 16 bp, P. troglodytes
gtcacctctgcctccc

SEQ ID NO: 255842 - DNA, 16 bp, P. troglodytes
gtcacctcttcagaga

SEQ ID NO: 255843 - DNA, 20 bp, P. troglodytes
gtcacctgaggtcaggagtt

SEQ ID NO: 255844 - DNA, 16 bp, P. troglodytes
gtcacctttgttccag

SEQ ID NO: 255845 - DNA, 16 bp, P. troglodytes
gtcaccttttgcagtg

SEQ ID NO: 255846 - DNA, 17 bp, P. troglodytes
gtcacgatctcctgacc

SEQ ID NO: 255847 - DNA, 16 bp, P. troglodytes
gtcacgctctgtcacc

SEQ ID NO: 255848 - DNA, 16 bp, P. troglodytes
gtcactcaggctgcag

SEQ ID NO: 255849 - DNA, 16 bp, P. troglodytes
gtcactcctctgctca

SEQ ID NO: 255850 - DNA, 16 bp, P. troglodytes
gtcactcctttctttg

SEQ ID NO: 255851 - DNA, 16 bp, P. troglodytes
gtcactctgtgccttt

SEQ ID NO: 255852 - DNA, 16 bp, P. troglodytes
gtcactgaggctggaa

SEQ ID NO: 255853 - DNA, 16 bp, P. troglodytes
gtcactgcactgcagc

SEQ ID NO: 255854 - DNA, 16 bp, P. troglodytes
gtcactgcagcctctg

SEQ ID NO: 255855 - DNA, 16 bp, P. troglodytes
gtcacttcccaccagg

SEQ ID NO: 255856 - DNA, 16 bp, P. troglodytes
gtcacttgaggtcggg

SEQ ID NO: 255857 - DNA, 16 bp, P. troglodytes
gtcagaagttccagac

SEQ ID NO: 255858 - DNA, 16 bp, P. troglodytes
gtcagaattgctatta

SEQ ID NO: 255859 - DNA, 16 bp, P. troglodytes
gtcagaatttcgagac

SEQ ID NO: 255860 - DNA, 16 bp, P. troglodytes
gtcagaccacagtgca

SEQ ID NO: 255861 - DNA, 21 bp, P. troglodytes
gtcagaccagttgtctgctct

SEQ ID NO: 255862 - DNA, 16 bp, P. troglodytes
gtcagacctaaagcca

SEQ ID NO: 255863 - DNA, 16 bp, P. troglodytes
gtcagagaagatgctt

SEQ ID NO: 255864 - DNA, 16 bp, P. troglodytes
gtcagagagatttgaa

SEQ ID NO: 255865 - DNA, 16 bp, P. troglodytes
gtcagaggccttttct

SEQ ID NO: 255866 - DNA, 16 bp, P. troglodytes
gtcagagggaggaggc

SEQ ID NO: 255867 - DNA, 25 bp, P. troglodytes
gtcagagtttaaggttatctctctt

SEQ ID NO: 255868 - DNA, 16 bp, P. troglodytes
gtcagatgcatacttt

SEQ ID NO: 255869 - DNA, 16 bp, P. troglodytes
gtcagatgcatagttc

SEQ ID NO: 255870 - DNA, 16 bp, P. troglodytes
gtcagcagcagcagca

SEQ ID NO: 255871 - DNA, 16 bp, P. troglodytes
gtcagcaggaaaacat

SEQ ID NO: 255872 - DNA, 16 bp, P. troglodytes
gtcagcaggtggcaaa

SEQ ID NO: 255873 - DNA, 16 bp, P. troglodytes
gtcagccaagctggag

SEQ ID NO: 255874 - DNA, 16 bp, P. troglodytes
gtcagcctgggcaaca

SEQ ID NO: 255875 - DNA, 16 bp, P. troglodytes
gtcagcgagaccatga

SEQ ID NO: 255876 - DNA, 16 bp, P. troglodytes
gtcagctgcttgattt

SEQ ID NO: 255877 - DNA, 16 bp, P. troglodytes
gtcaggaaaacagaaa

SEQ ID NO: 255878 - DNA, 16 bp, P. troglodytes
gtcaggaaacagatgc

SEQ ID NO: 255879 - DNA, 16 bp, P. troglodytes
gtcaggagacagagac

SEQ ID NO: 255880 - DNA, 16 bp, P. troglodytes
gtcaggaggcagaagg

SEQ ID NO: 255881 - DNA, 16 bp, P. troglodytes
gtcaggagttcaagcc

SEQ ID NO: 255882 - DNA, 16 bp, P. troglodytes
gtcaggagttggaggc

SEQ ID NO: 255883 - DNA, 16 bp, P. troglodytes
gtcaggatcagctgct

SEQ ID NO: 255884 - DNA, 16 bp, P. troglodytes
gtcaggcatggtggca

SEQ ID NO: 255885 - DNA, 16 bp, P. troglodytes
gtcaggccaggcacag

SEQ ID NO: 255886 - DNA, 16 bp, P. troglodytes
gtcaggctgtctcgaa

SEQ ID NO: 255887 - DNA, 16 bp, P. troglodytes
gtcagggacccacttg

SEQ ID NO: 255888 - DNA, 17 bp, P. troglodytes
gtcagggagttcccttt

SEQ ID NO: 255889 - DNA, 16 bp, P. troglodytes
gtcagggtcaggcctg

SEQ ID NO: 255890 - DNA, 16 bp, P. troglodytes
gtcagggtcagggtca

SEQ ID NO: 255891 - DNA, 16 bp, P. troglodytes
gtcagggttttttttt

SEQ ID NO: 255892 - DNA, 20 bp, P. troglodytes
gtcaggtctttcccttccca

SEQ ID NO: 255893 - DNA, 16 bp, P. troglodytes
gtcaggtgtggtggca

SEQ ID NO: 255894 - DNA, 16 bp, P. troglodytes
gtcagtagaaaggaat

SEQ ID NO: 255895 - DNA, 16 bp, P. troglodytes
gtcagtatggccattt

SEQ ID NO: 255896 - DNA, 16 bp, P. troglodytes
gtcagtggatctacta

SEQ ID NO: 255897 - DNA, 16 bp, P. troglodytes
gtcagtggatggaaaa

SEQ ID NO: 255898 - DNA, 16 bp, P. troglodytes
gtcagttcagagccag

SEQ ID NO: 255899 - DNA, 16 bp, P. troglodytes
gtcagtttagcaagaa

SEQ ID NO: 255900 - DNA, 16 bp, P. troglodytes
gtcagttttttaaaaa

SEQ ID NO: 255901 - DNA, 16 bp, P. troglodytes
gtcataaaaaatgaaa

SEQ ID NO: 255902 - DNA, 16 bp, P. troglodytes
gtcataaaacaagtct

SEQ ID NO: 255903 - DNA, 16 bp, P. troglodytes
gtcataaaagacattg

SEQ ID NO: 255904 - DNA, 16 bp, P. troglodytes
gtcatactgcccaagg

SEQ ID NO: 255905 - DNA, 16 bp, P. troglodytes
gtcatagctcactgca

SEQ ID NO: 255906 - DNA, 16 bp, P. troglodytes
gtcatatgcatagttt

SEQ ID NO: 255907 - DNA, 16 bp, P. troglodytes
gtcatatggtttttgt

SEQ ID NO: 255908 - DNA, 16 bp, P. troglodytes
gtcatcaagacagaaa

SEQ ID NO: 255909 - DNA, 16 bp, P. troglodytes
gtcatcatcaccatca

SEQ ID NO: 255910 - DNA, 16 bp, P. troglodytes
gtcatccagacagaaa

SEQ ID NO: 255911 - DNA, 16 bp, P. troglodytes
gtcatcgccattctcc

SEQ ID NO: 255912 - DNA, 16 bp, P. troglodytes
gtcatctcagcccaaa

SEQ ID NO: 255913 - DNA, 16 bp, P. troglodytes
gtcatctgaaggcttg

SEQ ID NO: 255914 - DNA, 16 bp, P. troglodytes
gtcatctgcaaacaaa

SEQ ID NO: 255915 - DNA, 16 bp, P. troglodytes
gtcatctgcctgcctc

SEQ ID NO: 255916 - DNA, 16 bp, P. troglodytes
gtcatcttcccacctc

SEQ ID NO: 255917 - DNA, 16 bp, P. troglodytes
gtcatgaaatccttgc

SEQ ID NO: 255918 - DNA, 16 bp, P. troglodytes
gtcatgaagcttccat

SEQ ID NO: 255919 - DNA, 16 bp, P. troglodytes
gtcatgagccaccgca

SEQ ID NO: 255920 - DNA, 16 bp, P. troglodytes
gtcatgatgtctgcaa

SEQ ID NO: 255921 - DNA, 16 bp, P. troglodytes
gtcatgcattgcttaa

SEQ ID NO: 255922 - DNA, 16 bp, P. troglodytes
gtcatgctggtgtgct

SEQ ID NO: 255923 - DNA, 16 bp, P. troglodytes
gtcatggtggagaagg

SEQ ID NO: 255924 - DNA, 16 bp, P. troglodytes
gtcatgttggccaggc

SEQ ID NO: 255925 - DNA, 16 bp, P. troglodytes
gtcattatttaatgat

SEQ ID NO: 255926 - DNA, 16 bp, P. troglodytes
gtcattcaggagctgg

SEQ ID NO: 255927 - DNA, 16 bp, P. troglodytes
gtcattgaggctggag

SEQ ID NO: 255928 - DNA, 16 bp, P. troglodytes
gtcattgcaaatgaca

SEQ ID NO: 255929 - DNA, 16 bp, P. troglodytes
gtcatttaaaattttt

SEQ ID NO: 255930 - DNA, 16 bp, P. troglodytes
gtcatttatgttcctc

SEQ ID NO: 255931 - DNA, 16 bp, P. troglodytes
gtcatttctccaagga

SEQ ID NO: 255932 - DNA, 16 bp, P. troglodytes
gtcatttgtatgtttt

SEQ ID NO: 255933 - DNA, 16 bp, P. troglodytes
gtcattttaaaaaata

SEQ ID NO: 255934 - DNA, 16 bp, P. troglodytes
gtcatttttaaaaaga

SEQ ID NO: 255935 - DNA, 16 bp, P. troglodytes
gtcatttttctcttgc

SEQ ID NO: 255936 - DNA, 16 bp, P. troglodytes
gtccaaaaggaaaata

SEQ ID NO: 255937 - DNA, 16 bp, P. troglodytes
gtccaaaatccagcag

SEQ ID NO: 255938 - DNA, 16 bp, P. troglodytes
gtccaaaggccagaga

SEQ ID NO: 255939 - DNA, 16 bp, P. troglodytes
gtccaagagtttgaga

SEQ ID NO: 255940 - DNA, 16 bp, P. troglodytes
gtccaagatcaagagg

SEQ ID NO: 255941 - DNA, 16 bp, P. troglodytes
gtccaagatcaaggtg

SEQ ID NO: 255942 - DNA, 16 bp, P. troglodytes
gtccaagatcagggtg

SEQ ID NO: 255943 - DNA, 16 bp, P. troglodytes
gtccaaggtcaaggca

SEQ ID NO: 255944 - DNA, 16 bp, P. troglodytes
gtccaccaccacgccc

SEQ ID NO: 255945 - DNA, 18 bp, P. troglodytes
gtccacccgccttggcct

SEQ ID NO: 255946 - DNA, 16 bp, P. troglodytes
gtccaccctgggcaac

SEQ ID NO: 255947 - DNA, 16 bp, P. troglodytes
gtccacctctgcctcc

SEQ ID NO: 255948 - DNA, 18 bp, P. troglodytes
gtccacctgccttggcct

SEQ ID NO: 255949 - DNA, 16 bp, P. troglodytes
gtccagaatgatgttt

SEQ ID NO: 255950 - DNA, 16 bp, P. troglodytes
gtccagagtctcatct

SEQ ID NO: 255951 - DNA, 16 bp, P. troglodytes
gtccagccactgtgca

SEQ ID NO: 255952 - DNA, 16 bp, P. troglodytes
gtccagcccacattca

SEQ ID NO: 255953 - DNA, 16 bp, P. troglodytes
gtccagcccaggctgg

SEQ ID NO: 255954 - DNA, 16 bp, P. troglodytes
gtccagcctgggaaac

SEQ ID NO: 255955 - DNA, 16 bp, P. troglodytes
gtccagcctgggcagc

SEQ ID NO: 255956 - DNA, 16 bp, P. troglodytes
gtccagctacttggga

SEQ ID NO: 255957 - DNA, 16 bp, P. troglodytes
gtccagctctcagcag

SEQ ID NO: 255958 - DNA, 16 bp, P. troglodytes
gtccaggacaggagat

SEQ ID NO: 255959 - DNA, 16 bp, P. troglodytes
gtccaggagccccaag

SEQ ID NO: 255960 - DNA, 16 bp, P. troglodytes
gtccaggagctcaaga

SEQ ID NO: 255961 - DNA, 16 bp, P. troglodytes
gtccaggcaggagtgc

SEQ ID NO: 255962 - DNA, 16 bp, P. troglodytes
gtccaggctgctgtgc

SEQ ID NO: 255963 - DNA, 16 bp, P. troglodytes
gtccaggctggaatgc

SEQ ID NO: 255964 - DNA, 16 bp, P. troglodytes
gtccaggttggtcttg

SEQ ID NO: 255965 - DNA, 16 bp, P. troglodytes
gtccagtaccagatgg

SEQ ID NO: 255966 - DNA, 16 bp, P. troglodytes
gtccagtttcagtctt

SEQ ID NO: 255967 - DNA, 16 bp, P. troglodytes
gtccatccatctgtcc

SEQ ID NO: 255968 - DNA, 16 bp, P. troglodytes
gtccatcctggctaac

SEQ ID NO: 255969 - DNA, 16 bp, P. troglodytes
gtccatgactaagatc

SEQ ID NO: 255970 - DNA, 16 bp, P. troglodytes
gtccatgctggagtgc

SEQ ID NO: 255971 - DNA, 16 bp, P. troglodytes
gtccatgtgctctcat

SEQ ID NO: 255972 - DNA, 16 bp, P. troglodytes
gtccattcatatcctt

SEQ ID NO: 255973 - DNA, 16 bp, P. troglodytes
gtccattcattcattc

SEQ ID NO: 255974 - DNA, 16 bp, P. troglodytes
gtccattttgatttga

SEQ ID NO: 255975 - DNA, 16 bp, P. troglodytes
gtccattttttaatca

SEQ ID NO: 255976 - DNA, 16 bp, P. troglodytes
gtcccacctccagccc

SEQ ID NO: 255977 - DNA, 16 bp, P. troglodytes
gtcccagaaggagaag

SEQ ID NO: 255978 - DNA, 16 bp, P. troglodytes
gtcccagaggggcacc

SEQ ID NO: 255979 - DNA, 17 bp, P. troglodytes
gtcccagcactttggga

SEQ ID NO: 255980 - DNA, 16 bp, P. troglodytes
gtcccagccacccagg

SEQ ID NO: 255981 - DNA, 17 bp, P. troglodytes
gtcccagccactcagga

SEQ ID NO: 255982 - DNA, 17 bp, P. troglodytes
gtcccagccctttggga

SEQ ID NO: 255983 - DNA, 16 bp, P. troglodytes
gtcccagcctcttggg

SEQ ID NO: 255984 - DNA, 16 bp, P. troglodytes
gtcccagcgacttggg

SEQ ID NO: 255985 - DNA, 16 bp, P. troglodytes
gtcccagctctgccac

SEQ ID NO: 255986 - DNA, 16 bp, P. troglodytes
gtcccagctgcctggg

SEQ ID NO: 255987 - DNA, 16 bp, P. troglodytes
gtcccaggaccagcag

SEQ ID NO: 255988 - DNA, 16 bp, P. troglodytes
gtcccaggctggtctc

SEQ ID NO: 255989 - DNA, 16 bp, P. troglodytes
gtcccagtctgacagc

SEQ ID NO: 255990 - DNA, 16 bp, P. troglodytes
gtcccataagattata

SEQ ID NO: 255991 - DNA, 16 bp, P. troglodytes
gtccccacacagagtc

SEQ ID NO: 255992 - DNA, 16 bp, P. troglodytes
gtccccagagtccatt

SEQ ID NO: 255993 - DNA, 16 bp, P. troglodytes
gtccccagggcccagc

SEQ ID NO: 255994 - DNA, 16 bp, P. troglodytes
gtccccagtccccagg

SEQ ID NO: 255995 - DNA, 16 bp, P. troglodytes
gtcccccagcctgaca

SEQ ID NO: 255996 - DNA, 16 bp, P. troglodytes
gtcccccaggcccagc

SEQ ID NO: 255997 - DNA, 16 bp, P. troglodytes
gtcccccaggccggag

SEQ ID NO: 255998 - DNA, 16 bp, P. troglodytes
gtcccctgggcccact

SEQ ID NO: 255999 - DNA, 16 bp, P. troglodytes
gtccccttttctccac

SEQ ID NO: 256000 - DNA, 16 bp, P. troglodytes
gtccctaatggcttcc

SEQ ID NO: 256001 - DNA, 16 bp, P. troglodytes
gtccctactggggcac

SEQ ID NO: 256002 - DNA, 16 bp, P. troglodytes
gtccctcagctgcagg

SEQ ID NO: 256003 - DNA, 16 bp, P. troglodytes
gtccctcatggcacag

SEQ ID NO: 256004 - DNA, 16 bp, P. troglodytes
gtccctgactcctgga

SEQ ID NO: 256005 - DNA, 16 bp, P. troglodytes
gtccctgacttcctgc

SEQ ID NO: 256006 - DNA, 16 bp, P. troglodytes
gtccctgccctcaagg

SEQ ID NO: 256007 - DNA, 16 bp, P. troglodytes
gtccctgccttcaagg

SEQ ID NO: 256008 - DNA, 16 bp, P. troglodytes
gtccctggaaaggaca

SEQ ID NO: 256009 - DNA, 16 bp, P. troglodytes
gtccctgggccagcag

SEQ ID NO: 256010 - DNA, 16 bp, P. troglodytes
gtccctgggcctggcc

SEQ ID NO: 256011 - DNA, 16 bp, P. troglodytes
gtccctggtgccaaaa

SEQ ID NO: 256012 - DNA, 16 bp, P. troglodytes
gtccctgtggccttcc

SEQ ID NO: 256013 - DNA, 16 bp, P. troglodytes
gtcccttgagcccagg

SEQ ID NO: 256014 - DNA, 16 bp, P. troglodytes
gtccgcctctgcctcc

SEQ ID NO: 256015 - DNA, 16 bp, P. troglodytes
gtccgtccgtccgtcc

SEQ ID NO: 256016 - DNA, 16 bp, P. troglodytes
gtccgtgtgttctcat

SEQ ID NO: 256017 - DNA, 17 bp, P. troglodytes
gtcctagcactttggga

SEQ ID NO: 256018 - DNA, 16 bp, P. troglodytes
gtcctcaacctttttg

SEQ ID NO: 256019 - DNA, 16 bp, P. troglodytes
gtcctcatggagaacc

SEQ ID NO: 256020 - DNA, 22 bp, P. troglodytes
gtcctccagatctgtcactatc

SEQ ID NO: 256021 - DNA, 16 bp, P. troglodytes
gtcctccagcctcagc

SEQ ID NO: 256022 - DNA, 16 bp, P. troglodytes
gtcctcccacctcagc

SEQ ID NO: 256023 - DNA, 16 bp, P. troglodytes
gtcctcccaccttagc

SEQ ID NO: 256024 - DNA, 16 bp, P. troglodytes
gtcctcctgccccagc

SEQ ID NO: 256025 - DNA, 16 bp, P. troglodytes
gtcctcctgcctcagc

SEQ ID NO: 256026 - DNA, 16 bp, P. troglodytes
gtcctgaacatccctc

SEQ ID NO: 256027 - DNA, 16 bp, P. troglodytes
gtcctgaactcctggc

SEQ ID NO: 256028 - DNA, 16 bp, P. troglodytes
gtcctgagccctgccc

SEQ ID NO: 256029 - DNA, 16 bp, P. troglodytes
gtcctgatgacatgtg

SEQ ID NO: 256030 - DNA, 16 bp, P. troglodytes
gtcctgcaagctctat

SEQ ID NO: 256031 - DNA, 16 bp, P. troglodytes
gtcctgcctcagcctc

SEQ ID NO: 256032 - DNA, 16 bp, P. troglodytes
gtcctgcctcagtctc

SEQ ID NO: 256033 - DNA, 16 bp, P. troglodytes
gtcctgctctgtcacc

SEQ ID NO: 256034 - DNA, 16 bp, P. troglodytes
gtcctgctgcttgctg

SEQ ID NO: 256035 - DNA, 16 bp, P. troglodytes
gtcctggcagcattca

SEQ ID NO: 256036 - DNA, 16 bp, P. troglodytes
gtcctggccagaacaa

SEQ ID NO: 256037 - DNA, 16 bp, P. troglodytes
gtcctggctctgccat

SEQ ID NO: 256038 - DNA, 16 bp, P. troglodytes
gtcctggctggtctca

SEQ ID NO: 256039 - DNA, 16 bp, P. troglodytes
gtcctgggccacatgc

SEQ ID NO: 256040 - DNA, 16 bp, P. troglodytes
gtcctgggcctggccc

SEQ ID NO: 256041 - DNA, 16 bp, P. troglodytes
gtcctgggctcaagtg

SEQ ID NO: 256042 - DNA, 16 bp, P. troglodytes
gtccttaaccttggca

SEQ ID NO: 256043 - DNA, 16 bp, P. troglodytes
gtccttactaaaaata

SEQ ID NO: 256044 - DNA, 16 bp, P. troglodytes
gtccttcagttccatc

SEQ ID NO: 256045 - DNA, 16 bp, P. troglodytes
gtccttgcaatagttt

SEQ ID NO: 256046 - DNA, 16 bp, P. troglodytes
gtccttgcccatgcca

SEQ ID NO: 256047 - DNA, 16 bp, P. troglodytes
gtccttgctcatgcct

SEQ ID NO: 256048 - DNA, 16 bp, P. troglodytes
gtccttgtgatctgcc

SEQ ID NO: 256049 - DNA, 16 bp, P. troglodytes
gtcctttccagcaaca

SEQ ID NO: 256050 - DNA, 16 bp, P. troglodytes
gtcctttccccacttt

SEQ ID NO: 256051 - DNA, 18 bp, P. troglodytes
gtcgaggtgggaggatcg

SEQ ID NO: 256052 - DNA, 16 bp, P. troglodytes
gtcgcccaggctgtag

SEQ ID NO: 256053 - DNA, 16 bp, P. troglodytes
gtcggccaggctggtt

SEQ ID NO: 256054 - DNA, 16 bp, P. troglodytes
gtcggcctgcaggcag

SEQ ID NO: 256055 - DNA, 16 bp, P. troglodytes
gtcggggcacagcttg

SEQ ID NO: 256056 - DNA, 16 bp, P. troglodytes
gtctaaaattatttca

SEQ ID NO: 256057 - DNA, 16 bp, P. troglodytes
gtctaacacttaagtc

SEQ ID NO: 256058 - DNA, 16 bp, P. troglodytes
gtctaatagaaatata

SEQ ID NO: 256059 - DNA, 16 bp, P. troglodytes
gtctaatatccagtat

SEQ ID NO: 256060 - DNA, 16 bp, P. troglodytes
gtctaatctgctgtta

SEQ ID NO: 256061 - DNA, 16 bp, P. troglodytes
gtctacagaggcaggt

SEQ ID NO: 256062 - DNA, 16 bp, P. troglodytes
gtctacagctcccagc

SEQ ID NO: 256063 - DNA, 16 bp, P. troglodytes
gtctactaaaaataca

SEQ ID NO: 256064 - DNA, 16 bp, P. troglodytes
gtctactaaaatacaa

SEQ ID NO: 256065 - DNA, 16 bp, P. troglodytes
gtctactgatttaaat

SEQ ID NO: 256066 - DNA, 16 bp, P. troglodytes
gtctagccaacatggc

SEQ ID NO: 256067 - DNA, 16 bp, P. troglodytes
gtctagctactcagga

SEQ ID NO: 256068 - DNA, 16 bp, P. troglodytes
gtctataaaaagaaaa

SEQ ID NO: 256069 - DNA, 16 bp, P. troglodytes
gtctatgaattttgtt

SEQ ID NO: 256070 - DNA, 16 bp, P. troglodytes
gtctatgtgtcttttt

SEQ ID NO: 256071 - DNA, 16 bp, P. troglodytes
gtctatgtgtgtgtgt

SEQ ID NO: 256072 - DNA, 16 bp, P. troglodytes
gtctatgtgtttgttt

SEQ ID NO: 256073 - DNA, 16 bp, P. troglodytes
gtctattcagggtttc

SEQ ID NO: 256074 - DNA, 16 bp, P. troglodytes
gtctatttctctgttt

SEQ ID NO: 256075 - DNA, 16 bp, P. troglodytes
gtctattttggagaat

SEQ ID NO: 256076 - DNA, 16 bp, P. troglodytes
gtctatttttatgtca

SEQ ID NO: 256077 - DNA, 16 bp, P. troglodytes
gtctcaaaaaaaaaat

SEQ ID NO: 256078 - DNA, 16 bp, P. troglodytes
gtctcaaaaaaaagtt

SEQ ID NO: 256079 - DNA, 16 bp, P. troglodytes
gtctcaaaaaaagaac

SEQ ID NO: 256080 - DNA, 16 bp, P. troglodytes
gtctcaaaaaacaaat

SEQ ID NO: 256081 - DNA, 16 bp, P. troglodytes
gtctcaaaaaacagaa

SEQ ID NO: 256082 - DNA, 16 bp, P. troglodytes
gtctcaaaaaagaaaa

SEQ ID NO: 256083 - DNA, 16 bp, P. troglodytes
gtctcaaaaaagaaga

SEQ ID NO: 256084 - DNA, 16 bp, P. troglodytes
gtctcaaaaacataat

SEQ ID NO: 256085 - DNA, 16 bp, P. troglodytes
gtctcaaaaaggaaaa

SEQ ID NO: 256086 - DNA, 16 bp, P. troglodytes
gtctcaaaaatgaaat

SEQ ID NO: 256087 - DNA, 16 bp, P. troglodytes
gtctcaaagaaaagga

SEQ ID NO: 256088 - DNA, 16 bp, P. troglodytes
gtctcaaagagatatt

SEQ ID NO: 256089 - DNA, 16 bp, P. troglodytes
gtctcaaaggaaaaaa

SEQ ID NO: 256090 - DNA, 16 bp, P. troglodytes
gtctcaaagtatctct

SEQ ID NO: 256091 - DNA, 16 bp, P. troglodytes
gtctcaaatgcctgag

SEQ ID NO: 256092 - DNA, 16 bp, P. troglodytes
gtctcaagagaaaaaa

SEQ ID NO: 256093 - DNA, 16 bp, P. troglodytes
gtctcacacacaaaaa

SEQ ID NO: 256094 - DNA, 16 bp, P. troglodytes
gtctcacagctctgga

SEQ ID NO: 256095 - DNA, 16 bp, P. troglodytes
gtctcacagtgttgcc

SEQ ID NO: 256096 - DNA, 16 bp, P. troglodytes
gtctcaccttgttgcc

SEQ ID NO: 256097 - DNA, 16 bp, P. troglodytes
gtctcactatgtcgcc

SEQ ID NO: 256098 - DNA, 16 bp, P. troglodytes
gtctcactatgttgct

SEQ ID NO: 256099 - DNA, 16 bp, P. troglodytes
gtctcactctgtcact

SEQ ID NO: 256100 - DNA, 16 bp, P. troglodytes
gtctcactctgtcagc

SEQ ID NO: 256101 - DNA, 16 bp, P. troglodytes
gtctcactctgtggtc

SEQ ID NO: 256102 - DNA, 16 bp, P. troglodytes
gtctcactctgttacc

SEQ ID NO: 256103 - DNA, 16 bp, P. troglodytes
gtctcactcttttgcc

SEQ ID NO: 256104 - DNA, 16 bp, P. troglodytes
gtctcactgcaacctc

SEQ ID NO: 256105 - DNA, 16 bp, P. troglodytes
gtctcactgtcaccag

SEQ ID NO: 256106 - DNA, 16 bp, P. troglodytes
gtctcactgtggtttt

SEQ ID NO: 256107 - DNA, 16 bp, P. troglodytes
gtctcactgtgtctcc

SEQ ID NO: 256108 - DNA, 16 bp, P. troglodytes
gtctcagaaaaagaga

SEQ ID NO: 256109 - DNA, 16 bp, P. troglodytes
gtctcagaaagaaaaa

SEQ ID NO: 256110 - DNA, 16 bp, P. troglodytes
gtctcagagacagttt

SEQ ID NO: 256111 - DNA, 16 bp, P. troglodytes
gtctcagcccagaatc

SEQ ID NO: 256112 - DNA, 16 bp, P. troglodytes
gtctcagccccaaatc

SEQ ID NO: 256113 - DNA, 16 bp, P. troglodytes
gtctcagcctccccag

SEQ ID NO: 256114 - DNA, 16 bp, P. troglodytes
gtctcagctcactgca

SEQ ID NO: 256115 - DNA, 16 bp, P. troglodytes
gtctcagcttccccag

SEQ ID NO: 256116 - DNA, 16 bp, P. troglodytes
gtctcaggcaggtcct

SEQ ID NO: 256117 - DNA, 16 bp, P. troglodytes
gtctcaggctctgctt

SEQ ID NO: 256118 - DNA, 16 bp, P. troglodytes
gtctcaggggaaaaaa

SEQ ID NO: 256119 - DNA, 16 bp, P. troglodytes
gtctcagtttccacat

SEQ ID NO: 256120 - DNA, 16 bp, P. troglodytes
gtctcataaataaata

SEQ ID NO: 256121 - DNA, 16 bp, P. troglodytes
gtctcataacataata

SEQ ID NO: 256122 - DNA, 16 bp, P. troglodytes
gtctcatctgaaggct

SEQ ID NO: 256123 - DNA, 16 bp, P. troglodytes
gtctccaaacaaacaa

SEQ ID NO: 256124 - DNA, 16 bp, P. troglodytes
gtctccaagaagtctg

SEQ ID NO: 256125 - DNA, 16 bp, P. troglodytes
gtctccacaatccctt

SEQ ID NO: 256126 - DNA, 16 bp, P. troglodytes
gtctccagcttgcaaa

SEQ ID NO: 256127 - DNA, 16 bp, P. troglodytes
gtctccaggcctgtga

SEQ ID NO: 256128 - DNA, 16 bp, P. troglodytes
gtctccattttcattt

SEQ ID NO: 256129 - DNA, 16 bp, P. troglodytes
gtctcccagggtggag

SEQ ID NO: 256130 - DNA, 16 bp, P. troglodytes
gtctcccaggttcaag

SEQ ID NO: 256131 - DNA, 16 bp, P. troglodytes
gtctcccaggttcagg

SEQ ID NO: 256132 - DNA, 16 bp, P. troglodytes
gtctccctctgatgcc

SEQ ID NO: 256133 - DNA, 16 bp, P. troglodytes
gtctccctggctcaag

SEQ ID NO: 256134 - DNA, 16 bp, P. troglodytes
gtctcctactcctgac

SEQ ID NO: 256135 - DNA, 16 bp, P. troglodytes
gtctcctcctccagga

SEQ ID NO: 256136 - DNA, 17 bp, P. troglodytes
gtctcctgacctcatga

SEQ ID NO: 256137 - DNA, 18 bp, P. troglodytes
gtctcctgcctcagcctc

SEQ ID NO: 256138 - DNA, 16 bp, P. troglodytes
gtctcctggattcaag

SEQ ID NO: 256139 - DNA, 16 bp, P. troglodytes
gtctcctgtcacccag

SEQ ID NO: 256140 - DNA, 16 bp, P. troglodytes
gtctcgaactcctgaa

SEQ ID NO: 256141 - DNA, 18 bp, P. troglodytes
gtctcgactaaaaataca

SEQ ID NO: 256142 - DNA, 18 bp, P. troglodytes
gtctcgatctgctgacct

SEQ ID NO: 256143 - DNA, 16 bp, P. troglodytes
gtctcgccctgtcacc

SEQ ID NO: 256144 - DNA, 16 bp, P. troglodytes
gtctcgccttgtcgcc

SEQ ID NO: 256145 - DNA, 16 bp, P. troglodytes
gtctcgctctgccacc

SEQ ID NO: 256146 - DNA, 16 bp, P. troglodytes
gtctcgctctgtggcc

SEQ ID NO: 256147 - DNA, 21 bp, P. troglodytes
gtctcggcctcccaaagtgct

SEQ ID NO: 256148 - DNA, 17 bp, P. troglodytes
gtctcgtgcctcagcct

SEQ ID NO: 256149 - DNA, 16 bp, P. troglodytes
gtctctaaaaagtaaa

SEQ ID NO: 256150 - DNA, 16 bp, P. troglodytes
gtctctaaaaatacaa

SEQ ID NO: 256151 - DNA, 16 bp, P. troglodytes
gtctctacaaaaacat

SEQ ID NO: 256152 - DNA, 16 bp, P. troglodytes
gtctctacaaaacaac

SEQ ID NO: 256153 - DNA, 16 bp, P. troglodytes
gtctctactaaaaaac

SEQ ID NO: 256154 - DNA, 17 bp, P. troglodytes
gtctctactaaaaataa

SEQ ID NO: 256155 - DNA, 16 bp, P. troglodytes
gtctctactaaaaatc

SEQ ID NO: 256156 - DNA, 16 bp, P. troglodytes
gtctctactaaaaatt

SEQ ID NO: 256157 - DNA, 16 bp, P. troglodytes
gtctctactagaaata

SEQ ID NO: 256158 - DNA, 16 bp, P. troglodytes
gtctctatctctatct

SEQ ID NO: 256159 - DNA, 16 bp, P. troglodytes
gtctctatgaaaaata

SEQ ID NO: 256160 - DNA, 16 bp, P. troglodytes
gtctctcaaaaaaaaa

SEQ ID NO: 256161 - DNA, 16 bp, P. troglodytes
gtctctcacaaggctg

SEQ ID NO: 256162 - DNA, 16 bp, P. troglodytes
gtctctcaggttaaat

SEQ ID NO: 256163 - DNA, 16 bp, P. troglodytes
gtctctcctggagctg

SEQ ID NO: 256164 - DNA, 16 bp, P. troglodytes
gtctctcctgttagaa

SEQ ID NO: 256165 - DNA, 16 bp, P. troglodytes
gtctctctcactctgt

SEQ ID NO: 256166 - DNA, 16 bp, P. troglodytes
gtctctctctctctgt

SEQ ID NO: 256167 - DNA, 16 bp, P. troglodytes
gtctctctctgtagcc

SEQ ID NO: 256168 - DNA, 16 bp, P. troglodytes
gtctctctctgtgtgt

SEQ ID NO: 256169 - DNA, 16 bp, P. troglodytes
gtctctgaaagaaaaa

SEQ ID NO: 256170 - DNA, 16 bp, P. troglodytes
gtctctgataaaaata

SEQ ID NO: 256171 - DNA, 16 bp, P. troglodytes
gtctctgccttcaagg

SEQ ID NO: 256172 - DNA, 16 bp, P. troglodytes
gtctctggtaaccacc

SEQ ID NO: 256173 - DNA, 16 bp, P. troglodytes
gtctctgtcacaacta

SEQ ID NO: 256174 - DNA, 16 bp, P. troglodytes
gtctctgtcacagcta

SEQ ID NO: 256175 - DNA, 16 bp, P. troglodytes
gtctctgtcacccaag

SEQ ID NO: 256176 - DNA, 16 bp, P. troglodytes
gtctctgtctctatct

SEQ ID NO: 256177 - DNA, 16 bp, P. troglodytes
gtctctgtctgtgtct

SEQ ID NO: 256178 - DNA, 16 bp, P. troglodytes
gtctctgttctgttcc

SEQ ID NO: 256179 - DNA, 16 bp, P. troglodytes
gtctctgttgcccaag

SEQ ID NO: 256180 - DNA, 16 bp, P. troglodytes
gtctcttaacctctct

SEQ ID NO: 256181 - DNA, 16 bp, P. troglodytes
gtctcttcattctgtt

SEQ ID NO: 256182 - DNA, 16 bp, P. troglodytes
gtctcttgaaaaaaaa

SEQ ID NO: 256183 - DNA, 17 bp, P. troglodytes
gtctcttgacctcgtga

SEQ ID NO: 256184 - DNA, 16 bp, P. troglodytes
gtctcttgtattcagg

SEQ ID NO: 256185 - DNA, 16 bp, P. troglodytes
gtctcttgtgacagtt

SEQ ID NO: 256186 - DNA, 16 bp, P. troglodytes
gtctgaaaaagacttt

SEQ ID NO: 256187 - DNA, 16 bp, P. troglodytes
gtctgaaaaagatttt

SEQ ID NO: 256188 - DNA, 16 bp, P. troglodytes
gtctgaacaaaatggt

SEQ ID NO: 256189 - DNA, 16 bp, P. troglodytes
gtctgaatttttaaaa

SEQ ID NO: 256190 - DNA, 16 bp, P. troglodytes
gtctgaccccagagcc

SEQ ID NO: 256191 - DNA, 16 bp, P. troglodytes
gtctgactccaaagtc

SEQ ID NO: 256192 - DNA, 16 bp, P. troglodytes
gtctgactctgttgcc

SEQ ID NO: 256193 - DNA, 16 bp, P. troglodytes
gtctgacttcttttgc

SEQ ID NO: 256194 - DNA, 16 bp, P. troglodytes
gtctgagaaataaaga

SEQ ID NO: 256195 - DNA, 16 bp, P. troglodytes
gtctgaggaaaaaaaa

SEQ ID NO: 256196 - DNA, 16 bp, P. troglodytes
gtctgaggaacagaaa

SEQ ID NO: 256197 - DNA, 16 bp, P. troglodytes
gtctgaggctggagaa

SEQ ID NO: 256198 - DNA, 16 bp, P. troglodytes
gtctgaggtgggagaa

SEQ ID NO: 256199 - DNA, 16 bp, P. troglodytes
gtctgaggttgcagtg

SEQ ID NO: 256200 - DNA, 16 bp, P. troglodytes
gtctgattttgagctt

SEQ ID NO: 256201 - DNA, 16 bp, P. troglodytes
gtctgcaagaagaaaa

SEQ ID NO: 256202 - DNA, 16 bp, P. troglodytes
gtctgcagaggcaggc

SEQ ID NO: 256203 - DNA, 16 bp, P. troglodytes
gtctgcagtttttcca

SEQ ID NO: 256204 - DNA, 16 bp, P. troglodytes
gtctgcatgtgtgtgt

SEQ ID NO: 256205 - DNA, 16 bp, P. troglodytes
gtctgcctagaatttc

SEQ ID NO: 256206 - DNA, 16 bp, P. troglodytes
gtctgcctcggcctcc

SEQ ID NO: 256207 - DNA, 16 bp, P. troglodytes
gtctgcctgcctgcct

SEQ ID NO: 256208 - DNA, 16 bp, P. troglodytes
gtctgcctgtctgcct

SEQ ID NO: 256209 - DNA, 17 bp, P. troglodytes
gtctgcctgttctcaga

SEQ ID NO: 256210 - DNA, 16 bp, P. troglodytes
gtctgccttccccagc

SEQ ID NO: 256211 - DNA, 16 bp, P. troglodytes
gtctgctaaaaataca

SEQ ID NO: 256212 - DNA, 16 bp, P. troglodytes
gtctgctgaagctgca

SEQ ID NO: 256213 - DNA, 16 bp, P. troglodytes
gtctgctgaccttccc

SEQ ID NO: 256214 - DNA, 16 bp, P. troglodytes
gtctgctggggctgcc

SEQ ID NO: 256215 - DNA, 16 bp, P. troglodytes
gtctgctttgggaaag

SEQ ID NO: 256216 - DNA, 16 bp, P. troglodytes
gtctggaactgaacct

SEQ ID NO: 256217 - DNA, 16 bp, P. troglodytes
gtctggaatggacctc

SEQ ID NO: 256218 - DNA, 16 bp, P. troglodytes
gtctggaattttggta

SEQ ID NO: 256219 - DNA, 16 bp, P. troglodytes
gtctggagaggacctc

SEQ ID NO: 256220 - DNA, 16 bp, P. troglodytes
gtctggagggtggtgg

SEQ ID NO: 256221 - DNA, 16 bp, P. troglodytes
gtctggagtgcacctc

SEQ ID NO: 256222 - DNA, 16 bp, P. troglodytes
gtctggagtggacctc

SEQ ID NO: 256223 - DNA, 16 bp, P. troglodytes
gtctggccacagtggc

SEQ ID NO: 256224 - DNA, 16 bp, P. troglodytes
gtctggctctgtcccc

SEQ ID NO: 256225 - DNA, 16 bp, P. troglodytes
gtctggctgggcacag

SEQ ID NO: 256226 - DNA, 16 bp, P. troglodytes
gtctgggagacagagt

SEQ ID NO: 256227 - DNA, 16 bp, P. troglodytes
gtctgggcattggaag

SEQ ID NO: 256228 - DNA, 16 bp, P. troglodytes
gtctgggtgggcacca

SEQ ID NO: 256229 - DNA, 16 bp, P. troglodytes
gtctggtggcacatgc

SEQ ID NO: 256230 - DNA, 16 bp, P. troglodytes
gtctgtaaaatgaaga

SEQ ID NO: 256231 - DNA, 16 bp, P. troglodytes
gtctgtatgtctgtgt

SEQ ID NO: 256232 - DNA, 16 bp, P. troglodytes
gtctgtatgtgtgtat

SEQ ID NO: 256233 - DNA, 16 bp, P. troglodytes
gtctgtcacccaggct

SEQ ID NO: 256234 - DNA, 16 bp, P. troglodytes
gtctgtccttccttcc

SEQ ID NO: 256235 - DNA, 16 bp, P. troglodytes
gtctgtctctcccttt

SEQ ID NO: 256236 - DNA, 16 bp, P. troglodytes
gtctgtctctctctca

SEQ ID NO: 256237 - DNA, 16 bp, P. troglodytes
gtctgtctctctgtct

SEQ ID NO: 256238 - DNA, 16 bp, P. troglodytes
gtctgtctctgtcacc

SEQ ID NO: 256239 - DNA, 16 bp, P. troglodytes
gtctgtctgcctgtct

SEQ ID NO: 256240 - DNA, 16 bp, P. troglodytes
gtctgtctgtctgtcc

SEQ ID NO: 256241 - DNA, 16 bp, P. troglodytes
gtctgtctgtctgtct

SEQ ID NO: 256242 - DNA, 16 bp, P. troglodytes
gtctgtgaattctttt

SEQ ID NO: 256243 - DNA, 16 bp, P. troglodytes
gtctgtgatttcctca

SEQ ID NO: 256244 - DNA, 16 bp, P. troglodytes
gtctgtgccctgcccc

SEQ ID NO: 256245 - DNA, 16 bp, P. troglodytes
gtctgtggctgctttt

SEQ ID NO: 256246 - DNA, 16 bp, P. troglodytes
gtctgtgtatatgtgt

SEQ ID NO: 256247 - DNA, 16 bp, P. troglodytes
gtctgtgtgtctgtct

SEQ ID NO: 256248 - DNA, 16 bp, P. troglodytes
gtctgtgtttttaaaa

SEQ ID NO: 256249 - DNA, 16 bp, P. troglodytes
gtctgttaggtccatt

SEQ ID NO: 256250 - DNA, 16 bp, P. troglodytes
gtctgttcaggtttta

SEQ ID NO: 256251 - DNA, 16 bp, P. troglodytes
gtctgttcataccctt

SEQ ID NO: 256252 - DNA, 16 bp, P. troglodytes
gtctgttcctgctgct

SEQ ID NO: 256253 - DNA, 16 bp, P. troglodytes
gtctgttgcccaggct

SEQ ID NO: 256254 - DNA, 16 bp, P. troglodytes
gtctgttggctgcata

SEQ ID NO: 256255 - DNA, 16 bp, P. troglodytes
gtctgttttgctcatt

SEQ ID NO: 256256 - DNA, 16 bp, P. troglodytes
gtctgttttgttcatt

SEQ ID NO: 256257 - DNA, 16 bp, P. troglodytes
gtctgttttttatgcc

SEQ ID NO: 256258 - DNA, 16 bp, P. troglodytes
gtcttaaaaaaacaaa

SEQ ID NO: 256259 - DNA, 16 bp, P. troglodytes
gtcttaaaaaggaagg

SEQ ID NO: 256260 - DNA, 16 bp, P. troglodytes
gtcttaaaaataaata

SEQ ID NO: 256261 - DNA, 16 bp, P. troglodytes
gtcttaataaatttaa

SEQ ID NO: 256262 - DNA, 16 bp, P. troglodytes
gtcttactctattgcc

SEQ ID NO: 256263 - DNA, 16 bp, P. troglodytes
gtcttactctgtcaac

SEQ ID NO: 256264 - DNA, 16 bp, P. troglodytes
gtcttatttattaaag

SEQ ID NO: 256265 - DNA, 16 bp, P. troglodytes
gtcttattttgaaaag

SEQ ID NO: 256266 - DNA, 16 bp, P. troglodytes
gtcttcaagctcactg

SEQ ID NO: 256267 - DNA, 16 bp, P. troglodytes
gtcttcaatccatctt

SEQ ID NO: 256268 - DNA, 16 bp, P. troglodytes
gtcttcacaatttggc

SEQ ID NO: 256269 - DNA, 16 bp, P. troglodytes
gtcttcacatggctgg

SEQ ID NO: 256270 - DNA, 16 bp, P. troglodytes
gtcttcagaattgtca

SEQ ID NO: 256271 - DNA, 16 bp, P. troglodytes
gtcttcatttccttat

SEQ ID NO: 256272 - DNA, 16 bp, P. troglodytes
gtcttcatttctgaag

SEQ ID NO: 256273 - DNA, 16 bp, P. troglodytes
gtcttccaacaaagaa

SEQ ID NO: 256274 - DNA, 16 bp, P. troglodytes
gtcttccacaaaacct

SEQ ID NO: 256275 - DNA, 16 bp, P. troglodytes
gtcttcctccccaaaa

SEQ ID NO: 256276 - DNA, 16 bp, P. troglodytes
gtcttcctttgtcacc

SEQ ID NO: 256277 - DNA, 16 bp, P. troglodytes
gtcttctcatttgtaa

SEQ ID NO: 256278 - DNA, 16 bp, P. troglodytes
gtcttctgcgtcgctc

SEQ ID NO: 256279 - DNA, 16 bp, P. troglodytes
gtcttcttgatttctt

SEQ ID NO: 256280 - DNA, 16 bp, P. troglodytes
gtcttcttttgagata

SEQ ID NO: 256281 - DNA, 16 bp, P. troglodytes
gtcttgaaaaaaaaaa

SEQ ID NO: 256282 - DNA, 16 bp, P. troglodytes
gtcttgaacatctgac

SEQ ID NO: 256283 - DNA, 16 bp, P. troglodytes
gtcttgaactactggc

SEQ ID NO: 256284 - DNA, 16 bp, P. troglodytes
gtcttgaagagatatt

SEQ ID NO: 256285 - DNA, 16 bp, P. troglodytes
gtcttgacctcttgac

SEQ ID NO: 256286 - DNA, 16 bp, P. troglodytes
gtcttgagctcttggg

SEQ ID NO: 256287 - DNA, 16 bp, P. troglodytes
gtcttgatttgcattt

SEQ ID NO: 256288 - DNA, 16 bp, P. troglodytes
gtcttgctcagcagat

SEQ ID NO: 256289 - DNA, 16 bp, P. troglodytes
gtcttgctctgacacc

SEQ ID NO: 256290 - DNA, 16 bp, P. troglodytes
gtcttgctctggtgcc

SEQ ID NO: 256291 - DNA, 16 bp, P. troglodytes
gtcttgctctgtcgct

SEQ ID NO: 256292 - DNA, 16 bp, P. troglodytes
gtcttgctctgtggcc

SEQ ID NO: 256293 - DNA, 16 bp, P. troglodytes
gtcttgctctgttgct

SEQ ID NO: 256294 - DNA, 16 bp, P. troglodytes
gtcttgctctttcgcc

SEQ ID NO: 256295 - DNA, 16 bp, P. troglodytes
gtcttgctgtcttggg

SEQ ID NO: 256296 - DNA, 16 bp, P. troglodytes
gtcttgctttgctgcc

SEQ ID NO: 256297 - DNA, 16 bp, P. troglodytes
gtcttgctttttaaaa

SEQ ID NO: 256298 - DNA, 16 bp, P. troglodytes
gtcttggaactcctgg

SEQ ID NO: 256299 - DNA, 16 bp, P. troglodytes
gtcttggacttttttt

SEQ ID NO: 256300 - DNA, 19 bp, P. troglodytes
gtcttggagttgctcttct

SEQ ID NO: 256301 - DNA, 16 bp, P. troglodytes
gtcttggctgggcatg

SEQ ID NO: 256302 - DNA, 16 bp, P. troglodytes
gtcttgggggaaaaaa

SEQ ID NO: 256303 - DNA, 16 bp, P. troglodytes
gtcttggtaaaataac

SEQ ID NO: 256304 - DNA, 16 bp, P. troglodytes
gtcttggtctgttgcc

SEQ ID NO: 256305 - DNA, 16 bp, P. troglodytes
gtctttaatcaatctt

SEQ ID NO: 256306 - DNA, 16 bp, P. troglodytes
gtctttactaaaaaaa

SEQ ID NO: 256307 - DNA, 16 bp, P. troglodytes
gtctttcagaccacag

SEQ ID NO: 256308 - DNA, 16 bp, P. troglodytes
gtctttcctgtgctct

SEQ ID NO: 256309 - DNA, 16 bp, P. troglodytes
gtctttctgtgcttgg

SEQ ID NO: 256310 - DNA, 16 bp, P. troglodytes
gtctttctttgttgcc

SEQ ID NO: 256311 - DNA, 16 bp, P. troglodytes
gtctttgattcatttt

SEQ ID NO: 256312 - DNA, 16 bp, P. troglodytes
gtctttgcctgctgcc

SEQ ID NO: 256313 - DNA, 16 bp, P. troglodytes
gtctttggaacttgcc

SEQ ID NO: 256314 - DNA, 16 bp, P. troglodytes
gtctttgtagcagcat

SEQ ID NO: 256315 - DNA, 16 bp, P. troglodytes
gtctttgtcatgaaat

SEQ ID NO: 256316 - DNA, 16 bp, P. troglodytes
gtctttgtccccagtt

SEQ ID NO: 256317 - DNA, 16 bp, P. troglodytes
gtctttgtctttcatg

SEQ ID NO: 256318 - DNA, 16 bp, P. troglodytes
gtctttgttctcactg

SEQ ID NO: 256319 - DNA, 16 bp, P. troglodytes
gtcttttcacattttt

SEQ ID NO: 256320 - DNA, 16 bp, P. troglodytes
gtcttttgaagacagc

SEQ ID NO: 256321 - DNA, 16 bp, P. troglodytes
gtcttttgtaactggc

SEQ ID NO: 256322 - DNA, 16 bp, P. troglodytes
gtctttttaaaaaaaa

SEQ ID NO: 256323 - DNA, 16 bp, P. troglodytes
gtctttttccatctct

SEQ ID NO: 256324 - DNA, 16 bp, P. troglodytes
gtctttttgatagtag

SEQ ID NO: 256325 - DNA, 16 bp, P. troglodytes
gtcttttttagtagag

SEQ ID NO: 256326 - DNA, 16 bp, P. troglodytes
gtcttttttgatcatt

SEQ ID NO: 256327 - DNA, 16 bp, P. troglodytes
gtgaaaaagagaatat

SEQ ID NO: 256328 - DNA, 16 bp, P. troglodytes
gtgaaaaaggagacat

SEQ ID NO: 256329 - DNA, 16 bp, P. troglodytes
gtgaaaaataaatttc

SEQ ID NO: 256330 - DNA, 16 bp, P. troglodytes
gtgaaaacagacaaat

SEQ ID NO: 256331 - DNA, 16 bp, P. troglodytes
gtgaaaactgactaat

SEQ ID NO: 256332 - DNA, 16 bp, P. troglodytes
gtgaaaagacaacctg

SEQ ID NO: 256333 - DNA, 16 bp, P. troglodytes
gtgaaaagagagactg

SEQ ID NO: 256334 - DNA, 16 bp, P. troglodytes
gtgaaaaggaaacact

SEQ ID NO: 256335 - DNA, 16 bp, P. troglodytes
gtgaaaatccatctca

SEQ ID NO: 256336 - DNA, 16 bp, P. troglodytes
gtgaaaatgaaaaatg

SEQ ID NO: 256337 - DNA, 16 bp, P. troglodytes
gtgaaaatgctgtata

SEQ ID NO: 256338 - DNA, 16 bp, P. troglodytes
gtgaaaatggaaatat

SEQ ID NO: 256339 - DNA, 16 bp, P. troglodytes
gtgaaaatggacatac

SEQ ID NO: 256340 - DNA, 16 bp, P. troglodytes
gtgaaaatggcaatac

SEQ ID NO: 256341 - DNA, 16 bp, P. troglodytes
gtgaaaatggccataa

SEQ ID NO: 256342 - DNA, 16 bp, P. troglodytes
gtgaaaatggccttac

SEQ ID NO: 256343 - DNA, 16 bp, P. troglodytes
gtgaaaattaccaaaa

SEQ ID NO: 256344 - DNA, 16 bp, P. troglodytes
gtgaaacaaacaaaca

SEQ ID NO: 256345 - DNA, 16 bp, P. troglodytes
gtgaaacacacacaca

SEQ ID NO: 256346 - DNA, 16 bp, P. troglodytes
gtgaaacagaacagaa

SEQ ID NO: 256347 - DNA, 16 bp, P. troglodytes
gtgaaacccagtgtct

SEQ ID NO: 256348 - DNA, 18 bp, P. troglodytes
gtgaaaccccatctctat

SEQ ID NO: 256349 - DNA, 16 bp, P. troglodytes
gtgaaaccccattttt

SEQ ID NO: 256350 - DNA, 16 bp, P. troglodytes
gtgaaacccccgcctc

SEQ ID NO: 256351 - DNA, 21 bp, P. troglodytes
gtgaaaccccgtctctactac

SEQ ID NO: 256352 - DNA, 16 bp, P. troglodytes
gtgaaaccccttatct

SEQ ID NO: 256353 - DNA, 16 bp, P. troglodytes
gtgaaaccccttctct

SEQ ID NO: 256354 - DNA, 16 bp, P. troglodytes
gtgaaaccctggctct

SEQ ID NO: 256355 - DNA, 16 bp, P. troglodytes
gtgaaacctcgtctcc

SEQ ID NO: 256356 - DNA, 17 bp, P. troglodytes
gtgaaaccttgtcttta

SEQ ID NO: 256357 - DNA, 16 bp, P. troglodytes
gtgaaactccatctca

SEQ ID NO: 256358 - DNA, 16 bp, P. troglodytes
gtgaaactctgtccca

SEQ ID NO: 256359 - DNA, 16 bp, P. troglodytes
gtgaaagaagccaagc

SEQ ID NO: 256360 - DNA, 16 bp, P. troglodytes
gtgaaagaagccagcc

SEQ ID NO: 256361 - DNA, 16 bp, P. troglodytes
gtgaaagagacagaga

SEQ ID NO: 256362 - DNA, 16 bp, P. troglodytes
gtgaaagaggaagcaa

SEQ ID NO: 256363 - DNA, 16 bp, P. troglodytes
gtgaaagcaagtttat

SEQ ID NO: 256364 - DNA, 16 bp, P. troglodytes
gtgaaagcagctgcag

SEQ ID NO: 256365 - DNA, 16 bp, P. troglodytes
gtgaaagttgatcata

SEQ ID NO: 256366 - DNA, 16 bp, P. troglodytes
gtgaaatatatatata

SEQ ID NO: 256367 - DNA, 16 bp, P. troglodytes
gtgaaatcctgtctgt

SEQ ID NO: 256368 - DNA, 16 bp, P. troglodytes
gtgaaatgaatgaatg

SEQ ID NO: 256369 - DNA, 16 bp, P. troglodytes
gtgaaatgccatcttt

SEQ ID NO: 256370 - DNA, 16 bp, P. troglodytes
gtgaaatgctatctct

SEQ ID NO: 256371 - DNA, 16 bp, P. troglodytes
gtgaaatggcgtgatc

SEQ ID NO: 256372 - DNA, 16 bp, P. troglodytes
gtgaaatggggataat

SEQ ID NO: 256373 - DNA, 16 bp, P. troglodytes
gtgaaatgttatctca

SEQ ID NO: 256374 - DNA, 16 bp, P. troglodytes
gtgaaattaaaattgc

SEQ ID NO: 256375 - DNA, 16 bp, P. troglodytes
gtgaaattccttctcc

SEQ ID NO: 256376 - DNA, 22 bp, P. troglodytes
gtgaaattgaggcaataattaa

SEQ ID NO: 256377 - DNA, 16 bp, P. troglodytes
gtgaaattggaatgtt

SEQ ID NO: 256378 - DNA, 16 bp, P. troglodytes
gtgaacaagacaaagt

SEQ ID NO: 256379 - DNA, 16 bp, P. troglodytes
gtgaacagtgcagcaa

SEQ ID NO: 256380 - DNA, 16 bp, P. troglodytes
gtgaaccaagatcgcg

SEQ ID NO: 256381 - DNA, 16 bp, P. troglodytes
gtgaaccctactgtga

SEQ ID NO: 256382 - DNA, 16 bp, P. troglodytes
gtgaacctggaaggca

SEQ ID NO: 256383 - DNA, 20 bp, P. troglodytes
gtgaacctgggaggcggagg

SEQ ID NO: 256384 - DNA, 16 bp, P. troglodytes
gtgaacgtgtgtgtgt

SEQ ID NO: 256385 - DNA, 16 bp, P. troglodytes
gtgaactataacaagt

SEQ ID NO: 256386 - DNA, 16 bp, P. troglodytes
gtgaagaaaagggaat

SEQ ID NO: 256387 - DNA, 16 bp, P. troglodytes
gtgaagaaaatcattg

SEQ ID NO: 256388 - DNA, 16 bp, P. troglodytes
gtgaagaaagtaaatg

SEQ ID NO: 256389 - DNA, 16 bp, P. troglodytes
gtgaagaagatgaaga

SEQ ID NO: 256390 - DNA, 16 bp, P. troglodytes
gtgaagaaggtcattg

SEQ ID NO: 256391 - DNA, 16 bp, P. troglodytes
gtgaagacatttcctt

SEQ ID NO: 256392 - DNA, 16 bp, P. troglodytes
gtgaagagcgaaagaa

SEQ ID NO: 256393 - DNA, 16 bp, P. troglodytes
gtgaagatgaaatgaa

SEQ ID NO: 256394 - DNA, 16 bp, P. troglodytes
gtgaagatgatgagga

SEQ ID NO: 256395 - DNA, 16 bp, P. troglodytes
gtgaagatgctgtaaa

SEQ ID NO: 256396 - DNA, 16 bp, P. troglodytes
gtgaagatgctgtgaa

SEQ ID NO: 256397 - DNA, 16 bp, P. troglodytes
gtgaagatggaagcag

SEQ ID NO: 256398 - DNA, 16 bp, P. troglodytes
gtgaagatgtgcctgc

SEQ ID NO: 256399 - DNA, 16 bp, P. troglodytes
gtgaagattaaatgaa

SEQ ID NO: 256400 - DNA, 16 bp, P. troglodytes
gtgaagcagaggacat

SEQ ID NO: 256401 - DNA, 16 bp, P. troglodytes
gtgaagcagggttttc

SEQ ID NO: 256402 - DNA, 16 bp, P. troglodytes
gtgaagcccaatgcaa

SEQ ID NO: 256403 - DNA, 16 bp, P. troglodytes
gtgaagcctcaggaag

SEQ ID NO: 256404 - DNA, 16 bp, P. troglodytes
gtgaagctggaagcca

SEQ ID NO: 256405 - DNA, 16 bp, P. troglodytes
gtgaaggagaagcaag

SEQ ID NO: 256406 - DNA, 16 bp, P. troglodytes
gtgaagggaaagcagg

SEQ ID NO: 256407 - DNA, 16 bp, P. troglodytes
gtgaaggggaagctgg

SEQ ID NO: 256408 - DNA, 16 bp, P. troglodytes
gtgaagtctgaaattt

SEQ ID NO: 256409 - DNA, 16 bp, P. troglodytes
gtgaagttgtcatgtg

SEQ ID NO: 256410 - DNA, 16 bp, P. troglodytes
gtgaataatgctacag

SEQ ID NO: 256411 - DNA, 16 bp, P. troglodytes
gtgaatattgctgcta

SEQ ID NO: 256412 - DNA, 17 bp, P. troglodytes
gtgaatccaggaggcag

SEQ ID NO: 256413 - DNA, 16 bp, P. troglodytes
gtgaatgaatcaatga

SEQ ID NO: 256414 - DNA, 16 bp, P. troglodytes
gtgaatggagcttgca

SEQ ID NO: 256415 - DNA, 16 bp, P. troglodytes
gtgaatgggattaagg

SEQ ID NO: 256416 - DNA, 16 bp, P. troglodytes
gtgaatgtgtgtatgt

SEQ ID NO: 256417 - DNA, 16 bp, P. troglodytes
gtgaattctcctgcct

SEQ ID NO: 256418 - DNA, 16 bp, P. troglodytes
gtgaatttggagctga

SEQ ID NO: 256419 - DNA, 16 bp, P. troglodytes
gtgacaaaaacaagca

SEQ ID NO: 256420 - DNA, 16 bp, P. troglodytes
gtgacaaagaccctgt

SEQ ID NO: 256421 - DNA, 16 bp, P. troglodytes
gtgacaaagtgagagc

SEQ ID NO: 256422 - DNA, 16 bp, P. troglodytes
gtgacaacagtgagac

SEQ ID NO: 256423 - DNA, 16 bp, P. troglodytes
gtgacaaccagaaatg

SEQ ID NO: 256424 - DNA, 16 bp, P. troglodytes
gtgacaagagccaaac

SEQ ID NO: 256425 - DNA, 16 bp, P. troglodytes
gtgacacagtcatagc

SEQ ID NO: 256426 - DNA, 16 bp, P. troglodytes
gtgacaccctgtctcc

SEQ ID NO: 256427 - DNA, 16 bp, P. troglodytes
gtgacacctttgcttt

SEQ ID NO: 256428 - DNA, 16 bp, P. troglodytes
gtgacagaatgagacc

SEQ ID NO: 256429 - DNA, 16 bp, P. troglodytes
gtgacagacagagacc

SEQ ID NO: 256430 - DNA, 16 bp, P. troglodytes
gtgacagagcaagatg

SEQ ID NO: 256431 - DNA, 16 bp, P. troglodytes
gtgacagagcagaact

SEQ ID NO: 256432 - DNA, 16 bp, P. troglodytes
gtgacagagcaggatt

SEQ ID NO: 256433 - DNA, 16 bp, P. troglodytes
gtgacagagccagagt

SEQ ID NO: 256434 - DNA, 16 bp, P. troglodytes
gtgacagagccaggat

SEQ ID NO: 256435 - DNA, 16 bp, P. troglodytes
gtgacagagcgagaca

SEQ ID NO: 256436 - DNA, 16 bp, P. troglodytes
gtgacagaggaagacc

SEQ ID NO: 256437 - DNA, 16 bp, P. troglodytes
gtgacagaggcagaag

SEQ ID NO: 256438 - DNA, 17 bp, P. troglodytes
gtgacagagtgagacct

SEQ ID NO: 256439 - DNA, 16 bp, P. troglodytes
gtgacagagtgagagc

SEQ ID NO: 256440 - DNA, 16 bp, P. troglodytes
gtgacagagtgggact

SEQ ID NO: 256441 - DNA, 16 bp, P. troglodytes
gtgacagctttgaaga

SEQ ID NO: 256442 - DNA, 16 bp, P. troglodytes
gtgacagtgagactct

SEQ ID NO: 256443 - DNA, 16 bp, P. troglodytes
gtgacagtgagactgt

SEQ ID NO: 256444 - DNA, 16 bp, P. troglodytes
gtgacagtgagctgag

SEQ ID NO: 256445 - DNA, 16 bp, P. troglodytes
gtgacagtgtgagact

SEQ ID NO: 256446 - DNA, 16 bp, P. troglodytes
gtgacagtttctcaga

SEQ ID NO: 256447 - DNA, 16 bp, P. troglodytes
gtgacatcagcaagat

SEQ ID NO: 256448 - DNA, 16 bp, P. troglodytes
gtgacccacctgcctc

SEQ ID NO: 256449 - DNA, 16 bp, P. troglodytes
gtgacccaggctggag

SEQ ID NO: 256450 - DNA, 16 bp, P. troglodytes
gtgacctcaggcaaat

SEQ ID NO: 256451 - DNA, 16 bp, P. troglodytes
gtgacctcaggtgatc

SEQ ID NO: 256452 - DNA, 16 bp, P. troglodytes
gtgacctctggaataa

SEQ ID NO: 256453 - DNA, 16 bp, P. troglodytes
gtgacctgtcctttct

SEQ ID NO: 256454 - DNA, 16 bp, P. troglodytes
gtgaccttaaacaagt

SEQ ID NO: 256455 - DNA, 16 bp, P. troglodytes
gtgaccttcagcaagt

SEQ ID NO: 256456 - DNA, 16 bp, P. troglodytes
gtgaccttcctgcttc

SEQ ID NO: 256457 - DNA, 16 bp, P. troglodytes
gtgaccttgggaaggt

SEQ ID NO: 256458 - DNA, 16 bp, P. troglodytes
gtgaccttgggcaaac

SEQ ID NO: 256459 - DNA, 16 bp, P. troglodytes
gtgaccttgggcaaat

SEQ ID NO: 256460 - DNA, 16 bp, P. troglodytes
gtgaccttgggcaagc

SEQ ID NO: 256461 - DNA, 16 bp, P. troglodytes
gtgaccttgggcagat

SEQ ID NO: 256462 - DNA, 16 bp, P. troglodytes
gtgaccttttttggaa

SEQ ID NO: 256463 - DNA, 16 bp, P. troglodytes
gtgacgcatgcctgta

SEQ ID NO: 256464 - DNA, 16 bp, P. troglodytes
gtgactcagcctccca

SEQ ID NO: 256465 - DNA, 16 bp, P. troglodytes
gtgactcaggaatgga

SEQ ID NO: 256466 - DNA, 16 bp, P. troglodytes
gtgactggcttatttt

SEQ ID NO: 256467 - DNA, 16 bp, P. troglodytes
gtgactgtggttccca

SEQ ID NO: 256468 - DNA, 16 bp, P. troglodytes
gtgactgtgtgagtca

SEQ ID NO: 256469 - DNA, 16 bp, P. troglodytes
gtgacttaaacaacag

SEQ ID NO: 256470 - DNA, 16 bp, P. troglodytes
gtgacttaggtgctgt

SEQ ID NO: 256471 - DNA, 16 bp, P. troglodytes
gtgacttgacactttt

SEQ ID NO: 256472 - DNA, 16 bp, P. troglodytes
gtgacttgtccaagat

SEQ ID NO: 256473 - DNA, 16 bp, P. troglodytes
gtgacttgtctgaggt

SEQ ID NO: 256474 - DNA, 16 bp, P. troglodytes
gtgacttgttttggcc

SEQ ID NO: 256475 - DNA, 17 bp, P. troglodytes
gtgactttcttcacaga

SEQ ID NO: 256476 - DNA, 16 bp, P. troglodytes
gtgactttgagaaagt

SEQ ID NO: 256477 - DNA, 16 bp, P. troglodytes
gtgactttgatttgca

SEQ ID NO: 256478 - DNA, 16 bp, P. troglodytes
gtgactttgctattgt

SEQ ID NO: 256479 - DNA, 16 bp, P. troglodytes
gtgactttgggcaggt

SEQ ID NO: 256480 - DNA, 16 bp, P. troglodytes
gtgagaaataaattta

SEQ ID NO: 256481 - DNA, 18 bp, P. troglodytes
gtgagaaataaatttcta

SEQ ID NO: 256482 - DNA, 16 bp, P. troglodytes
gtgagaacacacagtg

SEQ ID NO: 256483 - DNA, 18 bp, P. troglodytes
gtgagaacacatggacac

SEQ ID NO: 256484 - DNA, 16 bp, P. troglodytes
gtgagaacacttgaaa

SEQ ID NO: 256485 - DNA, 16 bp, P. troglodytes
gtgagaactctgtctc

SEQ ID NO: 256486 - DNA, 16 bp, P. troglodytes
gtgagaagtcactcac

SEQ ID NO: 256487 - DNA, 16 bp, P. troglodytes
gtgagaattctgggag

SEQ ID NO: 256488 - DNA, 16 bp, P. troglodytes
gtgagacagagtctcg

SEQ ID NO: 256489 - DNA, 16 bp, P. troglodytes
gtgagacagagtcttg

SEQ ID NO: 256490 - DNA, 16 bp, P. troglodytes
gtgagacagccaggtg

SEQ ID NO: 256491 - DNA, 16 bp, P. troglodytes
gtgagacagtgtctca

SEQ ID NO: 256492 - DNA, 16 bp, P. troglodytes
gtgagaccccacctct

SEQ ID NO: 256493 - DNA, 16 bp, P. troglodytes
gtgagacccctgtctc

SEQ ID NO: 256494 - DNA, 16 bp, P. troglodytes
gtgagaccctcgtctc

SEQ ID NO: 256495 - DNA, 16 bp, P. troglodytes
gtgagaccctgtattt

SEQ ID NO: 256496 - DNA, 16 bp, P. troglodytes
gtgagaccctgtctct

SEQ ID NO: 256497 - DNA, 16 bp, P. troglodytes
gtgagaccctttctct

SEQ ID NO: 256498 - DNA, 16 bp, P. troglodytes
gtgagaccttgtctct

SEQ ID NO: 256499 - DNA, 16 bp, P. troglodytes
gtgagactcagtctcc

SEQ ID NO: 256500 - DNA, 16 bp, P. troglodytes
gtgagactccaactct

SEQ ID NO: 256501 - DNA, 16 bp, P. troglodytes
gtgagactccatctcc

SEQ ID NO: 256502 - DNA, 16 bp, P. troglodytes
gtgagactccatctct

SEQ ID NO: 256503 - DNA, 16 bp, P. troglodytes
gtgagactctgcctct

SEQ ID NO: 256504 - DNA, 16 bp, P. troglodytes
gtgagactctgtgggc

SEQ ID NO: 256505 - DNA, 16 bp, P. troglodytes
gtgagactctgtttct

SEQ ID NO: 256506 - DNA, 16 bp, P. troglodytes
gtgagagaggaagcaa

SEQ ID NO: 256507 - DNA, 16 bp, P. troglodytes
gtgagagataggaatc

SEQ ID NO: 256508 - DNA, 16 bp, P. troglodytes
gtgagagcctcaggct

SEQ ID NO: 256509 - DNA, 16 bp, P. troglodytes
gtgagagtatttacac

SEQ ID NO: 256510 - DNA, 16 bp, P. troglodytes
gtgagataaatgcaca

SEQ ID NO: 256511 - DNA, 16 bp, P. troglodytes
gtgagatgataaaatg

SEQ ID NO: 256512 - DNA, 16 bp, P. troglodytes
gtgagattctgtttca

SEQ ID NO: 256513 - DNA, 16 bp, P. troglodytes
gtgagattgtggagaa

SEQ ID NO: 256514 - DNA, 16 bp, P. troglodytes
gtgagatttatgtttt

SEQ ID NO: 256515 - DNA, 16 bp, P. troglodytes
gtgagcaaggtggaga

SEQ ID NO: 256516 - DNA, 16 bp, P. troglodytes
gtgagcaccttttcat

SEQ ID NO: 256517 - DNA, 16 bp, P. troglodytes
gtgagcagcaggacct

SEQ ID NO: 256518 - DNA, 16 bp, P. troglodytes
gtgagcagcaggcgag

SEQ ID NO: 256519 - DNA, 16 bp, P. troglodytes
gtgagcagtgatcgca

SEQ ID NO: 256520 - DNA, 16 bp, P. troglodytes
gtgagcatgtgtgtga

SEQ ID NO: 256521 - DNA, 16 bp, P. troglodytes
gtgagccaacatcacg

SEQ ID NO: 256522 - DNA, 16 bp, P. troglodytes
gtgagccaacgcgccc

SEQ ID NO: 256523 - DNA, 16 bp, P. troglodytes
gtgagccaagactaca

SEQ ID NO: 256524 - DNA, 19 bp, P. troglodytes
gtgagccaagatcgcgcca

SEQ ID NO: 256525 - DNA, 16 bp, P. troglodytes
gtgagccacagggccc

SEQ ID NO: 256526 - DNA, 16 bp, P. troglodytes
gtgagccaccaagccc

SEQ ID NO: 256527 - DNA, 16 bp, P. troglodytes
gtgagccaccacaccc

SEQ ID NO: 256528 - DNA, 21 bp, P. troglodytes
gtgagccaccacacctggccc

SEQ ID NO: 256529 - DNA, 16 bp, P. troglodytes
gtgagccaccaccacc

SEQ ID NO: 256530 - DNA, 16 bp, P. troglodytes
gtgagccaccaccccc

SEQ ID NO: 256531 - DNA, 16 bp, P. troglodytes
gtgagccaccacgccc

SEQ ID NO: 256532 - DNA, 16 bp, P. troglodytes
gtgagccaccaggccc

SEQ ID NO: 256533 - DNA, 16 bp, P. troglodytes
gtgagccaccccgccc

SEQ ID NO: 256534 - DNA, 16 bp, P. troglodytes
gtgagccaccctgccc

SEQ ID NO: 256535 - DNA, 16 bp, P. troglodytes
gtgagccaccgcgcca

SEQ ID NO: 256536 - DNA, 16 bp, P. troglodytes
gtgagccactacatcc

SEQ ID NO: 256537 - DNA, 21 bp, P. troglodytes
gtgagccactgcacccggccg

SEQ ID NO: 256538 - DNA, 21 bp, P. troglodytes
gtgagccactgcacctggcca

SEQ ID NO: 256539 - DNA, 16 bp, P. troglodytes
gtgagccactgcccca

SEQ ID NO: 256540 - DNA, 16 bp, P. troglodytes
gtgagccactgcgccc

SEQ ID NO: 256541 - DNA, 18 bp, P. troglodytes
gtgagccactgcgcctga

SEQ ID NO: 256542 - DNA, 16 bp, P. troglodytes
gtgagccaggatggca

SEQ ID NO: 256543 - DNA, 16 bp, P. troglodytes
gtgagccaggcccagg

SEQ ID NO: 256544 - DNA, 16 bp, P. troglodytes
gtgagccatcacacca

SEQ ID NO: 256545 - DNA, 16 bp, P. troglodytes
gtgagccatgatagtg

SEQ ID NO: 256546 - DNA, 16 bp, P. troglodytes
gtgagccatgatcgtg

SEQ ID NO: 256547 - DNA, 16 bp, P. troglodytes
gtgagccatgattctg

SEQ ID NO: 256548 - DNA, 16 bp, P. troglodytes
gtgagccatggtgccc

SEQ ID NO: 256549 - DNA, 19 bp, P. troglodytes
gtgagcccagatcacgcca

SEQ ID NO: 256550 - DNA, 17 bp, P. troglodytes
gtgagcccaggagttca

SEQ ID NO: 256551 - DNA, 17 bp, P. troglodytes
gtgagcccgggaggtgg

SEQ ID NO: 256552 - DNA, 16 bp, P. troglodytes
gtgagccctgggccct

SEQ ID NO: 256553 - DNA, 19 bp, P. troglodytes
gtgagccgagattgcacca

SEQ ID NO: 256554 - DNA, 19 bp, P. troglodytes
gtgagccgaggtcgcgcca

SEQ ID NO: 256555 - DNA, 16 bp, P. troglodytes
gtgagccgtgatcaca

SEQ ID NO: 256556 - DNA, 16 bp, P. troglodytes
gtgagcctccacaccc

SEQ ID NO: 256557 - DNA, 16 bp, P. troglodytes
gtgagcctctgcgcct

SEQ ID NO: 256558 - DNA, 16 bp, P. troglodytes
gtgagctaccacgccc

SEQ ID NO: 256559 - DNA, 16 bp, P. troglodytes
gtgagctaccgtgccc

SEQ ID NO: 256560 - DNA, 16 bp, P. troglodytes
gtgagctatgacagtg

SEQ ID NO: 256561 - DNA, 16 bp, P. troglodytes
gtgagctgaagcaggg

SEQ ID NO: 256562 - DNA, 16 bp, P. troglodytes
gtgagctgagatcacc

SEQ ID NO: 256563 - DNA, 20 bp, P. troglodytes
gtgagctgagatcgcaccat

SEQ ID NO: 256564 - DNA, 16 bp, P. troglodytes
gtgagctgagatctct

SEQ ID NO: 256565 - DNA, 16 bp, P. troglodytes
gtgagctgagatggag

SEQ ID NO: 256566 - DNA, 16 bp, P. troglodytes
gtgagctgagttcatg

SEQ ID NO: 256567 - DNA, 16 bp, P. troglodytes
gtgagctgtgatcact

SEQ ID NO: 256568 - DNA, 16 bp, P. troglodytes
gtgagcttttaaaaat

SEQ ID NO: 256569 - DNA, 16 bp, P. troglodytes
gtgaggaaactgaggc

SEQ ID NO: 256570 - DNA, 16 bp, P. troglodytes
gtgaggaagctgcagg

SEQ ID NO: 256571 - DNA, 16 bp, P. troglodytes
gtgaggacacaaggag

SEQ ID NO: 256572 - DNA, 16 bp, P. troglodytes
gtgaggacacagcagg

SEQ ID NO: 256573 - DNA, 18 bp, P. troglodytes
gtgaggagcgtctctgcc

SEQ ID NO: 256574 - DNA, 16 bp, P. troglodytes
gtgaggagtttgagac

SEQ ID NO: 256575 - DNA, 16 bp, P. troglodytes
gtgaggatgaagagaa

SEQ ID NO: 256576 - DNA, 16 bp, P. troglodytes
gtgaggattatgggaa

SEQ ID NO: 256577 - DNA, 16 bp, P. troglodytes
gtgaggcactgcctca

SEQ ID NO: 256578 - DNA, 16 bp, P. troglodytes
gtgaggccagcatcat

SEQ ID NO: 256579 - DNA, 16 bp, P. troglodytes
gtgaggccaggagttc

SEQ ID NO: 256580 - DNA, 16 bp, P. troglodytes
gtgaggccaggcatgg

SEQ ID NO: 256581 - DNA, 16 bp, P. troglodytes
gtgaggcctccacagc

SEQ ID NO: 256582 - DNA, 16 bp, P. troglodytes
gtgaggctgaggtggg

SEQ ID NO: 256583 - DNA, 16 bp, P. troglodytes
gtgagggctaggaaaa

SEQ ID NO: 256584 - DNA, 16 bp, P. troglodytes
gtgaggggcgcttctg

SEQ ID NO: 256585 - DNA, 16 bp, P. troglodytes
gtgaggtatgggggaa

SEQ ID NO: 256586 - DNA, 16 bp, P. troglodytes
gtgaggtcaagagttc

SEQ ID NO: 256587 - DNA, 16 bp, P. troglodytes
gtgaggtcaggagttc

SEQ ID NO: 256588 - DNA, 16 bp, P. troglodytes
gtgaggtcaggagttt

SEQ ID NO: 256589 - DNA, 16 bp, P. troglodytes
gtgaggtctcactatg

SEQ ID NO: 256590 - DNA, 16 bp, P. troglodytes
gtgaggtgagattgtg

SEQ ID NO: 256591 - DNA, 16 bp, P. troglodytes
gtgaggtggctcaggc

SEQ ID NO: 256592 - DNA, 16 bp, P. troglodytes
gtgaggtgggagaatc

SEQ ID NO: 256593 - DNA, 16 bp, P. troglodytes
gtgagtaataaatttc

SEQ ID NO: 256594 - DNA, 16 bp, P. troglodytes
gtgagtcaagatggca

SEQ ID NO: 256595 - DNA, 16 bp, P. troglodytes
gtgagtcaccacgccc

SEQ ID NO: 256596 - DNA, 16 bp, P. troglodytes
gtgagtcactgcgccc

SEQ ID NO: 256597 - DNA, 16 bp, P. troglodytes
gtgagtcagtgagtgg

SEQ ID NO: 256598 - DNA, 16 bp, P. troglodytes
gtgagtgagctctcac

SEQ ID NO: 256599 - DNA, 16 bp, P. troglodytes
gtgagtgagtgagtga

SEQ ID NO: 256600 - DNA, 16 bp, P. troglodytes
gtgagtggatggatgg

SEQ ID NO: 256601 - DNA, 16 bp, P. troglodytes
gtgagtgtgaaggcct

SEQ ID NO: 256602 - DNA, 16 bp, P. troglodytes
gtgagtgttacaactc

SEQ ID NO: 256603 - DNA, 16 bp, P. troglodytes
gtgagtgttacagctc

SEQ ID NO: 256604 - DNA, 16 bp, P. troglodytes
gtgagttccaggtggg

SEQ ID NO: 256605 - DNA, 16 bp, P. troglodytes
gtgagttctcagaaga

SEQ ID NO: 256606 - DNA, 16 bp, P. troglodytes
gtgataaagcaagacc

SEQ ID NO: 256607 - DNA, 16 bp, P. troglodytes
gtgataaatatgttaa

SEQ ID NO: 256608 - DNA, 16 bp, P. troglodytes
gtgataataaaaagca

SEQ ID NO: 256609 - DNA, 16 bp, P. troglodytes
gtgataatgatgatga

SEQ ID NO: 256610 - DNA, 16 bp, P. troglodytes
gtgataccccatctct

SEQ ID NO: 256611 - DNA, 16 bp, P. troglodytes
gtgatagagcaagact

SEQ ID NO: 256612 - DNA, 16 bp, P. troglodytes
gtgatagagttctcac

SEQ ID NO: 256613 - DNA, 16 bp, P. troglodytes
gtgatagcagcctgaa

SEQ ID NO: 256614 - DNA, 16 bp, P. troglodytes
gtgatagtgccactgc

SEQ ID NO: 256615 - DNA, 16 bp, P. troglodytes
gtgatattcttcctaa

SEQ ID NO: 256616 - DNA, 16 bp, P. troglodytes
gtgatattgagcatct

SEQ ID NO: 256617 - DNA, 16 bp, P. troglodytes
gtgatattgattcttc

SEQ ID NO: 256618 - DNA, 16 bp, P. troglodytes
gtgatcaagtgggctt

SEQ ID NO: 256619 - DNA, 16 bp, P. troglodytes
gtgatcacactactgc

SEQ ID NO: 256620 - DNA, 16 bp, P. troglodytes
gtgatcacgccactgc

SEQ ID NO: 256621 - DNA, 16 bp, P. troglodytes
gtgatcacggctcact

SEQ ID NO: 256622 - DNA, 16 bp, P. troglodytes
gtgatcagaagcagca

SEQ ID NO: 256623 - DNA, 16 bp, P. troglodytes
gtgatcagatcagggt

SEQ ID NO: 256624 - DNA, 16 bp, P. troglodytes
gtgatcagccagctac

SEQ ID NO: 256625 - DNA, 16 bp, P. troglodytes
gtgatcatggctcact

SEQ ID NO: 256626 - DNA, 16 bp, P. troglodytes
gtgatccacacgcctc

SEQ ID NO: 256627 - DNA, 16 bp, P. troglodytes
gtgatccacccacctt

SEQ ID NO: 256628 - DNA, 16 bp, P. troglodytes
gtgatccacccatctc

SEQ ID NO: 256629 - DNA, 16 bp, P. troglodytes
gtgatccaccctcccc

SEQ ID NO: 256630 - DNA, 16 bp, P. troglodytes
gtgatccaccctcctc

SEQ ID NO: 256631 - DNA, 16 bp, P. troglodytes
gtgatccacctgccct

SEQ ID NO: 256632 - DNA, 16 bp, P. troglodytes
gtgatccacctgcctg

SEQ ID NO: 256633 - DNA, 16 bp, P. troglodytes
gtgatccacctgcttc

SEQ ID NO: 256634 - DNA, 16 bp, P. troglodytes
gtgatccagctgcctc

SEQ ID NO: 256635 - DNA, 16 bp, P. troglodytes
gtgatccagcttcatt

SEQ ID NO: 256636 - DNA, 16 bp, P. troglodytes
gtgatccatccacctc

SEQ ID NO: 256637 - DNA, 16 bp, P. troglodytes
gtgatccatctgcctc

SEQ ID NO: 256638 - DNA, 16 bp, P. troglodytes
gtgatcccatttgttc

SEQ ID NO: 256639 - DNA, 16 bp, P. troglodytes
gtgatccccttgcctc

SEQ ID NO: 256640 - DNA, 16 bp, P. troglodytes
gtgatccgcccacttc

SEQ ID NO: 256641 - DNA, 19 bp, P. troglodytes
gtgatccgcccgccttggc

SEQ ID NO: 256642 - DNA, 16 bp, P. troglodytes
gtgatccgccgacctc

SEQ ID NO: 256643 - DNA, 16 bp, P. troglodytes
gtgatcctgccactgc

SEQ ID NO: 256644 - DNA, 16 bp, P. troglodytes
gtgatccttccacctt

SEQ ID NO: 256645 - DNA, 16 bp, P. troglodytes
gtgatctacccgcctc

SEQ ID NO: 256646 - DNA, 18 bp, P. troglodytes
gtgatctcggctcactgt

SEQ ID NO: 256647 - DNA, 16 bp, P. troglodytes
gtgatctcggctcgct

SEQ ID NO: 256648 - DNA, 16 bp, P. troglodytes
gtgatctctgcacaca

SEQ ID NO: 256649 - DNA, 16 bp, P. troglodytes
gtgatctgcccacctc

SEQ ID NO: 256650 - DNA, 18 bp, P. troglodytes
gtgatctgcccacctcaa

SEQ ID NO: 256651 - DNA, 16 bp, P. troglodytes
gtgatctgcccatctc

SEQ ID NO: 256652 - DNA, 16 bp, P. troglodytes
gtgatctgcccgcctc

SEQ ID NO: 256653 - DNA, 16 bp, P. troglodytes
gtgatctgccctcctc

SEQ ID NO: 256654 - DNA, 16 bp, P. troglodytes
gtgatctgcctacctc

SEQ ID NO: 256655 - DNA, 16 bp, P. troglodytes
gtgatctgcctgcccc

SEQ ID NO: 256656 - DNA, 16 bp, P. troglodytes
gtgatctgctggcctc

SEQ ID NO: 256657 - DNA, 16 bp, P. troglodytes
gtgatctgcttgcctc

SEQ ID NO: 256658 - DNA, 16 bp, P. troglodytes
gtgatctgcttgcttc

SEQ ID NO: 256659 - DNA, 16 bp, P. troglodytes
gtgatcttcaggctgg

SEQ ID NO: 256660 - DNA, 16 bp, P. troglodytes
gtgatcttcccagctc

SEQ ID NO: 256661 - DNA, 16 bp, P. troglodytes
gtgatcttgaacaagt

SEQ ID NO: 256662 - DNA, 16 bp, P. troglodytes
gtgatcttggcttact

SEQ ID NO: 256663 - DNA, 16 bp, P. troglodytes
gtgatctttgatatta

SEQ ID NO: 256664 - DNA, 16 bp, P. troglodytes
gtgatctttgcttttg

SEQ ID NO: 256665 - DNA, 16 bp, P. troglodytes
gtgatgaaaatgttct

SEQ ID NO: 256666 - DNA, 16 bp, P. troglodytes
gtgatgaaataatctg

SEQ ID NO: 256667 - DNA, 16 bp, P. troglodytes
gtgatgaaatcatctg

SEQ ID NO: 256668 - DNA, 16 bp, P. troglodytes
gtgatgaagatgatga

SEQ ID NO: 256669 - DNA, 16 bp, P. troglodytes
gtgatgaagatgttct

SEQ ID NO: 256670 - DNA, 16 bp, P. troglodytes
gtgatgaggagaatgg

SEQ ID NO: 256671 - DNA, 16 bp, P. troglodytes
gtgatgatgaagatga

SEQ ID NO: 256672 - DNA, 16 bp, P. troglodytes
gtgatgatgagaagaa

SEQ ID NO: 256673 - DNA, 16 bp, P. troglodytes
gtgatgcagatgctgc

SEQ ID NO: 256674 - DNA, 16 bp, P. troglodytes
gtgatgcatcacattt

SEQ ID NO: 256675 - DNA, 16 bp, P. troglodytes
gtgatgcccttctttg

SEQ ID NO: 256676 - DNA, 16 bp, P. troglodytes
gtgatgctgatgctac

SEQ ID NO: 256677 - DNA, 16 bp, P. troglodytes
gtgatgctggggtttg

SEQ ID NO: 256678 - DNA, 16 bp, P. troglodytes
gtgatggagaaataaa

SEQ ID NO: 256679 - DNA, 16 bp, P. troglodytes
gtgatggagtctcgct

SEQ ID NO: 256680 - DNA, 16 bp, P. troglodytes
gtgatggcagcagcca

SEQ ID NO: 256681 - DNA, 16 bp, P. troglodytes
gtgatggcaggcacct

SEQ ID NO: 256682 - DNA, 16 bp, P. troglodytes
gtgatggcggccggga

SEQ ID NO: 256683 - DNA, 16 bp, P. troglodytes
gtgatggcgtgatctc

SEQ ID NO: 256684 - DNA, 16 bp, P. troglodytes
gtgatggctcacccct

SEQ ID NO: 256685 - DNA, 17 bp, P. troglodytes
gtgatggctcatgccta

SEQ ID NO: 256686 - DNA, 16 bp, P. troglodytes
gtgatgggatcaattg

SEQ ID NO: 256687 - DNA, 16 bp, P. troglodytes
gtgatgggattacagg

SEQ ID NO: 256688 - DNA, 16 bp, P. troglodytes
gtgatggtatctggag

SEQ ID NO: 256689 - DNA, 16 bp, P. troglodytes
gtgatggtgatgatga

SEQ ID NO: 256690 - DNA, 16 bp, P. troglodytes
gtgatggtgccactgc

SEQ ID NO: 256691 - DNA, 16 bp, P. troglodytes
gtgatggtggcagtgg

SEQ ID NO: 256692 - DNA, 16 bp, P. troglodytes
gtgatggtgtttggag

SEQ ID NO: 256693 - DNA, 16 bp, P. troglodytes
gtgatggttgcacaac

SEQ ID NO: 256694 - DNA, 16 bp, P. troglodytes
gtgatggttgcataac

SEQ ID NO: 256695 - DNA, 16 bp, P. troglodytes
gtgatgtcggctcact

SEQ ID NO: 256696 - DNA, 16 bp, P. troglodytes
gtgatgttcctcttcc

SEQ ID NO: 256697 - DNA, 16 bp, P. troglodytes
gtgatgttgacctttt

SEQ ID NO: 256698 - DNA, 16 bp, P. troglodytes
gtgattacaggtgtga

SEQ ID NO: 256699 - DNA, 16 bp, P. troglodytes
gtgattaggttatgag

SEQ ID NO: 256700 - DNA, 16 bp, P. troglodytes
gtgattatagttaaca

SEQ ID NO: 256701 - DNA, 16 bp, P. troglodytes
gtgattatttcacatt

SEQ ID NO: 256702 - DNA, 16 bp, P. troglodytes
gtgattcacccgcctc

SEQ ID NO: 256703 - DNA, 16 bp, P. troglodytes
gtgattctcaaacttt

SEQ ID NO: 256704 - DNA, 16 bp, P. troglodytes
gtgattctcagcctcc

SEQ ID NO: 256705 - DNA, 16 bp, P. troglodytes
gtgattctcctgtctt

SEQ ID NO: 256706 - DNA, 16 bp, P. troglodytes
gtgattctcgtgcctt

SEQ ID NO: 256707 - DNA, 16 bp, P. troglodytes
gtgattctgcctcagc

SEQ ID NO: 256708 - DNA, 16 bp, P. troglodytes
gtgattcttctgcctc

SEQ ID NO: 256709 - DNA, 16 bp, P. troglodytes
gtgattgcaccactgc

SEQ ID NO: 256710 - DNA, 16 bp, P. troglodytes
gtgattggaccatggg

SEQ ID NO: 256711 - DNA, 16 bp, P. troglodytes
gtgatttgaatgcaca

SEQ ID NO: 256712 - DNA, 16 bp, P. troglodytes
gtgatttttttaaaaa

SEQ ID NO: 256713 - DNA, 16 bp, P. troglodytes
gtgcaaccaccaccac

SEQ ID NO: 256714 - DNA, 41 bp, P. troglodytes
gtgcaagatgtgctttgttaaacagatgcttgaaggcagca

SEQ ID NO: 256715 - DNA, 16 bp, P. troglodytes
gtgcaagctgctggtg

SEQ ID NO: 256716 - DNA, 16 bp, P. troglodytes
gtgcaataaaaataga

SEQ ID NO: 256717 - DNA, 16 bp, P. troglodytes
gtgcaatagaacacca

SEQ ID NO: 256718 - DNA, 16 bp, P. troglodytes
gtgcacacacacaaca

SEQ ID NO: 256719 - DNA, 16 bp, P. troglodytes
gtgcacacatgtgcac

SEQ ID NO: 256720 - DNA, 16 bp, P. troglodytes
gtgcacaccaccactc

SEQ ID NO: 256721 - DNA, 16 bp, P. troglodytes
gtgcacagtaaatgta

SEQ ID NO: 256722 - DNA, 16 bp, P. troglodytes
gtgcacatgcacacac

SEQ ID NO: 256723 - DNA, 16 bp, P. troglodytes
gtgcaccaatcaacac

SEQ ID NO: 256724 - DNA, 17 bp, P. troglodytes
gtgcaccaccacacccg

SEQ ID NO: 256725 - DNA, 16 bp, P. troglodytes
gtgcaccaccacggcc

SEQ ID NO: 256726 - DNA, 16 bp, P. troglodytes
gtgcacccagaggacc

SEQ ID NO: 256727 - DNA, 16 bp, P. troglodytes
gtgcacctgcagtcct

SEQ ID NO: 256728 - DNA, 16 bp, P. troglodytes
gtgcacctgtagttct

SEQ ID NO: 256729 - DNA, 16 bp, P. troglodytes
gtgcacgctgccacgc

SEQ ID NO: 256730 - DNA, 16 bp, P. troglodytes
gtgcacgtgtgtgtgt

SEQ ID NO: 256731 - DNA, 17 bp, P. troglodytes
gtgcactccagcttggg

SEQ ID NO: 256732 - DNA, 16 bp, P. troglodytes
gtgcagaactggacag

SEQ ID NO: 256733 - DNA, 16 bp, P. troglodytes
gtgcagaagaaaaatg

SEQ ID NO: 256734 - DNA, 16 bp, P. troglodytes
gtgcagaagctcttca

SEQ ID NO: 256735 - DNA, 16 bp, P. troglodytes
gtgcagaagctctttc

SEQ ID NO: 256736 - DNA, 16 bp, P. troglodytes
gtgcagagcaaaaggg

SEQ ID NO: 256737 - DNA, 16 bp, P. troglodytes
gtgcagaggctcatgc

SEQ ID NO: 256738 - DNA, 16 bp, P. troglodytes
gtgcagcccatggaga

SEQ ID NO: 256739 - DNA, 16 bp, P. troglodytes
gtgcaggagaactccc

SEQ ID NO: 256740 - DNA, 16 bp, P. troglodytes
gtgcaggcatgagcca

SEQ ID NO: 256741 - DNA, 16 bp, P. troglodytes
gtgcaggctgggggag

SEQ ID NO: 256742 - DNA, 16 bp, P. troglodytes
gtgcaggctggtcttg

SEQ ID NO: 256743 - DNA, 16 bp, P. troglodytes
gtgcagggattagagg

SEQ ID NO: 256744 - DNA, 18 bp, P. troglodytes
gtgcaggttagttacata

SEQ ID NO: 256745 - DNA, 16 bp, P. troglodytes
gtgcagtcatttggag

SEQ ID NO: 256746 - DNA, 16 bp, P. troglodytes
gtgcagtgagccaaga

SEQ ID NO: 256747 - DNA, 16 bp, P. troglodytes
gtgcagtggaatgatc

SEQ ID NO: 256748 - DNA, 16 bp, P. troglodytes
gtgcagtggcaagatc

SEQ ID NO: 256749 - DNA, 16 bp, P. troglodytes
gtgcagtggcaagatt

SEQ ID NO: 256750 - DNA, 16 bp, P. troglodytes
gtgcagtggcacagtc

SEQ ID NO: 256751 - DNA, 16 bp, P. troglodytes
gtgcagtgggtgcaat

SEQ ID NO: 256752 - DNA, 16 bp, P. troglodytes
gtgcagtggtgccctc

SEQ ID NO: 256753 - DNA, 16 bp, P. troglodytes
gtgcagtggtgcgatt

SEQ ID NO: 256754 - DNA, 16 bp, P. troglodytes
gtgcatatgtgtgtga

SEQ ID NO: 256755 - DNA, 16 bp, P. troglodytes
gtgcatctgtgtgtgt

SEQ ID NO: 256756 - DNA, 16 bp, P. troglodytes
gtgcatgacttcacag

SEQ ID NO: 256757 - DNA, 16 bp, P. troglodytes
gtgcatgagtgtatgt

SEQ ID NO: 256758 - DNA, 16 bp, P. troglodytes
gtgcatgccactgcac

SEQ ID NO: 256759 - DNA, 16 bp, P. troglodytes
gtgcatgcctgtagtg

SEQ ID NO: 256760 - DNA, 16 bp, P. troglodytes
gtgcatgctgattggt

SEQ ID NO: 256761 - DNA, 16 bp, P. troglodytes
gtgcatggatgtgtgt

SEQ ID NO: 256762 - DNA, 16 bp, P. troglodytes
gtgcatggtggctcac

SEQ ID NO: 256763 - DNA, 16 bp, P. troglodytes
gtgcatgtctgtgtgt

SEQ ID NO: 256764 - DNA, 16 bp, P. troglodytes
gtgcatgtgcatgcat

SEQ ID NO: 256765 - DNA, 16 bp, P. troglodytes
gtgcatgtgcctttat

SEQ ID NO: 256766 - DNA, 16 bp, P. troglodytes
gtgcatgtgtgcatgg

SEQ ID NO: 256767 - DNA, 16 bp, P. troglodytes
gtgcatgtgtgcgtgc

SEQ ID NO: 256768 - DNA, 16 bp, P. troglodytes
gtgcatgtgtgtatgc

SEQ ID NO: 256769 - DNA, 16 bp, P. troglodytes
gtgcatgtgtgtgtgc

SEQ ID NO: 256770 - DNA, 16 bp, P. troglodytes
gtgcattggtgtgatc

SEQ ID NO: 256771 - DNA, 16 bp, P. troglodytes
gtgcatttacaaatct

SEQ ID NO: 256772 - DNA, 16 bp, P. troglodytes
gtgccaaaaatgttgg

SEQ ID NO: 256773 - DNA, 16 bp, P. troglodytes
gtgccaacacgcctgg

SEQ ID NO: 256774 - DNA, 16 bp, P. troglodytes
gtgccaaggctgagaa

SEQ ID NO: 256775 - DNA, 16 bp, P. troglodytes
gtgccacaatgcccag

SEQ ID NO: 256776 - DNA, 16 bp, P. troglodytes
gtgccacacacttaaa

SEQ ID NO: 256777 - DNA, 16 bp, P. troglodytes
gtgccacattttgtta

SEQ ID NO: 256778 - DNA, 16 bp, P. troglodytes
gtgccaccacacccag

SEQ ID NO: 256779 - DNA, 16 bp, P. troglodytes
gtgccaccacacctgg

SEQ ID NO: 256780 - DNA, 16 bp, P. troglodytes
gtgccaccacatctgg

SEQ ID NO: 256781 - DNA, 16 bp, P. troglodytes
gtgccaccacgtctgg

SEQ ID NO: 256782 - DNA, 16 bp, P. troglodytes
gtgccaccaggcccag

SEQ ID NO: 256783 - DNA, 16 bp, P. troglodytes
gtgccaccaggcctag

SEQ ID NO: 256784 - DNA, 16 bp, P. troglodytes
gtgccaccatgtttgg

SEQ ID NO: 256785 - DNA, 16 bp, P. troglodytes
gtgccacccaactggg

SEQ ID NO: 256786 - DNA, 16 bp, P. troglodytes
gtgccacgttggtttg

SEQ ID NO: 256787 - DNA, 16 bp, P. troglodytes
gtgccactatgcccag

SEQ ID NO: 256788 - DNA, 18 bp, P. troglodytes
gtgccactgcactccaga

SEQ ID NO: 256789 - DNA, 16 bp, P. troglodytes
gtgccactgccctcta

SEQ ID NO: 256790 - DNA, 16 bp, P. troglodytes
gtgccactggccacag

SEQ ID NO: 256791 - DNA, 16 bp, P. troglodytes
gtgccactgtgcccca

SEQ ID NO: 256792 - DNA, 16 bp, P. troglodytes
gtgccagacactgttt

SEQ ID NO: 256793 - DNA, 16 bp, P. troglodytes
gtgccagcagcagtgg

SEQ ID NO: 256794 - DNA, 16 bp, P. troglodytes
gtgccagcatggtcag

SEQ ID NO: 256795 - DNA, 16 bp, P. troglodytes
gtgccagcctgggtga

SEQ ID NO: 256796 - DNA, 16 bp, P. troglodytes
gtgccagctgctcagg

SEQ ID NO: 256797 - DNA, 16 bp, P. troglodytes
gtgccaggcactgggg

SEQ ID NO: 256798 - DNA, 16 bp, P. troglodytes
gtgccagtgcattcca

SEQ ID NO: 256799 - DNA, 16 bp, P. troglodytes
gtgccagtttccaaag

SEQ ID NO: 256800 - DNA, 16 bp, P. troglodytes
gtgccatcatgcctgg

SEQ ID NO: 256801 - DNA, 16 bp, P. troglodytes
gtgccatcatgctcag

SEQ ID NO: 256802 - DNA, 16 bp, P. troglodytes
gtgccatcccagctca

SEQ ID NO: 256803 - DNA, 16 bp, P. troglodytes
gtgccatgcacctgta

SEQ ID NO: 256804 - DNA, 17 bp, P. troglodytes
gtgccatgttgatgtgc

SEQ ID NO: 256805 - DNA, 18 bp, P. troglodytes
gtgccattgcactccagt

SEQ ID NO: 256806 - DNA, 16 bp, P. troglodytes
gtgcccaacaccatgc

SEQ ID NO: 256807 - DNA, 16 bp, P. troglodytes
gtgcccacagccaccc

SEQ ID NO: 256808 - DNA, 16 bp, P. troglodytes
gtgcccaccaccacat

SEQ ID NO: 256809 - DNA, 16 bp, P. troglodytes
gtgcccagcacagtgc

SEQ ID NO: 256810 - DNA, 16 bp, P. troglodytes
gtgcccagcctagaaa

SEQ ID NO: 256811 - DNA, 16 bp, P. troglodytes
gtgcccagcctcttct

SEQ ID NO: 256812 - DNA, 16 bp, P. troglodytes
gtgcccagcctgaaaa

SEQ ID NO: 256813 - DNA, 16 bp, P. troglodytes
gtgcccagctgaaaat

SEQ ID NO: 256814 - DNA, 16 bp, P. troglodytes
gtgcccaggctggtct

SEQ ID NO: 256815 - DNA, 16 bp, P. troglodytes
gtgcccagggagggca

SEQ ID NO: 256816 - DNA, 16 bp, P. troglodytes
gtgcccatcaccacgc

SEQ ID NO: 256817 - DNA, 16 bp, P. troglodytes
gtgccccaggctggag

SEQ ID NO: 256818 - DNA, 16 bp, P. troglodytes
gtgcccccacccccag

SEQ ID NO: 256819 - DNA, 16 bp, P. troglodytes
gtgcccgccaccaagc

SEQ ID NO: 256820 - DNA, 17 bp, P. troglodytes
gtgcccgccaccacgcc

SEQ ID NO: 256821 - DNA, 16 bp, P. troglodytes
gtgcccgccaccacgg

SEQ ID NO: 256822 - DNA, 17 bp, P. troglodytes
gtgcccgccaccatgcc

SEQ ID NO: 256823 - DNA, 16 bp, P. troglodytes
gtgcccggcccctttt

SEQ ID NO: 256824 - DNA, 16 bp, P. troglodytes
gtgcccggcctcattt

SEQ ID NO: 256825 - DNA, 16 bp, P. troglodytes
gtgccctggatgtggg

SEQ ID NO: 256826 - DNA, 16 bp, P. troglodytes
gtgcccttataaaaaa

SEQ ID NO: 256827 - DNA, 16 bp, P. troglodytes
gtgcccttataaagag

SEQ ID NO: 256828 - DNA, 16 bp, P. troglodytes
gtgccgccatgcccag

SEQ ID NO: 256829 - DNA, 16 bp, P. troglodytes
gtgcctatagtctcag

SEQ ID NO: 256830 - DNA, 16 bp, P. troglodytes
gtgcctcagcctccct

SEQ ID NO: 256831 - DNA, 16 bp, P. troglodytes
gtgcctcagcctctca

SEQ ID NO: 256832 - DNA, 16 bp, P. troglodytes
gtgcctcagcttcctt

SEQ ID NO: 256833 - DNA, 16 bp, P. troglodytes
gtgcctcagtctcctg

SEQ ID NO: 256834 - DNA, 16 bp, P. troglodytes
gtgcctcagtttactt

SEQ ID NO: 256835 - DNA, 16 bp, P. troglodytes
gtgcctcagtttcctt

SEQ ID NO: 256836 - DNA, 16 bp, P. troglodytes
gtgcctccacccaaat

SEQ ID NO: 256837 - DNA, 16 bp, P. troglodytes
gtgcctctgcctcctg

SEQ ID NO: 256838 - DNA, 16 bp, P. troglodytes
gtgcctgacaccacgc

SEQ ID NO: 256839 - DNA, 16 bp, P. troglodytes
gtgcctgagcacacat

SEQ ID NO: 256840 - DNA, 16 bp, P. troglodytes
gtgcctgcctatagtc

SEQ ID NO: 256841 - DNA, 16 bp, P. troglodytes
gtgcctggagctgagg

SEQ ID NO: 256842 - DNA, 16 bp, P. troglodytes
gtgcctggcacagagt

SEQ ID NO: 256843 - DNA, 16 bp, P. troglodytes
gtgcctggccaagatt

SEQ ID NO: 256844 - DNA, 16 bp, P. troglodytes
gtgcctggcccagaat

SEQ ID NO: 256845 - DNA, 16 bp, P. troglodytes
gtgcctggcccagggc

SEQ ID NO: 256846 - DNA, 16 bp, P. troglodytes
gtgcctggcccatggt

SEQ ID NO: 256847 - DNA, 16 bp, P. troglodytes
gtgcctggccccttct

SEQ ID NO: 256848 - DNA, 16 bp, P. troglodytes
gtgcctggcctttttt

SEQ ID NO: 256849 - DNA, 16 bp, P. troglodytes
gtgcctggcttggagg

SEQ ID NO: 256850 - DNA, 16 bp, P. troglodytes
gtgcctgggaggtgga

SEQ ID NO: 256851 - DNA, 16 bp, P. troglodytes
gtgcctgtaatcccaa

SEQ ID NO: 256852 - DNA, 16 bp, P. troglodytes
gtgcctgtatttccag

SEQ ID NO: 256853 - DNA, 16 bp, P. troglodytes
gtgcctgtgattccag

SEQ ID NO: 256854 - DNA, 16 bp, P. troglodytes
gtgcctgtggtctcag

SEQ ID NO: 256855 - DNA, 16 bp, P. troglodytes
gtgcctgtgtgtgcct

SEQ ID NO: 256856 - DNA, 16 bp, P. troglodytes
gtgcctgtgtgtgtgc

SEQ ID NO: 256857 - DNA, 16 bp, P. troglodytes
gtgcctgtttcctcat

SEQ ID NO: 256858 - DNA, 16 bp, P. troglodytes
gtgccttccctctgaa

SEQ ID NO: 256859 - DNA, 16 bp, P. troglodytes
gtgcgatctcgactca

SEQ ID NO: 256860 - DNA, 16 bp, P. troglodytes
gtgcgcacacacacac

SEQ ID NO: 256861 - DNA, 16 bp, P. troglodytes
gtgcgccaccacaccc

SEQ ID NO: 256862 - DNA, 16 bp, P. troglodytes
gtgcgcctgtagtcct

SEQ ID NO: 256863 - DNA, 16 bp, P. troglodytes
gtgcgcgcgcacacac

SEQ ID NO: 256864 - DNA, 16 bp, P. troglodytes
gtgcgcgcgcgcgcac

SEQ ID NO: 256865 - DNA, 16 bp, P. troglodytes
gtgcgcgtgtgcgtgt

SEQ ID NO: 256866 - DNA, 16 bp, P. troglodytes
gtgcggcagctcacgc

SEQ ID NO: 256867 - DNA, 16 bp, P. troglodytes
gtgcgggatccactgg

SEQ ID NO: 256868 - DNA, 16 bp, P. troglodytes
gtgcgtgagtgtgtgt

SEQ ID NO: 256869 - DNA, 16 bp, P. troglodytes
gtgcgtgcacacacac

SEQ ID NO: 256870 - DNA, 16 bp, P. troglodytes
gtgcgtgcgtgcgtgc

SEQ ID NO: 256871 - DNA, 16 bp, P. troglodytes
gtgcgtgcgtgcgtgt

SEQ ID NO: 256872 - DNA, 16 bp, P. troglodytes
gtgcgtgtagtcccag

SEQ ID NO: 256873 - DNA, 16 bp, P. troglodytes
gtgcgtgtggtgtgag

SEQ ID NO: 256874 - DNA, 16 bp, P. troglodytes
gtgcgtgtgtgcatgc

SEQ ID NO: 256875 - DNA, 16 bp, P. troglodytes
gtgcgtgtgtgtgtgc

SEQ ID NO: 256876 - DNA, 16 bp, P. troglodytes
gtgctaaaaagaaata

SEQ ID NO: 256877 - DNA, 16 bp, P. troglodytes
gtgctaacccattcat

SEQ ID NO: 256878 - DNA, 16 bp, P. troglodytes
gtgctactataacaga

SEQ ID NO: 256879 - DNA, 16 bp, P. troglodytes
gtgctagacactgtgc

SEQ ID NO: 256880 - DNA, 16 bp, P. troglodytes
gtgctagcattacagg

SEQ ID NO: 256881 - DNA, 16 bp, P. troglodytes
gtgctaggcactgagg

SEQ ID NO: 256882 - DNA, 16 bp, P. troglodytes
gtgctaggctctgggg

SEQ ID NO: 256883 - DNA, 16 bp, P. troglodytes
gtgctcaccaccacac

SEQ ID NO: 256884 - DNA, 16 bp, P. troglodytes
gtgctcaggagtttga

SEQ ID NO: 256885 - DNA, 16 bp, P. troglodytes
gtgctcagtaaatgtt

SEQ ID NO: 256886 - DNA, 16 bp, P. troglodytes
gtgctcagtgaatatt

SEQ ID NO: 256887 - DNA, 16 bp, P. troglodytes
gtgctcattggccatt

SEQ ID NO: 256888 - DNA, 16 bp, P. troglodytes
gtgctccacctgcctc

SEQ ID NO: 256889 - DNA, 16 bp, P. troglodytes
gtgctcccaggcttat

SEQ ID NO: 256890 - DNA, 16 bp, P. troglodytes
gtgctcctcacttcct

SEQ ID NO: 256891 - DNA, 16 bp, P. troglodytes
gtgctgagaagaatgt

SEQ ID NO: 256892 - DNA, 16 bp, P. troglodytes
gtgctgagataattgg

SEQ ID NO: 256893 - DNA, 16 bp, P. troglodytes
gtgctgaggcaggagg

SEQ ID NO: 256894 - DNA, 16 bp, P. troglodytes
gtgctgatatggtttg

SEQ ID NO: 256895 - DNA, 16 bp, P. troglodytes
gtgctgcaatggacat

SEQ ID NO: 256896 - DNA, 16 bp, P. troglodytes
gtgctgcgattacagg

SEQ ID NO: 256897 - DNA, 16 bp, P. troglodytes
gtgctgctgccatctc

SEQ ID NO: 256898 - DNA, 16 bp, P. troglodytes
gtgctgctggatttgg

SEQ ID NO: 256899 - DNA, 16 bp, P. troglodytes
gtgctggaattaaagg

SEQ ID NO: 256900 - DNA, 16 bp, P. troglodytes
gtgctggagcaactgg

SEQ ID NO: 256901 - DNA, 16 bp, P. troglodytes
gtgctggcagggctgg

SEQ ID NO: 256902 - DNA, 16 bp, P. troglodytes
gtgctggcatctggtg

SEQ ID NO: 256903 - DNA, 16 bp, P. troglodytes
gtgctggctcacgcct

SEQ ID NO: 256904 - DNA, 16 bp, P. troglodytes
gtgctgggaaaacttg

SEQ ID NO: 256905 - DNA, 16 bp, P. troglodytes
gtgctgggaagactgg

SEQ ID NO: 256906 - DNA, 16 bp, P. troglodytes
gtgctgggaattacag

SEQ ID NO: 256907 - DNA, 16 bp, P. troglodytes
gtgctgggactgcagg

SEQ ID NO: 256908 - DNA, 16 bp, P. troglodytes
gtgctgggagtacaga

SEQ ID NO: 256909 - DNA, 16 bp, P. troglodytes
gtgctgggataattag

SEQ ID NO: 256910 - DNA, 16 bp, P. troglodytes
gtgctgggcacggtgg

SEQ ID NO: 256911 - DNA, 16 bp, P. troglodytes
gtgctgggcactggag

SEQ ID NO: 256912 - DNA, 16 bp, P. troglodytes
gtgctgggcactgtgg

SEQ ID NO: 256913 - DNA, 16 bp, P. troglodytes
gtgctgggcatggtgg

SEQ ID NO: 256914 - DNA, 16 bp, P. troglodytes
gtgctgggggacccgg

SEQ ID NO: 256915 - DNA, 16 bp, P. troglodytes
gtgctggtatccacag

SEQ ID NO: 256916 - DNA, 16 bp, P. troglodytes
gtgctggtattgcagg

SEQ ID NO: 256917 - DNA, 16 bp, P. troglodytes
gtgctggtggccacag

SEQ ID NO: 256918 - DNA, 16 bp, P. troglodytes
gtgctggtgggagtgt

SEQ ID NO: 256919 - DNA, 16 bp, P. troglodytes
gtgctgtcatctaggc

SEQ ID NO: 256920 - DNA, 16 bp, P. troglodytes
gtgctgtgaggaatgg

SEQ ID NO: 256921 - DNA, 16 bp, P. troglodytes
gtgctgtggttcacac

SEQ ID NO: 256922 - DNA, 16 bp, P. troglodytes
gtgcttagtaaatgtt

SEQ ID NO: 256923 - DNA, 16 bp, P. troglodytes
gtgcttcagcctcccg

SEQ ID NO: 256924 - DNA, 16 bp, P. troglodytes
gtgcttcataaatatt

SEQ ID NO: 256925 - DNA, 16 bp, P. troglodytes
gtgcttcccgagtgag

SEQ ID NO: 256926 - DNA, 16 bp, P. troglodytes
gtgcttcctgggtgag

SEQ ID NO: 256927 - DNA, 16 bp, P. troglodytes
gtgcttgataaatgtt

SEQ ID NO: 256928 - DNA, 16 bp, P. troglodytes
gtgcttgcgggccagc

SEQ ID NO: 256929 - DNA, 16 bp, P. troglodytes
gtgcttgcttctcctt

SEQ ID NO: 256930 - DNA, 16 bp, P. troglodytes
gtgcttggcacagagt

SEQ ID NO: 256931 - DNA, 16 bp, P. troglodytes
gtgcttggctttggtt

SEQ ID NO: 256932 - DNA, 16 bp, P. troglodytes
gtgcttgtgaggtatt

SEQ ID NO: 256933 - DNA, 16 bp, P. troglodytes
gtgctttcattttcaa

SEQ ID NO: 256934 - DNA, 16 bp, P. troglodytes
gtgctttgcaaatatt

SEQ ID NO: 256935 - DNA, 16 bp, P. troglodytes
gtgctttgggaggcca

SEQ ID NO: 256936 - DNA, 16 bp, P. troglodytes
gtgctttgggaggccg

SEQ ID NO: 256937 - DNA, 16 bp, P. troglodytes
gtggaaaaaaggaaac

SEQ ID NO: 256938 - DNA, 16 bp, P. troglodytes
gtggaaaaagaaatat

SEQ ID NO: 256939 - DNA, 16 bp, P. troglodytes
gtggaaaaatcacaag

SEQ ID NO: 256940 - DNA, 16 bp, P. troglodytes
gtggaaaacagtgtgg

SEQ ID NO: 256941 - DNA, 16 bp, P. troglodytes
gtggaaaagctttttg

SEQ ID NO: 256942 - DNA, 16 bp, P. troglodytes
gtggaaaagtttggaa

SEQ ID NO: 256943 - DNA, 16 bp, P. troglodytes
gtggaaaggaaatgtg

SEQ ID NO: 256944 - DNA, 16 bp, P. troglodytes
gtggaaaggaacaact

SEQ ID NO: 256945 - DNA, 16 bp, P. troglodytes
gtggaaagtttgctca

SEQ ID NO: 256946 - DNA, 16 bp, P. troglodytes
gtggaaattaaacaat

SEQ ID NO: 256947 - DNA, 16 bp, P. troglodytes
gtggaacagaataaag

SEQ ID NO: 256948 - DNA, 16 bp, P. troglodytes
gtggaacagttttatc

SEQ ID NO: 256949 - DNA, 16 bp, P. troglodytes
gtggaactgctggatc

SEQ ID NO: 256950 - DNA, 16 bp, P. troglodytes
gtggaagaaaaagcca

SEQ ID NO: 256951 - DNA, 16 bp, P. troglodytes
gtggaagaaaatccac

SEQ ID NO: 256952 - DNA, 16 bp, P. troglodytes
gtggaagaaaattttt

SEQ ID NO: 256953 - DNA, 16 bp, P. troglodytes
gtggaagaatgaaact

SEQ ID NO: 256954 - DNA, 16 bp, P. troglodytes
gtggaagacaaaggaa

SEQ ID NO: 256955 - DNA, 16 bp, P. troglodytes
gtggaagacttcaaca

SEQ ID NO: 256956 - DNA, 16 bp, P. troglodytes
gtggaagccactttgg

SEQ ID NO: 256957 - DNA, 16 bp, P. troglodytes
gtggaagctgccaaga

SEQ ID NO: 256958 - DNA, 16 bp, P. troglodytes
gtggaagctgccaagg

SEQ ID NO: 256959 - DNA, 16 bp, P. troglodytes
gtggaagctttattct

SEQ ID NO: 256960 - DNA, 16 bp, P. troglodytes
gtggaaggaaagggct

SEQ ID NO: 256961 - DNA, 16 bp, P. troglodytes
gtggaaggcagagggg

SEQ ID NO: 256962 - DNA, 16 bp, P. troglodytes
gtggaaggctgccctg

SEQ ID NO: 256963 - DNA, 16 bp, P. troglodytes
gtggaagtcaatgtgg

SEQ ID NO: 256964 - DNA, 16 bp, P. troglodytes
gtggaagttcctcaaa

SEQ ID NO: 256965 - DNA, 16 bp, P. troglodytes
gtggaatagaaagaag

SEQ ID NO: 256966 - DNA, 16 bp, P. troglodytes
gtggaatattcatgaa

SEQ ID NO: 256967 - DNA, 16 bp, P. troglodytes
gtggaatctaaaaaat

SEQ ID NO: 256968 - DNA, 16 bp, P. troglodytes
gtggacacagggtggg

SEQ ID NO: 256969 - DNA, 16 bp, P. troglodytes
gtggacagagggagga

SEQ ID NO: 256970 - DNA, 16 bp, P. troglodytes
gtggacatccagtttt

SEQ ID NO: 256971 - DNA, 16 bp, P. troglodytes
gtggacatttgggttg

SEQ ID NO: 256972 - DNA, 16 bp, P. troglodytes
gtggacccgggaggcg

SEQ ID NO: 256973 - DNA, 16 bp, P. troglodytes
gtggacctttcagcag

SEQ ID NO: 256974 - DNA, 16 bp, P. troglodytes
gtggacgcccctcccc

SEQ ID NO: 256975 - DNA, 16 bp, P. troglodytes
gtggactgagtaaagc

SEQ ID NO: 256976 - DNA, 16 bp, P. troglodytes
gtggacttttggatta

SEQ ID NO: 256977 - DNA, 16 bp, P. troglodytes
gtggagaaacccagca

SEQ ID NO: 256978 - DNA, 16 bp, P. troglodytes
gtggagaaagaggaat

SEQ ID NO: 256979 - DNA, 16 bp, P. troglodytes
gtggagaaaggggaat

SEQ ID NO: 256980 - DNA, 16 bp, P. troglodytes
gtggagaaatatgaac

SEQ ID NO: 256981 - DNA, 16 bp, P. troglodytes
gtggagaaattggagc

SEQ ID NO: 256982 - DNA, 16 bp, P. troglodytes
gtggagaaatttgaac

SEQ ID NO: 256983 - DNA, 16 bp, P. troglodytes
gtggagaacctttatg

SEQ ID NO: 256984 - DNA, 16 bp, P. troglodytes
gtggagaagctttttg

SEQ ID NO: 256985 - DNA, 16 bp, P. troglodytes
gtggagaagttggaac

SEQ ID NO: 256986 - DNA, 16 bp, P. troglodytes
gtggagacagggtttt

SEQ ID NO: 256987 - DNA, 16 bp, P. troglodytes
gtggagacggggtttt

SEQ ID NO: 256988 - DNA, 16 bp, P. troglodytes
gtggagatggggtttt

SEQ ID NO: 256989 - DNA, 16 bp, P. troglodytes
gtggagatttaagatg

SEQ ID NO: 256990 - DNA, 16 bp, P. troglodytes
gtggagcagggctacc

SEQ ID NO: 256991 - DNA, 16 bp, P. troglodytes
gtggagctcaggaggt

SEQ ID NO: 256992 - DNA, 16 bp, P. troglodytes
gtggagctgctcaaga

SEQ ID NO: 256993 - DNA, 16 bp, P. troglodytes
gtggagctggcagtga

SEQ ID NO: 256994 - DNA, 16 bp, P. troglodytes
gtggaggacttcaaca

SEQ ID NO: 256995 - DNA, 16 bp, P. troglodytes
gtggaggagcagaggc

SEQ ID NO: 256996 - DNA, 16 bp, P. troglodytes
gtggaggaggcagcag

SEQ ID NO: 256997 - DNA, 16 bp, P. troglodytes
gtggaggcagaggcag

SEQ ID NO: 256998 - DNA, 16 bp, P. troglodytes
gtggaggcagaggttg

SEQ ID NO: 256999 - DNA, 16 bp, P. troglodytes
gtggaggcagcagtga

SEQ ID NO: 257000 - DNA, 16 bp, P. troglodytes
gtggaggctccaaccc

SEQ ID NO: 257001 - DNA, 16 bp, P. troglodytes
gtggaggctgcagtaa

SEQ ID NO: 257002 - DNA, 16 bp, P. troglodytes
gtggaggctgcagtga

SEQ ID NO: 257003 - DNA, 16 bp, P. troglodytes
gtggaggctgctgtga

SEQ ID NO: 257004 - DNA, 16 bp, P. troglodytes
gtggagggcaagggga

SEQ ID NO: 257005 - DNA, 16 bp, P. troglodytes
gtggaggggcaggcca

SEQ ID NO: 257006 - DNA, 16 bp, P. troglodytes
gtggaggggctggccc

SEQ ID NO: 257007 - DNA, 16 bp, P. troglodytes
gtggaggggtccccag

SEQ ID NO: 257008 - DNA, 16 bp, P. troglodytes
gtggaggttacaatga

SEQ ID NO: 257009 - DNA, 16 bp, P. troglodytes
gtggaggttctcaaac

SEQ ID NO: 257010 - DNA, 16 bp, P. troglodytes
gtggaggttgcagaga

SEQ ID NO: 257011 - DNA, 16 bp, P. troglodytes
gtggaggttgcagtga

SEQ ID NO: 257012 - DNA, 16 bp, P. troglodytes
gtggagtcaaaggaga

SEQ ID NO: 257013 - DNA, 16 bp, P. troglodytes
gtggagtctccctctg

SEQ ID NO: 257014 - DNA, 16 bp, P. troglodytes
gtggagtgcagtggtg

SEQ ID NO: 257015 - DNA, 16 bp, P. troglodytes
gtggagttgggaagag

SEQ ID NO: 257016 - DNA, 16 bp, P. troglodytes
gtggataaagaaaaca

SEQ ID NO: 257017 - DNA, 16 bp, P. troglodytes
gtggataagcttttag

SEQ ID NO: 257018 - DNA, 16 bp, P. troglodytes
gtggatcacctgaagg

SEQ ID NO: 257019 - DNA, 16 bp, P. troglodytes
gtggatcacctgagga

SEQ ID NO: 257020 - DNA, 16 bp, P. troglodytes
gtggatcacctgaggc

SEQ ID NO: 257021 - DNA, 16 bp, P. troglodytes
gtggatcacgaggtca

SEQ ID NO: 257022 - DNA, 16 bp, P. troglodytes
gtggatcacttgagga

SEQ ID NO: 257023 - DNA, 16 bp, P. troglodytes
gtggatcatgaggtta

SEQ ID NO: 257024 - DNA, 16 bp, P. troglodytes
gtggatccctgaggtc

SEQ ID NO: 257025 - DNA, 16 bp, P. troglodytes
gtggatcccttgagcc

SEQ ID NO: 257026 - DNA, 16 bp, P. troglodytes
gtggatgaaccttgaa

SEQ ID NO: 257027 - DNA, 16 bp, P. troglodytes
gtggatgaactgcaac

SEQ ID NO: 257028 - DNA, 16 bp, P. troglodytes
gtggatggagctggag

SEQ ID NO: 257029 - DNA, 16 bp, P. troglodytes
gtggatggatggaagg

SEQ ID NO: 257030 - DNA, 16 bp, P. troglodytes
gtggatggatggacag

SEQ ID NO: 257031 - DNA, 16 bp, P. troglodytes
gtggatgttaaagcca

SEQ ID NO: 257032 - DNA, 16 bp, P. troglodytes
gtggattaaagactta

SEQ ID NO: 257033 - DNA, 16 bp, P. troglodytes
gtggattcacagctga

SEQ ID NO: 257034 - DNA, 16 bp, P. troglodytes
gtggattgtgaagatt

SEQ ID NO: 257035 - DNA, 16 bp, P. troglodytes
gtggattttcttctgc

SEQ ID NO: 257036 - DNA, 16 bp, P. troglodytes
gtggcaaagcattcaa

SEQ ID NO: 257037 - DNA, 16 bp, P. troglodytes
gtggcacaggcctgtg

SEQ ID NO: 257038 - DNA, 16 bp, P. troglodytes
gtggcacatgcctgtg

SEQ ID NO: 257039 - DNA, 16 bp, P. troglodytes
gtggcacatgcctgtt

SEQ ID NO: 257040 - DNA, 16 bp, P. troglodytes
gtggcacatgctggta

SEQ ID NO: 257041 - DNA, 16 bp, P. troglodytes
gtggcacctttgcctg

SEQ ID NO: 257042 - DNA, 16 bp, P. troglodytes
gtggcacgtgcctata

SEQ ID NO: 257043 - DNA, 16 bp, P. troglodytes
gtggcactcatctgta

SEQ ID NO: 257044 - DNA, 16 bp, P. troglodytes
gtggcacttacctgta

SEQ ID NO: 257045 - DNA, 16 bp, P. troglodytes
gtggcagacccctgta

SEQ ID NO: 257046 - DNA, 16 bp, P. troglodytes
gtggcagagacagaag

SEQ ID NO: 257047 - DNA, 16 bp, P. troglodytes
gtggcagagccaggcc

SEQ ID NO: 257048 - DNA, 16 bp, P. troglodytes
gtggcagagctgggac

SEQ ID NO: 257049 - DNA, 16 bp, P. troglodytes
gtggcagaggttgcag

SEQ ID NO: 257050 - DNA, 16 bp, P. troglodytes
gtggcagatcatcagg

SEQ ID NO: 257051 - DNA, 16 bp, P. troglodytes
gtggcagctaaatgat

SEQ ID NO: 257052 - DNA, 16 bp, P. troglodytes
gtggcaggagacagag

SEQ ID NO: 257053 - DNA, 16 bp, P. troglodytes
gtggcaggcaagaaag

SEQ ID NO: 257054 - DNA, 16 bp, P. troglodytes
gtggcaggcacctata

SEQ ID NO: 257055 - DNA, 16 bp, P. troglodytes
gtggcaggcaggcctc

SEQ ID NO: 257056 - DNA, 16 bp, P. troglodytes
gtggcaggcgcctgta

SEQ ID NO: 257057 - DNA, 16 bp, P. troglodytes
gtggcagggcacagtg

SEQ ID NO: 257058 - DNA, 16 bp, P. troglodytes
gtggcaggtgagcaag

SEQ ID NO: 257059 - DNA, 18 bp, P. troglodytes
gtggcaggtgtctgtagt

SEQ ID NO: 257060 - DNA, 16 bp, P. troglodytes
gtggcagtggtggcag

SEQ ID NO: 257061 - DNA, 16 bp, P. troglodytes
gtggcagtgttgggag

SEQ ID NO: 257062 - DNA, 16 bp, P. troglodytes
gtggcataatctcagc

SEQ ID NO: 257063 - DNA, 16 bp, P. troglodytes
gtggcatatacctgta

SEQ ID NO: 257064 - DNA, 16 bp, P. troglodytes
gtggcatccgcctgta

SEQ ID NO: 257065 - DNA, 16 bp, P. troglodytes
gtggcatgatcatagg

SEQ ID NO: 257066 - DNA, 16 bp, P. troglodytes
gtggcatgcacctgca

SEQ ID NO: 257067 - DNA, 16 bp, P. troglodytes
gtggcatgcacctgtg

SEQ ID NO: 257068 - DNA, 16 bp, P. troglodytes
gtggcatgcatctata

SEQ ID NO: 257069 - DNA, 16 bp, P. troglodytes
gtggcatgcatctgtg

SEQ ID NO: 257070 - DNA, 16 bp, P. troglodytes
gtggccaacaagcatg

SEQ ID NO: 257071 - DNA, 16 bp, P. troglodytes
gtggccaagctggtac

SEQ ID NO: 257072 - DNA, 16 bp, P. troglodytes
gtggccaaggctggag

SEQ ID NO: 257073 - DNA, 16 bp, P. troglodytes
gtggccaccatgcctg

SEQ ID NO: 257074 - DNA, 16 bp, P. troglodytes
gtggccagaggagcag

SEQ ID NO: 257075 - DNA, 17 bp, P. troglodytes
gtggccaggcacggtgg

SEQ ID NO: 257076 - DNA, 16 bp, P. troglodytes
gtggccaggcgcggtg

SEQ ID NO: 257077 - DNA, 16 bp, P. troglodytes
gtggccaggctggtct

SEQ ID NO: 257078 - DNA, 16 bp, P. troglodytes
gtggccaggtatggtg

SEQ ID NO: 257079 - DNA, 16 bp, P. troglodytes
gtggccatagaattct

SEQ ID NO: 257080 - DNA, 16 bp, P. troglodytes
gtggccatggtggcag

SEQ ID NO: 257081 - DNA, 16 bp, P. troglodytes
gtggcccacacctgtg

SEQ ID NO: 257082 - DNA, 18 bp, P. troglodytes
gtggcccatgcctgtagt

SEQ ID NO: 257083 - DNA, 16 bp, P. troglodytes
gtggcccccacccagg

SEQ ID NO: 257084 - DNA, 16 bp, P. troglodytes
gtggcccctgctgctg

SEQ ID NO: 257085 - DNA, 16 bp, P. troglodytes
gtggccgaggcaggtg

SEQ ID NO: 257086 - DNA, 16 bp, P. troglodytes
gtggcctgggctggag

SEQ ID NO: 257087 - DNA, 16 bp, P. troglodytes
gtggcctgggtgacag

SEQ ID NO: 257088 - DNA, 16 bp, P. troglodytes
gtggccttgacctccc

SEQ ID NO: 257089 - DNA, 16 bp, P. troglodytes
gtggccttgagcaagt

SEQ ID NO: 257090 - DNA, 16 bp, P. troglodytes
gtggccttgctgagct

SEQ ID NO: 257091 - DNA, 16 bp, P. troglodytes
gtggcctttgtgtctg

SEQ ID NO: 257092 - DNA, 16 bp, P. troglodytes
gtggcgcaatctcacc

SEQ ID NO: 257093 - DNA, 16 bp, P. troglodytes
gtggcgcaatctcact

SEQ ID NO: 257094 - DNA, 16 bp, P. troglodytes
gtggcgcaatctcagc

SEQ ID NO: 257095 - DNA, 16 bp, P. troglodytes
gtggcgcatgcctgtg

SEQ ID NO: 257096 - DNA, 22 bp, P. troglodytes
gtggcgccatctcagctcactg

SEQ ID NO: 257097 - DNA, 16 bp, P. troglodytes
gtggcgcgatcccagc

SEQ ID NO: 257098 - DNA, 26 bp, P. troglodytes
gtggcgcgatctcggctcactgcaac

SEQ ID NO: 257099 - DNA, 18 bp, P. troglodytes
gtggcgcgatcttggctc

SEQ ID NO: 257100 - DNA, 26 bp, P. troglodytes
gtggcgcgatcttggctcactgcaac

SEQ ID NO: 257101 - DNA, 16 bp, P. troglodytes
gtggcggctgcctgta

SEQ ID NO: 257102 - DNA, 16 bp, P. troglodytes
gtggcgggcacctgtt

SEQ ID NO: 257103 - DNA, 16 bp, P. troglodytes
gtggcgggcatctgta

SEQ ID NO: 257104 - DNA, 16 bp, P. troglodytes
gtggcgggcgcctgtg

SEQ ID NO: 257105 - DNA, 16 bp, P. troglodytes
gtggcgggtgcctata

SEQ ID NO: 257106 - DNA, 17 bp, P. troglodytes
gtggcgtgatcttggct

SEQ ID NO: 257107 - DNA, 16 bp, P. troglodytes
gtggctactgtgttgg

SEQ ID NO: 257108 - DNA, 16 bp, P. troglodytes
gtggctagtggctact

SEQ ID NO: 257109 - DNA, 16 bp, P. troglodytes
gtggctcacaaggtca

SEQ ID NO: 257110 - DNA, 17 bp, P. troglodytes
gtggctcacaccctgta

SEQ ID NO: 257111 - DNA, 16 bp, P. troglodytes
gtggctcacagcctgt

SEQ ID NO: 257112 - DNA, 16 bp, P. troglodytes
gtggctcacgcctata

SEQ ID NO: 257113 - DNA, 17 bp, P. troglodytes
gtggctcactcctctaa

SEQ ID NO: 257114 - DNA, 16 bp, P. troglodytes
gtggctcagtctcagc

SEQ ID NO: 257115 - DNA, 16 bp, P. troglodytes
gtggctcatgcacttt

SEQ ID NO: 257116 - DNA, 17 bp, P. troglodytes
gtggctcatgcctgtat

SEQ ID NO: 257117 - DNA, 16 bp, P. troglodytes
gtggctccatcacagc

SEQ ID NO: 257118 - DNA, 16 bp, P. troglodytes
gtggctcccgcctgta

SEQ ID NO: 257119 - DNA, 16 bp, P. troglodytes
gtggctcgcacctgta

SEQ ID NO: 257120 - DNA, 16 bp, P. troglodytes
gtggctcgcttcttca

SEQ ID NO: 257121 - DNA, 16 bp, P. troglodytes
gtggctctggcctgta

SEQ ID NO: 257122 - DNA, 16 bp, P. troglodytes
gtggctgagcacagtg

SEQ ID NO: 257123 - DNA, 16 bp, P. troglodytes
gtggctgaggcaggag

SEQ ID NO: 257124 - DNA, 16 bp, P. troglodytes
gtggctgaggctggag

SEQ ID NO: 257125 - DNA, 16 bp, P. troglodytes
gtggctgagggaggag

SEQ ID NO: 257126 - DNA, 16 bp, P. troglodytes
gtggctgcagaacagc

SEQ ID NO: 257127 - DNA, 16 bp, P. troglodytes
gtggctgcagtgagct

SEQ ID NO: 257128 - DNA, 16 bp, P. troglodytes
gtggctgcatagtatt

SEQ ID NO: 257129 - DNA, 16 bp, P. troglodytes
gtggctgcccctcccc

SEQ ID NO: 257130 - DNA, 16 bp, P. troglodytes
gtggctggacgtggtg

SEQ ID NO: 257131 - DNA, 16 bp, P. troglodytes
gtggctggagctggag

SEQ ID NO: 257132 - DNA, 16 bp, P. troglodytes
gtggctggccaggcgg

SEQ ID NO: 257133 - DNA, 18 bp, P. troglodytes
gtggctggcgcctgtagt

SEQ ID NO: 257134 - DNA, 16 bp, P. troglodytes
gtggctgggactacag

SEQ ID NO: 257135 - DNA, 16 bp, P. troglodytes
gtggctgggagcagtg

SEQ ID NO: 257136 - DNA, 16 bp, P. troglodytes
gtggctgggtacagtg

SEQ ID NO: 257137 - DNA, 16 bp, P. troglodytes
gtggctgtaattccag

SEQ ID NO: 257138 - DNA, 16 bp, P. troglodytes
gtggcttaaaacaaca

SEQ ID NO: 257139 - DNA, 16 bp, P. troglodytes
gtggcttaaacaacac

SEQ ID NO: 257140 - DNA, 16 bp, P. troglodytes
gtggcttacacttgta

SEQ ID NO: 257141 - DNA, 16 bp, P. troglodytes
gtggcttatcttttca

SEQ ID NO: 257142 - DNA, 16 bp, P. troglodytes
gtggcttatttagttc

SEQ ID NO: 257143 - DNA, 16 bp, P. troglodytes
gtggcttggtagtggc

SEQ ID NO: 257144 - DNA, 16 bp, P. troglodytes
gtggcttttccaggag

SEQ ID NO: 257145 - DNA, 16 bp, P. troglodytes
gtgggaaagtaaaatg

SEQ ID NO: 257146 - DNA, 16 bp, P. troglodytes
gtgggaaagtgtggaa

SEQ ID NO: 257147 - DNA, 16 bp, P. troglodytes
gtgggaaagtttggag

SEQ ID NO: 257148 - DNA, 16 bp, P. troglodytes
gtgggaaccctgagct

SEQ ID NO: 257149 - DNA, 16 bp, P. troglodytes
gtgggaacgtaaaatg

SEQ ID NO: 257150 - DNA, 16 bp, P. troglodytes
gtgggaactggggctg

SEQ ID NO: 257151 - DNA, 16 bp, P. troglodytes
gtgggaagaggccagg

SEQ ID NO: 257152 - DNA, 16 bp, P. troglodytes
gtgggaagatttcttg

SEQ ID NO: 257153 - DNA, 16 bp, P. troglodytes
gtgggaaggactttgt

SEQ ID NO: 257154 - DNA, 16 bp, P. troglodytes
gtgggaatggaaagga

SEQ ID NO: 257155 - DNA, 16 bp, P. troglodytes
gtgggaattgaaaaat

SEQ ID NO: 257156 - DNA, 16 bp, P. troglodytes
gtgggacaggatgtgg

SEQ ID NO: 257157 - DNA, 16 bp, P. troglodytes
gtgggacccgctgagc

SEQ ID NO: 257158 - DNA, 16 bp, P. troglodytes
gtgggagataattgaa

SEQ ID NO: 257159 - DNA, 16 bp, P. troglodytes
gtgggagatgattgga

SEQ ID NO: 257160 - DNA, 16 bp, P. troglodytes
gtgggagcagggtgag

SEQ ID NO: 257161 - DNA, 24 bp, P. troglodytes
gtgggaggatcacttgagcctggg

SEQ ID NO: 257162 - DNA, 16 bp, P. troglodytes
gtgggaggattgactg

SEQ ID NO: 257163 - DNA, 17 bp, P. troglodytes
gtgggaggccgaggcag

SEQ ID NO: 257164 - DNA, 16 bp, P. troglodytes
gtgggagggacccagc

SEQ ID NO: 257165 - DNA, 16 bp, P. troglodytes
gtgggagggactgggt

SEQ ID NO: 257166 - DNA, 16 bp, P. troglodytes
gtgggagggccagttt

SEQ ID NO: 257167 - DNA, 16 bp, P. troglodytes
gtgggaggtgatttga

SEQ ID NO: 257168 - DNA, 16 bp, P. troglodytes
gtgggaggtggaggca

SEQ ID NO: 257169 - DNA, 17 bp, P. troglodytes
gtgggatctcactatgt

SEQ ID NO: 257170 - DNA, 16 bp, P. troglodytes
gtgggatttctcagcc

SEQ ID NO: 257171 - DNA, 16 bp, P. troglodytes
gtgggcaaagaacatg

SEQ ID NO: 257172 - DNA, 17 bp, P. troglodytes
gtgggcaacaagagtga

SEQ ID NO: 257173 - DNA, 16 bp, P. troglodytes
gtgggcagagatcaca

SEQ ID NO: 257174 - DNA, 16 bp, P. troglodytes
gtgggcagaggccagg

SEQ ID NO: 257175 - DNA, 16 bp, P. troglodytes
gtgggcagattgcttg

SEQ ID NO: 257176 - DNA, 16 bp, P. troglodytes
gtgggcagctgggcag

SEQ ID NO: 257177 - DNA, 16 bp, P. troglodytes
gtgggcagggcctggg

SEQ ID NO: 257178 - DNA, 16 bp, P. troglodytes
gtgggcaggggccagg

SEQ ID NO: 257179 - DNA, 16 bp, P. troglodytes
gtgggcatttagtggt

SEQ ID NO: 257180 - DNA, 16 bp, P. troglodytes
gtgggccaccacgccc

SEQ ID NO: 257181 - DNA, 16 bp, P. troglodytes
gtgggccccacccagt

SEQ ID NO: 257182 - DNA, 16 bp, P. troglodytes
gtgggcctgacctaat

SEQ ID NO: 257183 - DNA, 16 bp, P. troglodytes
gtgggctcccaaggtc

SEQ ID NO: 257184 - DNA, 16 bp, P. troglodytes
gtgggctcccatggcc

SEQ ID NO: 257185 - DNA, 16 bp, P. troglodytes
gtgggctcctctctgg

SEQ ID NO: 257186 - DNA, 16 bp, P. troglodytes
gtgggctgcatccact

SEQ ID NO: 257187 - DNA, 22 bp, P. troglodytes
gtgggctgggcgcagtggctca

SEQ ID NO: 257188 - DNA, 16 bp, P. troglodytes
gtggggaaataggaac

SEQ ID NO: 257189 - DNA, 16 bp, P. troglodytes
gtggggaagctgaggc

SEQ ID NO: 257190 - DNA, 16 bp, P. troglodytes
gtggggactctgtgtt

SEQ ID NO: 257191 - DNA, 16 bp, P. troglodytes
gtggggactgtggcaa

SEQ ID NO: 257192 - DNA, 16 bp, P. troglodytes
gtggggacttagagaa

SEQ ID NO: 257193 - DNA, 16 bp, P. troglodytes
gtggggacttggagaa

SEQ ID NO: 257194 - DNA, 19 bp, P. troglodytes
gtggggagagggtcagcag

SEQ ID NO: 257195 - DNA, 16 bp, P. troglodytes
gtggggagcacctctg

SEQ ID NO: 257196 - DNA, 16 bp, P. troglodytes
gtggggaggagcctgg

SEQ ID NO: 257197 - DNA, 16 bp, P. troglodytes
gtggggatgcctgcct

SEQ ID NO: 257198 - DNA, 16 bp, P. troglodytes
gtggggcactgaagaa

SEQ ID NO: 257199 - DNA, 16 bp, P. troglodytes
gtggggccagagccca

SEQ ID NO: 257200 - DNA, 16 bp, P. troglodytes
gtggggccaggcatgg

SEQ ID NO: 257201 - DNA, 16 bp, P. troglodytes
gtggggccgggcatgg

SEQ ID NO: 257202 - DNA, 16 bp, P. troglodytes
gtggggcctcatggga

SEQ ID NO: 257203 - DNA, 16 bp, P. troglodytes
gtggggcctgtgggag

SEQ ID NO: 257204 - DNA, 16 bp, P. troglodytes
gtggggcctttgccag

SEQ ID NO: 257205 - DNA, 16 bp, P. troglodytes
gtggggctgggcacag

SEQ ID NO: 257206 - DNA, 16 bp, P. troglodytes
gtgggggaggctcagg

SEQ ID NO: 257207 - DNA, 16 bp, P. troglodytes
gtgggggcagcacagg

SEQ ID NO: 257208 - DNA, 16 bp, P. troglodytes
gtgggggctccagccc

SEQ ID NO: 257209 - DNA, 16 bp, P. troglodytes
gtggggggctaaggga

SEQ ID NO: 257210 - DNA, 16 bp, P. troglodytes
gtggggggtgcctctg

SEQ ID NO: 257211 - DNA, 16 bp, P. troglodytes
gtggggtcggagcccc

SEQ ID NO: 257212 - DNA, 16 bp, P. troglodytes
gtggggtctcactatg

SEQ ID NO: 257213 - DNA, 16 bp, P. troglodytes
gtggggtcttgctctg

SEQ ID NO: 257214 - DNA, 16 bp, P. troglodytes
gtggggtctttaagag

SEQ ID NO: 257215 - DNA, 16 bp, P. troglodytes
gtggggtgggagcccc

SEQ ID NO: 257216 - DNA, 16 bp, P. troglodytes
gtggggtggtgcacac

SEQ ID NO: 257217 - DNA, 16 bp, P. troglodytes
gtggggtgtggtggca

SEQ ID NO: 257218 - DNA, 16 bp, P. troglodytes
gtggggtttctccatg

SEQ ID NO: 257219 - DNA, 16 bp, P. troglodytes
gtggggttttgtcatg

SEQ ID NO: 257220 - DNA, 16 bp, P. troglodytes
gtgggtagaggccaag

SEQ ID NO: 257221 - DNA, 16 bp, P. troglodytes
gtgggtatgaagtggt

SEQ ID NO: 257222 - DNA, 16 bp, P. troglodytes
gtgggtcctcaccaga

SEQ ID NO: 257223 - DNA, 16 bp, P. troglodytes
gtgggtgacagagcca

SEQ ID NO: 257224 - DNA, 16 bp, P. troglodytes
gtgggtgacagtgaac

SEQ ID NO: 257225 - DNA, 16 bp, P. troglodytes
gtgggtgatatggttt

SEQ ID NO: 257226 - DNA, 16 bp, P. troglodytes
gtgggtgcagcccaca

SEQ ID NO: 257227 - DNA, 16 bp, P. troglodytes
gtgggtgcagcccact

SEQ ID NO: 257228 - DNA, 16 bp, P. troglodytes
gtgggtgcccctctgg

SEQ ID NO: 257229 - DNA, 16 bp, P. troglodytes
gtgggtgcctgtaatc

SEQ ID NO: 257230 - DNA, 16 bp, P. troglodytes
gtgggtgctcaataaa

SEQ ID NO: 257231 - DNA, 16 bp, P. troglodytes
gtgggtgttcaataaa

SEQ ID NO: 257232 - DNA, 16 bp, P. troglodytes
gtgggttcctgtgcag

SEQ ID NO: 257233 - DNA, 16 bp, P. troglodytes
gtgggttcgtggtctt

SEQ ID NO: 257234 - DNA, 16 bp, P. troglodytes
gtgggttcttgggcag

SEQ ID NO: 257235 - DNA, 16 bp, P. troglodytes
gtgggttcttggtctc

SEQ ID NO: 257236 - DNA, 16 bp, P. troglodytes
gtgggtttggttttca

SEQ ID NO: 257237 - DNA, 16 bp, P. troglodytes
gtgggttttagtatat

SEQ ID NO: 257238 - DNA, 16 bp, P. troglodytes
gtggtaatgagtgagt

SEQ ID NO: 257239 - DNA, 16 bp, P. troglodytes
gtggtagcatgtgtca

SEQ ID NO: 257240 - DNA, 16 bp, P. troglodytes
gtggtagctcatgcct

SEQ ID NO: 257241 - DNA, 16 bp, P. troglodytes
gtggtaggcgcctgta

SEQ ID NO: 257242 - DNA, 16 bp, P. troglodytes
gtggtagttgctgaag

SEQ ID NO: 257243 - DNA, 16 bp, P. troglodytes
gtggtatatacatatg

SEQ ID NO: 257244 - DNA, 16 bp, P. troglodytes
gtggtatgtgtatgtg

SEQ ID NO: 257245 - DNA, 16 bp, P. troglodytes
gtggtattggcaaaag

SEQ ID NO: 257246 - DNA, 16 bp, P. troglodytes
gtggtcaaattctgga

SEQ ID NO: 257247 - DNA, 16 bp, P. troglodytes
gtggtcacagctactc

SEQ ID NO: 257248 - DNA, 16 bp, P. troglodytes
gtggtcaccatgcagt

SEQ ID NO: 257249 - DNA, 16 bp, P. troglodytes
gtggtcagaacttgag

SEQ ID NO: 257250 - DNA, 16 bp, P. troglodytes
gtggtcatctgcaagc

SEQ ID NO: 257251 - DNA, 16 bp, P. troglodytes
gtggtcccaactactc

SEQ ID NO: 257252 - DNA, 16 bp, P. troglodytes
gtggtcccagatactt

SEQ ID NO: 257253 - DNA, 16 bp, P. troglodytes
gtggtcctagctactc

SEQ ID NO: 257254 - DNA, 16 bp, P. troglodytes
gtggtcgcagctactc

SEQ ID NO: 257255 - DNA, 17 bp, P. troglodytes
gtggtctcactatgttg

SEQ ID NO: 257256 - DNA, 16 bp, P. troglodytes
gtggtctcagctcact

SEQ ID NO: 257257 - DNA, 18 bp, P. troglodytes
gtggtctcgaactcctga

SEQ ID NO: 257258 - DNA, 16 bp, P. troglodytes
gtggtctggataaaag

SEQ ID NO: 257259 - DNA, 16 bp, P. troglodytes
gtggtcttgaactctt

SEQ ID NO: 257260 - DNA, 16 bp, P. troglodytes
gtggtcttgccatgtt

SEQ ID NO: 257261 - DNA, 16 bp, P. troglodytes
gtggtcttgctcagcg

SEQ ID NO: 257262 - DNA, 17 bp, P. troglodytes
gtggtgaaacccagtct

SEQ ID NO: 257263 - DNA, 23 bp, P. troglodytes
gtggtgaaaccccatctctactg

SEQ ID NO: 257264 - DNA, 23 bp, P. troglodytes
gtggtgaaaccccgtctctactg

SEQ ID NO: 257265 - DNA, 17 bp, P. troglodytes
gtggtgaaactccatct

SEQ ID NO: 257266 - DNA, 16 bp, P. troglodytes
gtggtgaaactccgtc

SEQ ID NO: 257267 - DNA, 16 bp, P. troglodytes
gtggtgaaagggaaca

SEQ ID NO: 257268 - DNA, 16 bp, P. troglodytes
gtggtgaagtctgggc

SEQ ID NO: 257269 - DNA, 16 bp, P. troglodytes
gtggtgacagatggca

SEQ ID NO: 257270 - DNA, 16 bp, P. troglodytes
gtggtgatgcatgcct

SEQ ID NO: 257271 - DNA, 16 bp, P. troglodytes
gtggtgatgctggtgg

SEQ ID NO: 257272 - DNA, 16 bp, P. troglodytes
gtggtgatggtgataa

SEQ ID NO: 257273 - DNA, 27 bp, P. troglodytes
gtggtgcaatctcggctcactgcaagc

SEQ ID NO: 257274 - DNA, 24 bp, P. troglodytes
gtggtgcaatctcggctcactgcg

SEQ ID NO: 257275 - DNA, 16 bp, P. troglodytes
gtggtgcaatcttggt

SEQ ID NO: 257276 - DNA, 16 bp, P. troglodytes
gtggtgcacaccggta

SEQ ID NO: 257277 - DNA, 16 bp, P. troglodytes
gtggtgcacgtctgtg

SEQ ID NO: 257278 - DNA, 16 bp, P. troglodytes
gtggtgcaggatatgg

SEQ ID NO: 257279 - DNA, 16 bp, P. troglodytes
gtggtgcaggcctgtg

SEQ ID NO: 257280 - DNA, 16 bp, P. troglodytes
gtggtgcatacctata

SEQ ID NO: 257281 - DNA, 16 bp, P. troglodytes
gtggtgccatcatgac

SEQ ID NO: 257282 - DNA, 16 bp, P. troglodytes
gtggtgccatctgggc

SEQ ID NO: 257283 - DNA, 16 bp, P. troglodytes
gtggtgcctgcctgtg

SEQ ID NO: 257284 - DNA, 16 bp, P. troglodytes
gtggtgcgatctcaga

SEQ ID NO: 257285 - DNA, 16 bp, P. troglodytes
gtggtgcgcgcctgta

SEQ ID NO: 257286 - DNA, 16 bp, P. troglodytes
gtggtgctgggtgcct

SEQ ID NO: 257287 - DNA, 21 bp, P. troglodytes
gtggtggcacgcacctgtagt

SEQ ID NO: 257288 - DNA, 16 bp, P. troglodytes
gtggtggcagcagtgg

SEQ ID NO: 257289 - DNA, 16 bp, P. troglodytes
gtggtggcagctgcct

SEQ ID NO: 257290 - DNA, 16 bp, P. troglodytes
gtggtggcagtggcag

SEQ ID NO: 257291 - DNA, 16 bp, P. troglodytes
gtggtggcagtggtgg

SEQ ID NO: 257292 - DNA, 20 bp, P. troglodytes
gtggtggcatgtgcctgtag

SEQ ID NO: 257293 - DNA, 16 bp, P. troglodytes
gtggtggccacaggag

SEQ ID NO: 257294 - DNA, 16 bp, P. troglodytes
gtggtggccaggctgg

SEQ ID NO: 257295 - DNA, 16 bp, P. troglodytes
gtggtggcccacacct

SEQ ID NO: 257296 - DNA, 16 bp, P. troglodytes
gtggtggcccactcct

SEQ ID NO: 257297 - DNA, 16 bp, P. troglodytes
gtggtggccggcacct

SEQ ID NO: 257298 - DNA, 16 bp, P. troglodytes
gtggtggcctgtgcct

SEQ ID NO: 257299 - DNA, 17 bp, P. troglodytes
gtggtggcgcatgcctt

SEQ ID NO: 257300 - DNA, 16 bp, P. troglodytes
gtggtggcggccgcct

SEQ ID NO: 257301 - DNA, 16 bp, P. troglodytes
gtggtggcgggcatct

SEQ ID NO: 257302 - DNA, 16 bp, P. troglodytes
gtggtggcgtgcacct

SEQ ID NO: 257303 - DNA, 16 bp, P. troglodytes
gtggtggctcacgccc

SEQ ID NO: 257304 - DNA, 16 bp, P. troglodytes
gtggtggctcacgcct

SEQ ID NO: 257305 - DNA, 16 bp, P. troglodytes
gtggtggctcagacct

SEQ ID NO: 257306 - DNA, 16 bp, P. troglodytes
gtggtggctcatacct

SEQ ID NO: 257307 - DNA, 16 bp, P. troglodytes
gtggtggctcatgcct

SEQ ID NO: 257308 - DNA, 16 bp, P. troglodytes
gtggtggctgcagaac

SEQ ID NO: 257309 - DNA, 16 bp, P. troglodytes
gtggtggctgggcaga

SEQ ID NO: 257310 - DNA, 16 bp, P. troglodytes
gtggtggcttatacct

SEQ ID NO: 257311 - DNA, 16 bp, P. troglodytes
gtggtggcttgcacct

SEQ ID NO: 257312 - DNA, 16 bp, P. troglodytes
gtggtgggatgtgcct

SEQ ID NO: 257313 - DNA, 16 bp, P. troglodytes
gtggtgggcacctgca

SEQ ID NO: 257314 - DNA, 16 bp, P. troglodytes
gtggtgggcagggcca

SEQ ID NO: 257315 - DNA, 16 bp, P. troglodytes
gtggtgggccagggtg

SEQ ID NO: 257316 - DNA, 16 bp, P. troglodytes
gtggtgggcgcctgtg

SEQ ID NO: 257317 - DNA, 16 bp, P. troglodytes
gtggtgggctggattt

SEQ ID NO: 257318 - DNA, 16 bp, P. troglodytes
gtggtggggcacctgt

SEQ ID NO: 257319 - DNA, 16 bp, P. troglodytes
gtggtggtagcagcag

SEQ ID NO: 257320 - DNA, 16 bp, P. troglodytes
gtggtggtctggaacc

SEQ ID NO: 257321 - DNA, 16 bp, P. troglodytes
gtggtggtgaatgcct

SEQ ID NO: 257322 - DNA, 16 bp, P. troglodytes
gtggtggtgcaatctc

SEQ ID NO: 257323 - DNA, 16 bp, P. troglodytes
gtggtggtgcatgcct

SEQ ID NO: 257324 - DNA, 19 bp, P. troglodytes
gtggtggtgcatgcctgtc

SEQ ID NO: 257325 - DNA, 16 bp, P. troglodytes
gtggtggtgcatgctt

SEQ ID NO: 257326 - DNA, 16 bp, P. troglodytes
gtggtggtggcacatg

SEQ ID NO: 257327 - DNA, 16 bp, P. troglodytes
gtggtggtggcagtga

SEQ ID NO: 257328 - DNA, 16 bp, P. troglodytes
gtggtggtggccacag

SEQ ID NO: 257329 - DNA, 16 bp, P. troglodytes
gtggtggtgggcactg

SEQ ID NO: 257330 - DNA, 16 bp, P. troglodytes
gtggtggtgggcgcct

SEQ ID NO: 257331 - DNA, 16 bp, P. troglodytes
gtggtggtggtgaaga

SEQ ID NO: 257332 - DNA, 16 bp, P. troglodytes
gtggtggtggtggcca

SEQ ID NO: 257333 - DNA, 16 bp, P. troglodytes
gtggtggtgtacacct

SEQ ID NO: 257334 - DNA, 16 bp, P. troglodytes
gtggtggtgtgcacat

SEQ ID NO: 257335 - DNA, 16 bp, P. troglodytes
gtggtggtgttcacct

SEQ ID NO: 257336 - DNA, 16 bp, P. troglodytes
gtggtgtgatcaaagc

SEQ ID NO: 257337 - DNA, 16 bp, P. troglodytes
gtggtgtgatcttggg

SEQ ID NO: 257338 - DNA, 16 bp, P. troglodytes
gtggtgtgcgtctgta

SEQ ID NO: 257339 - DNA, 16 bp, P. troglodytes
gtggtgtgtccctgta

SEQ ID NO: 257340 - DNA, 16 bp, P. troglodytes
gtggtgtgtgcctata

SEQ ID NO: 257341 - DNA, 16 bp, P. troglodytes
gtggtgtgtgcctgtg

SEQ ID NO: 257342 - DNA, 16 bp, P. troglodytes
gtggttaagaacatgg

SEQ ID NO: 257343 - DNA, 16 bp, P. troglodytes
gtggttaagagcatgg

SEQ ID NO: 257344 - DNA, 16 bp, P. troglodytes
gtggttaccagagact

SEQ ID NO: 257345 - DNA, 16 bp, P. troglodytes
gtggttcatgactgta

SEQ ID NO: 257346 - DNA, 18 bp, P. troglodytes
gtggttcatgcctataat

SEQ ID NO: 257347 - DNA, 16 bp, P. troglodytes
gtggttcttaaacttg

SEQ ID NO: 257348 - DNA, 16 bp, P. troglodytes
gtggttcttaaacttt

SEQ ID NO: 257349 - DNA, 16 bp, P. troglodytes
gtggttgcagtgagcc

SEQ ID NO: 257350 - DNA, 16 bp, P. troglodytes
gtggttgccagggact

SEQ ID NO: 257351 - DNA, 16 bp, P. troglodytes
gtggttgccaggggct

SEQ ID NO: 257352 - DNA, 16 bp, P. troglodytes
gtggtttaaaaaaaaa

SEQ ID NO: 257353 - DNA, 16 bp, P. troglodytes
gtggtttcagaattgt

SEQ ID NO: 257354 - DNA, 16 bp, P. troglodytes
gtggtttctgtctcct

SEQ ID NO: 257355 - DNA, 16 bp, P. troglodytes
gtggtttgctacacct

SEQ ID NO: 257356 - DNA, 16 bp, P. troglodytes
gtggtttgctgcactc

SEQ ID NO: 257357 - DNA, 16 bp, P. troglodytes
gtggtttgctgtaccc

SEQ ID NO: 257358 - DNA, 16 bp, P. troglodytes
gtggttttgatttaca

SEQ ID NO: 257359 - DNA, 16 bp, P. troglodytes
gtggttttgatttcca

SEQ ID NO: 257360 - DNA, 16 bp, P. troglodytes
gtggttttgccatgtt

SEQ ID NO: 257361 - DNA, 17 bp, P. troglodytes
gtgtaatcccagctact

SEQ ID NO: 257362 - DNA, 16 bp, P. troglodytes
gtgtacacctgtagtc

SEQ ID NO: 257363 - DNA, 16 bp, P. troglodytes
gtgtacagcagcagca

SEQ ID NO: 257364 - DNA, 16 bp, P. troglodytes
gtgtacatacatgtat

SEQ ID NO: 257365 - DNA, 16 bp, P. troglodytes
gtgtaccctttaccca

SEQ ID NO: 257366 - DNA, 16 bp, P. troglodytes
gtgtacttaatgccac

SEQ ID NO: 257367 - DNA, 16 bp, P. troglodytes
gtgtagatttatttct

SEQ ID NO: 257368 - DNA, 17 bp, P. troglodytes
gtgtagtcccagctact

SEQ ID NO: 257369 - DNA, 16 bp, P. troglodytes
gtgtataattgttcat

SEQ ID NO: 257370 - DNA, 16 bp, P. troglodytes
gtgtatacatacatat

SEQ ID NO: 257371 - DNA, 16 bp, P. troglodytes
gtgtatactacatttt

SEQ ID NO: 257372 - DNA, 16 bp, P. troglodytes
gtgtatatacacatat

SEQ ID NO: 257373 - DNA, 16 bp, P. troglodytes
gtgtatatatacacat

SEQ ID NO: 257374 - DNA, 16 bp, P. troglodytes
gtgtatatatatataa

SEQ ID NO: 257375 - DNA, 16 bp, P. troglodytes
gtgtatatctgtatat

SEQ ID NO: 257376 - DNA, 20 bp, P. troglodytes
gtgtatatgtgccacacttt

SEQ ID NO: 257377 - DNA, 16 bp, P. troglodytes
gtgtatctaaacacat

SEQ ID NO: 257378 - DNA, 16 bp, P. troglodytes
gtgtatctgtgtatgt

SEQ ID NO: 257379 - DNA, 16 bp, P. troglodytes
gtgtatggatgtgtgt

SEQ ID NO: 257380 - DNA, 16 bp, P. troglodytes
gtgtatgtatatatac

SEQ ID NO: 257381 - DNA, 16 bp, P. troglodytes
gtgtatgtatgagtgt

SEQ ID NO: 257382 - DNA, 17 bp, P. troglodytes
gtgtatgtatgtgtatg

SEQ ID NO: 257383 - DNA, 16 bp, P. troglodytes
gtgtatgtgaaacata

SEQ ID NO: 257384 - DNA, 16 bp, P. troglodytes
gtgtatgtgagtgtgc

SEQ ID NO: 257385 - DNA, 16 bp, P. troglodytes
gtgtatgtgtacacat

SEQ ID NO: 257386 - DNA, 16 bp, P. troglodytes
gtgtatgtgtatacac

SEQ ID NO: 257387 - DNA, 16 bp, P. troglodytes
gtgtatgtgtgagaga

SEQ ID NO: 257388 - DNA, 16 bp, P. troglodytes
gtgtatgtgtgtgatg

SEQ ID NO: 257389 - DNA, 16 bp, P. troglodytes
gtgtattgcttttgca

SEQ ID NO: 257390 - DNA, 16 bp, P. troglodytes
gtgtattttacactta

SEQ ID NO: 257391 - DNA, 16 bp, P. troglodytes
gtgtattttatgtgta

SEQ ID NO: 257392 - DNA, 16 bp, P. troglodytes
gtgtatttttaatatc

SEQ ID NO: 257393 - DNA, 16 bp, P. troglodytes
gtgtcaacttgattag

SEQ ID NO: 257394 - DNA, 16 bp, P. troglodytes
gtgtcaagagcctgga

SEQ ID NO: 257395 - DNA, 17 bp, P. troglodytes
gtgtcaaggaaaaacac

SEQ ID NO: 257396 - DNA, 16 bp, P. troglodytes
gtgtcaagggtgactg

SEQ ID NO: 257397 - DNA, 16 bp, P. troglodytes
gtgtcacacctgtaat

SEQ ID NO: 257398 - DNA, 16 bp, P. troglodytes
gtgtcaccacccaaat

SEQ ID NO: 257399 - DNA, 16 bp, P. troglodytes
gtgtcactctgtcacc

SEQ ID NO: 257400 - DNA, 16 bp, P. troglodytes
gtgtcactgcactcca

SEQ ID NO: 257401 - DNA, 16 bp, P. troglodytes
gtgtcagaattgaatt

SEQ ID NO: 257402 - DNA, 16 bp, P. troglodytes
gtgtcagcaggattgg

SEQ ID NO: 257403 - DNA, 16 bp, P. troglodytes
gtgtcagctgagtttg

SEQ ID NO: 257404 - DNA, 16 bp, P. troglodytes
gtgtcagctgatccat

SEQ ID NO: 257405 - DNA, 16 bp, P. troglodytes
gtgtcagctggggctg

SEQ ID NO: 257406 - DNA, 16 bp, P. troglodytes
gtgtcaggcaatctgg

SEQ ID NO: 257407 - DNA, 16 bp, P. troglodytes
gtgtcaggtatttctt

SEQ ID NO: 257408 - DNA, 16 bp, P. troglodytes
gtgtcaggtgcctgta

SEQ ID NO: 257409 - DNA, 16 bp, P. troglodytes
gtgtcatcacagctca

SEQ ID NO: 257410 - DNA, 16 bp, P. troglodytes
gtgtcatctgagacaa

SEQ ID NO: 257411 - DNA, 16 bp, P. troglodytes
gtgtcatcttctctta

SEQ ID NO: 257412 - DNA, 16 bp, P. troglodytes
gtgtcatggccatcac

SEQ ID NO: 257413 - DNA, 16 bp, P. troglodytes
gtgtcatgggtgtttg

SEQ ID NO: 257414 - DNA, 16 bp, P. troglodytes
gtgtcattacatgtga

SEQ ID NO: 257415 - DNA, 16 bp, P. troglodytes
gtgtcatttaaaaata

SEQ ID NO: 257416 - DNA, 16 bp, P. troglodytes
gtgtccacacatacat

SEQ ID NO: 257417 - DNA, 16 bp, P. troglodytes
gtgtccaggaagaatg

SEQ ID NO: 257418 - DNA, 16 bp, P. troglodytes
gtgtccaggcagaagc

SEQ ID NO: 257419 - DNA, 16 bp, P. troglodytes
gtgtccatgtgttctt

SEQ ID NO: 257420 - DNA, 16 bp, P. troglodytes
gtgtcccaaagtgctg

SEQ ID NO: 257421 - DNA, 16 bp, P. troglodytes
gtgtcccagctccagg

SEQ ID NO: 257422 - DNA, 16 bp, P. troglodytes
gtgtccttataagaag

SEQ ID NO: 257423 - DNA, 16 bp, P. troglodytes
gtgtcctttgcaggaa

SEQ ID NO: 257424 - DNA, 16 bp, P. troglodytes
gtgtcggccaggctgg

SEQ ID NO: 257425 - DNA, 16 bp, P. troglodytes
gtgtctcaatttcctc

SEQ ID NO: 257426 - DNA, 16 bp, P. troglodytes
gtgtctcattctgttg

SEQ ID NO: 257427 - DNA, 16 bp, P. troglodytes
gtgtctcccaggtcct

SEQ ID NO: 257428 - DNA, 16 bp, P. troglodytes
gtgtctccctgtgttg

SEQ ID NO: 257429 - DNA, 16 bp, P. troglodytes
gtgtctcctccaaatt

SEQ ID NO: 257430 - DNA, 16 bp, P. troglodytes
gtgtctcgctctgtca

SEQ ID NO: 257431 - DNA, 16 bp, P. troglodytes
gtgtctctctgtgtgt

SEQ ID NO: 257432 - DNA, 16 bp, P. troglodytes
gtgtctctgcaggtga

SEQ ID NO: 257433 - DNA, 16 bp, P. troglodytes
gtgtctctgtgtgtgc

SEQ ID NO: 257434 - DNA, 16 bp, P. troglodytes
gtgtctctgtttcctt

SEQ ID NO: 257435 - DNA, 16 bp, P. troglodytes
gtgtctgagctcagcc

SEQ ID NO: 257436 - DNA, 16 bp, P. troglodytes
gtgtctggcatatagt

SEQ ID NO: 257437 - DNA, 16 bp, P. troglodytes
gtgtctggtgaaggcc

SEQ ID NO: 257438 - DNA, 16 bp, P. troglodytes
gtgtctggtgaggacc

SEQ ID NO: 257439 - DNA, 16 bp, P. troglodytes
gtgtctggtttccatt

SEQ ID NO: 257440 - DNA, 16 bp, P. troglodytes
gtgtctgtctgtctgc

SEQ ID NO: 257441 - DNA, 16 bp, P. troglodytes
gtgtctgtctgtctgt

SEQ ID NO: 257442 - DNA, 17 bp, P. troglodytes
gtgtctgtgtagaaaga

SEQ ID NO: 257443 - DNA, 16 bp, P. troglodytes
gtgtctgtgtctgtgt

SEQ ID NO: 257444 - DNA, 16 bp, P. troglodytes
gtgtctgtgtgtttgc

SEQ ID NO: 257445 - DNA, 16 bp, P. troglodytes
gtgtctgtttccttct

SEQ ID NO: 257446 - DNA, 16 bp, P. troglodytes
gtgtcttctctgattt

SEQ ID NO: 257447 - DNA, 16 bp, P. troglodytes
gtgtcttctgccagca

SEQ ID NO: 257448 - DNA, 16 bp, P. troglodytes
gtgtctttgggttgct

SEQ ID NO: 257449 - DNA, 16 bp, P. troglodytes
gtgtgaaaagaccaaa

SEQ ID NO: 257450 - DNA, 16 bp, P. troglodytes
gtgtgaaatggcatct

SEQ ID NO: 257451 - DNA, 16 bp, P. troglodytes
gtgtgaacctgggagg

SEQ ID NO: 257452 - DNA, 16 bp, P. troglodytes
gtgtgaagagaccacc

SEQ ID NO: 257453 - DNA, 16 bp, P. troglodytes
gtgtgaaggtgtgtgt

SEQ ID NO: 257454 - DNA, 16 bp, P. troglodytes
gtgtgaatgtgtgtgt

SEQ ID NO: 257455 - DNA, 16 bp, P. troglodytes
gtgtgacagcaaaact

SEQ ID NO: 257456 - DNA, 16 bp, P. troglodytes
gtgtgacccactgtgc

SEQ ID NO: 257457 - DNA, 16 bp, P. troglodytes
gtgtgacctcaggcag

SEQ ID NO: 257458 - DNA, 16 bp, P. troglodytes
gtgtgaccttgagcag

SEQ ID NO: 257459 - DNA, 16 bp, P. troglodytes
gtgtgaccttggagaa

SEQ ID NO: 257460 - DNA, 16 bp, P. troglodytes
gtgtgactgtgtgtgc

SEQ ID NO: 257461 - DNA, 16 bp, P. troglodytes
gtgtgagaataaacta

SEQ ID NO: 257462 - DNA, 16 bp, P. troglodytes
gtgtgagagtgtgtgt

SEQ ID NO: 257463 - DNA, 16 bp, P. troglodytes
gtgtgagatgttcccc

SEQ ID NO: 257464 - DNA, 16 bp, P. troglodytes
gtgtgagccactatgc

SEQ ID NO: 257465 - DNA, 16 bp, P. troglodytes
gtgtgagccactgagt

SEQ ID NO: 257466 - DNA, 16 bp, P. troglodytes
gtgtgagccaggatgg

SEQ ID NO: 257467 - DNA, 16 bp, P. troglodytes
gtgtgagccatcgtgt

SEQ ID NO: 257468 - DNA, 16 bp, P. troglodytes
gtgtgagccctctgtc

SEQ ID NO: 257469 - DNA, 16 bp, P. troglodytes
gtgtgagctaccacac

SEQ ID NO: 257470 - DNA, 16 bp, P. troglodytes
gtgtgagctgccatgc

SEQ ID NO: 257471 - DNA, 16 bp, P. troglodytes
gtgtgaggcaccgcac

SEQ ID NO: 257472 - DNA, 16 bp, P. troglodytes
gtgtgagtgcatgtga

SEQ ID NO: 257473 - DNA, 16 bp, P. troglodytes
gtgtgatgatcccctt

SEQ ID NO: 257474 - DNA, 16 bp, P. troglodytes
gtgtgatggtatctgt

SEQ ID NO: 257475 - DNA, 16 bp, P. troglodytes
gtgtgatggtgcgatc

SEQ ID NO: 257476 - DNA, 16 bp, P. troglodytes
gtgtgatggtgggtgc

SEQ ID NO: 257477 - DNA, 16 bp, P. troglodytes
gtgtgatgttagctgt

SEQ ID NO: 257478 - DNA, 26 bp, P. troglodytes
gtgtgatgttccccttcctgtgtcca

SEQ ID NO: 257479 - DNA, 16 bp, P. troglodytes
gtgtgatgtttacata

SEQ ID NO: 257480 - DNA, 16 bp, P. troglodytes
gtgtgcacacacacac

SEQ ID NO: 257481 - DNA, 16 bp, P. troglodytes
gtgtgcacacatgtgc

SEQ ID NO: 257482 - DNA, 16 bp, P. troglodytes
gtgtgcacatatgcat

SEQ ID NO: 257483 - DNA, 16 bp, P. troglodytes
gtgtgcacatgtgtgt

SEQ ID NO: 257484 - DNA, 16 bp, P. troglodytes
gtgtgcaccaccatgc

SEQ ID NO: 257485 - DNA, 16 bp, P. troglodytes
gtgtgcacgcatgcac

SEQ ID NO: 257486 - DNA, 16 bp, P. troglodytes
gtgtgcacgtgtgcgt

SEQ ID NO: 257487 - DNA, 16 bp, P. troglodytes
gtgtgcactaccacac

SEQ ID NO: 257488 - DNA, 16 bp, P. troglodytes
gtgtgcactgtaccca

SEQ ID NO: 257489 - DNA, 16 bp, P. troglodytes
gtgtgcagcttaggga

SEQ ID NO: 257490 - DNA, 16 bp, P. troglodytes
gtgtgcatgcgtgtgc

SEQ ID NO: 257491 - DNA, 16 bp, P. troglodytes
gtgtgcatggtgtgtg

SEQ ID NO: 257492 - DNA, 16 bp, P. troglodytes
gtgtgcatgtgcacgc

SEQ ID NO: 257493 - DNA, 16 bp, P. troglodytes
gtgtgcatgtgcgtgc

SEQ ID NO: 257494 - DNA, 16 bp, P. troglodytes
gtgtgcatgtgggtgt

SEQ ID NO: 257495 - DNA, 16 bp, P. troglodytes
gtgtgccaagcactgt

SEQ ID NO: 257496 - DNA, 16 bp, P. troglodytes
gtgtgccaccatacct

SEQ ID NO: 257497 - DNA, 16 bp, P. troglodytes
gtgtgccaccatgcct

SEQ ID NO: 257498 - DNA, 16 bp, P. troglodytes
gtgtgcccatgtgtgc

SEQ ID NO: 257499 - DNA, 16 bp, P. troglodytes
gtgtgccccaccatgc

SEQ ID NO: 257500 - DNA, 16 bp, P. troglodytes
gtgtgcccgtgtgtgt

SEQ ID NO: 257501 - DNA, 16 bp, P. troglodytes
gtgtgcctctgtgtgt

SEQ ID NO: 257502 - DNA, 16 bp, P. troglodytes
gtgtgcctggctgtgt

SEQ ID NO: 257503 - DNA, 17 bp, P. troglodytes
gtgtgcctgtggtccca

SEQ ID NO: 257504 - DNA, 16 bp, P. troglodytes
gtgtgcctgtgtgtgc

SEQ ID NO: 257505 - DNA, 16 bp, P. troglodytes
gtgtgcgcgcgcgcgc

SEQ ID NO: 257506 - DNA, 16 bp, P. troglodytes
gtgtgcgtctgtgtgt

SEQ ID NO: 257507 - DNA, 16 bp, P. troglodytes
gtgtgcgtgcgtgcac

SEQ ID NO: 257508 - DNA, 16 bp, P. troglodytes
gtgtgcgtgtgcgtgt

SEQ ID NO: 257509 - DNA, 16 bp, P. troglodytes
gtgtgcgtgtgtgcac

SEQ ID NO: 257510 - DNA, 16 bp, P. troglodytes
gtgtgcgtgtgtgcgc

SEQ ID NO: 257511 - DNA, 16 bp, P. troglodytes
gtgtgctgcaggggca

SEQ ID NO: 257512 - DNA, 16 bp, P. troglodytes
gtgtggaaattcctca

SEQ ID NO: 257513 - DNA, 16 bp, P. troglodytes
gtgtggaatatctttt

SEQ ID NO: 257514 - DNA, 16 bp, P. troglodytes
gtgtggaggggctggc

SEQ ID NO: 257515 - DNA, 16 bp, P. troglodytes
gtgtggatgattttag

SEQ ID NO: 257516 - DNA, 16 bp, P. troglodytes
gtgtggatgtatgtgt

SEQ ID NO: 257517 - DNA, 16 bp, P. troglodytes
gtgtggatgtatgttt

SEQ ID NO: 257518 - DNA, 16 bp, P. troglodytes
gtgtggatgtggtgaa

SEQ ID NO: 257519 - DNA, 16 bp, P. troglodytes
gtgtggcacctcccac

SEQ ID NO: 257520 - DNA, 16 bp, P. troglodytes
gtgtggcacctcccct

SEQ ID NO: 257521 - DNA, 16 bp, P. troglodytes
gtgtggccagagtggg

SEQ ID NO: 257522 - DNA, 16 bp, P. troglodytes
gtgtggccattttcac

SEQ ID NO: 257523 - DNA, 16 bp, P. troglodytes
gtgtggcctttgggaa

SEQ ID NO: 257524 - DNA, 16 bp, P. troglodytes
gtgtggctattcctca

SEQ ID NO: 257525 - DNA, 16 bp, P. troglodytes
gtgtggctggggaggc

SEQ ID NO: 257526 - DNA, 16 bp, P. troglodytes
gtgtggcttataaaca

SEQ ID NO: 257527 - DNA, 16 bp, P. troglodytes
gtgtgggcatgtgtgt

SEQ ID NO: 257528 - DNA, 16 bp, P. troglodytes
gtgtgggccaggctgg

SEQ ID NO: 257529 - DNA, 16 bp, P. troglodytes
gtgtggggaaaagaaa

SEQ ID NO: 257530 - DNA, 16 bp, P. troglodytes
gtgtggggacacagag

SEQ ID NO: 257531 - DNA, 16 bp, P. troglodytes
gtgtgggggtgcacac

SEQ ID NO: 257532 - DNA, 16 bp, P. troglodytes
gtgtgggtgggcctca

SEQ ID NO: 257533 - DNA, 16 bp, P. troglodytes
gtgtggtccctttaaa

SEQ ID NO: 257534 - DNA, 16 bp, P. troglodytes
gtgtggtgagaacatt

SEQ ID NO: 257535 - DNA, 16 bp, P. troglodytes
gtgtggtgctgtgcac

SEQ ID NO: 257536 - DNA, 16 bp, P. troglodytes
gtgtggtggcacgcac

SEQ ID NO: 257537 - DNA, 16 bp, P. troglodytes
gtgtggtggcaggcac

SEQ ID NO: 257538 - DNA, 16 bp, P. troglodytes
gtgtggtggcaggccc

SEQ ID NO: 257539 - DNA, 16 bp, P. troglodytes
gtgtggtggcgtgcac

SEQ ID NO: 257540 - DNA, 16 bp, P. troglodytes
gtgtggtggtgcaggc

SEQ ID NO: 257541 - DNA, 16 bp, P. troglodytes
gtgtggttgctcatgc

SEQ ID NO: 257542 - DNA, 16 bp, P. troglodytes
gtgtgtacatatatat

SEQ ID NO: 257543 - DNA, 16 bp, P. troglodytes
gtgtgtacatatgtaa

SEQ ID NO: 257544 - DNA, 16 bp, P. troglodytes
gtgtgtagcacctccc

SEQ ID NO: 257545 - DNA, 16 bp, P. troglodytes
gtgtgtatacacacac

SEQ ID NO: 257546 - DNA, 16 bp, P. troglodytes
gtgtgtatatataaaa

SEQ ID NO: 257547 - DNA, 16 bp, P. troglodytes
gtgtgtatatataatg

SEQ ID NO: 257548 - DNA, 16 bp, P. troglodytes
gtgtgtatatatatac

SEQ ID NO: 257549 - DNA, 16 bp, P. troglodytes
gtgtgtatatatatga

SEQ ID NO: 257550 - DNA, 16 bp, P. troglodytes
gtgtgtatatatgttt

SEQ ID NO: 257551 - DNA, 16 bp, P. troglodytes
gtgtgtatctatctat

SEQ ID NO: 257552 - DNA, 17 bp, P. troglodytes
gtgtgtatgtatgtata

SEQ ID NO: 257553 - DNA, 16 bp, P. troglodytes
gtgtgtatgtatgtga

SEQ ID NO: 257554 - DNA, 16 bp, P. troglodytes
gtgtgtatgtctgtgt

SEQ ID NO: 257555 - DNA, 16 bp, P. troglodytes
gtgtgtatgtgagaga

SEQ ID NO: 257556 - DNA, 16 bp, P. troglodytes
gtgtgtatgtgcacgt

SEQ ID NO: 257557 - DNA, 16 bp, P. troglodytes
gtgtgtatgtgtacat

SEQ ID NO: 257558 - DNA, 16 bp, P. troglodytes
gtgtgtatgtgtggag

SEQ ID NO: 257559 - DNA, 16 bp, P. troglodytes
gtgtgtatgtgtgtac

SEQ ID NO: 257560 - DNA, 17 bp, P. troglodytes
gtgtgtatgtgtgtata

SEQ ID NO: 257561 - DNA, 16 bp, P. troglodytes
gtgtgtatgtgtgtgc

SEQ ID NO: 257562 - DNA, 16 bp, P. troglodytes
gtgtgtcctctcctct

SEQ ID NO: 257563 - DNA, 16 bp, P. troglodytes
gtgtgtctctgcctgt

SEQ ID NO: 257564 - DNA, 16 bp, P. troglodytes
gtgtgtctgccaggct

SEQ ID NO: 257565 - DNA, 16 bp, P. troglodytes
gtgtgtctgtgtgttc

SEQ ID NO: 257566 - DNA, 16 bp, P. troglodytes
gtgtgtctttatagat

SEQ ID NO: 257567 - DNA, 16 bp, P. troglodytes
gtgtgtgagaaagaga

SEQ ID NO: 257568 - DNA, 16 bp, P. troglodytes
gtgtgtgagagagagg

SEQ ID NO: 257569 - DNA, 16 bp, P. troglodytes
gtgtgtgagagtgtgt

SEQ ID NO: 257570 - DNA, 16 bp, P. troglodytes
gtgtgtgagtgtgtat

SEQ ID NO: 257571 - DNA, 16 bp, P. troglodytes
gtgtgtgagtgtgtgc

SEQ ID NO: 257572 - DNA, 16 bp, P. troglodytes
gtgtgtgcacacgtgt

SEQ ID NO: 257573 - DNA, 16 bp, P. troglodytes
gtgtgtgcacatgcac

SEQ ID NO: 257574 - DNA, 16 bp, P. troglodytes
gtgtgtgcacgcacac

SEQ ID NO: 257575 - DNA, 16 bp, P. troglodytes
gtgtgtgcacgcgcgt

SEQ ID NO: 257576 - DNA, 16 bp, P. troglodytes
gtgtgtgcagtgtgtg

SEQ ID NO: 257577 - DNA, 16 bp, P. troglodytes
gtgtgtgcatacacac

SEQ ID NO: 257578 - DNA, 16 bp, P. troglodytes
gtgtgtgcatatttgt

SEQ ID NO: 257579 - DNA, 16 bp, P. troglodytes
gtgtgtgcatctgtgc

SEQ ID NO: 257580 - DNA, 16 bp, P. troglodytes
gtgtgtgcatgtatat

SEQ ID NO: 257581 - DNA, 16 bp, P. troglodytes
gtgtgtgcatgtgcac

SEQ ID NO: 257582 - DNA, 16 bp, P. troglodytes
gtgtgtgcctgtgtgc

SEQ ID NO: 257583 - DNA, 16 bp, P. troglodytes
gtgtgtgcgcacatgc

SEQ ID NO: 257584 - DNA, 17 bp, P. troglodytes
gtgtgtgcgcgcgcgcg

SEQ ID NO: 257585 - DNA, 16 bp, P. troglodytes
gtgtgtgcgcgcgtgt

SEQ ID NO: 257586 - DNA, 16 bp, P. troglodytes
gtgtgtgcgtgcacgt

SEQ ID NO: 257587 - DNA, 16 bp, P. troglodytes
gtgtgtgcttgtgtgc

SEQ ID NO: 257588 - DNA, 16 bp, P. troglodytes
gtgtgtggagacaggg

SEQ ID NO: 257589 - DNA, 16 bp, P. troglodytes
gtgtgtggctcatgcc

SEQ ID NO: 257590 - DNA, 16 bp, P. troglodytes
gtgtgtgtacacatac

SEQ ID NO: 257591 - DNA, 16 bp, P. troglodytes
gtgtgtgtagtatgtg

SEQ ID NO: 257592 - DNA, 16 bp, P. troglodytes
gtgtgtgtatacacat

SEQ ID NO: 257593 - DNA, 16 bp, P. troglodytes
gtgtgtgtatgtatat

SEQ ID NO: 257594 - DNA, 16 bp, P. troglodytes
gtgtgtgtatgtcttt

SEQ ID NO: 257595 - DNA, 16 bp, P. troglodytes
gtgtgtgtatgtgagg

SEQ ID NO: 257596 - DNA, 16 bp, P. troglodytes
gtgtgtgtatgtgtgc

SEQ ID NO: 257597 - DNA, 16 bp, P. troglodytes
gtgtgtgtatgttcat

SEQ ID NO: 257598 - DNA, 16 bp, P. troglodytes
gtgtgtgtctgtgtct

SEQ ID NO: 257599 - DNA, 16 bp, P. troglodytes
gtgtgtgtgagcatgc

SEQ ID NO: 257600 - DNA, 16 bp, P. troglodytes
gtgtgtgtgagcgtgt

SEQ ID NO: 257601 - DNA, 16 bp, P. troglodytes
gtgtgtgtgagtgaga

SEQ ID NO: 257602 - DNA, 16 bp, P. troglodytes
gtgtgtgtgcacatgc

SEQ ID NO: 257603 - DNA, 16 bp, P. troglodytes
gtgtgtgtgcacgcat

SEQ ID NO: 257604 - DNA, 16 bp, P. troglodytes
gtgtgtgtgcatgcgc

SEQ ID NO: 257605 - DNA, 16 bp, P. troglodytes
gtgtgtgtgcgcgcat

SEQ ID NO: 257606 - DNA, 16 bp, P. troglodytes
gtgtgtgtgcgtgtgc

SEQ ID NO: 257607 - DNA, 16 bp, P. troglodytes
gtgtgtgtggtgagaa

SEQ ID NO: 257608 - DNA, 16 bp, P. troglodytes
gtgtgtgtgtaacaga

SEQ ID NO: 257609 - DNA, 16 bp, P. troglodytes
gtgtgtgtgtaagtga

SEQ ID NO: 257610 - DNA, 16 bp, P. troglodytes
gtgtgtgtgtaatatt

SEQ ID NO: 257611 - DNA, 16 bp, P. troglodytes
gtgtgtgtgtaatggg

SEQ ID NO: 257612 - DNA, 16 bp, P. troglodytes
gtgtgtgtgtacactt

SEQ ID NO: 257613 - DNA, 16 bp, P. troglodytes
gtgtgtgtgtacatat

SEQ ID NO: 257614 - DNA, 16 bp, P. troglodytes
gtgtgtgtgtacgtgc

SEQ ID NO: 257615 - DNA, 16 bp, P. troglodytes
gtgtgtgtgtatacaa

SEQ ID NO: 257616 - DNA, 16 bp, P. troglodytes
gtgtgtgtgtatcatt

SEQ ID NO: 257617 - DNA, 16 bp, P. troglodytes
gtgtgtgtgtatcttc

SEQ ID NO: 257618 - DNA, 16 bp, P. troglodytes
gtgtgtgtgtatgaat

SEQ ID NO: 257619 - DNA, 16 bp, P. troglodytes
gtgtgtgtgtccacat

SEQ ID NO: 257620 - DNA, 16 bp, P. troglodytes
gtgtgtgtgtctgtgc

SEQ ID NO: 257621 - DNA, 16 bp, P. troglodytes
gtgtgtgtgtctttag

SEQ ID NO: 257622 - DNA, 16 bp, P. troglodytes
gtgtgtgtgtctttca

SEQ ID NO: 257623 - DNA, 16 bp, P. troglodytes
gtgtgtgtgtgagaaa

SEQ ID NO: 257624 - DNA, 16 bp, P. troglodytes
gtgtgtgtgtgatgag

SEQ ID NO: 257625 - DNA, 16 bp, P. troglodytes
gtgtgtgtgtgcacat

SEQ ID NO: 257626 - DNA, 16 bp, P. troglodytes
gtgtgtgtgtgcaggc

SEQ ID NO: 257627 - DNA, 16 bp, P. troglodytes
gtgtgtgtgtgcaggg

SEQ ID NO: 257628 - DNA, 16 bp, P. troglodytes
gtgtgtgtgtgcatgc

SEQ ID NO: 257629 - DNA, 16 bp, P. troglodytes
gtgtgtgtgtggcttc

SEQ ID NO: 257630 - DNA, 16 bp, P. troglodytes
gtgtgtgtgtggtgaa

SEQ ID NO: 257631 - DNA, 16 bp, P. troglodytes
gtgtgtgtgtgtaaag

SEQ ID NO: 257632 - DNA, 16 bp, P. troglodytes
gtgtgtgtgtgtaaga

SEQ ID NO: 257633 - DNA, 16 bp, P. troglodytes
gtgtgtgtgtgtaatc

SEQ ID NO: 257634 - DNA, 16 bp, P. troglodytes
gtgtgtgtgtgtagag

SEQ ID NO: 257635 - DNA, 16 bp, P. troglodytes
gtgtgtgtgtgtagta

SEQ ID NO: 257636 - DNA, 16 bp, P. troglodytes
gtgtgtgtgtgtatta

SEQ ID NO: 257637 - DNA, 16 bp, P. troglodytes
gtgtgtgtgtgtccat

SEQ ID NO: 257638 - DNA, 16 bp, P. troglodytes
gtgtgtgtgtgtccct

SEQ ID NO: 257639 - DNA, 16 bp, P. troglodytes
gtgtgtgtgtgtcctc

SEQ ID NO: 257640 - DNA, 16 bp, P. troglodytes
gtgtgtgtgtgtctat

SEQ ID NO: 257641 - DNA, 16 bp, P. troglodytes
gtgtgtgtgtgtgaac

SEQ ID NO: 257642 - DNA, 16 bp, P. troglodytes
gtgtgtgtgtgtgaat

SEQ ID NO: 257643 - DNA, 16 bp, P. troglodytes
gtgtgtgtgtgtgcgc

SEQ ID NO: 257644 - DNA, 22 bp, P. troglodytes
gtgtgtgtgtgtgcgcgcgcgc

SEQ ID NO: 257645 - DNA, 16 bp, P. troglodytes
gtgtgtgtgtgtttca

SEQ ID NO: 257646 - DNA, 16 bp, P. troglodytes
gtgtgtgtgtttaata

SEQ ID NO: 257647 - DNA, 16 bp, P. troglodytes
gtgtgtgtgtttacac

SEQ ID NO: 257648 - DNA, 16 bp, P. troglodytes
gtgtgtgtgtttagag

SEQ ID NO: 257649 - DNA, 16 bp, P. troglodytes
gtgtgtgtgtttattc

SEQ ID NO: 257650 - DNA, 16 bp, P. troglodytes
gtgtgtgtgtttggaa

SEQ ID NO: 257651 - DNA, 16 bp, P. troglodytes
gtgtgtgtgttttccc

SEQ ID NO: 257652 - DNA, 16 bp, P. troglodytes
gtgtgtgtgttttgac

SEQ ID NO: 257653 - DNA, 16 bp, P. troglodytes
gtgtgtgttcttcccc

SEQ ID NO: 257654 - DNA, 16 bp, P. troglodytes
gtgtgtgttgtgtata

SEQ ID NO: 257655 - DNA, 16 bp, P. troglodytes
gtgtgtgttgtgtgca

SEQ ID NO: 257656 - DNA, 16 bp, P. troglodytes
gtgtgtgtttgcatat

SEQ ID NO: 257657 - DNA, 16 bp, P. troglodytes
gtgtgttaggccattc

SEQ ID NO: 257658 - DNA, 16 bp, P. troglodytes
gtgtgttgcttaattt

SEQ ID NO: 257659 - DNA, 16 bp, P. troglodytes
gtgtgttgggattaca

SEQ ID NO: 257660 - DNA, 16 bp, P. troglodytes
gtgtgtttgagaaaca

SEQ ID NO: 257661 - DNA, 16 bp, P. troglodytes
gtgtgtttgagatgga

SEQ ID NO: 257662 - DNA, 16 bp, P. troglodytes
gtgtgtttgtgaatgt

SEQ ID NO: 257663 - DNA, 16 bp, P. troglodytes
gtgttaattgaatgca

SEQ ID NO: 257664 - DNA, 17 bp, P. troglodytes
gtgttacagctcataaa

SEQ ID NO: 257665 - DNA, 16 bp, P. troglodytes
gtgttagataattttg

SEQ ID NO: 257666 - DNA, 16 bp, P. troglodytes
gtgttatttgaaagtg

SEQ ID NO: 257667 - DNA, 16 bp, P. troglodytes
gtgttcaagaggaagc

SEQ ID NO: 257668 - DNA, 16 bp, P. troglodytes
gtgttcaataaatgct

SEQ ID NO: 257669 - DNA, 16 bp, P. troglodytes
gtgttcaataaatgtt

SEQ ID NO: 257670 - DNA, 16 bp, P. troglodytes
gtgttcacagtgactt

SEQ ID NO: 257671 - DNA, 16 bp, P. troglodytes
gtgttcagtaaatatt

SEQ ID NO: 257672 - DNA, 16 bp, P. troglodytes
gtgttcatttatttat

SEQ ID NO: 257673 - DNA, 16 bp, P. troglodytes
gtgttccaggcaccac

SEQ ID NO: 257674 - DNA, 16 bp, P. troglodytes
gtgttcctgcccaaat

SEQ ID NO: 257675 - DNA, 16 bp, P. troglodytes
gtgttcctgtttctcc

SEQ ID NO: 257676 - DNA, 16 bp, P. troglodytes
gtgttctcattgttca

SEQ ID NO: 257677 - DNA, 16 bp, P. troglodytes
gtgttctccctgtgtg

SEQ ID NO: 257678 - DNA, 16 bp, P. troglodytes
gtgttctctgatggta

SEQ ID NO: 257679 - DNA, 16 bp, P. troglodytes
gtgttctcttcaattt

SEQ ID NO: 257680 - DNA, 16 bp, P. troglodytes
gtgttgccatggcaat

SEQ ID NO: 257681 - DNA, 16 bp, P. troglodytes
gtgttgcccaagctgg

SEQ ID NO: 257682 - DNA, 17 bp, P. troglodytes
gtgttgcccaggctgga

SEQ ID NO: 257683 - DNA, 16 bp, P. troglodytes
gtgttggaaacttaat

SEQ ID NO: 257684 - DNA, 16 bp, P. troglodytes
gtgttgggaaaactgc

SEQ ID NO: 257685 - DNA, 16 bp, P. troglodytes
gtgttgggggagggac

SEQ ID NO: 257686 - DNA, 16 bp, P. troglodytes
gtgttgtgatcatagc

SEQ ID NO: 257687 - DNA, 16 bp, P. troglodytes
gtgttgttcaagggtc

SEQ ID NO: 257688 - DNA, 16 bp, P. troglodytes
gtgtttactgaaattg

SEQ ID NO: 257689 - DNA, 16 bp, P. troglodytes
gtgtttatggtattct

SEQ ID NO: 257690 - DNA, 16 bp, P. troglodytes
gtgtttatgtaaaatt

SEQ ID NO: 257691 - DNA, 16 bp, P. troglodytes
gtgtttatttgccatc

SEQ ID NO: 257692 - DNA, 16 bp, P. troglodytes
gtgtttcaccaggaga

SEQ ID NO: 257693 - DNA, 16 bp, P. troglodytes
gtgtttctatttctct

SEQ ID NO: 257694 - DNA, 16 bp, P. troglodytes
gtgtttctcaggctgg

SEQ ID NO: 257695 - DNA, 16 bp, P. troglodytes
gtgtttctctggagaa

SEQ ID NO: 257696 - DNA, 16 bp, P. troglodytes
gtgtttcttaaacttt

SEQ ID NO: 257697 - DNA, 16 bp, P. troglodytes
gtgtttgagacagagt

SEQ ID NO: 257698 - DNA, 16 bp, P. troglodytes
gtgtttgcaccactgc

SEQ ID NO: 257699 - DNA, 16 bp, P. troglodytes
gtgtttgctgaatgaa

SEQ ID NO: 257700 - DNA, 16 bp, P. troglodytes
gtgtttggcttatttt

SEQ ID NO: 257701 - DNA, 16 bp, P. troglodytes
gtgtttgtgcatgtgt

SEQ ID NO: 257702 - DNA, 16 bp, P. troglodytes
gtgtttgtgccactgc

SEQ ID NO: 257703 - DNA, 16 bp, P. troglodytes
gtgttttatagttctc

SEQ ID NO: 257704 - DNA, 16 bp, P. troglodytes
gtgttttcttttgaaa

SEQ ID NO: 257705 - DNA, 16 bp, P. troglodytes
gtgtttttaaaataaa

SEQ ID NO: 257706 - DNA, 16 bp, P. troglodytes
gtgtttttaacatgaa

SEQ ID NO: 257707 - DNA, 16 bp, P. troglodytes
gtgtttttcaactcca

SEQ ID NO: 257708 - DNA, 17 bp, P. troglodytes
gtgtttttccttgacac

SEQ ID NO: 257709 - DNA, 16 bp, P. troglodytes
gtgtttttggatgaga

SEQ ID NO: 257710 - DNA, 16 bp, P. troglodytes
gttaaaaaaaattgtg

SEQ ID NO: 257711 - DNA, 16 bp, P. troglodytes
gttaaaaactctaaat

SEQ ID NO: 257712 - DNA, 16 bp, P. troglodytes
gttaaaagacaaaact

SEQ ID NO: 257713 - DNA, 16 bp, P. troglodytes
gttaaaagcacagact

SEQ ID NO: 257714 - DNA, 16 bp, P. troglodytes
gttaaaagggaaattc

SEQ ID NO: 257715 - DNA, 16 bp, P. troglodytes
gttaaaagtaaaagga

SEQ ID NO: 257716 - DNA, 16 bp, P. troglodytes
gttaaaatgaagattc

SEQ ID NO: 257717 - DNA, 16 bp, P. troglodytes
gttaaaatgacaaatt

SEQ ID NO: 257718 - DNA, 16 bp, P. troglodytes
gttaaaatggcttaca

SEQ ID NO: 257719 - DNA, 16 bp, P. troglodytes
gttaaaattgtaaatt

SEQ ID NO: 257720 - DNA, 16 bp, P. troglodytes
gttaaacatttaccag

SEQ ID NO: 257721 - DNA, 16 bp, P. troglodytes
gttaaactctgttaaa

SEQ ID NO: 257722 - DNA, 16 bp, P. troglodytes
gttaaacttttctttt

SEQ ID NO: 257723 - DNA, 16 bp, P. troglodytes
gttaaataaaatatgt

SEQ ID NO: 257724 - DNA, 16 bp, P. troglodytes
gttaaataaattatga

SEQ ID NO: 257725 - DNA, 16 bp, P. troglodytes
gttaaataggttttct

SEQ ID NO: 257726 - DNA, 16 bp, P. troglodytes
gttaaatgaatgaatg

SEQ ID NO: 257727 - DNA, 16 bp, P. troglodytes
gttaaccaggctggag

SEQ ID NO: 257728 - DNA, 17 bp, P. troglodytes
gttaactctacttactg

SEQ ID NO: 257729 - DNA, 16 bp, P. troglodytes
gttaagaaccactgat

SEQ ID NO: 257730 - DNA, 16 bp, P. troglodytes
gttaagaaccattgct

SEQ ID NO: 257731 - DNA, 16 bp, P. troglodytes
gttaagatgataaatt

SEQ ID NO: 257732 - DNA, 16 bp, P. troglodytes
gttaagcaacttgccc

SEQ ID NO: 257733 - DNA, 16 bp, P. troglodytes
gttaaggatcttgaga

SEQ ID NO: 257734 - DNA, 16 bp, P. troglodytes
gttaaggattttagca

SEQ ID NO: 257735 - DNA, 16 bp, P. troglodytes
gttaaggcttcaacat

SEQ ID NO: 257736 - DNA, 16 bp, P. troglodytes
gttaagggaacaaatt

SEQ ID NO: 257737 - DNA, 16 bp, P. troglodytes
gttaagtgaaaaaagc

SEQ ID NO: 257738 - DNA, 16 bp, P. troglodytes
gttaagtgacttgtcc

SEQ ID NO: 257739 - DNA, 16 bp, P. troglodytes
gttaatatacaaaatt

SEQ ID NO: 257740 - DNA, 16 bp, P. troglodytes
gttaatattgatatat

SEQ ID NO: 257741 - DNA, 16 bp, P. troglodytes
gttaatgcagctggtg

SEQ ID NO: 257742 - DNA, 16 bp, P. troglodytes
gttaatggctgctgac

SEQ ID NO: 257743 - DNA, 16 bp, P. troglodytes
gttaattactgcctca

SEQ ID NO: 257744 - DNA, 16 bp, P. troglodytes
gttaattgactgttta

SEQ ID NO: 257745 - DNA, 16 bp, P. troglodytes
gttaattttgccaagg

SEQ ID NO: 257746 - DNA, 16 bp, P. troglodytes
gttacaaaagactgtg

SEQ ID NO: 257747 - DNA, 16 bp, P. troglodytes
gttacacagttccaaa

SEQ ID NO: 257748 - DNA, 16 bp, P. troglodytes
gttacagaaaaaaata

SEQ ID NO: 257749 - DNA, 16 bp, P. troglodytes
gttacagcagcaggaa

SEQ ID NO: 257750 - DNA, 16 bp, P. troglodytes
gttacagctcttaagg

SEQ ID NO: 257751 - DNA, 19 bp, P. troglodytes
gttacagctcttaaggtgg

SEQ ID NO: 257752 - DNA, 16 bp, P. troglodytes
gttacaggaaaaaaaa

SEQ ID NO: 257753 - DNA, 16 bp, P. troglodytes
gttacagggctttgac

SEQ ID NO: 257754 - DNA, 16 bp, P. troglodytes
gttacagtttattaca

SEQ ID NO: 257755 - DNA, 16 bp, P. troglodytes
gttacatatacacaat

SEQ ID NO: 257756 - DNA, 16 bp, P. troglodytes
gttacatatttttaaa

SEQ ID NO: 257757 - DNA, 16 bp, P. troglodytes
gttacatcctgataaa

SEQ ID NO: 257758 - DNA, 16 bp, P. troglodytes
gttacatgaataattt

SEQ ID NO: 257759 - DNA, 16 bp, P. troglodytes
gttacattatatggca

SEQ ID NO: 257760 - DNA, 16 bp, P. troglodytes
gttacccaggccagag

SEQ ID NO: 257761 - DNA, 16 bp, P. troglodytes
gttactgaatatttta

SEQ ID NO: 257762 - DNA, 16 bp, P. troglodytes
gttacttaatttccat

SEQ ID NO: 257763 - DNA, 16 bp, P. troglodytes
gttacttagcttctct

SEQ ID NO: 257764 - DNA, 16 bp, P. troglodytes
gttacttgcagctgaa

SEQ ID NO: 257765 - DNA, 16 bp, P. troglodytes
gttacttgtagccaaa

SEQ ID NO: 257766 - DNA, 16 bp, P. troglodytes
gttactttttatggct

SEQ ID NO: 257767 - DNA, 16 bp, P. troglodytes
gttagaaatgtaaatt

SEQ ID NO: 257768 - DNA, 16 bp, P. troglodytes
gttagaatgtaaatta

SEQ ID NO: 257769 - DNA, 16 bp, P. troglodytes
gttagacatttaaaag

SEQ ID NO: 257770 - DNA, 16 bp, P. troglodytes
gttagatgaatggcta

SEQ ID NO: 257771 - DNA, 17 bp, P. troglodytes
gttagccaggattgtct

SEQ ID NO: 257772 - DNA, 16 bp, P. troglodytes
gttagccaggtgtggt

SEQ ID NO: 257773 - DNA, 18 bp, P. troglodytes
gttagccgggcatggtgg

SEQ ID NO: 257774 - DNA, 16 bp, P. troglodytes
gttaggaaaactggat

SEQ ID NO: 257775 - DNA, 16 bp, P. troglodytes
gttaggaaacctgctg

SEQ ID NO: 257776 - DNA, 16 bp, P. troglodytes
gttagggtggggcaga

SEQ ID NO: 257777 - DNA, 16 bp, P. troglodytes
gttaggttggtgcaaa

SEQ ID NO: 257778 - DNA, 16 bp, P. troglodytes
gttagtctgttttgca

SEQ ID NO: 257779 - DNA, 16 bp, P. troglodytes
gttataatttctgttc

SEQ ID NO: 257780 - DNA, 16 bp, P. troglodytes
gttatactaatttata

SEQ ID NO: 257781 - DNA, 16 bp, P. troglodytes
gttatagcagcaggaa

SEQ ID NO: 257782 - DNA, 16 bp, P. troglodytes
gttatataagagaatg

SEQ ID NO: 257783 - DNA, 16 bp, P. troglodytes
gttatatatatagtta

SEQ ID NO: 257784 - DNA, 16 bp, P. troglodytes
gttatatgcaaatatt

SEQ ID NO: 257785 - DNA, 16 bp, P. troglodytes
gttatatgtaaatact

SEQ ID NO: 257786 - DNA, 16 bp, P. troglodytes
gttatccccattttac

SEQ ID NO: 257787 - DNA, 16 bp, P. troglodytes
gttatgaccaaaatgc

SEQ ID NO: 257788 - DNA, 16 bp, P. troglodytes
gttatgcaagatgaat

SEQ ID NO: 257789 - DNA, 16 bp, P. troglodytes
gttatgctgcccaggc

SEQ ID NO: 257790 - DNA, 16 bp, P. troglodytes
gttatgtgtattttgc

SEQ ID NO: 257791 - DNA, 16 bp, P. troglodytes
gttatgttccattggt

SEQ ID NO: 257792 - DNA, 16 bp, P. troglodytes
gttattaagctaatca

SEQ ID NO: 257793 - DNA, 16 bp, P. troglodytes
gttattacacaccaaa

SEQ ID NO: 257794 - DNA, 16 bp, P. troglodytes
gttattagagaaatgc

SEQ ID NO: 257795 - DNA, 16 bp, P. troglodytes
gttattatctccattt

SEQ ID NO: 257796 - DNA, 16 bp, P. troglodytes
gttattatttctttga

SEQ ID NO: 257797 - DNA, 16 bp, P. troglodytes
gttattcaggaggctg

SEQ ID NO: 257798 - DNA, 16 bp, P. troglodytes
gttattgatgggcatt

SEQ ID NO: 257799 - DNA, 16 bp, P. troglodytes
gttattgattttagat

SEQ ID NO: 257800 - DNA, 16 bp, P. troglodytes
gttattgtaaatggaa

SEQ ID NO: 257801 - DNA, 16 bp, P. troglodytes
gttattgtttttgaga

SEQ ID NO: 257802 - DNA, 16 bp, P. troglodytes
gttatttaatttctct

SEQ ID NO: 257803 - DNA, 16 bp, P. troglodytes
gttatttagaactttc

SEQ ID NO: 257804 - DNA, 16 bp, P. troglodytes
gttatttatatattct

SEQ ID NO: 257805 - DNA, 16 bp, P. troglodytes
gttatttattgtcttc

SEQ ID NO: 257806 - DNA, 16 bp, P. troglodytes
gttatttattttgcca

SEQ ID NO: 257807 - DNA, 16 bp, P. troglodytes
gttatttgaaaccaat

SEQ ID NO: 257808 - DNA, 16 bp, P. troglodytes
gttatttgagtttctt

SEQ ID NO: 257809 - DNA, 16 bp, P. troglodytes
gttattttaagccaca

SEQ ID NO: 257810 - DNA, 16 bp, P. troglodytes
gttatttttcctgatc

SEQ ID NO: 257811 - DNA, 16 bp, P. troglodytes
gttcaaagaggagctg

SEQ ID NO: 257812 - DNA, 16 bp, P. troglodytes
gttcaaagcccagctc

SEQ ID NO: 257813 - DNA, 16 bp, P. troglodytes
gttcaaatcacagctc

SEQ ID NO: 257814 - DNA, 16 bp, P. troglodytes
gttcaaatcccagctc

SEQ ID NO: 257815 - DNA, 16 bp, P. troglodytes
gttcaacacacacaaa

SEQ ID NO: 257816 - DNA, 16 bp, P. troglodytes
gttcaagaaattttcc

SEQ ID NO: 257817 - DNA, 16 bp, P. troglodytes
gttcaagaccaacctt

SEQ ID NO: 257818 - DNA, 16 bp, P. troglodytes
gttcaagaccagtgtg

SEQ ID NO: 257819 - DNA, 16 bp, P. troglodytes
gttcaagatcagcctg

SEQ ID NO: 257820 - DNA, 16 bp, P. troglodytes
gttcaagattagcctg

SEQ ID NO: 257821 - DNA, 16 bp, P. troglodytes
gttcaagcaattctgc

SEQ ID NO: 257822 - DNA, 16 bp, P. troglodytes
gttcaagcagttctgc

SEQ ID NO: 257823 - DNA, 16 bp, P. troglodytes
gttcaagccagtctcc

SEQ ID NO: 257824 - DNA, 16 bp, P. troglodytes
gttcaaggccagccca

SEQ ID NO: 257825 - DNA, 16 bp, P. troglodytes
gttcaagtcattctcc

SEQ ID NO: 257826 - DNA, 16 bp, P. troglodytes
gttcaagtcctgactc

SEQ ID NO: 257827 - DNA, 16 bp, P. troglodytes
gttcaagtcctgcctc

SEQ ID NO: 257828 - DNA, 16 bp, P. troglodytes
gttcaagtcttctgtt

SEQ ID NO: 257829 - DNA, 16 bp, P. troglodytes
gttcaagtgactcttc

SEQ ID NO: 257830 - DNA, 16 bp, P. troglodytes
gttcaataaatattta

SEQ ID NO: 257831 - DNA, 16 bp, P. troglodytes
gttcaataaatgatgc

SEQ ID NO: 257832 - DNA, 16 bp, P. troglodytes
gttcaattgttttaga

SEQ ID NO: 257833 - DNA, 16 bp, P. troglodytes
gttcaatttttaattt

SEQ ID NO: 257834 - DNA, 16 bp, P. troglodytes
gttcacagaactcagg

SEQ ID NO: 257835 - DNA, 16 bp, P. troglodytes
gttcacagcagcattt

SEQ ID NO: 257836 - DNA, 16 bp, P. troglodytes
gttcacagctggagag

SEQ ID NO: 257837 - DNA, 16 bp, P. troglodytes
gttcacagtcccacca

SEQ ID NO: 257838 - DNA, 16 bp, P. troglodytes
gttcacagttctggag

SEQ ID NO: 257839 - DNA, 16 bp, P. troglodytes
gttcacccaccagccc

SEQ ID NO: 257840 - DNA, 16 bp, P. troglodytes
gttcactcattcaaca

SEQ ID NO: 257841 - DNA, 16 bp, P. troglodytes
gttcactcttggtgtt

SEQ ID NO: 257842 - DNA, 16 bp, P. troglodytes
gttcactgcaagctcc

SEQ ID NO: 257843 - DNA, 16 bp, P. troglodytes
gttcactgcagccttg

SEQ ID NO: 257844 - DNA, 16 bp, P. troglodytes
gttcagaaaaggcaaa

SEQ ID NO: 257845 - DNA, 16 bp, P. troglodytes
gttcagagaccagcct

SEQ ID NO: 257846 - DNA, 16 bp, P. troglodytes
gttcagcctcccaagt

SEQ ID NO: 257847 - DNA, 16 bp, P. troglodytes
gttcaggagatggaga

SEQ ID NO: 257848 - DNA, 16 bp, P. troglodytes
gttcaggaggccagaa

SEQ ID NO: 257849 - DNA, 16 bp, P. troglodytes
gttcaggagtttgaaa

SEQ ID NO: 257850 - DNA, 16 bp, P. troglodytes
gttcaggctggtcttg

SEQ ID NO: 257851 - DNA, 16 bp, P. troglodytes
gttcagggattacagg

SEQ ID NO: 257852 - DNA, 16 bp, P. troglodytes
gttcagtatatgcaaa

SEQ ID NO: 257853 - DNA, 16 bp, P. troglodytes
gttcagtattatgttg

SEQ ID NO: 257854 - DNA, 16 bp, P. troglodytes
gttcagtggtaataaa

SEQ ID NO: 257855 - DNA, 16 bp, P. troglodytes
gttcatagcagcatta

SEQ ID NO: 257856 - DNA, 17 bp, P. troglodytes
gttcatccacaaggact

SEQ ID NO: 257857 - DNA, 16 bp, P. troglodytes
gttcatctcactgagg

SEQ ID NO: 257858 - DNA, 16 bp, P. troglodytes
gttcatgaaaatccac

SEQ ID NO: 257859 - DNA, 16 bp, P. troglodytes
gttcatgaggtttaaa

SEQ ID NO: 257860 - DNA, 16 bp, P. troglodytes
gttcatgtcatagtta

SEQ ID NO: 257861 - DNA, 16 bp, P. troglodytes
gttcattaaaaacaaa

SEQ ID NO: 257862 - DNA, 16 bp, P. troglodytes
gttcattcattatttg

SEQ ID NO: 257863 - DNA, 16 bp, P. troglodytes
gttcattcattccaca

SEQ ID NO: 257864 - DNA, 16 bp, P. troglodytes
gttcattgattgtaac

SEQ ID NO: 257865 - DNA, 16 bp, P. troglodytes
gttcatttattcaaca

SEQ ID NO: 257866 - DNA, 16 bp, P. troglodytes
gttcatttattcattc

SEQ ID NO: 257867 - DNA, 16 bp, P. troglodytes
gttccaaagctgaaga

SEQ ID NO: 257868 - DNA, 16 bp, P. troglodytes
gttccacccaccttgg

SEQ ID NO: 257869 - DNA, 16 bp, P. troglodytes
gttccagaccagccag

SEQ ID NO: 257870 - DNA, 16 bp, P. troglodytes
gttccagcctgggtga

SEQ ID NO: 257871 - DNA, 16 bp, P. troglodytes
gttccagcttcctggc

SEQ ID NO: 257872 - DNA, 16 bp, P. troglodytes
gttccagctttggcca

SEQ ID NO: 257873 - DNA, 16 bp, P. troglodytes
gttccaggacccccag

SEQ ID NO: 257874 - DNA, 16 bp, P. troglodytes
gttccaggcactgtgc

SEQ ID NO: 257875 - DNA, 16 bp, P. troglodytes
gttccatataattttt

SEQ ID NO: 257876 - DNA, 16 bp, P. troglodytes
gttccatcaatacctg

SEQ ID NO: 257877 - DNA, 16 bp, P. troglodytes
gttccatccagaaagg

SEQ ID NO: 257878 - DNA, 16 bp, P. troglodytes
gttccatctactgaga

SEQ ID NO: 257879 - DNA, 16 bp, P. troglodytes
gttccatctgcctgga

SEQ ID NO: 257880 - DNA, 16 bp, P. troglodytes
gttccatgactttgct

SEQ ID NO: 257881 - DNA, 16 bp, P. troglodytes
gttccatgtggctggg

SEQ ID NO: 257882 - DNA, 16 bp, P. troglodytes
gttccattcttctgca

SEQ ID NO: 257883 - DNA, 16 bp, P. troglodytes
gttcccaggctggtct

SEQ ID NO: 257884 - DNA, 16 bp, P. troglodytes
gttcccattcctgtgt

SEQ ID NO: 257885 - DNA, 16 bp, P. troglodytes
gttccccaggctggag

SEQ ID NO: 257886 - DNA, 16 bp, P. troglodytes
gttcccccaggccctg

SEQ ID NO: 257887 - DNA, 20 bp, P. troglodytes
gttccccttcctgtgtccaa

SEQ ID NO: 257888 - DNA, 16 bp, P. troglodytes
gttcccgtaatcccca

SEQ ID NO: 257889 - DNA, 16 bp, P. troglodytes
gttccctcatctgcac

SEQ ID NO: 257890 - DNA, 16 bp, P. troglodytes
gttccctctgcctggg

SEQ ID NO: 257891 - DNA, 16 bp, P. troglodytes
gttccctgcctccaga

SEQ ID NO: 257892 - DNA, 16 bp, P. troglodytes
gttccctttgcctgga

SEQ ID NO: 257893 - DNA, 16 bp, P. troglodytes
gttcctaacaggccac

SEQ ID NO: 257894 - DNA, 16 bp, P. troglodytes
gttcctatagtcccag

SEQ ID NO: 257895 - DNA, 16 bp, P. troglodytes
gttcctgataaaagga

SEQ ID NO: 257896 - DNA, 16 bp, P. troglodytes
gttcctgcaaaaaaca

SEQ ID NO: 257897 - DNA, 16 bp, P. troglodytes
gttcctgcaaaagaca

SEQ ID NO: 257898 - DNA, 16 bp, P. troglodytes
gttcctgcagggaagc

SEQ ID NO: 257899 - DNA, 16 bp, P. troglodytes
gttcctgcctcagggc

SEQ ID NO: 257900 - DNA, 16 bp, P. troglodytes
gttcctgggccaaatg

SEQ ID NO: 257901 - DNA, 16 bp, P. troglodytes
gttcctgggtgtatct

SEQ ID NO: 257902 - DNA, 16 bp, P. troglodytes
gttccttcatctgtaa

SEQ ID NO: 257903 - DNA, 16 bp, P. troglodytes
gttccttccagctctg

SEQ ID NO: 257904 - DNA, 16 bp, P. troglodytes
gttccttcctccactg

SEQ ID NO: 257905 - DNA, 16 bp, P. troglodytes
gttccttctagattct

SEQ ID NO: 257906 - DNA, 16 bp, P. troglodytes
gttccttctcatttgg

SEQ ID NO: 257907 - DNA, 16 bp, P. troglodytes
gttccttctggaggct

SEQ ID NO: 257908 - DNA, 16 bp, P. troglodytes
gttccttgacttgtgg

SEQ ID NO: 257909 - DNA, 16 bp, P. troglodytes
gttccttggagaaatg

SEQ ID NO: 257910 - DNA, 16 bp, P. troglodytes
gttcctttggagaaga

SEQ ID NO: 257911 - DNA, 16 bp, P. troglodytes
gttcgtgatcagcctg

SEQ ID NO: 257912 - DNA, 16 bp, P. troglodytes
gttctaaaagtttttt

SEQ ID NO: 257913 - DNA, 16 bp, P. troglodytes
gttctaaacatggaaa

SEQ ID NO: 257914 - DNA, 16 bp, P. troglodytes
gttctaagtactttac

SEQ ID NO: 257915 - DNA, 16 bp, P. troglodytes
gttctaatttgcattt

SEQ ID NO: 257916 - DNA, 16 bp, P. troglodytes
gttctagaggaacaga

SEQ ID NO: 257917 - DNA, 16 bp, P. troglodytes
gttctatagcactata

SEQ ID NO: 257918 - DNA, 16 bp, P. troglodytes
gttctcaaactcctga

SEQ ID NO: 257919 - DNA, 16 bp, P. troglodytes
gttctcaaggagaatg

SEQ ID NO: 257920 - DNA, 16 bp, P. troglodytes
gttctcacaagacctg

SEQ ID NO: 257921 - DNA, 17 bp, P. troglodytes
gttctcatcatttagct

SEQ ID NO: 257922 - DNA, 16 bp, P. troglodytes
gttctcatgcctcagc

SEQ ID NO: 257923 - DNA, 16 bp, P. troglodytes
gttctccaagtcccca

SEQ ID NO: 257924 - DNA, 16 bp, P. troglodytes
gttctccacctcccca

SEQ ID NO: 257925 - DNA, 16 bp, P. troglodytes
gttctccaggtcccca

SEQ ID NO: 257926 - DNA, 16 bp, P. troglodytes
gttctccatgttggtc

SEQ ID NO: 257927 - DNA, 16 bp, P. troglodytes
gttctcccatttgttt

SEQ ID NO: 257928 - DNA, 16 bp, P. troglodytes
gttctcctgccacagc

SEQ ID NO: 257929 - DNA, 16 bp, P. troglodytes
gttctcctgcctcacc

SEQ ID NO: 257930 - DNA, 17 bp, P. troglodytes
gttctcctgcctcagcc

SEQ ID NO: 257931 - DNA, 19 bp, P. troglodytes
gttctcctgcctcagcctc

SEQ ID NO: 257932 - DNA, 16 bp, P. troglodytes
gttctcgtgcctcagc

SEQ ID NO: 257933 - DNA, 16 bp, P. troglodytes
gttctctcacagttct

SEQ ID NO: 257934 - DNA, 16 bp, P. troglodytes
gttctctgcctccaga

SEQ ID NO: 257935 - DNA, 16 bp, P. troglodytes
gttctctgctcttgaa

SEQ ID NO: 257936 - DNA, 16 bp, P. troglodytes
gttctctggatttcct

SEQ ID NO: 257937 - DNA, 16 bp, P. troglodytes
gttctctggatttctt

SEQ ID NO: 257938 - DNA, 16 bp, P. troglodytes
gttctcttccatagca

SEQ ID NO: 257939 - DNA, 16 bp, P. troglodytes
gttctcttgctggtga

SEQ ID NO: 257940 - DNA, 16 bp, P. troglodytes
gttctctttctctgga

SEQ ID NO: 257941 - DNA, 16 bp, P. troglodytes
gttctgaagtctgctt

SEQ ID NO: 257942 - DNA, 16 bp, P. troglodytes
gttctgaatatccttg

SEQ ID NO: 257943 - DNA, 16 bp, P. troglodytes
gttctgcagcctctgc

SEQ ID NO: 257944 - DNA, 16 bp, P. troglodytes
gttctggaccccactc

SEQ ID NO: 257945 - DNA, 16 bp, P. troglodytes
gttctggaggacagtg

SEQ ID NO: 257946 - DNA, 16 bp, P. troglodytes
gttctggaggccagaa

SEQ ID NO: 257947 - DNA, 16 bp, P. troglodytes
gttctggaggccagag

SEQ ID NO: 257948 - DNA, 16 bp, P. troglodytes
gttctggaggctggag

SEQ ID NO: 257949 - DNA, 16 bp, P. troglodytes
gttctggaggtggatg

SEQ ID NO: 257950 - DNA, 16 bp, P. troglodytes
gttctgggattacagg

SEQ ID NO: 257951 - DNA, 17 bp, P. troglodytes
gttctgtcacccaggct

SEQ ID NO: 257952 - DNA, 16 bp, P. troglodytes
gttctgtcacctaggc

SEQ ID NO: 257953 - DNA, 16 bp, P. troglodytes
gttctgttccattctg

SEQ ID NO: 257954 - DNA, 16 bp, P. troglodytes
gttcttaaagaaaaga

SEQ ID NO: 257955 - DNA, 16 bp, P. troglodytes
gttcttcagtttttgg

SEQ ID NO: 257956 - DNA, 16 bp, P. troglodytes
gttcttccatttgtgt

SEQ ID NO: 257957 - DNA, 16 bp, P. troglodytes
gttcttccttaaatgt

SEQ ID NO: 257958 - DNA, 16 bp, P. troglodytes
gttcttgaactcttgg

SEQ ID NO: 257959 - DNA, 16 bp, P. troglodytes
gttcttggacctcaca

SEQ ID NO: 257960 - DNA, 16 bp, P. troglodytes
gttcttggatctcgcg

SEQ ID NO: 257961 - DNA, 16 bp, P. troglodytes
gttcttgtcaggtttg

SEQ ID NO: 257962 - DNA, 16 bp, P. troglodytes
gttctttaaaatatat

SEQ ID NO: 257963 - DNA, 16 bp, P. troglodytes
gttctttaagatgtat

SEQ ID NO: 257964 - DNA, 16 bp, P. troglodytes
gttctttaaggaattt

SEQ ID NO: 257965 - DNA, 16 bp, P. troglodytes
gttctttatacatttt

SEQ ID NO: 257966 - DNA, 16 bp, P. troglodytes
gttctttgaaagaaaa

SEQ ID NO: 257967 - DNA, 16 bp, P. troglodytes
gttctttgtacatttt

SEQ ID NO: 257968 - DNA, 16 bp, P. troglodytes
gttctttgtagattgt

SEQ ID NO: 257969 - DNA, 16 bp, P. troglodytes
gttctttgtagcttct

SEQ ID NO: 257970 - DNA, 16 bp, P. troglodytes
gttcttttaattctga

SEQ ID NO: 257971 - DNA, 16 bp, P. troglodytes
gttcttttgtcttagg

SEQ ID NO: 257972 - DNA, 16 bp, P. troglodytes
gttgaaaaactaccta

SEQ ID NO: 257973 - DNA, 16 bp, P. troglodytes
gttgaaaaaggaaata

SEQ ID NO: 257974 - DNA, 16 bp, P. troglodytes
gttgaaaatactgtaa

SEQ ID NO: 257975 - DNA, 16 bp, P. troglodytes
gttgaaaatgcattta

SEQ ID NO: 257976 - DNA, 16 bp, P. troglodytes
gttgaaagaaattgaa

SEQ ID NO: 257977 - DNA, 16 bp, P. troglodytes
gttgaaagtaaaagga

SEQ ID NO: 257978 - DNA, 16 bp, P. troglodytes
gttgaaataatttaaa

SEQ ID NO: 257979 - DNA, 16 bp, P. troglodytes
gttgaaccacatgaaa

SEQ ID NO: 257980 - DNA, 16 bp, P. troglodytes
gttgaaccaggcttgc

SEQ ID NO: 257981 - DNA, 16 bp, P. troglodytes
gttgaacccaggaggt

SEQ ID NO: 257982 - DNA, 16 bp, P. troglodytes
gttgaacctgggaggc

SEQ ID NO: 257983 - DNA, 16 bp, P. troglodytes
gttgaactaatgtaca

SEQ ID NO: 257984 - DNA, 16 bp, P. troglodytes
gttgaaggaaagaagc

SEQ ID NO: 257985 - DNA, 16 bp, P. troglodytes
gttgaaggcctgaata

SEQ ID NO: 257986 - DNA, 16 bp, P. troglodytes
gttgaataaaatattt

SEQ ID NO: 257987 - DNA, 16 bp, P. troglodytes
gttgaatctctgaaga

SEQ ID NO: 257988 - DNA, 16 bp, P. troglodytes
gttgaatctgtggatg

SEQ ID NO: 257989 - DNA, 16 bp, P. troglodytes
gttgaatgaatgaaga

SEQ ID NO: 257990 - DNA, 16 bp, P. troglodytes
gttgaatggtaattct

SEQ ID NO: 257991 - DNA, 16 bp, P. troglodytes
gttgaatttcattgaa

SEQ ID NO: 257992 - DNA, 16 bp, P. troglodytes
gttgaattttgtcaga

SEQ ID NO: 257993 - DNA, 16 bp, P. troglodytes
gttgacacttgaacaa

SEQ ID NO: 257994 - DNA, 16 bp, P. troglodytes
gttgagaaccactact

SEQ ID NO: 257995 - DNA, 16 bp, P. troglodytes
gttgagaactactgct

SEQ ID NO: 257996 - DNA, 16 bp, P. troglodytes
gttgagacagggtctc

SEQ ID NO: 257997 - DNA, 16 bp, P. troglodytes
gttgagagaaatgtaa

SEQ ID NO: 257998 - DNA, 16 bp, P. troglodytes
gttgagcatctctaat

SEQ ID NO: 257999 - DNA, 16 bp, P. troglodytes
gttgagcatctttcat

SEQ ID NO: 258000 - DNA, 16 bp, P. troglodytes
gttgagcattttttca

SEQ ID NO: 258001 - DNA, 16 bp, P. troglodytes
gttgagcccaggagtt

SEQ ID NO: 258002 - DNA, 16 bp, P. troglodytes
gttgagctcaggagtt

SEQ ID NO: 258003 - DNA, 16 bp, P. troglodytes
gttgaggaaactgagg

SEQ ID NO: 258004 - DNA, 16 bp, P. troglodytes
gttgaggcaagaggat

SEQ ID NO: 258005 - DNA, 16 bp, P. troglodytes
gttgaggccaggagtt

SEQ ID NO: 258006 - DNA, 16 bp, P. troglodytes
gttgaggctgtagtga

SEQ ID NO: 258007 - DNA, 16 bp, P. troglodytes
gttgaggctgtggtga

SEQ ID NO: 258008 - DNA, 16 bp, P. troglodytes
gttgaggtcaggagtt

SEQ ID NO: 258009 - DNA, 16 bp, P. troglodytes
gttgaggttgcagtga

SEQ ID NO: 258010 - DNA, 16 bp, P. troglodytes
gttgagtgaataaatg

SEQ ID NO: 258011 - DNA, 16 bp, P. troglodytes
gttgatattttaaaaa

SEQ ID NO: 258012 - DNA, 16 bp, P. troglodytes
gttgatctttttaaaa

SEQ ID NO: 258013 - DNA, 16 bp, P. troglodytes
gttgatgttgatgctc

SEQ ID NO: 258014 - DNA, 16 bp, P. troglodytes
gttgattaatgggtac

SEQ ID NO: 258015 - DNA, 16 bp, P. troglodytes
gttgattctcattatt

SEQ ID NO: 258016 - DNA, 16 bp, P. troglodytes
gttgattctttctcat

SEQ ID NO: 258017 - DNA, 16 bp, P. troglodytes
gttgatttcaaccctc

SEQ ID NO: 258018 - DNA, 16 bp, P. troglodytes
gttgatttctgcattt

SEQ ID NO: 258019 - DNA, 16 bp, P. troglodytes
gttgatttttgtatga

SEQ ID NO: 258020 - DNA, 16 bp, P. troglodytes
gttgcaaatatcttct

SEQ ID NO: 258021 - DNA, 16 bp, P. troglodytes
gttgcaagagttcttt

SEQ ID NO: 258022 - DNA, 16 bp, P. troglodytes
gttgcaattacttttg

SEQ ID NO: 258023 - DNA, 16 bp, P. troglodytes
gttgcaattgcttttg

SEQ ID NO: 258024 - DNA, 16 bp, P. troglodytes
gttgcagaaggaatgg

SEQ ID NO: 258025 - DNA, 16 bp, P. troglodytes
gttgcagaggctggaa

SEQ ID NO: 258026 - DNA, 16 bp, P. troglodytes
gttgcaggaagctgag

SEQ ID NO: 258027 - DNA, 18 bp, P. troglodytes
gttgcagggactgctgca

SEQ ID NO: 258028 - DNA, 16 bp, P. troglodytes
gttgcagtgagcaggg

SEQ ID NO: 258029 - DNA, 16 bp, P. troglodytes
gttgcagtgagccaat

SEQ ID NO: 258030 - DNA, 22 bp, P. troglodytes
gttgcagtgagtggagatcgcg

SEQ ID NO: 258031 - DNA, 16 bp, P. troglodytes
gttgccacaaatgaca

SEQ ID NO: 258032 - DNA, 16 bp, P. troglodytes
gttgccactgctggct

SEQ ID NO: 258033 - DNA, 16 bp, P. troglodytes
gttgccaggtaaaata

SEQ ID NO: 258034 - DNA, 16 bp, P. troglodytes
gttgccatggcaatga

SEQ ID NO: 258035 - DNA, 16 bp, P. troglodytes
gttgccatggcaatgg

SEQ ID NO: 258036 - DNA, 16 bp, P. troglodytes
gttgccattgcctttg

SEQ ID NO: 258037 - DNA, 16 bp, P. troglodytes
gttgccattgctttta

SEQ ID NO: 258038 - DNA, 16 bp, P. troglodytes
gttgcccaaggtggag

SEQ ID NO: 258039 - DNA, 16 bp, P. troglodytes
gttgcccagaccagag

SEQ ID NO: 258040 - DNA, 16 bp, P. troglodytes
gttgcccagcttggag

SEQ ID NO: 258041 - DNA, 16 bp, P. troglodytes
gttgcccaggctgccc

SEQ ID NO: 258042 - DNA, 16 bp, P. troglodytes
gttgcccatgcttttg

SEQ ID NO: 258043 - DNA, 16 bp, P. troglodytes
gttgcctggggctggg

SEQ ID NO: 258044 - DNA, 16 bp, P. troglodytes
gttgcctgtgtacttt

SEQ ID NO: 258045 - DNA, 16 bp, P. troglodytes
gttgctctcgaactcc

SEQ ID NO: 258046 - DNA, 16 bp, P. troglodytes
gttgctctggtttgaa

SEQ ID NO: 258047 - DNA, 16 bp, P. troglodytes
gttgctgcaaaagaca

SEQ ID NO: 258048 - DNA, 16 bp, P. troglodytes
gttgctgcagatgaca

SEQ ID NO: 258049 - DNA, 16 bp, P. troglodytes
gttgctgctgttgttg

SEQ ID NO: 258050 - DNA, 16 bp, P. troglodytes
gttgctgtctgtctca

SEQ ID NO: 258051 - DNA, 16 bp, P. troglodytes
gttgctgtgtgtatca

SEQ ID NO: 258052 - DNA, 16 bp, P. troglodytes
gttgctgttattattt

SEQ ID NO: 258053 - DNA, 16 bp, P. troglodytes
gttgcttatgcttttg

SEQ ID NO: 258054 - DNA, 16 bp, P. troglodytes
gttgcttccaaatttt

SEQ ID NO: 258055 - DNA, 16 bp, P. troglodytes
gttgcttccacctttt

SEQ ID NO: 258056 - DNA, 16 bp, P. troglodytes
gttggaaaggaagaaa

SEQ ID NO: 258057 - DNA, 16 bp, P. troglodytes
gttggaaatgtagaaa

SEQ ID NO: 258058 - DNA, 16 bp, P. troglodytes
gttggaacagcttgga

SEQ ID NO: 258059 - DNA, 16 bp, P. troglodytes
gttggaacttctggcc

SEQ ID NO: 258060 - DNA, 16 bp, P. troglodytes
gttggaagaagatgcc

SEQ ID NO: 258061 - DNA, 16 bp, P. troglodytes
gttggaagaattaata

SEQ ID NO: 258062 - DNA, 16 bp, P. troglodytes
gttggaatcaacttct

SEQ ID NO: 258063 - DNA, 16 bp, P. troglodytes
gttggaattacaggag

SEQ ID NO: 258064 - DNA, 16 bp, P. troglodytes
gttggaattatacagt

SEQ ID NO: 258065 - DNA, 16 bp, P. troglodytes
gttggagaacagcctg

SEQ ID NO: 258066 - DNA, 16 bp, P. troglodytes
gttggagaagagagta

SEQ ID NO: 258067 - DNA, 16 bp, P. troglodytes
gttggagtgcagtggc

SEQ ID NO: 258068 - DNA, 16 bp, P. troglodytes
gttggattaaagatga

SEQ ID NO: 258069 - DNA, 16 bp, P. troglodytes
gttggattcctagata

SEQ ID NO: 258070 - DNA, 16 bp, P. troglodytes
gttggcactcaataaa

SEQ ID NO: 258071 - DNA, 16 bp, P. troglodytes
gttggcattgagtgtc

SEQ ID NO: 258072 - DNA, 16 bp, P. troglodytes
gttggccagcctggtc

SEQ ID NO: 258073 - DNA, 16 bp, P. troglodytes
gttggccaggatggac

SEQ ID NO: 258074 - DNA, 16 bp, P. troglodytes
gttggccaggctcttc

SEQ ID NO: 258075 - DNA, 16 bp, P. troglodytes
gttggccaggctgcag

SEQ ID NO: 258076 - DNA, 16 bp, P. troglodytes
gttggccgggctggcc

SEQ ID NO: 258077 - DNA, 16 bp, P. troglodytes
gttggcgtgcagtggc

SEQ ID NO: 258078 - DNA, 16 bp, P. troglodytes
gttggctttttgaaaa

SEQ ID NO: 258079 - DNA, 16 bp, P. troglodytes
gttgggactacaggcg

SEQ ID NO: 258080 - DNA, 16 bp, P. troglodytes
gttgggacttcaacat

SEQ ID NO: 258081 - DNA, 16 bp, P. troglodytes
gttgggagagaagctg

SEQ ID NO: 258082 - DNA, 16 bp, P. troglodytes
gttgggaggctgaggt

SEQ ID NO: 258083 - DNA, 16 bp, P. troglodytes
gttgggattccaggtg

SEQ ID NO: 258084 - DNA, 16 bp, P. troglodytes
gttgggcaaccatcac

SEQ ID NO: 258085 - DNA, 16 bp, P. troglodytes
gttgggcaaggtggct

SEQ ID NO: 258086 - DNA, 16 bp, P. troglodytes
gttgggcccagtggct

SEQ ID NO: 258087 - DNA, 16 bp, P. troglodytes
gttgggctgctatttc

SEQ ID NO: 258088 - DNA, 16 bp, P. troglodytes
gttggggacccctggc

SEQ ID NO: 258089 - DNA, 16 bp, P. troglodytes
gttggggacccctgtt

SEQ ID NO: 258090 - DNA, 16 bp, P. troglodytes
gttggggatgaaatca

SEQ ID NO: 258091 - DNA, 16 bp, P. troglodytes
gttgggggtggtggca

SEQ ID NO: 258092 - DNA, 16 bp, P. troglodytes
gttggggtgcagtggc

SEQ ID NO: 258093 - DNA, 16 bp, P. troglodytes
gttgggtcaaatggta

SEQ ID NO: 258094 - DNA, 16 bp, P. troglodytes
gttggtgaccttcaga

SEQ ID NO: 258095 - DNA, 16 bp, P. troglodytes
gttggtgcgaaagtaa

SEQ ID NO: 258096 - DNA, 16 bp, P. troglodytes
gttggtgggaatgtaa

SEQ ID NO: 258097 - DNA, 16 bp, P. troglodytes
gttggtggggcaggag

SEQ ID NO: 258098 - DNA, 16 bp, P. troglodytes
gttggttcttcaaaaa

SEQ ID NO: 258099 - DNA, 16 bp, P. troglodytes
gttggttggcctccag

SEQ ID NO: 258100 - DNA, 16 bp, P. troglodytes
gttggttttgtatcct

SEQ ID NO: 258101 - DNA, 16 bp, P. troglodytes
gttggttttttaaaaa

SEQ ID NO: 258102 - DNA, 16 bp, P. troglodytes
gttgtaaatattttct

SEQ ID NO: 258103 - DNA, 16 bp, P. troglodytes
gttgtatttctataca

SEQ ID NO: 258104 - DNA, 16 bp, P. troglodytes
gttgtcctgcctttcc

SEQ ID NO: 258105 - DNA, 16 bp, P. troglodytes
gttgtgaagattaaag

SEQ ID NO: 258106 - DNA, 16 bp, P. troglodytes
gttgtgaggattaaac

SEQ ID NO: 258107 - DNA, 16 bp, P. troglodytes
gttgtgaggattaaag

SEQ ID NO: 258108 - DNA, 16 bp, P. troglodytes
gttgtgcaaccattgc

SEQ ID NO: 258109 - DNA, 16 bp, P. troglodytes
gttgtgcccacctttg

SEQ ID NO: 258110 - DNA, 16 bp, P. troglodytes
gttgtggcctgatgct

SEQ ID NO: 258111 - DNA, 16 bp, P. troglodytes
gttgtggtaaaataca

SEQ ID NO: 258112 - DNA, 16 bp, P. troglodytes
gttgtggtatcaggat

SEQ ID NO: 258113 - DNA, 16 bp, P. troglodytes
gttgtgtctaaactcc

SEQ ID NO: 258114 - DNA, 16 bp, P. troglodytes
gttgtgtctctgccag

SEQ ID NO: 258115 - DNA, 16 bp, P. troglodytes
gttgtgtcttcattct

SEQ ID NO: 258116 - DNA, 16 bp, P. troglodytes
gttgttatactgtatt

SEQ ID NO: 258117 - DNA, 16 bp, P. troglodytes
gttgttcagattcttt

SEQ ID NO: 258118 - DNA, 16 bp, P. troglodytes
gttgttcatagtattt

SEQ ID NO: 258119 - DNA, 16 bp, P. troglodytes
gttgttctgaggatta

SEQ ID NO: 258120 - DNA, 16 bp, P. troglodytes
gttgttgttgtcattt

SEQ ID NO: 258121 - DNA, 16 bp, P. troglodytes
gttgttgttgttactt

SEQ ID NO: 258122 - DNA, 16 bp, P. troglodytes
gttgttgttgttgccc

SEQ ID NO: 258123 - DNA, 16 bp, P. troglodytes
gttgttgttttaatca

SEQ ID NO: 258124 - DNA, 16 bp, P. troglodytes
gttgttgtttttaaaa

SEQ ID NO: 258125 - DNA, 16 bp, P. troglodytes
gttgtttataaattac

SEQ ID NO: 258126 - DNA, 16 bp, P. troglodytes
gttgtttgagtttctt

SEQ ID NO: 258127 - DNA, 16 bp, P. troglodytes
gttgtttgttcctcct

SEQ ID NO: 258128 - DNA, 16 bp, P. troglodytes
gttgttttaagctgtt

SEQ ID NO: 258129 - DNA, 16 bp, P. troglodytes
gttgtttttcctgatc

SEQ ID NO: 258130 - DNA, 16 bp, P. troglodytes
gtttaaaaaacaaaca

SEQ ID NO: 258131 - DNA, 16 bp, P. troglodytes
gtttaaaaaatgtttt

SEQ ID NO: 258132 - DNA, 16 bp, P. troglodytes
gtttaaaaacaaacaa

SEQ ID NO: 258133 - DNA, 16 bp, P. troglodytes
gtttaaaacacttgat

SEQ ID NO: 258134 - DNA, 16 bp, P. troglodytes
gtttaaaatgtttctt

SEQ ID NO: 258135 - DNA, 16 bp, P. troglodytes
gtttaaaattctcttt

SEQ ID NO: 258136 - DNA, 16 bp, P. troglodytes
gtttaaacaacaaaaa

SEQ ID NO: 258137 - DNA, 16 bp, P. troglodytes
gtttaaagtccgtttt

SEQ ID NO: 258138 - DNA, 16 bp, P. troglodytes
gtttaaatatacaaat

SEQ ID NO: 258139 - DNA, 16 bp, P. troglodytes
gtttaaattattttct

SEQ ID NO: 258140 - DNA, 16 bp, P. troglodytes
gtttaactctgtgaaa

SEQ ID NO: 258141 - DNA, 16 bp, P. troglodytes
gtttaagcaacccagt

SEQ ID NO: 258142 - DNA, 16 bp, P. troglodytes
gtttaaggaagctaaa

SEQ ID NO: 258143 - DNA, 16 bp, P. troglodytes
gtttaaggaagggatc

SEQ ID NO: 258144 - DNA, 16 bp, P. troglodytes
gtttaagtcttttatc

SEQ ID NO: 258145 - DNA, 16 bp, P. troglodytes
gtttaagtgattcttc

SEQ ID NO: 258146 - DNA, 16 bp, P. troglodytes
gtttaatagcatttta

SEQ ID NO: 258147 - DNA, 16 bp, P. troglodytes
gtttaatggacttaac

SEQ ID NO: 258148 - DNA, 16 bp, P. troglodytes
gtttaattggctcatg

SEQ ID NO: 258149 - DNA, 16 bp, P. troglodytes
gtttaatttccacaaa

SEQ ID NO: 258150 - DNA, 16 bp, P. troglodytes
gtttaatttccacata

SEQ ID NO: 258151 - DNA, 16 bp, P. troglodytes
gtttacaaaatgcttt

SEQ ID NO: 258152 - DNA, 16 bp, P. troglodytes
gtttacaaagtacttt

SEQ ID NO: 258153 - DNA, 16 bp, P. troglodytes
gtttacacttccacca

SEQ ID NO: 258154 - DNA, 16 bp, P. troglodytes
gtttacagcagcttta

SEQ ID NO: 258155 - DNA, 16 bp, P. troglodytes
gtttacagcatcttca

SEQ ID NO: 258156 - DNA, 23 bp, P. troglodytes
gtttacagtcccaccaacagtgt

SEQ ID NO: 258157 - DNA, 16 bp, P. troglodytes
gtttacatgctggatt

SEQ ID NO: 258158 - DNA, 16 bp, P. troglodytes
gtttaccagtttatta

SEQ ID NO: 258159 - DNA, 16 bp, P. troglodytes
gtttaccatgtgccag

SEQ ID NO: 258160 - DNA, 16 bp, P. troglodytes
gtttactgcagtacta

SEQ ID NO: 258161 - DNA, 16 bp, P. troglodytes
gtttactttattgtaa

SEQ ID NO: 258162 - DNA, 16 bp, P. troglodytes
gtttagaaagtaaaaa

SEQ ID NO: 258163 - DNA, 16 bp, P. troglodytes
gtttagatgaggtcat

SEQ ID NO: 258164 - DNA, 16 bp, P. troglodytes
gtttaggctgcagtga

SEQ ID NO: 258165 - DNA, 16 bp, P. troglodytes
gtttagtagaaatggg

SEQ ID NO: 258166 - DNA, 16 bp, P. troglodytes
gtttagttttggggaa

SEQ ID NO: 258167 - DNA, 16 bp, P. troglodytes
gtttataaaatacaaa

SEQ ID NO: 258168 - DNA, 16 bp, P. troglodytes
gtttataaaatctaca

SEQ ID NO: 258169 - DNA, 16 bp, P. troglodytes
gtttataaattgccca

SEQ ID NO: 258170 - DNA, 16 bp, P. troglodytes
gtttatacagcatttt

SEQ ID NO: 258171 - DNA, 16 bp, P. troglodytes
gtttatcaagacaatg

SEQ ID NO: 258172 - DNA, 16 bp, P. troglodytes
gtttatcttcttttga

SEQ ID NO: 258173 - DNA, 16 bp, P. troglodytes
gtttatcttttcaaag

SEQ ID NO: 258174 - DNA, 16 bp, P. troglodytes
gtttatgaagaaaaga

SEQ ID NO: 258175 - DNA, 16 bp, P. troglodytes
gtttatgacaaaccca

SEQ ID NO: 258176 - DNA, 16 bp, P. troglodytes
gtttatggccagattt

SEQ ID NO: 258177 - DNA, 16 bp, P. troglodytes
gtttatgtcctttgct

SEQ ID NO: 258178 - DNA, 16 bp, P. troglodytes
gtttatgtcctttgtc

SEQ ID NO: 258179 - DNA, 16 bp, P. troglodytes
gtttattaaaaagttt

SEQ ID NO: 258180 - DNA, 16 bp, P. troglodytes
gtttattcaacaaata

SEQ ID NO: 258181 - DNA, 16 bp, P. troglodytes
gtttattcatgttgtc

SEQ ID NO: 258182 - DNA, 16 bp, P. troglodytes
gtttattcattcatta

SEQ ID NO: 258183 - DNA, 16 bp, P. troglodytes
gtttattgagcacctg

SEQ ID NO: 258184 - DNA, 16 bp, P. troglodytes
gtttattgattttcgt

SEQ ID NO: 258185 - DNA, 16 bp, P. troglodytes
gtttattgggatgtaa

SEQ ID NO: 258186 - DNA, 16 bp, P. troglodytes
gtttatttctcactca

SEQ ID NO: 258187 - DNA, 16 bp, P. troglodytes
gtttatttctgggctt

SEQ ID NO: 258188 - DNA, 16 bp, P. troglodytes
gtttattttaaaagaa

SEQ ID NO: 258189 - DNA, 16 bp, P. troglodytes
gtttattttaaacaaa

SEQ ID NO: 258190 - DNA, 16 bp, P. troglodytes
gtttatttttcacagt

SEQ ID NO: 258191 - DNA, 16 bp, P. troglodytes
gtttatttttctctca

SEQ ID NO: 258192 - DNA, 16 bp, P. troglodytes
gtttatttttgtagag

SEQ ID NO: 258193 - DNA, 16 bp, P. troglodytes
gtttcaaaaaaagaaa

SEQ ID NO: 258194 - DNA, 16 bp, P. troglodytes
gtttcaaaaaataaat

SEQ ID NO: 258195 - DNA, 16 bp, P. troglodytes
gtttcaaaacaaacaa

SEQ ID NO: 258196 - DNA, 16 bp, P. troglodytes
gtttcaaaatgttttc

SEQ ID NO: 258197 - DNA, 16 bp, P. troglodytes
gtttcaaacttgcatg

SEQ ID NO: 258198 - DNA, 16 bp, P. troglodytes
gtttcaaagaaaatct

SEQ ID NO: 258199 - DNA, 16 bp, P. troglodytes
gtttcaaataaaaaaa

SEQ ID NO: 258200 - DNA, 16 bp, P. troglodytes
gtttcaaattttaaaa

SEQ ID NO: 258201 - DNA, 16 bp, P. troglodytes
gtttcaacaaaaaaaa

SEQ ID NO: 258202 - DNA, 16 bp, P. troglodytes
gtttcaagaaagttta

SEQ ID NO: 258203 - DNA, 16 bp, P. troglodytes
gtttcaataaaacttt

SEQ ID NO: 258204 - DNA, 16 bp, P. troglodytes
gtttcacagatagatt

SEQ ID NO: 258205 - DNA, 23 bp, P. troglodytes
gtttcaccatgttggccaggctt

SEQ ID NO: 258206 - DNA, 16 bp, P. troglodytes
gtttcaccctgttagt

SEQ ID NO: 258207 - DNA, 16 bp, P. troglodytes
gtttcaccgtattagc

SEQ ID NO: 258208 - DNA, 16 bp, P. troglodytes
gtttcactgctctaaa

SEQ ID NO: 258209 - DNA, 16 bp, P. troglodytes
gtttcactgtgtgagc

SEQ ID NO: 258210 - DNA, 16 bp, P. troglodytes
gtttcacttagcataa

SEQ ID NO: 258211 - DNA, 16 bp, P. troglodytes
gtttcaggcatccact

SEQ ID NO: 258212 - DNA, 16 bp, P. troglodytes
gtttcagtgagccgag

SEQ ID NO: 258213 - DNA, 16 bp, P. troglodytes
gtttcagtttgggaaa

SEQ ID NO: 258214 - DNA, 16 bp, P. troglodytes
gtttcagttttataag

SEQ ID NO: 258215 - DNA, 16 bp, P. troglodytes
gtttcataccagggat

SEQ ID NO: 258216 - DNA, 16 bp, P. troglodytes
gtttcatcatgttggc

SEQ ID NO: 258217 - DNA, 16 bp, P. troglodytes
gtttcattattttgca

SEQ ID NO: 258218 - DNA, 16 bp, P. troglodytes
gtttccaaaaaaaaaa

SEQ ID NO: 258219 - DNA, 16 bp, P. troglodytes
gtttccaaaaataaaa

SEQ ID NO: 258220 - DNA, 16 bp, P. troglodytes
gtttccaacctggtga

SEQ ID NO: 258221 - DNA, 16 bp, P. troglodytes
gtttccagaagagact

SEQ ID NO: 258222 - DNA, 16 bp, P. troglodytes
gtttccagaggaagga

SEQ ID NO: 258223 - DNA, 16 bp, P. troglodytes
gtttccagctggtgaa

SEQ ID NO: 258224 - DNA, 16 bp, P. troglodytes
gtttccatgtaattga

SEQ ID NO: 258225 - DNA, 16 bp, P. troglodytes
gtttcccagaatgctt

SEQ ID NO: 258226 - DNA, 16 bp, P. troglodytes
gtttcccaggctggag

SEQ ID NO: 258227 - DNA, 16 bp, P. troglodytes
gtttcccatctgaaaa

SEQ ID NO: 258228 - DNA, 16 bp, P. troglodytes
gtttccccacatcctt

SEQ ID NO: 258229 - DNA, 16 bp, P. troglodytes
gtttccccacattggc

SEQ ID NO: 258230 - DNA, 16 bp, P. troglodytes
gtttccccagcaccat

SEQ ID NO: 258231 - DNA, 16 bp, P. troglodytes
gtttccccatttcttg

SEQ ID NO: 258232 - DNA, 16 bp, P. troglodytes
gtttcccgaggcctcc

SEQ ID NO: 258233 - DNA, 16 bp, P. troglodytes
gtttccctacacaagc

SEQ ID NO: 258234 - DNA, 16 bp, P. troglodytes
gtttccctcatgctgt

SEQ ID NO: 258235 - DNA, 16 bp, P. troglodytes
gtttccctgtgttgcc

SEQ ID NO: 258236 - DNA, 16 bp, P. troglodytes
gtttcctcatttgcaa

SEQ ID NO: 258237 - DNA, 16 bp, P. troglodytes
gtttcctgaatttgaa

SEQ ID NO: 258238 - DNA, 16 bp, P. troglodytes
gtttccttctctgtaa

SEQ ID NO: 258239 - DNA, 16 bp, P. troglodytes
gtttccttcttaattt

SEQ ID NO: 258240 - DNA, 16 bp, P. troglodytes
gtttccttctttttaa

SEQ ID NO: 258241 - DNA, 16 bp, P. troglodytes
gtttccttgctcctca

SEQ ID NO: 258242 - DNA, 16 bp, P. troglodytes
gtttcctttgatgtgc

SEQ ID NO: 258243 - DNA, 16 bp, P. troglodytes
gtttcgccatgtttcc

SEQ ID NO: 258244 - DNA, 16 bp, P. troglodytes
gtttctaataccattc

SEQ ID NO: 258245 - DNA, 16 bp, P. troglodytes
gtttctaatgagaagt

SEQ ID NO: 258246 - DNA, 16 bp, P. troglodytes
gtttctaatttaattt

SEQ ID NO: 258247 - DNA, 16 bp, P. troglodytes
gtttctaatttttaaa

SEQ ID NO: 258248 - DNA, 16 bp, P. troglodytes
gtttctacaaaaataa

SEQ ID NO: 258249 - DNA, 16 bp, P. troglodytes
gtttctacacagcaaa

SEQ ID NO: 258250 - DNA, 16 bp, P. troglodytes
gtttctatgagtttga

SEQ ID NO: 258251 - DNA, 16 bp, P. troglodytes
gtttctcatcagactt

SEQ ID NO: 258252 - DNA, 16 bp, P. troglodytes
gtttctccacagcctt

SEQ ID NO: 258253 - DNA, 16 bp, P. troglodytes
gtttctcccacaacac

SEQ ID NO: 258254 - DNA, 16 bp, P. troglodytes
gtttctcccacctcag

SEQ ID NO: 258255 - DNA, 16 bp, P. troglodytes
gtttctctgatgacca

SEQ ID NO: 258256 - DNA, 16 bp, P. troglodytes
gtttctgaaatatttt

SEQ ID NO: 258257 - DNA, 16 bp, P. troglodytes
gtttctgatgagaaat

SEQ ID NO: 258258 - DNA, 22 bp, P. troglodytes
gtttctgattagcctctccaaa

SEQ ID NO: 258259 - DNA, 16 bp, P. troglodytes
gtttctgccatgttgg

SEQ ID NO: 258260 - DNA, 17 bp, P. troglodytes
gtttctgccgagagatc

SEQ ID NO: 258261 - DNA, 16 bp, P. troglodytes
gtttctgctgcctttt

SEQ ID NO: 258262 - DNA, 16 bp, P. troglodytes
gtttctgctgctgctt

SEQ ID NO: 258263 - DNA, 16 bp, P. troglodytes
gtttctgctttcttca

SEQ ID NO: 258264 - DNA, 16 bp, P. troglodytes
gtttctggagctgctt

SEQ ID NO: 258265 - DNA, 16 bp, P. troglodytes
gtttctggaggctggg

SEQ ID NO: 258266 - DNA, 16 bp, P. troglodytes
gtttctggggaggcct

SEQ ID NO: 258267 - DNA, 16 bp, P. troglodytes
gtttctggtgaggtct

SEQ ID NO: 258268 - DNA, 16 bp, P. troglodytes
gtttctgtatttttag

SEQ ID NO: 258269 - DNA, 16 bp, P. troglodytes
gtttctgttgagaaat

SEQ ID NO: 258270 - DNA, 16 bp, P. troglodytes
gtttctgttgttttaa

SEQ ID NO: 258271 - DNA, 16 bp, P. troglodytes
gtttctgttttctgca

SEQ ID NO: 258272 - DNA, 16 bp, P. troglodytes
gtttcttaacttctct

SEQ ID NO: 258273 - DNA, 16 bp, P. troglodytes
gtttcttcaataaata

SEQ ID NO: 258274 - DNA, 16 bp, P. troglodytes
gtttcttcacagaatt

SEQ ID NO: 258275 - DNA, 16 bp, P. troglodytes
gtttcttcagtttctt

SEQ ID NO: 258276 - DNA, 16 bp, P. troglodytes
gtttcttcatctgtga

SEQ ID NO: 258277 - DNA, 16 bp, P. troglodytes
gtttcttcatttgaaa

SEQ ID NO: 258278 - DNA, 16 bp, P. troglodytes
gtttcttcctctggaa

SEQ ID NO: 258279 - DNA, 16 bp, P. troglodytes
gtttctttaataaatg

SEQ ID NO: 258280 - DNA, 16 bp, P. troglodytes
gtttctttatatttaa

SEQ ID NO: 258281 - DNA, 16 bp, P. troglodytes
gtttctttatccattc

SEQ ID NO: 258282 - DNA, 16 bp, P. troglodytes
gtttcttttgagaagt

SEQ ID NO: 258283 - DNA, 16 bp, P. troglodytes
gtttctttttggagtg

SEQ ID NO: 258284 - DNA, 16 bp, P. troglodytes
gtttgaaaaatttgca

SEQ ID NO: 258285 - DNA, 16 bp, P. troglodytes
gtttgaaaatattttc

SEQ ID NO: 258286 - DNA, 16 bp, P. troglodytes
gtttgaaacttcttag

SEQ ID NO: 258287 - DNA, 16 bp, P. troglodytes
gtttgaaattatttca

SEQ ID NO: 258288 - DNA, 16 bp, P. troglodytes
gtttgaaattttccat

SEQ ID NO: 258289 - DNA, 16 bp, P. troglodytes
gtttgaacccaggaga

SEQ ID NO: 258290 - DNA, 16 bp, P. troglodytes
gtttgaacccaggagt

SEQ ID NO: 258291 - DNA, 16 bp, P. troglodytes
gtttgaagaccacctt

SEQ ID NO: 258292 - DNA, 16 bp, P. troglodytes
gtttgaatatggtttg

SEQ ID NO: 258293 - DNA, 16 bp, P. troglodytes
gtttgaatcccagttc

SEQ ID NO: 258294 - DNA, 16 bp, P. troglodytes
gtttgaatcctggctt

SEQ ID NO: 258295 - DNA, 16 bp, P. troglodytes
gtttgaatgcctttta

SEQ ID NO: 258296 - DNA, 16 bp, P. troglodytes
gtttgactggatatga

SEQ ID NO: 258297 - DNA, 16 bp, P. troglodytes
gtttgagaaacactgc

SEQ ID NO: 258298 - DNA, 16 bp, P. troglodytes
gtttgagaaacagaaa

SEQ ID NO: 258299 - DNA, 16 bp, P. troglodytes
gtttgagaaataaagg

SEQ ID NO: 258300 - DNA, 16 bp, P. troglodytes
gtttgagaatcactga

SEQ ID NO: 258301 - DNA, 16 bp, P. troglodytes
gtttgagagcagactg

SEQ ID NO: 258302 - DNA, 16 bp, P. troglodytes
gtttgagcccgggagg

SEQ ID NO: 258303 - DNA, 16 bp, P. troglodytes
gtttgagcctgggagg

SEQ ID NO: 258304 - DNA, 16 bp, P. troglodytes
gtttgaggatacagtg

SEQ ID NO: 258305 - DNA, 16 bp, P. troglodytes
gtttgaggccaggagt

SEQ ID NO: 258306 - DNA, 16 bp, P. troglodytes
gtttgagtcccaaaac

SEQ ID NO: 258307 - DNA, 16 bp, P. troglodytes
gtttgagttccttgtg

SEQ ID NO: 258308 - DNA, 16 bp, P. troglodytes
gtttgataaagatggg

SEQ ID NO: 258309 - DNA, 16 bp, P. troglodytes
gtttgatcttggctca

SEQ ID NO: 258310 - DNA, 16 bp, P. troglodytes
gtttgattgcattgtg

SEQ ID NO: 258311 - DNA, 16 bp, P. troglodytes
gtttgattgcttctag

SEQ ID NO: 258312 - DNA, 16 bp, P. troglodytes
gtttgcaaaaagaaaa

SEQ ID NO: 258313 - DNA, 16 bp, P. troglodytes
gtttgcaaagcacttt

SEQ ID NO: 258314 - DNA, 16 bp, P. troglodytes
gtttgcagatgaggaa

SEQ ID NO: 258315 - DNA, 16 bp, P. troglodytes
gtttgcaggcagtatg

SEQ ID NO: 258316 - DNA, 16 bp, P. troglodytes
gtttgcattttttaaa

SEQ ID NO: 258317 - DNA, 16 bp, P. troglodytes
gtttgccaagctggtc

SEQ ID NO: 258318 - DNA, 16 bp, P. troglodytes
gtttgcccaggctgga

SEQ ID NO: 258319 - DNA, 16 bp, P. troglodytes
gtttgccttatttgaa

SEQ ID NO: 258320 - DNA, 16 bp, P. troglodytes
gtttgctagtatcttg

SEQ ID NO: 258321 - DNA, 16 bp, P. troglodytes
gtttgctgacctctgt

SEQ ID NO: 258322 - DNA, 16 bp, P. troglodytes
gtttgctgggctccat

SEQ ID NO: 258323 - DNA, 16 bp, P. troglodytes
gtttggaaaatttgca

SEQ ID NO: 258324 - DNA, 16 bp, P. troglodytes
gtttggaaacattctt

SEQ ID NO: 258325 - DNA, 16 bp, P. troglodytes
gtttggagatttttca

SEQ ID NO: 258326 - DNA, 16 bp, P. troglodytes
gtttggagtgcagtgg

SEQ ID NO: 258327 - DNA, 16 bp, P. troglodytes
gtttggatttttgtcc

SEQ ID NO: 258328 - DNA, 16 bp, P. troglodytes
gtttggccaggctggt

SEQ ID NO: 258329 - DNA, 16 bp, P. troglodytes
gtttgggaaaataaaa

SEQ ID NO: 258330 - DNA, 16 bp, P. troglodytes
gtttgggaatctccac

SEQ ID NO: 258331 - DNA, 18 bp, P. troglodytes
gtttgggaggccaaggcg

SEQ ID NO: 258332 - DNA, 16 bp, P. troglodytes
gtttgggaggccgaag

SEQ ID NO: 258333 - DNA, 16 bp, P. troglodytes
gtttgggaggccgagg

SEQ ID NO: 258334 - DNA, 16 bp, P. troglodytes
gtttggggcttccacc

SEQ ID NO: 258335 - DNA, 16 bp, P. troglodytes
gtttggtactatccac

SEQ ID NO: 258336 - DNA, 16 bp, P. troglodytes
gtttggtggcacatgc

SEQ ID NO: 258337 - DNA, 16 bp, P. troglodytes
gtttgtaaatgtacca

SEQ ID NO: 258338 - DNA, 16 bp, P. troglodytes
gtttgtagttctcatt

SEQ ID NO: 258339 - DNA, 16 bp, P. troglodytes
gtttgtctgtctgtct

SEQ ID NO: 258340 - DNA, 16 bp, P. troglodytes
gtttgtggtcttgctg

SEQ ID NO: 258341 - DNA, 16 bp, P. troglodytes
gtttgtggtgatgctg

SEQ ID NO: 258342 - DNA, 16 bp, P. troglodytes
gtttgtgtgtgcattt

SEQ ID NO: 258343 - DNA, 16 bp, P. troglodytes
gtttgttaattttctg

SEQ ID NO: 258344 - DNA, 16 bp, P. troglodytes
gtttgttatatgggta

SEQ ID NO: 258345 - DNA, 16 bp, P. troglodytes
gtttgttcatctgtaa

SEQ ID NO: 258346 - DNA, 16 bp, P. troglodytes
gtttgttcattcattc

SEQ ID NO: 258347 - DNA, 16 bp, P. troglodytes
gtttgttctcacactg

SEQ ID NO: 258348 - DNA, 16 bp, P. troglodytes
gtttgttgcacagatt

SEQ ID NO: 258349 - DNA, 16 bp, P. troglodytes
gtttgtttcctcatct

SEQ ID NO: 258350 - DNA, 16 bp, P. troglodytes
gtttgtttgtttaaaa

SEQ ID NO: 258351 - DNA, 16 bp, P. troglodytes
gtttgtttgtttcaat

SEQ ID NO: 258352 - DNA, 16 bp, P. troglodytes
gtttgtttgtttccca

SEQ ID NO: 258353 - DNA, 16 bp, P. troglodytes
gtttgttttaatttca

SEQ ID NO: 258354 - DNA, 16 bp, P. troglodytes
gtttgttttatggccc

SEQ ID NO: 258355 - DNA, 16 bp, P. troglodytes
gtttgttttggagaca

SEQ ID NO: 258356 - DNA, 16 bp, P. troglodytes
gtttgttttgtctgac

SEQ ID NO: 258357 - DNA, 16 bp, P. troglodytes
gttttaaaaatgagag

SEQ ID NO: 258358 - DNA, 16 bp, P. troglodytes
gttttaaaaatggaaa

SEQ ID NO: 258359 - DNA, 16 bp, P. troglodytes
gttttaaaacaaaatt

SEQ ID NO: 258360 - DNA, 16 bp, P. troglodytes
gttttaaaacttttaa

SEQ ID NO: 258361 - DNA, 16 bp, P. troglodytes
gttttaaaagaagaaa

SEQ ID NO: 258362 - DNA, 16 bp, P. troglodytes
gttttaaaaggttttt

SEQ ID NO: 258363 - DNA, 16 bp, P. troglodytes
gttttaaaatacattt

SEQ ID NO: 258364 - DNA, 16 bp, P. troglodytes
gttttaaaatgtgagg

SEQ ID NO: 258365 - DNA, 16 bp, P. troglodytes
gttttaaaattcatat

SEQ ID NO: 258366 - DNA, 16 bp, P. troglodytes
gttttaaacctttaat

SEQ ID NO: 258367 - DNA, 16 bp, P. troglodytes
gttttaaagaaaattt

SEQ ID NO: 258368 - DNA, 16 bp, P. troglodytes
gttttaaattgcattt

SEQ ID NO: 258369 - DNA, 16 bp, P. troglodytes
gttttaaattgtgtgc

SEQ ID NO: 258370 - DNA, 16 bp, P. troglodytes
gttttaacaacaacaa

SEQ ID NO: 258371 - DNA, 16 bp, P. troglodytes
gttttaacagtttttt

SEQ ID NO: 258372 - DNA, 16 bp, P. troglodytes
gttttaacatcatatt

SEQ ID NO: 258373 - DNA, 16 bp, P. troglodytes
gttttaacattttctt

SEQ ID NO: 258374 - DNA, 16 bp, P. troglodytes
gttttaagaaagttta

SEQ ID NO: 258375 - DNA, 16 bp, P. troglodytes
gttttaagagctcttt

SEQ ID NO: 258376 - DNA, 16 bp, P. troglodytes
gttttaagcctcacat

SEQ ID NO: 258377 - DNA, 16 bp, P. troglodytes
gttttaatttctaata

SEQ ID NO: 258378 - DNA, 16 bp, P. troglodytes
gttttaatttgcatct

SEQ ID NO: 258379 - DNA, 16 bp, P. troglodytes
gttttaatttgcattt

SEQ ID NO: 258380 - DNA, 16 bp, P. troglodytes
gttttacaaaatgaaa

SEQ ID NO: 258381 - DNA, 16 bp, P. troglodytes
gttttacaaatgagaa

SEQ ID NO: 258382 - DNA, 16 bp, P. troglodytes
gttttacagatgagga

SEQ ID NO: 258383 - DNA, 16 bp, P. troglodytes
gttttactggtgaatt

SEQ ID NO: 258384 - DNA, 16 bp, P. troglodytes
gttttacttttttaaa

SEQ ID NO: 258385 - DNA, 16 bp, P. troglodytes
gttttagacagggtct

SEQ ID NO: 258386 - DNA, 16 bp, P. troglodytes
gttttagagcagtttt

SEQ ID NO: 258387 - DNA, 16 bp, P. troglodytes
gttttagcaaagtgct

SEQ ID NO: 258388 - DNA, 16 bp, P. troglodytes
gttttaggggaacagg

SEQ ID NO: 258389 - DNA, 21 bp, P. troglodytes
gttttagtagagacggggttt

SEQ ID NO: 258390 - DNA, 16 bp, P. troglodytes
gttttagtaggaatgg

SEQ ID NO: 258391 - DNA, 16 bp, P. troglodytes
gttttagttccttgta

SEQ ID NO: 258392 - DNA, 16 bp, P. troglodytes
gttttataaatgtctg

SEQ ID NO: 258393 - DNA, 16 bp, P. troglodytes
gttttatatttcaaaa

SEQ ID NO: 258394 - DNA, 16 bp, P. troglodytes
gttttatgatttcagg

SEQ ID NO: 258395 - DNA, 16 bp, P. troglodytes
gttttattaaaactaa

SEQ ID NO: 258396 - DNA, 16 bp, P. troglodytes
gttttattggaacaca

SEQ ID NO: 258397 - DNA, 16 bp, P. troglodytes
gttttatttcattgag

SEQ ID NO: 258398 - DNA, 16 bp, P. troglodytes
gttttatttcctcctt

SEQ ID NO: 258399 - DNA, 16 bp, P. troglodytes
gttttattttaagttc

SEQ ID NO: 258400 - DNA, 16 bp, P. troglodytes
gttttcaaagcctttg

SEQ ID NO: 258401 - DNA, 16 bp, P. troglodytes
gttttcaaatttttct

SEQ ID NO: 258402 - DNA, 16 bp, P. troglodytes
gttttcaacatttttt

SEQ ID NO: 258403 - DNA, 16 bp, P. troglodytes
gttttcaactcctttg

SEQ ID NO: 258404 - DNA, 16 bp, P. troglodytes
gttttcacagggaatg

SEQ ID NO: 258405 - DNA, 16 bp, P. troglodytes
gttttcacatggtctt

SEQ ID NO: 258406 - DNA, 16 bp, P. troglodytes
gttttcactctatttc

SEQ ID NO: 258407 - DNA, 16 bp, P. troglodytes
gttttcagaaagaaaa

SEQ ID NO: 258408 - DNA, 16 bp, P. troglodytes
gttttcagagacaggg

SEQ ID NO: 258409 - DNA, 16 bp, P. troglodytes
gttttcagccacccag

SEQ ID NO: 258410 - DNA, 16 bp, P. troglodytes
gttttcaggtatcttt

SEQ ID NO: 258411 - DNA, 16 bp, P. troglodytes
gttttcagtgtacatg

SEQ ID NO: 258412 - DNA, 16 bp, P. troglodytes
gttttcatcatgttgc

SEQ ID NO: 258413 - DNA, 16 bp, P. troglodytes
gttttcattataaaga

SEQ ID NO: 258414 - DNA, 16 bp, P. troglodytes
gttttcatttatttca

SEQ ID NO: 258415 - DNA, 16 bp, P. troglodytes
gttttcatttctcatg

SEQ ID NO: 258416 - DNA, 16 bp, P. troglodytes
gttttcatttctgtaa

SEQ ID NO: 258417 - DNA, 16 bp, P. troglodytes
gttttcattttaatat

SEQ ID NO: 258418 - DNA, 16 bp, P. troglodytes
gttttcatttttaaat

SEQ ID NO: 258419 - DNA, 16 bp, P. troglodytes
gttttccaaaatgttt

SEQ ID NO: 258420 - DNA, 16 bp, P. troglodytes
gttttccaagggaatg

SEQ ID NO: 258421 - DNA, 17 bp, P. troglodytes
gttttccaccctgggtg

SEQ ID NO: 258422 - DNA, 16 bp, P. troglodytes
gttttccagcttgcag

SEQ ID NO: 258423 - DNA, 16 bp, P. troglodytes
gttttccatttgcatg

SEQ ID NO: 258424 - DNA, 16 bp, P. troglodytes
gttttccattttgctt

SEQ ID NO: 258425 - DNA, 16 bp, P. troglodytes
gttttcccagcatcat

SEQ ID NO: 258426 - DNA, 16 bp, P. troglodytes
gttttcccatctgtaa

SEQ ID NO: 258427 - DNA, 16 bp, P. troglodytes
gttttcctcaagatct

SEQ ID NO: 258428 - DNA, 16 bp, P. troglodytes
gttttcctctaggatt

SEQ ID NO: 258429 - DNA, 16 bp, P. troglodytes
gttttcctgcttgaat

SEQ ID NO: 258430 - DNA, 16 bp, P. troglodytes
gttttccttttttaca

SEQ ID NO: 258431 - DNA, 16 bp, P. troglodytes
gttttctaaagtggtt

SEQ ID NO: 258432 - DNA, 16 bp, P. troglodytes
gttttctaaattattt

SEQ ID NO: 258433 - DNA, 16 bp, P. troglodytes
gttttctcatcagtaa

SEQ ID NO: 258434 - DNA, 16 bp, P. troglodytes
gttttctcatctataa

SEQ ID NO: 258435 - DNA, 16 bp, P. troglodytes
gttttctcatttgcaa

SEQ ID NO: 258436 - DNA, 16 bp, P. troglodytes
gttttctccttcctgg

SEQ ID NO: 258437 - DNA, 16 bp, P. troglodytes
gttttctctctgtgtg

SEQ ID NO: 258438 - DNA, 16 bp, P. troglodytes
gttttctgcacctatc

SEQ ID NO: 258439 - DNA, 16 bp, P. troglodytes
gttttctggaagagat

SEQ ID NO: 258440 - DNA, 16 bp, P. troglodytes
gttttctgttcctatg

SEQ ID NO: 258441 - DNA, 16 bp, P. troglodytes
gttttcttagaatctg

SEQ ID NO: 258442 - DNA, 16 bp, P. troglodytes
gttttcttctaggatt

SEQ ID NO: 258443 - DNA, 16 bp, P. troglodytes
gttttcttctagttgt

SEQ ID NO: 258444 - DNA, 16 bp, P. troglodytes
gttttcttgctgacct

SEQ ID NO: 258445 - DNA, 16 bp, P. troglodytes
gttttctttctagaaa

SEQ ID NO: 258446 - DNA, 16 bp, P. troglodytes
gttttctttgttgaag

SEQ ID NO: 258447 - DNA, 16 bp, P. troglodytes
gttttcttttaaaaag

SEQ ID NO: 258448 - DNA, 16 bp, P. troglodytes
gttttcttttaaaaat

SEQ ID NO: 258449 - DNA, 16 bp, P. troglodytes
gttttcttttaagaat

SEQ ID NO: 258450 - DNA, 16 bp, P. troglodytes
gttttgaaactctctt

SEQ ID NO: 258451 - DNA, 16 bp, P. troglodytes
gttttgaaaggttatt

SEQ ID NO: 258452 - DNA, 16 bp, P. troglodytes
gttttgaaatatgaaa

SEQ ID NO: 258453 - DNA, 16 bp, P. troglodytes
gttttgacaaatatat

SEQ ID NO: 258454 - DNA, 16 bp, P. troglodytes
gttttgacacaggcat

SEQ ID NO: 258455 - DNA, 16 bp, P. troglodytes
gttttgaggagtactg

SEQ ID NO: 258456 - DNA, 16 bp, P. troglodytes
gttttgagttctttga

SEQ ID NO: 258457 - DNA, 16 bp, P. troglodytes
gttttgatgactatgg

SEQ ID NO: 258458 - DNA, 16 bp, P. troglodytes
gttttgatttacattt

SEQ ID NO: 258459 - DNA, 16 bp, P. troglodytes
gttttgatttgcattt

SEQ ID NO: 258460 - DNA, 16 bp, P. troglodytes
gttttgcaaaataaaa

SEQ ID NO: 258461 - DNA, 16 bp, P. troglodytes
gttttgcagatgagaa

SEQ ID NO: 258462 - DNA, 16 bp, P. troglodytes
gttttgcaggctgtac

SEQ ID NO: 258463 - DNA, 16 bp, P. troglodytes
gttttgccatgttagc

SEQ ID NO: 258464 - DNA, 16 bp, P. troglodytes
gttttgcctttttaaa

SEQ ID NO: 258465 - DNA, 16 bp, P. troglodytes
gttttgctctgttgcc

SEQ ID NO: 258466 - DNA, 16 bp, P. troglodytes
gttttgctcttgtccc

SEQ ID NO: 258467 - DNA, 16 bp, P. troglodytes
gttttgctcttgttcc

SEQ ID NO: 258468 - DNA, 16 bp, P. troglodytes
gttttgctttgcattt

SEQ ID NO: 258469 - DNA, 16 bp, P. troglodytes
gttttgctttttaaat

SEQ ID NO: 258470 - DNA, 16 bp, P. troglodytes
gttttggaggctggaa

SEQ ID NO: 258471 - DNA, 16 bp, P. troglodytes
gttttggatttcttcc

SEQ ID NO: 258472 - DNA, 16 bp, P. troglodytes
gttttggatttcttta

SEQ ID NO: 258473 - DNA, 16 bp, P. troglodytes
gttttggcaggttttg

SEQ ID NO: 258474 - DNA, 16 bp, P. troglodytes
gttttggctgggcgtg

SEQ ID NO: 258475 - DNA, 16 bp, P. troglodytes
gttttgggccacacat

SEQ ID NO: 258476 - DNA, 16 bp, P. troglodytes
gttttggtatcagaat

SEQ ID NO: 258477 - DNA, 16 bp, P. troglodytes
gttttggtttttaaaa

SEQ ID NO: 258478 - DNA, 16 bp, P. troglodytes
gttttgtaaaataaaa

SEQ ID NO: 258479 - DNA, 16 bp, P. troglodytes
gttttgtaaataaagt

SEQ ID NO: 258480 - DNA, 16 bp, P. troglodytes
gttttgtaaatgtctg

SEQ ID NO: 258481 - DNA, 16 bp, P. troglodytes
gttttgtaagaaacca

SEQ ID NO: 258482 - DNA, 16 bp, P. troglodytes
gttttgtcatatctct

SEQ ID NO: 258483 - DNA, 16 bp, P. troglodytes
gttttgtcttttaaaa

SEQ ID NO: 258484 - DNA, 16 bp, P. troglodytes
gttttgtgactggctt

SEQ ID NO: 258485 - DNA, 16 bp, P. troglodytes
gttttgtggaatagaa

SEQ ID NO: 258486 - DNA, 16 bp, P. troglodytes
gttttgttctgtcacc

SEQ ID NO: 258487 - DNA, 16 bp, P. troglodytes
gttttgtttgaaacag

SEQ ID NO: 258488 - DNA, 16 bp, P. troglodytes
gttttgttttcaaaat

SEQ ID NO: 258489 - DNA, 16 bp, P. troglodytes
gttttgtttttgacac

SEQ ID NO: 258490 - DNA, 16 bp, P. troglodytes
gttttgtttttgatac

SEQ ID NO: 258491 - DNA, 16 bp, P. troglodytes
gtttttaaaaacactt

SEQ ID NO: 258492 - DNA, 16 bp, P. troglodytes
gtttttaaaaaggaat

SEQ ID NO: 258493 - DNA, 16 bp, P. troglodytes
gtttttaaaattctta

SEQ ID NO: 258494 - DNA, 16 bp, P. troglodytes
gtttttaaagaaactg

SEQ ID NO: 258495 - DNA, 16 bp, P. troglodytes
gtttttaaaggaaaaa

SEQ ID NO: 258496 - DNA, 16 bp, P. troglodytes
gtttttaaatcctgag

SEQ ID NO: 258497 - DNA, 16 bp, P. troglodytes
gtttttaaatgttttc

SEQ ID NO: 258498 - DNA, 16 bp, P. troglodytes
gtttttaacattttta

SEQ ID NO: 258499 - DNA, 16 bp, P. troglodytes
gtttttaccaaaaatg

SEQ ID NO: 258500 - DNA, 16 bp, P. troglodytes
gtttttacttgcattt

SEQ ID NO: 258501 - DNA, 16 bp, P. troglodytes
gtttttagacttttta

SEQ ID NO: 258502 - DNA, 26 bp, P. troglodytes
gtttttagtagagacggggtttcact

SEQ ID NO: 258503 - DNA, 24 bp, P. troglodytes
gtttttagtagagacggggtttct

SEQ ID NO: 258504 - DNA, 23 bp, P. troglodytes
gtttttagtagagacggggtttt

SEQ ID NO: 258505 - DNA, 16 bp, P. troglodytes
gtttttagtttctgtc

SEQ ID NO: 258506 - DNA, 16 bp, P. troglodytes
gtttttatcaaatttg

SEQ ID NO: 258507 - DNA, 16 bp, P. troglodytes
gtttttatcataaagg

SEQ ID NO: 258508 - DNA, 16 bp, P. troglodytes
gtttttatccattctg

SEQ ID NO: 258509 - DNA, 16 bp, P. troglodytes
gtttttatggaggctt

SEQ ID NO: 258510 - DNA, 16 bp, P. troglodytes
gtttttcaaaaaatta

SEQ ID NO: 258511 - DNA, 16 bp, P. troglodytes
gtttttcaaagggaat

SEQ ID NO: 258512 - DNA, 16 bp, P. troglodytes
gtttttcaacccacac

SEQ ID NO: 258513 - DNA, 16 bp, P. troglodytes
gtttttcataatggtt

SEQ ID NO: 258514 - DNA, 16 bp, P. troglodytes
gtttttccaaactgct

SEQ ID NO: 258515 - DNA, 16 bp, P. troglodytes
gtttttctaaaggaaa

SEQ ID NO: 258516 - DNA, 16 bp, P. troglodytes
gtttttctagttcctt

SEQ ID NO: 258517 - DNA, 16 bp, P. troglodytes
gtttttctgctctggt

SEQ ID NO: 258518 - DNA, 16 bp, P. troglodytes
gtttttctggagaacc

SEQ ID NO: 258519 - DNA, 16 bp, P. troglodytes
gtttttcttaaagcac

SEQ ID NO: 258520 - DNA, 16 bp, P. troglodytes
gtttttcttttaacat

SEQ ID NO: 258521 - DNA, 16 bp, P. troglodytes
gtttttgagaaggagt

SEQ ID NO: 258522 - DNA, 16 bp, P. troglodytes
gtttttgagaatgtgt

SEQ ID NO: 258523 - DNA, 16 bp, P. troglodytes
gtttttgaggaacttc

SEQ ID NO: 258524 - DNA, 16 bp, P. troglodytes
gtttttgcagagatgg

SEQ ID NO: 258525 - DNA, 16 bp, P. troglodytes
gtttttgccattaaaa

SEQ ID NO: 258526 - DNA, 16 bp, P. troglodytes
gtttttgccattactt

SEQ ID NO: 258527 - DNA, 16 bp, P. troglodytes
gtttttgccattgaaa

SEQ ID NO: 258528 - DNA, 16 bp, P. troglodytes
gtttttgcctacattt

SEQ ID NO: 258529 - DNA, 16 bp, P. troglodytes
gtttttgctattgtaa

SEQ ID NO: 258530 - DNA, 16 bp, P. troglodytes
gtttttgggaaacagg

SEQ ID NO: 258531 - DNA, 16 bp, P. troglodytes
gtttttggttacatga

SEQ ID NO: 258532 - DNA, 16 bp, P. troglodytes
gtttttgtgtggacat

SEQ ID NO: 258533 - DNA, 16 bp, P. troglodytes
gtttttgttgcattta

SEQ ID NO: 258534 - DNA, 16 bp, P. troglodytes
gttttttaaaaatctg

SEQ ID NO: 258535 - DNA, 16 bp, P. troglodytes
gttttttaaaattttc

SEQ ID NO: 258536 - DNA, 16 bp, P. troglodytes
gttttttaatctataa

SEQ ID NO: 258537 - DNA, 16 bp, P. troglodytes
gttttttattactgat

SEQ ID NO: 258538 - DNA, 16 bp, P. troglodytes
gttttttctagttctg

SEQ ID NO: 258539 - DNA, 16 bp, P. troglodytes
gttttttgagatggtg

SEQ ID NO: 258540 - DNA, 16 bp, P. troglodytes
gttttttgccttttag

SEQ ID NO: 258541 - DNA, 16 bp, P. troglodytes
gttttttggaattttc

SEQ ID NO: 258542 - DNA, 16 bp, P. troglodytes
gttttttggagacagt

SEQ ID NO: 258543 - DNA, 16 bp, P. troglodytes
gttttttgtagattct

SEQ ID NO: 258544 - DNA, 16 bp, P. troglodytes
gtttttttaaagaaaa

SEQ ID NO: 258545 - DNA, 16 bp, P. troglodytes
gtttttttgagacgga

SEQ ID NO: 258546 - DNA, 18 bp, P. troglodytes
gttttttttgagacggag

SEQ ID NO: 258547 - DNA, 16 bp, P. troglodytes
taaaaaaaagtggggg

SEQ ID NO: 258548 - DNA, 16 bp, P. troglodytes
taaaaaaacttttctt

SEQ ID NO: 258549 - DNA, 16 bp, P. troglodytes
taaaaaaagagtgttt

SEQ ID NO: 258550 - DNA, 16 bp, P. troglodytes
taaaaaaagatgagtt

SEQ ID NO: 258551 - DNA, 16 bp, P. troglodytes
taaaaaaagtccagga

SEQ ID NO: 258552 - DNA, 16 bp, P. troglodytes
taaaaaaataagccag

SEQ ID NO: 258553 - DNA, 16 bp, P. troglodytes
taaaaaactggaaaca

SEQ ID NO: 258554 - DNA, 16 bp, P. troglodytes
taaaaaagatacttgc

SEQ ID NO: 258555 - DNA, 16 bp, P. troglodytes
taaaaaaggaaatatc

SEQ ID NO: 258556 - DNA, 16 bp, P. troglodytes
taaaaaatcaagtttt

SEQ ID NO: 258557 - DNA, 16 bp, P. troglodytes
taaaaaatcaatgtgc

SEQ ID NO: 258558 - DNA, 16 bp, P. troglodytes
taaaaaatgatttgtt

SEQ ID NO: 258559 - DNA, 16 bp, P. troglodytes
taaaaaatgttaatgt

SEQ ID NO: 258560 - DNA, 16 bp, P. troglodytes
taaaaaatgttgagtt

SEQ ID NO: 258561 - DNA, 16 bp, P. troglodytes
taaaaaatgtttccaa

SEQ ID NO: 258562 - DNA, 16 bp, P. troglodytes
taaaaaatgttttgtt

SEQ ID NO: 258563 - DNA, 16 bp, P. troglodytes
taaaaaattaaatgac

SEQ ID NO: 258564 - DNA, 16 bp, P. troglodytes
taaaaaattatccttt

SEQ ID NO: 258565 - DNA, 16 bp, P. troglodytes
taaaaaattcagaaat

SEQ ID NO: 258566 - DNA, 16 bp, P. troglodytes
taaaaaattgttgttt

SEQ ID NO: 258567 - DNA, 16 bp, P. troglodytes
taaaaaattgtttgaa

SEQ ID NO: 258568 - DNA, 16 bp, P. troglodytes
taaaaacacctttaaa

SEQ ID NO: 258569 - DNA, 16 bp, P. troglodytes
taaaaacagaaaatgt

SEQ ID NO: 258570 - DNA, 16 bp, P. troglodytes
taaaaacagatttatt

SEQ ID NO: 258571 - DNA, 16 bp, P. troglodytes
taaaaacagctttaaa

SEQ ID NO: 258572 - DNA, 16 bp, P. troglodytes
taaaaacatacctgag

SEQ ID NO: 258573 - DNA, 16 bp, P. troglodytes
taaaaacattcctttt

SEQ ID NO: 258574 - DNA, 16 bp, P. troglodytes
taaaaacattttactt

SEQ ID NO: 258575 - DNA, 16 bp, P. troglodytes
taaaaacattttcaga

SEQ ID NO: 258576 - DNA, 16 bp, P. troglodytes
taaaaaccacatgatt

SEQ ID NO: 258577 - DNA, 16 bp, P. troglodytes
taaaaaccagtgaatt

SEQ ID NO: 258578 - DNA, 16 bp, P. troglodytes
taaaaaccattcttag

SEQ ID NO: 258579 - DNA, 16 bp, P. troglodytes
taaaaacctgtacaca

SEQ ID NO: 258580 - DNA, 16 bp, P. troglodytes
taaaaactctcaagaa

SEQ ID NO: 258581 - DNA, 16 bp, P. troglodytes
taaaaacttctgttca

SEQ ID NO: 258582 - DNA, 16 bp, P. troglodytes
taaaaacttttgtttt

SEQ ID NO: 258583 - DNA, 16 bp, P. troglodytes
taaaaagaaagcagag

SEQ ID NO: 258584 - DNA, 16 bp, P. troglodytes
taaaaagactgataat

SEQ ID NO: 258585 - DNA, 16 bp, P. troglodytes
taaaaagatgaatttt

SEQ ID NO: 258586 - DNA, 16 bp, P. troglodytes
taaaaagcaaacattt

SEQ ID NO: 258587 - DNA, 16 bp, P. troglodytes
taaaaagcaggaaatt

SEQ ID NO: 258588 - DNA, 16 bp, P. troglodytes
taaaaagcctagaaga

SEQ ID NO: 258589 - DNA, 16 bp, P. troglodytes
taaaaaggaagaaact

SEQ ID NO: 258590 - DNA, 16 bp, P. troglodytes
taaaaaggaatgaact

SEQ ID NO: 258591 - DNA, 16 bp, P. troglodytes
taaaaaggaatgaagt

SEQ ID NO: 258592 - DNA, 16 bp, P. troglodytes
taaaaaggaatgagat

SEQ ID NO: 258593 - DNA, 16 bp, P. troglodytes
taaaaaggatcttatt

SEQ ID NO: 258594 - DNA, 16 bp, P. troglodytes
taaaaaggcatttaaa

SEQ ID NO: 258595 - DNA, 16 bp, P. troglodytes
taaaaaggctttagaa

SEQ ID NO: 258596 - DNA, 16 bp, P. troglodytes
taaaaagggtgaattt

SEQ ID NO: 258597 - DNA, 16 bp, P. troglodytes
taaaaaggtattttat

SEQ ID NO: 258598 - DNA, 16 bp, P. troglodytes
taaaaaggtattttta

SEQ ID NO: 258599 - DNA, 16 bp, P. troglodytes
taaaaagtatctgaaa

SEQ ID NO: 258600 - DNA, 16 bp, P. troglodytes
taaaaagtcaaaattt

SEQ ID NO: 258601 - DNA, 16 bp, P. troglodytes
taaaaagtcaggaaag

SEQ ID NO: 258602 - DNA, 16 bp, P. troglodytes
taaaaagtcattttct

SEQ ID NO: 258603 - DNA, 16 bp, P. troglodytes
taaaaagtggatctca

SEQ ID NO: 258604 - DNA, 16 bp, P. troglodytes
taaaaagtgtgtgtgt

SEQ ID NO: 258605 - DNA, 16 bp, P. troglodytes
taaaaagttaaaatct

SEQ ID NO: 258606 - DNA, 16 bp, P. troglodytes
taaaaagttacaggaa

SEQ ID NO: 258607 - DNA, 16 bp, P. troglodytes
taaaaagttttgtaaa

SEQ ID NO: 258608 - DNA, 16 bp, P. troglodytes
taaaaagttttttctt

SEQ ID NO: 258609 - DNA, 16 bp, P. troglodytes
taaaaataaaagcagt

SEQ ID NO: 258610 - DNA, 16 bp, P. troglodytes
taaaaataaatctgtt

SEQ ID NO: 258611 - DNA, 16 bp, P. troglodytes
taaaaataagaacatt

SEQ ID NO: 258612 - DNA, 16 bp, P. troglodytes
taaaaataagacaatt

SEQ ID NO: 258613 - DNA, 16 bp, P. troglodytes
taaaaataagcttttt

SEQ ID NO: 258614 - DNA, 16 bp, P. troglodytes
taaaaataaggaaact

SEQ ID NO: 258615 - DNA, 16 bp, P. troglodytes
taaaaataagtctttt

SEQ ID NO: 258616 - DNA, 16 bp, P. troglodytes
taaaaataagtgtttt

SEQ ID NO: 258617 - DNA, 16 bp, P. troglodytes
taaaaataatgagatc

SEQ ID NO: 258618 - DNA, 16 bp, P. troglodytes
taaaaatacacatttt

SEQ ID NO: 258619 - DNA, 16 bp, P. troglodytes
taaaaatacagcaaat

SEQ ID NO: 258620 - DNA, 16 bp, P. troglodytes
taaaaatacagtgtaa

SEQ ID NO: 258621 - DNA, 16 bp, P. troglodytes
taaaaatacagtgtta

SEQ ID NO: 258622 - DNA, 16 bp, P. troglodytes
taaaaatactttgaaa

SEQ ID NO: 258623 - DNA, 16 bp, P. troglodytes
taaaaatagaattgcc

SEQ ID NO: 258624 - DNA, 16 bp, P. troglodytes
taaaaatagctttttt

SEQ ID NO: 258625 - DNA, 16 bp, P. troglodytes
taaaaataggatgtgt

SEQ ID NO: 258626 - DNA, 16 bp, P. troglodytes
taaaaataggcaaaag

SEQ ID NO: 258627 - DNA, 16 bp, P. troglodytes
taaaaatatgtactat

SEQ ID NO: 258628 - DNA, 16 bp, P. troglodytes
taaaaatatgtcaaaa

SEQ ID NO: 258629 - DNA, 16 bp, P. troglodytes
taaaaatatgtgtata

SEQ ID NO: 258630 - DNA, 16 bp, P. troglodytes
taaaaatattactcta

SEQ ID NO: 258631 - DNA, 16 bp, P. troglodytes
taaaaatattctggaa

SEQ ID NO: 258632 - DNA, 16 bp, P. troglodytes
taaaaatattctttca

SEQ ID NO: 258633 - DNA, 16 bp, P. troglodytes
taaaaatattgttttg

SEQ ID NO: 258634 - DNA, 16 bp, P. troglodytes
taaaaatattttctgt

SEQ ID NO: 258635 - DNA, 16 bp, P. troglodytes
taaaaatcaaagcaga

SEQ ID NO: 258636 - DNA, 16 bp, P. troglodytes
taaaaatcagattatt

SEQ ID NO: 258637 - DNA, 16 bp, P. troglodytes
taaaaatcaggaaaca

SEQ ID NO: 258638 - DNA, 16 bp, P. troglodytes
taaaaatccacattct

SEQ ID NO: 258639 - DNA, 16 bp, P. troglodytes
taaaaatccattttat

SEQ ID NO: 258640 - DNA, 16 bp, P. troglodytes
taaaaatcttcccaca

SEQ ID NO: 258641 - DNA, 16 bp, P. troglodytes
taaaaatgaaaatgtg

SEQ ID NO: 258642 - DNA, 16 bp, P. troglodytes
taaaaatgaaaattct

SEQ ID NO: 258643 - DNA, 16 bp, P. troglodytes
taaaaatgaaattgtt

SEQ ID NO: 258644 - DNA, 16 bp, P. troglodytes
taaaaatgaagacaca

SEQ ID NO: 258645 - DNA, 16 bp, P. troglodytes
taaaaatgaagcagaa

SEQ ID NO: 258646 - DNA, 16 bp, P. troglodytes
taaaaatgaagttttt

SEQ ID NO: 258647 - DNA, 16 bp, P. troglodytes
taaaaatgaatacata

SEQ ID NO: 258648 - DNA, 16 bp, P. troglodytes
taaaaatgaatgaact

SEQ ID NO: 258649 - DNA, 16 bp, P. troglodytes
taaaaatgagcatttt

SEQ ID NO: 258650 - DNA, 16 bp, P. troglodytes
taaaaatgagtgaaat

SEQ ID NO: 258651 - DNA, 16 bp, P. troglodytes
taaaaatgatgatgat

SEQ ID NO: 258652 - DNA, 16 bp, P. troglodytes
taaaaatgattttctt

SEQ ID NO: 258653 - DNA, 16 bp, P. troglodytes
taaaaatgattttgtt

SEQ ID NO: 258654 - DNA, 16 bp, P. troglodytes
taaaaatgcaaatcaa

SEQ ID NO: 258655 - DNA, 16 bp, P. troglodytes
taaaaatgcaaatgat

SEQ ID NO: 258656 - DNA, 16 bp, P. troglodytes
taaaaatgcaaattct

SEQ ID NO: 258657 - DNA, 16 bp, P. troglodytes
taaaaatgcaattaaa

SEQ ID NO: 258658 - DNA, 16 bp, P. troglodytes
taaaaatgcacacaca

SEQ ID NO: 258659 - DNA, 16 bp, P. troglodytes
taaaaatgcagattct

SEQ ID NO: 258660 - DNA, 16 bp, P. troglodytes
taaaaatgcatttatt

SEQ ID NO: 258661 - DNA, 16 bp, P. troglodytes
taaaaatgctaaaata

SEQ ID NO: 258662 - DNA, 16 bp, P. troglodytes
taaaaatgcttatttt

SEQ ID NO: 258663 - DNA, 16 bp, P. troglodytes
taaaaatgcttttaaa

SEQ ID NO: 258664 - DNA, 16 bp, P. troglodytes
taaaaatggaattact

SEQ ID NO: 258665 - DNA, 16 bp, P. troglodytes
taaaaatggagaaatg

SEQ ID NO: 258666 - DNA, 16 bp, P. troglodytes
taaaaatggcaaagaa

SEQ ID NO: 258667 - DNA, 16 bp, P. troglodytes
taaaaatgggaatttc

SEQ ID NO: 258668 - DNA, 16 bp, P. troglodytes
taaaaatggttaagac

SEQ ID NO: 258669 - DNA, 16 bp, P. troglodytes
taaaaatggttttaaa

SEQ ID NO: 258670 - DNA, 16 bp, P. troglodytes
taaaaatgtaaaactt

SEQ ID NO: 258671 - DNA, 16 bp, P. troglodytes
taaaaatgtacaaatt

SEQ ID NO: 258672 - DNA, 16 bp, P. troglodytes
taaaaatgtattatct

SEQ ID NO: 258673 - DNA, 16 bp, P. troglodytes
taaaaatgtattgaat

SEQ ID NO: 258674 - DNA, 16 bp, P. troglodytes
taaaaatgtatttgaa

SEQ ID NO: 258675 - DNA, 16 bp, P. troglodytes
taaaaatgtattttct

SEQ ID NO: 258676 - DNA, 16 bp, P. troglodytes
taaaaatgtcttcatt

SEQ ID NO: 258677 - DNA, 16 bp, P. troglodytes
taaaaatgtgtagcac

SEQ ID NO: 258678 - DNA, 16 bp, P. troglodytes
taaaaatgtgttaata

SEQ ID NO: 258679 - DNA, 16 bp, P. troglodytes
taaaaatgtgtttata

SEQ ID NO: 258680 - DNA, 16 bp, P. troglodytes
taaaaatgtgttttaa

SEQ ID NO: 258681 - DNA, 16 bp, P. troglodytes
taaaaatgttcccttt

SEQ ID NO: 258682 - DNA, 16 bp, P. troglodytes
taaaaatgttgaattt

SEQ ID NO: 258683 - DNA, 16 bp, P. troglodytes
taaaaatgtttaacat

SEQ ID NO: 258684 - DNA, 16 bp, P. troglodytes
taaaaatgtttacatt

SEQ ID NO: 258685 - DNA, 16 bp, P. troglodytes
taaaaatgtttctata

SEQ ID NO: 258686 - DNA, 16 bp, P. troglodytes
taaaaatgtttgaatt

SEQ ID NO: 258687 - DNA, 16 bp, P. troglodytes
taaaaatgttttaatg

SEQ ID NO: 258688 - DNA, 16 bp, P. troglodytes
taaaaatgtttttctg

SEQ ID NO: 258689 - DNA, 16 bp, P. troglodytes
taaaaattaagaacat

SEQ ID NO: 258690 - DNA, 16 bp, P. troglodytes
taaaaattacagaaat

SEQ ID NO: 258691 - DNA, 16 bp, P. troglodytes
taaaaattactttggg

SEQ ID NO: 258692 - DNA, 16 bp, P. troglodytes
taaaaattatacagaa

SEQ ID NO: 258693 - DNA, 16 bp, P. troglodytes
taaaaattatacagta

SEQ ID NO: 258694 - DNA, 16 bp, P. troglodytes
taaaaattcagaaaat

SEQ ID NO: 258695 - DNA, 16 bp, P. troglodytes
taaaaattctaaaaga

SEQ ID NO: 258696 - DNA, 16 bp, P. troglodytes
taaaaattctagaaaa

SEQ ID NO: 258697 - DNA, 16 bp, P. troglodytes
taaaaattgtcaaaaa

SEQ ID NO: 258698 - DNA, 16 bp, P. troglodytes
taaaaattgtgtttct

SEQ ID NO: 258699 - DNA, 16 bp, P. troglodytes
taaaaattgttttgta

SEQ ID NO: 258700 - DNA, 16 bp, P. troglodytes
taaaaattgtttttct

SEQ ID NO: 258701 - DNA, 16 bp, P. troglodytes
taaaaatttcttttgt

SEQ ID NO: 258702 - DNA, 16 bp, P. troglodytes
taaaaatttttagtag

SEQ ID NO: 258703 - DNA, 16 bp, P. troglodytes
taaaacaaagatgata

SEQ ID NO: 258704 - DNA, 16 bp, P. troglodytes
taaaacaaagtttaaa

SEQ ID NO: 258705 - DNA, 16 bp, P. troglodytes
taaaacaaagttttaa

SEQ ID NO: 258706 - DNA, 16 bp, P. troglodytes
taaaacaaatgtattt

SEQ ID NO: 258707 - DNA, 16 bp, P. troglodytes
taaaacaacacagatt

SEQ ID NO: 258708 - DNA, 16 bp, P. troglodytes
taaaacaacacatatt

SEQ ID NO: 258709 - DNA, 16 bp, P. troglodytes
taaaacaactagagaa

SEQ ID NO: 258710 - DNA, 16 bp, P. troglodytes
taaaacaacttttcaa

SEQ ID NO: 258711 - DNA, 16 bp, P. troglodytes
taaaacaagtacttct

SEQ ID NO: 258712 - DNA, 16 bp, P. troglodytes
taaaacaatagaaatt

SEQ ID NO: 258713 - DNA, 16 bp, P. troglodytes
taaaacaatgtaaatg

SEQ ID NO: 258714 - DNA, 16 bp, P. troglodytes
taaaacaatgttttta

SEQ ID NO: 258715 - DNA, 16 bp, P. troglodytes
taaaacaatttgaaaa

SEQ ID NO: 258716 - DNA, 16 bp, P. troglodytes
taaaacaattttgtaa

SEQ ID NO: 258717 - DNA, 16 bp, P. troglodytes
taaaacacattttctt

SEQ ID NO: 258718 - DNA, 16 bp, P. troglodytes
taaaacaccaaagcaa

SEQ ID NO: 258719 - DNA, 16 bp, P. troglodytes
taaaacactaaaagca

SEQ ID NO: 258720 - DNA, 16 bp, P. troglodytes
taaaacagaaatacca

SEQ ID NO: 258721 - DNA, 16 bp, P. troglodytes
taaaacagaatgagat

SEQ ID NO: 258722 - DNA, 16 bp, P. troglodytes
taaaacagaattataa

SEQ ID NO: 258723 - DNA, 16 bp, P. troglodytes
taaaacagacttgaaa

SEQ ID NO: 258724 - DNA, 16 bp, P. troglodytes
taaaacagcaagagaa

SEQ ID NO: 258725 - DNA, 16 bp, P. troglodytes
taaaacagcagcaaca

SEQ ID NO: 258726 - DNA, 16 bp, P. troglodytes
taaaacaggcagaaaa

SEQ ID NO: 258727 - DNA, 16 bp, P. troglodytes
taaaacagtgcctggc

SEQ ID NO: 258728 - DNA, 16 bp, P. troglodytes
taaaacagtttttttt

SEQ ID NO: 258729 - DNA, 16 bp, P. troglodytes
taaaacataatttttc

SEQ ID NO: 258730 - DNA, 16 bp, P. troglodytes
taaaacatgatgagtt

SEQ ID NO: 258731 - DNA, 16 bp, P. troglodytes
taaaacattaaaaatg

SEQ ID NO: 258732 - DNA, 16 bp, P. troglodytes
taaaacattcaaagaa

SEQ ID NO: 258733 - DNA, 16 bp, P. troglodytes
taaaacattcttttct

SEQ ID NO: 258734 - DNA, 16 bp, P. troglodytes
taaaacatttagaaaa

SEQ ID NO: 258735 - DNA, 16 bp, P. troglodytes
taaaacatttagaaca

SEQ ID NO: 258736 - DNA, 16 bp, P. troglodytes
taaaacatttagtttt

SEQ ID NO: 258737 - DNA, 16 bp, P. troglodytes
taaaacatttctatca

SEQ ID NO: 258738 - DNA, 16 bp, P. troglodytes
taaaacatttgaaatt

SEQ ID NO: 258739 - DNA, 16 bp, P. troglodytes
taaaacatttgttttt

SEQ ID NO: 258740 - DNA, 16 bp, P. troglodytes
taaaacattttagaat

SEQ ID NO: 258741 - DNA, 16 bp, P. troglodytes
taaaacattttatgta

SEQ ID NO: 258742 - DNA, 16 bp, P. troglodytes
taaaacatttttagaa

SEQ ID NO: 258743 - DNA, 16 bp, P. troglodytes
taaaaccactagaaga

SEQ ID NO: 258744 - DNA, 16 bp, P. troglodytes
taaaaccatcagatct

SEQ ID NO: 258745 - DNA, 16 bp, P. troglodytes
taaaaccatttttaaa

SEQ ID NO: 258746 - DNA, 16 bp, P. troglodytes
taaaaccatttttatt

SEQ ID NO: 258747 - DNA, 16 bp, P. troglodytes
taaaacccaggaggca

SEQ ID NO: 258748 - DNA, 16 bp, P. troglodytes
taaaacccatctgatg

SEQ ID NO: 258749 - DNA, 16 bp, P. troglodytes
taaaaccccatctgta

SEQ ID NO: 258750 - DNA, 16 bp, P. troglodytes
taaaaccttttttctt

SEQ ID NO: 258751 - DNA, 16 bp, P. troglodytes
taaaacctttttttct

SEQ ID NO: 258752 - DNA, 16 bp, P. troglodytes
taaaactactagaagg

SEQ ID NO: 258753 - DNA, 16 bp, P. troglodytes
taaaactactagaata

SEQ ID NO: 258754 - DNA, 16 bp, P. troglodytes
taaaactccggtctcc

SEQ ID NO: 258755 - DNA, 16 bp, P. troglodytes
taaaactcctaaaaga

SEQ ID NO: 258756 - DNA, 16 bp, P. troglodytes
taaaactcctagaaga

SEQ ID NO: 258757 - DNA, 16 bp, P. troglodytes
taaaactctattttta

SEQ ID NO: 258758 - DNA, 16 bp, P. troglodytes
taaaactctcagcaaa

SEQ ID NO: 258759 - DNA, 16 bp, P. troglodytes
taaaactctcatctcc

SEQ ID NO: 258760 - DNA, 16 bp, P. troglodytes
taaaactgaaattaaa

SEQ ID NO: 258761 - DNA, 16 bp, P. troglodytes
taaaactgagaaattt

SEQ ID NO: 258762 - DNA, 16 bp, P. troglodytes
taaaactggattgtgg

SEQ ID NO: 258763 - DNA, 16 bp, P. troglodytes
taaaactgtaatcata

SEQ ID NO: 258764 - DNA, 16 bp, P. troglodytes
taaaactgtaattttt

SEQ ID NO: 258765 - DNA, 16 bp, P. troglodytes
taaaactgtattttaa

SEQ ID NO: 258766 - DNA, 16 bp, P. troglodytes
taaaactgttctaaaa

SEQ ID NO: 258767 - DNA, 16 bp, P. troglodytes
taaaacttctttcaaa

SEQ ID NO: 258768 - DNA, 16 bp, P. troglodytes
taaaacttgtatatat

SEQ ID NO: 258769 - DNA, 16 bp, P. troglodytes
taaaactttaaaactt

SEQ ID NO: 258770 - DNA, 16 bp, P. troglodytes
taaaactttactgaaa

SEQ ID NO: 258771 - DNA, 16 bp, P. troglodytes
taaaactttactgaag

SEQ ID NO: 258772 - DNA, 16 bp, P. troglodytes
taaaactttattcaca

SEQ ID NO: 258773 - DNA, 16 bp, P. troglodytes
taaaactttggaaaat

SEQ ID NO: 258774 - DNA, 16 bp, P. troglodytes
taaaacttttaaaact

SEQ ID NO: 258775 - DNA, 16 bp, P. troglodytes
taaaacttttgaaaat

SEQ ID NO: 258776 - DNA, 16 bp, P. troglodytes
taaaagaaaaacttga

SEQ ID NO: 258777 - DNA, 16 bp, P. troglodytes
taaaagaaaaacttta

SEQ ID NO: 258778 - DNA, 16 bp, P. troglodytes
taaaagaaaagacagc

SEQ ID NO: 258779 - DNA, 16 bp, P. troglodytes
taaaagaaacacattt

SEQ ID NO: 258780 - DNA, 16 bp, P. troglodytes
taaaagaaaccagggc

SEQ ID NO: 258781 - DNA, 16 bp, P. troglodytes
taaaagaaatgcttaa

SEQ ID NO: 258782 - DNA, 16 bp, P. troglodytes
taaaagaactacagaa

SEQ ID NO: 258783 - DNA, 16 bp, P. troglodytes
taaaagacaaaatatt

SEQ ID NO: 258784 - DNA, 16 bp, P. troglodytes
taaaagacaaatattt

SEQ ID NO: 258785 - DNA, 16 bp, P. troglodytes
taaaagacaaggaaag

SEQ ID NO: 258786 - DNA, 16 bp, P. troglodytes
taaaagacactcccac

SEQ ID NO: 258787 - DNA, 16 bp, P. troglodytes
taaaagagaagcagag

SEQ ID NO: 258788 - DNA, 16 bp, P. troglodytes
taaaagatacaaaatg

SEQ ID NO: 258789 - DNA, 16 bp, P. troglodytes
taaaagcaaaggcagc

SEQ ID NO: 258790 - DNA, 16 bp, P. troglodytes
taaaagcagctagaga

SEQ ID NO: 258791 - DNA, 16 bp, P. troglodytes
taaaagcattttattt

SEQ ID NO: 258792 - DNA, 16 bp, P. troglodytes
taaaagccctgtctcc

SEQ ID NO: 258793 - DNA, 16 bp, P. troglodytes
taaaagctatctatga

SEQ ID NO: 258794 - DNA, 16 bp, P. troglodytes
taaaagcttatttatt

SEQ ID NO: 258795 - DNA, 16 bp, P. troglodytes
taaaagctttctgagg

SEQ ID NO: 258796 - DNA, 16 bp, P. troglodytes
taaaaggagatttatt

SEQ ID NO: 258797 - DNA, 16 bp, P. troglodytes
taaaaggagttctaaa

SEQ ID NO: 258798 - DNA, 16 bp, P. troglodytes
taaaaggcatttaaaa

SEQ ID NO: 258799 - DNA, 16 bp, P. troglodytes
taaaagggaatgagat

SEQ ID NO: 258800 - DNA, 16 bp, P. troglodytes
taaaagtacaaaactt

SEQ ID NO: 258801 - DNA, 16 bp, P. troglodytes
taaaagtagaaatcaa

SEQ ID NO: 258802 - DNA, 16 bp, P. troglodytes
taaaagtagaactaca

SEQ ID NO: 258803 - DNA, 16 bp, P. troglodytes
taaaagtatacaaaat

SEQ ID NO: 258804 - DNA, 16 bp, P. troglodytes
taaaagtatttttctt

SEQ ID NO: 258805 - DNA, 16 bp, P. troglodytes
taaaagtcatcaccat

SEQ ID NO: 258806 - DNA, 16 bp, P. troglodytes
taaaagtcatttttaa

SEQ ID NO: 258807 - DNA, 16 bp, P. troglodytes
taaaagtcttagaaga

SEQ ID NO: 258808 - DNA, 16 bp, P. troglodytes
taaaagtcttttaaaa

SEQ ID NO: 258809 - DNA, 16 bp, P. troglodytes
taaaagtgctactcca

SEQ ID NO: 258810 - DNA, 16 bp, P. troglodytes
taaaagtgttcctttt

SEQ ID NO: 258811 - DNA, 16 bp, P. troglodytes
taaaagtgttttgaaa

SEQ ID NO: 258812 - DNA, 16 bp, P. troglodytes
taaaagttagttcaaa

SEQ ID NO: 258813 - DNA, 16 bp, P. troglodytes
taaaagttgctgttta

SEQ ID NO: 258814 - DNA, 16 bp, P. troglodytes
taaaagttggaaataa

SEQ ID NO: 258815 - DNA, 16 bp, P. troglodytes
taaaagttggaaattt

SEQ ID NO: 258816 - DNA, 16 bp, P. troglodytes
taaaagtttatttaca

SEQ ID NO: 258817 - DNA, 16 bp, P. troglodytes
taaaagttttctttct

SEQ ID NO: 258818 - DNA, 16 bp, P. troglodytes
taaaagttttgtttgt

SEQ ID NO: 258819 - DNA, 16 bp, P. troglodytes
taaaataaaagcacag

SEQ ID NO: 258820 - DNA, 16 bp, P. troglodytes
taaaataaaataactg

SEQ ID NO: 258821 - DNA, 16 bp, P. troglodytes
taaaataaaatagagc

SEQ ID NO: 258822 - DNA, 16 bp, P. troglodytes
taaaataaaatgactg

SEQ ID NO: 258823 - DNA, 16 bp, P. troglodytes
taaaataaaatgcatg

SEQ ID NO: 258824 - DNA, 16 bp, P. troglodytes
taaaataaaatgcatt

SEQ ID NO: 258825 - DNA, 16 bp, P. troglodytes
taaaataaaggtattt

SEQ ID NO: 258826 - DNA, 16 bp, P. troglodytes
taaaataaatctcttt

SEQ ID NO: 258827 - DNA, 16 bp, P. troglodytes
taaaataactatgaaa

SEQ ID NO: 258828 - DNA, 16 bp, P. troglodytes
taaaataactcattta

SEQ ID NO: 258829 - DNA, 16 bp, P. troglodytes
taaaataactgcaaaa

SEQ ID NO: 258830 - DNA, 16 bp, P. troglodytes
taaaataacttaaaag

SEQ ID NO: 258831 - DNA, 16 bp, P. troglodytes
taaaataagccaagca

SEQ ID NO: 258832 - DNA, 16 bp, P. troglodytes
taaaataagccagaaa

SEQ ID NO: 258833 - DNA, 16 bp, P. troglodytes
taaaataaggctgaga

SEQ ID NO: 258834 - DNA, 16 bp, P. troglodytes
taaaataaggtcatta

SEQ ID NO: 258835 - DNA, 16 bp, P. troglodytes
taaaataataaaagct

SEQ ID NO: 258836 - DNA, 16 bp, P. troglodytes
taaaataatgcctttt

SEQ ID NO: 258837 - DNA, 16 bp, P. troglodytes
taaaataattactact

SEQ ID NO: 258838 - DNA, 16 bp, P. troglodytes
taaaataattattgca

SEQ ID NO: 258839 - DNA, 16 bp, P. troglodytes
taaaataattctttca

SEQ ID NO: 258840 - DNA, 16 bp, P. troglodytes
taaaataattttgcat

SEQ ID NO: 258841 - DNA, 16 bp, P. troglodytes
taaaataattttgtga

SEQ ID NO: 258842 - DNA, 16 bp, P. troglodytes
taaaatacaaatgtct

SEQ ID NO: 258843 - DNA, 16 bp, P. troglodytes
taaaatacagtaaaat

SEQ ID NO: 258844 - DNA, 16 bp, P. troglodytes
taaaatacatgtttat

SEQ ID NO: 258845 - DNA, 16 bp, P. troglodytes
taaaatacattctttt

SEQ ID NO: 258846 - DNA, 16 bp, P. troglodytes
taaaatacatttttga

SEQ ID NO: 258847 - DNA, 16 bp, P. troglodytes
taaaatactgaatttt

SEQ ID NO: 258848 - DNA, 16 bp, P. troglodytes
taaaatactggcaaac

SEQ ID NO: 258849 - DNA, 16 bp, P. troglodytes
taaaatactggcaaat

SEQ ID NO: 258850 - DNA, 16 bp, P. troglodytes
taaaatactgtaaaat

SEQ ID NO: 258851 - DNA, 16 bp, P. troglodytes
taaaatacttaggaat

SEQ ID NO: 258852 - DNA, 16 bp, P. troglodytes
taaaatactttgtttt

SEQ ID NO: 258853 - DNA, 16 bp, P. troglodytes
taaaatagcaaatttt

SEQ ID NO: 258854 - DNA, 16 bp, P. troglodytes
taaaatagggataata

SEQ ID NO: 258855 - DNA, 16 bp, P. troglodytes
taaaatagggatagta

SEQ ID NO: 258856 - DNA, 16 bp, P. troglodytes
taaaatagtttctctt

SEQ ID NO: 258857 - DNA, 16 bp, P. troglodytes
taaaatataaagacat

SEQ ID NO: 258858 - DNA, 16 bp, P. troglodytes
taaaatatacactttt

SEQ ID NO: 258859 - DNA, 16 bp, P. troglodytes
taaaatatatatttgc

SEQ ID NO: 258860 - DNA, 16 bp, P. troglodytes
taaaatatatgttaca

SEQ ID NO: 258861 - DNA, 16 bp, P. troglodytes
taaaatatattcttca

SEQ ID NO: 258862 - DNA, 16 bp, P. troglodytes
taaaatatatttggaa

SEQ ID NO: 258863 - DNA, 16 bp, P. troglodytes
taaaatatgaattttg

SEQ ID NO: 258864 - DNA, 16 bp, P. troglodytes
taaaatatgcattata

SEQ ID NO: 258865 - DNA, 16 bp, P. troglodytes
taaaatatgtaaatca

SEQ ID NO: 258866 - DNA, 16 bp, P. troglodytes
taaaatattagcaagt

SEQ ID NO: 258867 - DNA, 16 bp, P. troglodytes
taaaatattcagtaca

SEQ ID NO: 258868 - DNA, 16 bp, P. troglodytes
taaaatatttaaacag

SEQ ID NO: 258869 - DNA, 16 bp, P. troglodytes
taaaatatttaccatc

SEQ ID NO: 258870 - DNA, 16 bp, P. troglodytes
taaaatatttctggaa

SEQ ID NO: 258871 - DNA, 16 bp, P. troglodytes
taaaatatttggagag

SEQ ID NO: 258872 - DNA, 16 bp, P. troglodytes
taaaatatttgtatgt

SEQ ID NO: 258873 - DNA, 16 bp, P. troglodytes
taaaatattttagatg

SEQ ID NO: 258874 - DNA, 16 bp, P. troglodytes
taaaatattttcacaa

SEQ ID NO: 258875 - DNA, 16 bp, P. troglodytes
taaaatattttcttgt

SEQ ID NO: 258876 - DNA, 16 bp, P. troglodytes
taaaatattttgatga

SEQ ID NO: 258877 - DNA, 16 bp, P. troglodytes
taaaatattttgcaaa

SEQ ID NO: 258878 - DNA, 16 bp, P. troglodytes
taaaatatttttatgg

SEQ ID NO: 258879 - DNA, 16 bp, P. troglodytes
taaaatcaaaacaagt

SEQ ID NO: 258880 - DNA, 16 bp, P. troglodytes
taaaatcaaaatgaat

SEQ ID NO: 258881 - DNA, 16 bp, P. troglodytes
taaaatcagaaattaa

SEQ ID NO: 258882 - DNA, 16 bp, P. troglodytes
taaaatcatgtatttt

SEQ ID NO: 258883 - DNA, 16 bp, P. troglodytes
taaaatcatgttttta

SEQ ID NO: 258884 - DNA, 16 bp, P. troglodytes
taaaatccaaaacttt

SEQ ID NO: 258885 - DNA, 16 bp, P. troglodytes
taaaatccagcatccc

SEQ ID NO: 258886 - DNA, 16 bp, P. troglodytes
taaaatccatacattt

SEQ ID NO: 258887 - DNA, 16 bp, P. troglodytes
taaaatccctggaaga

SEQ ID NO: 258888 - DNA, 16 bp, P. troglodytes
taaaatcctagcactt

SEQ ID NO: 258889 - DNA, 16 bp, P. troglodytes
taaaatcctgtcattt

SEQ ID NO: 258890 - DNA, 16 bp, P. troglodytes
taaaatccttctcaga

SEQ ID NO: 258891 - DNA, 16 bp, P. troglodytes
taaaatctactgtctt

SEQ ID NO: 258892 - DNA, 16 bp, P. troglodytes
taaaatctctctctct

SEQ ID NO: 258893 - DNA, 16 bp, P. troglodytes
taaaatctgattattt

SEQ ID NO: 258894 - DNA, 16 bp, P. troglodytes
taaaatctgtgcattt

SEQ ID NO: 258895 - DNA, 16 bp, P. troglodytes
taaaatgaaaatgttt

SEQ ID NO: 258896 - DNA, 16 bp, P. troglodytes
taaaatgaacttttaa

SEQ ID NO: 258897 - DNA, 16 bp, P. troglodytes
taaaatgaagacattt

SEQ ID NO: 258898 - DNA, 16 bp, P. troglodytes
taaaatgaaggacaaa

SEQ ID NO: 258899 - DNA, 16 bp, P. troglodytes
taaaatgacttctttt

SEQ ID NO: 258900 - DNA, 16 bp, P. troglodytes
taaaatgagaaatttt

SEQ ID NO: 258901 - DNA, 16 bp, P. troglodytes
taaaatgagaattaca

SEQ ID NO: 258902 - DNA, 16 bp, P. troglodytes
taaaatgagatttttt

SEQ ID NO: 258903 - DNA, 16 bp, P. troglodytes
taaaatgaggataata

SEQ ID NO: 258904 - DNA, 16 bp, P. troglodytes
taaaatgaggttaata

SEQ ID NO: 258905 - DNA, 16 bp, P. troglodytes
taaaatgatgtatttt

SEQ ID NO: 258906 - DNA, 16 bp, P. troglodytes
taaaatgatttgggaa

SEQ ID NO: 258907 - DNA, 16 bp, P. troglodytes
taaaatgcaaaactat

SEQ ID NO: 258908 - DNA, 16 bp, P. troglodytes
taaaatgctaaaaata

SEQ ID NO: 258909 - DNA, 16 bp, P. troglodytes
taaaatgctaaaataa

SEQ ID NO: 258910 - DNA, 16 bp, P. troglodytes
taaaatgctaaatatt

SEQ ID NO: 258911 - DNA, 16 bp, P. troglodytes
taaaatgctctaaaat

SEQ ID NO: 258912 - DNA, 16 bp, P. troglodytes
taaaatgctgctgaaa

SEQ ID NO: 258913 - DNA, 16 bp, P. troglodytes
taaaatgctggaatta

SEQ ID NO: 258914 - DNA, 16 bp, P. troglodytes
taaaatgctggcaaac

SEQ ID NO: 258915 - DNA, 16 bp, P. troglodytes
taaaatggaaaatttt

SEQ ID NO: 258916 - DNA, 16 bp, P. troglodytes
taaaatggaaataaca

SEQ ID NO: 258917 - DNA, 16 bp, P. troglodytes
taaaatggaaatacta

SEQ ID NO: 258918 - DNA, 16 bp, P. troglodytes
taaaatggaaattttt

SEQ ID NO: 258919 - DNA, 16 bp, P. troglodytes
taaaatggaattatat

SEQ ID NO: 258920 - DNA, 16 bp, P. troglodytes
taaaatggagataact

SEQ ID NO: 258921 - DNA, 16 bp, P. troglodytes
taaaatggaggtaata

SEQ ID NO: 258922 - DNA, 16 bp, P. troglodytes
taaaatggattttaaa

SEQ ID NO: 258923 - DNA, 16 bp, P. troglodytes
taaaatgggaatcata

SEQ ID NO: 258924 - DNA, 16 bp, P. troglodytes
taaaatgggagtaata

SEQ ID NO: 258925 - DNA, 16 bp, P. troglodytes
taaaatggggaaataa

SEQ ID NO: 258926 - DNA, 16 bp, P. troglodytes
taaaatggggacagta

SEQ ID NO: 258927 - DNA, 16 bp, P. troglodytes
taaaatggggataaca

SEQ ID NO: 258928 - DNA, 16 bp, P. troglodytes
taaaatggggataatt

SEQ ID NO: 258929 - DNA, 16 bp, P. troglodytes
taaaatggggatgaga

SEQ ID NO: 258930 - DNA, 16 bp, P. troglodytes
taaaatggggatgatg

SEQ ID NO: 258931 - DNA, 16 bp, P. troglodytes
taaaatggggatgatt

SEQ ID NO: 258932 - DNA, 16 bp, P. troglodytes
taaaatggggctaaca

SEQ ID NO: 258933 - DNA, 16 bp, P. troglodytes
taaaatggtaatattt

SEQ ID NO: 258934 - DNA, 16 bp, P. troglodytes
taaaatgtaaacattt

SEQ ID NO: 258935 - DNA, 16 bp, P. troglodytes
taaaatgtacagttaa

SEQ ID NO: 258936 - DNA, 16 bp, P. troglodytes
taaaatgtagagtttt

SEQ ID NO: 258937 - DNA, 16 bp, P. troglodytes
taaaatgtataacaaa

SEQ ID NO: 258938 - DNA, 16 bp, P. troglodytes
taaaatgtatgtgtat

SEQ ID NO: 258939 - DNA, 16 bp, P. troglodytes
taaaatgtcattaaat

SEQ ID NO: 258940 - DNA, 16 bp, P. troglodytes
taaaatgtcatttaaa

SEQ ID NO: 258941 - DNA, 16 bp, P. troglodytes
taaaatgtccagaata

SEQ ID NO: 258942 - DNA, 16 bp, P. troglodytes
taaaatgtgtatgaaa

SEQ ID NO: 258943 - DNA, 16 bp, P. troglodytes
taaaatgtgtctttta

SEQ ID NO: 258944 - DNA, 16 bp, P. troglodytes
taaaatgtgtttggaa

SEQ ID NO: 258945 - DNA, 16 bp, P. troglodytes
taaaatgttaagtttt

SEQ ID NO: 258946 - DNA, 16 bp, P. troglodytes
taaaatgttaatatca

SEQ ID NO: 258947 - DNA, 16 bp, P. troglodytes
taaaatgttatcaaat

SEQ ID NO: 258948 - DNA, 16 bp, P. troglodytes
taaaatgttgagatta

SEQ ID NO: 258949 - DNA, 16 bp, P. troglodytes
taaaatgttgggatta

SEQ ID NO: 258950 - DNA, 16 bp, P. troglodytes
taaaatgttgtatatt

SEQ ID NO: 258951 - DNA, 16 bp, P. troglodytes
taaaatgtttaatgaa

SEQ ID NO: 258952 - DNA, 16 bp, P. troglodytes
taaaatgtttaggaat

SEQ ID NO: 258953 - DNA, 16 bp, P. troglodytes
taaaatgtttcattta

SEQ ID NO: 258954 - DNA, 16 bp, P. troglodytes
taaaatgtttgaaatt

SEQ ID NO: 258955 - DNA, 16 bp, P. troglodytes
taaaatgtttggaaaa

SEQ ID NO: 258956 - DNA, 16 bp, P. troglodytes
taaaatgtttgttaaa

SEQ ID NO: 258957 - DNA, 16 bp, P. troglodytes
taaaatgttttcattt

SEQ ID NO: 258958 - DNA, 16 bp, P. troglodytes
taaaatgttttctttt

SEQ ID NO: 258959 - DNA, 16 bp, P. troglodytes
taaaattaaaaactga

SEQ ID NO: 258960 - DNA, 16 bp, P. troglodytes
taaaattaaaatactg

SEQ ID NO: 258961 - DNA, 16 bp, P. troglodytes
taaaattaaatgagca

SEQ ID NO: 258962 - DNA, 16 bp, P. troglodytes
taaaattaaatttctg

SEQ ID NO: 258963 - DNA, 16 bp, P. troglodytes
taaaattaatttcacc

SEQ ID NO: 258964 - DNA, 16 bp, P. troglodytes
taaaattacagaaaat

SEQ ID NO: 258965 - DNA, 16 bp, P. troglodytes
taaaattacagaaatt

SEQ ID NO: 258966 - DNA, 16 bp, P. troglodytes
taaaattaccttcagg

SEQ ID NO: 258967 - DNA, 16 bp, P. troglodytes
taaaattatatttcct

SEQ ID NO: 258968 - DNA, 16 bp, P. troglodytes
taaaattatcagatct

SEQ ID NO: 258969 - DNA, 16 bp, P. troglodytes
taaaattatcctttta

SEQ ID NO: 258970 - DNA, 16 bp, P. troglodytes
taaaattattctgttt

SEQ ID NO: 258971 - DNA, 16 bp, P. troglodytes
taaaattattttgtga

SEQ ID NO: 258972 - DNA, 16 bp, P. troglodytes
taaaattcaacaccca

SEQ ID NO: 258973 - DNA, 16 bp, P. troglodytes
taaaattcacagggaa

SEQ ID NO: 258974 - DNA, 16 bp, P. troglodytes
taaaattcacataaca

SEQ ID NO: 258975 - DNA, 16 bp, P. troglodytes
taaaattcaccatttt

SEQ ID NO: 258976 - DNA, 16 bp, P. troglodytes
taaaattcactatttt

SEQ ID NO: 258977 - DNA, 16 bp, P. troglodytes
taaaattcacttattt

SEQ ID NO: 258978 - DNA, 16 bp, P. troglodytes
taaaattcaggctgag

SEQ ID NO: 258979 - DNA, 16 bp, P. troglodytes
taaaattcatcctttt

SEQ ID NO: 258980 - DNA, 16 bp, P. troglodytes
taaaattcatgtgaaa

SEQ ID NO: 258981 - DNA, 16 bp, P. troglodytes
taaaattcatttgaaa

SEQ ID NO: 258982 - DNA, 16 bp, P. troglodytes
taaaattccattgtat

SEQ ID NO: 258983 - DNA, 16 bp, P. troglodytes
taaaattctattttgt

SEQ ID NO: 258984 - DNA, 16 bp, P. troglodytes
taaaattctgtaattt

SEQ ID NO: 258985 - DNA, 16 bp, P. troglodytes
taaaattctgtctcaa

SEQ ID NO: 258986 - DNA, 16 bp, P. troglodytes
taaaattctgtgattt

SEQ ID NO: 258987 - DNA, 16 bp, P. troglodytes
taaaattcttaaaatg

SEQ ID NO: 258988 - DNA, 16 bp, P. troglodytes
taaaattgacataaaa

SEQ ID NO: 258989 - DNA, 16 bp, P. troglodytes
taaaattgataaacat

SEQ ID NO: 258990 - DNA, 16 bp, P. troglodytes
taaaattgataaacct

SEQ ID NO: 258991 - DNA, 16 bp, P. troglodytes
taaaattgatcatttt

SEQ ID NO: 258992 - DNA, 16 bp, P. troglodytes
taaaattgcacagaac

SEQ ID NO: 258993 - DNA, 16 bp, P. troglodytes
taaaattggattatta

SEQ ID NO: 258994 - DNA, 16 bp, P. troglodytes
taaaattgtacttttt

SEQ ID NO: 258995 - DNA, 16 bp, P. troglodytes
taaaattgttttctct

SEQ ID NO: 258996 - DNA, 16 bp, P. troglodytes
taaaattgttttgaaa

SEQ ID NO: 258997 - DNA, 16 bp, P. troglodytes
taaaattgttttgaat

SEQ ID NO: 258998 - DNA, 16 bp, P. troglodytes
taaaattgtttttcta

SEQ ID NO: 258999 - DNA, 16 bp, P. troglodytes
taaaatttaaaaagca

SEQ ID NO: 259000 - DNA, 16 bp, P. troglodytes
taaaatttaccattta

SEQ ID NO: 259001 - DNA, 16 bp, P. troglodytes
taaaatttaccatttt

SEQ ID NO: 259002 - DNA, 16 bp, P. troglodytes
taaaatttatatggaa

SEQ ID NO: 259003 - DNA, 16 bp, P. troglodytes
taaaatttatttctga

SEQ ID NO: 259004 - DNA, 16 bp, P. troglodytes
taaaatttcaatttct

SEQ ID NO: 259005 - DNA, 16 bp, P. troglodytes
taaaatttccagaaaa

SEQ ID NO: 259006 - DNA, 16 bp, P. troglodytes
taaaatttctcttttg

SEQ ID NO: 259007 - DNA, 16 bp, P. troglodytes
taaaatttctgaaaaa

SEQ ID NO: 259008 - DNA, 16 bp, P. troglodytes
taaaatttctgttctt

SEQ ID NO: 259009 - DNA, 16 bp, P. troglodytes
taaaatttgctatttt

SEQ ID NO: 259010 - DNA, 16 bp, P. troglodytes
taaaatttgtaatttg

SEQ ID NO: 259011 - DNA, 16 bp, P. troglodytes
taaaattttattggaa

SEQ ID NO: 259012 - DNA, 16 bp, P. troglodytes
taaaattttcacattt

SEQ ID NO: 259013 - DNA, 16 bp, P. troglodytes
taaaattttcattttg

SEQ ID NO: 259014 - DNA, 16 bp, P. troglodytes
taaaattttggaaaac

SEQ ID NO: 259015 - DNA, 16 bp, P. troglodytes
taaaattttgtgtaga

SEQ ID NO: 259016 - DNA, 16 bp, P. troglodytes
taaaattttgtttaca

SEQ ID NO: 259017 - DNA, 16 bp, P. troglodytes
taaacaaaaactgaga

SEQ ID NO: 259018 - DNA, 16 bp, P. troglodytes
taaacaaaaatggaat

SEQ ID NO: 259019 - DNA, 16 bp, P. troglodytes
taaacaaaatgtagca

SEQ ID NO: 259020 - DNA, 16 bp, P. troglodytes
taaacaaaggaggttt

SEQ ID NO: 259021 - DNA, 16 bp, P. troglodytes
taaacaaatgaatgaa

SEQ ID NO: 259022 - DNA, 16 bp, P. troglodytes
taaacaaatggaaaac

SEQ ID NO: 259023 - DNA, 16 bp, P. troglodytes
taaacaacagacattt

SEQ ID NO: 259024 - DNA, 16 bp, P. troglodytes
taaacaagtgaacaaa

SEQ ID NO: 259025 - DNA, 16 bp, P. troglodytes
taaacaatgaaccaaa

SEQ ID NO: 259026 - DNA, 16 bp, P. troglodytes
taaacaatgaaccaat

SEQ ID NO: 259027 - DNA, 16 bp, P. troglodytes
taaacacaatgaaata

SEQ ID NO: 259028 - DNA, 16 bp, P. troglodytes
taaacacagaaattga

SEQ ID NO: 259029 - DNA, 16 bp, P. troglodytes
taaacacatcatggag

SEQ ID NO: 259030 - DNA, 16 bp, P. troglodytes
taaacactatgtaaat

SEQ ID NO: 259031 - DNA, 16 bp, P. troglodytes
taaacagaagcaaaga

SEQ ID NO: 259032 - DNA, 16 bp, P. troglodytes
taaacagaattatttg

SEQ ID NO: 259033 - DNA, 16 bp, P. troglodytes
taaacagaattgaaaa

SEQ ID NO: 259034 - DNA, 16 bp, P. troglodytes
taaacagaattttaaa

SEQ ID NO: 259035 - DNA, 16 bp, P. troglodytes
taaacagcaagtaata

SEQ ID NO: 259036 - DNA, 16 bp, P. troglodytes
taaacataaaagctaa

SEQ ID NO: 259037 - DNA, 16 bp, P. troglodytes
taaacataacttttat

SEQ ID NO: 259038 - DNA, 16 bp, P. troglodytes
taaacataatcagaaa

SEQ ID NO: 259039 - DNA, 16 bp, P. troglodytes
taaacatacatgtgcg

SEQ ID NO: 259040 - DNA, 16 bp, P. troglodytes
taaacatactcttact

SEQ ID NO: 259041 - DNA, 16 bp, P. troglodytes
taaacatagaaaatgt

SEQ ID NO: 259042 - DNA, 16 bp, P. troglodytes
taaacatatatgtgca

SEQ ID NO: 259043 - DNA, 16 bp, P. troglodytes
taaacatatgaatgca

SEQ ID NO: 259044 - DNA, 16 bp, P. troglodytes
taaacatatttttaag

SEQ ID NO: 259045 - DNA, 16 bp, P. troglodytes
taaacatcttaaaaag

SEQ ID NO: 259046 - DNA, 16 bp, P. troglodytes
taaacatcttaacaga

SEQ ID NO: 259047 - DNA, 16 bp, P. troglodytes
taaacatcttttcctt

SEQ ID NO: 259048 - DNA, 16 bp, P. troglodytes
taaacatgtaaataaa

SEQ ID NO: 259049 - DNA, 16 bp, P. troglodytes
taaacattcttctcaa

SEQ ID NO: 259050 - DNA, 16 bp, P. troglodytes
taaacattcttttcct

SEQ ID NO: 259051 - DNA, 16 bp, P. troglodytes
taaacattgtttctat

SEQ ID NO: 259052 - DNA, 16 bp, P. troglodytes
taaacattgtttttta

SEQ ID NO: 259053 - DNA, 16 bp, P. troglodytes
taaacatttaaaaatg

SEQ ID NO: 259054 - DNA, 16 bp, P. troglodytes
taaacatttaaagaag

SEQ ID NO: 259055 - DNA, 16 bp, P. troglodytes
taaacatttacatatt

SEQ ID NO: 259056 - DNA, 16 bp, P. troglodytes
taaacatttcttttca

SEQ ID NO: 259057 - DNA, 16 bp, P. troglodytes
taaacatttgtgtaca

SEQ ID NO: 259058 - DNA, 16 bp, P. troglodytes
taaacatttgtgtgca

SEQ ID NO: 259059 - DNA, 16 bp, P. troglodytes
taaacatttgttgaat

SEQ ID NO: 259060 - DNA, 16 bp, P. troglodytes
taaacatttgttttaa

SEQ ID NO: 259061 - DNA, 16 bp, P. troglodytes
taaacattttaaaact

SEQ ID NO: 259062 - DNA, 16 bp, P. troglodytes
taaacattttctgttt

SEQ ID NO: 259063 - DNA, 16 bp, P. troglodytes
taaacattttgatttt

SEQ ID NO: 259064 - DNA, 16 bp, P. troglodytes
taaacatttttctaaa

SEQ ID NO: 259065 - DNA, 16 bp, P. troglodytes
taaacattttttgttt

SEQ ID NO: 259066 - DNA, 16 bp, P. troglodytes
taaaccaacagaaatt

SEQ ID NO: 259067 - DNA, 16 bp, P. troglodytes
taaaccaagaagaaat

SEQ ID NO: 259068 - DNA, 16 bp, P. troglodytes
taaaccacatttattt

SEQ ID NO: 259069 - DNA, 16 bp, P. troglodytes
taaaccagcagtgtaa

SEQ ID NO: 259070 - DNA, 16 bp, P. troglodytes
taaaccaggaagaagt

SEQ ID NO: 259071 - DNA, 16 bp, P. troglodytes
taaacccatcgtaagt

SEQ ID NO: 259072 - DNA, 21 bp, P. troglodytes
taaaccccgtctctactaaaa

SEQ ID NO: 259073 - DNA, 16 bp, P. troglodytes
taaacccctttccttt

SEQ ID NO: 259074 - DNA, 16 bp, P. troglodytes
taaacctcatgaacta

SEQ ID NO: 259075 - DNA, 16 bp, P. troglodytes
taaacctctttatttt

SEQ ID NO: 259076 - DNA, 16 bp, P. troglodytes
taaacctcttttctct

SEQ ID NO: 259077 - DNA, 16 bp, P. troglodytes
taaacctgtttttttt

SEQ ID NO: 259078 - DNA, 16 bp, P. troglodytes
taaacctttcttcttt

SEQ ID NO: 259079 - DNA, 16 bp, P. troglodytes
taaacctttcttttca

SEQ ID NO: 259080 - DNA, 16 bp, P. troglodytes
taaacctttttaaaaa

SEQ ID NO: 259081 - DNA, 16 bp, P. troglodytes
taaacggagtcttgct

SEQ ID NO: 259082 - DNA, 16 bp, P. troglodytes
taaactatagtcaccc

SEQ ID NO: 259083 - DNA, 17 bp, P. troglodytes
taaactcaagagcttct

SEQ ID NO: 259084 - DNA, 16 bp, P. troglodytes
taaactcattttaaaa

SEQ ID NO: 259085 - DNA, 16 bp, P. troglodytes
taaactcctgacctcc

SEQ ID NO: 259086 - DNA, 16 bp, P. troglodytes
taaactgaaatttaaa

SEQ ID NO: 259087 - DNA, 16 bp, P. troglodytes
taaactgaataaaaat

SEQ ID NO: 259088 - DNA, 16 bp, P. troglodytes
taaactgaggctcaga

SEQ ID NO: 259089 - DNA, 16 bp, P. troglodytes
taaactgatttttttc

SEQ ID NO: 259090 - DNA, 16 bp, P. troglodytes
taaactgtacatattt

SEQ ID NO: 259091 - DNA, 16 bp, P. troglodytes
taaactgtggtacatt

SEQ ID NO: 259092 - DNA, 16 bp, P. troglodytes
taaactttaagtcaaa

SEQ ID NO: 259093 - DNA, 16 bp, P. troglodytes
taaactttcttaaaac

SEQ ID NO: 259094 - DNA, 16 bp, P. troglodytes
taaacttttaaagttt

SEQ ID NO: 259095 - DNA, 16 bp, P. troglodytes
taaactttttaaagaa

SEQ ID NO: 259096 - DNA, 16 bp, P. troglodytes
taaagaaaaagaggtt

SEQ ID NO: 259097 - DNA, 16 bp, P. troglodytes
taaagaaaaagatgtt

SEQ ID NO: 259098 - DNA, 16 bp, P. troglodytes
taaagaaaaagtggca

SEQ ID NO: 259099 - DNA, 16 bp, P. troglodytes
taaagaaaaataatct

SEQ ID NO: 259100 - DNA, 16 bp, P. troglodytes
taaagaaaacaatttt

SEQ ID NO: 259101 - DNA, 16 bp, P. troglodytes
taaagaaaacatattt

SEQ ID NO: 259102 - DNA, 16 bp, P. troglodytes
taaagaaaagaagttc

SEQ ID NO: 259103 - DNA, 16 bp, P. troglodytes
taaagaaaagagattt

SEQ ID NO: 259104 - DNA, 16 bp, P. troglodytes
taaagaaaagcatttt

SEQ ID NO: 259105 - DNA, 16 bp, P. troglodytes
taaagaaaaggaattt

SEQ ID NO: 259106 - DNA, 16 bp, P. troglodytes
taaagaaaaggatttt

SEQ ID NO: 259107 - DNA, 16 bp, P. troglodytes
taaagaaaagttattt

SEQ ID NO: 259108 - DNA, 16 bp, P. troglodytes
taaagaaaatggtttt

SEQ ID NO: 259109 - DNA, 16 bp, P. troglodytes
taaagaaaatgttatt

SEQ ID NO: 259110 - DNA, 16 bp, P. troglodytes
taaagaaaatgttttt

SEQ ID NO: 259111 - DNA, 16 bp, P. troglodytes
taaagaaaatttggca

SEQ ID NO: 259112 - DNA, 16 bp, P. troglodytes
taaagaaaatttttag

SEQ ID NO: 259113 - DNA, 16 bp, P. troglodytes
taaagaaacatctgag

SEQ ID NO: 259114 - DNA, 16 bp, P. troglodytes
taaagaaactgaagtt

SEQ ID NO: 259115 - DNA, 16 bp, P. troglodytes
taaagaaagggatgtt

SEQ ID NO: 259116 - DNA, 16 bp, P. troglodytes
taaagaaagtgacttt

SEQ ID NO: 259117 - DNA, 16 bp, P. troglodytes
taaagaaataaaactt

SEQ ID NO: 259118 - DNA, 16 bp, P. troglodytes
taaagaaatactcaag

SEQ ID NO: 259119 - DNA, 16 bp, P. troglodytes
taaagaaatgatctga

SEQ ID NO: 259120 - DNA, 16 bp, P. troglodytes
taaagaaattattcat

SEQ ID NO: 259121 - DNA, 16 bp, P. troglodytes
taaagaaattcctgag

SEQ ID NO: 259122 - DNA, 16 bp, P. troglodytes
taaagaaattgccaaa

SEQ ID NO: 259123 - DNA, 16 bp, P. troglodytes
taaagaaattgtgata

SEQ ID NO: 259124 - DNA, 16 bp, P. troglodytes
taaagaaattgtggca

SEQ ID NO: 259125 - DNA, 16 bp, P. troglodytes
taaagaacaaaaattt

SEQ ID NO: 259126 - DNA, 16 bp, P. troglodytes
taaagaacacttaaaa

SEQ ID NO: 259127 - DNA, 16 bp, P. troglodytes
taaagaactaaaggaa

SEQ ID NO: 259128 - DNA, 16 bp, P. troglodytes
taaagaactagaaaag

SEQ ID NO: 259129 - DNA, 16 bp, P. troglodytes
taaagaactctcagaa

SEQ ID NO: 259130 - DNA, 16 bp, P. troglodytes
taaagaactcttaaaa

SEQ ID NO: 259131 - DNA, 16 bp, P. troglodytes
taaagaactcttacaa

SEQ ID NO: 259132 - DNA, 16 bp, P. troglodytes
taaagaactgagggtc

SEQ ID NO: 259133 - DNA, 16 bp, P. troglodytes
taaagaactgcctgaa

SEQ ID NO: 259134 - DNA, 16 bp, P. troglodytes
taaagaactggaaaag

SEQ ID NO: 259135 - DNA, 16 bp, P. troglodytes
taaagaacttagtcat

SEQ ID NO: 259136 - DNA, 16 bp, P. troglodytes
taaagaacttccttta

SEQ ID NO: 259137 - DNA, 16 bp, P. troglodytes
taaagaactttttaaa

SEQ ID NO: 259138 - DNA, 16 bp, P. troglodytes
taaagaagagagattt

SEQ ID NO: 259139 - DNA, 16 bp, P. troglodytes
taaagaagcacatata

SEQ ID NO: 259140 - DNA, 16 bp, P. troglodytes
taaagaagcagtctgg

SEQ ID NO: 259141 - DNA, 16 bp, P. troglodytes
taaagaagcatgttct

SEQ ID NO: 259142 - DNA, 16 bp, P. troglodytes
taaagaaggaaaatgt

SEQ ID NO: 259143 - DNA, 16 bp, P. troglodytes
taaagaagtaattaag

SEQ ID NO: 259144 - DNA, 16 bp, P. troglodytes
taaagaagttaagtaa

SEQ ID NO: 259145 - DNA, 16 bp, P. troglodytes
taaagaatgttttaaa

SEQ ID NO: 259146 - DNA, 16 bp, P. troglodytes
taaagaattcagaagg

SEQ ID NO: 259147 - DNA, 16 bp, P. troglodytes
taaagaattcttaaaa

SEQ ID NO: 259148 - DNA, 16 bp, P. troglodytes
taaagaattttcaaaa

SEQ ID NO: 259149 - DNA, 16 bp, P. troglodytes
taaagacaaggttttg

SEQ ID NO: 259150 - DNA, 16 bp, P. troglodytes
taaagacaattatttt

SEQ ID NO: 259151 - DNA, 16 bp, P. troglodytes
taaagacacatgcaca

SEQ ID NO: 259152 - DNA, 16 bp, P. troglodytes
taaagacacattcaca

SEQ ID NO: 259153 - DNA, 16 bp, P. troglodytes
taaagacaccttattt

SEQ ID NO: 259154 - DNA, 16 bp, P. troglodytes
taaagacagaatttat

SEQ ID NO: 259155 - DNA, 16 bp, P. troglodytes
taaagacagatgcaca

SEQ ID NO: 259156 - DNA, 16 bp, P. troglodytes
taaagacataactgag

SEQ ID NO: 259157 - DNA, 16 bp, P. troglodytes
taaagaccaaaggtag

SEQ ID NO: 259158 - DNA, 16 bp, P. troglodytes
taaagacccatcagtg

SEQ ID NO: 259159 - DNA, 16 bp, P. troglodytes
taaagaccctgctgat

SEQ ID NO: 259160 - DNA, 16 bp, P. troglodytes
taaagactacaataaa

SEQ ID NO: 259161 - DNA, 16 bp, P. troglodytes
taaagacttaaatgtt

SEQ ID NO: 259162 - DNA, 16 bp, P. troglodytes
taaagactttaaaaat

SEQ ID NO: 259163 - DNA, 16 bp, P. troglodytes
taaagactttaatgta

SEQ ID NO: 259164 - DNA, 16 bp, P. troglodytes
taaagactttttaaat

SEQ ID NO: 259165 - DNA, 16 bp, P. troglodytes
taaagagacatgaaaa

SEQ ID NO: 259166 - DNA, 16 bp, P. troglodytes
taaagagagttcttca

SEQ ID NO: 259167 - DNA, 16 bp, P. troglodytes
taaagagcaaaataac

SEQ ID NO: 259168 - DNA, 16 bp, P. troglodytes
taaagagcttctgcaa

SEQ ID NO: 259169 - DNA, 16 bp, P. troglodytes
taaagagcttttaaaa

SEQ ID NO: 259170 - DNA, 16 bp, P. troglodytes
taaagaggaaactgag

SEQ ID NO: 259171 - DNA, 16 bp, P. troglodytes
taaagaggaagttaaa

SEQ ID NO: 259172 - DNA, 16 bp, P. troglodytes
taaagaggtaattaaa

SEQ ID NO: 259173 - DNA, 16 bp, P. troglodytes
taaagagtttcagttt

SEQ ID NO: 259174 - DNA, 16 bp, P. troglodytes
taaagagtttggattt

SEQ ID NO: 259175 - DNA, 16 bp, P. troglodytes
taaagataaaagcaga

SEQ ID NO: 259176 - DNA, 16 bp, P. troglodytes
taaagatagacaaata

SEQ ID NO: 259177 - DNA, 16 bp, P. troglodytes
taaagatatttttgaa

SEQ ID NO: 259178 - DNA, 16 bp, P. troglodytes
taaagatgaaaacata

SEQ ID NO: 259179 - DNA, 16 bp, P. troglodytes
taaagatggcatttca

SEQ ID NO: 259180 - DNA, 16 bp, P. troglodytes
taaagatggggtcttg

SEQ ID NO: 259181 - DNA, 16 bp, P. troglodytes
taaagatggggtttca

SEQ ID NO: 259182 - DNA, 16 bp, P. troglodytes
taaagatgtaattttt

SEQ ID NO: 259183 - DNA, 16 bp, P. troglodytes
taaagatgttttaaaa

SEQ ID NO: 259184 - DNA, 16 bp, P. troglodytes
taaagattgttttaaa

SEQ ID NO: 259185 - DNA, 16 bp, P. troglodytes
taaagattttaaaact

SEQ ID NO: 259186 - DNA, 16 bp, P. troglodytes
taaagcaaaacatttt

SEQ ID NO: 259187 - DNA, 16 bp, P. troglodytes
taaagcaaaattaaga

SEQ ID NO: 259188 - DNA, 16 bp, P. troglodytes
taaagcaaattatttt

SEQ ID NO: 259189 - DNA, 16 bp, P. troglodytes
taaagcaaccactaaa

SEQ ID NO: 259190 - DNA, 16 bp, P. troglodytes
taaagcaagtcacaca

SEQ ID NO: 259191 - DNA, 16 bp, P. troglodytes
taaagcacagattgct

SEQ ID NO: 259192 - DNA, 16 bp, P. troglodytes
taaagcaccaagcaga

SEQ ID NO: 259193 - DNA, 16 bp, P. troglodytes
taaagcacttagaata

SEQ ID NO: 259194 - DNA, 16 bp, P. troglodytes
taaagcagaaacagct

SEQ ID NO: 259195 - DNA, 16 bp, P. troglodytes
taaagcagatgaccct

SEQ ID NO: 259196 - DNA, 16 bp, P. troglodytes
taaagcagctattata

SEQ ID NO: 259197 - DNA, 16 bp, P. troglodytes
taaagcagtgtttctc

SEQ ID NO: 259198 - DNA, 16 bp, P. troglodytes
taaagcataataataa

SEQ ID NO: 259199 - DNA, 16 bp, P. troglodytes
taaagcataatttaaa

SEQ ID NO: 259200 - DNA, 16 bp, P. troglodytes
taaagcataattttaa

SEQ ID NO: 259201 - DNA, 16 bp, P. troglodytes
taaagcattatttctg

SEQ ID NO: 259202 - DNA, 16 bp, P. troglodytes
taaagccatcctccca

SEQ ID NO: 259203 - DNA, 16 bp, P. troglodytes
taaagccattcaacaa

SEQ ID NO: 259204 - DNA, 16 bp, P. troglodytes
taaagctattaaaata

SEQ ID NO: 259205 - DNA, 16 bp, P. troglodytes
taaagctatttttaaa

SEQ ID NO: 259206 - DNA, 16 bp, P. troglodytes
taaagctgctataaac

SEQ ID NO: 259207 - DNA, 16 bp, P. troglodytes
taaagctgttaaaaaa

SEQ ID NO: 259208 - DNA, 16 bp, P. troglodytes
taaagctgttggaact

SEQ ID NO: 259209 - DNA, 16 bp, P. troglodytes
taaagcttttagaaga

SEQ ID NO: 259210 - DNA, 16 bp, P. troglodytes
taaagcttttttattt

SEQ ID NO: 259211 - DNA, 16 bp, P. troglodytes
taaaggaaaaaatgtt

SEQ ID NO: 259212 - DNA, 16 bp, P. troglodytes
taaaggaaaatattga

SEQ ID NO: 259213 - DNA, 16 bp, P. troglodytes
taaaggaaatactaaa

SEQ ID NO: 259214 - DNA, 16 bp, P. troglodytes
taaaggaaatatttca

SEQ ID NO: 259215 - DNA, 16 bp, P. troglodytes
taaaggaagtccttca

SEQ ID NO: 259216 - DNA, 16 bp, P. troglodytes
taaaggacatgatctt

SEQ ID NO: 259217 - DNA, 16 bp, P. troglodytes
taaaggagaaaaatca

SEQ ID NO: 259218 - DNA, 16 bp, P. troglodytes
taaaggagatcatttt

SEQ ID NO: 259219 - DNA, 16 bp, P. troglodytes
taaaggagattggaag

SEQ ID NO: 259220 - DNA, 16 bp, P. troglodytes
taaaggcattcagttt

SEQ ID NO: 259221 - DNA, 16 bp, P. troglodytes
taaaggccatgtatga

SEQ ID NO: 259222 - DNA, 16 bp, P. troglodytes
taaagggccagacagt

SEQ ID NO: 259223 - DNA, 16 bp, P. troglodytes
taaagggccagagagt

SEQ ID NO: 259224 - DNA, 16 bp, P. troglodytes
taaaggggactttgtt

SEQ ID NO: 259225 - DNA, 16 bp, P. troglodytes
taaagggttggaaaaa

SEQ ID NO: 259226 - DNA, 16 bp, P. troglodytes
taaaggtcttcatcct

SEQ ID NO: 259227 - DNA, 16 bp, P. troglodytes
taaaggtggtgtggac

SEQ ID NO: 259228 - DNA, 16 bp, P. troglodytes
taaagtacatttttaa

SEQ ID NO: 259229 - DNA, 16 bp, P. troglodytes
taaagtaggtactatt

SEQ ID NO: 259230 - DNA, 16 bp, P. troglodytes
taaagtatgtatatat

SEQ ID NO: 259231 - DNA, 16 bp, P. troglodytes
taaagtcaactgatta

SEQ ID NO: 259232 - DNA, 16 bp, P. troglodytes
taaagtgaaaacaaat

SEQ ID NO: 259233 - DNA, 16 bp, P. troglodytes
taaagtgaaagcaagt

SEQ ID NO: 259234 - DNA, 16 bp, P. troglodytes
taaagtgagagacatg

SEQ ID NO: 259235 - DNA, 16 bp, P. troglodytes
taaagtgcagtttaaa

SEQ ID NO: 259236 - DNA, 16 bp, P. troglodytes
taaagtgctaggatta

SEQ ID NO: 259237 - DNA, 16 bp, P. troglodytes
taaagtgctgggatta

SEQ ID NO: 259238 - DNA, 16 bp, P. troglodytes
taaagtggcagtgttt

SEQ ID NO: 259239 - DNA, 16 bp, P. troglodytes
taaagtgtacaagtca

SEQ ID NO: 259240 - DNA, 16 bp, P. troglodytes
taaagtgttttcctga

SEQ ID NO: 259241 - DNA, 16 bp, P. troglodytes
taaagtgtttttaaaa

SEQ ID NO: 259242 - DNA, 16 bp, P. troglodytes
taaagttcttatggaa

SEQ ID NO: 259243 - DNA, 16 bp, P. troglodytes
taaagttgattttaaa

SEQ ID NO: 259244 - DNA, 16 bp, P. troglodytes
taaagttggaatttat

SEQ ID NO: 259245 - DNA, 16 bp, P. troglodytes
taaagtttgagaacca

SEQ ID NO: 259246 - DNA, 16 bp, P. troglodytes
taaagtttgtcaattt

SEQ ID NO: 259247 - DNA, 16 bp, P. troglodytes
taaagtttgttttatc

SEQ ID NO: 259248 - DNA, 16 bp, P. troglodytes
taaagttttactggaa

SEQ ID NO: 259249 - DNA, 16 bp, P. troglodytes
taaagttttatttgaa

SEQ ID NO: 259250 - DNA, 16 bp, P. troglodytes
taaataaaaccatttt

SEQ ID NO: 259251 - DNA, 16 bp, P. troglodytes
taaataaaatctttga

SEQ ID NO: 259252 - DNA, 16 bp, P. troglodytes
taaataaaatgtacat

SEQ ID NO: 259253 - DNA, 16 bp, P. troglodytes
taaataaacaaatgga

SEQ ID NO: 259254 - DNA, 16 bp, P. troglodytes
taaataaacatctttt

SEQ ID NO: 259255 - DNA, 16 bp, P. troglodytes
taaataaagcaaatat

SEQ ID NO: 259256 - DNA, 16 bp, P. troglodytes
taaataaagctgctgt

SEQ ID NO: 259257 - DNA, 16 bp, P. troglodytes
taaataaagttaaaca

SEQ ID NO: 259258 - DNA, 16 bp, P. troglodytes
taaataaataaggcaa

SEQ ID NO: 259259 - DNA, 16 bp, P. troglodytes
taaataaataatgaca

SEQ ID NO: 259260 - DNA, 16 bp, P. troglodytes
taaataaatacacttt

SEQ ID NO: 259261 - DNA, 16 bp, P. troglodytes
taaataaatacatgct

SEQ ID NO: 259262 - DNA, 16 bp, P. troglodytes
taaataaatacatgtt

SEQ ID NO: 259263 - DNA, 16 bp, P. troglodytes
taaataaatacattga

SEQ ID NO: 259264 - DNA, 16 bp, P. troglodytes
taaataaatattcact

SEQ ID NO: 259265 - DNA, 16 bp, P. troglodytes
taaataaatcaagatg

SEQ ID NO: 259266 - DNA, 16 bp, P. troglodytes
taaataaatgaattca

SEQ ID NO: 259267 - DNA, 16 bp, P. troglodytes
taaataaatgcagaga

SEQ ID NO: 259268 - DNA, 16 bp, P. troglodytes
taaataaatggaatca

SEQ ID NO: 259269 - DNA, 16 bp, P. troglodytes
taaataaatggtggta

SEQ ID NO: 259270 - DNA, 16 bp, P. troglodytes
taaataaatgtgtata

SEQ ID NO: 259271 - DNA, 16 bp, P. troglodytes
taaataaatgtgtttt

SEQ ID NO: 259272 - DNA, 16 bp, P. troglodytes
taaataaatgttagtt

SEQ ID NO: 259273 - DNA, 16 bp, P. troglodytes
taaataaattacagta

SEQ ID NO: 259274 - DNA, 16 bp, P. troglodytes
taaataactaaaagta

SEQ ID NO: 259275 - DNA, 16 bp, P. troglodytes
taaataactttaaaag

SEQ ID NO: 259276 - DNA, 16 bp, P. troglodytes
taaataataaaacttg

SEQ ID NO: 259277 - DNA, 16 bp, P. troglodytes
taaataataaagatca

SEQ ID NO: 259278 - DNA, 16 bp, P. troglodytes
taaataatacatttct

SEQ ID NO: 259279 - DNA, 16 bp, P. troglodytes
taaataatagacattt

SEQ ID NO: 259280 - DNA, 16 bp, P. troglodytes
taaataatgcagaaaa

SEQ ID NO: 259281 - DNA, 16 bp, P. troglodytes
taaataatgtgtacat

SEQ ID NO: 259282 - DNA, 16 bp, P. troglodytes
taaataattctaccaa

SEQ ID NO: 259283 - DNA, 16 bp, P. troglodytes
taaataatttgcctaa

SEQ ID NO: 259284 - DNA, 16 bp, P. troglodytes
taaatacaaaaattag

SEQ ID NO: 259285 - DNA, 16 bp, P. troglodytes
taaatacaaaattgca

SEQ ID NO: 259286 - DNA, 16 bp, P. troglodytes
taaatacaaatgcaaa

SEQ ID NO: 259287 - DNA, 16 bp, P. troglodytes
taaatacacacaattt

SEQ ID NO: 259288 - DNA, 16 bp, P. troglodytes
taaatacacatatatt

SEQ ID NO: 259289 - DNA, 16 bp, P. troglodytes
taaatacagattttta

SEQ ID NO: 259290 - DNA, 16 bp, P. troglodytes
taaatacagttttatt

SEQ ID NO: 259291 - DNA, 16 bp, P. troglodytes
taaatacatacatatt

SEQ ID NO: 259292 - DNA, 16 bp, P. troglodytes
taaatacatattttct

SEQ ID NO: 259293 - DNA, 16 bp, P. troglodytes
taaatacatttatgat

SEQ ID NO: 259294 - DNA, 16 bp, P. troglodytes
taaatactacatgttc

SEQ ID NO: 259295 - DNA, 16 bp, P. troglodytes
taaatacttcagtatg

SEQ ID NO: 259296 - DNA, 16 bp, P. troglodytes
taaatagaaaatgaca

SEQ ID NO: 259297 - DNA, 16 bp, P. troglodytes
taaatagaaccaaaga

SEQ ID NO: 259298 - DNA, 16 bp, P. troglodytes
taaatagcaataataa

SEQ ID NO: 259299 - DNA, 16 bp, P. troglodytes
taaatagtttgcaaat

SEQ ID NO: 259300 - DNA, 16 bp, P. troglodytes
taaatagtttttttct

SEQ ID NO: 259301 - DNA, 16 bp, P. troglodytes
taaatataaagataca

SEQ ID NO: 259302 - DNA, 16 bp, P. troglodytes
taaatatacacaattt

SEQ ID NO: 259303 - DNA, 16 bp, P. troglodytes
taaatatataaagcaa

SEQ ID NO: 259304 - DNA, 16 bp, P. troglodytes
taaatatatatgcacc

SEQ ID NO: 259305 - DNA, 16 bp, P. troglodytes
taaatatatattgcat

SEQ ID NO: 259306 - DNA, 16 bp, P. troglodytes
taaatatatgtagttt

SEQ ID NO: 259307 - DNA, 16 bp, P. troglodytes
taaatatatgtgtgta

SEQ ID NO: 259308 - DNA, 16 bp, P. troglodytes
taaatatcctgatttg

SEQ ID NO: 259309 - DNA, 16 bp, P. troglodytes
taaatatctgtttaat

SEQ ID NO: 259310 - DNA, 16 bp, P. troglodytes
taaatatcttttgaat

SEQ ID NO: 259311 - DNA, 16 bp, P. troglodytes
taaatatgctaattac

SEQ ID NO: 259312 - DNA, 16 bp, P. troglodytes
taaatatgtatgtaaa

SEQ ID NO: 259313 - DNA, 16 bp, P. troglodytes
taaatatgttttaaag

SEQ ID NO: 259314 - DNA, 16 bp, P. troglodytes
taaatatgttttctct

SEQ ID NO: 259315 - DNA, 16 bp, P. troglodytes
taaatatgttttgaat

SEQ ID NO: 259316 - DNA, 16 bp, P. troglodytes
taaatattcattcatt

SEQ ID NO: 259317 - DNA, 16 bp, P. troglodytes
taaatattctacaatg

SEQ ID NO: 259318 - DNA, 16 bp, P. troglodytes
taaatatttactatgt

SEQ ID NO: 259319 - DNA, 16 bp, P. troglodytes
taaatatttaggattg

SEQ ID NO: 259320 - DNA, 16 bp, P. troglodytes
taaatatttaggcttt

SEQ ID NO: 259321 - DNA, 16 bp, P. troglodytes
taaatatttattgtct

SEQ ID NO: 259322 - DNA, 16 bp, P. troglodytes
taaatatttcactcca

SEQ ID NO: 259323 - DNA, 16 bp, P. troglodytes
taaatatttccatatt

SEQ ID NO: 259324 - DNA, 16 bp, P. troglodytes
taaatatttctgtgaa

SEQ ID NO: 259325 - DNA, 16 bp, P. troglodytes
taaatatttcttgaaa

SEQ ID NO: 259326 - DNA, 16 bp, P. troglodytes
taaatatttcttgaat

SEQ ID NO: 259327 - DNA, 16 bp, P. troglodytes
taaatatttgaaatgt

SEQ ID NO: 259328 - DNA, 16 bp, P. troglodytes
taaatatttgcagaat

SEQ ID NO: 259329 - DNA, 16 bp, P. troglodytes
taaatatttgcattta

SEQ ID NO: 259330 - DNA, 16 bp, P. troglodytes
taaatatttgctaaat

SEQ ID NO: 259331 - DNA, 16 bp, P. troglodytes
taaatatttgctgaat

SEQ ID NO: 259332 - DNA, 16 bp, P. troglodytes
taaatatttgtgaata

SEQ ID NO: 259333 - DNA, 16 bp, P. troglodytes
taaatatttgttaagt

SEQ ID NO: 259334 - DNA, 16 bp, P. troglodytes
taaatatttgttgaac

SEQ ID NO: 259335 - DNA, 16 bp, P. troglodytes
taaatatttgttgaat

SEQ ID NO: 259336 - DNA, 16 bp, P. troglodytes
taaatatttgttgagt

SEQ ID NO: 259337 - DNA, 16 bp, P. troglodytes
taaatatttgtttaca

SEQ ID NO: 259338 - DNA, 16 bp, P. troglodytes
taaatattttcaaaga

SEQ ID NO: 259339 - DNA, 16 bp, P. troglodytes
taaatattttcaacaa

SEQ ID NO: 259340 - DNA, 16 bp, P. troglodytes
taaatattttctgctt

SEQ ID NO: 259341 - DNA, 16 bp, P. troglodytes
taaatattttgcatat

SEQ ID NO: 259342 - DNA, 16 bp, P. troglodytes
taaatatttttcaagt

SEQ ID NO: 259343 - DNA, 16 bp, P. troglodytes
taaatcaaaagttaga

SEQ ID NO: 259344 - DNA, 16 bp, P. troglodytes
taaatcaatgaataaa

SEQ ID NO: 259345 - DNA, 16 bp, P. troglodytes
taaatcagaatctctg

SEQ ID NO: 259346 - DNA, 16 bp, P. troglodytes
taaatcagaatctgca

SEQ ID NO: 259347 - DNA, 16 bp, P. troglodytes
taaatcaggaagaatt

SEQ ID NO: 259348 - DNA, 16 bp, P. troglodytes
taaatcagtagactga

SEQ ID NO: 259349 - DNA, 16 bp, P. troglodytes
taaatcattcatgaag

SEQ ID NO: 259350 - DNA, 16 bp, P. troglodytes
taaatcattctaccaa

SEQ ID NO: 259351 - DNA, 16 bp, P. troglodytes
taaatcattttcaaaa

SEQ ID NO: 259352 - DNA, 16 bp, P. troglodytes
taaatccaaatactta

SEQ ID NO: 259353 - DNA, 16 bp, P. troglodytes
taaatccagtgacaag

SEQ ID NO: 259354 - DNA, 16 bp, P. troglodytes
taaatctaaaatgatt

SEQ ID NO: 259355 - DNA, 16 bp, P. troglodytes
taaatctaagacttga

SEQ ID NO: 259356 - DNA, 16 bp, P. troglodytes
taaatctatatataga

SEQ ID NO: 259357 - DNA, 17 bp, P. troglodytes
taaatctcatgtcctca

SEQ ID NO: 259358 - DNA, 16 bp, P. troglodytes
taaatctccaaaataa

SEQ ID NO: 259359 - DNA, 16 bp, P. troglodytes
taaatctctctctttt

SEQ ID NO: 259360 - DNA, 16 bp, P. troglodytes
taaatctctttgcttt

SEQ ID NO: 259361 - DNA, 16 bp, P. troglodytes
taaatctggcaaccct

SEQ ID NO: 259362 - DNA, 16 bp, P. troglodytes
taaatctggcaatcct

SEQ ID NO: 259363 - DNA, 16 bp, P. troglodytes
taaatctgttttttaa

SEQ ID NO: 259364 - DNA, 17 bp, P. troglodytes
taaatcttgctgctgct

SEQ ID NO: 259365 - DNA, 16 bp, P. troglodytes
taaatctttaaagaaa

SEQ ID NO: 259366 - DNA, 16 bp, P. troglodytes
taaatctttgttgaat

SEQ ID NO: 259367 - DNA, 16 bp, P. troglodytes
taaatgaaacaagatt

SEQ ID NO: 259368 - DNA, 16 bp, P. troglodytes
taaatgaaatattcat

SEQ ID NO: 259369 - DNA, 16 bp, P. troglodytes
taaatgaaattgattt

SEQ ID NO: 259370 - DNA, 16 bp, P. troglodytes
taaatgaagaggatga

SEQ ID NO: 259371 - DNA, 16 bp, P. troglodytes
taaatgaaggagagat

SEQ ID NO: 259372 - DNA, 16 bp, P. troglodytes
taaatgaatgaatatg

SEQ ID NO: 259373 - DNA, 16 bp, P. troglodytes
taaatgaatgaatgag

SEQ ID NO: 259374 - DNA, 16 bp, P. troglodytes
taaatgaattaagcaa

SEQ ID NO: 259375 - DNA, 16 bp, P. troglodytes
taaatgacagagctgg

SEQ ID NO: 259376 - DNA, 16 bp, P. troglodytes
taaatgacattttaaa

SEQ ID NO: 259377 - DNA, 16 bp, P. troglodytes
taaatgagaaaatgtg

SEQ ID NO: 259378 - DNA, 16 bp, P. troglodytes
taaatgagattgtttt

SEQ ID NO: 259379 - DNA, 16 bp, P. troglodytes
taaatgagtttttaaa

SEQ ID NO: 259380 - DNA, 16 bp, P. troglodytes
taaatgatcaaataaa

SEQ ID NO: 259381 - DNA, 16 bp, P. troglodytes
taaatgatgttgagca

SEQ ID NO: 259382 - DNA, 16 bp, P. troglodytes
taaatgatttgcccaa

SEQ ID NO: 259383 - DNA, 16 bp, P. troglodytes
taaatgcaatttttaa

SEQ ID NO: 259384 - DNA, 16 bp, P. troglodytes
taaatgcatattttat

SEQ ID NO: 259385 - DNA, 16 bp, P. troglodytes
taaatgccactgaatt

SEQ ID NO: 259386 - DNA, 16 bp, P. troglodytes
taaatgcccacataaa

SEQ ID NO: 259387 - DNA, 16 bp, P. troglodytes
taaatgccttcttttg

SEQ ID NO: 259388 - DNA, 16 bp, P. troglodytes
taaatgctcaataaat

SEQ ID NO: 259389 - DNA, 16 bp, P. troglodytes
taaatgctcaataatt

SEQ ID NO: 259390 - DNA, 16 bp, P. troglodytes
taaatgcttgttgaat

SEQ ID NO: 259391 - DNA, 16 bp, P. troglodytes
taaatgctttaagaaa

SEQ ID NO: 259392 - DNA, 16 bp, P. troglodytes
taaatgcttttttaaa

SEQ ID NO: 259393 - DNA, 16 bp, P. troglodytes
taaatggaaagatatg

SEQ ID NO: 259394 - DNA, 16 bp, P. troglodytes
taaatggaaatggaaa

SEQ ID NO: 259395 - DNA, 16 bp, P. troglodytes
taaatggaattatttt

SEQ ID NO: 259396 - DNA, 16 bp, P. troglodytes
taaatggatgggtgga

SEQ ID NO: 259397 - DNA, 16 bp, P. troglodytes
taaatggattgtttgt

SEQ ID NO: 259398 - DNA, 16 bp, P. troglodytes
taaatggattttaaaa

SEQ ID NO: 259399 - DNA, 16 bp, P. troglodytes
taaatggcagaactgg

SEQ ID NO: 259400 - DNA, 16 bp, P. troglodytes
taaatggcattatttt

SEQ ID NO: 259401 - DNA, 16 bp, P. troglodytes
taaatgggagttcatt

SEQ ID NO: 259402 - DNA, 16 bp, P. troglodytes
taaatgggattataca

SEQ ID NO: 259403 - DNA, 16 bp, P. troglodytes
taaatggtaattttaa

SEQ ID NO: 259404 - DNA, 16 bp, P. troglodytes
taaatggtattatgtt

SEQ ID NO: 259405 - DNA, 16 bp, P. troglodytes
taaatggtattgtgtt

SEQ ID NO: 259406 - DNA, 16 bp, P. troglodytes
taaatggttctgggaa

SEQ ID NO: 259407 - DNA, 16 bp, P. troglodytes
taaatggttctgggat

SEQ ID NO: 259408 - DNA, 16 bp, P. troglodytes
taaatggttgaaaaaa

SEQ ID NO: 259409 - DNA, 16 bp, P. troglodytes
taaatgtaaaacacaa

SEQ ID NO: 259410 - DNA, 16 bp, P. troglodytes
taaatgtaaaatgtga

SEQ ID NO: 259411 - DNA, 16 bp, P. troglodytes
taaatgtaaaattcca

SEQ ID NO: 259412 - DNA, 16 bp, P. troglodytes
taaatgtaaaccaaaa

SEQ ID NO: 259413 - DNA, 16 bp, P. troglodytes
taaatgtaatgcattt

SEQ ID NO: 259414 - DNA, 16 bp, P. troglodytes
taaatgtacattttaa

SEQ ID NO: 259415 - DNA, 16 bp, P. troglodytes
taaatgtatacatttt

SEQ ID NO: 259416 - DNA, 16 bp, P. troglodytes
taaatgtatgtattta

SEQ ID NO: 259417 - DNA, 16 bp, P. troglodytes
taaatgtcattaaaat

SEQ ID NO: 259418 - DNA, 16 bp, P. troglodytes
taaatgtcattttaaa

SEQ ID NO: 259419 - DNA, 16 bp, P. troglodytes
taaatgtgaaatgtca

SEQ ID NO: 259420 - DNA, 16 bp, P. troglodytes
taaatgtgtatatgta

SEQ ID NO: 259421 - DNA, 16 bp, P. troglodytes
taaatgtgtatgcacc

SEQ ID NO: 259422 - DNA, 16 bp, P. troglodytes
taaatgtgtttgagtt

SEQ ID NO: 259423 - DNA, 16 bp, P. troglodytes
taaatgttaatttcat

SEQ ID NO: 259424 - DNA, 16 bp, P. troglodytes
taaatgttagtttctt

SEQ ID NO: 259425 - DNA, 16 bp, P. troglodytes
taaatgttatgtatat

SEQ ID NO: 259426 - DNA, 16 bp, P. troglodytes
taaatgttatttttct

SEQ ID NO: 259427 - DNA, 16 bp, P. troglodytes
taaatgttcagtaaat

SEQ ID NO: 259428 - DNA, 16 bp, P. troglodytes
taaatgttcatgaaat

SEQ ID NO: 259429 - DNA, 16 bp, P. troglodytes
taaatgttcccttttc

SEQ ID NO: 259430 - DNA, 16 bp, P. troglodytes
taaatgttctataaat

SEQ ID NO: 259431 - DNA, 16 bp, P. troglodytes
taaatgttctgtaaat

SEQ ID NO: 259432 - DNA, 16 bp, P. troglodytes
taaatgttcttaccac

SEQ ID NO: 259433 - DNA, 16 bp, P. troglodytes
taaatgttgaaaattt

SEQ ID NO: 259434 - DNA, 16 bp, P. troglodytes
taaatgttgtttataa

SEQ ID NO: 259435 - DNA, 16 bp, P. troglodytes
taaatgtttaacaact

SEQ ID NO: 259436 - DNA, 16 bp, P. troglodytes
taaatgtttaacattt

SEQ ID NO: 259437 - DNA, 16 bp, P. troglodytes
taaatgtttacattta

SEQ ID NO: 259438 - DNA, 16 bp, P. troglodytes
taaatgtttcaaaata

SEQ ID NO: 259439 - DNA, 16 bp, P. troglodytes
taaatgtttcattttt

SEQ ID NO: 259440 - DNA, 16 bp, P. troglodytes
taaatgtttcttgaat

SEQ ID NO: 259441 - DNA, 16 bp, P. troglodytes
taaatgtttcttttct

SEQ ID NO: 259442 - DNA, 16 bp, P. troglodytes
taaatgtttgaaatat

SEQ ID NO: 259443 - DNA, 16 bp, P. troglodytes
taaatgttttccaaat

SEQ ID NO: 259444 - DNA, 16 bp, P. troglodytes
taaatgttttccattt

SEQ ID NO: 259445 - DNA, 16 bp, P. troglodytes
taaatgttttctcatt

SEQ ID NO: 259446 - DNA, 16 bp, P. troglodytes
taaatgttttctgaat

SEQ ID NO: 259447 - DNA, 16 bp, P. troglodytes
taaattaaaaatgcat

SEQ ID NO: 259448 - DNA, 16 bp, P. troglodytes
taaattaacagcttat

SEQ ID NO: 259449 - DNA, 16 bp, P. troglodytes
taaattacactttaag

SEQ ID NO: 259450 - DNA, 16 bp, P. troglodytes
taaattacccagtctt

SEQ ID NO: 259451 - DNA, 16 bp, P. troglodytes
taaattagctgggtgt

SEQ ID NO: 259452 - DNA, 16 bp, P. troglodytes
taaattagtacaactg

SEQ ID NO: 259453 - DNA, 16 bp, P. troglodytes
taaattagttcaacca

SEQ ID NO: 259454 - DNA, 16 bp, P. troglodytes
taaattatctcattta

SEQ ID NO: 259455 - DNA, 16 bp, P. troglodytes
taaattatggtaaaat

SEQ ID NO: 259456 - DNA, 16 bp, P. troglodytes
taaattatggtatatt

SEQ ID NO: 259457 - DNA, 16 bp, P. troglodytes
taaattatttcaatct

SEQ ID NO: 259458 - DNA, 16 bp, P. troglodytes
taaattatttcagcaa

SEQ ID NO: 259459 - DNA, 16 bp, P. troglodytes
taaattatttttggaa

SEQ ID NO: 259460 - DNA, 16 bp, P. troglodytes
taaattcacatgcagt

SEQ ID NO: 259461 - DNA, 16 bp, P. troglodytes
taaattcatcatttta

SEQ ID NO: 259462 - DNA, 16 bp, P. troglodytes
taaattcctagaagtg

SEQ ID NO: 259463 - DNA, 16 bp, P. troglodytes
taaattcctttaaaat

SEQ ID NO: 259464 - DNA, 16 bp, P. troglodytes
taaattctctcagctt

SEQ ID NO: 259465 - DNA, 16 bp, P. troglodytes
taaattctgtattttt

SEQ ID NO: 259466 - DNA, 16 bp, P. troglodytes
taaattctgtgaagaa

SEQ ID NO: 259467 - DNA, 16 bp, P. troglodytes
taaattctgtttttaa

SEQ ID NO: 259468 - DNA, 16 bp, P. troglodytes
taaattctttaaagaa

SEQ ID NO: 259469 - DNA, 16 bp, P. troglodytes
taaattctttgccaag

SEQ ID NO: 259470 - DNA, 16 bp, P. troglodytes
taaattgaaaatatca

SEQ ID NO: 259471 - DNA, 16 bp, P. troglodytes
taaattgaatcatata

SEQ ID NO: 259472 - DNA, 16 bp, P. troglodytes
taaattgatttcatga

SEQ ID NO: 259473 - DNA, 16 bp, P. troglodytes
taaattgctgggatta

SEQ ID NO: 259474 - DNA, 16 bp, P. troglodytes
taaattgcttttaatt

SEQ ID NO: 259475 - DNA, 16 bp, P. troglodytes
taaattggaaaatatt

SEQ ID NO: 259476 - DNA, 16 bp, P. troglodytes
taaattggaaagaaag

SEQ ID NO: 259477 - DNA, 16 bp, P. troglodytes
taaattgtatttcttt

SEQ ID NO: 259478 - DNA, 16 bp, P. troglodytes
taaattgttttctgaa

SEQ ID NO: 259479 - DNA, 16 bp, P. troglodytes
taaatttaaaacaaag

SEQ ID NO: 259480 - DNA, 16 bp, P. troglodytes
taaatttaaagaagtt

SEQ ID NO: 259481 - DNA, 16 bp, P. troglodytes
taaatttaaccaagaa

SEQ ID NO: 259482 - DNA, 16 bp, P. troglodytes
taaatttaatgcattt

SEQ ID NO: 259483 - DNA, 16 bp, P. troglodytes
taaatttacagaaaaa

SEQ ID NO: 259484 - DNA, 16 bp, P. troglodytes
taaatttattttgctt

SEQ ID NO: 259485 - DNA, 16 bp, P. troglodytes
taaatttcaaatgtct

SEQ ID NO: 259486 - DNA, 16 bp, P. troglodytes
taaatttcaattgttt

SEQ ID NO: 259487 - DNA, 16 bp, P. troglodytes
taaatttcacatggaa

SEQ ID NO: 259488 - DNA, 16 bp, P. troglodytes
taaatttcagaaaaca

SEQ ID NO: 259489 - DNA, 16 bp, P. troglodytes
taaatttcataaggaa

SEQ ID NO: 259490 - DNA, 16 bp, P. troglodytes
taaatttctagaaaca

SEQ ID NO: 259491 - DNA, 16 bp, P. troglodytes
taaatttctcagtttt

SEQ ID NO: 259492 - DNA, 16 bp, P. troglodytes
taaatttctgattttt

SEQ ID NO: 259493 - DNA, 16 bp, P. troglodytes
taaatttctggaaata

SEQ ID NO: 259494 - DNA, 16 bp, P. troglodytes
taaatttctggttttt

SEQ ID NO: 259495 - DNA, 16 bp, P. troglodytes
taaatttctgtggttt

SEQ ID NO: 259496 - DNA, 16 bp, P. troglodytes
taaatttctgttcatt

SEQ ID NO: 259497 - DNA, 16 bp, P. troglodytes
taaatttctgttgttg

SEQ ID NO: 259498 - DNA, 16 bp, P. troglodytes
taaatttctgttgttt

SEQ ID NO: 259499 - DNA, 16 bp, P. troglodytes
taaatttctgtttatt

SEQ ID NO: 259500 - DNA, 16 bp, P. troglodytes
taaatttgcattttta

SEQ ID NO: 259501 - DNA, 16 bp, P. troglodytes
taaatttgctttaaaa

SEQ ID NO: 259502 - DNA, 16 bp, P. troglodytes
taaatttggaaaatat

SEQ ID NO: 259503 - DNA, 16 bp, P. troglodytes
taaatttggaaaggag

SEQ ID NO: 259504 - DNA, 16 bp, P. troglodytes
taaatttgggaagaat

SEQ ID NO: 259505 - DNA, 16 bp, P. troglodytes
taaattttagaaaaca

SEQ ID NO: 259506 - DNA, 16 bp, P. troglodytes
taaattttatgtggaa

SEQ ID NO: 259507 - DNA, 16 bp, P. troglodytes
taaattttcctttaag

SEQ ID NO: 259508 - DNA, 16 bp, P. troglodytes
taaattttcttttaag

SEQ ID NO: 259509 - DNA, 16 bp, P. troglodytes
taaattttgttttcta

SEQ ID NO: 259510 - DNA, 16 bp, P. troglodytes
taaatttttcattttg

SEQ ID NO: 259511 - DNA, 16 bp, P. troglodytes
taaatttttgttcatt

SEQ ID NO: 259512 - DNA, 16 bp, P. troglodytes
taaatttttgttgact

SEQ ID NO: 259513 - DNA, 16 bp, P. troglodytes
taaattttttgaagaa

SEQ ID NO: 259514 - DNA, 16 bp, P. troglodytes
taaattttttgagaca

SEQ ID NO: 259515 - DNA, 16 bp, P. troglodytes
taacaaaaacagcatg

SEQ ID NO: 259516 - DNA, 16 bp, P. troglodytes
taacaaaagacagatt

SEQ ID NO: 259517 - DNA, 16 bp, P. troglodytes
taacaaaatattttct

SEQ ID NO: 259518 - DNA, 16 bp, P. troglodytes
taacaaaatgaaaagt

SEQ ID NO: 259519 - DNA, 16 bp, P. troglodytes
taacaaacacaaagga

SEQ ID NO: 259520 - DNA, 16 bp, P. troglodytes
taacaaacctacacat

SEQ ID NO: 259521 - DNA, 16 bp, P. troglodytes
taacaaacctgaatgt

SEQ ID NO: 259522 - DNA, 16 bp, P. troglodytes
taacaaatatattcag

SEQ ID NO: 259523 - DNA, 16 bp, P. troglodytes
taacaaatgtatcact

SEQ ID NO: 259524 - DNA, 16 bp, P. troglodytes
taacaacttctaccaa

SEQ ID NO: 259525 - DNA, 16 bp, P. troglodytes
taacaacttgaacatt

SEQ ID NO: 259526 - DNA, 17 bp, P. troglodytes
taacaagagcaaaactc

SEQ ID NO: 259527 - DNA, 16 bp, P. troglodytes
taacaagagtgaaact

SEQ ID NO: 259528 - DNA, 16 bp, P. troglodytes
taacaagccctccagg

SEQ ID NO: 259529 - DNA, 16 bp, P. troglodytes
taacaagtgttggcaa

SEQ ID NO: 259530 - DNA, 16 bp, P. troglodytes
taacaataatgaaaat

SEQ ID NO: 259531 - DNA, 16 bp, P. troglodytes
taacaatagctgatga

SEQ ID NO: 259532 - DNA, 16 bp, P. troglodytes
taacaatcactgcagt

SEQ ID NO: 259533 - DNA, 16 bp, P. troglodytes
taacaatgtttcagtc

SEQ ID NO: 259534 - DNA, 16 bp, P. troglodytes
taacaattctttatat

SEQ ID NO: 259535 - DNA, 16 bp, P. troglodytes
taacaattttaatttc

SEQ ID NO: 259536 - DNA, 16 bp, P. troglodytes
taacaattttgaaata

SEQ ID NO: 259537 - DNA, 16 bp, P. troglodytes
taacaccagcctgggc

SEQ ID NO: 259538 - DNA, 16 bp, P. troglodytes
taacacctaatacaat

SEQ ID NO: 259539 - DNA, 16 bp, P. troglodytes
taacactttatttaca

SEQ ID NO: 259540 - DNA, 16 bp, P. troglodytes
taacagaagaacagaa

SEQ ID NO: 259541 - DNA, 16 bp, P. troglodytes
taacagacccacagct

SEQ ID NO: 259542 - DNA, 16 bp, P. troglodytes
taacagagcgagactt

SEQ ID NO: 259543 - DNA, 16 bp, P. troglodytes
taacagagtaaacaga

SEQ ID NO: 259544 - DNA, 16 bp, P. troglodytes
taacagagtctcactc

SEQ ID NO: 259545 - DNA, 16 bp, P. troglodytes
taacagagtgagactg

SEQ ID NO: 259546 - DNA, 16 bp, P. troglodytes
taacagcagcagcagc

SEQ ID NO: 259547 - DNA, 16 bp, P. troglodytes
taacagccaaaaagta

SEQ ID NO: 259548 - DNA, 16 bp, P. troglodytes
taacaggaaaaaaatg

SEQ ID NO: 259549 - DNA, 16 bp, P. troglodytes
taacaggaggaatttt

SEQ ID NO: 259550 - DNA, 16 bp, P. troglodytes
taacaggccactgacc

SEQ ID NO: 259551 - DNA, 16 bp, P. troglodytes
taacagggaaataact

SEQ ID NO: 259552 - DNA, 16 bp, P. troglodytes
taacaggtttttgaga

SEQ ID NO: 259553 - DNA, 16 bp, P. troglodytes
taacagtgttttaaaa

SEQ ID NO: 259554 - DNA, 16 bp, P. troglodytes
taacagtttaaaaaaa

SEQ ID NO: 259555 - DNA, 16 bp, P. troglodytes
taacataaatgaaaat

SEQ ID NO: 259556 - DNA, 16 bp, P. troglodytes
taacatagtcatttat

SEQ ID NO: 259557 - DNA, 16 bp, P. troglodytes
taacatagtgaaaccc

SEQ ID NO: 259558 - DNA, 17 bp, P. troglodytes
taacatagtgagacccc

SEQ ID NO: 259559 - DNA, 16 bp, P. troglodytes
taacatagtgagacct

SEQ ID NO: 259560 - DNA, 16 bp, P. troglodytes
taacatatataaaatg

SEQ ID NO: 259561 - DNA, 16 bp, P. troglodytes
taacatatatgtatat

SEQ ID NO: 259562 - DNA, 16 bp, P. troglodytes
taacatatccacaggt

SEQ ID NO: 259563 - DNA, 16 bp, P. troglodytes
taacatatttatcacc

SEQ ID NO: 259564 - DNA, 16 bp, P. troglodytes
taacatcagaaaaatt

SEQ ID NO: 259565 - DNA, 16 bp, P. troglodytes
taacatcattattgta

SEQ ID NO: 259566 - DNA, 16 bp, P. troglodytes
taacatctacaatcag

SEQ ID NO: 259567 - DNA, 16 bp, P. troglodytes
taacatctctgaaatc

SEQ ID NO: 259568 - DNA, 16 bp, P. troglodytes
taacatcttgcattgg

SEQ ID NO: 259569 - DNA, 16 bp, P. troglodytes
taacatgaaaatatta

SEQ ID NO: 259570 - DNA, 16 bp, P. troglodytes
taacatgatgttttca

SEQ ID NO: 259571 - DNA, 16 bp, P. troglodytes
taacatgctcctgaat

SEQ ID NO: 259572 - DNA, 17 bp, P. troglodytes
taacatggtaaaaccct

SEQ ID NO: 259573 - DNA, 18 bp, P. troglodytes
taacatggtgaaactccg

SEQ ID NO: 259574 - DNA, 16 bp, P. troglodytes
taacatgtattgagca

SEQ ID NO: 259575 - DNA, 16 bp, P. troglodytes
taacattaaatgtgaa

SEQ ID NO: 259576 - DNA, 16 bp, P. troglodytes
taacattaagaaaaat

SEQ ID NO: 259577 - DNA, 16 bp, P. troglodytes
taacattctcaaaatg

SEQ ID NO: 259578 - DNA, 16 bp, P. troglodytes
taacattcttaaatat

SEQ ID NO: 259579 - DNA, 16 bp, P. troglodytes
taacatttaccatctt

SEQ ID NO: 259580 - DNA, 16 bp, P. troglodytes
taacatttctgaaatt

SEQ ID NO: 259581 - DNA, 16 bp, P. troglodytes
taacattttaacattt

SEQ ID NO: 259582 - DNA, 16 bp, P. troglodytes
taacattttaatttgt

SEQ ID NO: 259583 - DNA, 16 bp, P. troglodytes
taacattttacatatt

SEQ ID NO: 259584 - DNA, 16 bp, P. troglodytes
taacattttatagttt

SEQ ID NO: 259585 - DNA, 16 bp, P. troglodytes
taacattttattatga

SEQ ID NO: 259586 - DNA, 16 bp, P. troglodytes
taacattttcatttct

SEQ ID NO: 259587 - DNA, 16 bp, P. troglodytes
taacattttcctttct

SEQ ID NO: 259588 - DNA, 16 bp, P. troglodytes
taacattttgaaagaa

SEQ ID NO: 259589 - DNA, 16 bp, P. troglodytes
taacattttgctatat

SEQ ID NO: 259590 - DNA, 16 bp, P. troglodytes
taacattttgtatttt

SEQ ID NO: 259591 - DNA, 16 bp, P. troglodytes
taacattttgttattt

SEQ ID NO: 259592 - DNA, 16 bp, P. troglodytes
taacattttgttttaa

SEQ ID NO: 259593 - DNA, 16 bp, P. troglodytes
taacattttttccttc

SEQ ID NO: 259594 - DNA, 16 bp, P. troglodytes
taaccaaaaaccacct

SEQ ID NO: 259595 - DNA, 16 bp, P. troglodytes
taaccaaagaagcaaa

SEQ ID NO: 259596 - DNA, 16 bp, P. troglodytes
taaccaaagaagtgaa

SEQ ID NO: 259597 - DNA, 16 bp, P. troglodytes
taaccaaaggaatata

SEQ ID NO: 259598 - DNA, 16 bp, P. troglodytes
taaccaaataccatct

SEQ ID NO: 259599 - DNA, 16 bp, P. troglodytes
taaccaagaagagaga

SEQ ID NO: 259600 - DNA, 16 bp, P. troglodytes
taaccaaggagtcaaa

SEQ ID NO: 259601 - DNA, 16 bp, P. troglodytes
taaccaatatttattg

SEQ ID NO: 259602 - DNA, 16 bp, P. troglodytes
taaccacctcccaaag

SEQ ID NO: 259603 - DNA, 16 bp, P. troglodytes
taaccacctttctact

SEQ ID NO: 259604 - DNA, 16 bp, P. troglodytes
taaccactgataattc

SEQ ID NO: 259605 - DNA, 16 bp, P. troglodytes
taaccaggagaaaaat

SEQ ID NO: 259606 - DNA, 16 bp, P. troglodytes
taaccaggagtggtgg

SEQ ID NO: 259607 - DNA, 16 bp, P. troglodytes
taaccagggaggtgaa

SEQ ID NO: 259608 - DNA, 16 bp, P. troglodytes
taaccatttttaaagt

SEQ ID NO: 259609 - DNA, 16 bp, P. troglodytes
taaccatttttaagta

SEQ ID NO: 259610 - DNA, 16 bp, P. troglodytes
taacccatttatgctg

SEQ ID NO: 259611 - DNA, 16 bp, P. troglodytes
taaccccattttacaa

SEQ ID NO: 259612 - DNA, 16 bp, P. troglodytes
taacctaaatcatctc

SEQ ID NO: 259613 - DNA, 16 bp, P. troglodytes
taacctaaatgctatt

SEQ ID NO: 259614 - DNA, 16 bp, P. troglodytes
taacctaggaaatact

SEQ ID NO: 259615 - DNA, 16 bp, P. troglodytes
taacctataaagaaaa

SEQ ID NO: 259616 - DNA, 16 bp, P. troglodytes
taacctcaaactccca

SEQ ID NO: 259617 - DNA, 16 bp, P. troglodytes
taacctccgtctcctg

SEQ ID NO: 259618 - DNA, 16 bp, P. troglodytes
taacctctctctctct

SEQ ID NO: 259619 - DNA, 16 bp, P. troglodytes
taacctctctgtgcct

SEQ ID NO: 259620 - DNA, 16 bp, P. troglodytes
taacctctgcctcccg

SEQ ID NO: 259621 - DNA, 16 bp, P. troglodytes
taacctctgcctccta

SEQ ID NO: 259622 - DNA, 16 bp, P. troglodytes
taacctctgtgtgcct

SEQ ID NO: 259623 - DNA, 16 bp, P. troglodytes
taacctctttgtgtct

SEQ ID NO: 259624 - DNA, 16 bp, P. troglodytes
taaccttaattacatc

SEQ ID NO: 259625 - DNA, 16 bp, P. troglodytes
taaccttagcttactg

SEQ ID NO: 259626 - DNA, 16 bp, P. troglodytes
taacctttctgagcct

SEQ ID NO: 259627 - DNA, 16 bp, P. troglodytes
taactaacatttactg

SEQ ID NO: 259628 - DNA, 16 bp, P. troglodytes
taactagatcccattt

SEQ ID NO: 259629 - DNA, 16 bp, P. troglodytes
taactataagtatact

SEQ ID NO: 259630 - DNA, 16 bp, P. troglodytes
taactatagtcatctt

SEQ ID NO: 259631 - DNA, 16 bp, P. troglodytes
taactatcctgaatat

SEQ ID NO: 259632 - DNA, 16 bp, P. troglodytes
taactatttgttgaat

SEQ ID NO: 259633 - DNA, 16 bp, P. troglodytes
taactatttttaaatg

SEQ ID NO: 259634 - DNA, 17 bp, P. troglodytes
taactcaggaatggaaa

SEQ ID NO: 259635 - DNA, 16 bp, P. troglodytes
taactcatgcctgaat

SEQ ID NO: 259636 - DNA, 16 bp, P. troglodytes
taactcatttaatatt

SEQ ID NO: 259637 - DNA, 16 bp, P. troglodytes
taactccaagacacat

SEQ ID NO: 259638 - DNA, 16 bp, P. troglodytes
taactcccatagccct

SEQ ID NO: 259639 - DNA, 16 bp, P. troglodytes
taactctgatgatagt

SEQ ID NO: 259640 - DNA, 16 bp, P. troglodytes
taactgaaatgttgta

SEQ ID NO: 259641 - DNA, 16 bp, P. troglodytes
taactgaaattaaaaa

SEQ ID NO: 259642 - DNA, 16 bp, P. troglodytes
taactgaagatggatt

SEQ ID NO: 259643 - DNA, 16 bp, P. troglodytes
taactgcagcaggagc

SEQ ID NO: 259644 - DNA, 16 bp, P. troglodytes
taactgcatttttaaa

SEQ ID NO: 259645 - DNA, 16 bp, P. troglodytes
taactgccagtcctct

SEQ ID NO: 259646 - DNA, 16 bp, P. troglodytes
taactgccctgctgac

SEQ ID NO: 259647 - DNA, 16 bp, P. troglodytes
taactgcctgtttttc

SEQ ID NO: 259648 - DNA, 16 bp, P. troglodytes
taactgctcaataaat

SEQ ID NO: 259649 - DNA, 16 bp, P. troglodytes
taactgctgttagggg

SEQ ID NO: 259650 - DNA, 16 bp, P. troglodytes
taactgcttaataaat

SEQ ID NO: 259651 - DNA, 16 bp, P. troglodytes
taactggaaaaataaa

SEQ ID NO: 259652 - DNA, 16 bp, P. troglodytes
taactgggcatggtga

SEQ ID NO: 259653 - DNA, 16 bp, P. troglodytes
taactgggtgtggtag

SEQ ID NO: 259654 - DNA, 16 bp, P. troglodytes
taactgtgtgtgtgtg

SEQ ID NO: 259655 - DNA, 16 bp, P. troglodytes
taacttcaatattgtt

SEQ ID NO: 259656 - DNA, 16 bp, P. troglodytes
taacttcatttaaaaa

SEQ ID NO: 259657 - DNA, 16 bp, P. troglodytes
taacttcatttttaaa

SEQ ID NO: 259658 - DNA, 16 bp, P. troglodytes
taacttctctgaggct

SEQ ID NO: 259659 - DNA, 16 bp, P. troglodytes
taacttctctgggcct

SEQ ID NO: 259660 - DNA, 16 bp, P. troglodytes
taacttctctgtgcct

SEQ ID NO: 259661 - DNA, 16 bp, P. troglodytes
taacttcttcctgctg

SEQ ID NO: 259662 - DNA, 16 bp, P. troglodytes
taacttctttcaaaat

SEQ ID NO: 259663 - DNA, 16 bp, P. troglodytes
taacttgagatctttc

SEQ ID NO: 259664 - DNA, 18 bp, P. troglodytes
taacttgatgactatgtg

SEQ ID NO: 259665 - DNA, 16 bp, P. troglodytes
taacttgctgagattt

SEQ ID NO: 259666 - DNA, 16 bp, P. troglodytes
taacttgtcatttaca

SEQ ID NO: 259667 - DNA, 16 bp, P. troglodytes
taactttaaaaaagaa

SEQ ID NO: 259668 - DNA, 16 bp, P. troglodytes
taactttcaaaatatt

SEQ ID NO: 259669 - DNA, 16 bp, P. troglodytes
taactttcttgtactt

SEQ ID NO: 259670 - DNA, 16 bp, P. troglodytes
taacttttatttaagt

SEQ ID NO: 259671 - DNA, 16 bp, P. troglodytes
taacttttatttcagt

SEQ ID NO: 259672 - DNA, 16 bp, P. troglodytes
taacttttctgagcct

SEQ ID NO: 259673 - DNA, 16 bp, P. troglodytes
taactttttaaacatt

SEQ ID NO: 259674 - DNA, 16 bp, P. troglodytes
taactttttaagaaaa

SEQ ID NO: 259675 - DNA, 16 bp, P. troglodytes
taactttttaagaaat

SEQ ID NO: 259676 - DNA, 16 bp, P. troglodytes
taactttttttgtgtg

SEQ ID NO: 259677 - DNA, 16 bp, P. troglodytes
taagaaaaaatgttca

SEQ ID NO: 259678 - DNA, 16 bp, P. troglodytes
taagaaaacatatttt

SEQ ID NO: 259679 - DNA, 16 bp, P. troglodytes
taagaaaacccaattc

SEQ ID NO: 259680 - DNA, 16 bp, P. troglodytes
taagaaaactgaagcc

SEQ ID NO: 259681 - DNA, 16 bp, P. troglodytes
taagaaaatcattttt

SEQ ID NO: 259682 - DNA, 16 bp, P. troglodytes
taagaaaatgacattt

SEQ ID NO: 259683 - DNA, 16 bp, P. troglodytes
taagaaaatgtggccc

SEQ ID NO: 259684 - DNA, 16 bp, P. troglodytes
taagaaaattaacaca

SEQ ID NO: 259685 - DNA, 16 bp, P. troglodytes
taagaaaatttacaaa

SEQ ID NO: 259686 - DNA, 16 bp, P. troglodytes
taagaaacaaatttat

SEQ ID NO: 259687 - DNA, 16 bp, P. troglodytes
taagaaacagaaattt

SEQ ID NO: 259688 - DNA, 16 bp, P. troglodytes
taagaaacttaaattt

SEQ ID NO: 259689 - DNA, 16 bp, P. troglodytes
taagaaacttgaaaaa

SEQ ID NO: 259690 - DNA, 16 bp, P. troglodytes
taagaaacttgcccaa

SEQ ID NO: 259691 - DNA, 16 bp, P. troglodytes
taagaaactttttttt

SEQ ID NO: 259692 - DNA, 16 bp, P. troglodytes
taagaaagcaattcca

SEQ ID NO: 259693 - DNA, 16 bp, P. troglodytes
taagaaagtttatgaa

SEQ ID NO: 259694 - DNA, 16 bp, P. troglodytes
taagaaagttttattt

SEQ ID NO: 259695 - DNA, 16 bp, P. troglodytes
taagaaatacattttt

SEQ ID NO: 259696 - DNA, 16 bp, P. troglodytes
taagaaatatttacaa

SEQ ID NO: 259697 - DNA, 16 bp, P. troglodytes
taagaaatatttctta

SEQ ID NO: 259698 - DNA, 16 bp, P. troglodytes
taagaaatgcatttca

SEQ ID NO: 259699 - DNA, 16 bp, P. troglodytes
taagaaatttggaaaa

SEQ ID NO: 259700 - DNA, 16 bp, P. troglodytes
taagaacattcacatt

SEQ ID NO: 259701 - DNA, 16 bp, P. troglodytes
taagaacattgaaaaa

SEQ ID NO: 259702 - DNA, 16 bp, P. troglodytes
taagaacatttaaaat

SEQ ID NO: 259703 - DNA, 16 bp, P. troglodytes
taagaacttgatttat

SEQ ID NO: 259704 - DNA, 16 bp, P. troglodytes
taagaagaaagtttat

SEQ ID NO: 259705 - DNA, 16 bp, P. troglodytes
taagaagacatgacaa

SEQ ID NO: 259706 - DNA, 16 bp, P. troglodytes
taagaatacagtatat

SEQ ID NO: 259707 - DNA, 16 bp, P. troglodytes
taagaatatagcatat

SEQ ID NO: 259708 - DNA, 16 bp, P. troglodytes
taagaattttcaaaat

SEQ ID NO: 259709 - DNA, 16 bp, P. troglodytes
taagacaaaaattgtt

SEQ ID NO: 259710 - DNA, 16 bp, P. troglodytes
taagacatatatatat

SEQ ID NO: 259711 - DNA, 16 bp, P. troglodytes
taagacatttattttt

SEQ ID NO: 259712 - DNA, 16 bp, P. troglodytes
taagaccatgggaaaa

SEQ ID NO: 259713 - DNA, 16 bp, P. troglodytes
taagacctcaaaccat

SEQ ID NO: 259714 - DNA, 16 bp, P. troglodytes
taagacctcaaactat

SEQ ID NO: 259715 - DNA, 16 bp, P. troglodytes
taagacctgaaactgt

SEQ ID NO: 259716 - DNA, 16 bp, P. troglodytes
taagaccttgtctcta

SEQ ID NO: 259717 - DNA, 16 bp, P. troglodytes
taagacggagtcttgc

SEQ ID NO: 259718 - DNA, 16 bp, P. troglodytes
taagacttcaaaagaa

SEQ ID NO: 259719 - DNA, 16 bp, P. troglodytes
taagagaagacaacac

SEQ ID NO: 259720 - DNA, 16 bp, P. troglodytes
taagagatatttttaa

SEQ ID NO: 259721 - DNA, 16 bp, P. troglodytes
taagagcgaaactctg

SEQ ID NO: 259722 - DNA, 16 bp, P. troglodytes
taagagctgtgagaca

SEQ ID NO: 259723 - DNA, 16 bp, P. troglodytes
taagaggattgcttga

SEQ ID NO: 259724 - DNA, 16 bp, P. troglodytes
taagagggaggcagga

SEQ ID NO: 259725 - DNA, 16 bp, P. troglodytes
taagatagatagatag

SEQ ID NO: 259726 - DNA, 16 bp, P. troglodytes
taagatcacatcatct

SEQ ID NO: 259727 - DNA, 16 bp, P. troglodytes
taagatcagaaacaaa

SEQ ID NO: 259728 - DNA, 17 bp, P. troglodytes
taagatccactggcttg

SEQ ID NO: 259729 - DNA, 16 bp, P. troglodytes
taagatgattattttg

SEQ ID NO: 259730 - DNA, 16 bp, P. troglodytes
taagatgattttttaa

SEQ ID NO: 259731 - DNA, 16 bp, P. troglodytes
taagatgcacattttt

SEQ ID NO: 259732 - DNA, 16 bp, P. troglodytes
taagatggtaaatgtt

SEQ ID NO: 259733 - DNA, 16 bp, P. troglodytes
taagatgtgtcttgct

SEQ ID NO: 259734 - DNA, 16 bp, P. troglodytes
taagatgttaattgta

SEQ ID NO: 259735 - DNA, 16 bp, P. troglodytes
taagattttctatata

SEQ ID NO: 259736 - DNA, 16 bp, P. troglodytes
taagatttttctttct

SEQ ID NO: 259737 - DNA, 16 bp, P. troglodytes
taagattttttttcta

SEQ ID NO: 259738 - DNA, 16 bp, P. troglodytes
taagcaaaaagagcaa

SEQ ID NO: 259739 - DNA, 16 bp, P. troglodytes
taagcaaaaggaagaa

SEQ ID NO: 259740 - DNA, 16 bp, P. troglodytes
taagcaaaagggaaaa

SEQ ID NO: 259741 - DNA, 16 bp, P. troglodytes
taagcaaagtgttgaa

SEQ ID NO: 259742 - DNA, 16 bp, P. troglodytes
taagcaagtcacttaa

SEQ ID NO: 259743 - DNA, 16 bp, P. troglodytes
taagcaatgcatgact

SEQ ID NO: 259744 - DNA, 17 bp, P. troglodytes
taagcactcaataaatg

SEQ ID NO: 259745 - DNA, 16 bp, P. troglodytes
taagcactttacacat

SEQ ID NO: 259746 - DNA, 16 bp, P. troglodytes
taagcagagagatgga

SEQ ID NO: 259747 - DNA, 16 bp, P. troglodytes
taagcagggcaggaga

SEQ ID NO: 259748 - DNA, 16 bp, P. troglodytes
taagcagtttttaaaa

SEQ ID NO: 259749 - DNA, 16 bp, P. troglodytes
taagcatagaaaaggt

SEQ ID NO: 259750 - DNA, 16 bp, P. troglodytes
taagcatcttttcttt

SEQ ID NO: 259751 - DNA, 16 bp, P. troglodytes
taagcattattttaaa

SEQ ID NO: 259752 - DNA, 16 bp, P. troglodytes
taagcatttattttta

SEQ ID NO: 259753 - DNA, 16 bp, P. troglodytes
taagccaccagtctat

SEQ ID NO: 259754 - DNA, 16 bp, P. troglodytes
taagccaccatgcctg

SEQ ID NO: 259755 - DNA, 16 bp, P. troglodytes
taagccacctagtcta

SEQ ID NO: 259756 - DNA, 16 bp, P. troglodytes
taagccactgtgcttg

SEQ ID NO: 259757 - DNA, 16 bp, P. troglodytes
taagccactgttattt

SEQ ID NO: 259758 - DNA, 16 bp, P. troglodytes
taagccagaagagatt

SEQ ID NO: 259759 - DNA, 16 bp, P. troglodytes
taagccagacattaaa

SEQ ID NO: 259760 - DNA, 16 bp, P. troglodytes
taagccagctgcagaa

SEQ ID NO: 259761 - DNA, 28 bp, P. troglodytes
taagccatcatatcccctgtgacctgca

SEQ ID NO: 259762 - DNA, 16 bp, P. troglodytes
taagccccaagccttg

SEQ ID NO: 259763 - DNA, 16 bp, P. troglodytes
taagccgggcatggtg

SEQ ID NO: 259764 - DNA, 16 bp, P. troglodytes
taagccgggcgtggtg

SEQ ID NO: 259765 - DNA, 16 bp, P. troglodytes
taagcctcaatttcct

SEQ ID NO: 259766 - DNA, 16 bp, P. troglodytes
taagcctcagctttct

SEQ ID NO: 259767 - DNA, 16 bp, P. troglodytes
taagcgattctcctgt

SEQ ID NO: 259768 - DNA, 16 bp, P. troglodytes
taagcggctggcagag

SEQ ID NO: 259769 - DNA, 16 bp, P. troglodytes
taagctataggaggag

SEQ ID NO: 259770 - DNA, 16 bp, P. troglodytes
taagctatgagaacac

SEQ ID NO: 259771 - DNA, 19 bp, P. troglodytes
taagctatgaggatgcaaa

SEQ ID NO: 259772 - DNA, 16 bp, P. troglodytes
taagctatttaaaaat

SEQ ID NO: 259773 - DNA, 16 bp, P. troglodytes
taagctccaggaaggc

SEQ ID NO: 259774 - DNA, 16 bp, P. troglodytes
taagctcccacttata

SEQ ID NO: 259775 - DNA, 16 bp, P. troglodytes
taagcttaatgaggaa

SEQ ID NO: 259776 - DNA, 16 bp, P. troglodytes
taagcttcagtttcct

SEQ ID NO: 259777 - DNA, 16 bp, P. troglodytes
taagcttcagttttct

SEQ ID NO: 259778 - DNA, 16 bp, P. troglodytes
taagctttagtttcct

SEQ ID NO: 259779 - DNA, 16 bp, P. troglodytes
taagcttttaaaatat

SEQ ID NO: 259780 - DNA, 16 bp, P. troglodytes
taagcttttttcatat

SEQ ID NO: 259781 - DNA, 16 bp, P. troglodytes
taaggaaacagaggct

SEQ ID NO: 259782 - DNA, 16 bp, P. troglodytes
taaggaaactgaaaaa

SEQ ID NO: 259783 - DNA, 16 bp, P. troglodytes
taaggaaagaagctat

SEQ ID NO: 259784 - DNA, 16 bp, P. troglodytes
taaggaaagagaacaa

SEQ ID NO: 259785 - DNA, 16 bp, P. troglodytes
taaggaactgaatttt

SEQ ID NO: 259786 - DNA, 16 bp, P. troglodytes
taaggaacttaaaaca

SEQ ID NO: 259787 - DNA, 16 bp, P. troglodytes
taaggaagaatttttt

SEQ ID NO: 259788 - DNA, 16 bp, P. troglodytes
taaggaagaggagttg

SEQ ID NO: 259789 - DNA, 16 bp, P. troglodytes
taaggaatacaataaa

SEQ ID NO: 259790 - DNA, 16 bp, P. troglodytes
taaggaatattgactc

SEQ ID NO: 259791 - DNA, 16 bp, P. troglodytes
taaggaatgtgggaag

SEQ ID NO: 259792 - DNA, 16 bp, P. troglodytes
taaggacacacacaca

SEQ ID NO: 259793 - DNA, 16 bp, P. troglodytes
taaggacaccagtcat

SEQ ID NO: 259794 - DNA, 16 bp, P. troglodytes
taaggaggagtttccc

SEQ ID NO: 259795 - DNA, 16 bp, P. troglodytes
taaggagtgtgtgtgt

SEQ ID NO: 259796 - DNA, 16 bp, P. troglodytes
taaggataaggataag

SEQ ID NO: 259797 - DNA, 16 bp, P. troglodytes
taaggattttcttttt

SEQ ID NO: 259798 - DNA, 16 bp, P. troglodytes
taaggcaaaaataatt

SEQ ID NO: 259799 - DNA, 16 bp, P. troglodytes
taaggcaaatgctgag

SEQ ID NO: 259800 - DNA, 16 bp, P. troglodytes
taaggcagcagtcccc

SEQ ID NO: 259801 - DNA, 16 bp, P. troglodytes
taaggcagtggttctc

SEQ ID NO: 259802 - DNA, 16 bp, P. troglodytes
taaggcattttgttat

SEQ ID NO: 259803 - DNA, 16 bp, P. troglodytes
taaggctggatgcagt

SEQ ID NO: 259804 - DNA, 16 bp, P. troglodytes
taaggctgttttacag

SEQ ID NO: 259805 - DNA, 16 bp, P. troglodytes
taaggctgttttgctt

SEQ ID NO: 259806 - DNA, 16 bp, P. troglodytes
taagggaaataaatca

SEQ ID NO: 259807 - DNA, 16 bp, P. troglodytes
taagggcaggagaaga

SEQ ID NO: 259808 - DNA, 16 bp, P. troglodytes
taagggccgggcacgg

SEQ ID NO: 259809 - DNA, 16 bp, P. troglodytes
taaggggattttaagt

SEQ ID NO: 259810 - DNA, 16 bp, P. troglodytes
taaggggcttttcccc

SEQ ID NO: 259811 - DNA, 16 bp, P. troglodytes
taaggggcttttccct

SEQ ID NO: 259812 - DNA, 16 bp, P. troglodytes
taaggtaaaatgaggt

SEQ ID NO: 259813 - DNA, 16 bp, P. troglodytes
taaggtaatatattca

SEQ ID NO: 259814 - DNA, 17 bp, P. troglodytes
taaggtcagaatcttct

SEQ ID NO: 259815 - DNA, 16 bp, P. troglodytes
taaggtgagaggattg

SEQ ID NO: 259816 - DNA, 16 bp, P. troglodytes
taaggtgatcctccca

SEQ ID NO: 259817 - DNA, 16 bp, P. troglodytes
taaggtgggaagatca

SEQ ID NO: 259818 - DNA, 21 bp, P. troglodytes
taaggtgggtggatcacttga

SEQ ID NO: 259819 - DNA, 16 bp, P. troglodytes
taaggttggtgcaaaa

SEQ ID NO: 259820 - DNA, 16 bp, P. troglodytes
taaggttttattaaaa

SEQ ID NO: 259821 - DNA, 16 bp, P. troglodytes
taagtaaaataagcca

SEQ ID NO: 259822 - DNA, 16 bp, P. troglodytes
taagtaaaataagtca

SEQ ID NO: 259823 - DNA, 16 bp, P. troglodytes
taagtaacttgcctaa

SEQ ID NO: 259824 - DNA, 16 bp, P. troglodytes
taagtaacttggccaa

SEQ ID NO: 259825 - DNA, 16 bp, P. troglodytes
taagtaatctagagat

SEQ ID NO: 259826 - DNA, 16 bp, P. troglodytes
taagtactcaagaaat

SEQ ID NO: 259827 - DNA, 16 bp, P. troglodytes
taagtagcagagccag

SEQ ID NO: 259828 - DNA, 16 bp, P. troglodytes
taagtattcaataaat

SEQ ID NO: 259829 - DNA, 16 bp, P. troglodytes
taagtatttaattcat

SEQ ID NO: 259830 - DNA, 16 bp, P. troglodytes
taagtatttttaaatg

SEQ ID NO: 259831 - DNA, 16 bp, P. troglodytes
taagtcaaaccattgt

SEQ ID NO: 259832 - DNA, 16 bp, P. troglodytes
taagtcaccagctgca

SEQ ID NO: 259833 - DNA, 16 bp, P. troglodytes
taagtctcagtttctt

SEQ ID NO: 259834 - DNA, 16 bp, P. troglodytes
taagtctcctgaggcc

SEQ ID NO: 259835 - DNA, 16 bp, P. troglodytes
taagtcttaaaatcag

SEQ ID NO: 259836 - DNA, 16 bp, P. troglodytes
taagtctttaatccat

SEQ ID NO: 259837 - DNA, 16 bp, P. troglodytes
taagtgaaagaaacca

SEQ ID NO: 259838 - DNA, 16 bp, P. troglodytes
taagtgaaagaagcca

SEQ ID NO: 259839 - DNA, 16 bp, P. troglodytes
taagtgaaataaacca

SEQ ID NO: 259840 - DNA, 16 bp, P. troglodytes
taagtgaaataagcca

SEQ ID NO: 259841 - DNA, 16 bp, P. troglodytes
taagtgaaggagaagt

SEQ ID NO: 259842 - DNA, 16 bp, P. troglodytes
taagtgaagtaattca

SEQ ID NO: 259843 - DNA, 16 bp, P. troglodytes
taagtgacaaagccag

SEQ ID NO: 259844 - DNA, 16 bp, P. troglodytes
taagtgacataagcca

SEQ ID NO: 259845 - DNA, 16 bp, P. troglodytes
taagtgacttgctcaa

SEQ ID NO: 259846 - DNA, 16 bp, P. troglodytes
taagtgagaacaggtg

SEQ ID NO: 259847 - DNA, 16 bp, P. troglodytes
taagtgagaatatatg

SEQ ID NO: 259848 - DNA, 16 bp, P. troglodytes
taagtgagatcatgaa

SEQ ID NO: 259849 - DNA, 16 bp, P. troglodytes
taagtgagatcatgca

SEQ ID NO: 259850 - DNA, 16 bp, P. troglodytes
taagtgagtgagtgag

SEQ ID NO: 259851 - DNA, 16 bp, P. troglodytes
taagtgcagccagaga

SEQ ID NO: 259852 - DNA, 16 bp, P. troglodytes
taagtgctcaataaat

SEQ ID NO: 259853 - DNA, 17 bp, P. troglodytes
taagtgctgggattaca

SEQ ID NO: 259854 - DNA, 16 bp, P. troglodytes
taagtgctgtggagaa

SEQ ID NO: 259855 - DNA, 16 bp, P. troglodytes
taagtgcttgaggtga

SEQ ID NO: 259856 - DNA, 16 bp, P. troglodytes
taagtgcttgataaat

SEQ ID NO: 259857 - DNA, 16 bp, P. troglodytes
taagtggaaagatatc

SEQ ID NO: 259858 - DNA, 16 bp, P. troglodytes
taagtggaatcatgca

SEQ ID NO: 259859 - DNA, 16 bp, P. troglodytes
taagtgggagctaaat

SEQ ID NO: 259860 - DNA, 18 bp, P. troglodytes
taagtgggtgcctcatga

SEQ ID NO: 259861 - DNA, 16 bp, P. troglodytes
taagtgtaaaatacat

SEQ ID NO: 259862 - DNA, 16 bp, P. troglodytes
taagtgtctgtcaaca

SEQ ID NO: 259863 - DNA, 16 bp, P. troglodytes
taagtgtgagccactg

SEQ ID NO: 259864 - DNA, 16 bp, P. troglodytes
taagtgtggtggcaca

SEQ ID NO: 259865 - DNA, 16 bp, P. troglodytes
taagtgtgtgtgtgta

SEQ ID NO: 259866 - DNA, 16 bp, P. troglodytes
taagttcaatgtttct

SEQ ID NO: 259867 - DNA, 16 bp, P. troglodytes
taagttctttagcagt

SEQ ID NO: 259868 - DNA, 16 bp, P. troglodytes
taagttcttttgtggt

SEQ ID NO: 259869 - DNA, 16 bp, P. troglodytes
taagttgaaccattgt

SEQ ID NO: 259870 - DNA, 16 bp, P. troglodytes
taagtttatgattatg

SEQ ID NO: 259871 - DNA, 16 bp, P. troglodytes
taagtttcaggataca

SEQ ID NO: 259872 - DNA, 16 bp, P. troglodytes
taagtttccagcacat

SEQ ID NO: 259873 - DNA, 16 bp, P. troglodytes
taagttttacattttt

SEQ ID NO: 259874 - DNA, 16 bp, P. troglodytes
taagttttcaataaat

SEQ ID NO: 259875 - DNA, 16 bp, P. troglodytes
taagttttgcattttt

SEQ ID NO: 259876 - DNA, 16 bp, P. troglodytes
taataaaaacatttct

SEQ ID NO: 259877 - DNA, 16 bp, P. troglodytes
taataaaaagacaact

SEQ ID NO: 259878 - DNA, 16 bp, P. troglodytes
taataaaacttttctt

SEQ ID NO: 259879 - DNA, 16 bp, P. troglodytes
taataaaagacatgaa

SEQ ID NO: 259880 - DNA, 16 bp, P. troglodytes
taataaaagccacata

SEQ ID NO: 259881 - DNA, 16 bp, P. troglodytes
taataaaagccatcta

SEQ ID NO: 259882 - DNA, 16 bp, P. troglodytes
taataaaatgaacaat

SEQ ID NO: 259883 - DNA, 16 bp, P. troglodytes
taataaaatgcaattt

SEQ ID NO: 259884 - DNA, 16 bp, P. troglodytes
taataaacacatattt

SEQ ID NO: 259885 - DNA, 16 bp, P. troglodytes
taataaacatatgaaa

SEQ ID NO: 259886 - DNA, 16 bp, P. troglodytes
taataaacatattttg

SEQ ID NO: 259887 - DNA, 16 bp, P. troglodytes
taataaaccttcacat

SEQ ID NO: 259888 - DNA, 16 bp, P. troglodytes
taataaacttgctttc

SEQ ID NO: 259889 - DNA, 16 bp, P. troglodytes
taataaactttccttt

SEQ ID NO: 259890 - DNA, 16 bp, P. troglodytes
taataaactttgtttt

SEQ ID NO: 259891 - DNA, 16 bp, P. troglodytes
taataaagaaatacat

SEQ ID NO: 259892 - DNA, 16 bp, P. troglodytes
taataaagggatcaat

SEQ ID NO: 259893 - DNA, 16 bp, P. troglodytes
taataaagtcctttgt

SEQ ID NO: 259894 - DNA, 16 bp, P. troglodytes
taataaataaagacac

SEQ ID NO: 259895 - DNA, 16 bp, P. troglodytes
taataaatattccttt

SEQ ID NO: 259896 - DNA, 16 bp, P. troglodytes
taataaatatttcagg

SEQ ID NO: 259897 - DNA, 16 bp, P. troglodytes
taataaatatttgctg

SEQ ID NO: 259898 - DNA, 16 bp, P. troglodytes
taataaatattttctg

SEQ ID NO: 259899 - DNA, 16 bp, P. troglodytes
taataaatctcctctt

SEQ ID NO: 259900 - DNA, 16 bp, P. troglodytes
taataaatgctttgga

SEQ ID NO: 259901 - DNA, 16 bp, P. troglodytes
taataaatggtgctag

SEQ ID NO: 259902 - DNA, 16 bp, P. troglodytes
taataaatgtctttta

SEQ ID NO: 259903 - DNA, 16 bp, P. troglodytes
taataaatgttttcat

SEQ ID NO: 259904 - DNA, 16 bp, P. troglodytes
taataacaaactccac

SEQ ID NO: 259905 - DNA, 16 bp, P. troglodytes
taataacagctattta

SEQ ID NO: 259906 - DNA, 16 bp, P. troglodytes
taataacagtaataaa

SEQ ID NO: 259907 - DNA, 16 bp, P. troglodytes
taataagtattgcctc

SEQ ID NO: 259908 - DNA, 16 bp, P. troglodytes
taataataacagcaac

SEQ ID NO: 259909 - DNA, 16 bp, P. troglodytes
taataataacatcaac

SEQ ID NO: 259910 - DNA, 16 bp, P. troglodytes
taataataataaagac

SEQ ID NO: 259911 - DNA, 16 bp, P. troglodytes
taataataataattcc

SEQ ID NO: 259912 - DNA, 16 bp, P. troglodytes
taataataatagcaat

SEQ ID NO: 259913 - DNA, 16 bp, P. troglodytes
taataataatgatgat

SEQ ID NO: 259914 - DNA, 16 bp, P. troglodytes
taataatagtaatagt

SEQ ID NO: 259915 - DNA, 16 bp, P. troglodytes
taataatagtttctac

SEQ ID NO: 259916 - DNA, 16 bp, P. troglodytes
taatacaaataaaatg

SEQ ID NO: 259917 - DNA, 16 bp, P. troglodytes
taatacaaatggaaaa

SEQ ID NO: 259918 - DNA, 16 bp, P. troglodytes
taatacacatacacac

SEQ ID NO: 259919 - DNA, 16 bp, P. troglodytes
taatacactaatacaa

SEQ ID NO: 259920 - DNA, 16 bp, P. troglodytes
taatacaggaaattgg

SEQ ID NO: 259921 - DNA, 16 bp, P. troglodytes
taatacatacaacata

SEQ ID NO: 259922 - DNA, 16 bp, P. troglodytes
taatacatattataca

SEQ ID NO: 259923 - DNA, 16 bp, P. troglodytes
taatacatgttcatta

SEQ ID NO: 259924 - DNA, 16 bp, P. troglodytes
taataccacacatctg

SEQ ID NO: 259925 - DNA, 16 bp, P. troglodytes
taataccagcagtttg

SEQ ID NO: 259926 - DNA, 16 bp, P. troglodytes
taatacctatgtgatg

SEQ ID NO: 259927 - DNA, 16 bp, P. troglodytes
taatactgaaagtcct

SEQ ID NO: 259928 - DNA, 16 bp, P. troglodytes
taatacttcattgtgt

SEQ ID NO: 259929 - DNA, 16 bp, P. troglodytes
taatactttcactaat

SEQ ID NO: 259930 - DNA, 16 bp, P. troglodytes
taatacttttgtcttt

SEQ ID NO: 259931 - DNA, 16 bp, P. troglodytes
taatagaatggtttat

SEQ ID NO: 259932 - DNA, 16 bp, P. troglodytes
taatagactgagtggg

SEQ ID NO: 259933 - DNA, 16 bp, P. troglodytes
taatagctaacattta

SEQ ID NO: 259934 - DNA, 16 bp, P. troglodytes
taatagctaacatttc

SEQ ID NO: 259935 - DNA, 16 bp, P. troglodytes
taatagtgtgtgtgtg

SEQ ID NO: 259936 - DNA, 16 bp, P. troglodytes
taatataaacatttca

SEQ ID NO: 259937 - DNA, 16 bp, P. troglodytes
taatataatgtaaatg

SEQ ID NO: 259938 - DNA, 16 bp, P. troglodytes
taatataatgttttca

SEQ ID NO: 259939 - DNA, 16 bp, P. troglodytes
taatatatgtaaaaca

SEQ ID NO: 259940 - DNA, 16 bp, P. troglodytes
taatatattcattcat

SEQ ID NO: 259941 - DNA, 16 bp, P. troglodytes
taatatcagcactttg

SEQ ID NO: 259942 - DNA, 30 bp, P. troglodytes
taatatccagaatctacaaagaacttaaat

SEQ ID NO: 259943 - DNA, 16 bp, P. troglodytes
taatatccagaatctg

SEQ ID NO: 259944 - DNA, 16 bp, P. troglodytes
taatatccctgatgaa

SEQ ID NO: 259945 - DNA, 16 bp, P. troglodytes
taatatcctttataat

SEQ ID NO: 259946 - DNA, 16 bp, P. troglodytes
taatatctttccattt

SEQ ID NO: 259947 - DNA, 16 bp, P. troglodytes
taatatgctgtacagg

SEQ ID NO: 259948 - DNA, 16 bp, P. troglodytes
taatatggtttggctg

SEQ ID NO: 259949 - DNA, 16 bp, P. troglodytes
taatattattcccatt

SEQ ID NO: 259950 - DNA, 16 bp, P. troglodytes
taatattattttccaa

SEQ ID NO: 259951 - DNA, 16 bp, P. troglodytes
taatattccactgtat

SEQ ID NO: 259952 - DNA, 16 bp, P. troglodytes
taatattccattttaa

SEQ ID NO: 259953 - DNA, 16 bp, P. troglodytes
taatattccattttgt

SEQ ID NO: 259954 - DNA, 16 bp, P. troglodytes
taatattctattgtgt

SEQ ID NO: 259955 - DNA, 16 bp, P. troglodytes
taatattctgttttat

SEQ ID NO: 259956 - DNA, 16 bp, P. troglodytes
taatattgatgatcct

SEQ ID NO: 259957 - DNA, 16 bp, P. troglodytes
taatattgtaaagatg

SEQ ID NO: 259958 - DNA, 16 bp, P. troglodytes
taatatttaatgactg

SEQ ID NO: 259959 - DNA, 16 bp, P. troglodytes
taatatttgccatttt

SEQ ID NO: 259960 - DNA, 16 bp, P. troglodytes
taatatttgctttata

SEQ ID NO: 259961 - DNA, 16 bp, P. troglodytes
taatattttaaaagga

SEQ ID NO: 259962 - DNA, 16 bp, P. troglodytes
taatattttatgacat

SEQ ID NO: 259963 - DNA, 16 bp, P. troglodytes
taatattttgacatat

SEQ ID NO: 259964 - DNA, 16 bp, P. troglodytes
taatatttttgaggtt

SEQ ID NO: 259965 - DNA, 16 bp, P. troglodytes
taatatttttggacca

SEQ ID NO: 259966 - DNA, 16 bp, P. troglodytes
taatattttttgagac

SEQ ID NO: 259967 - DNA, 16 bp, P. troglodytes
taatcaaactgttgaa

SEQ ID NO: 259968 - DNA, 16 bp, P. troglodytes
taatcaagctaattaa

SEQ ID NO: 259969 - DNA, 16 bp, P. troglodytes
taatcacaagggttct

SEQ ID NO: 259970 - DNA, 16 bp, P. troglodytes
taatcacacctgtaat

SEQ ID NO: 259971 - DNA, 19 bp, P. troglodytes
taatcacagcactttggga

SEQ ID NO: 259972 - DNA, 16 bp, P. troglodytes
taatcacatctgcaga

SEQ ID NO: 259973 - DNA, 16 bp, P. troglodytes
taatcacattttttaa

SEQ ID NO: 259974 - DNA, 16 bp, P. troglodytes
taatcacctctttaaa

SEQ ID NO: 259975 - DNA, 16 bp, P. troglodytes
taatcaccttctaaag

SEQ ID NO: 259976 - DNA, 16 bp, P. troglodytes
taatcagatttttaaa

SEQ ID NO: 259977 - DNA, 16 bp, P. troglodytes
taatcagcaaagtaaa

SEQ ID NO: 259978 - DNA, 16 bp, P. troglodytes
taatcagggttctcca

SEQ ID NO: 259979 - DNA, 16 bp, P. troglodytes
taatcagtgttttata

SEQ ID NO: 259980 - DNA, 16 bp, P. troglodytes
taatcagtttttaaaa

SEQ ID NO: 259981 - DNA, 16 bp, P. troglodytes
taatcatagctcactg

SEQ ID NO: 259982 - DNA, 16 bp, P. troglodytes
taatcatattttcaaa

SEQ ID NO: 259983 - DNA, 16 bp, P. troglodytes
taatcatcaagaaaga

SEQ ID NO: 259984 - DNA, 16 bp, P. troglodytes
taatcatgtggttttg

SEQ ID NO: 259985 - DNA, 16 bp, P. troglodytes
taatcattaaggaaat

SEQ ID NO: 259986 - DNA, 16 bp, P. troglodytes
taatccaaacactttg

SEQ ID NO: 259987 - DNA, 16 bp, P. troglodytes
taatccaatatgactg

SEQ ID NO: 259988 - DNA, 16 bp, P. troglodytes
taatccaattttttaa

SEQ ID NO: 259989 - DNA, 20 bp, P. troglodytes
taatccagcatataaacaga

SEQ ID NO: 259990 - DNA, 16 bp, P. troglodytes
taatccattcagccag

SEQ ID NO: 259991 - DNA, 16 bp, P. troglodytes
taatcccaaatgtgat

SEQ ID NO: 259992 - DNA, 16 bp, P. troglodytes
taatcccaacaccttg

SEQ ID NO: 259993 - DNA, 16 bp, P. troglodytes
taatcccaacacttca

SEQ ID NO: 259994 - DNA, 16 bp, P. troglodytes
taatcccaacacttgg

SEQ ID NO: 259995 - DNA, 16 bp, P. troglodytes
taatcccaacacttta

SEQ ID NO: 259996 - DNA, 17 bp, P. troglodytes
taatcccaacactttga

SEQ ID NO: 259997 - DNA, 19 bp, P. troglodytes
taatcccaacactttggga

SEQ ID NO: 259998 - DNA, 16 bp, P. troglodytes
taatcccaacactttt

SEQ ID NO: 259999 - DNA, 16 bp, P. troglodytes
taatcccaacagtttg

SEQ ID NO: 260000 - DNA, 16 bp, P. troglodytes
taatcccaacatgttg

SEQ ID NO: 260001 - DNA, 16 bp, P. troglodytes
taatcccaacattctg

SEQ ID NO: 260002 - DNA, 16 bp, P. troglodytes
taatcccaacattttg

SEQ ID NO: 260003 - DNA, 16 bp, P. troglodytes
taatcccaagactttg

SEQ ID NO: 260004 - DNA, 19 bp, P. troglodytes
taatcccaccactttggga

SEQ ID NO: 260005 - DNA, 16 bp, P. troglodytes
taatcccagaacttcg

SEQ ID NO: 260006 - DNA, 19 bp, P. troglodytes
taatcccagaactttggga

SEQ ID NO: 260007 - DNA, 16 bp, P. troglodytes
taatcccagaattttg

SEQ ID NO: 260008 - DNA, 16 bp, P. troglodytes
taatcccagcaattca

SEQ ID NO: 260009 - DNA, 16 bp, P. troglodytes
taatcccagcaattta

SEQ ID NO: 260010 - DNA, 19 bp, P. troglodytes
taatcccagcaatttggga

SEQ ID NO: 260011 - DNA, 16 bp, P. troglodytes
taatcccagcacactg

SEQ ID NO: 260012 - DNA, 19 bp, P. troglodytes
taatcccagcacattggga

SEQ ID NO: 260013 - DNA, 19 bp, P. troglodytes
taatcccagcaccttggga

SEQ ID NO: 260014 - DNA, 19 bp, P. troglodytes
taatcccagcaccttgggg

SEQ ID NO: 260015 - DNA, 19 bp, P. troglodytes
taatcccagcacgttggga

SEQ ID NO: 260016 - DNA, 19 bp, P. troglodytes
taatcccagcactatggga

SEQ ID NO: 260017 - DNA, 19 bp, P. troglodytes
taatcccagcactctggga

SEQ ID NO: 260018 - DNA, 16 bp, P. troglodytes
taatcccagcacttag

SEQ ID NO: 260019 - DNA, 16 bp, P. troglodytes
taatcccagcacttct

SEQ ID NO: 260020 - DNA, 16 bp, P. troglodytes
taatcccagcacttgg

SEQ ID NO: 260021 - DNA, 16 bp, P. troglodytes
taatcccagcacttta

SEQ ID NO: 260022 - DNA, 16 bp, P. troglodytes
taatcccagcactttc

SEQ ID NO: 260023 - DNA, 17 bp, P. troglodytes
taatcccagcactttga

SEQ ID NO: 260024 - DNA, 18 bp, P. troglodytes
taatcccagcactttgca

SEQ ID NO: 260025 - DNA, 19 bp, P. troglodytes
taatcccagcactttgcga

SEQ ID NO: 260026 - DNA, 18 bp, P. troglodytes
taatcccagcactttgga

SEQ ID NO: 260027 - DNA, 18 bp, P. troglodytes
taatcccagcactttggc

SEQ ID NO: 260028 - DNA, 19 bp, P. troglodytes
taatcccagcactttggga

SEQ ID NO: 260029 - DNA, 19 bp, P. troglodytes
taatcccagcactttgggc

SEQ ID NO: 260030 - DNA, 19 bp, P. troglodytes
taatcccagcactttgggg

SEQ ID NO: 260031 - DNA, 19 bp, P. troglodytes
taatcccagcactttgggt

SEQ ID NO: 260032 - DNA, 17 bp, P. troglodytes
taatcccagcactttgt

SEQ ID NO: 260033 - DNA, 16 bp, P. troglodytes
taatcccagcactttt

SEQ ID NO: 260034 - DNA, 19 bp, P. troglodytes
taatcccagcagtttggga

SEQ ID NO: 260035 - DNA, 16 bp, P. troglodytes
taatcccagcatttgg

SEQ ID NO: 260036 - DNA, 17 bp, P. troglodytes
taatcccagcattttga

SEQ ID NO: 260037 - DNA, 17 bp, P. troglodytes
taatcccagcattttgc

SEQ ID NO: 260038 - DNA, 19 bp, P. troglodytes
taatcccagcattttggga

SEQ ID NO: 260039 - DNA, 19 bp, P. troglodytes
taatcccagccctttggga

SEQ ID NO: 260040 - DNA, 19 bp, P. troglodytes
taatcccagcgctttggga

SEQ ID NO: 260041 - DNA, 16 bp, P. troglodytes
taatcccagctcagga

SEQ ID NO: 260042 - DNA, 19 bp, P. troglodytes
taatcccagctctttggga

SEQ ID NO: 260043 - DNA, 16 bp, P. troglodytes
taatcccagctgctcc

SEQ ID NO: 260044 - DNA, 16 bp, P. troglodytes
taatcccaggacttcg

SEQ ID NO: 260045 - DNA, 19 bp, P. troglodytes
taatcccaggactttggga

SEQ ID NO: 260046 - DNA, 16 bp, P. troglodytes
taatcccaggtactca

SEQ ID NO: 260047 - DNA, 16 bp, P. troglodytes
taatcccaggtacttg

SEQ ID NO: 260048 - DNA, 16 bp, P. troglodytes
taatcccaggtattca

SEQ ID NO: 260049 - DNA, 16 bp, P. troglodytes
taatcccagtacttta

SEQ ID NO: 260050 - DNA, 17 bp, P. troglodytes
taatcccagtactttga

SEQ ID NO: 260051 - DNA, 19 bp, P. troglodytes
taatcccagtactttggga

SEQ ID NO: 260052 - DNA, 19 bp, P. troglodytes
taatcccagtactttgggg

SEQ ID NO: 260053 - DNA, 16 bp, P. troglodytes
taatcccagtattttg

SEQ ID NO: 260054 - DNA, 16 bp, P. troglodytes
taatcccagtgctttg

SEQ ID NO: 260055 - DNA, 16 bp, P. troglodytes
taatcccagtgctttt

SEQ ID NO: 260056 - DNA, 17 bp, P. troglodytes
taatcccatcactttga

SEQ ID NO: 260057 - DNA, 19 bp, P. troglodytes
taatcccatcactttggga

SEQ ID NO: 260058 - DNA, 16 bp, P. troglodytes
taatccccatgtgtca

SEQ ID NO: 260059 - DNA, 16 bp, P. troglodytes
taatccccatgtgttg

SEQ ID NO: 260060 - DNA, 16 bp, P. troglodytes
taatccctgcactttg

SEQ ID NO: 260061 - DNA, 16 bp, P. troglodytes
taatccctgcattttg

SEQ ID NO: 260062 - DNA, 16 bp, P. troglodytes
taatccctgcgctttg

SEQ ID NO: 260063 - DNA, 16 bp, P. troglodytes
taatcctaaaatttat

SEQ ID NO: 260064 - DNA, 16 bp, P. troglodytes
taatcctaacacttta

SEQ ID NO: 260065 - DNA, 16 bp, P. troglodytes
taatcctaacactttg

SEQ ID NO: 260066 - DNA, 16 bp, P. troglodytes
taatcctaaccctttg

SEQ ID NO: 260067 - DNA, 16 bp, P. troglodytes
taatcctaatgctttg

SEQ ID NO: 260068 - DNA, 19 bp, P. troglodytes
taatcctagaactttggga

SEQ ID NO: 260069 - DNA, 16 bp, P. troglodytes
taatcctagcactctg

SEQ ID NO: 260070 - DNA, 16 bp, P. troglodytes
taatcctagcactttg

SEQ ID NO: 260071 - DNA, 17 bp, P. troglodytes
taatcctagcactttga

SEQ ID NO: 260072 - DNA, 19 bp, P. troglodytes
taatcctagcactttggga

SEQ ID NO: 260073 - DNA, 19 bp, P. troglodytes
taatcctagcactttgggt

SEQ ID NO: 260074 - DNA, 16 bp, P. troglodytes
taatcctagcattttg

SEQ ID NO: 260075 - DNA, 19 bp, P. troglodytes
taatcctagtactttggga

SEQ ID NO: 260076 - DNA, 16 bp, P. troglodytes
taatcctagtgttttg

SEQ ID NO: 260077 - DNA, 16 bp, P. troglodytes
taatcctcacaaccac

SEQ ID NO: 260078 - DNA, 16 bp, P. troglodytes
taatcctcataataac

SEQ ID NO: 260079 - DNA, 16 bp, P. troglodytes
taatcctcctgcctta

SEQ ID NO: 260080 - DNA, 16 bp, P. troglodytes
taatccttgcaacaac

SEQ ID NO: 260081 - DNA, 16 bp, P. troglodytes
taatcgtggtttttgc

SEQ ID NO: 260082 - DNA, 16 bp, P. troglodytes
taatcgtggtttttgt

SEQ ID NO: 260083 - DNA, 16 bp, P. troglodytes
taatctaagcttccac

SEQ ID NO: 260084 - DNA, 16 bp, P. troglodytes
taatctcaaatcaaaa

SEQ ID NO: 260085 - DNA, 16 bp, P. troglodytes
taatctcaacactttg

SEQ ID NO: 260086 - DNA, 16 bp, P. troglodytes
taatctcagcactctg

SEQ ID NO: 260087 - DNA, 16 bp, P. troglodytes
taatctcagcactttc

SEQ ID NO: 260088 - DNA, 16 bp, P. troglodytes
taatctcagcactttg

SEQ ID NO: 260089 - DNA, 19 bp, P. troglodytes
taatctcagcactttggga

SEQ ID NO: 260090 - DNA, 16 bp, P. troglodytes
taatctcagcactttt

SEQ ID NO: 260091 - DNA, 16 bp, P. troglodytes
taatctcagcattttg

SEQ ID NO: 260092 - DNA, 16 bp, P. troglodytes
taatctcagctactcc

SEQ ID NO: 260093 - DNA, 16 bp, P. troglodytes
taatctcatctagaaa

SEQ ID NO: 260094 - DNA, 16 bp, P. troglodytes
taatctccaactcctg

SEQ ID NO: 260095 - DNA, 16 bp, P. troglodytes
taatctctctgagact

SEQ ID NO: 260096 - DNA, 16 bp, P. troglodytes
taatctgatttttaaa

SEQ ID NO: 260097 - DNA, 16 bp, P. troglodytes
taatctgctttttgtc

SEQ ID NO: 260098 - DNA, 16 bp, P. troglodytes
taatctgtacaagaaa

SEQ ID NO: 260099 - DNA, 16 bp, P. troglodytes
taatctgtttacattc

SEQ ID NO: 260100 - DNA, 16 bp, P. troglodytes
taatctttacaaaaac

SEQ ID NO: 260101 - DNA, 16 bp, P. troglodytes
taatgaaaacaaatga

SEQ ID NO: 260102 - DNA, 16 bp, P. troglodytes
taatgaaaacattttt

SEQ ID NO: 260103 - DNA, 16 bp, P. troglodytes
taatgaaaatgaaaac

SEQ ID NO: 260104 - DNA, 16 bp, P. troglodytes
taatgaaaatggccat

SEQ ID NO: 260105 - DNA, 16 bp, P. troglodytes
taatgaaagatttttg

SEQ ID NO: 260106 - DNA, 16 bp, P. troglodytes
taatgaaataaatcat

SEQ ID NO: 260107 - DNA, 16 bp, P. troglodytes
taatgaaataatggat

SEQ ID NO: 260108 - DNA, 16 bp, P. troglodytes
taatgaaataattaca

SEQ ID NO: 260109 - DNA, 16 bp, P. troglodytes
taatgaaatatatcaa

SEQ ID NO: 260110 - DNA, 16 bp, P. troglodytes
taatgaagacatacct

SEQ ID NO: 260111 - DNA, 16 bp, P. troglodytes
taatgaagcttccata

SEQ ID NO: 260112 - DNA, 16 bp, P. troglodytes
taatgaagtgttgaat

SEQ ID NO: 260113 - DNA, 16 bp, P. troglodytes
taatgaatatgtatta

SEQ ID NO: 260114 - DNA, 16 bp, P. troglodytes
taatgacctccagttc

SEQ ID NO: 260115 - DNA, 16 bp, P. troglodytes
taatgagaccctgtct

SEQ ID NO: 260116 - DNA, 16 bp, P. troglodytes
taatgagattttaaaa

SEQ ID NO: 260117 - DNA, 16 bp, P. troglodytes
taatgaggatgaagat

SEQ ID NO: 260118 - DNA, 16 bp, P. troglodytes
taatgaggatgtggag

SEQ ID NO: 260119 - DNA, 16 bp, P. troglodytes
taatgagtgagttctc

SEQ ID NO: 260120 - DNA, 16 bp, P. troglodytes
taatgagtgtgaggtg

SEQ ID NO: 260121 - DNA, 16 bp, P. troglodytes
taatgagttcatgtcc

SEQ ID NO: 260122 - DNA, 16 bp, P. troglodytes
taatgatcatctgagc

SEQ ID NO: 260123 - DNA, 16 bp, P. troglodytes
taatgatgagcatttt

SEQ ID NO: 260124 - DNA, 16 bp, P. troglodytes
taatgatgatgatgat

SEQ ID NO: 260125 - DNA, 16 bp, P. troglodytes
taatgatgttaagcat

SEQ ID NO: 260126 - DNA, 16 bp, P. troglodytes
taatgatgttgaaaat

SEQ ID NO: 260127 - DNA, 16 bp, P. troglodytes
taatgattttttttcc

SEQ ID NO: 260128 - DNA, 16 bp, P. troglodytes
taatgcaaactgttgt

SEQ ID NO: 260129 - DNA, 16 bp, P. troglodytes
taatgcaattcctatc

SEQ ID NO: 260130 - DNA, 16 bp, P. troglodytes
taatgcatcttaaaga

SEQ ID NO: 260131 - DNA, 16 bp, P. troglodytes
taatgccagctactcg

SEQ ID NO: 260132 - DNA, 16 bp, P. troglodytes
taatgctatgtaaata

SEQ ID NO: 260133 - DNA, 16 bp, P. troglodytes
taatgctcacaacaac

SEQ ID NO: 260134 - DNA, 16 bp, P. troglodytes
taatgcttattttaaa

SEQ ID NO: 260135 - DNA, 16 bp, P. troglodytes
taatgctttatatttt

SEQ ID NO: 260136 - DNA, 16 bp, P. troglodytes
taatgcttttaaaatg

SEQ ID NO: 260137 - DNA, 16 bp, P. troglodytes
taatggaaaattacag

SEQ ID NO: 260138 - DNA, 16 bp, P. troglodytes
taatggaagaaaatat

SEQ ID NO: 260139 - DNA, 16 bp, P. troglodytes
taatggaagactttaa

SEQ ID NO: 260140 - DNA, 16 bp, P. troglodytes
taatggacaaaataac

SEQ ID NO: 260141 - DNA, 16 bp, P. troglodytes
taatggaggaacagaa

SEQ ID NO: 260142 - DNA, 16 bp, P. troglodytes
taatggagtactattc

SEQ ID NO: 260143 - DNA, 16 bp, P. troglodytes
taatggatacaaaatt

SEQ ID NO: 260144 - DNA, 16 bp, P. troglodytes
taatggatacaaagtt

SEQ ID NO: 260145 - DNA, 16 bp, P. troglodytes
taatggatttacagtt

SEQ ID NO: 260146 - DNA, 16 bp, P. troglodytes
taatggcccctgcttt

SEQ ID NO: 260147 - DNA, 16 bp, P. troglodytes
taatggctgtgtttaa

SEQ ID NO: 260148 - DNA, 16 bp, P. troglodytes
taatggcttccagttc

SEQ ID NO: 260149 - DNA, 16 bp, P. troglodytes
taatgggcacaaaaaa

SEQ ID NO: 260150 - DNA, 16 bp, P. troglodytes
taatgggtacaatgta

SEQ ID NO: 260151 - DNA, 28 bp, P. troglodytes
taatggtaaagggatcaattcaacaaga

SEQ ID NO: 260152 - DNA, 16 bp, P. troglodytes
taatggtattgtggtt

SEQ ID NO: 260153 - DNA, 16 bp, P. troglodytes
taatggtgaatacatg

SEQ ID NO: 260154 - DNA, 16 bp, P. troglodytes
taatggttgaaaactt

SEQ ID NO: 260155 - DNA, 16 bp, P. troglodytes
taatggtttttaaaaa

SEQ ID NO: 260156 - DNA, 16 bp, P. troglodytes
taatggtttttccttt

SEQ ID NO: 260157 - DNA, 16 bp, P. troglodytes
taatgtaaaaaagact

SEQ ID NO: 260158 - DNA, 16 bp, P. troglodytes
taatgtaacatattca

SEQ ID NO: 260159 - DNA, 16 bp, P. troglodytes
taatgtaatgtcctcc

SEQ ID NO: 260160 - DNA, 16 bp, P. troglodytes
taatgtagaatcagtg

SEQ ID NO: 260161 - DNA, 16 bp, P. troglodytes
taatgtataatgtata

SEQ ID NO: 260162 - DNA, 16 bp, P. troglodytes
taatgtatataatgta

SEQ ID NO: 260163 - DNA, 16 bp, P. troglodytes
taatgtattcattcat

SEQ ID NO: 260164 - DNA, 16 bp, P. troglodytes
taatgtcacaatctcc

SEQ ID NO: 260165 - DNA, 16 bp, P. troglodytes
taatgtcagaattgaa

SEQ ID NO: 260166 - DNA, 16 bp, P. troglodytes
taatgtcctctagatt

SEQ ID NO: 260167 - DNA, 16 bp, P. troglodytes
taatgtcctctggaat

SEQ ID NO: 260168 - DNA, 16 bp, P. troglodytes
taatgtctgtattttt

SEQ ID NO: 260169 - DNA, 16 bp, P. troglodytes
taatgtcttcaaggtt

SEQ ID NO: 260170 - DNA, 16 bp, P. troglodytes
taatgtcttcttttcc

SEQ ID NO: 260171 - DNA, 16 bp, P. troglodytes
taatgtctttttaaaa

SEQ ID NO: 260172 - DNA, 16 bp, P. troglodytes
taatgtgatatgaaaa

SEQ ID NO: 260173 - DNA, 16 bp, P. troglodytes
taatgtgatattttaa

SEQ ID NO: 260174 - DNA, 16 bp, P. troglodytes
taatgtgattttaaaa

SEQ ID NO: 260175 - DNA, 16 bp, P. troglodytes
taatgtgcaaaataac

SEQ ID NO: 260176 - DNA, 16 bp, P. troglodytes
taatgtgcacatcttt

SEQ ID NO: 260177 - DNA, 16 bp, P. troglodytes
taatgtgcttgaatca

SEQ ID NO: 260178 - DNA, 16 bp, P. troglodytes
taatgtggtaaattat

SEQ ID NO: 260179 - DNA, 16 bp, P. troglodytes
taatgtgtacagagtt

SEQ ID NO: 260180 - DNA, 16 bp, P. troglodytes
taatgtgtgtgtatgt

SEQ ID NO: 260181 - DNA, 16 bp, P. troglodytes
taatgttccattgtgt

SEQ ID NO: 260182 - DNA, 16 bp, P. troglodytes
taatgttctttttaaa

SEQ ID NO: 260183 - DNA, 16 bp, P. troglodytes
taatgttgaaatgagt

SEQ ID NO: 260184 - DNA, 16 bp, P. troglodytes
taatgtttattaagca

SEQ ID NO: 260185 - DNA, 16 bp, P. troglodytes
taatgttttcaaggtt

SEQ ID NO: 260186 - DNA, 16 bp, P. troglodytes
taatgttttttaaaca

SEQ ID NO: 260187 - DNA, 16 bp, P. troglodytes
taattaaactaaagaa

SEQ ID NO: 260188 - DNA, 16 bp, P. troglodytes
taattacaaagagaaa

SEQ ID NO: 260189 - DNA, 16 bp, P. troglodytes
taattacaataaatgt

SEQ ID NO: 260190 - DNA, 16 bp, P. troglodytes
taattacacctgcaaa

SEQ ID NO: 260191 - DNA, 16 bp, P. troglodytes
taattacagaagaaaa

SEQ ID NO: 260192 - DNA, 16 bp, P. troglodytes
taattacatctgcaaa

SEQ ID NO: 260193 - DNA, 16 bp, P. troglodytes
taattacatggaaaat

SEQ ID NO: 260194 - DNA, 16 bp, P. troglodytes
taattactataacttt

SEQ ID NO: 260195 - DNA, 16 bp, P. troglodytes
taattactgtattttg

SEQ ID NO: 260196 - DNA, 16 bp, P. troglodytes
taattactgtattttt

SEQ ID NO: 260197 - DNA, 16 bp, P. troglodytes
taattacttaattact

SEQ ID NO: 260198 - DNA, 16 bp, P. troglodytes
taattacttcccaaag

SEQ ID NO: 260199 - DNA, 16 bp, P. troglodytes
taattagcatattcat

SEQ ID NO: 260200 - DNA, 21 bp, P. troglodytes
taattagctgggtgtggtggc

SEQ ID NO: 260201 - DNA, 16 bp, P. troglodytes
taattagcttgattat

SEQ ID NO: 260202 - DNA, 16 bp, P. troglodytes
taattagcttgattta

SEQ ID NO: 260203 - DNA, 16 bp, P. troglodytes
taattagtgatgctga

SEQ ID NO: 260204 - DNA, 16 bp, P. troglodytes
taattataattgttac

SEQ ID NO: 260205 - DNA, 16 bp, P. troglodytes
taattatagatttaca

SEQ ID NO: 260206 - DNA, 16 bp, P. troglodytes
taattatctcaaaata

SEQ ID NO: 260207 - DNA, 16 bp, P. troglodytes
taattatcttccaaag

SEQ ID NO: 260208 - DNA, 16 bp, P. troglodytes
taattattagagaaat

SEQ ID NO: 260209 - DNA, 16 bp, P. troglodytes
taattattatagcttt

SEQ ID NO: 260210 - DNA, 16 bp, P. troglodytes
taattattgccattct

SEQ ID NO: 260211 - DNA, 16 bp, P. troglodytes
taattattttgtatct

SEQ ID NO: 260212 - DNA, 16 bp, P. troglodytes
taattcaatatgactg

SEQ ID NO: 260213 - DNA, 16 bp, P. troglodytes
taattcacacaccata

SEQ ID NO: 260214 - DNA, 16 bp, P. troglodytes
taattcacatgccata

SEQ ID NO: 260215 - DNA, 16 bp, P. troglodytes
taattcagccactgtg

SEQ ID NO: 260216 - DNA, 16 bp, P. troglodytes
taattcatataccata

SEQ ID NO: 260217 - DNA, 16 bp, P. troglodytes
taattcatttgtttat

SEQ ID NO: 260218 - DNA, 16 bp, P. troglodytes
taattcattttaagaa

SEQ ID NO: 260219 - DNA, 16 bp, P. troglodytes
taattccaacactttg

SEQ ID NO: 260220 - DNA, 16 bp, P. troglodytes
taattccagaacattt

SEQ ID NO: 260221 - DNA, 16 bp, P. troglodytes
taattccagcacttgg

SEQ ID NO: 260222 - DNA, 17 bp, P. troglodytes
taattccagcactttga

SEQ ID NO: 260223 - DNA, 16 bp, P. troglodytes
taattccatttatata

SEQ ID NO: 260224 - DNA, 16 bp, P. troglodytes
taattcccattttaca

SEQ ID NO: 260225 - DNA, 16 bp, P. troglodytes
taattcctggaacctg

SEQ ID NO: 260226 - DNA, 16 bp, P. troglodytes
taattctcacaacaat

SEQ ID NO: 260227 - DNA, 16 bp, P. troglodytes
taattctcagaacaac

SEQ ID NO: 260228 - DNA, 16 bp, P. troglodytes
taattctcattgtaaa

SEQ ID NO: 260229 - DNA, 16 bp, P. troglodytes
taattctccagcctca

SEQ ID NO: 260230 - DNA, 16 bp, P. troglodytes
taattctgattttaaa

SEQ ID NO: 260231 - DNA, 16 bp, P. troglodytes
taattctgtatataaa

SEQ ID NO: 260232 - DNA, 16 bp, P. troglodytes
taattctgtcattcct

SEQ ID NO: 260233 - DNA, 16 bp, P. troglodytes
taattcttatctttgt

SEQ ID NO: 260234 - DNA, 16 bp, P. troglodytes
taattcttgggtgttt

SEQ ID NO: 260235 - DNA, 16 bp, P. troglodytes
taattctttattgtgg

SEQ ID NO: 260236 - DNA, 16 bp, P. troglodytes
taattctttgttttgg

SEQ ID NO: 260237 - DNA, 16 bp, P. troglodytes
taattctttttatgtg

SEQ ID NO: 260238 - DNA, 16 bp, P. troglodytes
taattgaatcataggg

SEQ ID NO: 260239 - DNA, 16 bp, P. troglodytes
taattgaatcatgaag

SEQ ID NO: 260240 - DNA, 16 bp, P. troglodytes
taattgaatcatgggg

SEQ ID NO: 260241 - DNA, 16 bp, P. troglodytes
taattgactttttaaa

SEQ ID NO: 260242 - DNA, 16 bp, P. troglodytes
taattgataattgaag

SEQ ID NO: 260243 - DNA, 16 bp, P. troglodytes
taattgatataaacaa

SEQ ID NO: 260244 - DNA, 16 bp, P. troglodytes
taattgcatggttttg

SEQ ID NO: 260245 - DNA, 16 bp, P. troglodytes
taattgcttttttaaa

SEQ ID NO: 260246 - DNA, 16 bp, P. troglodytes
taattggagcattttg

SEQ ID NO: 260247 - DNA, 16 bp, P. troglodytes
taattggattatttgt

SEQ ID NO: 260248 - DNA, 16 bp, P. troglodytes
taattggattgtttgt

SEQ ID NO: 260249 - DNA, 17 bp, P. troglodytes
taattggcatagacata

SEQ ID NO: 260250 - DNA, 16 bp, P. troglodytes
taattggtctggggtg

SEQ ID NO: 260251 - DNA, 16 bp, P. troglodytes
taattgtatagttttg

SEQ ID NO: 260252 - DNA, 16 bp, P. troglodytes
taattgtcagattcaa

SEQ ID NO: 260253 - DNA, 16 bp, P. troglodytes
taattgtcagattcag

SEQ ID NO: 260254 - DNA, 16 bp, P. troglodytes
taattgtgataaaata

SEQ ID NO: 260255 - DNA, 16 bp, P. troglodytes
taattgtgatgtgagg

SEQ ID NO: 260256 - DNA, 16 bp, P. troglodytes
taattgtgattttaaa

SEQ ID NO: 260257 - DNA, 16 bp, P. troglodytes
taattgtgtgtgtgtg

SEQ ID NO: 260258 - DNA, 16 bp, P. troglodytes
taatttaaaaagtcaa

SEQ ID NO: 260259 - DNA, 16 bp, P. troglodytes
taatttaaaaatcact

SEQ ID NO: 260260 - DNA, 16 bp, P. troglodytes
taatttaaatgtttct

SEQ ID NO: 260261 - DNA, 16 bp, P. troglodytes
taatttaacaaaagaa

SEQ ID NO: 260262 - DNA, 16 bp, P. troglodytes
taatttactttgaaat

SEQ ID NO: 260263 - DNA, 16 bp, P. troglodytes
taatttagaaaacaaa

SEQ ID NO: 260264 - DNA, 16 bp, P. troglodytes
taatttataaagcaaa

SEQ ID NO: 260265 - DNA, 16 bp, P. troglodytes
taatttataaattcag

SEQ ID NO: 260266 - DNA, 16 bp, P. troglodytes
taatttatgaagtaaa

SEQ ID NO: 260267 - DNA, 16 bp, P. troglodytes
taatttattctctttg

SEQ ID NO: 260268 - DNA, 16 bp, P. troglodytes
taatttatttcagaaa

SEQ ID NO: 260269 - DNA, 16 bp, P. troglodytes
taatttcaaaaaagaa

SEQ ID NO: 260270 - DNA, 16 bp, P. troglodytes
taatttcaaaagaaaa

SEQ ID NO: 260271 - DNA, 16 bp, P. troglodytes
taatttcacataattt

SEQ ID NO: 260272 - DNA, 16 bp, P. troglodytes
taatttcagaaaataa

SEQ ID NO: 260273 - DNA, 16 bp, P. troglodytes
taatttcagtttcttt

SEQ ID NO: 260274 - DNA, 16 bp, P. troglodytes
taatttccacacattt

SEQ ID NO: 260275 - DNA, 16 bp, P. troglodytes
taatttccagtttaat

SEQ ID NO: 260276 - DNA, 16 bp, P. troglodytes
taatttctaaagaaaa

SEQ ID NO: 260277 - DNA, 16 bp, P. troglodytes
taatttctaagaaatt

SEQ ID NO: 260278 - DNA, 16 bp, P. troglodytes
taatttctattgacct

SEQ ID NO: 260279 - DNA, 16 bp, P. troglodytes
taatttctattgattt

SEQ ID NO: 260280 - DNA, 16 bp, P. troglodytes
taatttctgaaataaa

SEQ ID NO: 260281 - DNA, 16 bp, P. troglodytes
taatttctgcattttt

SEQ ID NO: 260282 - DNA, 16 bp, P. troglodytes
taatttctgcttttta

SEQ ID NO: 260283 - DNA, 16 bp, P. troglodytes
taatttctgtgtattt

SEQ ID NO: 260284 - DNA, 16 bp, P. troglodytes
taatttctgttttcct

SEQ ID NO: 260285 - DNA, 16 bp, P. troglodytes
taatttctttcattga

SEQ ID NO: 260286 - DNA, 16 bp, P. troglodytes
taatttctttgagaaa

SEQ ID NO: 260287 - DNA, 16 bp, P. troglodytes
taatttgaatgtttct

SEQ ID NO: 260288 - DNA, 16 bp, P. troglodytes
taatttgcaaaatttt

SEQ ID NO: 260289 - DNA, 16 bp, P. troglodytes
taatttgcaaagaaaa

SEQ ID NO: 260290 - DNA, 16 bp, P. troglodytes
taatttgcacatattt

SEQ ID NO: 260291 - DNA, 16 bp, P. troglodytes
taatttgcattatttt

SEQ ID NO: 260292 - DNA, 16 bp, P. troglodytes
taatttgcatttcttt

SEQ ID NO: 260293 - DNA, 16 bp, P. troglodytes
taatttgcttgattta

SEQ ID NO: 260294 - DNA, 16 bp, P. troglodytes
taatttgggtttgtct

SEQ ID NO: 260295 - DNA, 16 bp, P. troglodytes
taatttggtcttgagg

SEQ ID NO: 260296 - DNA, 16 bp, P. troglodytes
taatttgtatatttct

SEQ ID NO: 260297 - DNA, 16 bp, P. troglodytes
taatttgtgaagaaaa

SEQ ID NO: 260298 - DNA, 16 bp, P. troglodytes
taatttgttacatagc

SEQ ID NO: 260299 - DNA, 16 bp, P. troglodytes
taatttgtttattcat

SEQ ID NO: 260300 - DNA, 16 bp, P. troglodytes
taattttaaagcattt

SEQ ID NO: 260301 - DNA, 16 bp, P. troglodytes
taattttacctgtttc

SEQ ID NO: 260302 - DNA, 16 bp, P. troglodytes
taattttagacattct

SEQ ID NO: 260303 - DNA, 16 bp, P. troglodytes
taattttatatgtcaa

SEQ ID NO: 260304 - DNA, 16 bp, P. troglodytes
taattttattatctgt

SEQ ID NO: 260305 - DNA, 16 bp, P. troglodytes
taattttcaaaagaat

SEQ ID NO: 260306 - DNA, 16 bp, P. troglodytes
taattttcaaatattg

SEQ ID NO: 260307 - DNA, 16 bp, P. troglodytes
taattttcaaatgtat

SEQ ID NO: 260308 - DNA, 16 bp, P. troglodytes
taattttcaaattgtt

SEQ ID NO: 260309 - DNA, 16 bp, P. troglodytes
taattttccaaacttt

SEQ ID NO: 260310 - DNA, 16 bp, P. troglodytes
taattttctagaaaaa

SEQ ID NO: 260311 - DNA, 16 bp, P. troglodytes
taattttctcactgtt

SEQ ID NO: 260312 - DNA, 16 bp, P. troglodytes
taattttctctattgt

SEQ ID NO: 260313 - DNA, 16 bp, P. troglodytes
taattttctcttcttg

SEQ ID NO: 260314 - DNA, 16 bp, P. troglodytes
taattttcttcatgtt

SEQ ID NO: 260315 - DNA, 16 bp, P. troglodytes
taattttctttgtgat

SEQ ID NO: 260316 - DNA, 16 bp, P. troglodytes
taattttgaaaacttt

SEQ ID NO: 260317 - DNA, 16 bp, P. troglodytes
taattttgagaaaatt

SEQ ID NO: 260318 - DNA, 16 bp, P. troglodytes
taattttgctagatat

SEQ ID NO: 260319 - DNA, 16 bp, P. troglodytes
taattttgctcatttt

SEQ ID NO: 260320 - DNA, 16 bp, P. troglodytes
taattttgctttaaat

SEQ ID NO: 260321 - DNA, 16 bp, P. troglodytes
taattttgctttaatt

SEQ ID NO: 260322 - DNA, 16 bp, P. troglodytes
taattttgttgaaaat

SEQ ID NO: 260323 - DNA, 16 bp, P. troglodytes
taattttgtttctaaa

SEQ ID NO: 260324 - DNA, 16 bp, P. troglodytes
taatttttaaagctat

SEQ ID NO: 260325 - DNA, 16 bp, P. troglodytes
taatttttaagagtgt

SEQ ID NO: 260326 - DNA, 16 bp, P. troglodytes
taatttttagaaagat

SEQ ID NO: 260327 - DNA, 16 bp, P. troglodytes
taatttttctgagcct

SEQ ID NO: 260328 - DNA, 16 bp, P. troglodytes
taatttttctgtagag

SEQ ID NO: 260329 - DNA, 16 bp, P. troglodytes
taatttttgaaaactt

SEQ ID NO: 260330 - DNA, 16 bp, P. troglodytes
taatttttgaaaagca

SEQ ID NO: 260331 - DNA, 16 bp, P. troglodytes
taatttttgaatcttt

SEQ ID NO: 260332 - DNA, 16 bp, P. troglodytes
taatttttgacatttt

SEQ ID NO: 260333 - DNA, 16 bp, P. troglodytes
taatttttgcatatat

SEQ ID NO: 260334 - DNA, 16 bp, P. troglodytes
taatttttgccagtct

SEQ ID NO: 260335 - DNA, 16 bp, P. troglodytes
taatttttgtaaagat

SEQ ID NO: 260336 - DNA, 16 bp, P. troglodytes
taatttttgtactctt

SEQ ID NO: 260337 - DNA, 16 bp, P. troglodytes
taatttttgtcattct

SEQ ID NO: 260338 - DNA, 16 bp, P. troglodytes
taatttttgtcttctc

SEQ ID NO: 260339 - DNA, 16 bp, P. troglodytes
taatttttgtgtatga

SEQ ID NO: 260340 - DNA, 18 bp, P. troglodytes
taattttttgtagagatg

SEQ ID NO: 260341 - DNA, 16 bp, P. troglodytes
taatttttttaagaca

SEQ ID NO: 260342 - DNA, 16 bp, P. troglodytes
taatttttttccaaaa

SEQ ID NO: 260343 - DNA, 16 bp, P. troglodytes
taatttttttccctgt

SEQ ID NO: 260344 - DNA, 16 bp, P. troglodytes
taatttttttgtagag

SEQ ID NO: 260345 - DNA, 16 bp, P. troglodytes
taattttttttccagt

SEQ ID NO: 260346 - DNA, 16 bp, P. troglodytes
tacaaaaaataaccag

SEQ ID NO: 260347 - DNA, 16 bp, P. troglodytes
tacaaaaaataagcca

SEQ ID NO: 260348 - DNA, 16 bp, P. troglodytes
tacaaaaacaggcagc

SEQ ID NO: 260349 - DNA, 16 bp, P. troglodytes
tacaaaaagtctgttt

SEQ ID NO: 260350 - DNA, 16 bp, P. troglodytes
tacaaaaatatcttct

SEQ ID NO: 260351 - DNA, 16 bp, P. troglodytes
tacaaaaatcagctga

SEQ ID NO: 260352 - DNA, 16 bp, P. troglodytes
tacaaaaatcctcaat

SEQ ID NO: 260353 - DNA, 16 bp, P. troglodytes
tacaaaaatccttaac

SEQ ID NO: 260354 - DNA, 16 bp, P. troglodytes
tacaaaaattagctgc

SEQ ID NO: 260355 - DNA, 16 bp, P. troglodytes
tacaaaaatttgctga

SEQ ID NO: 260356 - DNA, 16 bp, P. troglodytes
tacaaaactgtacagc

SEQ ID NO: 260357 - DNA, 16 bp, P. troglodytes
tacaaaagaaaaaggt

SEQ ID NO: 260358 - DNA, 16 bp, P. troglodytes
tacaaaagaaattagc

SEQ ID NO: 260359 - DNA, 16 bp, P. troglodytes
tacaaaagatttaaaa

SEQ ID NO: 260360 - DNA, 16 bp, P. troglodytes
tacaaaagtcaaaaag

SEQ ID NO: 260361 - DNA, 16 bp, P. troglodytes
tacaaaagttagccag

SEQ ID NO: 260362 - DNA, 16 bp, P. troglodytes
tacaaaagttttaaat

SEQ ID NO: 260363 - DNA, 16 bp, P. troglodytes
tacaaaatattttctt

SEQ ID NO: 260364 - DNA, 16 bp, P. troglodytes
tacaaaatgagtgttt

SEQ ID NO: 260365 - DNA, 16 bp, P. troglodytes
tacaaaatgttgctga

SEQ ID NO: 260366 - DNA, 16 bp, P. troglodytes
tacaaaattctgatga

SEQ ID NO: 260367 - DNA, 16 bp, P. troglodytes
tacaaaatttcagtta

SEQ ID NO: 260368 - DNA, 16 bp, P. troglodytes
tacaaacaaccccatc

SEQ ID NO: 260369 - DNA, 16 bp, P. troglodytes
tacaaacacatatata

SEQ ID NO: 260370 - DNA, 16 bp, P. troglodytes
tacaaaccaaggaaca

SEQ ID NO: 260371 - DNA, 16 bp, P. troglodytes
tacaaacctggacagc

SEQ ID NO: 260372 - DNA, 16 bp, P. troglodytes
tacaaacttgtacagc

SEQ ID NO: 260373 - DNA, 16 bp, P. troglodytes
tacaaagaaaaatatt

SEQ ID NO: 260374 - DNA, 16 bp, P. troglodytes
tacaaagaaaaccaca

SEQ ID NO: 260375 - DNA, 16 bp, P. troglodytes
tacaaagaaaactcca

SEQ ID NO: 260376 - DNA, 16 bp, P. troglodytes
tacaaagaaatacctg

SEQ ID NO: 260377 - DNA, 16 bp, P. troglodytes
tacaaagaaataggaa

SEQ ID NO: 260378 - DNA, 16 bp, P. troglodytes
tacaaagaaatcagaa

SEQ ID NO: 260379 - DNA, 16 bp, P. troglodytes
tacaaagaatttttaa

SEQ ID NO: 260380 - DNA, 16 bp, P. troglodytes
tacaaagctacagtaa

SEQ ID NO: 260381 - DNA, 16 bp, P. troglodytes
tacaaagctatagtaa

SEQ ID NO: 260382 - DNA, 16 bp, P. troglodytes
tacaaaggaatgaagt

SEQ ID NO: 260383 - DNA, 16 bp, P. troglodytes
tacaaaggagaaaact

SEQ ID NO: 260384 - DNA, 16 bp, P. troglodytes
tacaaaggtgccaaga

SEQ ID NO: 260385 - DNA, 16 bp, P. troglodytes
tacaaagtaaaaatat

SEQ ID NO: 260386 - DNA, 16 bp, P. troglodytes
tacaaagtattttttt

SEQ ID NO: 260387 - DNA, 16 bp, P. troglodytes
tacaaataaggaaaca

SEQ ID NO: 260388 - DNA, 16 bp, P. troglodytes
tacaaatacaattttt

SEQ ID NO: 260389 - DNA, 16 bp, P. troglodytes
tacaaatatgtaaaaa

SEQ ID NO: 260390 - DNA, 16 bp, P. troglodytes
tacaaatattttcatt

SEQ ID NO: 260391 - DNA, 16 bp, P. troglodytes
tacaaatgaagaaaat

SEQ ID NO: 260392 - DNA, 16 bp, P. troglodytes
tacaaatgaagaaatt

SEQ ID NO: 260393 - DNA, 16 bp, P. troglodytes
tacaaatgcaaaaatt

SEQ ID NO: 260394 - DNA, 16 bp, P. troglodytes
tacaaatgtaaagaat

SEQ ID NO: 260395 - DNA, 16 bp, P. troglodytes
tacaaatgtggaaact

SEQ ID NO: 260396 - DNA, 16 bp, P. troglodytes
tacaaattgtatatat

SEQ ID NO: 260397 - DNA, 16 bp, P. troglodytes
tacaaatttaaaaatg

SEQ ID NO: 260398 - DNA, 16 bp, P. troglodytes
tacaaatttacaaatt

SEQ ID NO: 260399 - DNA, 16 bp, P. troglodytes
tacaaatttcaaattt

SEQ ID NO: 260400 - DNA, 16 bp, P. troglodytes
tacaaattttgtttta

SEQ ID NO: 260401 - DNA, 16 bp, P. troglodytes
tacaacaaatccctgt

SEQ ID NO: 260402 - DNA, 16 bp, P. troglodytes
tacaacacactgatgg

SEQ ID NO: 260403 - DNA, 16 bp, P. troglodytes
tacaacagcaaagaca

SEQ ID NO: 260404 - DNA, 16 bp, P. troglodytes
tacaacatgacatttt

SEQ ID NO: 260405 - DNA, 16 bp, P. troglodytes
tacaacatggatggat

SEQ ID NO: 260406 - DNA, 16 bp, P. troglodytes
tacaacatttttttaa

SEQ ID NO: 260407 - DNA, 16 bp, P. troglodytes
tacaaccactttgaaa

SEQ ID NO: 260408 - DNA, 16 bp, P. troglodytes
tacaaccagaaatacc

SEQ ID NO: 260409 - DNA, 16 bp, P. troglodytes
tacaaccatcaccatt

SEQ ID NO: 260410 - DNA, 17 bp, P. troglodytes
tacaaccatctgatctt

SEQ ID NO: 260411 - DNA, 16 bp, P. troglodytes
tacaagaaacacattt

SEQ ID NO: 260412 - DNA, 16 bp, P. troglodytes
tacaagaaacatggca

SEQ ID NO: 260413 - DNA, 16 bp, P. troglodytes
tacaagaaatgccaaa

SEQ ID NO: 260414 - DNA, 16 bp, P. troglodytes
tacaagaaatgttaaa

SEQ ID NO: 260415 - DNA, 16 bp, P. troglodytes
tacaagaatttcacaa

SEQ ID NO: 260416 - DNA, 16 bp, P. troglodytes
tacaagagacaaagaa

SEQ ID NO: 260417 - DNA, 16 bp, P. troglodytes
tacaagatctagaaaa

SEQ ID NO: 260418 - DNA, 16 bp, P. troglodytes
tacaagatgaaaaagt

SEQ ID NO: 260419 - DNA, 16 bp, P. troglodytes
tacaagatgaataagt

SEQ ID NO: 260420 - DNA, 16 bp, P. troglodytes
tacaagcaaatggaag

SEQ ID NO: 260421 - DNA, 16 bp, P. troglodytes
tacaagccaagaaatg

SEQ ID NO: 260422 - DNA, 16 bp, P. troglodytes
tacaagccagaagagg

SEQ ID NO: 260423 - DNA, 16 bp, P. troglodytes
tacaagccagaagata

SEQ ID NO: 260424 - DNA, 16 bp, P. troglodytes
tacaagccagggagag

SEQ ID NO: 260425 - DNA, 16 bp, P. troglodytes
tacaaggaactcaaac

SEQ ID NO: 260426 - DNA, 16 bp, P. troglodytes
tacaaggagaactaca

SEQ ID NO: 260427 - DNA, 16 bp, P. troglodytes
tacaaggagaagctgg

SEQ ID NO: 260428 - DNA, 16 bp, P. troglodytes
tacaaggattaaatga

SEQ ID NO: 260429 - DNA, 16 bp, P. troglodytes
tacaaggctacagcaa

SEQ ID NO: 260430 - DNA, 16 bp, P. troglodytes
tacaaggctactgtaa

SEQ ID NO: 260431 - DNA, 16 bp, P. troglodytes
tacaagggtacagtaa

SEQ ID NO: 260432 - DNA, 16 bp, P. troglodytes
tacaaggtgaagcagc

SEQ ID NO: 260433 - DNA, 16 bp, P. troglodytes
tacaagtacatgccac

SEQ ID NO: 260434 - DNA, 16 bp, P. troglodytes
tacaagtgcatgtgtc

SEQ ID NO: 260435 - DNA, 16 bp, P. troglodytes
tacaagtgtgagccac

SEQ ID NO: 260436 - DNA, 16 bp, P. troglodytes
tacaagtgtgagccat

SEQ ID NO: 260437 - DNA, 16 bp, P. troglodytes
tacaagtgtgcaccac

SEQ ID NO: 260438 - DNA, 16 bp, P. troglodytes
tacaagttgagcatcc

SEQ ID NO: 260439 - DNA, 16 bp, P. troglodytes
tacaataaagcaagct

SEQ ID NO: 260440 - DNA, 16 bp, P. troglodytes
tacaataaattattgc

SEQ ID NO: 260441 - DNA, 16 bp, P. troglodytes
tacaatagtgatgtta

SEQ ID NO: 260442 - DNA, 16 bp, P. troglodytes
tacaatatttgtcctt

SEQ ID NO: 260443 - DNA, 16 bp, P. troglodytes
tacaatattttcaact

SEQ ID NO: 260444 - DNA, 16 bp, P. troglodytes
tacaatatttttcctt

SEQ ID NO: 260445 - DNA, 16 bp, P. troglodytes
tacaatcaacaaaatg

SEQ ID NO: 260446 - DNA, 16 bp, P. troglodytes
tacaatcagcagatgg

SEQ ID NO: 260447 - DNA, 16 bp, P. troglodytes
tacaatcatggtggaa

SEQ ID NO: 260448 - DNA, 16 bp, P. troglodytes
tacaatcctggtggaa

SEQ ID NO: 260449 - DNA, 18 bp, P. troglodytes
tacaatcgggttttatac

SEQ ID NO: 260450 - DNA, 16 bp, P. troglodytes
tacaatgaaatattca

SEQ ID NO: 260451 - DNA, 16 bp, P. troglodytes
tacaatgaagaaaata

SEQ ID NO: 260452 - DNA, 16 bp, P. troglodytes
tacaatgaggagctgg

SEQ ID NO: 260453 - DNA, 16 bp, P. troglodytes
tacaatgatttatatt

SEQ ID NO: 260454 - DNA, 16 bp, P. troglodytes
tacaatgctggtggga

SEQ ID NO: 260455 - DNA, 16 bp, P. troglodytes
tacaatggcaccatct

SEQ ID NO: 260456 - DNA, 16 bp, P. troglodytes
tacaatggcatcaaaa

SEQ ID NO: 260457 - DNA, 16 bp, P. troglodytes
tacaatgggaataatt

SEQ ID NO: 260458 - DNA, 16 bp, P. troglodytes
tacaatgtatatgtat

SEQ ID NO: 260459 - DNA, 16 bp, P. troglodytes
tacaatgtatttgtgt

SEQ ID NO: 260460 - DNA, 16 bp, P. troglodytes
tacaatgtgatatttt

SEQ ID NO: 260461 - DNA, 16 bp, P. troglodytes
tacaatgtttgatttt

SEQ ID NO: 260462 - DNA, 16 bp, P. troglodytes
tacaatgtttggtttt

SEQ ID NO: 260463 - DNA, 16 bp, P. troglodytes
tacaattcagtggcat

SEQ ID NO: 260464 - DNA, 16 bp, P. troglodytes
tacaatttccatttta

SEQ ID NO: 260465 - DNA, 16 bp, P. troglodytes
tacaatttttgttaaa

SEQ ID NO: 260466 - DNA, 16 bp, P. troglodytes
tacacaaaatatattt

SEQ ID NO: 260467 - DNA, 16 bp, P. troglodytes
tacacaaatacttatt

SEQ ID NO: 260468 - DNA, 16 bp, P. troglodytes
tacacaacattgtgaa

SEQ ID NO: 260469 - DNA, 16 bp, P. troglodytes
tacacacacacacacg

SEQ ID NO: 260470 - DNA, 16 bp, P. troglodytes
tacacacacacacgca

SEQ ID NO: 260471 - DNA, 16 bp, P. troglodytes
tacacacacacataca

SEQ ID NO: 260472 - DNA, 16 bp, P. troglodytes
tacacacacacgcaca

SEQ ID NO: 260473 - DNA, 16 bp, P. troglodytes
tacacacacagacaca

SEQ ID NO: 260474 - DNA, 16 bp, P. troglodytes
tacacacacatacaca

SEQ ID NO: 260475 - DNA, 16 bp, P. troglodytes
tacacacacatgcaca

SEQ ID NO: 260476 - DNA, 16 bp, P. troglodytes
tacacacacgtacaca

SEQ ID NO: 260477 - DNA, 16 bp, P. troglodytes
tacacacatacacaca

SEQ ID NO: 260478 - DNA, 16 bp, P. troglodytes
tacacacatatacata

SEQ ID NO: 260479 - DNA, 16 bp, P. troglodytes
tacacacatatatatt

SEQ ID NO: 260480 - DNA, 16 bp, P. troglodytes
tacacacatatgcaca

SEQ ID NO: 260481 - DNA, 16 bp, P. troglodytes
tacacaccaccatgct

SEQ ID NO: 260482 - DNA, 16 bp, P. troglodytes
tacacacgtatacaca

SEQ ID NO: 260483 - DNA, 16 bp, P. troglodytes
tacacactgctggtgg

SEQ ID NO: 260484 - DNA, 16 bp, P. troglodytes
tacacactggattttg

SEQ ID NO: 260485 - DNA, 16 bp, P. troglodytes
tacacactgtgtgtgt

SEQ ID NO: 260486 - DNA, 16 bp, P. troglodytes
tacacacttttaaata

SEQ ID NO: 260487 - DNA, 16 bp, P. troglodytes
tacacagatgaagaaa

SEQ ID NO: 260488 - DNA, 16 bp, P. troglodytes
tacacagtggaatact

SEQ ID NO: 260489 - DNA, 16 bp, P. troglodytes
tacacataagataatt

SEQ ID NO: 260490 - DNA, 16 bp, P. troglodytes
tacacatacacacaca

SEQ ID NO: 260491 - DNA, 16 bp, P. troglodytes
tacacatataaacaca

SEQ ID NO: 260492 - DNA, 16 bp, P. troglodytes
tacacatatacatatg

SEQ ID NO: 260493 - DNA, 16 bp, P. troglodytes
tacacatatatcaaaa

SEQ ID NO: 260494 - DNA, 16 bp, P. troglodytes
tacacatcctattttt

SEQ ID NO: 260495 - DNA, 16 bp, P. troglodytes
tacacatgtgcaccac

SEQ ID NO: 260496 - DNA, 16 bp, P. troglodytes
tacacatttaaaattt

SEQ ID NO: 260497 - DNA, 16 bp, P. troglodytes
tacacatttatttaat

SEQ ID NO: 260498 - DNA, 16 bp, P. troglodytes
tacacatttcttaaaa

SEQ ID NO: 260499 - DNA, 16 bp, P. troglodytes
tacacattttatatat

SEQ ID NO: 260500 - DNA, 16 bp, P. troglodytes
tacaccaaaaccccat

SEQ ID NO: 260501 - DNA, 16 bp, P. troglodytes
tacaccaaactcccat

SEQ ID NO: 260502 - DNA, 16 bp, P. troglodytes
tacaccaatcagatgt

SEQ ID NO: 260503 - DNA, 16 bp, P. troglodytes
tacaccaccatgcctg

SEQ ID NO: 260504 - DNA, 18 bp, P. troglodytes
tacaccactacactccag

SEQ ID NO: 260505 - DNA, 16 bp, P. troglodytes
tacaccagcctgggtg

SEQ ID NO: 260506 - DNA, 16 bp, P. troglodytes
tacaccatggaagact

SEQ ID NO: 260507 - DNA, 16 bp, P. troglodytes
tacaccatgttggcca

SEQ ID NO: 260508 - DNA, 17 bp, P. troglodytes
tacacccagctaatttt

SEQ ID NO: 260509 - DNA, 16 bp, P. troglodytes
tacacccattccaaat

SEQ ID NO: 260510 - DNA, 16 bp, P. troglodytes
tacaccctccaaagac

SEQ ID NO: 260511 - DNA, 16 bp, P. troglodytes
tacactcacacacaca

SEQ ID NO: 260512 - DNA, 16 bp, P. troglodytes
tacactccaccctggg

SEQ ID NO: 260513 - DNA, 16 bp, P. troglodytes
tacactccagcctagg

SEQ ID NO: 260514 - DNA, 16 bp, P. troglodytes
tacactccagcctggg

SEQ ID NO: 260515 - DNA, 16 bp, P. troglodytes
tacactccagcttggg

SEQ ID NO: 260516 - DNA, 16 bp, P. troglodytes
tacactccggcctggg

SEQ ID NO: 260517 - DNA, 16 bp, P. troglodytes
tacactctagcctggg

SEQ ID NO: 260518 - DNA, 16 bp, P. troglodytes
tacactctggcctggg

SEQ ID NO: 260519 - DNA, 16 bp, P. troglodytes
tacactgaaaaaaata

SEQ ID NO: 260520 - DNA, 16 bp, P. troglodytes
tacactgaaaataaaa

SEQ ID NO: 260521 - DNA, 16 bp, P. troglodytes
tacactgacacacaga

SEQ ID NO: 260522 - DNA, 16 bp, P. troglodytes
tacactgttggtagaa

SEQ ID NO: 260523 - DNA, 16 bp, P. troglodytes
tacactgttggtggga

SEQ ID NO: 260524 - DNA, 16 bp, P. troglodytes
tacacttaaaattggt

SEQ ID NO: 260525 - DNA, 16 bp, P. troglodytes
tacacttaggctacat

SEQ ID NO: 260526 - DNA, 16 bp, P. troglodytes
tacactttatatatat

SEQ ID NO: 260527 - DNA, 16 bp, P. troglodytes
tacactttgggaggcc

SEQ ID NO: 260528 - DNA, 16 bp, P. troglodytes
tacacttttgatggga

SEQ ID NO: 260529 - DNA, 16 bp, P. troglodytes
tacagaaaaattgaaa

SEQ ID NO: 260530 - DNA, 16 bp, P. troglodytes
tacagaaaagaggttt

SEQ ID NO: 260531 - DNA, 16 bp, P. troglodytes
tacagaaaataacaag

SEQ ID NO: 260532 - DNA, 16 bp, P. troglodytes
tacagaaaataataat

SEQ ID NO: 260533 - DNA, 16 bp, P. troglodytes
tacagaaaatattttt

SEQ ID NO: 260534 - DNA, 16 bp, P. troglodytes
tacagaaaatcaaaga

SEQ ID NO: 260535 - DNA, 16 bp, P. troglodytes
tacagaaaatgttttt

SEQ ID NO: 260536 - DNA, 16 bp, P. troglodytes
tacagaaacagccaga

SEQ ID NO: 260537 - DNA, 16 bp, P. troglodytes
tacagaaagttcccat

SEQ ID NO: 260538 - DNA, 16 bp, P. troglodytes
tacagaaataaaatat

SEQ ID NO: 260539 - DNA, 16 bp, P. troglodytes
tacagaaatagaaaag

SEQ ID NO: 260540 - DNA, 16 bp, P. troglodytes
tacagaaatagaaata

SEQ ID NO: 260541 - DNA, 16 bp, P. troglodytes
tacagaacaaaatgaa

SEQ ID NO: 260542 - DNA, 16 bp, P. troglodytes
tacagaaccacagaat

SEQ ID NO: 260543 - DNA, 16 bp, P. troglodytes
tacagaataataataa

SEQ ID NO: 260544 - DNA, 16 bp, P. troglodytes
tacagaatatatttta

SEQ ID NO: 260545 - DNA, 16 bp, P. troglodytes
tacagaatgggcaaaa

SEQ ID NO: 260546 - DNA, 16 bp, P. troglodytes
tacagaattctaagtt

SEQ ID NO: 260547 - DNA, 16 bp, P. troglodytes
tacagaattttttttt

SEQ ID NO: 260548 - DNA, 16 bp, P. troglodytes
tacagacaaggaaatg

SEQ ID NO: 260549 - DNA, 16 bp, P. troglodytes
tacagacacacacata

SEQ ID NO: 260550 - DNA, 16 bp, P. troglodytes
tacagacacacccagg

SEQ ID NO: 260551 - DNA, 16 bp, P. troglodytes
tacagacagggtttca

SEQ ID NO: 260552 - DNA, 16 bp, P. troglodytes
tacagacaggttttca

SEQ ID NO: 260553 - DNA, 16 bp, P. troglodytes
tacagacattagccac

SEQ ID NO: 260554 - DNA, 17 bp, P. troglodytes
tacagacggggtttcac

SEQ ID NO: 260555 - DNA, 16 bp, P. troglodytes
tacagagaacaggaat

SEQ ID NO: 260556 - DNA, 16 bp, P. troglodytes
tacagagaagaaaata

SEQ ID NO: 260557 - DNA, 16 bp, P. troglodytes
tacagagagttcccat

SEQ ID NO: 260558 - DNA, 16 bp, P. troglodytes
tacagagcaagaccct

SEQ ID NO: 260559 - DNA, 16 bp, P. troglodytes
tacagagcaagactcc

SEQ ID NO: 260560 - DNA, 16 bp, P. troglodytes
tacagagctgtagtaa

SEQ ID NO: 260561 - DNA, 16 bp, P. troglodytes
tacagaggaaaagaaa

SEQ ID NO: 260562 - DNA, 16 bp, P. troglodytes
tacagaggaggaaaca

SEQ ID NO: 260563 - DNA, 16 bp, P. troglodytes
tacagagggcccctgg

SEQ ID NO: 260564 - DNA, 19 bp, P. troglodytes
tacagagtctcactctgtt

SEQ ID NO: 260565 - DNA, 16 bp, P. troglodytes
tacagagtgagaccct

SEQ ID NO: 260566 - DNA, 16 bp, P. troglodytes
tacagagtttctgttt

SEQ ID NO: 260567 - DNA, 16 bp, P. troglodytes
tacagataagaaaaca

SEQ ID NO: 260568 - DNA, 16 bp, P. troglodytes
tacagataagaaaacc

SEQ ID NO: 260569 - DNA, 16 bp, P. troglodytes
tacagatatgagccat

SEQ ID NO: 260570 - DNA, 16 bp, P. troglodytes
tacagatgaagaaatg

SEQ ID NO: 260571 - DNA, 16 bp, P. troglodytes
tacagatgaggaaaaa

SEQ ID NO: 260572 - DNA, 16 bp, P. troglodytes
tacagatgaggaaaag

SEQ ID NO: 260573 - DNA, 16 bp, P. troglodytes
tacagatgcatgccac

SEQ ID NO: 260574 - DNA, 16 bp, P. troglodytes
tacagatggggaaacc

SEQ ID NO: 260575 - DNA, 17 bp, P. troglodytes
tacagattatttcatca

SEQ ID NO: 260576 - DNA, 16 bp, P. troglodytes
tacagattcattgcaa

SEQ ID NO: 260577 - DNA, 16 bp, P. troglodytes
tacagcaaaaatatgg

SEQ ID NO: 260578 - DNA, 16 bp, P. troglodytes
tacagcaaaggaaaca

SEQ ID NO: 260579 - DNA, 16 bp, P. troglodytes
tacagcaccttcaact

SEQ ID NO: 260580 - DNA, 16 bp, P. troglodytes
tacagcagaagtgatg

SEQ ID NO: 260581 - DNA, 16 bp, P. troglodytes
tacagcagcaatggga

SEQ ID NO: 260582 - DNA, 16 bp, P. troglodytes
tacagcagtgagcaaa

SEQ ID NO: 260583 - DNA, 16 bp, P. troglodytes
tacagcatgatgacta

SEQ ID NO: 260584 - DNA, 16 bp, P. troglodytes
tacagcatggtttact

SEQ ID NO: 260585 - DNA, 16 bp, P. troglodytes
tacagcatgttattgt

SEQ ID NO: 260586 - DNA, 18 bp, P. troglodytes
tacagccataccaccctg

SEQ ID NO: 260587 - DNA, 16 bp, P. troglodytes
tacagccccactcctg

SEQ ID NO: 260588 - DNA, 16 bp, P. troglodytes
tacagccgggcgcagt

SEQ ID NO: 260589 - DNA, 16 bp, P. troglodytes
tacagcctccctcccg

SEQ ID NO: 260590 - DNA, 16 bp, P. troglodytes
tacagcctgaagaacc

SEQ ID NO: 260591 - DNA, 16 bp, P. troglodytes
tacagcctgcagaaac

SEQ ID NO: 260592 - DNA, 16 bp, P. troglodytes
tacagcctgcaggcca

SEQ ID NO: 260593 - DNA, 16 bp, P. troglodytes
tacagcctgggcaaca

SEQ ID NO: 260594 - DNA, 16 bp, P. troglodytes
tacagcctgggcaata

SEQ ID NO: 260595 - DNA, 16 bp, P. troglodytes
tacagcctgggcgaca

SEQ ID NO: 260596 - DNA, 16 bp, P. troglodytes
tacagctatacaatgt

SEQ ID NO: 260597 - DNA, 16 bp, P. troglodytes
tacagctcaggccatt

SEQ ID NO: 260598 - DNA, 16 bp, P. troglodytes
tacagctcattgcagc

SEQ ID NO: 260599 - DNA, 16 bp, P. troglodytes
tacagcttggtgtttg

SEQ ID NO: 260600 - DNA, 16 bp, P. troglodytes
tacaggaaaacaaaca

SEQ ID NO: 260601 - DNA, 16 bp, P. troglodytes
tacaggaaaagcagaa

SEQ ID NO: 260602 - DNA, 16 bp, P. troglodytes
tacaggaaacatggct

SEQ ID NO: 260603 - DNA, 16 bp, P. troglodytes
tacaggaaatacagag

SEQ ID NO: 260604 - DNA, 16 bp, P. troglodytes
tacaggaagcatggct

SEQ ID NO: 260605 - DNA, 16 bp, P. troglodytes
tacaggaagcatggtg

SEQ ID NO: 260606 - DNA, 16 bp, P. troglodytes
tacaggaatgttcata

SEQ ID NO: 260607 - DNA, 16 bp, P. troglodytes
tacaggatgctcagtt

SEQ ID NO: 260608 - DNA, 16 bp, P. troglodytes
tacaggcaagtgccac

SEQ ID NO: 260609 - DNA, 16 bp, P. troglodytes
tacaggcacaagccac

SEQ ID NO: 260610 - DNA, 16 bp, P. troglodytes
tacaggcacatgccac

SEQ ID NO: 260611 - DNA, 18 bp, P. troglodytes
tacaggcaccggccacca

SEQ ID NO: 260612 - DNA, 16 bp, P. troglodytes
tacaggcacctgccac

SEQ ID NO: 260613 - DNA, 16 bp, P. troglodytes
tacaggcacctgcccc

SEQ ID NO: 260614 - DNA, 16 bp, P. troglodytes
tacaggcacgcagcac

SEQ ID NO: 260615 - DNA, 16 bp, P. troglodytes
tacaggcacttgccac

SEQ ID NO: 260616 - DNA, 18 bp, P. troglodytes
tacaggcatgaggcacca

SEQ ID NO: 260617 - DNA, 16 bp, P. troglodytes
tacaggccaggaaaga

SEQ ID NO: 260618 - DNA, 16 bp, P. troglodytes
tacaggcctgacccac

SEQ ID NO: 260619 - DNA, 16 bp, P. troglodytes
tacaggcgcccaccac

SEQ ID NO: 260620 - DNA, 16 bp, P. troglodytes
tacaggcgcgagccac

SEQ ID NO: 260621 - DNA, 16 bp, P. troglodytes
tacaggcgggagccac

SEQ ID NO: 260622 - DNA, 18 bp, P. troglodytes
tacaggcgtgagccaacg

SEQ ID NO: 260623 - DNA, 16 bp, P. troglodytes
tacaggcgtgagccgc

SEQ ID NO: 260624 - DNA, 16 bp, P. troglodytes
tacaggcttgagccat

SEQ ID NO: 260625 - DNA, 17 bp, P. troglodytes
tacagggaactcaaaca

SEQ ID NO: 260626 - DNA, 16 bp, P. troglodytes
tacagggttgttgtga

SEQ ID NO: 260627 - DNA, 16 bp, P. troglodytes
tacaggtacatgccac

SEQ ID NO: 260628 - DNA, 16 bp, P. troglodytes
tacaggtcataaagac

SEQ ID NO: 260629 - DNA, 16 bp, P. troglodytes
tacaggtgcgtgctac

SEQ ID NO: 260630 - DNA, 16 bp, P. troglodytes
tacaggtggccgccac

SEQ ID NO: 260631 - DNA, 16 bp, P. troglodytes
tacaggtgtgtaccac

SEQ ID NO: 260632 - DNA, 23 bp, P. troglodytes
tacaggtgtgtgccaccacacct

SEQ ID NO: 260633 - DNA, 16 bp, P. troglodytes
tacaggttaagtatcc

SEQ ID NO: 260634 - DNA, 16 bp, P. troglodytes
tacaggttgagcatcc

SEQ ID NO: 260635 - DNA, 16 bp, P. troglodytes
tacagtaaagaaacag

SEQ ID NO: 260636 - DNA, 16 bp, P. troglodytes
tacagtaagatatttt

SEQ ID NO: 260637 - DNA, 16 bp, P. troglodytes
tacagtaggaaaaaaa

SEQ ID NO: 260638 - DNA, 16 bp, P. troglodytes
tacagtataaaagatt

SEQ ID NO: 260639 - DNA, 16 bp, P. troglodytes
tacagtatacactgct

SEQ ID NO: 260640 - DNA, 16 bp, P. troglodytes
tacagtatattgttat

SEQ ID NO: 260641 - DNA, 16 bp, P. troglodytes
tacagtattcaataca

SEQ ID NO: 260642 - DNA, 16 bp, P. troglodytes
tacagtattttcaact

SEQ ID NO: 260643 - DNA, 16 bp, P. troglodytes
tacagtatttttttta

SEQ ID NO: 260644 - DNA, 16 bp, P. troglodytes
tacagtcaccaaaaca

SEQ ID NO: 260645 - DNA, 16 bp, P. troglodytes
tacagtcactctggaa

SEQ ID NO: 260646 - DNA, 16 bp, P. troglodytes
tacagtcatgtgttgc

SEQ ID NO: 260647 - DNA, 16 bp, P. troglodytes
tacagtcattatgaaa

SEQ ID NO: 260648 - DNA, 16 bp, P. troglodytes
tacagtccttgtttct

SEQ ID NO: 260649 - DNA, 16 bp, P. troglodytes
tacagtctcggctcac

SEQ ID NO: 260650 - DNA, 16 bp, P. troglodytes
tacagtctgcagaact

SEQ ID NO: 260651 - DNA, 16 bp, P. troglodytes
tacagtcttgctctgt

SEQ ID NO: 260652 - DNA, 16 bp, P. troglodytes
tacagtgaaatattat

SEQ ID NO: 260653 - DNA, 16 bp, P. troglodytes
tacagtgaactgtgat

SEQ ID NO: 260654 - DNA, 16 bp, P. troglodytes
tacagtgagataccat

SEQ ID NO: 260655 - DNA, 16 bp, P. troglodytes
tacagtgagccgaggt

SEQ ID NO: 260656 - DNA, 16 bp, P. troglodytes
tacagtgagctacgat

SEQ ID NO: 260657 - DNA, 16 bp, P. troglodytes
tacagtgagctatgat

SEQ ID NO: 260658 - DNA, 16 bp, P. troglodytes
tacagtggcgcgatct

SEQ ID NO: 260659 - DNA, 16 bp, P. troglodytes
tacagtggtgtgatct

SEQ ID NO: 260660 - DNA, 16 bp, P. troglodytes
tacagtgtacactgct

SEQ ID NO: 260661 - DNA, 16 bp, P. troglodytes
tacagtgtgatatttc

SEQ ID NO: 260662 - DNA, 16 bp, P. troglodytes
tacagtgtggatgaac

SEQ ID NO: 260663 - DNA, 16 bp, P. troglodytes
tacagtgtgtgccacc

SEQ ID NO: 260664 - DNA, 16 bp, P. troglodytes
tacagttgatcctcat

SEQ ID NO: 260665 - DNA, 16 bp, P. troglodytes
tacagttgcctatagt

SEQ ID NO: 260666 - DNA, 16 bp, P. troglodytes
tacagttggccctctg

SEQ ID NO: 260667 - DNA, 16 bp, P. troglodytes
tacagtttcagttttc

SEQ ID NO: 260668 - DNA, 16 bp, P. troglodytes
tacagtttctttaaaa

SEQ ID NO: 260669 - DNA, 16 bp, P. troglodytes
tacagtttgatgaatt

SEQ ID NO: 260670 - DNA, 16 bp, P. troglodytes
tacagtttggatattt

SEQ ID NO: 260671 - DNA, 16 bp, P. troglodytes
tacagttttcagtgta

SEQ ID NO: 260672 - DNA, 16 bp, P. troglodytes
tacagttttgtttgtt

SEQ ID NO: 260673 - DNA, 16 bp, P. troglodytes
tacagttttgttttct

SEQ ID NO: 260674 - DNA, 16 bp, P. troglodytes
tacataaaattagcca

SEQ ID NO: 260675 - DNA, 16 bp, P. troglodytes
tacataaagaactctt

SEQ ID NO: 260676 - DNA, 16 bp, P. troglodytes
tacataaaggtaaagg

SEQ ID NO: 260677 - DNA, 16 bp, P. troglodytes
tacataaagtgcttag

SEQ ID NO: 260678 - DNA, 16 bp, P. troglodytes
tacataaatacacaca

SEQ ID NO: 260679 - DNA, 16 bp, P. troglodytes
tacataaatatgtaat

SEQ ID NO: 260680 - DNA, 16 bp, P. troglodytes
tacatacaatgaaatg

SEQ ID NO: 260681 - DNA, 16 bp, P. troglodytes
tacatacacacatttt

SEQ ID NO: 260682 - DNA, 16 bp, P. troglodytes
tacatacacatatgca

SEQ ID NO: 260683 - DNA, 16 bp, P. troglodytes
tacatacatacataca

SEQ ID NO: 260684 - DNA, 16 bp, P. troglodytes
tacatacatacattta

SEQ ID NO: 260685 - DNA, 16 bp, P. troglodytes
tacatacatatacaca

SEQ ID NO: 260686 - DNA, 16 bp, P. troglodytes
tacatacatatatgtg

SEQ ID NO: 260687 - DNA, 16 bp, P. troglodytes
tacatacatatttata

SEQ ID NO: 260688 - DNA, 16 bp, P. troglodytes
tacatacatgtttata

SEQ ID NO: 260689 - DNA, 16 bp, P. troglodytes
tacatacattatttta

SEQ ID NO: 260690 - DNA, 16 bp, P. troglodytes
tacatacattttaata

SEQ ID NO: 260691 - DNA, 16 bp, P. troglodytes
tacatacattttatat

SEQ ID NO: 260692 - DNA, 16 bp, P. troglodytes
tacatacctatatata

SEQ ID NO: 260693 - DNA, 16 bp, P. troglodytes
tacatactgtactact

SEQ ID NO: 260694 - DNA, 16 bp, P. troglodytes
tacatactgtataatt

SEQ ID NO: 260695 - DNA, 16 bp, P. troglodytes
tacatagtatgtgtat

SEQ ID NO: 260696 - DNA, 16 bp, P. troglodytes
tacatataaaaatgta

SEQ ID NO: 260697 - DNA, 16 bp, P. troglodytes
tacatatacacacaca

SEQ ID NO: 260698 - DNA, 16 bp, P. troglodytes
tacatatacacataca

SEQ ID NO: 260699 - DNA, 20 bp, P. troglodytes
tacatatacaccatggaata

SEQ ID NO: 260700 - DNA, 16 bp, P. troglodytes
tacatatacatatatc

SEQ ID NO: 260701 - DNA, 16 bp, P. troglodytes
tacatatacatatatt

SEQ ID NO: 260702 - DNA, 16 bp, P. troglodytes
tacatatacatgtgta

SEQ ID NO: 260703 - DNA, 16 bp, P. troglodytes
tacatatactatgttt

SEQ ID NO: 260704 - DNA, 16 bp, P. troglodytes
tacatatataatatac

SEQ ID NO: 260705 - DNA, 16 bp, P. troglodytes
tacatatatacacaca

SEQ ID NO: 260706 - DNA, 16 bp, P. troglodytes
tacatatatacattta

SEQ ID NO: 260707 - DNA, 16 bp, P. troglodytes
tacatatatatacaca

SEQ ID NO: 260708 - DNA, 16 bp, P. troglodytes
tacatatatatatttg

SEQ ID NO: 260709 - DNA, 16 bp, P. troglodytes
tacatatatatgaaaa

SEQ ID NO: 260710 - DNA, 16 bp, P. troglodytes
tacatatatatgcaca

SEQ ID NO: 260711 - DNA, 16 bp, P. troglodytes
tacatatatatttaga

SEQ ID NO: 260712 - DNA, 16 bp, P. troglodytes
tacatatatgtacaca

SEQ ID NO: 260713 - DNA, 16 bp, P. troglodytes
tacatatatttgcata

SEQ ID NO: 260714 - DNA, 16 bp, P. troglodytes
tacatatatttgtata

SEQ ID NO: 260715 - DNA, 16 bp, P. troglodytes
tacatatgcagaatgt

SEQ ID NO: 260716 - DNA, 16 bp, P. troglodytes
tacatatgtaaaatat

SEQ ID NO: 260717 - DNA, 16 bp, P. troglodytes
tacatatgtaaataac

SEQ ID NO: 260718 - DNA, 16 bp, P. troglodytes
tacatatgtacacatg

SEQ ID NO: 260719 - DNA, 16 bp, P. troglodytes
tacatatgtatatgta

SEQ ID NO: 260720 - DNA, 16 bp, P. troglodytes
tacatatgtattacat

SEQ ID NO: 260721 - DNA, 16 bp, P. troglodytes
tacatatgtgtatata

SEQ ID NO: 260722 - DNA, 16 bp, P. troglodytes
tacatatgtgtgtata

SEQ ID NO: 260723 - DNA, 16 bp, P. troglodytes
tacatatgtttatata

SEQ ID NO: 260724 - DNA, 16 bp, P. troglodytes
tacatattatatgtaa

SEQ ID NO: 260725 - DNA, 16 bp, P. troglodytes
tacatattatgtatta

SEQ ID NO: 260726 - DNA, 16 bp, P. troglodytes
tacatattcaataaat

SEQ ID NO: 260727 - DNA, 16 bp, P. troglodytes
tacatatttaatgaat

SEQ ID NO: 260728 - DNA, 16 bp, P. troglodytes
tacatatttgaaaata

SEQ ID NO: 260729 - DNA, 16 bp, P. troglodytes
tacatatttgtataca

SEQ ID NO: 260730 - DNA, 16 bp, P. troglodytes
tacatcaaaaaagtaa

SEQ ID NO: 260731 - DNA, 17 bp, P. troglodytes
tacatcaaaaagcttat

SEQ ID NO: 260732 - DNA, 16 bp, P. troglodytes
tacatcaaaatagaac

SEQ ID NO: 260733 - DNA, 16 bp, P. troglodytes
tacatcacagaatact

SEQ ID NO: 260734 - DNA, 16 bp, P. troglodytes
tacatcagacaaaata

SEQ ID NO: 260735 - DNA, 16 bp, P. troglodytes
tacatcagcatcacca

SEQ ID NO: 260736 - DNA, 16 bp, P. troglodytes
tacatcctgctgattg

SEQ ID NO: 260737 - DNA, 16 bp, P. troglodytes
tacatctactatgtac

SEQ ID NO: 260738 - DNA, 16 bp, P. troglodytes
tacatctagaaaaccc

SEQ ID NO: 260739 - DNA, 16 bp, P. troglodytes
tacatctatgtattta

SEQ ID NO: 260740 - DNA, 16 bp, P. troglodytes
tacatctcattggcca

SEQ ID NO: 260741 - DNA, 16 bp, P. troglodytes
tacatctggtccagct

SEQ ID NO: 260742 - DNA, 16 bp, P. troglodytes
tacatcttcctccatc

SEQ ID NO: 260743 - DNA, 16 bp, P. troglodytes
tacatgaaaagatact

SEQ ID NO: 260744 - DNA, 16 bp, P. troglodytes
tacatgaaaataaatt

SEQ ID NO: 260745 - DNA, 16 bp, P. troglodytes
tacatgaataaacaaa

SEQ ID NO: 260746 - DNA, 16 bp, P. troglodytes
tacatgaggaaactga

SEQ ID NO: 260747 - DNA, 16 bp, P. troglodytes
tacatgcacacacaca

SEQ ID NO: 260748 - DNA, 17 bp, P. troglodytes
tacatgcaggtcacagg

SEQ ID NO: 260749 - DNA, 17 bp, P. troglodytes
tacatggaaattgaaca

SEQ ID NO: 260750 - DNA, 17 bp, P. troglodytes
tacatggataagttctt

SEQ ID NO: 260751 - DNA, 16 bp, P. troglodytes
tacatgggaattatgg

SEQ ID NO: 260752 - DNA, 16 bp, P. troglodytes
tacatgggcatgtgtc

SEQ ID NO: 260753 - DNA, 16 bp, P. troglodytes
tacatgggtgtgttca

SEQ ID NO: 260754 - DNA, 16 bp, P. troglodytes
tacatgtaagacctga

SEQ ID NO: 260755 - DNA, 27 bp, P. troglodytes
tacatgtaccctaaaacttaaagtata

SEQ ID NO: 260756 - DNA, 16 bp, P. troglodytes
tacatgtatatacaca

SEQ ID NO: 260757 - DNA, 16 bp, P. troglodytes
tacatgtatatatcta

SEQ ID NO: 260758 - DNA, 16 bp, P. troglodytes
tacatgtatatattgt

SEQ ID NO: 260759 - DNA, 16 bp, P. troglodytes
tacatgtattatatac

SEQ ID NO: 260760 - DNA, 16 bp, P. troglodytes
tacatgtattatttct

SEQ ID NO: 260761 - DNA, 16 bp, P. troglodytes
tacatgtatttatatt

SEQ ID NO: 260762 - DNA, 16 bp, P. troglodytes
tacatgtatttgtttg

SEQ ID NO: 260763 - DNA, 16 bp, P. troglodytes
tacatgtattttcttt

SEQ ID NO: 260764 - DNA, 16 bp, P. troglodytes
tacatgtatttttaaa

SEQ ID NO: 260765 - DNA, 16 bp, P. troglodytes
tacatgtgcacacaca

SEQ ID NO: 260766 - DNA, 18 bp, P. troglodytes
tacatgtgcacagtgtgc

SEQ ID NO: 260767 - DNA, 16 bp, P. troglodytes
tacatgtgtaatatat

SEQ ID NO: 260768 - DNA, 16 bp, P. troglodytes
tacatgtgtcatgctg

SEQ ID NO: 260769 - DNA, 16 bp, P. troglodytes
tacatgtgtgtgtgta

SEQ ID NO: 260770 - DNA, 16 bp, P. troglodytes
tacatgtgttagataa

SEQ ID NO: 260771 - DNA, 16 bp, P. troglodytes
tacatgttaatataaa

SEQ ID NO: 260772 - DNA, 16 bp, P. troglodytes
tacatgtttattgaat

SEQ ID NO: 260773 - DNA, 16 bp, P. troglodytes
tacatgtttgaaattt

SEQ ID NO: 260774 - DNA, 16 bp, P. troglodytes
tacatgtttttaaatt

SEQ ID NO: 260775 - DNA, 16 bp, P. troglodytes
tacattaaaaagatca

SEQ ID NO: 260776 - DNA, 16 bp, P. troglodytes
tacattaatagatttt

SEQ ID NO: 260777 - DNA, 16 bp, P. troglodytes
tacattagggtttact

SEQ ID NO: 260778 - DNA, 16 bp, P. troglodytes
tacattataatgtata

SEQ ID NO: 260779 - DNA, 16 bp, P. troglodytes
tacattatatatgtat

SEQ ID NO: 260780 - DNA, 16 bp, P. troglodytes
tacattatctcactta

SEQ ID NO: 260781 - DNA, 16 bp, P. troglodytes
tacattattattaact

SEQ ID NO: 260782 - DNA, 16 bp, P. troglodytes
tacattattcattata

SEQ ID NO: 260783 - DNA, 16 bp, P. troglodytes
tacattcataaggttt

SEQ ID NO: 260784 - DNA, 16 bp, P. troglodytes
tacattcatagggttt

SEQ ID NO: 260785 - DNA, 16 bp, P. troglodytes
tacattccaaccagca

SEQ ID NO: 260786 - DNA, 16 bp, P. troglodytes
tacattccagcctggg

SEQ ID NO: 260787 - DNA, 16 bp, P. troglodytes
tacattcccattagca

SEQ ID NO: 260788 - DNA, 16 bp, P. troglodytes
tacattctcccaagac

SEQ ID NO: 260789 - DNA, 16 bp, P. troglodytes
tacattctggatatta

SEQ ID NO: 260790 - DNA, 16 bp, P. troglodytes
tacattcttctcagca

SEQ ID NO: 260791 - DNA, 16 bp, P. troglodytes
tacattgtgtaatgat

SEQ ID NO: 260792 - DNA, 16 bp, P. troglodytes
tacattgtgtttttgt

SEQ ID NO: 260793 - DNA, 16 bp, P. troglodytes
tacatttaaaatgttt

SEQ ID NO: 260794 - DNA, 16 bp, P. troglodytes
tacatttaaacatttt

SEQ ID NO: 260795 - DNA, 16 bp, P. troglodytes
tacatttaaagtaatt

SEQ ID NO: 260796 - DNA, 16 bp, P. troglodytes
tacatttaagtctgta

SEQ ID NO: 260797 - DNA, 16 bp, P. troglodytes
tacatttagaaaaaaa

SEQ ID NO: 260798 - DNA, 16 bp, P. troglodytes
tacatttatgttttat

SEQ ID NO: 260799 - DNA, 16 bp, P. troglodytes
tacatttcaaaatcaa

SEQ ID NO: 260800 - DNA, 16 bp, P. troglodytes
tacatttccatttatt

SEQ ID NO: 260801 - DNA, 16 bp, P. troglodytes
tacatttctaatcatt

SEQ ID NO: 260802 - DNA, 16 bp, P. troglodytes
tacatttctataaata

SEQ ID NO: 260803 - DNA, 16 bp, P. troglodytes
tacatttctgttcatt

SEQ ID NO: 260804 - DNA, 16 bp, P. troglodytes
tacatttctgtttctt

SEQ ID NO: 260805 - DNA, 16 bp, P. troglodytes
tacatttgaaaatttt

SEQ ID NO: 260806 - DNA, 16 bp, P. troglodytes
tacatttgatttttaa

SEQ ID NO: 260807 - DNA, 16 bp, P. troglodytes
tacattttaaaaatgt

SEQ ID NO: 260808 - DNA, 16 bp, P. troglodytes
tacattttaaaacatt

SEQ ID NO: 260809 - DNA, 16 bp, P. troglodytes
tacattttaaaagcaa

SEQ ID NO: 260810 - DNA, 16 bp, P. troglodytes
tacattttcataaaat

SEQ ID NO: 260811 - DNA, 16 bp, P. troglodytes
tacattttccaaaaca

SEQ ID NO: 260812 - DNA, 16 bp, P. troglodytes
tacattttctcattta

SEQ ID NO: 260813 - DNA, 17 bp, P. troglodytes
tacattttctttatcca

SEQ ID NO: 260814 - DNA, 16 bp, P. troglodytes
tacattttgaaatcag

SEQ ID NO: 260815 - DNA, 16 bp, P. troglodytes
tacattttgtaaggct

SEQ ID NO: 260816 - DNA, 16 bp, P. troglodytes
tacattttgtttttaa

SEQ ID NO: 260817 - DNA, 16 bp, P. troglodytes
tacatttttaaaatca

SEQ ID NO: 260818 - DNA, 16 bp, P. troglodytes
tacatttttaaagttt

SEQ ID NO: 260819 - DNA, 16 bp, P. troglodytes
tacatttttaaatagt

SEQ ID NO: 260820 - DNA, 16 bp, P. troglodytes
tacatttttcaaaact

SEQ ID NO: 260821 - DNA, 16 bp, P. troglodytes
tacatttttgaaaata

SEQ ID NO: 260822 - DNA, 16 bp, P. troglodytes
tacatttttgtaaatc

SEQ ID NO: 260823 - DNA, 16 bp, P. troglodytes
tacatttttgtttaat

SEQ ID NO: 260824 - DNA, 16 bp, P. troglodytes
tacattttttaaaatg

SEQ ID NO: 260825 - DNA, 16 bp, P. troglodytes
tacatttttttcctaa

SEQ ID NO: 260826 - DNA, 16 bp, P. troglodytes
tacatttttttctgaa

SEQ ID NO: 260827 - DNA, 16 bp, P. troglodytes
taccaaaaaaatggaa

SEQ ID NO: 260828 - DNA, 16 bp, P. troglodytes
taccaaaaagacatat

SEQ ID NO: 260829 - DNA, 16 bp, P. troglodytes
taccaaaacagatata

SEQ ID NO: 260830 - DNA, 16 bp, P. troglodytes
taccaaaatatttatt

SEQ ID NO: 260831 - DNA, 16 bp, P. troglodytes
taccaaaatttattta

SEQ ID NO: 260832 - DNA, 16 bp, P. troglodytes
taccaaagacatggaa

SEQ ID NO: 260833 - DNA, 16 bp, P. troglodytes
taccaaagattactaa

SEQ ID NO: 260834 - DNA, 16 bp, P. troglodytes
taccaaagcctggaag

SEQ ID NO: 260835 - DNA, 16 bp, P. troglodytes
taccaaatgtttaaag

SEQ ID NO: 260836 - DNA, 16 bp, P. troglodytes
taccaagaaccagaaa

SEQ ID NO: 260837 - DNA, 16 bp, P. troglodytes
taccaagacagttgta

SEQ ID NO: 260838 - DNA, 17 bp, P. troglodytes
taccaagcaaatggaaa

SEQ ID NO: 260839 - DNA, 16 bp, P. troglodytes
taccaataaaacttta

SEQ ID NO: 260840 - DNA, 16 bp, P. troglodytes
taccaatgacattctt

SEQ ID NO: 260841 - DNA, 16 bp, P. troglodytes
taccaatttgctgtat

SEQ ID NO: 260842 - DNA, 16 bp, P. troglodytes
taccacaaactgagtg

SEQ ID NO: 260843 - DNA, 16 bp, P. troglodytes
taccacaaacttagtg

SEQ ID NO: 260844 - DNA, 16 bp, P. troglodytes
taccacaattaaaaat

SEQ ID NO: 260845 - DNA, 16 bp, P. troglodytes
taccacaatttaaaaa

SEQ ID NO: 260846 - DNA, 20 bp, P. troglodytes
taccacacccggctaatttt

SEQ ID NO: 260847 - DNA, 16 bp, P. troglodytes
taccacagtttgttca

SEQ ID NO: 260848 - DNA, 16 bp, P. troglodytes
taccacagtttgttta

SEQ ID NO: 260849 - DNA, 16 bp, P. troglodytes
taccaccaagcccggc

SEQ ID NO: 260850 - DNA, 16 bp, P. troglodytes
taccaccacacccggc

SEQ ID NO: 260851 - DNA, 16 bp, P. troglodytes
taccaccatgcctggc

SEQ ID NO: 260852 - DNA, 17 bp, P. troglodytes
taccaccatgctcggct

SEQ ID NO: 260853 - DNA, 16 bp, P. troglodytes
taccaccatggctggc

SEQ ID NO: 260854 - DNA, 16 bp, P. troglodytes
taccacctcataccca

SEQ ID NO: 260855 - DNA, 18 bp, P. troglodytes
taccacgcccagctaatt

SEQ ID NO: 260856 - DNA, 18 bp, P. troglodytes
taccactcccagctaatt

SEQ ID NO: 260857 - DNA, 16 bp, P. troglodytes
taccactctctcctgg

SEQ ID NO: 260858 - DNA, 16 bp, P. troglodytes
taccactctggtgcag

SEQ ID NO: 260859 - DNA, 16 bp, P. troglodytes
taccactgccctccag

SEQ ID NO: 260860 - DNA, 16 bp, P. troglodytes
taccagaagaaaacat

SEQ ID NO: 260861 - DNA, 16 bp, P. troglodytes
taccagaatctcaggg

SEQ ID NO: 260862 - DNA, 17 bp, P. troglodytes
taccagaatctctggga

SEQ ID NO: 260863 - DNA, 16 bp, P. troglodytes
taccagaattactttt

SEQ ID NO: 260864 - DNA, 16 bp, P. troglodytes
taccagaggctggggg

SEQ ID NO: 260865 - DNA, 17 bp, P. troglodytes
taccagatgtggtttca

SEQ ID NO: 260866 - DNA, 16 bp, P. troglodytes
taccagcaccatgaca

SEQ ID NO: 260867 - DNA, 16 bp, P. troglodytes
taccagccacagcaaa

SEQ ID NO: 260868 - DNA, 16 bp, P. troglodytes
taccagcccagagcct

SEQ ID NO: 260869 - DNA, 17 bp, P. troglodytes
taccagcctgggcaaca

SEQ ID NO: 260870 - DNA, 16 bp, P. troglodytes
taccagctcacattcc

SEQ ID NO: 260871 - DNA, 16 bp, P. troglodytes
taccagctcagccaca

SEQ ID NO: 260872 - DNA, 17 bp, P. troglodytes
taccagctgctgcaaaa

SEQ ID NO: 260873 - DNA, 16 bp, P. troglodytes
taccagctgggcacag

SEQ ID NO: 260874 - DNA, 16 bp, P. troglodytes
taccagggataaagag

SEQ ID NO: 260875 - DNA, 16 bp, P. troglodytes
taccataatttactta

SEQ ID NO: 260876 - DNA, 16 bp, P. troglodytes
taccatactggacagc

SEQ ID NO: 260877 - DNA, 16 bp, P. troglodytes
taccatcacattggag

SEQ ID NO: 260878 - DNA, 16 bp, P. troglodytes
taccatctcattaaaa

SEQ ID NO: 260879 - DNA, 16 bp, P. troglodytes
taccatgaggcttaca

SEQ ID NO: 260880 - DNA, 16 bp, P. troglodytes
taccatgcccagctaa

SEQ ID NO: 260881 - DNA, 16 bp, P. troglodytes
taccattatataatga

SEQ ID NO: 260882 - DNA, 20 bp, P. troglodytes
taccattcaggacacaggca

SEQ ID NO: 260883 - DNA, 17 bp, P. troglodytes
taccattcaggacatac

SEQ ID NO: 260884 - DNA, 27 bp, P. troglodytes
taccattcaggacataggcatgggcaa

SEQ ID NO: 260885 - DNA, 16 bp, P. troglodytes
taccattcaggacatt

SEQ ID NO: 260886 - DNA, 19 bp, P. troglodytes
taccattcaggccataggc

SEQ ID NO: 260887 - DNA, 20 bp, P. troglodytes
taccattcagggcataggca

SEQ ID NO: 260888 - DNA, 16 bp, P. troglodytes
taccatttattaaata

SEQ ID NO: 260889 - DNA, 16 bp, P. troglodytes
taccatttcagtcttg

SEQ ID NO: 260890 - DNA, 16 bp, P. troglodytes
taccatttgactcagc

SEQ ID NO: 260891 - DNA, 16 bp, P. troglodytes
taccatttgatccagc

SEQ ID NO: 260892 - DNA, 16 bp, P. troglodytes
taccattttacatttc

SEQ ID NO: 260893 - DNA, 16 bp, P. troglodytes
tacccaaaccagacaa

SEQ ID NO: 260894 - DNA, 16 bp, P. troglodytes
tacccaaagaaataga

SEQ ID NO: 260895 - DNA, 16 bp, P. troglodytes
tacccaaagaactata

SEQ ID NO: 260896 - DNA, 16 bp, P. troglodytes
tacccaacaactgcag

SEQ ID NO: 260897 - DNA, 16 bp, P. troglodytes
tacccaacaattgcag

SEQ ID NO: 260898 - DNA, 16 bp, P. troglodytes
tacccaacttcaaaat

SEQ ID NO: 260899 - DNA, 16 bp, P. troglodytes
tacccaagaactgcag

SEQ ID NO: 260900 - DNA, 16 bp, P. troglodytes
tacccaataaatattt

SEQ ID NO: 260901 - DNA, 16 bp, P. troglodytes
tacccacctcagcctc

SEQ ID NO: 260902 - DNA, 16 bp, P. troglodytes
tacccactgcttgctc

SEQ ID NO: 260903 - DNA, 16 bp, P. troglodytes
tacccagaagtgagat

SEQ ID NO: 260904 - DNA, 16 bp, P. troglodytes
tacccagataattttt

SEQ ID NO: 260905 - DNA, 16 bp, P. troglodytes
tacccagattcataaa

SEQ ID NO: 260906 - DNA, 16 bp, P. troglodytes
tacccagcaatcccat

SEQ ID NO: 260907 - DNA, 16 bp, P. troglodytes
tacccaggctggtctt

SEQ ID NO: 260908 - DNA, 16 bp, P. troglodytes
tacccagtaatgaaat

SEQ ID NO: 260909 - DNA, 16 bp, P. troglodytes
tacccagtctcaggaa

SEQ ID NO: 260910 - DNA, 16 bp, P. troglodytes
tacccagtctcagtat

SEQ ID NO: 260911 - DNA, 16 bp, P. troglodytes
tacccattgtttagct

SEQ ID NO: 260912 - DNA, 16 bp, P. troglodytes
taccccatctctctct

SEQ ID NO: 260913 - DNA, 18 bp, P. troglodytes
taccccctgcttgctcaa

SEQ ID NO: 260914 - DNA, 16 bp, P. troglodytes
tacccctgaacctgaa

SEQ ID NO: 260915 - DNA, 16 bp, P. troglodytes
tacccctgatgaacat

SEQ ID NO: 260916 - DNA, 16 bp, P. troglodytes
taccctaagcaaatta

SEQ ID NO: 260917 - DNA, 16 bp, P. troglodytes
taccctccagcctggg

SEQ ID NO: 260918 - DNA, 16 bp, P. troglodytes
taccctcctgcctcag

SEQ ID NO: 260919 - DNA, 16 bp, P. troglodytes
taccctggaacttaaa

SEQ ID NO: 260920 - DNA, 16 bp, P. troglodytes
tacccttcccagcccc

SEQ ID NO: 260921 - DNA, 16 bp, P. troglodytes
tacccttctcagcctc

SEQ ID NO: 260922 - DNA, 16 bp, P. troglodytes
tacccttctgacaaag

SEQ ID NO: 260923 - DNA, 16 bp, P. troglodytes
tacccttttctccaca

SEQ ID NO: 260924 - DNA, 16 bp, P. troglodytes
tacctacctcacagga

SEQ ID NO: 260925 - DNA, 16 bp, P. troglodytes
tacctactgtgtgcag

SEQ ID NO: 260926 - DNA, 16 bp, P. troglodytes
tacctagaaatggaat

SEQ ID NO: 260927 - DNA, 17 bp, P. troglodytes
tacctaggctatatggt

SEQ ID NO: 260928 - DNA, 16 bp, P. troglodytes
tacctaggtgatgggc

SEQ ID NO: 260929 - DNA, 16 bp, P. troglodytes
tacctatatttttaaa

SEQ ID NO: 260930 - DNA, 16 bp, P. troglodytes
tacctatctaacaaac

SEQ ID NO: 260931 - DNA, 16 bp, P. troglodytes
tacctatgtgacaaac

SEQ ID NO: 260932 - DNA, 16 bp, P. troglodytes
tacctcaaaataataa

SEQ ID NO: 260933 - DNA, 16 bp, P. troglodytes
tacctcacttcaaatt

SEQ ID NO: 260934 - DNA, 16 bp, P. troglodytes
tacctcatggagttgt

SEQ ID NO: 260935 - DNA, 16 bp, P. troglodytes
tacctcattcttccta

SEQ ID NO: 260936 - DNA, 16 bp, P. troglodytes
tacctcattcttttaa

SEQ ID NO: 260937 - DNA, 16 bp, P. troglodytes
tacctcattttaactt

SEQ ID NO: 260938 - DNA, 16 bp, P. troglodytes
tacctccagggttcaa

SEQ ID NO: 260939 - DNA, 16 bp, P. troglodytes
tacctctccagcctca

SEQ ID NO: 260940 - DNA, 16 bp, P. troglodytes
tacctctggtataatt

SEQ ID NO: 260941 - DNA, 16 bp, P. troglodytes
tacctgacacatagta

SEQ ID NO: 260942 - DNA, 36 bp, P. troglodytes
tacctgacttcaaactatactacaaggctacagtaa

SEQ ID NO: 260943 - DNA, 41 bp, P. troglodytes
tacctgacttcaaactatactacaaggctacagtaaccaaa

SEQ ID NO: 260944 - DNA, 16 bp, P. troglodytes
tacctgaggttgggag

SEQ ID NO: 260945 - DNA, 16 bp, P. troglodytes
tacctgcactcctatg

SEQ ID NO: 260946 - DNA, 16 bp, P. troglodytes
tacctgcactttggga

SEQ ID NO: 260947 - DNA, 16 bp, P. troglodytes
tacctgccaggcactg

SEQ ID NO: 260948 - DNA, 16 bp, P. troglodytes
tacctgctgtgtgacc

SEQ ID NO: 260949 - DNA, 16 bp, P. troglodytes
tacctgcttccccttt

SEQ ID NO: 260950 - DNA, 16 bp, P. troglodytes
tacctggcttatttca

SEQ ID NO: 260951 - DNA, 16 bp, P. troglodytes
tacctgggaccacagg

SEQ ID NO: 260952 - DNA, 16 bp, P. troglodytes
tacctgggggccaggc

SEQ ID NO: 260953 - DNA, 16 bp, P. troglodytes
tacctgtaatcccagc

SEQ ID NO: 260954 - DNA, 16 bp, P. troglodytes
tacctgtgaaataact

SEQ ID NO: 260955 - DNA, 16 bp, P. troglodytes
tacctgtgcaggtttg

SEQ ID NO: 260956 - DNA, 16 bp, P. troglodytes
taccttacatggcaaa

SEQ ID NO: 260957 - DNA, 16 bp, P. troglodytes
taccttgaatataaat

SEQ ID NO: 260958 - DNA, 16 bp, P. troglodytes
tacctttaaaatttta

SEQ ID NO: 260959 - DNA, 16 bp, P. troglodytes
tacctttcaagtttat

SEQ ID NO: 260960 - DNA, 16 bp, P. troglodytes
tacctttgatctttga

SEQ ID NO: 260961 - DNA, 16 bp, P. troglodytes
taccttttaagcattt

SEQ ID NO: 260962 - DNA, 16 bp, P. troglodytes
taccttttttaaaaaa

SEQ ID NO: 260963 - DNA, 16 bp, P. troglodytes
tacgcaaaggattata

SEQ ID NO: 260964 - DNA, 16 bp, P. troglodytes
tacgcccagctaattt

SEQ ID NO: 260965 - DNA, 16 bp, P. troglodytes
tacgcctttgcatcct

SEQ ID NO: 260966 - DNA, 16 bp, P. troglodytes
tacgggcatgcaccac

SEQ ID NO: 260967 - DNA, 16 bp, P. troglodytes
tacggtcccaccaaca

SEQ ID NO: 260968 - DNA, 16 bp, P. troglodytes
tacgtatatgtatata

SEQ ID NO: 260969 - DNA, 16 bp, P. troglodytes
tacgtggatggtggca

SEQ ID NO: 260970 - DNA, 16 bp, P. troglodytes
tacgttttcatttctc

SEQ ID NO: 260971 - DNA, 16 bp, P. troglodytes
tactaaaaagacagaa

SEQ ID NO: 260972 - DNA, 16 bp, P. troglodytes
tactaaaaatgcagaa

SEQ ID NO: 260973 - DNA, 16 bp, P. troglodytes
tactaaaaatgtgaaa

SEQ ID NO: 260974 - DNA, 16 bp, P. troglodytes
tactaaaagtgcaaaa

SEQ ID NO: 260975 - DNA, 16 bp, P. troglodytes
tactaaaatgcaaaaa

SEQ ID NO: 260976 - DNA, 16 bp, P. troglodytes
tactaaaattagccgg

SEQ ID NO: 260977 - DNA, 16 bp, P. troglodytes
tactaaacatttttta

SEQ ID NO: 260978 - DNA, 16 bp, P. troglodytes
tactaaagaagaaaag

SEQ ID NO: 260979 - DNA, 16 bp, P. troglodytes
tactaaagatataagt

SEQ ID NO: 260980 - DNA, 16 bp, P. troglodytes
tactaaatcagaatct

SEQ ID NO: 260981 - DNA, 16 bp, P. troglodytes
tactaattttgtgttt

SEQ ID NO: 260982 - DNA, 16 bp, P. troglodytes
tactaatttttgtatt

SEQ ID NO: 260983 - DNA, 16 bp, P. troglodytes
tactacaaagcaacag

SEQ ID NO: 260984 - DNA, 17 bp, P. troglodytes
tactacactccagcctg

SEQ ID NO: 260985 - DNA, 16 bp, P. troglodytes
tactacaggactacag

SEQ ID NO: 260986 - DNA, 16 bp, P. troglodytes
tactacaggttgagta

SEQ ID NO: 260987 - DNA, 16 bp, P. troglodytes
tactacatcttattca

SEQ ID NO: 260988 - DNA, 16 bp, P. troglodytes
tactactactattatt

SEQ ID NO: 260989 - DNA, 16 bp, P. troglodytes
tactactgaactgtac

SEQ ID NO: 260990 - DNA, 16 bp, P. troglodytes
tactacttccatctct

SEQ ID NO: 260991 - DNA, 16 bp, P. troglodytes
tactagaaaatttaaa

SEQ ID NO: 260992 - DNA, 16 bp, P. troglodytes
tactagacataagaaa

SEQ ID NO: 260993 - DNA, 16 bp, P. troglodytes
tactagattttaaaaa

SEQ ID NO: 260994 - DNA, 16 bp, P. troglodytes
tactataaacacctgt

SEQ ID NO: 260995 - DNA, 16 bp, P. troglodytes
tactatatagaaatac

SEQ ID NO: 260996 - DNA, 16 bp, P. troglodytes
tactatcatgaaaaca

SEQ ID NO: 260997 - DNA, 16 bp, P. troglodytes
tactatccccatcaag

SEQ ID NO: 260998 - DNA, 16 bp, P. troglodytes
tactatcttctcaatt

SEQ ID NO: 260999 - DNA, 16 bp, P. troglodytes
tactatggtttgaatg

SEQ ID NO: 261000 - DNA, 16 bp, P. troglodytes
tactatgtatatgtat

SEQ ID NO: 261001 - DNA, 16 bp, P. troglodytes
tactatgtgccaagaa

SEQ ID NO: 261002 - DNA, 16 bp, P. troglodytes
tactatgtgccagata

SEQ ID NO: 261003 - DNA, 16 bp, P. troglodytes
tactatgtgccaggca

SEQ ID NO: 261004 - DNA, 16 bp, P. troglodytes
tactatgtgccaggct

SEQ ID NO: 261005 - DNA, 16 bp, P. troglodytes
tactatgtggcaggca

SEQ ID NO: 261006 - DNA, 16 bp, P. troglodytes
tactattctcatggta

SEQ ID NO: 261007 - DNA, 16 bp, P. troglodytes
tactattgccatttta

SEQ ID NO: 261008 - DNA, 16 bp, P. troglodytes
tactattggtgggaat

SEQ ID NO: 261009 - DNA, 16 bp, P. troglodytes
tactatttgttgaaaa

SEQ ID NO: 261010 - DNA, 16 bp, P. troglodytes
tactattttgctattt

SEQ ID NO: 261011 - DNA, 16 bp, P. troglodytes
tactatttttgagaca

SEQ ID NO: 261012 - DNA, 16 bp, P. troglodytes
tactcaaaataattga

SEQ ID NO: 261013 - DNA, 16 bp, P. troglodytes
tactcaacaatgaaaa

SEQ ID NO: 261014 - DNA, 16 bp, P. troglodytes
tactcaacagtaaaaa

SEQ ID NO: 261015 - DNA, 16 bp, P. troglodytes
tactcaagcctgggtg

SEQ ID NO: 261016 - DNA, 16 bp, P. troglodytes
tactcaataaatactt

SEQ ID NO: 261017 - DNA, 16 bp, P. troglodytes
tactcaataaatattt

SEQ ID NO: 261018 - DNA, 16 bp, P. troglodytes
tactcactcttattct

SEQ ID NO: 261019 - DNA, 16 bp, P. troglodytes
tactcagaagctgagg

SEQ ID NO: 261020 - DNA, 16 bp, P. troglodytes
tactcagcaataaaaa

SEQ ID NO: 261021 - DNA, 16 bp, P. troglodytes
tactcagcctcaggta

SEQ ID NO: 261022 - DNA, 16 bp, P. troglodytes
tactcagccttaaaaa

SEQ ID NO: 261023 - DNA, 16 bp, P. troglodytes
tactcaggaagctgaa

SEQ ID NO: 261024 - DNA, 16 bp, P. troglodytes
tactcaggaggatgaa

SEQ ID NO: 261025 - DNA, 16 bp, P. troglodytes
tactcaggaggcagag

SEQ ID NO: 261026 - DNA, 16 bp, P. troglodytes
tactcaggagggtgag

SEQ ID NO: 261027 - DNA, 16 bp, P. troglodytes
tactcaggaggttggg

SEQ ID NO: 261028 - DNA, 16 bp, P. troglodytes
tactcaggcatggtgg

SEQ ID NO: 261029 - DNA, 16 bp, P. troglodytes
tactcattgtctcagt

SEQ ID NO: 261030 - DNA, 16 bp, P. troglodytes
tactccacagacagag

SEQ ID NO: 261031 - DNA, 16 bp, P. troglodytes
tactccacatcctcac

SEQ ID NO: 261032 - DNA, 16 bp, P. troglodytes
tactccagaggctgaa

SEQ ID NO: 261033 - DNA, 16 bp, P. troglodytes
tactccagcctgagtg

SEQ ID NO: 261034 - DNA, 20 bp, P. troglodytes
tactccagcctggatgacag

SEQ ID NO: 261035 - DNA, 23 bp, P. troglodytes
tactccagcctgggcaacagtga

SEQ ID NO: 261036 - DNA, 16 bp, P. troglodytes
tactccatatatatat

SEQ ID NO: 261037 - DNA, 16 bp, P. troglodytes
tactccattgtgtgga

SEQ ID NO: 261038 - DNA, 20 bp, P. troglodytes
tactccgagctacaggagga

SEQ ID NO: 261039 - DNA, 20 bp, P. troglodytes
tactcctcgagaagagcaac

SEQ ID NO: 261040 - DNA, 16 bp, P. troglodytes
tactcctgcctgggtg

SEQ ID NO: 261041 - DNA, 16 bp, P. troglodytes
tactcggaaggctgag

SEQ ID NO: 261042 - DNA, 16 bp, P. troglodytes
tactcggaggctgaga

SEQ ID NO: 261043 - DNA, 16 bp, P. troglodytes
tactctatttttaaaa

SEQ ID NO: 261044 - DNA, 16 bp, P. troglodytes
tactctctggctcttt

SEQ ID NO: 261045 - DNA, 16 bp, P. troglodytes
tactctgatctttatt

SEQ ID NO: 261046 - DNA, 16 bp, P. troglodytes
tactctggaagctgaa

SEQ ID NO: 261047 - DNA, 16 bp, P. troglodytes
tactctgtcacccagg

SEQ ID NO: 261048 - DNA, 16 bp, P. troglodytes
tactctgtgccaggta

SEQ ID NO: 261049 - DNA, 16 bp, P. troglodytes
tactcttctgacaaag

SEQ ID NO: 261050 - DNA, 16 bp, P. troglodytes
tactctttgtacctct

SEQ ID NO: 261051 - DNA, 16 bp, P. troglodytes
tactgaaaaaaataca

SEQ ID NO: 261052 - DNA, 16 bp, P. troglodytes
tactgaaaaatgcatc

SEQ ID NO: 261053 - DNA, 16 bp, P. troglodytes
tactgaaaacagaaaa

SEQ ID NO: 261054 - DNA, 16 bp, P. troglodytes
tactgaaaatataaaa

SEQ ID NO: 261055 - DNA, 16 bp, P. troglodytes
tactgaaaatgaaaaa

SEQ ID NO: 261056 - DNA, 16 bp, P. troglodytes
tactgaaagaaagaaa

SEQ ID NO: 261057 - DNA, 16 bp, P. troglodytes
tactgaactatacact

SEQ ID NO: 261058 - DNA, 16 bp, P. troglodytes
tactgaactccagcct

SEQ ID NO: 261059 - DNA, 16 bp, P. troglodytes
tactgaagattttttt

SEQ ID NO: 261060 - DNA, 16 bp, P. troglodytes
tactgaagtataattt

SEQ ID NO: 261061 - DNA, 16 bp, P. troglodytes
tactgaagtttttttt

SEQ ID NO: 261062 - DNA, 16 bp, P. troglodytes
tactgaatactatagg

SEQ ID NO: 261063 - DNA, 16 bp, P. troglodytes
tactgaatatacaaaa

SEQ ID NO: 261064 - DNA, 16 bp, P. troglodytes
tactgaatgtggaaaa

SEQ ID NO: 261065 - DNA, 16 bp, P. troglodytes
tactgaattagaatct

SEQ ID NO: 261066 - DNA, 16 bp, P. troglodytes
tactgaatttgttgat

SEQ ID NO: 261067 - DNA, 16 bp, P. troglodytes
tactgacacaaaaaca

SEQ ID NO: 261068 - DNA, 16 bp, P. troglodytes
tactgacagcactaga

SEQ ID NO: 261069 - DNA, 16 bp, P. troglodytes
tactgacattttaaaa

SEQ ID NO: 261070 - DNA, 16 bp, P. troglodytes
tactgacctcgtgatc

SEQ ID NO: 261071 - DNA, 16 bp, P. troglodytes
tactgaggagactgag

SEQ ID NO: 261072 - DNA, 16 bp, P. troglodytes
tactgaggaggctgag

SEQ ID NO: 261073 - DNA, 16 bp, P. troglodytes
tactgagtcagaaact

SEQ ID NO: 261074 - DNA, 16 bp, P. troglodytes
tactgagtgaaaaaag

SEQ ID NO: 261075 - DNA, 16 bp, P. troglodytes
tactgatatggtttgg

SEQ ID NO: 261076 - DNA, 16 bp, P. troglodytes
tactgatgaatggata

SEQ ID NO: 261077 - DNA, 16 bp, P. troglodytes
tactgatgagaaaact

SEQ ID NO: 261078 - DNA, 16 bp, P. troglodytes
tactgattttcatatg

SEQ ID NO: 261079 - DNA, 17 bp, P. troglodytes
tactgcaacctccacct

SEQ ID NO: 261080 - DNA, 20 bp, P. troglodytes
tactgcaacctccacctcct

SEQ ID NO: 261081 - DNA, 16 bp, P. troglodytes
tactgcaacttctgcc

SEQ ID NO: 261082 - DNA, 16 bp, P. troglodytes
tactgcaccattttat

SEQ ID NO: 261083 - DNA, 16 bp, P. troglodytes
tactgcactccagccc

SEQ ID NO: 261084 - DNA, 16 bp, P. troglodytes
tactgcaggaacagaa

SEQ ID NO: 261085 - DNA, 16 bp, P. troglodytes
tactgcatgccaggca

SEQ ID NO: 261086 - DNA, 16 bp, P. troglodytes
tactgcattccaacct

SEQ ID NO: 261087 - DNA, 16 bp, P. troglodytes
tactgcatttttaaaa

SEQ ID NO: 261088 - DNA, 16 bp, P. troglodytes
tactgcccaggctgga

SEQ ID NO: 261089 - DNA, 16 bp, P. troglodytes
tactgcctcaacttca

SEQ ID NO: 261090 - DNA, 16 bp, P. troglodytes
tactgcctcagcctcc

SEQ ID NO: 261091 - DNA, 16 bp, P. troglodytes
tactgctattaagata

SEQ ID NO: 261092 - DNA, 16 bp, P. troglodytes
tactgctcaaggtcat

SEQ ID NO: 261093 - DNA, 16 bp, P. troglodytes
tactgctttgaatgtg

SEQ ID NO: 261094 - DNA, 16 bp, P. troglodytes
tactggaagaaaaaaa

SEQ ID NO: 261095 - DNA, 16 bp, P. troglodytes
tactggaagtcctagc

SEQ ID NO: 261096 - DNA, 16 bp, P. troglodytes
tactggatcacagccc

SEQ ID NO: 261097 - DNA, 16 bp, P. troglodytes
tactggccattctcca

SEQ ID NO: 261098 - DNA, 16 bp, P. troglodytes
tactgggaaactgaat

SEQ ID NO: 261099 - DNA, 16 bp, P. troglodytes
tactgggcatctaccc

SEQ ID NO: 261100 - DNA, 16 bp, P. troglodytes
tactgggttgaatggt

SEQ ID NO: 261101 - DNA, 16 bp, P. troglodytes
tactggtacaaaaaga

SEQ ID NO: 261102 - DNA, 16 bp, P. troglodytes
tactgtaaatgtattt

SEQ ID NO: 261103 - DNA, 16 bp, P. troglodytes
tactgtaactttttta

SEQ ID NO: 261104 - DNA, 16 bp, P. troglodytes
tactgtactctttgga

SEQ ID NO: 261105 - DNA, 16 bp, P. troglodytes
tactgtagactttata

SEQ ID NO: 261106 - DNA, 16 bp, P. troglodytes
tactgtagccttgaag

SEQ ID NO: 261107 - DNA, 16 bp, P. troglodytes
tactgtatgattccat

SEQ ID NO: 261108 - DNA, 16 bp, P. troglodytes
tactgtattgtatatt

SEQ ID NO: 261109 - DNA, 16 bp, P. troglodytes
tactgtatttgtttat

SEQ ID NO: 261110 - DNA, 16 bp, P. troglodytes
tactgtgcctaattta

SEQ ID NO: 261111 - DNA, 16 bp, P. troglodytes
tactgtggtttgaatg

SEQ ID NO: 261112 - DNA, 16 bp, P. troglodytes
tactgtgtatcaggca

SEQ ID NO: 261113 - DNA, 16 bp, P. troglodytes
tactgtgtgctaagca

SEQ ID NO: 261114 - DNA, 16 bp, P. troglodytes
tactgtgtgtgtgtat

SEQ ID NO: 261115 - DNA, 16 bp, P. troglodytes
tactgttctcatggtg

SEQ ID NO: 261116 - DNA, 16 bp, P. troglodytes
tactgttgtggaatat

SEQ ID NO: 261117 - DNA, 16 bp, P. troglodytes
tactgtttaatttcca

SEQ ID NO: 261118 - DNA, 16 bp, P. troglodytes
tactgtttgaattttt

SEQ ID NO: 261119 - DNA, 16 bp, P. troglodytes
tacttaaaaaatgttt

SEQ ID NO: 261120 - DNA, 16 bp, P. troglodytes
tacttaaaaccctcca

SEQ ID NO: 261121 - DNA, 16 bp, P. troglodytes
tacttaaaaggaaaaa

SEQ ID NO: 261122 - DNA, 16 bp, P. troglodytes
tacttaatctttctga

SEQ ID NO: 261123 - DNA, 16 bp, P. troglodytes
tacttaatttctctgt

SEQ ID NO: 261124 - DNA, 16 bp, P. troglodytes
tacttactatgttcca

SEQ ID NO: 261125 - DNA, 16 bp, P. troglodytes
tacttagcatgttttc

SEQ ID NO: 261126 - DNA, 16 bp, P. troglodytes
tacttatatgaggtac

SEQ ID NO: 261127 - DNA, 16 bp, P. troglodytes
tacttatcatttttgt

SEQ ID NO: 261128 - DNA, 17 bp, P. troglodytes
tacttatgcaaatttct

SEQ ID NO: 261129 - DNA, 16 bp, P. troglodytes
tacttatggaaatttc

SEQ ID NO: 261130 - DNA, 16 bp, P. troglodytes
tacttcaagttctggg

SEQ ID NO: 261131 - DNA, 16 bp, P. troglodytes
tacttcagcctcctga

SEQ ID NO: 261132 - DNA, 16 bp, P. troglodytes
tacttcagtttcctca

SEQ ID NO: 261133 - DNA, 16 bp, P. troglodytes
tacttcataaatatat

SEQ ID NO: 261134 - DNA, 16 bp, P. troglodytes
tacttcatagaattgt

SEQ ID NO: 261135 - DNA, 16 bp, P. troglodytes
tacttcatttttaaaa

SEQ ID NO: 261136 - DNA, 16 bp, P. troglodytes
tacttcctgacttcag

SEQ ID NO: 261137 - DNA, 16 bp, P. troglodytes
tacttcctgggctcaa

SEQ ID NO: 261138 - DNA, 16 bp, P. troglodytes
tacttcctgtacagcc

SEQ ID NO: 261139 - DNA, 16 bp, P. troglodytes
tacttctcagggctag

SEQ ID NO: 261140 - DNA, 16 bp, P. troglodytes
tacttgaaaaacaaaa

SEQ ID NO: 261141 - DNA, 16 bp, P. troglodytes
tacttgaaaattttaa

SEQ ID NO: 261142 - DNA, 16 bp, P. troglodytes
tacttgaaatttgcta

SEQ ID NO: 261143 - DNA, 16 bp, P. troglodytes
tacttgcacaaaccta

SEQ ID NO: 261144 - DNA, 16 bp, P. troglodytes
tacttgctttttaaaa

SEQ ID NO: 261145 - DNA, 16 bp, P. troglodytes
tacttgggaacctgag

SEQ ID NO: 261146 - DNA, 18 bp, P. troglodytes
tacttgggaggcagaggt

SEQ ID NO: 261147 - DNA, 20 bp, P. troglodytes
tacttgggaggccaaggcag

SEQ ID NO: 261148 - DNA, 16 bp, P. troglodytes
tacttgggatgctaag

SEQ ID NO: 261149 - DNA, 16 bp, P. troglodytes
tacttggggaaaaaaa

SEQ ID NO: 261150 - DNA, 16 bp, P. troglodytes
tacttgggtgacagga

SEQ ID NO: 261151 - DNA, 16 bp, P. troglodytes
tacttgtacaaaaaca

SEQ ID NO: 261152 - DNA, 16 bp, P. troglodytes
tactttaaaaagtata

SEQ ID NO: 261153 - DNA, 16 bp, P. troglodytes
tactttaaaaggaaaa

SEQ ID NO: 261154 - DNA, 16 bp, P. troglodytes
tactttaaaatgtaca

SEQ ID NO: 261155 - DNA, 16 bp, P. troglodytes
tactttaaaatgtttg

SEQ ID NO: 261156 - DNA, 16 bp, P. troglodytes
tactttaaatgtaaat

SEQ ID NO: 261157 - DNA, 16 bp, P. troglodytes
tactttaaattttagg

SEQ ID NO: 261158 - DNA, 16 bp, P. troglodytes
tactttaactggagga

SEQ ID NO: 261159 - DNA, 16 bp, P. troglodytes
tactttaagttccagg

SEQ ID NO: 261160 - DNA, 16 bp, P. troglodytes
tactttacattttaaa

SEQ ID NO: 261161 - DNA, 16 bp, P. troglodytes
tactttatatattctg

SEQ ID NO: 261162 - DNA, 16 bp, P. troglodytes
tactttatttttgaaa

SEQ ID NO: 261163 - DNA, 16 bp, P. troglodytes
tactttccatttttca

SEQ ID NO: 261164 - DNA, 19 bp, P. troglodytes
tactttctgcagaaagggt

SEQ ID NO: 261165 - DNA, 16 bp, P. troglodytes
tactttgaaaaatatt

SEQ ID NO: 261166 - DNA, 16 bp, P. troglodytes
tactttgaaaataaaa

SEQ ID NO: 261167 - DNA, 16 bp, P. troglodytes
tactttgaattatttt

SEQ ID NO: 261168 - DNA, 16 bp, P. troglodytes
tactttgcctccttca

SEQ ID NO: 261169 - DNA, 16 bp, P. troglodytes
tactttggaggttgag

SEQ ID NO: 261170 - DNA, 19 bp, P. troglodytes
tactttgggaggccaaggt

SEQ ID NO: 261171 - DNA, 17 bp, P. troglodytes
tactttgggaggctgag

SEQ ID NO: 261172 - DNA, 19 bp, P. troglodytes
tactttgggaggctgaggt

SEQ ID NO: 261173 - DNA, 16 bp, P. troglodytes
tactttgggaggctgg

SEQ ID NO: 261174 - DNA, 16 bp, P. troglodytes
tactttgtaatattct

SEQ ID NO: 261175 - DNA, 16 bp, P. troglodytes
tactttgtttaaaaaa

SEQ ID NO: 261176 - DNA, 16 bp, P. troglodytes
tacttttaaaaagaga

SEQ ID NO: 261177 - DNA, 16 bp, P. troglodytes
tacttttaaaacatat

SEQ ID NO: 261178 - DNA, 16 bp, P. troglodytes
tacttttaaaattgta

SEQ ID NO: 261179 - DNA, 16 bp, P. troglodytes
tacttttaaagaaaat

SEQ ID NO: 261180 - DNA, 16 bp, P. troglodytes
tacttttaagttttag

SEQ ID NO: 261181 - DNA, 16 bp, P. troglodytes
tacttttcagagtcct

SEQ ID NO: 261182 - DNA, 16 bp, P. troglodytes
tacttttctgaatttt

SEQ ID NO: 261183 - DNA, 16 bp, P. troglodytes
tacttttgaaatattt

SEQ ID NO: 261184 - DNA, 16 bp, P. troglodytes
tacttttgcactgacc

SEQ ID NO: 261185 - DNA, 16 bp, P. troglodytes
tacttttgggttcaca

SEQ ID NO: 261186 - DNA, 16 bp, P. troglodytes
tacttttgtacccatt

SEQ ID NO: 261187 - DNA, 16 bp, P. troglodytes
tacttttgttttaaaa

SEQ ID NO: 261188 - DNA, 16 bp, P. troglodytes
tactttttaaaagatg

SEQ ID NO: 261189 - DNA, 16 bp, P. troglodytes
tactttttaaagaata

SEQ ID NO: 261190 - DNA, 16 bp, P. troglodytes
tactttttaaagtttt

SEQ ID NO: 261191 - DNA, 16 bp, P. troglodytes
tactttttaaatgtaa

SEQ ID NO: 261192 - DNA, 16 bp, P. troglodytes
tactttttaacaaaaa

SEQ ID NO: 261193 - DNA, 16 bp, P. troglodytes
tactttttcctttctg

SEQ ID NO: 261194 - DNA, 16 bp, P. troglodytes
tactttttggctatta

SEQ ID NO: 261195 - DNA, 16 bp, P. troglodytes
tactttttgtctctat

SEQ ID NO: 261196 - DNA, 16 bp, P. troglodytes
tacttttttaaaagta

SEQ ID NO: 261197 - DNA, 16 bp, P. troglodytes
tacttttttaaacaaa

SEQ ID NO: 261198 - DNA, 16 bp, P. troglodytes
tactttttttaatgtg

SEQ ID NO: 261199 - DNA, 16 bp, P. troglodytes
tagaaaaaaaactact

SEQ ID NO: 261200 - DNA, 16 bp, P. troglodytes
tagaaaaaaaatactt

SEQ ID NO: 261201 - DNA, 16 bp, P. troglodytes
tagaaaaaaatgcatt

SEQ ID NO: 261202 - DNA, 16 bp, P. troglodytes
tagaaaaaactcttct

SEQ ID NO: 261203 - DNA, 16 bp, P. troglodytes
tagaaaaaagttattt

SEQ ID NO: 261204 - DNA, 16 bp, P. troglodytes
tagaaaaaataattct

SEQ ID NO: 261205 - DNA, 16 bp, P. troglodytes
tagaaaaacatttcat

SEQ ID NO: 261206 - DNA, 16 bp, P. troglodytes
tagaaaaagagtgttt

SEQ ID NO: 261207 - DNA, 16 bp, P. troglodytes
tagaaaaagatatttt

SEQ ID NO: 261208 - DNA, 16 bp, P. troglodytes
tagaaaaagctgtgaa

SEQ ID NO: 261209 - DNA, 16 bp, P. troglodytes
tagaaaaaggacatta

SEQ ID NO: 261210 - DNA, 16 bp, P. troglodytes
tagaaaaataatttca

SEQ ID NO: 261211 - DNA, 16 bp, P. troglodytes
tagaaaaatacatatt

SEQ ID NO: 261212 - DNA, 16 bp, P. troglodytes
tagaaaaatattttga

SEQ ID NO: 261213 - DNA, 16 bp, P. troglodytes
tagaaaaatcagaaat

SEQ ID NO: 261214 - DNA, 16 bp, P. troglodytes
tagaaaaatgggcaaa

SEQ ID NO: 261215 - DNA, 16 bp, P. troglodytes
tagaaaaattagctga

SEQ ID NO: 261216 - DNA, 16 bp, P. troglodytes
tagaaaaattggcaaa

SEQ ID NO: 261217 - DNA, 16 bp, P. troglodytes
tagaaaacaaatacag

SEQ ID NO: 261218 - DNA, 16 bp, P. troglodytes
tagaaaacaatatttt

SEQ ID NO: 261219 - DNA, 16 bp, P. troglodytes
tagaaaacatttttta

SEQ ID NO: 261220 - DNA, 16 bp, P. troglodytes
tagaaaaccaaacatt

SEQ ID NO: 261221 - DNA, 21 bp, P. troglodytes
tagaaaaccccatcatctcag

SEQ ID NO: 261222 - DNA, 16 bp, P. troglodytes
tagaaaaccctgaaga

SEQ ID NO: 261223 - DNA, 16 bp, P. troglodytes
tagaaaacctaaaaga

SEQ ID NO: 261224 - DNA, 16 bp, P. troglodytes
tagaaaacctaaagga

SEQ ID NO: 261225 - DNA, 16 bp, P. troglodytes
tagaaaacctagaaat

SEQ ID NO: 261226 - DNA, 16 bp, P. troglodytes
tagaaaactggaaaaa

SEQ ID NO: 261227 - DNA, 16 bp, P. troglodytes
tagaaaactttttttt

SEQ ID NO: 261228 - DNA, 16 bp, P. troglodytes
tagaaaagaaaaactc

SEQ ID NO: 261229 - DNA, 16 bp, P. troglodytes
tagaaaagaagagcaa

SEQ ID NO: 261230 - DNA, 16 bp, P. troglodytes
tagaaaagcaagagaa

SEQ ID NO: 261231 - DNA, 16 bp, P. troglodytes
tagaaaaggaaactga

SEQ ID NO: 261232 - DNA, 16 bp, P. troglodytes
tagaaaaggtaaaact

SEQ ID NO: 261233 - DNA, 16 bp, P. troglodytes
tagaaaaggtagagta

SEQ ID NO: 261234 - DNA, 16 bp, P. troglodytes
tagaaaagttacagta

SEQ ID NO: 261235 - DNA, 16 bp, P. troglodytes
tagaaaataatgcatt

SEQ ID NO: 261236 - DNA, 16 bp, P. troglodytes
tagaaaatacattatt

SEQ ID NO: 261237 - DNA, 16 bp, P. troglodytes
tagaaaatatccaaaa

SEQ ID NO: 261238 - DNA, 16 bp, P. troglodytes
tagaaaatatttcaca

SEQ ID NO: 261239 - DNA, 16 bp, P. troglodytes
tagaaaatcagcaaag

SEQ ID NO: 261240 - DNA, 16 bp, P. troglodytes
tagaaaatctcagcaa

SEQ ID NO: 261241 - DNA, 16 bp, P. troglodytes
tagaaaatgagcaaag

SEQ ID NO: 261242 - DNA, 16 bp, P. troglodytes
tagaaaatgcaaaata

SEQ ID NO: 261243 - DNA, 16 bp, P. troglodytes
tagaaaatgcagaaat

SEQ ID NO: 261244 - DNA, 16 bp, P. troglodytes
tagaaaatgctttttt

SEQ ID NO: 261245 - DNA, 16 bp, P. troglodytes
tagaaaatgttttgaa

SEQ ID NO: 261246 - DNA, 16 bp, P. troglodytes
tagaaaattattttgt

SEQ ID NO: 261247 - DNA, 16 bp, P. troglodytes
tagaaaattccagaaa

SEQ ID NO: 261248 - DNA, 16 bp, P. troglodytes
tagaaacaaagtctca

SEQ ID NO: 261249 - DNA, 16 bp, P. troglodytes
tagaaacacacacaca

SEQ ID NO: 261250 - DNA, 16 bp, P. troglodytes
tagaaacagaaaatca

SEQ ID NO: 261251 - DNA, 16 bp, P. troglodytes
tagaaacagagtttca

SEQ ID NO: 261252 - DNA, 16 bp, P. troglodytes
tagaaacattttattt

SEQ ID NO: 261253 - DNA, 16 bp, P. troglodytes
tagaaacatttttaca

SEQ ID NO: 261254 - DNA, 16 bp, P. troglodytes
tagaaaccatcctggc

SEQ ID NO: 261255 - DNA, 16 bp, P. troglodytes
tagaaagaacctatgt

SEQ ID NO: 261256 - DNA, 16 bp, P. troglodytes
tagaaagaatcaatat

SEQ ID NO: 261257 - DNA, 16 bp, P. troglodytes
tagaaagatttatatt

SEQ ID NO: 261258 - DNA, 16 bp, P. troglodytes
tagaaaggctgaggca

SEQ ID NO: 261259 - DNA, 16 bp, P. troglodytes
tagaaagtaaaaagtt

SEQ ID NO: 261260 - DNA, 16 bp, P. troglodytes
tagaaagtctagaaga

SEQ ID NO: 261261 - DNA, 16 bp, P. troglodytes
tagaaataaagtgcat

SEQ ID NO: 261262 - DNA, 16 bp, P. troglodytes
tagaaataacatttga

SEQ ID NO: 261263 - DNA, 16 bp, P. troglodytes
tagaaataccagttga

SEQ ID NO: 261264 - DNA, 16 bp, P. troglodytes
tagaaataccatatga

SEQ ID NO: 261265 - DNA, 16 bp, P. troglodytes
tagaaatagacccaca

SEQ ID NO: 261266 - DNA, 16 bp, P. troglodytes
tagaaatagcattgaa

SEQ ID NO: 261267 - DNA, 16 bp, P. troglodytes
tagaaatattttcttt

SEQ ID NO: 261268 - DNA, 16 bp, P. troglodytes
tagaaatatttttaag

SEQ ID NO: 261269 - DNA, 16 bp, P. troglodytes
tagaaatcaacaacaa

SEQ ID NO: 261270 - DNA, 16 bp, P. troglodytes
tagaaatcaataacaa

SEQ ID NO: 261271 - DNA, 16 bp, P. troglodytes
tagaaatcacaacaaa

SEQ ID NO: 261272 - DNA, 16 bp, P. troglodytes
tagaaatgaaacagga

SEQ ID NO: 261273 - DNA, 16 bp, P. troglodytes
tagaaatgattaaact

SEQ ID NO: 261274 - DNA, 16 bp, P. troglodytes
tagaaatgattaagct

SEQ ID NO: 261275 - DNA, 16 bp, P. troglodytes
tagaaatgcaaaatct

SEQ ID NO: 261276 - DNA, 16 bp, P. troglodytes
tagaaatgcagattct

SEQ ID NO: 261277 - DNA, 16 bp, P. troglodytes
tagaaatgcagcatct

SEQ ID NO: 261278 - DNA, 16 bp, P. troglodytes
tagaaatgtaaatttt

SEQ ID NO: 261279 - DNA, 16 bp, P. troglodytes
tagaaatgtattctct

SEQ ID NO: 261280 - DNA, 16 bp, P. troglodytes
tagaaatgttctgtat

SEQ ID NO: 261281 - DNA, 16 bp, P. troglodytes
tagaaatgtttttaaa

SEQ ID NO: 261282 - DNA, 16 bp, P. troglodytes
tagaaattataacaaa

SEQ ID NO: 261283 - DNA, 16 bp, P. troglodytes
tagaaattcttaattt

SEQ ID NO: 261284 - DNA, 16 bp, P. troglodytes
tagaaatttagaattt

SEQ ID NO: 261285 - DNA, 16 bp, P. troglodytes
tagaacattttcatca

SEQ ID NO: 261286 - DNA, 16 bp, P. troglodytes
tagaaccaatgacaaa

SEQ ID NO: 261287 - DNA, 19 bp, P. troglodytes
tagaaccagaaatatcatt

SEQ ID NO: 261288 - DNA, 16 bp, P. troglodytes
tagaactatatatata

SEQ ID NO: 261289 - DNA, 19 bp, P. troglodytes
tagaactcaggattaagaa

SEQ ID NO: 261290 - DNA, 16 bp, P. troglodytes
tagaactgaaagtata

SEQ ID NO: 261291 - DNA, 16 bp, P. troglodytes
tagaactgataaacaa

SEQ ID NO: 261292 - DNA, 16 bp, P. troglodytes
tagaacttatgtttaa

SEQ ID NO: 261293 - DNA, 16 bp, P. troglodytes
tagaagaaaacactgg

SEQ ID NO: 261294 - DNA, 16 bp, P. troglodytes
tagaagaaaatctatg

SEQ ID NO: 261295 - DNA, 16 bp, P. troglodytes
tagaagaaagcataga

SEQ ID NO: 261296 - DNA, 16 bp, P. troglodytes
tagaagaaatagctga

SEQ ID NO: 261297 - DNA, 16 bp, P. troglodytes
tagaagaaatatctaa

SEQ ID NO: 261298 - DNA, 16 bp, P. troglodytes
tagaagaaatattttt

SEQ ID NO: 261299 - DNA, 16 bp, P. troglodytes
tagaagaaatgaatga

SEQ ID NO: 261300 - DNA, 16 bp, P. troglodytes
tagaagaactagaaaa

SEQ ID NO: 261301 - DNA, 16 bp, P. troglodytes
tagaagaataaaactg

SEQ ID NO: 261302 - DNA, 16 bp, P. troglodytes
tagaagaggcaaggaa

SEQ ID NO: 261303 - DNA, 16 bp, P. troglodytes
tagaagcaactcaaat

SEQ ID NO: 261304 - DNA, 16 bp, P. troglodytes
tagaagcagcagcagg

SEQ ID NO: 261305 - DNA, 16 bp, P. troglodytes
tagaagccagaagaga

SEQ ID NO: 261306 - DNA, 16 bp, P. troglodytes
tagaaggaataaattc

SEQ ID NO: 261307 - DNA, 16 bp, P. troglodytes
tagaaggcaaagaatt

SEQ ID NO: 261308 - DNA, 16 bp, P. troglodytes
tagaaggcaaaggaga

SEQ ID NO: 261309 - DNA, 16 bp, P. troglodytes
tagaaggctgaaactg

SEQ ID NO: 261310 - DNA, 16 bp, P. troglodytes
tagaagtagaaatacc

SEQ ID NO: 261311 - DNA, 16 bp, P. troglodytes
tagaagtcaataacag

SEQ ID NO: 261312 - DNA, 16 bp, P. troglodytes
tagaagttggaaaagg

SEQ ID NO: 261313 - DNA, 16 bp, P. troglodytes
tagaagtttatcaatt

SEQ ID NO: 261314 - DNA, 16 bp, P. troglodytes
tagaataatgtttgac

SEQ ID NO: 261315 - DNA, 16 bp, P. troglodytes
tagaatacttttttct

SEQ ID NO: 261316 - DNA, 16 bp, P. troglodytes
tagaatattttcatta

SEQ ID NO: 261317 - DNA, 16 bp, P. troglodytes
tagaatcaatgaaata

SEQ ID NO: 261318 - DNA, 16 bp, P. troglodytes
tagaatcagtggaagc

SEQ ID NO: 261319 - DNA, 16 bp, P. troglodytes
tagaatcagtgggatc

SEQ ID NO: 261320 - DNA, 16 bp, P. troglodytes
tagaatgaattatttt

SEQ ID NO: 261321 - DNA, 16 bp, P. troglodytes
tagaatgtaagctcca

SEQ ID NO: 261322 - DNA, 16 bp, P. troglodytes
tagaatgtaagctccc

SEQ ID NO: 261323 - DNA, 16 bp, P. troglodytes
tagaatgttttataaa

SEQ ID NO: 261324 - DNA, 16 bp, P. troglodytes
tagaatgtttttcttt

SEQ ID NO: 261325 - DNA, 16 bp, P. troglodytes
tagaattaataaacaa

SEQ ID NO: 261326 - DNA, 16 bp, P. troglodytes
tagaattacagacatg

SEQ ID NO: 261327 - DNA, 16 bp, P. troglodytes
tagaattatacaatat

SEQ ID NO: 261328 - DNA, 16 bp, P. troglodytes
tagaattgtatataaa

SEQ ID NO: 261329 - DNA, 16 bp, P. troglodytes
tagaatttgctttaaa

SEQ ID NO: 261330 - DNA, 16 bp, P. troglodytes
tagaatttggctttga

SEQ ID NO: 261331 - DNA, 16 bp, P. troglodytes
tagaatttgtgaaggg

SEQ ID NO: 261332 - DNA, 16 bp, P. troglodytes
tagaatttttaaaatg

SEQ ID NO: 261333 - DNA, 16 bp, P. troglodytes
tagaatttttatttct

SEQ ID NO: 261334 - DNA, 16 bp, P. troglodytes
tagacaaacagagaac

SEQ ID NO: 261335 - DNA, 16 bp, P. troglodytes
tagacaaattaaattt

SEQ ID NO: 261336 - DNA, 16 bp, P. troglodytes
tagacacacatataca

SEQ ID NO: 261337 - DNA, 16 bp, P. troglodytes
tagacacagggtcttg

SEQ ID NO: 261338 - DNA, 16 bp, P. troglodytes
tagacacattaaaaaa

SEQ ID NO: 261339 - DNA, 16 bp, P. troglodytes
tagacactcaataaac

SEQ ID NO: 261340 - DNA, 16 bp, P. troglodytes
tagacactgggtttca

SEQ ID NO: 261341 - DNA, 16 bp, P. troglodytes
tagacacttaataaat

SEQ ID NO: 261342 - DNA, 16 bp, P. troglodytes
tagacagaagcatttt

SEQ ID NO: 261343 - DNA, 16 bp, P. troglodytes
tagacagacagacaga

SEQ ID NO: 261344 - DNA, 16 bp, P. troglodytes
tagacagatagacaga

SEQ ID NO: 261345 - DNA, 16 bp, P. troglodytes
tagacagggtctcact

SEQ ID NO: 261346 - DNA, 16 bp, P. troglodytes
tagacagttctccaaa

SEQ ID NO: 261347 - DNA, 16 bp, P. troglodytes
tagacataagaaatga

SEQ ID NO: 261348 - DNA, 16 bp, P. troglodytes
tagacattcagtaaat

SEQ ID NO: 261349 - DNA, 16 bp, P. troglodytes
tagacattttaatttt

SEQ ID NO: 261350 - DNA, 16 bp, P. troglodytes
tagaccacatgatagg

SEQ ID NO: 261351 - DNA, 16 bp, P. troglodytes
tagacccagaagagag

SEQ ID NO: 261352 - DNA, 16 bp, P. troglodytes
tagaccctcactggga

SEQ ID NO: 261353 - DNA, 16 bp, P. troglodytes
tagacctctttttctt

SEQ ID NO: 261354 - DNA, 16 bp, P. troglodytes
tagacctgggttcaaa

SEQ ID NO: 261355 - DNA, 16 bp, P. troglodytes
tagacctgtctcctgg

SEQ ID NO: 261356 - DNA, 16 bp, P. troglodytes
tagacggggtttcacc

SEQ ID NO: 261357 - DNA, 16 bp, P. troglodytes
tagactccatctcaaa

SEQ ID NO: 261358 - DNA, 16 bp, P. troglodytes
tagactgaggcaggag

SEQ ID NO: 261359 - DNA, 16 bp, P. troglodytes
tagactggcctagcct

SEQ ID NO: 261360 - DNA, 16 bp, P. troglodytes
tagacttacagaaaaa

SEQ ID NO: 261361 - DNA, 16 bp, P. troglodytes
tagacttgattaagaa

SEQ ID NO: 261362 - DNA, 16 bp, P. troglodytes
tagagaaaaggaaacc

SEQ ID NO: 261363 - DNA, 16 bp, P. troglodytes
tagagaaaatcaatga

SEQ ID NO: 261364 - DNA, 16 bp, P. troglodytes
tagagaaagaagaaca

SEQ ID NO: 261365 - DNA, 16 bp, P. troglodytes
tagagaaagagtctca

SEQ ID NO: 261366 - DNA, 16 bp, P. troglodytes
tagagaaagagtttca

SEQ ID NO: 261367 - DNA, 16 bp, P. troglodytes
tagagaaagatattaa

SEQ ID NO: 261368 - DNA, 16 bp, P. troglodytes
tagagaaataaaatgt

SEQ ID NO: 261369 - DNA, 16 bp, P. troglodytes
tagagaaatgcaaacc

SEQ ID NO: 261370 - DNA, 17 bp, P. troglodytes
tagagaaattcaaatca

SEQ ID NO: 261371 - DNA, 16 bp, P. troglodytes
tagagaacctggaaat

SEQ ID NO: 261372 - DNA, 16 bp, P. troglodytes
tagagaagatccaaat

SEQ ID NO: 261373 - DNA, 16 bp, P. troglodytes
tagagaagtgcttaaa

SEQ ID NO: 261374 - DNA, 16 bp, P. troglodytes
tagagacaaaaagtag

SEQ ID NO: 261375 - DNA, 16 bp, P. troglodytes
tagagacaagcctggg

SEQ ID NO: 261376 - DNA, 16 bp, P. troglodytes
tagagacaaggttttg

SEQ ID NO: 261377 - DNA, 16 bp, P. troglodytes
tagagacagggattca

SEQ ID NO: 261378 - DNA, 16 bp, P. troglodytes
tagagacagggtctca

SEQ ID NO: 261379 - DNA, 16 bp, P. troglodytes
tagagacagggtctcc

SEQ ID NO: 261380 - DNA, 16 bp, P. troglodytes
tagagacagggtttcg

SEQ ID NO: 261381 - DNA, 16 bp, P. troglodytes
tagagacagggtttct

SEQ ID NO: 261382 - DNA, 16 bp, P. troglodytes
tagagacagggttttg

SEQ ID NO: 261383 - DNA, 16 bp, P. troglodytes
tagagacaggttttgc

SEQ ID NO: 261384 - DNA, 16 bp, P. troglodytes
tagagaccagtctggg

SEQ ID NO: 261385 - DNA, 16 bp, P. troglodytes
tagagacctcagaaat

SEQ ID NO: 261386 - DNA, 18 bp, P. troglodytes
tagagacgaggtttcact

SEQ ID NO: 261387 - DNA, 17 bp, P. troglodytes
tagagacggagttttac

SEQ ID NO: 261388 - DNA, 16 bp, P. troglodytes
tagagacgggggtctc

SEQ ID NO: 261389 - DNA, 18 bp, P. troglodytes
tagagacgtggtttcacc

SEQ ID NO: 261390 - DNA, 16 bp, P. troglodytes
tagagactggctttca

SEQ ID NO: 261391 - DNA, 16 bp, P. troglodytes
tagagactggggtttc

SEQ ID NO: 261392 - DNA, 17 bp, P. troglodytes
tagagacttgttgaatg

SEQ ID NO: 261393 - DNA, 16 bp, P. troglodytes
tagagagatttttttt

SEQ ID NO: 261394 - DNA, 16 bp, P. troglodytes
tagagaggaacataac

SEQ ID NO: 261395 - DNA, 16 bp, P. troglodytes
tagagagtccagaaat

SEQ ID NO: 261396 - DNA, 16 bp, P. troglodytes
tagagataaggtttca

SEQ ID NO: 261397 - DNA, 16 bp, P. troglodytes
tagagatacacacaca

SEQ ID NO: 261398 - DNA, 20 bp, P. troglodytes
tagagatagggtttcaccgt

SEQ ID NO: 261399 - DNA, 16 bp, P. troglodytes
tagagatagggttttg

SEQ ID NO: 261400 - DNA, 16 bp, P. troglodytes
tagagatatttttaaa

SEQ ID NO: 261401 - DNA, 16 bp, P. troglodytes
tagagatcatctagtc

SEQ ID NO: 261402 - DNA, 16 bp, P. troglodytes
tagagatcatgccact

SEQ ID NO: 261403 - DNA, 16 bp, P. troglodytes
tagagatctgtggagc

SEQ ID NO: 261404 - DNA, 16 bp, P. troglodytes
tagagatgagaaaaca

SEQ ID NO: 261405 - DNA, 16 bp, P. troglodytes
tagagatgagatttta

SEQ ID NO: 261406 - DNA, 16 bp, P. troglodytes
tagagatgaggtctcc

SEQ ID NO: 261407 - DNA, 19 bp, P. troglodytes
tagagatggagtttcacca

SEQ ID NO: 261408 - DNA, 16 bp, P. troglodytes
tagagatggagtttga

SEQ ID NO: 261409 - DNA, 16 bp, P. troglodytes
tagagatggcgtctca

SEQ ID NO: 261410 - DNA, 16 bp, P. troglodytes
tagagatggggttttg

SEQ ID NO: 261411 - DNA, 16 bp, P. troglodytes
tagagatgggtgtctc

SEQ ID NO: 261412 - DNA, 18 bp, P. troglodytes
tagagatggtgtttcacc

SEQ ID NO: 261413 - DNA, 16 bp, P. troglodytes
tagagcagttttatgt

SEQ ID NO: 261414 - DNA, 16 bp, P. troglodytes
tagagcctccagaggg

SEQ ID NO: 261415 - DNA, 16 bp, P. troglodytes
tagagctcctgggctc

SEQ ID NO: 261416 - DNA, 16 bp, P. troglodytes
tagagctggaatttga

SEQ ID NO: 261417 - DNA, 16 bp, P. troglodytes
tagaggaaatggacaa

SEQ ID NO: 261418 - DNA, 16 bp, P. troglodytes
tagaggaactagaaaa

SEQ ID NO: 261419 - DNA, 17 bp, P. troglodytes
tagaggaattgctaact

SEQ ID NO: 261420 - DNA, 16 bp, P. troglodytes
tagaggagcaagagca

SEQ ID NO: 261421 - DNA, 16 bp, P. troglodytes
tagaggaggagctgga

SEQ ID NO: 261422 - DNA, 16 bp, P. troglodytes
tagaggcagggtctca

SEQ ID NO: 261423 - DNA, 16 bp, P. troglodytes
tagaggctgcctacat

SEQ ID NO: 261424 - DNA, 16 bp, P. troglodytes
tagaggctgggcacag

SEQ ID NO: 261425 - DNA, 16 bp, P. troglodytes
tagaggctgggtgcag

SEQ ID NO: 261426 - DNA, 16 bp, P. troglodytes
tagagggtatttaaac

SEQ ID NO: 261427 - DNA, 16 bp, P. troglodytes
tagaggtggggtttta

SEQ ID NO: 261428 - DNA, 20 bp, P. troglodytes
tagaggtgtttgtagtattc

SEQ ID NO: 261429 - DNA, 16 bp, P. troglodytes
tagaggttctctatga

SEQ ID NO: 261430 - DNA, 16 bp, P. troglodytes
tagaggttgcagtgag

SEQ ID NO: 261431 - DNA, 16 bp, P. troglodytes
tagagtctcactctgt

SEQ ID NO: 261432 - DNA, 16 bp, P. troglodytes
tagagtgagactgtct

SEQ ID NO: 261433 - DNA, 16 bp, P. troglodytes
tagagtgcagtgatgt

SEQ ID NO: 261434 - DNA, 16 bp, P. troglodytes
tagagttggggttttg

SEQ ID NO: 261435 - DNA, 16 bp, P. troglodytes
tagagtttacattcta

SEQ ID NO: 261436 - DNA, 16 bp, P. troglodytes
tagataaaaccagaaa

SEQ ID NO: 261437 - DNA, 16 bp, P. troglodytes
tagataaaatcacaaa

SEQ ID NO: 261438 - DNA, 16 bp, P. troglodytes
tagataaacgtgtgcc

SEQ ID NO: 261439 - DNA, 16 bp, P. troglodytes
tagataaactggaaat

SEQ ID NO: 261440 - DNA, 16 bp, P. troglodytes
tagataaataaataca

SEQ ID NO: 261441 - DNA, 16 bp, P. troglodytes
tagataaatggaacag

SEQ ID NO: 261442 - DNA, 16 bp, P. troglodytes
tagataaatttgggga

SEQ ID NO: 261443 - DNA, 16 bp, P. troglodytes
tagataactaatacag

SEQ ID NO: 261444 - DNA, 16 bp, P. troglodytes
tagatacaacaccaaa

SEQ ID NO: 261445 - DNA, 16 bp, P. troglodytes
tagatacacacataca

SEQ ID NO: 261446 - DNA, 16 bp, P. troglodytes
tagatacactaaaaat

SEQ ID NO: 261447 - DNA, 16 bp, P. troglodytes
tagatacatatataca

SEQ ID NO: 261448 - DNA, 16 bp, P. troglodytes
tagatagatgatagac

SEQ ID NO: 261449 - DNA, 16 bp, P. troglodytes
tagatagtttgcaaat

SEQ ID NO: 261450 - DNA, 16 bp, P. troglodytes
tagatatagaattctg

SEQ ID NO: 261451 - DNA, 16 bp, P. troglodytes
tagatatagatagatg

SEQ ID NO: 261452 - DNA, 16 bp, P. troglodytes
tagatatctatctata

SEQ ID NO: 261453 - DNA, 16 bp, P. troglodytes
tagatatgaaattctg

SEQ ID NO: 261454 - DNA, 16 bp, P. troglodytes
tagatatgtatatatg

SEQ ID NO: 261455 - DNA, 16 bp, P. troglodytes
tagatatgtatgtata

SEQ ID NO: 261456 - DNA, 16 bp, P. troglodytes
tagatatttttcaaaa

SEQ ID NO: 261457 - DNA, 16 bp, P. troglodytes
tagatcacattttctt

SEQ ID NO: 261458 - DNA, 16 bp, P. troglodytes
tagatcattttttaaa

SEQ ID NO: 261459 - DNA, 16 bp, P. troglodytes
tagatcccttgcatgc

SEQ ID NO: 261460 - DNA, 16 bp, P. troglodytes
tagatctttcctcctt

SEQ ID NO: 261461 - DNA, 16 bp, P. troglodytes
tagatgaaatagacca

SEQ ID NO: 261462 - DNA, 16 bp, P. troglodytes
tagatgaaattggaaa

SEQ ID NO: 261463 - DNA, 16 bp, P. troglodytes
tagatgaaattttaaa

SEQ ID NO: 261464 - DNA, 16 bp, P. troglodytes
tagatgaagaaattga

SEQ ID NO: 261465 - DNA, 16 bp, P. troglodytes
tagatgaataaatgaa

SEQ ID NO: 261466 - DNA, 16 bp, P. troglodytes
tagatgactggttgat

SEQ ID NO: 261467 - DNA, 16 bp, P. troglodytes
tagatgatatagatat

SEQ ID NO: 261468 - DNA, 16 bp, P. troglodytes
tagatgatgatgatga

SEQ ID NO: 261469 - DNA, 16 bp, P. troglodytes
tagatgcagaaaaggt

SEQ ID NO: 261470 - DNA, 16 bp, P. troglodytes
tagatgccattaaaaa

SEQ ID NO: 261471 - DNA, 16 bp, P. troglodytes
tagatgccctttattt

SEQ ID NO: 261472 - DNA, 16 bp, P. troglodytes
tagatgctaaataaat

SEQ ID NO: 261473 - DNA, 16 bp, P. troglodytes
tagatgctattaagaa

SEQ ID NO: 261474 - DNA, 16 bp, P. troglodytes
tagatgctcaataaat

SEQ ID NO: 261475 - DNA, 16 bp, P. troglodytes
tagatggagaaaaggc

SEQ ID NO: 261476 - DNA, 16 bp, P. troglodytes
tagatggcaccttctt

SEQ ID NO: 261477 - DNA, 16 bp, P. troglodytes
tagatggttggatgga

SEQ ID NO: 261478 - DNA, 16 bp, P. troglodytes
tagatgtaaaaatctt

SEQ ID NO: 261479 - DNA, 16 bp, P. troglodytes
tagatgtctatttggt

SEQ ID NO: 261480 - DNA, 16 bp, P. troglodytes
tagatgtggccatgtg

SEQ ID NO: 261481 - DNA, 16 bp, P. troglodytes
tagatgtgtgtgtgtg

SEQ ID NO: 261482 - DNA, 16 bp, P. troglodytes
tagattacatataata

SEQ ID NO: 261483 - DNA, 16 bp, P. troglodytes
tagattagtgattgcc

SEQ ID NO: 261484 - DNA, 16 bp, P. troglodytes
tagattattgttaact

SEQ ID NO: 261485 - DNA, 16 bp, P. troglodytes
tagattcagggggcac

SEQ ID NO: 261486 - DNA, 16 bp, P. troglodytes
tagattccatgctatt

SEQ ID NO: 261487 - DNA, 16 bp, P. troglodytes
tagattctggacatta

SEQ ID NO: 261488 - DNA, 16 bp, P. troglodytes
tagattgattccatgt

SEQ ID NO: 261489 - DNA, 16 bp, P. troglodytes
tagatttaggggatac

SEQ ID NO: 261490 - DNA, 17 bp, P. troglodytes
tagatttggtcttttca

SEQ ID NO: 261491 - DNA, 16 bp, P. troglodytes
tagattttaaaaatga

SEQ ID NO: 261492 - DNA, 16 bp, P. troglodytes
tagattttctttaaaa

SEQ ID NO: 261493 - DNA, 16 bp, P. troglodytes
tagattttgaagattt

SEQ ID NO: 261494 - DNA, 16 bp, P. troglodytes
tagattttgaagtcag

SEQ ID NO: 261495 - DNA, 16 bp, P. troglodytes
tagatttttctccatt

SEQ ID NO: 261496 - DNA, 16 bp, P. troglodytes
tagatttttttcctct

SEQ ID NO: 261497 - DNA, 16 bp, P. troglodytes
tagatttttttctaat

SEQ ID NO: 261498 - DNA, 16 bp, P. troglodytes
tagcaaaactccatct

SEQ ID NO: 261499 - DNA, 16 bp, P. troglodytes
tagcaaaatggcagaa

SEQ ID NO: 261500 - DNA, 17 bp, P. troglodytes
tagcaaatatttattga

SEQ ID NO: 261501 - DNA, 16 bp, P. troglodytes
tagcaaatgaaaatac

SEQ ID NO: 261502 - DNA, 16 bp, P. troglodytes
tagcaaattaattgaa

SEQ ID NO: 261503 - DNA, 16 bp, P. troglodytes
tagcaaattatcaaac

SEQ ID NO: 261504 - DNA, 16 bp, P. troglodytes
tagcaacatggatgga

SEQ ID NO: 261505 - DNA, 16 bp, P. troglodytes
tagcaactttattcat

SEQ ID NO: 261506 - DNA, 16 bp, P. troglodytes
tagcaagacaggcaaa

SEQ ID NO: 261507 - DNA, 18 bp, P. troglodytes
tagcaagactctgtctca

SEQ ID NO: 261508 - DNA, 16 bp, P. troglodytes
tagcaagagaactaga

SEQ ID NO: 261509 - DNA, 16 bp, P. troglodytes
tagcaataaagcattt

SEQ ID NO: 261510 - DNA, 16 bp, P. troglodytes
tagcaataaggtattt

SEQ ID NO: 261511 - DNA, 16 bp, P. troglodytes
tagcacatgcttgtaa

SEQ ID NO: 261512 - DNA, 16 bp, P. troglodytes
tagcacattttcttta

SEQ ID NO: 261513 - DNA, 16 bp, P. troglodytes
tagcaccactgaactc

SEQ ID NO: 261514 - DNA, 16 bp, P. troglodytes
tagcacctatttttat

SEQ ID NO: 261515 - DNA, 19 bp, P. troglodytes
tagcactttgggaggccaa

SEQ ID NO: 261516 - DNA, 19 bp, P. troglodytes
tagcactttgggaggctga

SEQ ID NO: 261517 - DNA, 16 bp, P. troglodytes
tagcagaagaaaagaa

SEQ ID NO: 261518 - DNA, 16 bp, P. troglodytes
tagcagaagaaaggaa

SEQ ID NO: 261519 - DNA, 16 bp, P. troglodytes
tagcagaagacatgaa

SEQ ID NO: 261520 - DNA, 16 bp, P. troglodytes
tagcagagctgggatt

SEQ ID NO: 261521 - DNA, 16 bp, P. troglodytes
tagcagagtagggtga

SEQ ID NO: 261522 - DNA, 16 bp, P. troglodytes
tagcagcagcagcagt

SEQ ID NO: 261523 - DNA, 16 bp, P. troglodytes
tagcagcatcatttat

SEQ ID NO: 261524 - DNA, 16 bp, P. troglodytes
tagcagcctgaagcca

SEQ ID NO: 261525 - DNA, 16 bp, P. troglodytes
tagcagggactacagg

SEQ ID NO: 261526 - DNA, 16 bp, P. troglodytes
tagcagggtgagaatg

SEQ ID NO: 261527 - DNA, 16 bp, P. troglodytes
tagcaggtgctcaata

SEQ ID NO: 261528 - DNA, 16 bp, P. troglodytes
tagcaggtgtggtggt

SEQ ID NO: 261529 - DNA, 16 bp, P. troglodytes
tagcagtcactcctca

SEQ ID NO: 261530 - DNA, 16 bp, P. troglodytes
tagcagtgagccaaga

SEQ ID NO: 261531 - DNA, 16 bp, P. troglodytes
tagcagttaaaaaaga

SEQ ID NO: 261532 - DNA, 16 bp, P. troglodytes
tagcataattcttaaa

SEQ ID NO: 261533 - DNA, 16 bp, P. troglodytes
tagcatattttgaagt

SEQ ID NO: 261534 - DNA, 16 bp, P. troglodytes
tagcatctggcttcct

SEQ ID NO: 261535 - DNA, 16 bp, P. troglodytes
tagcatgggaaagacc

SEQ ID NO: 261536 - DNA, 16 bp, P. troglodytes
tagcatgtatcagcac

SEQ ID NO: 261537 - DNA, 16 bp, P. troglodytes
tagcattatgtctaaa

SEQ ID NO: 261538 - DNA, 16 bp, P. troglodytes
tagcattcacattgta

SEQ ID NO: 261539 - DNA, 16 bp, P. troglodytes
tagcatttaaaaaaat

SEQ ID NO: 261540 - DNA, 16 bp, P. troglodytes
tagcatttgttgattt

SEQ ID NO: 261541 - DNA, 16 bp, P. troglodytes
tagcatttttaaatta

SEQ ID NO: 261542 - DNA, 16 bp, P. troglodytes
tagccaaaaagcagaa

SEQ ID NO: 261543 - DNA, 16 bp, P. troglodytes
tagccaaaaggcagaa

SEQ ID NO: 261544 - DNA, 16 bp, P. troglodytes
tagccaaaaggtagaa

SEQ ID NO: 261545 - DNA, 16 bp, P. troglodytes
tagccaaagcaatctg

SEQ ID NO: 261546 - DNA, 16 bp, P. troglodytes
tagccaacatggtgaa

SEQ ID NO: 261547 - DNA, 16 bp, P. troglodytes
tagccaagacatggaa

SEQ ID NO: 261548 - DNA, 16 bp, P. troglodytes
tagccaagatagggaa

SEQ ID NO: 261549 - DNA, 16 bp, P. troglodytes
tagccaagatttggaa

SEQ ID NO: 261550 - DNA, 16 bp, P. troglodytes
tagccaagggaagcct

SEQ ID NO: 261551 - DNA, 16 bp, P. troglodytes
tagccaagtgtggtga

SEQ ID NO: 261552 - DNA, 16 bp, P. troglodytes
tagccacagctggagc

SEQ ID NO: 261553 - DNA, 16 bp, P. troglodytes
tagccacatgtgacta

SEQ ID NO: 261554 - DNA, 16 bp, P. troglodytes
tagccacatgtggcta

SEQ ID NO: 261555 - DNA, 16 bp, P. troglodytes
tagccaccacagctga

SEQ ID NO: 261556 - DNA, 16 bp, P. troglodytes
tagccaccccaacctt

SEQ ID NO: 261557 - DNA, 16 bp, P. troglodytes
tagccaccctgttgtg

SEQ ID NO: 261558 - DNA, 16 bp, P. troglodytes
tagccagacatggtgg

SEQ ID NO: 261559 - DNA, 16 bp, P. troglodytes
tagccagagagaaagg

SEQ ID NO: 261560 - DNA, 16 bp, P. troglodytes
tagccagctgtagtgg

SEQ ID NO: 261561 - DNA, 16 bp, P. troglodytes
tagccagctttcccag

SEQ ID NO: 261562 - DNA, 16 bp, P. troglodytes
tagccaggactacagg

SEQ ID NO: 261563 - DNA, 21 bp, P. troglodytes
tagccaggcacagtggctcat

SEQ ID NO: 261564 - DNA, 16 bp, P. troglodytes
tagccaggcctggtgg

SEQ ID NO: 261565 - DNA, 19 bp, P. troglodytes
tagccaggcctggtggtgg

SEQ ID NO: 261566 - DNA, 16 bp, P. troglodytes
tagccaggcttggtgg

SEQ ID NO: 261567 - DNA, 16 bp, P. troglodytes
tagccaggtgccatgg

SEQ ID NO: 261568 - DNA, 16 bp, P. troglodytes
tagccaggtgtgatga

SEQ ID NO: 261569 - DNA, 16 bp, P. troglodytes
tagccaggtgtggccg

SEQ ID NO: 261570 - DNA, 16 bp, P. troglodytes
tagccaggtgtggtga

SEQ ID NO: 261571 - DNA, 16 bp, P. troglodytes
tagccagttgtggtgg

SEQ ID NO: 261572 - DNA, 16 bp, P. troglodytes
tagccagttttccaaa

SEQ ID NO: 261573 - DNA, 16 bp, P. troglodytes
tagccatcctagtagg

SEQ ID NO: 261574 - DNA, 16 bp, P. troglodytes
tagccatctgcaagcc

SEQ ID NO: 261575 - DNA, 16 bp, P. troglodytes
tagccattctggtggg

SEQ ID NO: 261576 - DNA, 17 bp, P. troglodytes
tagcccacttacattta

SEQ ID NO: 261577 - DNA, 16 bp, P. troglodytes
tagccccaaactgaaa

SEQ ID NO: 261578 - DNA, 16 bp, P. troglodytes
tagcccctttattttg

SEQ ID NO: 261579 - DNA, 16 bp, P. troglodytes
tagcccctttgttttg

SEQ ID NO: 261580 - DNA, 16 bp, P. troglodytes
tagccctcagaaggaa

SEQ ID NO: 261581 - DNA, 17 bp, P. troglodytes
tagccgagatcatgcca

SEQ ID NO: 261582 - DNA, 16 bp, P. troglodytes
tagccggatatggtgg

SEQ ID NO: 261583 - DNA, 16 bp, P. troglodytes
tagccggccatggtgg

SEQ ID NO: 261584 - DNA, 18 bp, P. troglodytes
tagccgggagtggtggca

SEQ ID NO: 261585 - DNA, 16 bp, P. troglodytes
tagccgggatggtctt

SEQ ID NO: 261586 - DNA, 16 bp, P. troglodytes
tagccgggcacggtgg

SEQ ID NO: 261587 - DNA, 16 bp, P. troglodytes
tagccgggcatggtga

SEQ ID NO: 261588 - DNA, 16 bp, P. troglodytes
tagccgggcctggtgg

SEQ ID NO: 261589 - DNA, 16 bp, P. troglodytes
tagccgggcgcagtgg

SEQ ID NO: 261590 - DNA, 16 bp, P. troglodytes
tagccgggcgcggtgg

SEQ ID NO: 261591 - DNA, 20 bp, P. troglodytes
tagccgggcgtggtggcacg

SEQ ID NO: 261592 - DNA, 16 bp, P. troglodytes
tagccgggtgcggtgg

SEQ ID NO: 261593 - DNA, 16 bp, P. troglodytes
tagcctaatttgtatt

SEQ ID NO: 261594 - DNA, 16 bp, P. troglodytes
tagcctattgctccta

SEQ ID NO: 261595 - DNA, 16 bp, P. troglodytes
tagcctcaatctccca

SEQ ID NO: 261596 - DNA, 16 bp, P. troglodytes
tagcctcagcctcccg

SEQ ID NO: 261597 - DNA, 18 bp, P. troglodytes
tagcctcccaaagtgcta

SEQ ID NO: 261598 - DNA, 22 bp, P. troglodytes
tagcctcctgagtagctgggac

SEQ ID NO: 261599 - DNA, 16 bp, P. troglodytes
tagcctgacatggtgg

SEQ ID NO: 261600 - DNA, 16 bp, P. troglodytes
tagcctggatgacaca

SEQ ID NO: 261601 - DNA, 16 bp, P. troglodytes
tagcctggcatgttgg

SEQ ID NO: 261602 - DNA, 25 bp, P. troglodytes
tagcctggccaacatggtgaaacct

SEQ ID NO: 261603 - DNA, 23 bp, P. troglodytes
tagcctggccaacatggtgaaat

SEQ ID NO: 261604 - DNA, 16 bp, P. troglodytes
tagcctggccatcatg

SEQ ID NO: 261605 - DNA, 16 bp, P. troglodytes
tagcctggctgcttct

SEQ ID NO: 261606 - DNA, 17 bp, P. troglodytes
tagcctgggcaacagaa

SEQ ID NO: 261607 - DNA, 16 bp, P. troglodytes
tagcctgggctggagt

SEQ ID NO: 261608 - DNA, 16 bp, P. troglodytes
tagccttgtagaatga

SEQ ID NO: 261609 - DNA, 16 bp, P. troglodytes
tagcctttataataaa

SEQ ID NO: 261610 - DNA, 16 bp, P. troglodytes
tagccttttagtatag

SEQ ID NO: 261611 - DNA, 16 bp, P. troglodytes
tagccttttcagataa

SEQ ID NO: 261612 - DNA, 16 bp, P. troglodytes
tagcgctttgggaggc

SEQ ID NO: 261613 - DNA, 16 bp, P. troglodytes
tagcgttgatggtctt

SEQ ID NO: 261614 - DNA, 16 bp, P. troglodytes
tagctaaagttaaaaa

SEQ ID NO: 261615 - DNA, 16 bp, P. troglodytes
tagctaagactacagg

SEQ ID NO: 261616 - DNA, 16 bp, P. troglodytes
tagctaagatcattga

SEQ ID NO: 261617 - DNA, 16 bp, P. troglodytes
tagctaattaaaaaat

SEQ ID NO: 261618 - DNA, 16 bp, P. troglodytes
tagctaattttttgta

SEQ ID NO: 261619 - DNA, 17 bp, P. troglodytes
tagctactcagaaggct

SEQ ID NO: 261620 - DNA, 16 bp, P. troglodytes
tagctaggactgcaga

SEQ ID NO: 261621 - DNA, 16 bp, P. troglodytes
tagctaggattacagg

SEQ ID NO: 261622 - DNA, 16 bp, P. troglodytes
tagctataattttgta

SEQ ID NO: 261623 - DNA, 16 bp, P. troglodytes
tagctatgtgactttg

SEQ ID NO: 261624 - DNA, 16 bp, P. troglodytes
tagctattaaaataat

SEQ ID NO: 261625 - DNA, 16 bp, P. troglodytes
tagctattattattaa

SEQ ID NO: 261626 - DNA, 16 bp, P. troglodytes
tagctattgtaaacag

SEQ ID NO: 261627 - DNA, 16 bp, P. troglodytes
tagctatttaaaaata

SEQ ID NO: 261628 - DNA, 16 bp, P. troglodytes
tagctatttaaattta

SEQ ID NO: 261629 - DNA, 16 bp, P. troglodytes
tagctatttgaaacta

SEQ ID NO: 261630 - DNA, 17 bp, P. troglodytes
tagctcaaggtttgtga

SEQ ID NO: 261631 - DNA, 16 bp, P. troglodytes
tagctcactgcaacct

SEQ ID NO: 261632 - DNA, 16 bp, P. troglodytes
tagctcactgcaactt

SEQ ID NO: 261633 - DNA, 16 bp, P. troglodytes
tagctcactgcagcct

SEQ ID NO: 261634 - DNA, 16 bp, P. troglodytes
tagctcactgcagtct

SEQ ID NO: 261635 - DNA, 16 bp, P. troglodytes
tagctcactgtagcct

SEQ ID NO: 261636 - DNA, 16 bp, P. troglodytes
tagctcaggcctgtaa

SEQ ID NO: 261637 - DNA, 16 bp, P. troglodytes
tagctcagtgtggtgg

SEQ ID NO: 261638 - DNA, 16 bp, P. troglodytes
tagctcatttttaaat

SEQ ID NO: 261639 - DNA, 16 bp, P. troglodytes
tagctcctacttatga

SEQ ID NO: 261640 - DNA, 16 bp, P. troglodytes
tagctctgtggcccag

SEQ ID NO: 261641 - DNA, 16 bp, P. troglodytes
tagctcttctctgcag

SEQ ID NO: 261642 - DNA, 16 bp, P. troglodytes
tagctgaatagaccaa

SEQ ID NO: 261643 - DNA, 16 bp, P. troglodytes
tagctgagaccacaga

SEQ ID NO: 261644 - DNA, 16 bp, P. troglodytes
tagctgagaccacagg

SEQ ID NO: 261645 - DNA, 16 bp, P. troglodytes
tagctgagctaaggag

SEQ ID NO: 261646 - DNA, 16 bp, P. troglodytes
tagctgatgagctaaa

SEQ ID NO: 261647 - DNA, 16 bp, P. troglodytes
tagctgattattttgc

SEQ ID NO: 261648 - DNA, 16 bp, P. troglodytes
tagctgatttttgtat

SEQ ID NO: 261649 - DNA, 16 bp, P. troglodytes
tagctgctcttgccac

SEQ ID NO: 261650 - DNA, 16 bp, P. troglodytes
tagctggaactacagt

SEQ ID NO: 261651 - DNA, 16 bp, P. troglodytes
tagctggatatggtgg

SEQ ID NO: 261652 - DNA, 16 bp, P. troglodytes
tagctggatgcagtgg

SEQ ID NO: 261653 - DNA, 16 bp, P. troglodytes
tagctggcattacagg

SEQ ID NO: 261654 - DNA, 16 bp, P. troglodytes
tagctggcttctttac

SEQ ID NO: 261655 - DNA, 16 bp, P. troglodytes
tagctgggacaacaga

SEQ ID NO: 261656 - DNA, 16 bp, P. troglodytes
tagctgggaccacaca

SEQ ID NO: 261657 - DNA, 16 bp, P. troglodytes
tagctgggactacaag

SEQ ID NO: 261658 - DNA, 16 bp, P. troglodytes
tagctgggactcaggc

SEQ ID NO: 261659 - DNA, 16 bp, P. troglodytes
tagctgggagcagtgg

SEQ ID NO: 261660 - DNA, 16 bp, P. troglodytes
tagctgggataatagg

SEQ ID NO: 261661 - DNA, 16 bp, P. troglodytes
tagctgggatcacagg

SEQ ID NO: 261662 - DNA, 21 bp, P. troglodytes
tagctgggattacaggtgcct

SEQ ID NO: 261663 - DNA, 20 bp, P. troglodytes
tagctgggattacaggtgtg

SEQ ID NO: 261664 - DNA, 16 bp, P. troglodytes
tagctgggcacggtgg

SEQ ID NO: 261665 - DNA, 16 bp, P. troglodytes
tagctgggcactgtgg

SEQ ID NO: 261666 - DNA, 16 bp, P. troglodytes
tagctgggcctacagg

SEQ ID NO: 261667 - DNA, 16 bp, P. troglodytes
tagctgggcctggtgg

SEQ ID NO: 261668 - DNA, 16 bp, P. troglodytes
tagctgggcgcagtgg

SEQ ID NO: 261669 - DNA, 16 bp, P. troglodytes
tagctggggatggtgg

SEQ ID NO: 261670 - DNA, 16 bp, P. troglodytes
tagctgggtggtggtg

SEQ ID NO: 261671 - DNA, 16 bp, P. troglodytes
tagctgtgtaaccttg

SEQ ID NO: 261672 - DNA, 16 bp, P. troglodytes
tagctgtgtgaccttg

SEQ ID NO: 261673 - DNA, 16 bp, P. troglodytes
tagctgtgtgatcttg

SEQ ID NO: 261674 - DNA, 16 bp, P. troglodytes
tagctgtgtggccttg

SEQ ID NO: 261675 - DNA, 16 bp, P. troglodytes
tagctgtttattttgc

SEQ ID NO: 261676 - DNA, 16 bp, P. troglodytes
tagcttactgcaacct

SEQ ID NO: 261677 - DNA, 16 bp, P. troglodytes
tagcttactgcagcct

SEQ ID NO: 261678 - DNA, 16 bp, P. troglodytes
tagcttataaataaca

SEQ ID NO: 261679 - DNA, 16 bp, P. troglodytes
tagcttcagacttttc

SEQ ID NO: 261680 - DNA, 16 bp, P. troglodytes
tagcttcaggatgggg

SEQ ID NO: 261681 - DNA, 16 bp, P. troglodytes
tagcttgaattacagg

SEQ ID NO: 261682 - DNA, 16 bp, P. troglodytes
tagcttgagcctggga

SEQ ID NO: 261683 - DNA, 16 bp, P. troglodytes
tagcttgtccaaggtc

SEQ ID NO: 261684 - DNA, 16 bp, P. troglodytes
tagctttaggggtaca

SEQ ID NO: 261685 - DNA, 16 bp, P. troglodytes
tagctttattgaggta

SEQ ID NO: 261686 - DNA, 16 bp, P. troglodytes
tagctttcagcctgtc

SEQ ID NO: 261687 - DNA, 16 bp, P. troglodytes
tagctttcctttcctg

SEQ ID NO: 261688 - DNA, 16 bp, P. troglodytes
tagctttgaatgatct

SEQ ID NO: 261689 - DNA, 16 bp, P. troglodytes
tagcttttaaatttgt

SEQ ID NO: 261690 - DNA, 16 bp, P. troglodytes
tagcttttgaatttat

SEQ ID NO: 261691 - DNA, 16 bp, P. troglodytes
tagcttttgagtttgt

SEQ ID NO: 261692 - DNA, 16 bp, P. troglodytes
tagcttttgatttaaa

SEQ ID NO: 261693 - DNA, 16 bp, P. troglodytes
tagctttttaaaaaat

SEQ ID NO: 261694 - DNA, 16 bp, P. troglodytes
taggaaaaaatgctca

SEQ ID NO: 261695 - DNA, 16 bp, P. troglodytes
taggaaaaatcaatat

SEQ ID NO: 261696 - DNA, 16 bp, P. troglodytes
taggaaaaccagagaa

SEQ ID NO: 261697 - DNA, 37 bp, P. troglodytes
taggaaaagaggaagtcaaattgtccctgtttgcaga

SEQ ID NO: 261698 - DNA, 16 bp, P. troglodytes
taggaaatatactttt

SEQ ID NO: 261699 - DNA, 16 bp, P. troglodytes
taggaaatgtccagaa

SEQ ID NO: 261700 - DNA, 16 bp, P. troglodytes
taggaaattaatacag

SEQ ID NO: 261701 - DNA, 16 bp, P. troglodytes
taggaacacttttaca

SEQ ID NO: 261702 - DNA, 16 bp, P. troglodytes
taggaacattcaaaat

SEQ ID NO: 261703 - DNA, 16 bp, P. troglodytes
taggaagaaccaatat

SEQ ID NO: 261704 - DNA, 16 bp, P. troglodytes
taggaagaatcaatat

SEQ ID NO: 261705 - DNA, 16 bp, P. troglodytes
taggaatgaatttaac

SEQ ID NO: 261706 - DNA, 16 bp, P. troglodytes
taggacagagcacctg

SEQ ID NO: 261707 - DNA, 16 bp, P. troglodytes
taggacaggtctgatg

SEQ ID NO: 261708 - DNA, 16 bp, P. troglodytes
taggaccacaggcatg

SEQ ID NO: 261709 - DNA, 16 bp, P. troglodytes
taggactacaggcaca

SEQ ID NO: 261710 - DNA, 16 bp, P. troglodytes
taggagaaaaaggcat

SEQ ID NO: 261711 - DNA, 20 bp, P. troglodytes
taggagaatcacttgaacct

SEQ ID NO: 261712 - DNA, 16 bp, P. troglodytes
taggagaatcgcttga

SEQ ID NO: 261713 - DNA, 16 bp, P. troglodytes
taggagattgaggctg

SEQ ID NO: 261714 - DNA, 16 bp, P. troglodytes
taggaggaataagttc

SEQ ID NO: 261715 - DNA, 19 bp, P. troglodytes
taggaggattgcttgagcc

SEQ ID NO: 261716 - DNA, 16 bp, P. troglodytes
taggaggccaaggctg

SEQ ID NO: 261717 - DNA, 16 bp, P. troglodytes
taggaggcccaggtgg

SEQ ID NO: 261718 - DNA, 16 bp, P. troglodytes
taggaggccgagacag

SEQ ID NO: 261719 - DNA, 20 bp, P. troglodytes
taggaggctgaggtgggagg

SEQ ID NO: 261720 - DNA, 16 bp, P. troglodytes
taggagggttgcttga

SEQ ID NO: 261721 - DNA, 16 bp, P. troglodytes
taggagtagaattgct

SEQ ID NO: 261722 - DNA, 16 bp, P. troglodytes
taggagtggaattgct

SEQ ID NO: 261723 - DNA, 16 bp, P. troglodytes
taggagtggaatttct

SEQ ID NO: 261724 - DNA, 16 bp, P. troglodytes
taggagtggttagaga

SEQ ID NO: 261725 - DNA, 16 bp, P. troglodytes
taggatcatgttatct

SEQ ID NO: 261726 - DNA, 16 bp, P. troglodytes
taggatgactataatt

SEQ ID NO: 261727 - DNA, 27 bp, P. troglodytes
taggatggtctcgatctcctgacctcg

SEQ ID NO: 261728 - DNA, 16 bp, P. troglodytes
taggattacaagtgcc

SEQ ID NO: 261729 - DNA, 16 bp, P. troglodytes
taggattacaggcgta

SEQ ID NO: 261730 - DNA, 16 bp, P. troglodytes
taggattacgggcatg

SEQ ID NO: 261731 - DNA, 16 bp, P. troglodytes
taggattgctttttct

SEQ ID NO: 261732 - DNA, 16 bp, P. troglodytes
taggatttttaaaaat

SEQ ID NO: 261733 - DNA, 16 bp, P. troglodytes
taggatttttcttctt

SEQ ID NO: 261734 - DNA, 16 bp, P. troglodytes
taggcaaaaactggaa

SEQ ID NO: 261735 - DNA, 16 bp, P. troglodytes
taggcaaaggatttga

SEQ ID NO: 261736 - DNA, 16 bp, P. troglodytes
taggcaaattcagaga

SEQ ID NO: 261737 - DNA, 16 bp, P. troglodytes
taggcaacaaaatgag

SEQ ID NO: 261738 - DNA, 16 bp, P. troglodytes
taggcaacagagtgag

SEQ ID NO: 261739 - DNA, 16 bp, P. troglodytes
taggcaagagaaataa

SEQ ID NO: 261740 - DNA, 16 bp, P. troglodytes
taggcaagataaagaa

SEQ ID NO: 261741 - DNA, 17 bp, P. troglodytes
taggcaataggaatttt

SEQ ID NO: 261742 - DNA, 17 bp, P. troglodytes
taggcacattgtcatca

SEQ ID NO: 261743 - DNA, 16 bp, P. troglodytes
taggcagaaaactgaa

SEQ ID NO: 261744 - DNA, 16 bp, P. troglodytes
taggcagaataatggc

SEQ ID NO: 261745 - DNA, 16 bp, P. troglodytes
taggcatctcaaactt

SEQ ID NO: 261746 - DNA, 18 bp, P. troglodytes
taggcatgagccaccacg

SEQ ID NO: 261747 - DNA, 17 bp, P. troglodytes
taggcatgagccaccat

SEQ ID NO: 261748 - DNA, 16 bp, P. troglodytes
taggcattcaataaat

SEQ ID NO: 261749 - DNA, 16 bp, P. troglodytes
taggcattgatggaac

SEQ ID NO: 261750 - DNA, 16 bp, P. troglodytes
taggcatttattgtta

SEQ ID NO: 261751 - DNA, 16 bp, P. troglodytes
taggccaaaccaatgt

SEQ ID NO: 261752 - DNA, 16 bp, P. troglodytes
taggccagcaggctgg

SEQ ID NO: 261753 - DNA, 16 bp, P. troglodytes
taggccaggatggtct

SEQ ID NO: 261754 - DNA, 16 bp, P. troglodytes
taggccaggcaaggtg

SEQ ID NO: 261755 - DNA, 16 bp, P. troglodytes
taggccaggctggtct

SEQ ID NO: 261756 - DNA, 22 bp, P. troglodytes
taggccgggcacagtggctcac

SEQ ID NO: 261757 - DNA, 16 bp, P. troglodytes
taggcgattttgtcat

SEQ ID NO: 261758 - DNA, 16 bp, P. troglodytes
taggcgcagtggctca

SEQ ID NO: 261759 - DNA, 16 bp, P. troglodytes
taggcgtgagccacca

SEQ ID NO: 261760 - DNA, 16 bp, P. troglodytes
taggcgtgagccaccg

SEQ ID NO: 261761 - DNA, 16 bp, P. troglodytes
taggcgtgagccactg

SEQ ID NO: 261762 - DNA, 16 bp, P. troglodytes
taggcgtggtggtggg

SEQ ID NO: 261763 - DNA, 16 bp, P. troglodytes
taggctacactaaatt

SEQ ID NO: 261764 - DNA, 19 bp, P. troglodytes
taggctagagtgcaatggt

SEQ ID NO: 261765 - DNA, 16 bp, P. troglodytes
taggctagagtgcagt

SEQ ID NO: 261766 - DNA, 16 bp, P. troglodytes
taggctatttattact

SEQ ID NO: 261767 - DNA, 16 bp, P. troglodytes
taggctctggagccag

SEQ ID NO: 261768 - DNA, 16 bp, P. troglodytes
taggctgaggaggaag

SEQ ID NO: 261769 - DNA, 16 bp, P. troglodytes
taggctgaggcaggag

SEQ ID NO: 261770 - DNA, 18 bp, P. troglodytes
taggctgaggtgagagga

SEQ ID NO: 261771 - DNA, 23 bp, P. troglodytes
taggctggagtgcaatggtgcga

SEQ ID NO: 261772 - DNA, 28 bp, P. troglodytes
taggctggagtgcagtggtgcgatctca

SEQ ID NO: 261773 - DNA, 16 bp, P. troglodytes
taggctgggcatagtg

SEQ ID NO: 261774 - DNA, 16 bp, P. troglodytes
taggctgggtatggtg

SEQ ID NO: 261775 - DNA, 16 bp, P. troglodytes
taggctgggtgcagtg

SEQ ID NO: 261776 - DNA, 17 bp, P. troglodytes
taggctggtctcgaact

SEQ ID NO: 261777 - DNA, 16 bp, P. troglodytes
taggctttataaacac

SEQ ID NO: 261778 - DNA, 16 bp, P. troglodytes
taggctttgtgagcca

SEQ ID NO: 261779 - DNA, 16 bp, P. troglodytes
tagggaaaaaaatcta

SEQ ID NO: 261780 - DNA, 16 bp, P. troglodytes
tagggaaactgaggct

SEQ ID NO: 261781 - DNA, 16 bp, P. troglodytes
tagggaagctgagaca

SEQ ID NO: 261782 - DNA, 16 bp, P. troglodytes
tagggaatcctttctg

SEQ ID NO: 261783 - DNA, 16 bp, P. troglodytes
tagggacatggatgaa

SEQ ID NO: 261784 - DNA, 16 bp, P. troglodytes
tagggacttggagaac

SEQ ID NO: 261785 - DNA, 16 bp, P. troglodytes
tagggagaccctgtct

SEQ ID NO: 261786 - DNA, 16 bp, P. troglodytes
tagggaggcctcagaa

SEQ ID NO: 261787 - DNA, 16 bp, P. troglodytes
tagggagtcctttcct

SEQ ID NO: 261788 - DNA, 16 bp, P. troglodytes
tagggatctttcacct

SEQ ID NO: 261789 - DNA, 16 bp, P. troglodytes
tagggcaagcttgtat

SEQ ID NO: 261790 - DNA, 16 bp, P. troglodytes
tagggcccttaagaat

SEQ ID NO: 261791 - DNA, 16 bp, P. troglodytes
tagggcctgagaattt

SEQ ID NO: 261792 - DNA, 16 bp, P. troglodytes
tagggccttgagcaaa

SEQ ID NO: 261793 - DNA, 16 bp, P. troglodytes
tagggctgttgtgagg

SEQ ID NO: 261794 - DNA, 16 bp, P. troglodytes
taggggccaagggaaa

SEQ ID NO: 261795 - DNA, 16 bp, P. troglodytes
taggggctcaataaat

SEQ ID NO: 261796 - DNA, 17 bp, P. troglodytes
tagggtacatgtgcaca

SEQ ID NO: 261797 - DNA, 16 bp, P. troglodytes
tagggtctcactctgt

SEQ ID NO: 261798 - DNA, 16 bp, P. troglodytes
tagggttacagattaa

SEQ ID NO: 261799 - DNA, 20 bp, P. troglodytes
tagggtttcaccatgttggt

SEQ ID NO: 261800 - DNA, 16 bp, P. troglodytes
tagggtttttaaaaaa

SEQ ID NO: 261801 - DNA, 17 bp, P. troglodytes
taggtaaacaaagcagc

SEQ ID NO: 261802 - DNA, 16 bp, P. troglodytes
taggtacacaataaat

SEQ ID NO: 261803 - DNA, 16 bp, P. troglodytes
taggtactgttattat

SEQ ID NO: 261804 - DNA, 16 bp, P. troglodytes
taggtaggtaagagac

SEQ ID NO: 261805 - DNA, 16 bp, P. troglodytes
taggtatatacatgcc

SEQ ID NO: 261806 - DNA, 16 bp, P. troglodytes
taggtattgatggaac

SEQ ID NO: 261807 - DNA, 16 bp, P. troglodytes
taggtatttacctaag

SEQ ID NO: 261808 - DNA, 16 bp, P. troglodytes
taggtatttgtcttaa

SEQ ID NO: 261809 - DNA, 16 bp, P. troglodytes
taggtattttattccc

SEQ ID NO: 261810 - DNA, 16 bp, P. troglodytes
taggtattttattctt

SEQ ID NO: 261811 - DNA, 16 bp, P. troglodytes
taggtattttttgtag

SEQ ID NO: 261812 - DNA, 16 bp, P. troglodytes
taggtcatgagagctc

SEQ ID NO: 261813 - DNA, 16 bp, P. troglodytes
taggtccaagagtcca

SEQ ID NO: 261814 - DNA, 16 bp, P. troglodytes
taggtcctttttccat

SEQ ID NO: 261815 - DNA, 16 bp, P. troglodytes
taggtgaaggagaaat

SEQ ID NO: 261816 - DNA, 16 bp, P. troglodytes
taggtgcaggaaacca

SEQ ID NO: 261817 - DNA, 18 bp, P. troglodytes
taggtgcatgccaccaca

SEQ ID NO: 261818 - DNA, 16 bp, P. troglodytes
taggtgctcagtaaat

SEQ ID NO: 261819 - DNA, 17 bp, P. troglodytes
taggtgggaatggaaca

SEQ ID NO: 261820 - DNA, 16 bp, P. troglodytes
taggtgggactacagt

SEQ ID NO: 261821 - DNA, 16 bp, P. troglodytes
taggtgtgacccacca

SEQ ID NO: 261822 - DNA, 21 bp, P. troglodytes
taggtgtgagccaccgcaccc

SEQ ID NO: 261823 - DNA, 16 bp, P. troglodytes
taggtgtgagccactg

SEQ ID NO: 261824 - DNA, 16 bp, P. troglodytes
taggtgtggtggtgcg

SEQ ID NO: 261825 - DNA, 16 bp, P. troglodytes
taggtgttcaatacat

SEQ ID NO: 261826 - DNA, 16 bp, P. troglodytes
taggttcatccatgtt

SEQ ID NO: 261827 - DNA, 16 bp, P. troglodytes
taggttccacttgtca

SEQ ID NO: 261828 - DNA, 16 bp, P. troglodytes
taggttcttgaaaact

SEQ ID NO: 261829 - DNA, 16 bp, P. troglodytes
taggttgattccatat

SEQ ID NO: 261830 - DNA, 16 bp, P. troglodytes
taggttgcagtgagcc

SEQ ID NO: 261831 - DNA, 16 bp, P. troglodytes
taggttgcctgctcct

SEQ ID NO: 261832 - DNA, 16 bp, P. troglodytes
taggtttggacattta

SEQ ID NO: 261833 - DNA, 16 bp, P. troglodytes
taggtttggtcttttt

SEQ ID NO: 261834 - DNA, 16 bp, P. troglodytes
taggttttattctagg

SEQ ID NO: 261835 - DNA, 16 bp, P. troglodytes
taggtttttgtgtgaa

SEQ ID NO: 261836 - DNA, 16 bp, P. troglodytes
tagtaaaacctcatct

SEQ ID NO: 261837 - DNA, 16 bp, P. troglodytes
tagtaaagatggagtt

SEQ ID NO: 261838 - DNA, 16 bp, P. troglodytes
tagtaaataaataaac

SEQ ID NO: 261839 - DNA, 16 bp, P. troglodytes
tagtaaatgacagagc

SEQ ID NO: 261840 - DNA, 16 bp, P. troglodytes
tagtaaatttattttc

SEQ ID NO: 261841 - DNA, 16 bp, P. troglodytes
tagtaacagccattct

SEQ ID NO: 261842 - DNA, 16 bp, P. troglodytes
tagtaacatcaaagat

SEQ ID NO: 261843 - DNA, 16 bp, P. troglodytes
tagtaagcactcaaaa

SEQ ID NO: 261844 - DNA, 16 bp, P. troglodytes
tagtaagtggtagagc

SEQ ID NO: 261845 - DNA, 16 bp, P. troglodytes
tagtaataataatact

SEQ ID NO: 261846 - DNA, 16 bp, P. troglodytes
tagtacagacagggtc

SEQ ID NO: 261847 - DNA, 16 bp, P. troglodytes
tagtaccagctacttg

SEQ ID NO: 261848 - DNA, 16 bp, P. troglodytes
tagtaccagctcttct

SEQ ID NO: 261849 - DNA, 16 bp, P. troglodytes
tagtagaagaaataat

SEQ ID NO: 261850 - DNA, 17 bp, P. troglodytes
tagtagagacagagctt

SEQ ID NO: 261851 - DNA, 20 bp, P. troglodytes
tagtagaggcggggtttcat

SEQ ID NO: 261852 - DNA, 16 bp, P. troglodytes
tagtagcaatggggtt

SEQ ID NO: 261853 - DNA, 16 bp, P. troglodytes
tagtaggataatgaag

SEQ ID NO: 261854 - DNA, 16 bp, P. troglodytes
tagtaggtgctcaaaa

SEQ ID NO: 261855 - DNA, 16 bp, P. troglodytes
tagtaggtgttcagta

SEQ ID NO: 261856 - DNA, 16 bp, P. troglodytes
tagtagtagtagtagt

SEQ ID NO: 261857 - DNA, 16 bp, P. troglodytes
tagtatctcattatgg

SEQ ID NO: 261858 - DNA, 16 bp, P. troglodytes
tagtattattttcatt

SEQ ID NO: 261859 - DNA, 16 bp, P. troglodytes
tagtattccactgtgt

SEQ ID NO: 261860 - DNA, 16 bp, P. troglodytes
tagtattccattgtgt

SEQ ID NO: 261861 - DNA, 16 bp, P. troglodytes
tagtattcctttgtat

SEQ ID NO: 261862 - DNA, 16 bp, P. troglodytes
tagtatttccatttta

SEQ ID NO: 261863 - DNA, 16 bp, P. troglodytes
tagtatttgtgtatct

SEQ ID NO: 261864 - DNA, 16 bp, P. troglodytes
tagtattttcaataaa

SEQ ID NO: 261865 - DNA, 16 bp, P. troglodytes
tagtcaaaaagtagaa

SEQ ID NO: 261866 - DNA, 16 bp, P. troglodytes
tagtcaaactgctgaa

SEQ ID NO: 261867 - DNA, 16 bp, P. troglodytes
tagtcaaattcataga

SEQ ID NO: 261868 - DNA, 16 bp, P. troglodytes
tagtcaattgattttc

SEQ ID NO: 261869 - DNA, 16 bp, P. troglodytes
tagtcaccatgatgta

SEQ ID NO: 261870 - DNA, 16 bp, P. troglodytes
tagtcagagaaatgca

SEQ ID NO: 261871 - DNA, 16 bp, P. troglodytes
tagtcaggaggctgag

SEQ ID NO: 261872 - DNA, 16 bp, P. troglodytes
tagtcatcctacagtg

SEQ ID NO: 261873 - DNA, 16 bp, P. troglodytes
tagtcatggcagaagg

SEQ ID NO: 261874 - DNA, 16 bp, P. troglodytes
tagtcattaaggaaat

SEQ ID NO: 261875 - DNA, 16 bp, P. troglodytes
tagtcattcaataaat

SEQ ID NO: 261876 - DNA, 16 bp, P. troglodytes
tagtcccagcactctg

SEQ ID NO: 261877 - DNA, 16 bp, P. troglodytes
tagtcccagccactca

SEQ ID NO: 261878 - DNA, 21 bp, P. troglodytes
tagtcccagctactcgggaga

SEQ ID NO: 261879 - DNA, 17 bp, P. troglodytes
tagtcccagctgctcgg

SEQ ID NO: 261880 - DNA, 16 bp, P. troglodytes
tagtcccccaaagtct

SEQ ID NO: 261881 - DNA, 16 bp, P. troglodytes
tagtccccccttatct

SEQ ID NO: 261882 - DNA, 16 bp, P. troglodytes
tagtcctgtatttctt

SEQ ID NO: 261883 - DNA, 16 bp, P. troglodytes
tagtcctttctcagat

SEQ ID NO: 261884 - DNA, 16 bp, P. troglodytes
tagtctcaaacttctg

SEQ ID NO: 261885 - DNA, 16 bp, P. troglodytes
tagtctcattctgtca

SEQ ID NO: 261886 - DNA, 16 bp, P. troglodytes
tagtctcgctctgttg

SEQ ID NO: 261887 - DNA, 16 bp, P. troglodytes
tagtctggccaacatg

SEQ ID NO: 261888 - DNA, 16 bp, P. troglodytes
tagtctttgcagtctg

SEQ ID NO: 261889 - DNA, 16 bp, P. troglodytes
tagtgaaacctcattt

SEQ ID NO: 261890 - DNA, 16 bp, P. troglodytes
tagtgaacattgtacc

SEQ ID NO: 261891 - DNA, 16 bp, P. troglodytes
tagtgaagacatggaa

SEQ ID NO: 261892 - DNA, 16 bp, P. troglodytes
tagtgaagcaaattaa

SEQ ID NO: 261893 - DNA, 16 bp, P. troglodytes
tagtgaataaatctca

SEQ ID NO: 261894 - DNA, 16 bp, P. troglodytes
tagtgaataagtctca

SEQ ID NO: 261895 - DNA, 16 bp, P. troglodytes
tagtgaatgaatctca

SEQ ID NO: 261896 - DNA, 16 bp, P. troglodytes
tagtgaatgagtctca

SEQ ID NO: 261897 - DNA, 16 bp, P. troglodytes
tagtgacagaaagtag

SEQ ID NO: 261898 - DNA, 17 bp, P. troglodytes
tagtgagaccccgtctc

SEQ ID NO: 261899 - DNA, 16 bp, P. troglodytes
tagtgagacctcatct

SEQ ID NO: 261900 - DNA, 16 bp, P. troglodytes
tagtgagccatgattg

SEQ ID NO: 261901 - DNA, 17 bp, P. troglodytes
tagtgagccgagatcgc

SEQ ID NO: 261902 - DNA, 16 bp, P. troglodytes
tagtgagctatgatca

SEQ ID NO: 261903 - DNA, 17 bp, P. troglodytes
tagtgagctgtgattgt

SEQ ID NO: 261904 - DNA, 16 bp, P. troglodytes
tagtgagggagacaga

SEQ ID NO: 261905 - DNA, 16 bp, P. troglodytes
tagtgagtttggggtc

SEQ ID NO: 261906 - DNA, 16 bp, P. troglodytes
tagtgatattgacaat

SEQ ID NO: 261907 - DNA, 16 bp, P. troglodytes
tagtgatattgagaat

SEQ ID NO: 261908 - DNA, 16 bp, P. troglodytes
tagtgatgatgaacat

SEQ ID NO: 261909 - DNA, 16 bp, P. troglodytes
tagtgatggtggtggt

SEQ ID NO: 261910 - DNA, 16 bp, P. troglodytes
tagtgattaagtctca

SEQ ID NO: 261911 - DNA, 18 bp, P. troglodytes
tagtgcaatggcgcaatc

SEQ ID NO: 261912 - DNA, 16 bp, P. troglodytes
tagtgccattgcattc

SEQ ID NO: 261913 - DNA, 16 bp, P. troglodytes
tagtgccgcaataaat

SEQ ID NO: 261914 - DNA, 16 bp, P. troglodytes
tagtgcctggcacata

SEQ ID NO: 261915 - DNA, 16 bp, P. troglodytes
tagtgcctggcacatg

SEQ ID NO: 261916 - DNA, 16 bp, P. troglodytes
tagtgctgcaatgaat

SEQ ID NO: 261917 - DNA, 16 bp, P. troglodytes
tagtggagaaggggtt

SEQ ID NO: 261918 - DNA, 17 bp, P. troglodytes
tagtggagctgtgagaa

SEQ ID NO: 261919 - DNA, 16 bp, P. troglodytes
tagtggattatctttt

SEQ ID NO: 261920 - DNA, 16 bp, P. troglodytes
tagtggcacagtctca

SEQ ID NO: 261921 - DNA, 16 bp, P. troglodytes
tagtggcgcacacctg

SEQ ID NO: 261922 - DNA, 16 bp, P. troglodytes
tagtggctaccatatt

SEQ ID NO: 261923 - DNA, 16 bp, P. troglodytes
tagtggctcacacctg

SEQ ID NO: 261924 - DNA, 16 bp, P. troglodytes
tagtggctcacgcctg

SEQ ID NO: 261925 - DNA, 16 bp, P. troglodytes
tagtggctcatgcctg

SEQ ID NO: 261926 - DNA, 16 bp, P. troglodytes
tagtggcttatgcctg

SEQ ID NO: 261927 - DNA, 16 bp, P. troglodytes
tagtgggaatataaat

SEQ ID NO: 261928 - DNA, 16 bp, P. troglodytes
tagtggtgttctctgt

SEQ ID NO: 261929 - DNA, 16 bp, P. troglodytes
tagtggttacagtggg

SEQ ID NO: 261930 - DNA, 16 bp, P. troglodytes
tagtggttttcaaact

SEQ ID NO: 261931 - DNA, 16 bp, P. troglodytes
tagtgtactcatcacc

SEQ ID NO: 261932 - DNA, 16 bp, P. troglodytes
tagtgtattttatgta

SEQ ID NO: 261933 - DNA, 16 bp, P. troglodytes
tagtgtccttataaaa

SEQ ID NO: 261934 - DNA, 16 bp, P. troglodytes
tagtgtctgctgggtg

SEQ ID NO: 261935 - DNA, 16 bp, P. troglodytes
tagtgtgatgaaatct

SEQ ID NO: 261936 - DNA, 16 bp, P. troglodytes
tagtgtgtatgtgtgt

SEQ ID NO: 261937 - DNA, 17 bp, P. troglodytes
tagtgtgtgcgtgtgtg

SEQ ID NO: 261938 - DNA, 16 bp, P. troglodytes
tagtgttaaaagaaaa

SEQ ID NO: 261939 - DNA, 16 bp, P. troglodytes
tagtgttaagtgtatt

SEQ ID NO: 261940 - DNA, 16 bp, P. troglodytes
tagtgttctctgtatt

SEQ ID NO: 261941 - DNA, 16 bp, P. troglodytes
tagtgtttctgcagag

SEQ ID NO: 261942 - DNA, 16 bp, P. troglodytes
tagtgttttgtagttc

SEQ ID NO: 261943 - DNA, 16 bp, P. troglodytes
tagttaaatttgaatt

SEQ ID NO: 261944 - DNA, 16 bp, P. troglodytes
tagttaacatttactg

SEQ ID NO: 261945 - DNA, 16 bp, P. troglodytes
tagttaataattcttt

SEQ ID NO: 261946 - DNA, 16 bp, P. troglodytes
tagttaatagtattat

SEQ ID NO: 261947 - DNA, 16 bp, P. troglodytes
tagttactgtagcctt

SEQ ID NO: 261948 - DNA, 17 bp, P. troglodytes
tagttacttcctagata

SEQ ID NO: 261949 - DNA, 16 bp, P. troglodytes
tagttaggattacagg

SEQ ID NO: 261950 - DNA, 16 bp, P. troglodytes
tagttatcttttaaaa

SEQ ID NO: 261951 - DNA, 16 bp, P. troglodytes
tagttatttcttctct

SEQ ID NO: 261952 - DNA, 16 bp, P. troglodytes
tagttatttttcctaa

SEQ ID NO: 261953 - DNA, 16 bp, P. troglodytes
tagttcaaaatatttt

SEQ ID NO: 261954 - DNA, 16 bp, P. troglodytes
tagttcaaataatttt

SEQ ID NO: 261955 - DNA, 19 bp, P. troglodytes
tagttcaaccattgtggaa

SEQ ID NO: 261956 - DNA, 16 bp, P. troglodytes
tagttcacagcagcct

SEQ ID NO: 261957 - DNA, 16 bp, P. troglodytes
tagttcactgaagcct

SEQ ID NO: 261958 - DNA, 16 bp, P. troglodytes
tagttcactgcaacct

SEQ ID NO: 261959 - DNA, 16 bp, P. troglodytes
tagttcattaattttt

SEQ ID NO: 261960 - DNA, 16 bp, P. troglodytes
tagttcattccttttt

SEQ ID NO: 261961 - DNA, 16 bp, P. troglodytes
tagttcatttacattc

SEQ ID NO: 261962 - DNA, 16 bp, P. troglodytes
tagttctccttgtaga

SEQ ID NO: 261963 - DNA, 16 bp, P. troglodytes
tagttctggatccttg

SEQ ID NO: 261964 - DNA, 16 bp, P. troglodytes
tagttctttgtagcag

SEQ ID NO: 261965 - DNA, 16 bp, P. troglodytes
tagttgcaacagagac

SEQ ID NO: 261966 - DNA, 16 bp, P. troglodytes
tagttgtagatccttg

SEQ ID NO: 261967 - DNA, 16 bp, P. troglodytes
tagttgttcaataaat

SEQ ID NO: 261968 - DNA, 16 bp, P. troglodytes
tagtttataaagaaag

SEQ ID NO: 261969 - DNA, 16 bp, P. troglodytes
tagtttatttgcatag

SEQ ID NO: 261970 - DNA, 16 bp, P. troglodytes
tagtttcagaattgct

SEQ ID NO: 261971 - DNA, 16 bp, P. troglodytes
tagtttcagtaagaat

SEQ ID NO: 261972 - DNA, 16 bp, P. troglodytes
tagtttcatttcattg

SEQ ID NO: 261973 - DNA, 16 bp, P. troglodytes
tagtttcttcatctat

SEQ ID NO: 261974 - DNA, 16 bp, P. troglodytes
tagtttgaatgtttgt

SEQ ID NO: 261975 - DNA, 16 bp, P. troglodytes
tagtttgacttctttt

SEQ ID NO: 261976 - DNA, 16 bp, P. troglodytes
tagtttgactttttct

SEQ ID NO: 261977 - DNA, 16 bp, P. troglodytes
tagtttgattccactg

SEQ ID NO: 261978 - DNA, 17 bp, P. troglodytes
tagtttgccaagaatga

SEQ ID NO: 261979 - DNA, 16 bp, P. troglodytes
tagtttgctgacccct

SEQ ID NO: 261980 - DNA, 16 bp, P. troglodytes
tagttttacagaaaaa

SEQ ID NO: 261981 - DNA, 16 bp, P. troglodytes
tagttttataataagt

SEQ ID NO: 261982 - DNA, 16 bp, P. troglodytes
tagttttcagtgtaca

SEQ ID NO: 261983 - DNA, 16 bp, P. troglodytes
tagttttcattttaaa

SEQ ID NO: 261984 - DNA, 16 bp, P. troglodytes
tagttttgaaaaataa

SEQ ID NO: 261985 - DNA, 16 bp, P. troglodytes
tagttttgctgtcaca

SEQ ID NO: 261986 - DNA, 16 bp, P. troglodytes
tagttttgctttttcc

SEQ ID NO: 261987 - DNA, 16 bp, P. troglodytes
tagtttttatctgaaa

SEQ ID NO: 261988 - DNA, 16 bp, P. troglodytes
tagtttttatgagaag

SEQ ID NO: 261989 - DNA, 16 bp, P. troglodytes
tagtttttcagctctt

SEQ ID NO: 261990 - DNA, 16 bp, P. troglodytes
tagtttttcagtcttt

SEQ ID NO: 261991 - DNA, 16 bp, P. troglodytes
tagttttttaatcctc

SEQ ID NO: 261992 - DNA, 16 bp, P. troglodytes
tagttttttgaaaaat

SEQ ID NO: 261993 - DNA, 16 bp, P. troglodytes
tagtttttttgaggaa

SEQ ID NO: 261994 - DNA, 16 bp, P. troglodytes
tataaaaaaattagct

SEQ ID NO: 261995 - DNA, 16 bp, P. troglodytes
tataaaaaatcagcca

SEQ ID NO: 261996 - DNA, 16 bp, P. troglodytes
tataaaaaattagctg

SEQ ID NO: 261997 - DNA, 16 bp, P. troglodytes
tataaaaaccctggaa

SEQ ID NO: 261998 - DNA, 16 bp, P. troglodytes
tataaaaagaaacatt

SEQ ID NO: 261999 - DNA, 16 bp, P. troglodytes
tataaaaataaatgca

SEQ ID NO: 262000 - DNA, 16 bp, P. troglodytes
tataaaaatcttagaa

SEQ ID NO: 262001 - DNA, 16 bp, P. troglodytes
tataaaaatgtgtttt

SEQ ID NO: 262002 - DNA, 16 bp, P. troglodytes
tataaaaattagcaag

SEQ ID NO: 262003 - DNA, 16 bp, P. troglodytes
tataaaaattctgttt

SEQ ID NO: 262004 - DNA, 16 bp, P. troglodytes
tataaaaattggccag

SEQ ID NO: 262005 - DNA, 16 bp, P. troglodytes
tataaaacaaaaattg

SEQ ID NO: 262006 - DNA, 16 bp, P. troglodytes
tataaaacactgatga

SEQ ID NO: 262007 - DNA, 16 bp, P. troglodytes
tataaaacaggaataa

SEQ ID NO: 262008 - DNA, 16 bp, P. troglodytes
tataaaacatttcatt

SEQ ID NO: 262009 - DNA, 16 bp, P. troglodytes
tataaaacttagaaaa

SEQ ID NO: 262010 - DNA, 16 bp, P. troglodytes
tataaaagaaaatcta

SEQ ID NO: 262011 - DNA, 16 bp, P. troglodytes
tataaaagaaaatctt

SEQ ID NO: 262012 - DNA, 16 bp, P. troglodytes
tataaaagaggcctca

SEQ ID NO: 262013 - DNA, 16 bp, P. troglodytes
tataaaagtagataca

SEQ ID NO: 262014 - DNA, 16 bp, P. troglodytes
tataaaatacattgtt

SEQ ID NO: 262015 - DNA, 16 bp, P. troglodytes
tataaaatggaatatt

SEQ ID NO: 262016 - DNA, 16 bp, P. troglodytes
tataaaatggagataa

SEQ ID NO: 262017 - DNA, 16 bp, P. troglodytes
tataaaatgggggtaa

SEQ ID NO: 262018 - DNA, 16 bp, P. troglodytes
tataaaatgtgatttt

SEQ ID NO: 262019 - DNA, 16 bp, P. troglodytes
tataaaatgttttatg

SEQ ID NO: 262020 - DNA, 16 bp, P. troglodytes
tataaaattaatcatc

SEQ ID NO: 262021 - DNA, 16 bp, P. troglodytes
tataaaattgcaaaaa

SEQ ID NO: 262022 - DNA, 16 bp, P. troglodytes
tataaacaatggaaat

SEQ ID NO: 262023 - DNA, 16 bp, P. troglodytes
tataaacacatatgca

SEQ ID NO: 262024 - DNA, 16 bp, P. troglodytes
tataaacacctctact

SEQ ID NO: 262025 - DNA, 16 bp, P. troglodytes
tataaacatatttttg

SEQ ID NO: 262026 - DNA, 16 bp, P. troglodytes
tataaacatgtatgta

SEQ ID NO: 262027 - DNA, 16 bp, P. troglodytes
tataaacatgtttata

SEQ ID NO: 262028 - DNA, 16 bp, P. troglodytes
tataaacatgttttaa

SEQ ID NO: 262029 - DNA, 16 bp, P. troglodytes
tataaacatttgtgta

SEQ ID NO: 262030 - DNA, 16 bp, P. troglodytes
tataaacccagcactt

SEQ ID NO: 262031 - DNA, 16 bp, P. troglodytes
tataaaccttttataa

SEQ ID NO: 262032 - DNA, 16 bp, P. troglodytes
tataaactgctttggg

SEQ ID NO: 262033 - DNA, 16 bp, P. troglodytes
tataaactgtattttt

SEQ ID NO: 262034 - DNA, 16 bp, P. troglodytes
tataaagaaaaaaggc

SEQ ID NO: 262035 - DNA, 16 bp, P. troglodytes
tataaagaaactgcat

SEQ ID NO: 262036 - DNA, 16 bp, P. troglodytes
tataaagaaatgaggt

SEQ ID NO: 262037 - DNA, 16 bp, P. troglodytes
tataaagacacacaaa

SEQ ID NO: 262038 - DNA, 16 bp, P. troglodytes
tataaagatacatgca

SEQ ID NO: 262039 - DNA, 16 bp, P. troglodytes
tataaagatgtatttt

SEQ ID NO: 262040 - DNA, 16 bp, P. troglodytes
tataaagcaaaataat

SEQ ID NO: 262041 - DNA, 16 bp, P. troglodytes
tataaagcaatatata

SEQ ID NO: 262042 - DNA, 16 bp, P. troglodytes
tataaagcatttagaa

SEQ ID NO: 262043 - DNA, 16 bp, P. troglodytes
tataaagctaaaataa

SEQ ID NO: 262044 - DNA, 16 bp, P. troglodytes
tataaaggaaaactta

SEQ ID NO: 262045 - DNA, 16 bp, P. troglodytes
tataaaggccttttaa

SEQ ID NO: 262046 - DNA, 16 bp, P. troglodytes
tataaagttaaacata

SEQ ID NO: 262047 - DNA, 16 bp, P. troglodytes
tataaataatgctgcc

SEQ ID NO: 262048 - DNA, 16 bp, P. troglodytes
tataaatacatatgta

SEQ ID NO: 262049 - DNA, 16 bp, P. troglodytes
tataaatatacagata

SEQ ID NO: 262050 - DNA, 16 bp, P. troglodytes
tataaatatatatgca

SEQ ID NO: 262051 - DNA, 16 bp, P. troglodytes
tataaatatatgcatt

SEQ ID NO: 262052 - DNA, 16 bp, P. troglodytes
tataaatatgtacata

SEQ ID NO: 262053 - DNA, 16 bp, P. troglodytes
tataaatatttccaaa

SEQ ID NO: 262054 - DNA, 17 bp, P. troglodytes
tataaatcatgctgcta

SEQ ID NO: 262055 - DNA, 24 bp, P. troglodytes
tataaatcatgctgctataaagac

SEQ ID NO: 262056 - DNA, 16 bp, P. troglodytes
tataaatgaagaaact

SEQ ID NO: 262057 - DNA, 16 bp, P. troglodytes
tataaatgaggaaaat

SEQ ID NO: 262058 - DNA, 16 bp, P. troglodytes
tataaatggaaacaaa

SEQ ID NO: 262059 - DNA, 16 bp, P. troglodytes
tataaatggaatcaca

SEQ ID NO: 262060 - DNA, 16 bp, P. troglodytes
tataaatgggatcata

SEQ ID NO: 262061 - DNA, 16 bp, P. troglodytes
tataaatgtatataga

SEQ ID NO: 262062 - DNA, 16 bp, P. troglodytes
tataaatgtgtatgtg

SEQ ID NO: 262063 - DNA, 16 bp, P. troglodytes
tataaatgtgtttata

SEQ ID NO: 262064 - DNA, 16 bp, P. troglodytes
tataaattaacctaat

SEQ ID NO: 262065 - DNA, 16 bp, P. troglodytes
tataaattacctggtc

SEQ ID NO: 262066 - DNA, 16 bp, P. troglodytes
tataaattatacctca

SEQ ID NO: 262067 - DNA, 16 bp, P. troglodytes
tataaattatgctact

SEQ ID NO: 262068 - DNA, 16 bp, P. troglodytes
tataaatttgagagct

SEQ ID NO: 262069 - DNA, 16 bp, P. troglodytes
tataaatttgtcaaaa

SEQ ID NO: 262070 - DNA, 16 bp, P. troglodytes
tataaatttgtttctt

SEQ ID NO: 262071 - DNA, 16 bp, P. troglodytes
tataaattttcctcta

SEQ ID NO: 262072 - DNA, 16 bp, P. troglodytes
tataacaaaatgacat

SEQ ID NO: 262073 - DNA, 16 bp, P. troglodytes
tataacaactatttac

SEQ ID NO: 262074 - DNA, 16 bp, P. troglodytes
tataactttgtaactt

SEQ ID NO: 262075 - DNA, 16 bp, P. troglodytes
tataacttttgactcc

SEQ ID NO: 262076 - DNA, 16 bp, P. troglodytes
tataagagttctcttt

SEQ ID NO: 262077 - DNA, 16 bp, P. troglodytes
tataagatcatattat

SEQ ID NO: 262078 - DNA, 16 bp, P. troglodytes
tataagcactcccttt

SEQ ID NO: 262079 - DNA, 16 bp, P. troglodytes
tataagcattcctttt

SEQ ID NO: 262080 - DNA, 16 bp, P. troglodytes
tataagctttcctttt

SEQ ID NO: 262081 - DNA, 16 bp, P. troglodytes
tataagctttttaaaa

SEQ ID NO: 262082 - DNA, 16 bp, P. troglodytes
tataaggaaaagagat

SEQ ID NO: 262083 - DNA, 16 bp, P. troglodytes
tataaggaaatacctg

SEQ ID NO: 262084 - DNA, 16 bp, P. troglodytes
tataaggccagcatta

SEQ ID NO: 262085 - DNA, 16 bp, P. troglodytes
tataagggcgctaatc

SEQ ID NO: 262086 - DNA, 16 bp, P. troglodytes
tataaggtggaaggaa

SEQ ID NO: 262087 - DNA, 16 bp, P. troglodytes
tataagtgagagctaa

SEQ ID NO: 262088 - DNA, 16 bp, P. troglodytes
tataataaaatgcaaa

SEQ ID NO: 262089 - DNA, 16 bp, P. troglodytes
tataatagcaaagact

SEQ ID NO: 262090 - DNA, 16 bp, P. troglodytes
tataatagcaataaaa

SEQ ID NO: 262091 - DNA, 16 bp, P. troglodytes
tataatatataatgtg

SEQ ID NO: 262092 - DNA, 16 bp, P. troglodytes
tataatatatattcca

SEQ ID NO: 262093 - DNA, 16 bp, P. troglodytes
tataatatgtgtatat

SEQ ID NO: 262094 - DNA, 16 bp, P. troglodytes
tataatattgagtctt

SEQ ID NO: 262095 - DNA, 16 bp, P. troglodytes
tataatcccagctagt

SEQ ID NO: 262096 - DNA, 16 bp, P. troglodytes
tataatcctagctact

SEQ ID NO: 262097 - DNA, 16 bp, P. troglodytes
tataatcctagtactt

SEQ ID NO: 262098 - DNA, 16 bp, P. troglodytes
tataatcctttaaaaa

SEQ ID NO: 262099 - DNA, 16 bp, P. troglodytes
tataatctcagctact

SEQ ID NO: 262100 - DNA, 16 bp, P. troglodytes
tataatgaaaccaatt

SEQ ID NO: 262101 - DNA, 16 bp, P. troglodytes
tataatgaagctgaaa

SEQ ID NO: 262102 - DNA, 16 bp, P. troglodytes
tataatgactttcttt

SEQ ID NO: 262103 - DNA, 16 bp, P. troglodytes
tataatgcaaatattt

SEQ ID NO: 262104 - DNA, 16 bp, P. troglodytes
tataatgtatacatta

SEQ ID NO: 262105 - DNA, 16 bp, P. troglodytes
tataatgtgtgtgtgt

SEQ ID NO: 262106 - DNA, 16 bp, P. troglodytes
tataatgttgaataga

SEQ ID NO: 262107 - DNA, 16 bp, P. troglodytes
tataatgttttaagaa

SEQ ID NO: 262108 - DNA, 16 bp, P. troglodytes
tataattatgtcatct

SEQ ID NO: 262109 - DNA, 16 bp, P. troglodytes
tataattatttctgta

SEQ ID NO: 262110 - DNA, 16 bp, P. troglodytes
tataattcaagatgat

SEQ ID NO: 262111 - DNA, 16 bp, P. troglodytes
tataattctgtcattt

SEQ ID NO: 262112 - DNA, 16 bp, P. troglodytes
tataattctgtttata

SEQ ID NO: 262113 - DNA, 16 bp, P. troglodytes
tataattctttttgta

SEQ ID NO: 262114 - DNA, 16 bp, P. troglodytes
tataattgaaacaaaa

SEQ ID NO: 262115 - DNA, 16 bp, P. troglodytes
tataattgacaaaaat

SEQ ID NO: 262116 - DNA, 16 bp, P. troglodytes
tataattgatgaacct

SEQ ID NO: 262117 - DNA, 16 bp, P. troglodytes
tataattgtatatatg

SEQ ID NO: 262118 - DNA, 16 bp, P. troglodytes
tataatttcattcata

SEQ ID NO: 262119 - DNA, 16 bp, P. troglodytes
tataattttgagaaaa

SEQ ID NO: 262120 - DNA, 16 bp, P. troglodytes
tatacaaaagtaaatt

SEQ ID NO: 262121 - DNA, 16 bp, P. troglodytes
tatacaaaagtcaact

SEQ ID NO: 262122 - DNA, 16 bp, P. troglodytes
tatacaaagaattata

SEQ ID NO: 262123 - DNA, 16 bp, P. troglodytes
tatacaaatgagaaaa

SEQ ID NO: 262124 - DNA, 16 bp, P. troglodytes
tatacaatgcagtatt

SEQ ID NO: 262125 - DNA, 16 bp, P. troglodytes
tatacaattcattcat

SEQ ID NO: 262126 - DNA, 16 bp, P. troglodytes
tatacacaaaagaata

SEQ ID NO: 262127 - DNA, 16 bp, P. troglodytes
tatacacacacacact

SEQ ID NO: 262128 - DNA, 16 bp, P. troglodytes
tatacacacatacaca

SEQ ID NO: 262129 - DNA, 16 bp, P. troglodytes
tatacacatatacaca

SEQ ID NO: 262130 - DNA, 16 bp, P. troglodytes
tatacaccaacaacag

SEQ ID NO: 262131 - DNA, 19 bp, P. troglodytes
tatacaccaataacagaca

SEQ ID NO: 262132 - DNA, 17 bp, P. troglodytes
tatacaccaataataga

SEQ ID NO: 262133 - DNA, 17 bp, P. troglodytes
tatacacgtatacgtgt

SEQ ID NO: 262134 - DNA, 16 bp, P. troglodytes
tatacactttaaaatg

SEQ ID NO: 262135 - DNA, 16 bp, P. troglodytes
tatacagacacacaca

SEQ ID NO: 262136 - DNA, 16 bp, P. troglodytes
tatacagatatataca

SEQ ID NO: 262137 - DNA, 16 bp, P. troglodytes
tatacagatggaaaat

SEQ ID NO: 262138 - DNA, 16 bp, P. troglodytes
tatacagcaaaggaaa

SEQ ID NO: 262139 - DNA, 16 bp, P. troglodytes
tatacataatacattt

SEQ ID NO: 262140 - DNA, 16 bp, P. troglodytes
tatacataatgagata

SEQ ID NO: 262141 - DNA, 16 bp, P. troglodytes
tatacatacacacaca

SEQ ID NO: 262142 - DNA, 16 bp, P. troglodytes
tatacatacacataca

SEQ ID NO: 262143 - DNA, 16 bp, P. troglodytes
tatacatacagtggaa

SEQ ID NO: 262144 - DNA, 16 bp, P. troglodytes
tatacatacatacata

SEQ ID NO: 262145 - DNA, 16 bp, P. troglodytes
tatacatacatataca

SEQ ID NO: 262146 - DNA, 16 bp, P. troglodytes
tatacatacatatatg

SEQ ID NO: 262147 - DNA, 16 bp, P. troglodytes
tatacatacatgtgta

SEQ ID NO: 262148 - DNA, 16 bp, P. troglodytes
tatacatactatgttt

SEQ ID NO: 262149 - DNA, 16 bp, P. troglodytes
tatacatagaaaatcc

SEQ ID NO: 262150 - DNA, 16 bp, P. troglodytes
tatacatagatatata

SEQ ID NO: 262151 - DNA, 16 bp, P. troglodytes
tatacatatacataca

SEQ ID NO: 262152 - DNA, 16 bp, P. troglodytes
tatacatatatataga

SEQ ID NO: 262153 - DNA, 16 bp, P. troglodytes
tatacatatgcatttt

SEQ ID NO: 262154 - DNA, 16 bp, P. troglodytes
tatacatcatagaata

SEQ ID NO: 262155 - DNA, 16 bp, P. troglodytes
tatacatcatttcact

SEQ ID NO: 262156 - DNA, 18 bp, P. troglodytes
tatacatccagatggcct

SEQ ID NO: 262157 - DNA, 16 bp, P. troglodytes
tatacatgcacacaca

SEQ ID NO: 262158 - DNA, 16 bp, P. troglodytes
tatacatgtatgtatt

SEQ ID NO: 262159 - DNA, 16 bp, P. troglodytes
tatacatgtatgtgta

SEQ ID NO: 262160 - DNA, 16 bp, P. troglodytes
tatacatgtgtatata

SEQ ID NO: 262161 - DNA, 16 bp, P. troglodytes
tatacattatgtatat

SEQ ID NO: 262162 - DNA, 16 bp, P. troglodytes
tatacattctatgtat

SEQ ID NO: 262163 - DNA, 16 bp, P. troglodytes
tatacattctggatac

SEQ ID NO: 262164 - DNA, 16 bp, P. troglodytes
tatacattcttctcag

SEQ ID NO: 262165 - DNA, 16 bp, P. troglodytes
tatacattgtgaaatg

SEQ ID NO: 262166 - DNA, 16 bp, P. troglodytes
tatacatttgacaaag

SEQ ID NO: 262167 - DNA, 16 bp, P. troglodytes
tatacattttacatat

SEQ ID NO: 262168 - DNA, 16 bp, P. troglodytes
tatacattttctatgt

SEQ ID NO: 262169 - DNA, 16 bp, P. troglodytes
tatacatttttaaaag

SEQ ID NO: 262170 - DNA, 16 bp, P. troglodytes
tatacattttttaagt

SEQ ID NO: 262171 - DNA, 16 bp, P. troglodytes
tataccagtaccatgt

SEQ ID NO: 262172 - DNA, 16 bp, P. troglodytes
tataccatattttaaa

SEQ ID NO: 262173 - DNA, 16 bp, P. troglodytes
tatacccaaagattat

SEQ ID NO: 262174 - DNA, 16 bp, P. troglodytes
tatacccagctaattt

SEQ ID NO: 262175 - DNA, 16 bp, P. troglodytes
tataccctttatcatt

SEQ ID NO: 262176 - DNA, 16 bp, P. troglodytes
tatacctcaataaaac

SEQ ID NO: 262177 - DNA, 16 bp, P. troglodytes
tatacctccattgtat

SEQ ID NO: 262178 - DNA, 16 bp, P. troglodytes
tatactaaaaagcact

SEQ ID NO: 262179 - DNA, 16 bp, P. troglodytes
tatactagcaacaaac

SEQ ID NO: 262180 - DNA, 16 bp, P. troglodytes
tatactatacttttaa

SEQ ID NO: 262181 - DNA, 16 bp, P. troglodytes
tatactatatacatat

SEQ ID NO: 262182 - DNA, 16 bp, P. troglodytes
tatactatatattgta

SEQ ID NO: 262183 - DNA, 16 bp, P. troglodytes
tatactatgttcatgg

SEQ ID NO: 262184 - DNA, 16 bp, P. troglodytes
tatactcagtaatgag

SEQ ID NO: 262185 - DNA, 16 bp, P. troglodytes
tatactcatgtaacaa

SEQ ID NO: 262186 - DNA, 16 bp, P. troglodytes
tatactccagcctggg

SEQ ID NO: 262187 - DNA, 16 bp, P. troglodytes
tatactgaaatatata

SEQ ID NO: 262188 - DNA, 16 bp, P. troglodytes
tatactgacttctttt

SEQ ID NO: 262189 - DNA, 16 bp, P. troglodytes
tatactgtatatttta

SEQ ID NO: 262190 - DNA, 16 bp, P. troglodytes
tatactgtatgtatat

SEQ ID NO: 262191 - DNA, 16 bp, P. troglodytes
tatactgtattcttaa

SEQ ID NO: 262192 - DNA, 16 bp, P. troglodytes
tatactgtattgtttt

SEQ ID NO: 262193 - DNA, 16 bp, P. troglodytes
tatactgtatttttac

SEQ ID NO: 262194 - DNA, 16 bp, P. troglodytes
tatactgtggaatact

SEQ ID NO: 262195 - DNA, 16 bp, P. troglodytes
tatactgttaatcttt

SEQ ID NO: 262196 - DNA, 16 bp, P. troglodytes
tatacttaaaaattgt

SEQ ID NO: 262197 - DNA, 16 bp, P. troglodytes
tatacttcaagtttta

SEQ ID NO: 262198 - DNA, 16 bp, P. troglodytes
tatacttggcttgatt

SEQ ID NO: 262199 - DNA, 16 bp, P. troglodytes
tatacttgtgtgtata

SEQ ID NO: 262200 - DNA, 16 bp, P. troglodytes
tatactttaaaatggt

SEQ ID NO: 262201 - DNA, 16 bp, P. troglodytes
tatactttatatgtat

SEQ ID NO: 262202 - DNA, 16 bp, P. troglodytes
tatagaaaaattaact

SEQ ID NO: 262203 - DNA, 16 bp, P. troglodytes
tatagaacagctgcct

SEQ ID NO: 262204 - DNA, 16 bp, P. troglodytes
tatagaagaggaaact

SEQ ID NO: 262205 - DNA, 16 bp, P. troglodytes
tatagacaggcttgag

SEQ ID NO: 262206 - DNA, 16 bp, P. troglodytes
tatagacccaaaagaa

SEQ ID NO: 262207 - DNA, 16 bp, P. troglodytes
tatagactccacctct

SEQ ID NO: 262208 - DNA, 16 bp, P. troglodytes
tatagagaaatctttc

SEQ ID NO: 262209 - DNA, 16 bp, P. troglodytes
tatagagagagagatg

SEQ ID NO: 262210 - DNA, 16 bp, P. troglodytes
tatagagatgaggtct

SEQ ID NO: 262211 - DNA, 16 bp, P. troglodytes
tatagagatggggttt

SEQ ID NO: 262212 - DNA, 16 bp, P. troglodytes
tatagataaggaaatt

SEQ ID NO: 262213 - DNA, 16 bp, P. troglodytes
tatagatacagatata

SEQ ID NO: 262214 - DNA, 16 bp, P. troglodytes
tatagatgaatatata

SEQ ID NO: 262215 - DNA, 16 bp, P. troglodytes
tatagatgagaagact

SEQ ID NO: 262216 - DNA, 16 bp, P. troglodytes
tatagatttggtcttt

SEQ ID NO: 262217 - DNA, 16 bp, P. troglodytes
tatagcagattctact

SEQ ID NO: 262218 - DNA, 16 bp, P. troglodytes
tatagcaggaaagaaa

SEQ ID NO: 262219 - DNA, 16 bp, P. troglodytes
tatagcagttttattt

SEQ ID NO: 262220 - DNA, 16 bp, P. troglodytes
tatagcatgttactgt

SEQ ID NO: 262221 - DNA, 18 bp, P. troglodytes
tatagccaagacaatcct

SEQ ID NO: 262222 - DNA, 16 bp, P. troglodytes
tataggcacatgccac

SEQ ID NO: 262223 - DNA, 16 bp, P. troglodytes
tataggcatggaccac

SEQ ID NO: 262224 - DNA, 16 bp, P. troglodytes
tataggccaggcatgg

SEQ ID NO: 262225 - DNA, 16 bp, P. troglodytes
tatagggcacttacca

SEQ ID NO: 262226 - DNA, 16 bp, P. troglodytes
tataggtgcctgccac

SEQ ID NO: 262227 - DNA, 16 bp, P. troglodytes
tataggtgtgagctat

SEQ ID NO: 262228 - DNA, 16 bp, P. troglodytes
tatagtaaaatgattt

SEQ ID NO: 262229 - DNA, 16 bp, P. troglodytes
tatagtaaccatttca

SEQ ID NO: 262230 - DNA, 16 bp, P. troglodytes
tatagtaatgcaagaa

SEQ ID NO: 262231 - DNA, 16 bp, P. troglodytes
tatagtaggtgttcaa

SEQ ID NO: 262232 - DNA, 16 bp, P. troglodytes
tatagtcactttggaa

SEQ ID NO: 262233 - DNA, 16 bp, P. troglodytes
tatagtcatgtgccac

SEQ ID NO: 262234 - DNA, 16 bp, P. troglodytes
tatagtcccagctact

SEQ ID NO: 262235 - DNA, 16 bp, P. troglodytes
tatagtcctagctact

SEQ ID NO: 262236 - DNA, 16 bp, P. troglodytes
tatagtctcagctact

SEQ ID NO: 262237 - DNA, 18 bp, P. troglodytes
tatagtgaaaccccatct

SEQ ID NO: 262238 - DNA, 16 bp, P. troglodytes
tatagtgagaccctat

SEQ ID NO: 262239 - DNA, 16 bp, P. troglodytes
tatagtgtatatataa

SEQ ID NO: 262240 - DNA, 16 bp, P. troglodytes
tatagttaatagtaat

SEQ ID NO: 262241 - DNA, 16 bp, P. troglodytes
tatagttccagctgct

SEQ ID NO: 262242 - DNA, 16 bp, P. troglodytes
tatagttggaatcata

SEQ ID NO: 262243 - DNA, 16 bp, P. troglodytes
tatagtttcatttctt

SEQ ID NO: 262244 - DNA, 16 bp, P. troglodytes
tatagttttcagcata

SEQ ID NO: 262245 - DNA, 16 bp, P. troglodytes
tatagttttgagagtt

SEQ ID NO: 262246 - DNA, 16 bp, P. troglodytes
tatagttttgggtctt

SEQ ID NO: 262247 - DNA, 16 bp, P. troglodytes
tatagtttttatcttg

SEQ ID NO: 262248 - DNA, 16 bp, P. troglodytes
tatataaaaatatgtg

SEQ ID NO: 262249 - DNA, 16 bp, P. troglodytes
tatataaaatagcaaa

SEQ ID NO: 262250 - DNA, 16 bp, P. troglodytes
tatataaaatatgcaa

SEQ ID NO: 262251 - DNA, 16 bp, P. troglodytes
tatataaaatatgctt

SEQ ID NO: 262252 - DNA, 16 bp, P. troglodytes
tatataaaatgtattc

SEQ ID NO: 262253 - DNA, 16 bp, P. troglodytes
tatataaacatatatg

SEQ ID NO: 262254 - DNA, 16 bp, P. troglodytes
tatataaacattaact

SEQ ID NO: 262255 - DNA, 16 bp, P. troglodytes
tatataaagcacttaa

SEQ ID NO: 262256 - DNA, 16 bp, P. troglodytes
tatataaatacacaga

SEQ ID NO: 262257 - DNA, 16 bp, P. troglodytes
tatataaatcattcta

SEQ ID NO: 262258 - DNA, 16 bp, P. troglodytes
tatataaattgctttg

SEQ ID NO: 262259 - DNA, 16 bp, P. troglodytes
tatataacaaacttgc

SEQ ID NO: 262260 - DNA, 16 bp, P. troglodytes
tatataacatacatat

SEQ ID NO: 262261 - DNA, 16 bp, P. troglodytes
tatataaggcaaatat

SEQ ID NO: 262262 - DNA, 16 bp, P. troglodytes
tatataagtatatatg

SEQ ID NO: 262263 - DNA, 16 bp, P. troglodytes
tatataatgtatgtat

SEQ ID NO: 262264 - DNA, 16 bp, P. troglodytes
tatataatgtgtgtat

SEQ ID NO: 262265 - DNA, 16 bp, P. troglodytes
tatataatgtttacat

SEQ ID NO: 262266 - DNA, 16 bp, P. troglodytes
tatataatttgcattt

SEQ ID NO: 262267 - DNA, 16 bp, P. troglodytes
tatataatttttgtct

SEQ ID NO: 262268 - DNA, 16 bp, P. troglodytes
tatatacacaaacata

SEQ ID NO: 262269 - DNA, 16 bp, P. troglodytes
tatatacacacacacc

SEQ ID NO: 262270 - DNA, 16 bp, P. troglodytes
tatatacacacataca

SEQ ID NO: 262271 - DNA, 16 bp, P. troglodytes
tatatacacatacaca

SEQ ID NO: 262272 - DNA, 16 bp, P. troglodytes
tatatacacatataat

SEQ ID NO: 262273 - DNA, 16 bp, P. troglodytes
tatatacacatatata

SEQ ID NO: 262274 - DNA, 16 bp, P. troglodytes
tatatacacatatgta

SEQ ID NO: 262275 - DNA, 16 bp, P. troglodytes
tatatacacttaatat

SEQ ID NO: 262276 - DNA, 16 bp, P. troglodytes
tatatacagtatatta

SEQ ID NO: 262277 - DNA, 16 bp, P. troglodytes
tatatacataaaaatg

SEQ ID NO: 262278 - DNA, 16 bp, P. troglodytes
tatatacatacacaca

SEQ ID NO: 262279 - DNA, 16 bp, P. troglodytes
tatatacatacacata

SEQ ID NO: 262280 - DNA, 16 bp, P. troglodytes
tatatacatacataca

SEQ ID NO: 262281 - DNA, 16 bp, P. troglodytes
tatatacatatacaca

SEQ ID NO: 262282 - DNA, 20 bp, P. troglodytes
tatatacatatatacatata

SEQ ID NO: 262283 - DNA, 16 bp, P. troglodytes
tatatacatatgtata

SEQ ID NO: 262284 - DNA, 16 bp, P. troglodytes
tatatacatccatata

SEQ ID NO: 262285 - DNA, 16 bp, P. troglodytes
tatatacatgcatgca

SEQ ID NO: 262286 - DNA, 16 bp, P. troglodytes
tatatacatggaaaaa

SEQ ID NO: 262287 - DNA, 16 bp, P. troglodytes
tatatacatgtaatat

SEQ ID NO: 262288 - DNA, 16 bp, P. troglodytes
tatatacatgtatata

SEQ ID NO: 262289 - DNA, 19 bp, P. troglodytes
tatataccaataacagaca

SEQ ID NO: 262290 - DNA, 16 bp, P. troglodytes
tatataccacattttt

SEQ ID NO: 262291 - DNA, 16 bp, P. troglodytes
tatataccatgtaata

SEQ ID NO: 262292 - DNA, 16 bp, P. troglodytes
tatatacccaaaggaa

SEQ ID NO: 262293 - DNA, 16 bp, P. troglodytes
tatatacttacatatg

SEQ ID NO: 262294 - DNA, 16 bp, P. troglodytes
tatatacttcatatat

SEQ ID NO: 262295 - DNA, 16 bp, P. troglodytes
tatatacttgtatata

SEQ ID NO: 262296 - DNA, 16 bp, P. troglodytes
tatatagacatacaca

SEQ ID NO: 262297 - DNA, 16 bp, P. troglodytes
tatatagagagataga

SEQ ID NO: 262298 - DNA, 16 bp, P. troglodytes
tatatagatagataga

SEQ ID NO: 262299 - DNA, 16 bp, P. troglodytes
tatatagatatatgta

SEQ ID NO: 262300 - DNA, 16 bp, P. troglodytes
tatataggaaagtgat

SEQ ID NO: 262301 - DNA, 16 bp, P. troglodytes
tatataggtatataga

SEQ ID NO: 262302 - DNA, 16 bp, P. troglodytes
tatatagtatatgtat

SEQ ID NO: 262303 - DNA, 16 bp, P. troglodytes
tatatagtgtatgtgt

SEQ ID NO: 262304 - DNA, 16 bp, P. troglodytes
tatatataaaatctgt

SEQ ID NO: 262305 - DNA, 16 bp, P. troglodytes
tatatataatatgtgt

SEQ ID NO: 262306 - DNA, 16 bp, P. troglodytes
tatatatacacatgta

SEQ ID NO: 262307 - DNA, 16 bp, P. troglodytes
tatatatacatttgtg

SEQ ID NO: 262308 - DNA, 16 bp, P. troglodytes
tatatataccatttat

SEQ ID NO: 262309 - DNA, 16 bp, P. troglodytes
tatatatactgtgttt

SEQ ID NO: 262310 - DNA, 16 bp, P. troglodytes
tatatataggatatat

SEQ ID NO: 262311 - DNA, 16 bp, P. troglodytes
tatatataggtatata

SEQ ID NO: 262312 - DNA, 16 bp, P. troglodytes
tatatatagtatgtgt

SEQ ID NO: 262313 - DNA, 16 bp, P. troglodytes
tatatatagtgtatat

SEQ ID NO: 262314 - DNA, 16 bp, P. troglodytes
tatatatatacacaca

SEQ ID NO: 262315 - DNA, 16 bp, P. troglodytes
tatatatatacatgta

SEQ ID NO: 262316 - DNA, 16 bp, P. troglodytes
tatatatatactacag

SEQ ID NO: 262317 - DNA, 16 bp, P. troglodytes
tatatatatagttatg

SEQ ID NO: 262318 - DNA, 16 bp, P. troglodytes
tatatatatataaacc

SEQ ID NO: 262319 - DNA, 21 bp, P. troglodytes
tatatatatatacacacacat

SEQ ID NO: 262320 - DNA, 16 bp, P. troglodytes
tatatatatatatagg

SEQ ID NO: 262321 - DNA, 16 bp, P. troglodytes
tatatatatatgcatg

SEQ ID NO: 262322 - DNA, 16 bp, P. troglodytes
tatatatatatgctaa

SEQ ID NO: 262323 - DNA, 16 bp, P. troglodytes
tatatatatatgcttc

SEQ ID NO: 262324 - DNA, 16 bp, P. troglodytes
tatatatatatggaca

SEQ ID NO: 262325 - DNA, 16 bp, P. troglodytes
tatatatatatggaga

SEQ ID NO: 262326 - DNA, 16 bp, P. troglodytes
tatatatatatgtaca

SEQ ID NO: 262327 - DNA, 16 bp, P. troglodytes
tatatatatctcacat

SEQ ID NO: 262328 - DNA, 16 bp, P. troglodytes
tatatatatgcatatg

SEQ ID NO: 262329 - DNA, 16 bp, P. troglodytes
tatatatatgtacaca

SEQ ID NO: 262330 - DNA, 16 bp, P. troglodytes
tatatatatgtgcaca

SEQ ID NO: 262331 - DNA, 18 bp, P. troglodytes
tatatatatgtgtatatg

SEQ ID NO: 262332 - DNA, 16 bp, P. troglodytes
tatatatatgttcata

SEQ ID NO: 262333 - DNA, 16 bp, P. troglodytes
tatatatattcccttt

SEQ ID NO: 262334 - DNA, 16 bp, P. troglodytes
tatatatatttctttg

SEQ ID NO: 262335 - DNA, 16 bp, P. troglodytes
tatatatatttgcata

SEQ ID NO: 262336 - DNA, 16 bp, P. troglodytes
tatatatattttgaag

SEQ ID NO: 262337 - DNA, 16 bp, P. troglodytes
tatatatctaaacata

SEQ ID NO: 262338 - DNA, 16 bp, P. troglodytes
tatatatctacacaca

SEQ ID NO: 262339 - DNA, 16 bp, P. troglodytes
tatatatctatatatg

SEQ ID NO: 262340 - DNA, 16 bp, P. troglodytes
tatatatctcatatat

SEQ ID NO: 262341 - DNA, 16 bp, P. troglodytes
tatatatctgtaaata

SEQ ID NO: 262342 - DNA, 16 bp, P. troglodytes
tatatatgcaaagaaa

SEQ ID NO: 262343 - DNA, 16 bp, P. troglodytes
tatatatgcatatatt

SEQ ID NO: 262344 - DNA, 16 bp, P. troglodytes
tatatatgccaggcac

SEQ ID NO: 262345 - DNA, 16 bp, P. troglodytes
tatatatggtgtatat

SEQ ID NO: 262346 - DNA, 16 bp, P. troglodytes
tatatatgtacatata

SEQ ID NO: 262347 - DNA, 16 bp, P. troglodytes
tatatatgtagataca

SEQ ID NO: 262348 - DNA, 16 bp, P. troglodytes
tatatatgtatacaca

SEQ ID NO: 262349 - DNA, 16 bp, P. troglodytes
tatatatgtatactta

SEQ ID NO: 262350 - DNA, 16 bp, P. troglodytes
tatatatgtatagtat

SEQ ID NO: 262351 - DNA, 16 bp, P. troglodytes
tatatatgtatataca

SEQ ID NO: 262352 - DNA, 16 bp, P. troglodytes
tatatatgtatatgtg

SEQ ID NO: 262353 - DNA, 16 bp, P. troglodytes
tatatatgtatctata

SEQ ID NO: 262354 - DNA, 16 bp, P. troglodytes
tatatatgtatgaatg

SEQ ID NO: 262355 - DNA, 16 bp, P. troglodytes
tatatatgtatgtaaa

SEQ ID NO: 262356 - DNA, 16 bp, P. troglodytes
tatatatgtatttgaa

SEQ ID NO: 262357 - DNA, 16 bp, P. troglodytes
tatatatgtgcatgca

SEQ ID NO: 262358 - DNA, 16 bp, P. troglodytes
tatatatgtgctatat

SEQ ID NO: 262359 - DNA, 16 bp, P. troglodytes
tatatatgttcatata

SEQ ID NO: 262360 - DNA, 16 bp, P. troglodytes
tatatatgtttatttc

SEQ ID NO: 262361 - DNA, 16 bp, P. troglodytes
tatatattcatatgtg

SEQ ID NO: 262362 - DNA, 16 bp, P. troglodytes
tatatattccatatat

SEQ ID NO: 262363 - DNA, 16 bp, P. troglodytes
tatatattcttttgta

SEQ ID NO: 262364 - DNA, 16 bp, P. troglodytes
tatatattgctgaatt

SEQ ID NO: 262365 - DNA, 16 bp, P. troglodytes
tatatatttgcatata

SEQ ID NO: 262366 - DNA, 16 bp, P. troglodytes
tatatatttgtgtatg

SEQ ID NO: 262367 - DNA, 16 bp, P. troglodytes
tatatattttaagatg

SEQ ID NO: 262368 - DNA, 16 bp, P. troglodytes
tatatattttaccaaa

SEQ ID NO: 262369 - DNA, 16 bp, P. troglodytes
tatatatttttctgtg

SEQ ID NO: 262370 - DNA, 16 bp, P. troglodytes
tatatattttttccag

SEQ ID NO: 262371 - DNA, 16 bp, P. troglodytes
tatatcaatagttcat

SEQ ID NO: 262372 - DNA, 16 bp, P. troglodytes
tatatcacaaatattt

SEQ ID NO: 262373 - DNA, 16 bp, P. troglodytes
tatatcacattttctt

SEQ ID NO: 262374 - DNA, 16 bp, P. troglodytes
tatatcagaaaaaaat

SEQ ID NO: 262375 - DNA, 16 bp, P. troglodytes
tatatcagagacttga

SEQ ID NO: 262376 - DNA, 16 bp, P. troglodytes
tatatcatatatagta

SEQ ID NO: 262377 - DNA, 16 bp, P. troglodytes
tatatcatattatgat

SEQ ID NO: 262378 - DNA, 16 bp, P. troglodytes
tatatcatgtatatat

SEQ ID NO: 262379 - DNA, 16 bp, P. troglodytes
tatatccagagaaaat

SEQ ID NO: 262380 - DNA, 16 bp, P. troglodytes
tatatccatataacaa

SEQ ID NO: 262381 - DNA, 16 bp, P. troglodytes
tatatccatatctata

SEQ ID NO: 262382 - DNA, 16 bp, P. troglodytes
tatatccatttttaaa

SEQ ID NO: 262383 - DNA, 16 bp, P. troglodytes
tatatctaatttgtat

SEQ ID NO: 262384 - DNA, 16 bp, P. troglodytes
tatatctatatctata

SEQ ID NO: 262385 - DNA, 16 bp, P. troglodytes
tatatctatgtatata

SEQ ID NO: 262386 - DNA, 16 bp, P. troglodytes
tatatctattatgtat

SEQ ID NO: 262387 - DNA, 16 bp, P. troglodytes
tatatctccatttatt

SEQ ID NO: 262388 - DNA, 16 bp, P. troglodytes
tatatctctatataaa

SEQ ID NO: 262389 - DNA, 16 bp, P. troglodytes
tatatctctatatata

SEQ ID NO: 262390 - DNA, 16 bp, P. troglodytes
tatatctctcttttgg

SEQ ID NO: 262391 - DNA, 16 bp, P. troglodytes
tatatctgtatatata

SEQ ID NO: 262392 - DNA, 16 bp, P. troglodytes
tatatcttatacatat

SEQ ID NO: 262393 - DNA, 16 bp, P. troglodytes
tatatgaaaatgcaaa

SEQ ID NO: 262394 - DNA, 16 bp, P. troglodytes
tatatgaaacataagt

SEQ ID NO: 262395 - DNA, 16 bp, P. troglodytes
tatatgaaatatgtat

SEQ ID NO: 262396 - DNA, 16 bp, P. troglodytes
tatatgaagaactcct

SEQ ID NO: 262397 - DNA, 16 bp, P. troglodytes
tatatgaagagagaga

SEQ ID NO: 262398 - DNA, 16 bp, P. troglodytes
tatatgaagatattcc

SEQ ID NO: 262399 - DNA, 16 bp, P. troglodytes
tatatgaatatatgtg

SEQ ID NO: 262400 - DNA, 16 bp, P. troglodytes
tatatgacaaatgttt

SEQ ID NO: 262401 - DNA, 16 bp, P. troglodytes
tatatgacctttcaga

SEQ ID NO: 262402 - DNA, 16 bp, P. troglodytes
tatatgactttttaaa

SEQ ID NO: 262403 - DNA, 16 bp, P. troglodytes
tatatgagaaaatatt

SEQ ID NO: 262404 - DNA, 16 bp, P. troglodytes
tatatgatataaggaa

SEQ ID NO: 262405 - DNA, 16 bp, P. troglodytes
tatatgatattctaga

SEQ ID NO: 262406 - DNA, 16 bp, P. troglodytes
tatatgcaaataaaat

SEQ ID NO: 262407 - DNA, 16 bp, P. troglodytes
tatatgcaaatataaa

SEQ ID NO: 262408 - DNA, 16 bp, P. troglodytes
tatatgcaacatatat

SEQ ID NO: 262409 - DNA, 16 bp, P. troglodytes
tatatgcacacacaca

SEQ ID NO: 262410 - DNA, 16 bp, P. troglodytes
tatatgcatatataca

SEQ ID NO: 262411 - DNA, 16 bp, P. troglodytes
tatatgcatatatata

SEQ ID NO: 262412 - DNA, 16 bp, P. troglodytes
tatatgcatatgtgta

SEQ ID NO: 262413 - DNA, 16 bp, P. troglodytes
tatatgccaggcactg

SEQ ID NO: 262414 - DNA, 16 bp, P. troglodytes
tatatgctataaaata

SEQ ID NO: 262415 - DNA, 16 bp, P. troglodytes
tatatgctatctataa

SEQ ID NO: 262416 - DNA, 16 bp, P. troglodytes
tatatgcttatatatt

SEQ ID NO: 262417 - DNA, 16 bp, P. troglodytes
tatatggaaatgcaaa

SEQ ID NO: 262418 - DNA, 16 bp, P. troglodytes
tatatggagagagaga

SEQ ID NO: 262419 - DNA, 16 bp, P. troglodytes
tatatggcttttatta

SEQ ID NO: 262420 - DNA, 16 bp, P. troglodytes
tatatgtaaatataca

SEQ ID NO: 262421 - DNA, 16 bp, P. troglodytes
tatatgtaaatgaaat

SEQ ID NO: 262422 - DNA, 16 bp, P. troglodytes
tatatgtaatgtatat

SEQ ID NO: 262423 - DNA, 16 bp, P. troglodytes
tatatgtaattgtata

SEQ ID NO: 262424 - DNA, 16 bp, P. troglodytes
tatatgtacatacata

SEQ ID NO: 262425 - DNA, 16 bp, P. troglodytes
tatatgtacatattca

SEQ ID NO: 262426 - DNA, 16 bp, P. troglodytes
tatatgtatacatata

SEQ ID NO: 262427 - DNA, 16 bp, P. troglodytes
tatatgtatataactt

SEQ ID NO: 262428 - DNA, 16 bp, P. troglodytes
tatatgtatatatcac

SEQ ID NO: 262429 - DNA, 16 bp, P. troglodytes
tatatgtatatattag

SEQ ID NO: 262430 - DNA, 16 bp, P. troglodytes
tatatgtatatcacat

SEQ ID NO: 262431 - DNA, 16 bp, P. troglodytes
tatatgtatatgtata

SEQ ID NO: 262432 - DNA, 16 bp, P. troglodytes
tatatgtatgtaaata

SEQ ID NO: 262433 - DNA, 16 bp, P. troglodytes
tatatgtatgtacaca

SEQ ID NO: 262434 - DNA, 16 bp, P. troglodytes
tatatgtatgtataat

SEQ ID NO: 262435 - DNA, 16 bp, P. troglodytes
tatatgtatgtgtgtt

SEQ ID NO: 262436 - DNA, 16 bp, P. troglodytes
tatatgtattacattt

SEQ ID NO: 262437 - DNA, 16 bp, P. troglodytes
tatatgtgaatatata

SEQ ID NO: 262438 - DNA, 16 bp, P. troglodytes
tatatgtgcacacaca

SEQ ID NO: 262439 - DNA, 16 bp, P. troglodytes
tatatgtgcagaatgt

SEQ ID NO: 262440 - DNA, 16 bp, P. troglodytes
tatatgtgccaccttt

SEQ ID NO: 262441 - DNA, 16 bp, P. troglodytes
tatatgtggtccatca

SEQ ID NO: 262442 - DNA, 16 bp, P. troglodytes
tatatgtgtaaataca

SEQ ID NO: 262443 - DNA, 16 bp, P. troglodytes
tatatgtgtacatata

SEQ ID NO: 262444 - DNA, 16 bp, P. troglodytes
tatatgtgtatacaca

SEQ ID NO: 262445 - DNA, 16 bp, P. troglodytes
tatatgtgtatacata

SEQ ID NO: 262446 - DNA, 16 bp, P. troglodytes
tatatgtgtatgtaca

SEQ ID NO: 262447 - DNA, 16 bp, P. troglodytes
tatatgtgtgtacata

SEQ ID NO: 262448 - DNA, 16 bp, P. troglodytes
tatatgtgtgtgtatt

SEQ ID NO: 262449 - DNA, 16 bp, P. troglodytes
tatatgtgtgtgtgta

SEQ ID NO: 262450 - DNA, 16 bp, P. troglodytes
tatatgttatatatac

SEQ ID NO: 262451 - DNA, 16 bp, P. troglodytes
tatatgtttgttggct

SEQ ID NO: 262452 - DNA, 16 bp, P. troglodytes
tatattaaaaaatgct

SEQ ID NO: 262453 - DNA, 16 bp, P. troglodytes
tatattaaatgtgaat

SEQ ID NO: 262454 - DNA, 16 bp, P. troglodytes
tatattaagttaaaca

SEQ ID NO: 262455 - DNA, 16 bp, P. troglodytes
tatattacaaagccat

SEQ ID NO: 262456 - DNA, 16 bp, P. troglodytes
tatattacaagtatat

SEQ ID NO: 262457 - DNA, 16 bp, P. troglodytes
tatattagttcatttt

SEQ ID NO: 262458 - DNA, 16 bp, P. troglodytes
tatattatttcatgta

SEQ ID NO: 262459 - DNA, 16 bp, P. troglodytes
tatattcaagtatata

SEQ ID NO: 262460 - DNA, 16 bp, P. troglodytes
tatattcaataaatgt

SEQ ID NO: 262461 - DNA, 16 bp, P. troglodytes
tatattcacagaattg

SEQ ID NO: 262462 - DNA, 16 bp, P. troglodytes
tatattcagatatata

SEQ ID NO: 262463 - DNA, 16 bp, P. troglodytes
tatattcatatataca

SEQ ID NO: 262464 - DNA, 16 bp, P. troglodytes
tatattcatatgtatt

SEQ ID NO: 262465 - DNA, 16 bp, P. troglodytes
tatattcattaattca

SEQ ID NO: 262466 - DNA, 16 bp, P. troglodytes
tatattccatctactg

SEQ ID NO: 262467 - DNA, 16 bp, P. troglodytes
tatattcccagcactt

SEQ ID NO: 262468 - DNA, 16 bp, P. troglodytes
tatattctagataaaa

SEQ ID NO: 262469 - DNA, 16 bp, P. troglodytes
tatattctgaatacaa

SEQ ID NO: 262470 - DNA, 16 bp, P. troglodytes
tatattcttcaaaaat

SEQ ID NO: 262471 - DNA, 16 bp, P. troglodytes
tatattcttctgcagt

SEQ ID NO: 262472 - DNA, 16 bp, P. troglodytes
tatattgaatgaataa

SEQ ID NO: 262473 - DNA, 16 bp, P. troglodytes
tatattgactttgtat

SEQ ID NO: 262474 - DNA, 16 bp, P. troglodytes
tatattgtatttttac

SEQ ID NO: 262475 - DNA, 16 bp, P. troglodytes
tatattgtggtaaaat

SEQ ID NO: 262476 - DNA, 16 bp, P. troglodytes
tatattgttgaatttg

SEQ ID NO: 262477 - DNA, 16 bp, P. troglodytes
tatatttaaagacaaa

SEQ ID NO: 262478 - DNA, 16 bp, P. troglodytes
tatatttaaatgcaaa

SEQ ID NO: 262479 - DNA, 16 bp, P. troglodytes
tatatttacagaaaat

SEQ ID NO: 262480 - DNA, 16 bp, P. troglodytes
tatatttagatacata

SEQ ID NO: 262481 - DNA, 16 bp, P. troglodytes
tatatttatggggcac

SEQ ID NO: 262482 - DNA, 16 bp, P. troglodytes
tatatttcagaatagc

SEQ ID NO: 262483 - DNA, 16 bp, P. troglodytes
tatatttcttattatg

SEQ ID NO: 262484 - DNA, 16 bp, P. troglodytes
tatatttctttgatat

SEQ ID NO: 262485 - DNA, 16 bp, P. troglodytes
tatatttgaaaaacaa

SEQ ID NO: 262486 - DNA, 16 bp, P. troglodytes
tatatttgaaatgtat

SEQ ID NO: 262487 - DNA, 16 bp, P. troglodytes
tatatttgcatataca

SEQ ID NO: 262488 - DNA, 16 bp, P. troglodytes
tatatttgcatatttt

SEQ ID NO: 262489 - DNA, 16 bp, P. troglodytes
tatatttgcttttaaa

SEQ ID NO: 262490 - DNA, 16 bp, P. troglodytes
tatatttgtatacaaa

SEQ ID NO: 262491 - DNA, 16 bp, P. troglodytes
tatatttgtgtatgta

SEQ ID NO: 262492 - DNA, 16 bp, P. troglodytes
tatattttaaaatgct

SEQ ID NO: 262493 - DNA, 16 bp, P. troglodytes
tatattttaaagctat

SEQ ID NO: 262494 - DNA, 16 bp, P. troglodytes
tatattttaccaaatt

SEQ ID NO: 262495 - DNA, 16 bp, P. troglodytes
tatattttaccacaat

SEQ ID NO: 262496 - DNA, 16 bp, P. troglodytes
tatattttagaaatgt

SEQ ID NO: 262497 - DNA, 16 bp, P. troglodytes
tatattttagcatttt

SEQ ID NO: 262498 - DNA, 16 bp, P. troglodytes
tatattttattgcata

SEQ ID NO: 262499 - DNA, 16 bp, P. troglodytes
tatattttcaggaatt

SEQ ID NO: 262500 - DNA, 16 bp, P. troglodytes
tatattttcatatgct

SEQ ID NO: 262501 - DNA, 16 bp, P. troglodytes
tatattttctgaatat

SEQ ID NO: 262502 - DNA, 16 bp, P. troglodytes
tatattttctgaattt

SEQ ID NO: 262503 - DNA, 16 bp, P. troglodytes
tatattttcttgtaaa

SEQ ID NO: 262504 - DNA, 16 bp, P. troglodytes
tatattttgccaaatt

SEQ ID NO: 262505 - DNA, 16 bp, P. troglodytes
tatattttgggggtat

SEQ ID NO: 262506 - DNA, 16 bp, P. troglodytes
tatatttttaaaactc

SEQ ID NO: 262507 - DNA, 16 bp, P. troglodytes
tatatttttaaaagca

SEQ ID NO: 262508 - DNA, 16 bp, P. troglodytes
tatatttttaaagtac

SEQ ID NO: 262509 - DNA, 16 bp, P. troglodytes
tatatttttcatagag

SEQ ID NO: 262510 - DNA, 16 bp, P. troglodytes
tatattttttaaagca

SEQ ID NO: 262511 - DNA, 16 bp, P. troglodytes
tatattttttaaagct

SEQ ID NO: 262512 - DNA, 16 bp, P. troglodytes
tatattttttaatgct

SEQ ID NO: 262513 - DNA, 16 bp, P. troglodytes
tatatttttttctaag

SEQ ID NO: 262514 - DNA, 16 bp, P. troglodytes
tatcaaaacatttcat

SEQ ID NO: 262515 - DNA, 16 bp, P. troglodytes
tatcaaaaccaagaaa

SEQ ID NO: 262516 - DNA, 16 bp, P. troglodytes
tatcaaaaccagaaaa

SEQ ID NO: 262517 - DNA, 16 bp, P. troglodytes
tatcaaaatatctcat

SEQ ID NO: 262518 - DNA, 16 bp, P. troglodytes
tatcaaaatcccagct

SEQ ID NO: 262519 - DNA, 16 bp, P. troglodytes
tatcaaaatctgtatt

SEQ ID NO: 262520 - DNA, 16 bp, P. troglodytes
tatcaaaatgtcaaaa

SEQ ID NO: 262521 - DNA, 16 bp, P. troglodytes
tatcaaaatttgtgag

SEQ ID NO: 262522 - DNA, 16 bp, P. troglodytes
tatcaaacatcaggaa

SEQ ID NO: 262523 - DNA, 16 bp, P. troglodytes
tatcaaaggacttttc

SEQ ID NO: 262524 - DNA, 17 bp, P. troglodytes
tatcaaaggccttttct

SEQ ID NO: 262525 - DNA, 16 bp, P. troglodytes
tatcaacatcattttt

SEQ ID NO: 262526 - DNA, 17 bp, P. troglodytes
tatcaagcagaacagga

SEQ ID NO: 262527 - DNA, 16 bp, P. troglodytes
tatcaagttgaagaag

SEQ ID NO: 262528 - DNA, 16 bp, P. troglodytes
tatcaatcaatcaatc

SEQ ID NO: 262529 - DNA, 16 bp, P. troglodytes
tatcaatgtcaatatc

SEQ ID NO: 262530 - DNA, 16 bp, P. troglodytes
tatcaatgttaaattt

SEQ ID NO: 262531 - DNA, 16 bp, P. troglodytes
tatcaattctgttgat

SEQ ID NO: 262532 - DNA, 16 bp, P. troglodytes
tatcaattttgttaat

SEQ ID NO: 262533 - DNA, 16 bp, P. troglodytes
tatcaatttttattgc

SEQ ID NO: 262534 - DNA, 16 bp, P. troglodytes
tatcacaatttttaaa

SEQ ID NO: 262535 - DNA, 16 bp, P. troglodytes
tatcacactgtggttt

SEQ ID NO: 262536 - DNA, 16 bp, P. troglodytes
tatcacagaaataaaa

SEQ ID NO: 262537 - DNA, 16 bp, P. troglodytes
tatcacagcattattc

SEQ ID NO: 262538 - DNA, 16 bp, P. troglodytes
tatcacagccatgtag

SEQ ID NO: 262539 - DNA, 16 bp, P. troglodytes
tatcacatggcaagag

SEQ ID NO: 262540 - DNA, 16 bp, P. troglodytes
tatcaccagcaaaggc

SEQ ID NO: 262541 - DNA, 16 bp, P. troglodytes
tatcaccccaaaagga

SEQ ID NO: 262542 - DNA, 17 bp, P. troglodytes
tatcacgaggtcaggag

SEQ ID NO: 262543 - DNA, 21 bp, P. troglodytes
tatcactcagtcagctgcaga

SEQ ID NO: 262544 - DNA, 16 bp, P. troglodytes
tatcactcccatttta

SEQ ID NO: 262545 - DNA, 16 bp, P. troglodytes
tatcactgtcttccat

SEQ ID NO: 262546 - DNA, 16 bp, P. troglodytes
tatcagaaactcaaaa

SEQ ID NO: 262547 - DNA, 16 bp, P. troglodytes
tatcagaattttaaaa

SEQ ID NO: 262548 - DNA, 16 bp, P. troglodytes
tatcagatatgtgttt

SEQ ID NO: 262549 - DNA, 16 bp, P. troglodytes
tatcagcatcacctgg

SEQ ID NO: 262550 - DNA, 16 bp, P. troglodytes
tatcagcattttgggc

SEQ ID NO: 262551 - DNA, 16 bp, P. troglodytes
tatcagcattttggtc

SEQ ID NO: 262552 - DNA, 16 bp, P. troglodytes
tatcagctacttggga

SEQ ID NO: 262553 - DNA, 16 bp, P. troglodytes
tatcagctgatgaatg

SEQ ID NO: 262554 - DNA, 17 bp, P. troglodytes
tatcagcttaagaaact

SEQ ID NO: 262555 - DNA, 29 bp, P. troglodytes
tatcagcttaaggagattttgggctgaga

SEQ ID NO: 262556 - DNA, 16 bp, P. troglodytes
tatcaggaagatgctg

SEQ ID NO: 262557 - DNA, 16 bp, P. troglodytes
tatcaggatgatgcag

SEQ ID NO: 262558 - DNA, 16 bp, P. troglodytes
tatcaggtactatgct

SEQ ID NO: 262559 - DNA, 16 bp, P. troglodytes
tatcagtatttcattc

SEQ ID NO: 262560 - DNA, 16 bp, P. troglodytes
tatcagtgccattttt

SEQ ID NO: 262561 - DNA, 16 bp, P. troglodytes
tatcagtgttaatttc

SEQ ID NO: 262562 - DNA, 16 bp, P. troglodytes
tatcagttttgcttca

SEQ ID NO: 262563 - DNA, 16 bp, P. troglodytes
tatcataaaggatatt

SEQ ID NO: 262564 - DNA, 16 bp, P. troglodytes
tatcatactgttttga

SEQ ID NO: 262565 - DNA, 16 bp, P. troglodytes
tatcatatgtaaatta

SEQ ID NO: 262566 - DNA, 16 bp, P. troglodytes
tatcatcatcatcatc

SEQ ID NO: 262567 - DNA, 16 bp, P. troglodytes
tatcatcatgaaaaca

SEQ ID NO: 262568 - DNA, 16 bp, P. troglodytes
tatcatctcattttat

SEQ ID NO: 262569 - DNA, 16 bp, P. troglodytes
tatcatctttggagaa

SEQ ID NO: 262570 - DNA, 16 bp, P. troglodytes
tatcatgaatgcagga

SEQ ID NO: 262571 - DNA, 16 bp, P. troglodytes
tatcatgagaacagca

SEQ ID NO: 262572 - DNA, 16 bp, P. troglodytes
tatcatgctacctgac

SEQ ID NO: 262573 - DNA, 16 bp, P. troglodytes
tatcatgttttaattt

SEQ ID NO: 262574 - DNA, 16 bp, P. troglodytes
tatcatgtttttaaaa

SEQ ID NO: 262575 - DNA, 16 bp, P. troglodytes
tatcattaatcattag

SEQ ID NO: 262576 - DNA, 16 bp, P. troglodytes
tatcattatcttcatt

SEQ ID NO: 262577 - DNA, 16 bp, P. troglodytes
tatcattcattttgaa

SEQ ID NO: 262578 - DNA, 16 bp, P. troglodytes
tatcattctgtcaccc

SEQ ID NO: 262579 - DNA, 16 bp, P. troglodytes
tatcattgatgggaat

SEQ ID NO: 262580 - DNA, 16 bp, P. troglodytes
tatcattgccatttta

SEQ ID NO: 262581 - DNA, 16 bp, P. troglodytes
tatcatttattgagtg

SEQ ID NO: 262582 - DNA, 16 bp, P. troglodytes
tatcatttgtaaaatg

SEQ ID NO: 262583 - DNA, 16 bp, P. troglodytes
tatcattttataatga

SEQ ID NO: 262584 - DNA, 16 bp, P. troglodytes
tatcatttttattgtg

SEQ ID NO: 262585 - DNA, 16 bp, P. troglodytes
tatccaaaaaatcatt

SEQ ID NO: 262586 - DNA, 16 bp, P. troglodytes
tatccaaaatgaaata

SEQ ID NO: 262587 - DNA, 16 bp, P. troglodytes
tatccaaagaaatata

SEQ ID NO: 262588 - DNA, 16 bp, P. troglodytes
tatccaagatgtaaga

SEQ ID NO: 262589 - DNA, 16 bp, P. troglodytes
tatccaataaatatca

SEQ ID NO: 262590 - DNA, 16 bp, P. troglodytes
tatccacaccaaaacc

SEQ ID NO: 262591 - DNA, 16 bp, P. troglodytes
tatccacatgcagaaa

SEQ ID NO: 262592 - DNA, 16 bp, P. troglodytes
tatccaccaccatgcc

SEQ ID NO: 262593 - DNA, 16 bp, P. troglodytes
tatccacccaccttgg

SEQ ID NO: 262594 - DNA, 16 bp, P. troglodytes
tatccaccttctgaag

SEQ ID NO: 262595 - DNA, 16 bp, P. troglodytes
tatccactagatgcca

SEQ ID NO: 262596 - DNA, 16 bp, P. troglodytes
tatccacttcttccag

SEQ ID NO: 262597 - DNA, 16 bp, P. troglodytes
tatccagaagatctgg

SEQ ID NO: 262598 - DNA, 16 bp, P. troglodytes
tatccagaggaaaaga

SEQ ID NO: 262599 - DNA, 16 bp, P. troglodytes
tatccagttttcctgg

SEQ ID NO: 262600 - DNA, 16 bp, P. troglodytes
tatccatatgcaaaat

SEQ ID NO: 262601 - DNA, 16 bp, P. troglodytes
tatccatctgacaaga

SEQ ID NO: 262602 - DNA, 16 bp, P. troglodytes
tatccatgaacatgaa

SEQ ID NO: 262603 - DNA, 20 bp, P. troglodytes
tatcccaacactttgggagg

SEQ ID NO: 262604 - DNA, 16 bp, P. troglodytes
tatcccaccaaactaa

SEQ ID NO: 262605 - DNA, 18 bp, P. troglodytes
tatcccagcactttggga

SEQ ID NO: 262606 - DNA, 16 bp, P. troglodytes
tatcccagctactctg

SEQ ID NO: 262607 - DNA, 18 bp, P. troglodytes
tatcccagctacttggga

SEQ ID NO: 262608 - DNA, 16 bp, P. troglodytes
tatcccattggttctg

SEQ ID NO: 262609 - DNA, 16 bp, P. troglodytes
tatccctgataaatat

SEQ ID NO: 262610 - DNA, 16 bp, P. troglodytes
tatcctatgttttctt

SEQ ID NO: 262611 - DNA, 16 bp, P. troglodytes
tatcctcagcaaatta

SEQ ID NO: 262612 - DNA, 16 bp, P. troglodytes
tatcctcattttaaaa

SEQ ID NO: 262613 - DNA, 16 bp, P. troglodytes
tatcctgaagctttac

SEQ ID NO: 262614 - DNA, 16 bp, P. troglodytes
tatcctgagattttgc

SEQ ID NO: 262615 - DNA, 16 bp, P. troglodytes
tatcctgctgtggctg

SEQ ID NO: 262616 - DNA, 16 bp, P. troglodytes
tatcctggacatttca

SEQ ID NO: 262617 - DNA, 16 bp, P. troglodytes
tatcctggttattaat

SEQ ID NO: 262618 - DNA, 16 bp, P. troglodytes
tatcctgttttatttc

SEQ ID NO: 262619 - DNA, 16 bp, P. troglodytes
tatccttaaatgtaaa

SEQ ID NO: 262620 - DNA, 16 bp, P. troglodytes
tatccttcatgaacat

SEQ ID NO: 262621 - DNA, 16 bp, P. troglodytes
tatccttgatgagcat

SEQ ID NO: 262622 - DNA, 16 bp, P. troglodytes
tatccttgtttacaga

SEQ ID NO: 262623 - DNA, 16 bp, P. troglodytes
tatccttgtttgcaaa

SEQ ID NO: 262624 - DNA, 16 bp, P. troglodytes
tatcctttataataaa

SEQ ID NO: 262625 - DNA, 16 bp, P. troglodytes
tatcctttctccactg

SEQ ID NO: 262626 - DNA, 16 bp, P. troglodytes
tatcctttgtaataaa

SEQ ID NO: 262627 - DNA, 16 bp, P. troglodytes
tatcctttgtccactt

SEQ ID NO: 262628 - DNA, 16 bp, P. troglodytes
tatccttttgtgactg

SEQ ID NO: 262629 - DNA, 16 bp, P. troglodytes
tatcgattttgttgat

SEQ ID NO: 262630 - DNA, 16 bp, P. troglodytes
tatctaatttttgtat

SEQ ID NO: 262631 - DNA, 17 bp, P. troglodytes
tatctagaaaaccccac

SEQ ID NO: 262632 - DNA, 17 bp, P. troglodytes
tatctaggaagtaacta

SEQ ID NO: 262633 - DNA, 16 bp, P. troglodytes
tatctaggaagtaagt

SEQ ID NO: 262634 - DNA, 16 bp, P. troglodytes
tatctatatatgcata

SEQ ID NO: 262635 - DNA, 16 bp, P. troglodytes
tatctatatgtatccc

SEQ ID NO: 262636 - DNA, 16 bp, P. troglodytes
tatctatatgtatgta

SEQ ID NO: 262637 - DNA, 16 bp, P. troglodytes
tatctatctacccatc

SEQ ID NO: 262638 - DNA, 16 bp, P. troglodytes
tatctatctatataaa

SEQ ID NO: 262639 - DNA, 16 bp, P. troglodytes
tatctatctatctatg

SEQ ID NO: 262640 - DNA, 16 bp, P. troglodytes
tatctatgtaacaaat

SEQ ID NO: 262641 - DNA, 16 bp, P. troglodytes
tatctatgtatatgta

SEQ ID NO: 262642 - DNA, 16 bp, P. troglodytes
tatctattgatctatc

SEQ ID NO: 262643 - DNA, 16 bp, P. troglodytes
tatctatttatctgtc

SEQ ID NO: 262644 - DNA, 16 bp, P. troglodytes
tatctattttgttaat

SEQ ID NO: 262645 - DNA, 16 bp, P. troglodytes
tatctcaagaacagca

SEQ ID NO: 262646 - DNA, 16 bp, P. troglodytes
tatctcaagttcaaag

SEQ ID NO: 262647 - DNA, 16 bp, P. troglodytes
tatctcagaacttaaa

SEQ ID NO: 262648 - DNA, 16 bp, P. troglodytes
tatctcatgtacctca

SEQ ID NO: 262649 - DNA, 16 bp, P. troglodytes
tatctcattgctgttt

SEQ ID NO: 262650 - DNA, 17 bp, P. troglodytes
tatctcattgtggtttt

SEQ ID NO: 262651 - DNA, 16 bp, P. troglodytes
tatctcattgttattt

SEQ ID NO: 262652 - DNA, 16 bp, P. troglodytes
tatctcatttaatctt

SEQ ID NO: 262653 - DNA, 16 bp, P. troglodytes
tatctcatttaatttg

SEQ ID NO: 262654 - DNA, 16 bp, P. troglodytes
tatctcattttaaaaa

SEQ ID NO: 262655 - DNA, 16 bp, P. troglodytes
tatctccaaaaaagaa

SEQ ID NO: 262656 - DNA, 16 bp, P. troglodytes
tatctccagggcatgt

SEQ ID NO: 262657 - DNA, 16 bp, P. troglodytes
tatctctatatagata

SEQ ID NO: 262658 - DNA, 16 bp, P. troglodytes
tatctctcagaccaca

SEQ ID NO: 262659 - DNA, 16 bp, P. troglodytes
tatctctcctaatgct

SEQ ID NO: 262660 - DNA, 16 bp, P. troglodytes
tatctctctcaagttc

SEQ ID NO: 262661 - DNA, 16 bp, P. troglodytes
tatctctgatgaatat

SEQ ID NO: 262662 - DNA, 16 bp, P. troglodytes
tatctctgttttggca

SEQ ID NO: 262663 - DNA, 16 bp, P. troglodytes
tatctcttaaaaaaga

SEQ ID NO: 262664 - DNA, 16 bp, P. troglodytes
tatctcttttaaaaat

SEQ ID NO: 262665 - DNA, 16 bp, P. troglodytes
tatctgaaaacaaaaa

SEQ ID NO: 262666 - DNA, 16 bp, P. troglodytes
tatctgaaaatgtgga

SEQ ID NO: 262667 - DNA, 16 bp, P. troglodytes
tatctgacttcaaact

SEQ ID NO: 262668 - DNA, 16 bp, P. troglodytes
tatctgagactacagg

SEQ ID NO: 262669 - DNA, 16 bp, P. troglodytes
tatctgagactggata

SEQ ID NO: 262670 - DNA, 16 bp, P. troglodytes
tatctgcagtcccagc

SEQ ID NO: 262671 - DNA, 16 bp, P. troglodytes
tatctgcatttccatg

SEQ ID NO: 262672 - DNA, 18 bp, P. troglodytes
tatctgcccacctcggcc

SEQ ID NO: 262673 - DNA, 18 bp, P. troglodytes
tatctgcccgcctcggcc

SEQ ID NO: 262674 - DNA, 16 bp, P. troglodytes
tatctggaaaaaaaaa

SEQ ID NO: 262675 - DNA, 16 bp, P. troglodytes
tatctggatgcctttt

SEQ ID NO: 262676 - DNA, 16 bp, P. troglodytes
tatctggcacatggta

SEQ ID NO: 262677 - DNA, 16 bp, P. troglodytes
tatctgggaatatctt

SEQ ID NO: 262678 - DNA, 16 bp, P. troglodytes
tatctgtaaaatggat

SEQ ID NO: 262679 - DNA, 16 bp, P. troglodytes
tatctgtatctatata

SEQ ID NO: 262680 - DNA, 16 bp, P. troglodytes
tatctgtggctgcttt

SEQ ID NO: 262681 - DNA, 16 bp, P. troglodytes
tatctgtgggagctaa

SEQ ID NO: 262682 - DNA, 16 bp, P. troglodytes
tatctgtgtgtgtgtg

SEQ ID NO: 262683 - DNA, 16 bp, P. troglodytes
tatctgttatgatgat

SEQ ID NO: 262684 - DNA, 16 bp, P. troglodytes
tatcttaaaattcata

SEQ ID NO: 262685 - DNA, 16 bp, P. troglodytes
tatcttacatggcaaa

SEQ ID NO: 262686 - DNA, 16 bp, P. troglodytes
tatcttcattttaaag

SEQ ID NO: 262687 - DNA, 16 bp, P. troglodytes
tatcttcattttacag

SEQ ID NO: 262688 - DNA, 16 bp, P. troglodytes
tatcttctcccagttt

SEQ ID NO: 262689 - DNA, 16 bp, P. troglodytes
tatcttctttgatgaa

SEQ ID NO: 262690 - DNA, 16 bp, P. troglodytes
tatcttcttttatgaa

SEQ ID NO: 262691 - DNA, 16 bp, P. troglodytes
tatcttgaaatataca

SEQ ID NO: 262692 - DNA, 16 bp, P. troglodytes
tatcttgaatgtaaat

SEQ ID NO: 262693 - DNA, 17 bp, P. troglodytes
tatcttggctcactgca

SEQ ID NO: 262694 - DNA, 16 bp, P. troglodytes
tatctttaggtctttg

SEQ ID NO: 262695 - DNA, 16 bp, P. troglodytes
tatctttatagcaaca

SEQ ID NO: 262696 - DNA, 16 bp, P. troglodytes
tatctttcaaaagtga

SEQ ID NO: 262697 - DNA, 16 bp, P. troglodytes
tatctttccaggaatt

SEQ ID NO: 262698 - DNA, 16 bp, P. troglodytes
tatctttctgtcttct

SEQ ID NO: 262699 - DNA, 16 bp, P. troglodytes
tatctttgagtcttca

SEQ ID NO: 262700 - DNA, 16 bp, P. troglodytes
tatcttttaaagatat

SEQ ID NO: 262701 - DNA, 16 bp, P. troglodytes
tatcttttcagcaata

SEQ ID NO: 262702 - DNA, 16 bp, P. troglodytes
tatcttttcagcaatg

SEQ ID NO: 262703 - DNA, 16 bp, P. troglodytes
tatcttttctgaccat

SEQ ID NO: 262704 - DNA, 16 bp, P. troglodytes
tatcttttgacatttt

SEQ ID NO: 262705 - DNA, 16 bp, P. troglodytes
tatctttttaaaaaac

SEQ ID NO: 262706 - DNA, 16 bp, P. troglodytes
tatcttttttaaaaga

SEQ ID NO: 262707 - DNA, 16 bp, P. troglodytes
tatgaaaaaaaatgct

SEQ ID NO: 262708 - DNA, 16 bp, P. troglodytes
tatgaaaaaaatacat

SEQ ID NO: 262709 - DNA, 16 bp, P. troglodytes
tatgaaaaaatgatca

SEQ ID NO: 262710 - DNA, 16 bp, P. troglodytes
tatgaaaaaatgtgca

SEQ ID NO: 262711 - DNA, 16 bp, P. troglodytes
tatgaaaaacagtttg

SEQ ID NO: 262712 - DNA, 16 bp, P. troglodytes
tatgaaaaactgtatg

SEQ ID NO: 262713 - DNA, 16 bp, P. troglodytes
tatgaaaaagtcaaaa

SEQ ID NO: 262714 - DNA, 16 bp, P. troglodytes
tatgaaaatatgtttt

SEQ ID NO: 262715 - DNA, 16 bp, P. troglodytes
tatgaaaatcaactca

SEQ ID NO: 262716 - DNA, 16 bp, P. troglodytes
tatgaaaatcctagaa

SEQ ID NO: 262717 - DNA, 16 bp, P. troglodytes
tatgaaaatgaaatgt

SEQ ID NO: 262718 - DNA, 16 bp, P. troglodytes
tatgaaaattttcaaa

SEQ ID NO: 262719 - DNA, 16 bp, P. troglodytes
tatgaaacactgctga

SEQ ID NO: 262720 - DNA, 16 bp, P. troglodytes
tatgaaagtataaaac

SEQ ID NO: 262721 - DNA, 16 bp, P. troglodytes
tatgaaagttctagat

SEQ ID NO: 262722 - DNA, 16 bp, P. troglodytes
tatgaaatatgtattt

SEQ ID NO: 262723 - DNA, 16 bp, P. troglodytes
tatgaaatattttgaa

SEQ ID NO: 262724 - DNA, 16 bp, P. troglodytes
tatgaaattatgtaaa

SEQ ID NO: 262725 - DNA, 16 bp, P. troglodytes
tatgaaattctggggt

SEQ ID NO: 262726 - DNA, 16 bp, P. troglodytes
tatgaaattcttgatt

SEQ ID NO: 262727 - DNA, 16 bp, P. troglodytes
tatgaaatttagaatt

SEQ ID NO: 262728 - DNA, 16 bp, P. troglodytes
tatgaacaaatgctca

SEQ ID NO: 262729 - DNA, 16 bp, P. troglodytes
tatgaacagacacttt

SEQ ID NO: 262730 - DNA, 16 bp, P. troglodytes
tatgaacatttgtgta

SEQ ID NO: 262731 - DNA, 16 bp, P. troglodytes
tatgaacattttcaaa

SEQ ID NO: 262732 - DNA, 16 bp, P. troglodytes
tatgaacatttttatg

SEQ ID NO: 262733 - DNA, 16 bp, P. troglodytes
tatgaagaaaagagat

SEQ ID NO: 262734 - DNA, 16 bp, P. troglodytes
tatgaagaaaatctgg

SEQ ID NO: 262735 - DNA, 16 bp, P. troglodytes
tatgaagaaaatggaa

SEQ ID NO: 262736 - DNA, 16 bp, P. troglodytes
tatgaagaaacagaaa

SEQ ID NO: 262737 - DNA, 16 bp, P. troglodytes
tatgaagaaactacat

SEQ ID NO: 262738 - DNA, 16 bp, P. troglodytes
tatgaagacaataaaa

SEQ ID NO: 262739 - DNA, 16 bp, P. troglodytes
tatgaagatgaaatga

SEQ ID NO: 262740 - DNA, 16 bp, P. troglodytes
tatgaagccagtatta

SEQ ID NO: 262741 - DNA, 16 bp, P. troglodytes
tatgaagctagtatta

SEQ ID NO: 262742 - DNA, 16 bp, P. troglodytes
tatgaaggctcctgtg

SEQ ID NO: 262743 - DNA, 16 bp, P. troglodytes
tatgaagtagtatctc

SEQ ID NO: 262744 - DNA, 16 bp, P. troglodytes
tatgaagtgtctgtca

SEQ ID NO: 262745 - DNA, 16 bp, P. troglodytes
tatgaagttaaaacca

SEQ ID NO: 262746 - DNA, 16 bp, P. troglodytes
tatgaataatgctgtt

SEQ ID NO: 262747 - DNA, 16 bp, P. troglodytes
tatgaatatatgaata

SEQ ID NO: 262748 - DNA, 16 bp, P. troglodytes
tatgaatatccagttt

SEQ ID NO: 262749 - DNA, 16 bp, P. troglodytes
tatgaatatttatgta

SEQ ID NO: 262750 - DNA, 16 bp, P. troglodytes
tatgaatgaagctgct

SEQ ID NO: 262751 - DNA, 16 bp, P. troglodytes
tatgaatggaatcata

SEQ ID NO: 262752 - DNA, 16 bp, P. troglodytes
tatgaatgttcttaat

SEQ ID NO: 262753 - DNA, 16 bp, P. troglodytes
tatgaattttacaata

SEQ ID NO: 262754 - DNA, 16 bp, P. troglodytes
tatgaattttaggttt

SEQ ID NO: 262755 - DNA, 17 bp, P. troglodytes
tatgacaaacccacagg

SEQ ID NO: 262756 - DNA, 16 bp, P. troglodytes
tatgacaaactcacag

SEQ ID NO: 262757 - DNA, 16 bp, P. troglodytes
tatgacaaagccacag

SEQ ID NO: 262758 - DNA, 16 bp, P. troglodytes
tatgacaaatccacag

SEQ ID NO: 262759 - DNA, 16 bp, P. troglodytes
tatgacaatattttaa

SEQ ID NO: 262760 - DNA, 16 bp, P. troglodytes
tatgacattctggaag

SEQ ID NO: 262761 - DNA, 16 bp, P. troglodytes
tatgaccacatgacca

SEQ ID NO: 262762 - DNA, 16 bp, P. troglodytes
tatgacccagcaattg

SEQ ID NO: 262763 - DNA, 16 bp, P. troglodytes
tatgactgagtaatat

SEQ ID NO: 262764 - DNA, 16 bp, P. troglodytes
tatgactttctggaaa

SEQ ID NO: 262765 - DNA, 16 bp, P. troglodytes
tatgactttttaattt

SEQ ID NO: 262766 - DNA, 16 bp, P. troglodytes
tatgagaaaatatttt

SEQ ID NO: 262767 - DNA, 16 bp, P. troglodytes
tatgagaaaattaatt

SEQ ID NO: 262768 - DNA, 16 bp, P. troglodytes
tatgagaaacaaattt

SEQ ID NO: 262769 - DNA, 16 bp, P. troglodytes
tatgagaaataaatgt

SEQ ID NO: 262770 - DNA, 16 bp, P. troglodytes
tatgagaatctaatgc

SEQ ID NO: 262771 - DNA, 16 bp, P. troglodytes
tatgagatggtgtctc

SEQ ID NO: 262772 - DNA, 16 bp, P. troglodytes
tatgagccaccatgcc

SEQ ID NO: 262773 - DNA, 16 bp, P. troglodytes
tatgagccactgtgcc

SEQ ID NO: 262774 - DNA, 16 bp, P. troglodytes
tatgagccctttgtca

SEQ ID NO: 262775 - DNA, 16 bp, P. troglodytes
tatgaggaagaaaata

SEQ ID NO: 262776 - DNA, 16 bp, P. troglodytes
tatgaggaggctggag

SEQ ID NO: 262777 - DNA, 16 bp, P. troglodytes
tatgaggccaccatca

SEQ ID NO: 262778 - DNA, 17 bp, P. troglodytes
tatgaggccagcatcat

SEQ ID NO: 262779 - DNA, 16 bp, P. troglodytes
tatgaggtagatatta

SEQ ID NO: 262780 - DNA, 16 bp, P. troglodytes
tatgaggtttaaggaa

SEQ ID NO: 262781 - DNA, 16 bp, P. troglodytes
tatgagtgaaatcatg

SEQ ID NO: 262782 - DNA, 16 bp, P. troglodytes
tatgagtgaccaatgg

SEQ ID NO: 262783 - DNA, 16 bp, P. troglodytes
tatgagtgagaacatt

SEQ ID NO: 262784 - DNA, 16 bp, P. troglodytes
tatgagtgtgtgtgtg

SEQ ID NO: 262785 - DNA, 16 bp, P. troglodytes
tatgagtttgactatt

SEQ ID NO: 262786 - DNA, 16 bp, P. troglodytes
tatgataaaatgattt

SEQ ID NO: 262787 - DNA, 16 bp, P. troglodytes
tatgataatctaatgc

SEQ ID NO: 262788 - DNA, 16 bp, P. troglodytes
tatgatagcatcaaaa

SEQ ID NO: 262789 - DNA, 16 bp, P. troglodytes
tatgatattgtctgtg

SEQ ID NO: 262790 - DNA, 16 bp, P. troglodytes
tatgatcatgtcactg

SEQ ID NO: 262791 - DNA, 16 bp, P. troglodytes
tatgatcattattatt

SEQ ID NO: 262792 - DNA, 16 bp, P. troglodytes
tatgatcttgggcaag

SEQ ID NO: 262793 - DNA, 16 bp, P. troglodytes
tatgatgaaatactac

SEQ ID NO: 262794 - DNA, 16 bp, P. troglodytes
tatgatgatgatgatt

SEQ ID NO: 262795 - DNA, 16 bp, P. troglodytes
tatgatggtgccactg

SEQ ID NO: 262796 - DNA, 16 bp, P. troglodytes
tatgatgtacaacatg

SEQ ID NO: 262797 - DNA, 16 bp, P. troglodytes
tatgatgtgctgctgg

SEQ ID NO: 262798 - DNA, 16 bp, P. troglodytes
tatgattcagcaatct

SEQ ID NO: 262799 - DNA, 16 bp, P. troglodytes
tatgattgtactactg

SEQ ID NO: 262800 - DNA, 16 bp, P. troglodytes
tatgcaaaaaataaat

SEQ ID NO: 262801 - DNA, 16 bp, P. troglodytes
tatgcaaaatatatat

SEQ ID NO: 262802 - DNA, 16 bp, P. troglodytes
tatgcaaataaatata

SEQ ID NO: 262803 - DNA, 16 bp, P. troglodytes
tatgcaaatagttgtt

SEQ ID NO: 262804 - DNA, 16 bp, P. troglodytes
tatgcaaatgttcata

SEQ ID NO: 262805 - DNA, 16 bp, P. troglodytes
tatgcaagagaaagaa

SEQ ID NO: 262806 - DNA, 16 bp, P. troglodytes
tatgcaatcatcacca

SEQ ID NO: 262807 - DNA, 16 bp, P. troglodytes
tatgcacatacacaca

SEQ ID NO: 262808 - DNA, 16 bp, P. troglodytes
tatgcacatacataca

SEQ ID NO: 262809 - DNA, 16 bp, P. troglodytes
tatgcactttatttct

SEQ ID NO: 262810 - DNA, 16 bp, P. troglodytes
tatgcagaagaatgga

SEQ ID NO: 262811 - DNA, 16 bp, P. troglodytes
tatgcagacaagtgaa

SEQ ID NO: 262812 - DNA, 16 bp, P. troglodytes
tatgcagccaacagac

SEQ ID NO: 262813 - DNA, 16 bp, P. troglodytes
tatgcagccatataaa

SEQ ID NO: 262814 - DNA, 16 bp, P. troglodytes
tatgcagccattaaaa

SEQ ID NO: 262815 - DNA, 16 bp, P. troglodytes
tatgcagctattgatc

SEQ ID NO: 262816 - DNA, 16 bp, P. troglodytes
tatgcagggcttaaaa

SEQ ID NO: 262817 - DNA, 16 bp, P. troglodytes
tatgcatatatacatg

SEQ ID NO: 262818 - DNA, 16 bp, P. troglodytes
tatgcatatatatttg

SEQ ID NO: 262819 - DNA, 16 bp, P. troglodytes
tatgcatcaaaggaca

SEQ ID NO: 262820 - DNA, 16 bp, P. troglodytes
tatgcatctcttccat

SEQ ID NO: 262821 - DNA, 16 bp, P. troglodytes
tatgcatgtaagaaat

SEQ ID NO: 262822 - DNA, 16 bp, P. troglodytes
tatgcatgtatcttta

SEQ ID NO: 262823 - DNA, 16 bp, P. troglodytes
tatgcatttatgtata

SEQ ID NO: 262824 - DNA, 16 bp, P. troglodytes
tatgcattttaaaatt

SEQ ID NO: 262825 - DNA, 16 bp, P. troglodytes
tatgccaccacacctg

SEQ ID NO: 262826 - DNA, 16 bp, P. troglodytes
tatgccaccatgccca

SEQ ID NO: 262827 - DNA, 16 bp, P. troglodytes
tatgccaggctaattt

SEQ ID NO: 262828 - DNA, 16 bp, P. troglodytes
tatgcccacagagcct

SEQ ID NO: 262829 - DNA, 16 bp, P. troglodytes
tatgcccagctaattt

SEQ ID NO: 262830 - DNA, 16 bp, P. troglodytes
tatgcccggctaattt

SEQ ID NO: 262831 - DNA, 16 bp, P. troglodytes
tatgcctataatccca

SEQ ID NO: 262832 - DNA, 18 bp, P. troglodytes
tatgcctggctaattttt

SEQ ID NO: 262833 - DNA, 16 bp, P. troglodytes
tatgcctgtaatccag

SEQ ID NO: 262834 - DNA, 16 bp, P. troglodytes
tatgccttttatttat

SEQ ID NO: 262835 - DNA, 16 bp, P. troglodytes
tatgctgaaaattata

SEQ ID NO: 262836 - DNA, 16 bp, P. troglodytes
tatgctgaaacctaat

SEQ ID NO: 262837 - DNA, 16 bp, P. troglodytes
tatgctggcagcaata

SEQ ID NO: 262838 - DNA, 16 bp, P. troglodytes
tatgctttaaaataaa

SEQ ID NO: 262839 - DNA, 16 bp, P. troglodytes
tatgcttttttaaaaa

SEQ ID NO: 262840 - DNA, 16 bp, P. troglodytes
tatggaaaaattattt

SEQ ID NO: 262841 - DNA, 16 bp, P. troglodytes
tatggaaaacaatatg

SEQ ID NO: 262842 - DNA, 16 bp, P. troglodytes
tatggaaaacactgtg

SEQ ID NO: 262843 - DNA, 16 bp, P. troglodytes
tatggaaaacagtatg

SEQ ID NO: 262844 - DNA, 16 bp, P. troglodytes
tatggaaaacagtgtg

SEQ ID NO: 262845 - DNA, 16 bp, P. troglodytes
tatggaaaagaaagac

SEQ ID NO: 262846 - DNA, 16 bp, P. troglodytes
tatggaaaatagtatg

SEQ ID NO: 262847 - DNA, 16 bp, P. troglodytes
tatggaaaatatttat

SEQ ID NO: 262848 - DNA, 16 bp, P. troglodytes
tatggaaacaaaaaag

SEQ ID NO: 262849 - DNA, 16 bp, P. troglodytes
tatggaaataaaacat

SEQ ID NO: 262850 - DNA, 16 bp, P. troglodytes
tatggaaccaataaag

SEQ ID NO: 262851 - DNA, 16 bp, P. troglodytes
tatggaaccatgaaag

SEQ ID NO: 262852 - DNA, 16 bp, P. troglodytes
tatggacactgaaatt

SEQ ID NO: 262853 - DNA, 16 bp, P. troglodytes
tatggacatttattag

SEQ ID NO: 262854 - DNA, 16 bp, P. troglodytes
tatggactgaatattt

SEQ ID NO: 262855 - DNA, 16 bp, P. troglodytes
tatggactgaattgtg

SEQ ID NO: 262856 - DNA, 16 bp, P. troglodytes
tatggactttggatga

SEQ ID NO: 262857 - DNA, 16 bp, P. troglodytes
tatggagaaacaggaa

SEQ ID NO: 262858 - DNA, 16 bp, P. troglodytes
tatggagaaagtttca

SEQ ID NO: 262859 - DNA, 16 bp, P. troglodytes
tatggagaaataggaa

SEQ ID NO: 262860 - DNA, 16 bp, P. troglodytes
tatggagaccaaggtt

SEQ ID NO: 262861 - DNA, 16 bp, P. troglodytes
tatggagcaacaggaa

SEQ ID NO: 262862 - DNA, 16 bp, P. troglodytes
tatggagccataaaaa

SEQ ID NO: 262863 - DNA, 16 bp, P. troglodytes
tatggataaagaaaat

SEQ ID NO: 262864 - DNA, 16 bp, P. troglodytes
tatggataaagctgct

SEQ ID NO: 262865 - DNA, 16 bp, P. troglodytes
tatggatatggatatg

SEQ ID NO: 262866 - DNA, 16 bp, P. troglodytes
tatggatgagaaaaca

SEQ ID NO: 262867 - DNA, 16 bp, P. troglodytes
tatggattagaagaat

SEQ ID NO: 262868 - DNA, 16 bp, P. troglodytes
tatggatttttaaaaa

SEQ ID NO: 262869 - DNA, 16 bp, P. troglodytes
tatggcaaaaaccaca

SEQ ID NO: 262870 - DNA, 16 bp, P. troglodytes
tatggcaagagataga

SEQ ID NO: 262871 - DNA, 16 bp, P. troglodytes
tatggcacatgtatac

SEQ ID NO: 262872 - DNA, 16 bp, P. troglodytes
tatggcagccctagca

SEQ ID NO: 262873 - DNA, 16 bp, P. troglodytes
tatggcctgcagaacc

SEQ ID NO: 262874 - DNA, 16 bp, P. troglodytes
tatggcctgcagtgca

SEQ ID NO: 262875 - DNA, 44 bp, P. troglodytes; identical to SEQ ID NO: 130427

SEQ ID NO: 262876 - DNA, 16 bp, P. troglodytes
tatgggactatgtaaa

SEQ ID NO: 262877 - DNA, 16 bp, P. troglodytes
tatgggctgaactgtg

SEQ ID NO: 262878 - DNA, 17 bp, P. troglodytes
tatgggctgggcacagt

SEQ ID NO: 262879 - DNA, 16 bp, P. troglodytes
tatgggggcagtttcc

SEQ ID NO: 262880 - DNA, 16 bp, P. troglodytes
tatgggttttaacaaa

SEQ ID NO: 262881 - DNA, 16 bp, P. troglodytes
tatgggttttgaaaaa

SEQ ID NO: 262882 - DNA, 16 bp, P. troglodytes
tatggtagaaaaggaa

SEQ ID NO: 262883 - DNA, 17 bp, P. troglodytes
tatggtagctcatgcct

SEQ ID NO: 262884 - DNA, 16 bp, P. troglodytes
tatggtagtcactagc

SEQ ID NO: 262885 - DNA, 16 bp, P. troglodytes
tatggtatgtaaatta

SEQ ID NO: 262886 - DNA, 16 bp, P. troglodytes
tatggtatgtgagtta

SEQ ID NO: 262887 - DNA, 16 bp, P. troglodytes
tatggtcaattgattt

SEQ ID NO: 262888 - DNA, 16 bp, P. troglodytes
tatggtctctgtgcag

SEQ ID NO: 262889 - DNA, 16 bp, P. troglodytes
tatggtgaaaatggaa

SEQ ID NO: 262890 - DNA, 16 bp, P. troglodytes
tatggtgaaacaccat

SEQ ID NO: 262891 - DNA, 29 bp, P. troglodytes
tatggtgaaaccccatctctactaaaaaa

SEQ ID NO: 262892 - DNA, 22 bp, P. troglodytes
tatggtgaaaccccgtctctat

SEQ ID NO: 262893 - DNA, 16 bp, P. troglodytes
tatggtggaaaaggga

SEQ ID NO: 262894 - DNA, 16 bp, P. troglodytes
tatggtggcatgtgcc

SEQ ID NO: 262895 - DNA, 17 bp, P. troglodytes
tatggtggctcatgcct

SEQ ID NO: 262896 - DNA, 16 bp, P. troglodytes
tatggtggtacatgcc

SEQ ID NO: 262897 - DNA, 16 bp, P. troglodytes
tatggtggtgggcacc

SEQ ID NO: 262898 - DNA, 16 bp, P. troglodytes
tatggtgtgaggtagg

SEQ ID NO: 262899 - DNA, 16 bp, P. troglodytes
tatggtttctactgaa

SEQ ID NO: 262900 - DNA, 16 bp, P. troglodytes
tatggtttggatttgc

SEQ ID NO: 262901 - DNA, 16 bp, P. troglodytes
tatggttttaaaaatg

SEQ ID NO: 262902 - DNA, 16 bp, P. troglodytes
tatggtttttctgtgt

SEQ ID NO: 262903 - DNA, 16 bp, P. troglodytes
tatgtaaaaaacctgc

SEQ ID NO: 262904 - DNA, 16 bp, P. troglodytes
tatgtaaaaatgaaag

SEQ ID NO: 262905 - DNA, 16 bp, P. troglodytes
tatgtaaaacatttac

SEQ ID NO: 262906 - DNA, 16 bp, P. troglodytes
tatgtaaaatatgtat

SEQ ID NO: 262907 - DNA, 16 bp, P. troglodytes
tatgtaaacaaatgag

SEQ ID NO: 262908 - DNA, 16 bp, P. troglodytes
tatgtaaacataaata

SEQ ID NO: 262909 - DNA, 16 bp, P. troglodytes
tatgtaaagaattctt

SEQ ID NO: 262910 - DNA, 16 bp, P. troglodytes
tatgtaaatatatatg

SEQ ID NO: 262911 - DNA, 16 bp, P. troglodytes
tatgtaaatatatgaa

SEQ ID NO: 262912 - DNA, 16 bp, P. troglodytes
tatgtaaatgaatgtg

SEQ ID NO: 262913 - DNA, 16 bp, P. troglodytes
tatgtaaatgtatata

SEQ ID NO: 262914 - DNA, 16 bp, P. troglodytes
tatgtaaattatgcct

SEQ ID NO: 262915 - DNA, 16 bp, P. troglodytes
tatgtaacaaaattgc

SEQ ID NO: 262916 - DNA, 16 bp, P. troglodytes
tatgtaacaaacatgc

SEQ ID NO: 262917 - DNA, 16 bp, P. troglodytes
tatgtaacaaacctgt

SEQ ID NO: 262918 - DNA, 18 bp, P. troglodytes
tatgtaactaacctgcac

SEQ ID NO: 262919 - DNA, 16 bp, P. troglodytes
tatgtaagaagtacat

SEQ ID NO: 262920 - DNA, 16 bp, P. troglodytes
tatgtaagatgtacat

SEQ ID NO: 262921 - DNA, 16 bp, P. troglodytes
tatgtaataaacatat

SEQ ID NO: 262922 - DNA, 16 bp, P. troglodytes
tatgtaatactatata

SEQ ID NO: 262923 - DNA, 16 bp, P. troglodytes
tatgtaatatatgtaa

SEQ ID NO: 262924 - DNA, 16 bp, P. troglodytes
tatgtacaaatatgta

SEQ ID NO: 262925 - DNA, 16 bp, P. troglodytes
tatgtacaacattttc

SEQ ID NO: 262926 - DNA, 16 bp, P. troglodytes
tatgtacagaaaaaaa

SEQ ID NO: 262927 - DNA, 16 bp, P. troglodytes
tatgtacataaatatg

SEQ ID NO: 262928 - DNA, 16 bp, P. troglodytes
tatgtacatacatatg

SEQ ID NO: 262929 - DNA, 16 bp, P. troglodytes
tatgtacatgtacaca

SEQ ID NO: 262930 - DNA, 16 bp, P. troglodytes
tatgtacattttatat

SEQ ID NO: 262931 - DNA, 16 bp, P. troglodytes
tatgtaccacatttgc

SEQ ID NO: 262932 - DNA, 16 bp, P. troglodytes
tatgtaccaggctctg

SEQ ID NO: 262933 - DNA, 16 bp, P. troglodytes
tatgtaccatgttttc

SEQ ID NO: 262934 - DNA, 16 bp, P. troglodytes
tatgtacccaaaggaa

SEQ ID NO: 262935 - DNA, 16 bp, P. troglodytes
tatgtacccacaaaaa

SEQ ID NO: 262936 - DNA, 16 bp, P. troglodytes
tatgtacttaaaatat

SEQ ID NO: 262937 - DNA, 16 bp, P. troglodytes
tatgtagaaaacccca

SEQ ID NO: 262938 - DNA, 16 bp, P. troglodytes
tatgtagtttttaaaa

SEQ ID NO: 262939 - DNA, 16 bp, P. troglodytes
tatgtataagtatata

SEQ ID NO: 262940 - DNA, 16 bp, P. troglodytes
tatgtatacatttgta

SEQ ID NO: 262941 - DNA, 16 bp, P. troglodytes
tatgtatatacaaaat

SEQ ID NO: 262942 - DNA, 16 bp, P. troglodytes
tatgtatatacacaca

SEQ ID NO: 262943 - DNA, 16 bp, P. troglodytes
tatgtatatagatatg

SEQ ID NO: 262944 - DNA, 16 bp, P. troglodytes
tatgtatatagtatgt

SEQ ID NO: 262945 - DNA, 16 bp, P. troglodytes
tatgtatatataagaa

SEQ ID NO: 262946 - DNA, 16 bp, P. troglodytes
tatgtatatatatcta

SEQ ID NO: 262947 - DNA, 16 bp, P. troglodytes
tatgtatatatatgta

SEQ ID NO: 262948 - DNA, 16 bp, P. troglodytes
tatgtatatatgtgat

SEQ ID NO: 262949 - DNA, 16 bp, P. troglodytes
tatgtatatatgtgta

SEQ ID NO: 262950 - DNA, 16 bp, P. troglodytes
tatgtatatattttca

SEQ ID NO: 262951 - DNA, 16 bp, P. troglodytes
tatgtatatctatata

SEQ ID NO: 262952 - DNA, 16 bp, P. troglodytes
tatgtatatgtataca

SEQ ID NO: 262953 - DNA, 16 bp, P. troglodytes
tatgtatatgtatgtg

SEQ ID NO: 262954 - DNA, 16 bp, P. troglodytes
tatgtatatgtgatat

SEQ ID NO: 262955 - DNA, 16 bp, P. troglodytes
tatgtatattgcagca

SEQ ID NO: 262956 - DNA, 16 bp, P. troglodytes
tatgtatctagaaatt

SEQ ID NO: 262957 - DNA, 16 bp, P. troglodytes
tatgtatctatttatt

SEQ ID NO: 262958 - DNA, 16 bp, P. troglodytes
tatgtatctcatatat

SEQ ID NO: 262959 - DNA, 16 bp, P. troglodytes
tatgtatctgtgtgtg

SEQ ID NO: 262960 - DNA, 16 bp, P. troglodytes
tatgtatgaatataca

SEQ ID NO: 262961 - DNA, 16 bp, P. troglodytes
tatgtatgtaaaatat

SEQ ID NO: 262962 - DNA, 16 bp, P. troglodytes
tatgtatgtataaata

SEQ ID NO: 262963 - DNA, 16 bp, P. troglodytes
tatgtatgtatgtatc

SEQ ID NO: 262964 - DNA, 16 bp, P. troglodytes
tatgtatgtatgtatt

SEQ ID NO: 262965 - DNA, 16 bp, P. troglodytes
tatgtatgtgaatata

SEQ ID NO: 262966 - DNA, 16 bp, P. troglodytes
tatgtatgtgtaaata

SEQ ID NO: 262967 - DNA, 16 bp, P. troglodytes
tatgtatgttatactt

SEQ ID NO: 262968 - DNA, 16 bp, P. troglodytes
tatgtattatctcaca

SEQ ID NO: 262969 - DNA, 16 bp, P. troglodytes
tatgtattattttcta

SEQ ID NO: 262970 - DNA, 16 bp, P. troglodytes
tatgtattcacaaaga

SEQ ID NO: 262971 - DNA, 16 bp, P. troglodytes
tatgtattctttaaaa

SEQ ID NO: 262972 - DNA, 16 bp, P. troglodytes
tatgtattgtaaatat

SEQ ID NO: 262973 - DNA, 16 bp, P. troglodytes
tatgtatttaaaaaca

SEQ ID NO: 262974 - DNA, 16 bp, P. troglodytes
tatgtatttatcattt

SEQ ID NO: 262975 - DNA, 16 bp, P. troglodytes
tatgtatttcatcttt

SEQ ID NO: 262976 - DNA, 16 bp, P. troglodytes
tatgtatttgtatagt

SEQ ID NO: 262977 - DNA, 16 bp, P. troglodytes
tatgtatttgtcaaaa

SEQ ID NO: 262978 - DNA, 16 bp, P. troglodytes
tatgtattttcttaaa

SEQ ID NO: 262979 - DNA, 16 bp, P. troglodytes
tatgtcaaagggacac

SEQ ID NO: 262980 - DNA, 16 bp, P. troglodytes
tatgtcaagtaatttt

SEQ ID NO: 262981 - DNA, 16 bp, P. troglodytes
tatgtcagtatgttca

SEQ ID NO: 262982 - DNA, 16 bp, P. troglodytes
tatgtcataatttttt

SEQ ID NO: 262983 - DNA, 16 bp, P. troglodytes
tatgtcatatatatgt

SEQ ID NO: 262984 - DNA, 16 bp, P. troglodytes
tatgtcattaaacatc

SEQ ID NO: 262985 - DNA, 16 bp, P. troglodytes
tatgtcatttaaaatt

SEQ ID NO: 262986 - DNA, 16 bp, P. troglodytes
tatgtcatttatttat

SEQ ID NO: 262987 - DNA, 16 bp, P. troglodytes
tatgtccatgtgttct

SEQ ID NO: 262988 - DNA, 16 bp, P. troglodytes
tatgtcctgagtggta

SEQ ID NO: 262989 - DNA, 16 bp, P. troglodytes
tatgtctgttttcatg

SEQ ID NO: 262990 - DNA, 16 bp, P. troglodytes
tatgtcttctgagaaa

SEQ ID NO: 262991 - DNA, 16 bp, P. troglodytes
tatgtctttatcagca

SEQ ID NO: 262992 - DNA, 16 bp, P. troglodytes
tatgtctttattagca

SEQ ID NO: 262993 - DNA, 16 bp, P. troglodytes
tatgtctttggttttg

SEQ ID NO: 262994 - DNA, 16 bp, P. troglodytes
tatgtctttttaatat

SEQ ID NO: 262995 - DNA, 16 bp, P. troglodytes
tatgtgaaaagaaaat

SEQ ID NO: 262996 - DNA, 18 bp, P. troglodytes
tatgtgaaaagaccaaac

SEQ ID NO: 262997 - DNA, 16 bp, P. troglodytes
tatgtgaattatgtct

SEQ ID NO: 262998 - DNA, 16 bp, P. troglodytes
tatgtgaatttttaaa

SEQ ID NO: 262999 - DNA, 16 bp, P. troglodytes
tatgtgaccttggaaa

SEQ ID NO: 263000 - DNA, 16 bp, P. troglodytes
tatgtgaccttgggca

SEQ ID NO: 263001 - DNA, 16 bp, P. troglodytes
tatgtgatcttttgtg

SEQ ID NO: 263002 - DNA, 16 bp, P. troglodytes
tatgtgattgatttta

SEQ ID NO: 263003 - DNA, 16 bp, P. troglodytes
tatgtgattttaaaat

SEQ ID NO: 263004 - DNA, 16 bp, P. troglodytes
tatgtgcacatgtgtg

SEQ ID NO: 263005 - DNA, 16 bp, P. troglodytes
tatgtgcatgtatctt

SEQ ID NO: 263006 - DNA, 16 bp, P. troglodytes
tatgtgcatgtgtgtg

SEQ ID NO: 263007 - DNA, 16 bp, P. troglodytes
tatgtgccaagcattg

SEQ ID NO: 263008 - DNA, 16 bp, P. troglodytes
tatgtgccagatattg

SEQ ID NO: 263009 - DNA, 16 bp, P. troglodytes
tatgtgccaggcacta

SEQ ID NO: 263010 - DNA, 16 bp, P. troglodytes
tatgtgcctgtgtgtg

SEQ ID NO: 263011 - DNA, 16 bp, P. troglodytes
tatgtgctagacactg

SEQ ID NO: 263012 - DNA, 16 bp, P. troglodytes
tatgtggactcttttt

SEQ ID NO: 263013 - DNA, 16 bp, P. troglodytes
tatgtggcagacactg

SEQ ID NO: 263014 - DNA, 16 bp, P. troglodytes
tatgtgggaactctct

SEQ ID NO: 263015 - DNA, 16 bp, P. troglodytes
tatgtgggtttatttc

SEQ ID NO: 263016 - DNA, 21 bp, P. troglodytes
tatgtggtcaattttggaata

SEQ ID NO: 263017 - DNA, 16 bp, P. troglodytes
tatgtgtaatatatat

SEQ ID NO: 263018 - DNA, 16 bp, P. troglodytes
tatgtgtacatacaca

SEQ ID NO: 263019 - DNA, 16 bp, P. troglodytes
tatgtgtataaatata

SEQ ID NO: 263020 - DNA, 16 bp, P. troglodytes
tatgtgtatacatata

SEQ ID NO: 263021 - DNA, 16 bp, P. troglodytes
tatgtgtatatatgtt

SEQ ID NO: 263022 - DNA, 16 bp, P. troglodytes
tatgtgtatgtatacg

SEQ ID NO: 263023 - DNA, 19 bp, P. troglodytes
tatgtgtatgtatgtatat

SEQ ID NO: 263024 - DNA, 16 bp, P. troglodytes
tatgtgtccaggaatt

SEQ ID NO: 263025 - DNA, 16 bp, P. troglodytes
tatgtgtgaatgtgtg

SEQ ID NO: 263026 - DNA, 16 bp, P. troglodytes
tatgtgtgtatatgtg

SEQ ID NO: 263027 - DNA, 16 bp, P. troglodytes
tatgtgtgtatattca

SEQ ID NO: 263028 - DNA, 16 bp, P. troglodytes
tatgtgtgtatgtata

SEQ ID NO: 263029 - DNA, 16 bp, P. troglodytes
tatgtgtgtatgtgaa

SEQ ID NO: 263030 - DNA, 16 bp, P. troglodytes
tatgtgtgtgcatata

SEQ ID NO: 263031 - DNA, 16 bp, P. troglodytes
tatgtgtgtgcatgtg

SEQ ID NO: 263032 - DNA, 16 bp, P. troglodytes
tatgtgtgtgtatgtc

SEQ ID NO: 263033 - DNA, 16 bp, P. troglodytes
tatgtgtgtgtatgtg

SEQ ID NO: 263034 - DNA, 16 bp, P. troglodytes
tatgtgtgtgtgcaca

SEQ ID NO: 263035 - DNA, 16 bp, P. troglodytes
tatgtgtgtgtgcgtg

SEQ ID NO: 263036 - DNA, 16 bp, P. troglodytes
tatgtgtgttttaaaa

SEQ ID NO: 263037 - DNA, 16 bp, P. troglodytes
tatgtgtttgtgcatg

SEQ ID NO: 263038 - DNA, 16 bp, P. troglodytes
tatgttaaataagagt

SEQ ID NO: 263039 - DNA, 16 bp, P. troglodytes
tatgttaattatacct

SEQ ID NO: 263040 - DNA, 16 bp, P. troglodytes
tatgttacatttattt

SEQ ID NO: 263041 - DNA, 16 bp, P. troglodytes
tatgttatgtgcattt

SEQ ID NO: 263042 - DNA, 16 bp, P. troglodytes
tatgttattgatgtca

SEQ ID NO: 263043 - DNA, 16 bp, P. troglodytes
tatgttattggtaagg

SEQ ID NO: 263044 - DNA, 16 bp, P. troglodytes
tatgttcactatctgg

SEQ ID NO: 263045 - DNA, 16 bp, P. troglodytes
tatgttccagacactg

SEQ ID NO: 263046 - DNA, 16 bp, P. troglodytes
tatgttccaggcattg

SEQ ID NO: 263047 - DNA, 16 bp, P. troglodytes
tatgttctataaagtt

SEQ ID NO: 263048 - DNA, 16 bp, P. troglodytes
tatgttctcaataaat

SEQ ID NO: 263049 - DNA, 16 bp, P. troglodytes
tatgttctgttccatt

SEQ ID NO: 263050 - DNA, 16 bp, P. troglodytes
tatgttctttaaaaaa

SEQ ID NO: 263051 - DNA, 16 bp, P. troglodytes
tatgttgaaacctaat

SEQ ID NO: 263052 - DNA, 16 bp, P. troglodytes
tatgttgaaatactaa

SEQ ID NO: 263053 - DNA, 16 bp, P. troglodytes
tatgttgaaatcctaa

SEQ ID NO: 263054 - DNA, 16 bp, P. troglodytes
tatgttgaagtcttaa

SEQ ID NO: 263055 - DNA, 16 bp, P. troglodytes
tatgttgcccacgctg

SEQ ID NO: 263056 - DNA, 16 bp, P. troglodytes
tatgttgcccagacta

SEQ ID NO: 263057 - DNA, 16 bp, P. troglodytes
tatgttgcccaggctc

SEQ ID NO: 263058 - DNA, 16 bp, P. troglodytes
tatgttgcccaggttg

SEQ ID NO: 263059 - DNA, 16 bp, P. troglodytes
tatgttggccaggcag

SEQ ID NO: 263060 - DNA, 16 bp, P. troglodytes
tatgttggctgtgagt

SEQ ID NO: 263061 - DNA, 16 bp, P. troglodytes
tatgtttaaagtaatt

SEQ ID NO: 263062 - DNA, 16 bp, P. troglodytes
tatgtttacaattgtt

SEQ ID NO: 263063 - DNA, 16 bp, P. troglodytes
tatgtttacatattat

SEQ ID NO: 263064 - DNA, 16 bp, P. troglodytes
tatgtttacttttata

SEQ ID NO: 263065 - DNA, 16 bp, P. troglodytes
tatgtttagatatgca

SEQ ID NO: 263066 - DNA, 16 bp, P. troglodytes
tatgtttatatacaca

SEQ ID NO: 263067 - DNA, 16 bp, P. troglodytes
tatgtttatcacagta

SEQ ID NO: 263068 - DNA, 16 bp, P. troglodytes
tatgtttatcgcggca

SEQ ID NO: 263069 - DNA, 16 bp, P. troglodytes
tatgtttattgcggca

SEQ ID NO: 263070 - DNA, 16 bp, P. troglodytes
tatgtttattgtggca

SEQ ID NO: 263071 - DNA, 16 bp, P. troglodytes
tatgtttctagaaatt

SEQ ID NO: 263072 - DNA, 16 bp, P. troglodytes
tatgtttctctccacc

SEQ ID NO: 263073 - DNA, 16 bp, P. troglodytes
tatgtttcttggccac

SEQ ID NO: 263074 - DNA, 16 bp, P. troglodytes
tatgtttctttttaaa

SEQ ID NO: 263075 - DNA, 16 bp, P. troglodytes
tatgtttgtgagattt

SEQ ID NO: 263076 - DNA, 16 bp, P. troglodytes
tatgttttcagaaatt

SEQ ID NO: 263077 - DNA, 16 bp, P. troglodytes
tatgttttcattttga

SEQ ID NO: 263078 - DNA, 16 bp, P. troglodytes
tatgttttcttccaga

SEQ ID NO: 263079 - DNA, 16 bp, P. troglodytes
tatgttttgaagtcag

SEQ ID NO: 263080 - DNA, 16 bp, P. troglodytes
tatgttttgtttccat

SEQ ID NO: 263081 - DNA, 16 bp, P. troglodytes
tatgtttttcaaaata

SEQ ID NO: 263082 - DNA, 16 bp, P. troglodytes
tatgttttttaaaaag

SEQ ID NO: 263083 - DNA, 16 bp, P. troglodytes
tattaaaaagtaaaca

SEQ ID NO: 263084 - DNA, 16 bp, P. troglodytes
tattaaaaagtcacaa

SEQ ID NO: 263085 - DNA, 16 bp, P. troglodytes
tattaaaaagtctaaa

SEQ ID NO: 263086 - DNA, 16 bp, P. troglodytes
tattaaaaatagcaaa

SEQ ID NO: 263087 - DNA, 16 bp, P. troglodytes
tattaaaacagaaaat

SEQ ID NO: 263088 - DNA, 16 bp, P. troglodytes
tattaaaactgaaaat

SEQ ID NO: 263089 - DNA, 16 bp, P. troglodytes
tattaaaactgataaa

SEQ ID NO: 263090 - DNA, 16 bp, P. troglodytes
tattaaaactgatttt

SEQ ID NO: 263091 - DNA, 16 bp, P. troglodytes
tattaaaaggattata

SEQ ID NO: 263092 - DNA, 16 bp, P. troglodytes
tattaaaatcctcctc

SEQ ID NO: 263093 - DNA, 16 bp, P. troglodytes
tattaaaatgcatttt

SEQ ID NO: 263094 - DNA, 16 bp, P. troglodytes
tattaaaatgtattca

SEQ ID NO: 263095 - DNA, 16 bp, P. troglodytes
tattaaaattcacatt

SEQ ID NO: 263096 - DNA, 16 bp, P. troglodytes
tattaaaattccaatg

SEQ ID NO: 263097 - DNA, 16 bp, P. troglodytes
tattaaacatttacca

SEQ ID NO: 263098 - DNA, 16 bp, P. troglodytes
tattaaagaaactgaa

SEQ ID NO: 263099 - DNA, 16 bp, P. troglodytes
tattaaagacttaaat

SEQ ID NO: 263100 - DNA, 16 bp, P. troglodytes
tattaaagagactgtt

SEQ ID NO: 263101 - DNA, 16 bp, P. troglodytes
tattaaaggcattcag

SEQ ID NO: 263102 - DNA, 16 bp, P. troglodytes
tattaaaggctgtaaa

SEQ ID NO: 263103 - DNA, 16 bp, P. troglodytes
tattaaatactgtatt

SEQ ID NO: 263104 - DNA, 16 bp, P. troglodytes
tattaaatattttcag

SEQ ID NO: 263105 - DNA, 16 bp, P. troglodytes
tattaaatgtgcaata

SEQ ID NO: 263106 - DNA, 16 bp, P. troglodytes
tattaaatgtttcttt

SEQ ID NO: 263107 - DNA, 16 bp, P. troglodytes
tattaacccatcacct

SEQ ID NO: 263108 - DNA, 16 bp, P. troglodytes
tattaaccttaaaggt

SEQ ID NO: 263109 - DNA, 16 bp, P. troglodytes
tattaactacactaga

SEQ ID NO: 263110 - DNA, 16 bp, P. troglodytes
tattaactcattaaat

SEQ ID NO: 263111 - DNA, 16 bp, P. troglodytes
tattaactcattgaat

SEQ ID NO: 263112 - DNA, 16 bp, P. troglodytes
tattaactcatttaat

SEQ ID NO: 263113 - DNA, 16 bp, P. troglodytes
tattaactccatttta

SEQ ID NO: 263114 - DNA, 16 bp, P. troglodytes
tattaactctttatca

SEQ ID NO: 263115 - DNA, 16 bp, P. troglodytes
tattaagtggaagtgg

SEQ ID NO: 263116 - DNA, 16 bp, P. troglodytes
tattaagtgttcaata

SEQ ID NO: 263117 - DNA, 16 bp, P. troglodytes
tattaatagtaacaat

SEQ ID NO: 263118 - DNA, 16 bp, P. troglodytes
tattaatatagccact

SEQ ID NO: 263119 - DNA, 16 bp, P. troglodytes
tattaatccattttca

SEQ ID NO: 263120 - DNA, 16 bp, P. troglodytes
tattaatcttttgtca

SEQ ID NO: 263121 - DNA, 16 bp, P. troglodytes
tattaattcttctgat

SEQ ID NO: 263122 - DNA, 16 bp, P. troglodytes
tattacaaaagaagaa

SEQ ID NO: 263123 - DNA, 16 bp, P. troglodytes
tattacaaacaatatt

SEQ ID NO: 263124 - DNA, 16 bp, P. troglodytes
tattacaaataaagat

SEQ ID NO: 263125 - DNA, 16 bp, P. troglodytes
tattacaaataaagct

SEQ ID NO: 263126 - DNA, 16 bp, P. troglodytes
tattacaaatgaaaaa

SEQ ID NO: 263127 - DNA, 16 bp, P. troglodytes
tattacaaatgaggaa

SEQ ID NO: 263128 - DNA, 16 bp, P. troglodytes
tattacaataaagtaa

SEQ ID NO: 263129 - DNA, 16 bp, P. troglodytes
tattacacattttaaa

SEQ ID NO: 263130 - DNA, 16 bp, P. troglodytes
tattacagatgaagaa

SEQ ID NO: 263131 - DNA, 16 bp, P. troglodytes
tattaccaaggctttg

SEQ ID NO: 263132 - DNA, 16 bp, P. troglodytes
tattaccacattttct

SEQ ID NO: 263133 - DNA, 16 bp, P. troglodytes
tattacccctatttta

SEQ ID NO: 263134 - DNA, 16 bp, P. troglodytes
tattacctgagtgaca

SEQ ID NO: 263135 - DNA, 16 bp, P. troglodytes
tattacctttaaaaaa

SEQ ID NO: 263136 - DNA, 16 bp, P. troglodytes
tattactattattgta

SEQ ID NO: 263137 - DNA, 16 bp, P. troglodytes
tattactcaagaaata

SEQ ID NO: 263138 - DNA, 16 bp, P. troglodytes
tattactcccatttta

SEQ ID NO: 263139 - DNA, 16 bp, P. troglodytes
tattactgaataatat

SEQ ID NO: 263140 - DNA, 16 bp, P. troglodytes
tattactgcctcagtt

SEQ ID NO: 263141 - DNA, 16 bp, P. troglodytes
tattactgtctttatt

SEQ ID NO: 263142 - DNA, 16 bp, P. troglodytes
tattagaaacattttt

SEQ ID NO: 263143 - DNA, 16 bp, P. troglodytes
tattagacaaaacaga

SEQ ID NO: 263144 - DNA, 16 bp, P. troglodytes
tattagatattttcct

SEQ ID NO: 263145 - DNA, 16 bp, P. troglodytes
tattagcctgtaattt

SEQ ID NO: 263146 - DNA, 17 bp, P. troglodytes
tattagctgggcatggt

SEQ ID NO: 263147 - DNA, 16 bp, P. troglodytes
tattagtcaaggttct

SEQ ID NO: 263148 - DNA, 16 bp, P. troglodytes
tattagtcagggttct

SEQ ID NO: 263149 - DNA, 16 bp, P. troglodytes
tattagtccattttca

SEQ ID NO: 263150 - DNA, 16 bp, P. troglodytes
tattagtccgttttca

SEQ ID NO: 263151 - DNA, 16 bp, P. troglodytes
tattagtctgttctca

SEQ ID NO: 263152 - DNA, 16 bp, P. troglodytes
tattagtctgttttca

SEQ ID NO: 263153 - DNA, 16 bp, P. troglodytes
tattataaacaacact

SEQ ID NO: 263154 - DNA, 16 bp, P. troglodytes
tattataaaggataca

SEQ ID NO: 263155 - DNA, 16 bp, P. troglodytes
tattatacatacacat

SEQ ID NO: 263156 - DNA, 16 bp, P. troglodytes
tattataggcatgagc

SEQ ID NO: 263157 - DNA, 16 bp, P. troglodytes
tattatatatacatac

SEQ ID NO: 263158 - DNA, 16 bp, P. troglodytes
tattatatatgatcat

SEQ ID NO: 263159 - DNA, 16 bp, P. troglodytes
tattatatcaaaaaga

SEQ ID NO: 263160 - DNA, 16 bp, P. troglodytes
tattatatcacaatat

SEQ ID NO: 263161 - DNA, 16 bp, P. troglodytes
tattatatgctgtatt

SEQ ID NO: 263162 - DNA, 16 bp, P. troglodytes
tattatatgtacatat

SEQ ID NO: 263163 - DNA, 16 bp, P. troglodytes
tattatatgtagatat

SEQ ID NO: 263164 - DNA, 16 bp, P. troglodytes
tattatcacaccactg

SEQ ID NO: 263165 - DNA, 16 bp, P. troglodytes
tattatcaccatcatt

SEQ ID NO: 263166 - DNA, 16 bp, P. troglodytes
tattatcagtattatt

SEQ ID NO: 263167 - DNA, 16 bp, P. troglodytes
tattatcattcagttc

SEQ ID NO: 263168 - DNA, 16 bp, P. troglodytes
tattatccaggctggt

SEQ ID NO: 263169 - DNA, 16 bp, P. troglodytes
tattatcccatttaat

SEQ ID NO: 263170 - DNA, 16 bp, P. troglodytes
tattatccctatttta

SEQ ID NO: 263171 - DNA, 16 bp, P. troglodytes
tattatcctcatttta

SEQ ID NO: 263172 - DNA, 16 bp, P. troglodytes
tattatctccattttg

SEQ ID NO: 263173 - DNA, 16 bp, P. troglodytes
tattatctgtatttta

SEQ ID NO: 263174 - DNA, 16 bp, P. troglodytes
tattatgaatgatgct

SEQ ID NO: 263175 - DNA, 16 bp, P. troglodytes
tattatgcagctatta

SEQ ID NO: 263176 - DNA, 16 bp, P. troglodytes
tattatgcataatgct

SEQ ID NO: 263177 - DNA, 16 bp, P. troglodytes
tattatgccatgaatt

SEQ ID NO: 263178 - DNA, 16 bp, P. troglodytes
tattatgtacatatat

SEQ ID NO: 263179 - DNA, 16 bp, P. troglodytes
tattatgtacattata

SEQ ID NO: 263180 - DNA, 16 bp, P. troglodytes
tattatgtacatttta

SEQ ID NO: 263181 - DNA, 16 bp, P. troglodytes
tattatgttgagtgaa

SEQ ID NO: 263182 - DNA, 16 bp, P. troglodytes
tattatgttgatgtat

SEQ ID NO: 263183 - DNA, 16 bp, P. troglodytes
tattattattgcattg

SEQ ID NO: 263184 - DNA, 16 bp, P. troglodytes
tattattattgtcatc

SEQ ID NO: 263185 - DNA, 16 bp, P. troglodytes
tattattattttcaga

SEQ ID NO: 263186 - DNA, 16 bp, P. troglodytes
tattattatttttgcc

SEQ ID NO: 263187 - DNA, 16 bp, P. troglodytes
tattattctgtccctg

SEQ ID NO: 263188 - DNA, 16 bp, P. troglodytes
tattattgaagaaaat

SEQ ID NO: 263189 - DNA, 16 bp, P. troglodytes
tattattgactataat

SEQ ID NO: 263190 - DNA, 16 bp, P. troglodytes
tattattgataagtaa

SEQ ID NO: 263191 - DNA, 16 bp, P. troglodytes
tattattgctgtttta

SEQ ID NO: 263192 - DNA, 16 bp, P. troglodytes
tattattggctgtaca

SEQ ID NO: 263193 - DNA, 16 bp, P. troglodytes
tattattgtgtgagag

SEQ ID NO: 263194 - DNA, 16 bp, P. troglodytes
tattatttatatctgt

SEQ ID NO: 263195 - DNA, 16 bp, P. troglodytes
tattatttctccttca

SEQ ID NO: 263196 - DNA, 16 bp, P. troglodytes
tattatttctttgaat

SEQ ID NO: 263197 - DNA, 16 bp, P. troglodytes
tattatttgcatataa

SEQ ID NO: 263198 - DNA, 16 bp, P. troglodytes
tattattttaaatgtc

SEQ ID NO: 263199 - DNA, 16 bp, P. troglodytes
tattattttccaaaat

SEQ ID NO: 263200 - DNA, 16 bp, P. troglodytes
tattattttgaaatac

SEQ ID NO: 263201 - DNA, 16 bp, P. troglodytes
tattattttgagaaat

SEQ ID NO: 263202 - DNA, 16 bp, P. troglodytes
tattattttgcttaat

SEQ ID NO: 263203 - DNA, 16 bp, P. troglodytes
tattattttgttctca

SEQ ID NO: 263204 - DNA, 16 bp, P. troglodytes
tattatttttgaaaca

SEQ ID NO: 263205 - DNA, 16 bp, P. troglodytes
tattatttttgagatg

SEQ ID NO: 263206 - DNA, 16 bp, P. troglodytes
tattatttttttccag

SEQ ID NO: 263207 - DNA, 16 bp, P. troglodytes
tattcaaaggaaaaga

SEQ ID NO: 263208 - DNA, 16 bp, P. troglodytes
tattcaaataggaaaa

SEQ ID NO: 263209 - DNA, 16 bp, P. troglodytes
tattcaacagagtatt

SEQ ID NO: 263210 - DNA, 16 bp, P. troglodytes
tattcaacatagtatg

SEQ ID NO: 263211 - DNA, 16 bp, P. troglodytes
tattcaacatagtcct

SEQ ID NO: 263212 - DNA, 16 bp, P. troglodytes
tattcaactcattaat

SEQ ID NO: 263213 - DNA, 16 bp, P. troglodytes
tattcaagaaaataga

SEQ ID NO: 263214 - DNA, 16 bp, P. troglodytes
tattcaagaaatattt

SEQ ID NO: 263215 - DNA, 16 bp, P. troglodytes
tattcaagaaatcatt

SEQ ID NO: 263216 - DNA, 16 bp, P. troglodytes
tattcaagatggagtc

SEQ ID NO: 263217 - DNA, 16 bp, P. troglodytes
tattcaagtgaaagga

SEQ ID NO: 263218 - DNA, 16 bp, P. troglodytes
tattcaataaatgata

SEQ ID NO: 263219 - DNA, 16 bp, P. troglodytes
tattcaataaatggtg

SEQ ID NO: 263220 - DNA, 16 bp, P. troglodytes
tattcaatgaacattt

SEQ ID NO: 263221 - DNA, 16 bp, P. troglodytes
tattcaattcaattca

SEQ ID NO: 263222 - DNA, 16 bp, P. troglodytes
tattcacaatagccaa

SEQ ID NO: 263223 - DNA, 16 bp, P. troglodytes
tattcacacaatggaa

SEQ ID NO: 263224 - DNA, 16 bp, P. troglodytes
tattcacaggcatgat

SEQ ID NO: 263225 - DNA, 16 bp, P. troglodytes
tattcacagtagccaa

SEQ ID NO: 263226 - DNA, 16 bp, P. troglodytes
tattcaccattacagt

SEQ ID NO: 263227 - DNA, 16 bp, P. troglodytes
tattcacctgacctct

SEQ ID NO: 263228 - DNA, 16 bp, P. troglodytes
tattcacctgttgatg

SEQ ID NO: 263229 - DNA, 16 bp, P. troglodytes
tattcactattgtgag

SEQ ID NO: 263230 - DNA, 16 bp, P. troglodytes
tattcactcattcatt

SEQ ID NO: 263231 - DNA, 16 bp, P. troglodytes
tattcagaaaatattt

SEQ ID NO: 263232 - DNA, 16 bp, P. troglodytes
tattcagaatatatga

SEQ ID NO: 263233 - DNA, 16 bp, P. troglodytes
tattcagagattgaac

SEQ ID NO: 263234 - DNA, 16 bp, P. troglodytes
tattcagatgttttgc

SEQ ID NO: 263235 - DNA, 16 bp, P. troglodytes
tattcagattgtctat

SEQ ID NO: 263236 - DNA, 16 bp, P. troglodytes
tattcagatttcacta

SEQ ID NO: 263237 - DNA, 16 bp, P. troglodytes
tattcagatttctcca

SEQ ID NO: 263238 - DNA, 16 bp, P. troglodytes
tattcagcaacaaaaa

SEQ ID NO: 263239 - DNA, 16 bp, P. troglodytes
tattcagcaagaaaaa

SEQ ID NO: 263240 - DNA, 16 bp, P. troglodytes
tattcagcaattaaaa

SEQ ID NO: 263241 - DNA, 16 bp, P. troglodytes
tattcagcactaaaaa

SEQ ID NO: 263242 - DNA, 16 bp, P. troglodytes
tattcagcattgtact

SEQ ID NO: 263243 - DNA, 16 bp, P. troglodytes
tattcagcctgaagaa

SEQ ID NO: 263244 - DNA, 16 bp, P. troglodytes
tattcagctatgaaaa

SEQ ID NO: 263245 - DNA, 16 bp, P. troglodytes
tattcagcttttaaaa

SEQ ID NO: 263246 - DNA, 16 bp, P. troglodytes
tattcaggagacacat

SEQ ID NO: 263247 - DNA, 16 bp, P. troglodytes
tattcaggcaacaact

SEQ ID NO: 263248 - DNA, 16 bp, P. troglodytes
tattcagtcataaaag

SEQ ID NO: 263249 - DNA, 16 bp, P. troglodytes
tattcagtgaaaggct

SEQ ID NO: 263250 - DNA, 16 bp, P. troglodytes
tattcagtttttccag

SEQ ID NO: 263251 - DNA, 16 bp, P. troglodytes
tattcataaggaatat

SEQ ID NO: 263252 - DNA, 16 bp, P. troglodytes
tattcatagcagtttt

SEQ ID NO: 263253 - DNA, 16 bp, P. troglodytes
tattcatatatataca

SEQ ID NO: 263254 - DNA, 16 bp, P. troglodytes
tattcatcaattaaaa

SEQ ID NO: 263255 - DNA, 16 bp, P. troglodytes
tattcatccctccctc

SEQ ID NO: 263256 - DNA, 16 bp, P. troglodytes
tattcatcttttcaaa

SEQ ID NO: 263257 - DNA, 16 bp, P. troglodytes
tattcatgtattattt

SEQ ID NO: 263258 - DNA, 16 bp, P. troglodytes
tattcattaaatgaat

SEQ ID NO: 263259 - DNA, 16 bp, P. troglodytes
tattcattaagtgaaa

SEQ ID NO: 263260 - DNA, 16 bp, P. troglodytes
tattcattcactcact

SEQ ID NO: 263261 - DNA, 16 bp, P. troglodytes
tattcattcacttaaa

SEQ ID NO: 263262 - DNA, 16 bp, P. troglodytes
tattcattcagtcatt

SEQ ID NO: 263263 - DNA, 16 bp, P. troglodytes
tattcattcattcaga

SEQ ID NO: 263264 - DNA, 16 bp, P. troglodytes
tattcattctgccatt

SEQ ID NO: 263265 - DNA, 16 bp, P. troglodytes
tattcattgaatgcct

SEQ ID NO: 263266 - DNA, 16 bp, P. troglodytes
tattcatttatcaaaa

SEQ ID NO: 263267 - DNA, 19 bp, P. troglodytes
tattccaaaattgaccaca

SEQ ID NO: 263268 - DNA, 21 bp, P. troglodytes
tattccaaaattgaccacata

SEQ ID NO: 263269 - DNA, 16 bp, P. troglodytes
tattccaaagtatttt

SEQ ID NO: 263270 - DNA, 16 bp, P. troglodytes
tattccatagtgtgtg

SEQ ID NO: 263271 - DNA, 16 bp, P. troglodytes
tattccatggtatata

SEQ ID NO: 263272 - DNA, 16 bp, P. troglodytes
tattccatgtgtatat

SEQ ID NO: 263273 - DNA, 16 bp, P. troglodytes
tattccattgtataga

SEQ ID NO: 263274 - DNA, 16 bp, P. troglodytes
tattccattttaaaat

SEQ ID NO: 263275 - DNA, 16 bp, P. troglodytes
tattcccatcaaacta

SEQ ID NO: 263276 - DNA, 16 bp, P. troglodytes
tattcccattttataa

SEQ ID NO: 263277 - DNA, 20 bp, P. troglodytes
tattccccttcctgtgtcca

SEQ ID NO: 263278 - DNA, 16 bp, P. troglodytes
tattccctttgaaaac

SEQ ID NO: 263279 - DNA, 16 bp, P. troglodytes
tattcctaagaatttt

SEQ ID NO: 263280 - DNA, 16 bp, P. troglodytes
tattcctataaatatt

SEQ ID NO: 263281 - DNA, 16 bp, P. troglodytes
tattcctcaaaactgt

SEQ ID NO: 263282 - DNA, 16 bp, P. troglodytes
tattcctcattttaca

SEQ ID NO: 263283 - DNA, 16 bp, P. troglodytes
tattcctgcagtcatt

SEQ ID NO: 263284 - DNA, 16 bp, P. troglodytes
tattcctgctcttttt

SEQ ID NO: 263285 - DNA, 16 bp, P. troglodytes
tattcctgggataaac

SEQ ID NO: 263286 - DNA, 16 bp, P. troglodytes
tattcctttctgtttg

SEQ ID NO: 263287 - DNA, 16 bp, P. troglodytes
tattcctttttatggc

SEQ ID NO: 263288 - DNA, 16 bp, P. troglodytes
tattcggccatcttgc

SEQ ID NO: 263289 - DNA, 19 bp, P. troglodytes
tattcgggtgggagtgacc

SEQ ID NO: 263290 - DNA, 16 bp, P. troglodytes
tattctaaaatatttg

SEQ ID NO: 263291 - DNA, 16 bp, P. troglodytes
tattctaaacatttca

SEQ ID NO: 263292 - DNA, 16 bp, P. troglodytes
tattctaaagaagaaa

SEQ ID NO: 263293 - DNA, 16 bp, P. troglodytes
tattctacaaatattt

SEQ ID NO: 263294 - DNA, 16 bp, P. troglodytes
tattctaggtacctca

SEQ ID NO: 263295 - DNA, 16 bp, P. troglodytes
tattctatgtatatat

SEQ ID NO: 263296 - DNA, 16 bp, P. troglodytes
tattctattgtgtata

SEQ ID NO: 263297 - DNA, 16 bp, P. troglodytes
tattctattttattga

SEQ ID NO: 263298 - DNA, 16 bp, P. troglodytes
tattctcattttacag

SEQ ID NO: 263299 - DNA, 19 bp, P. troglodytes
tattctcctgcctcagcct

SEQ ID NO: 263300 - DNA, 30 bp, P. troglodytes
tattctctgatggtagtttgtatttctgtg

SEQ ID NO: 263301 - DNA, 16 bp, P. troglodytes
tattctgaaatatatt

SEQ ID NO: 263302 - DNA, 16 bp, P. troglodytes
tattctgaacatttca

SEQ ID NO: 263303 - DNA, 16 bp, P. troglodytes
tattctgaatattaat

SEQ ID NO: 263304 - DNA, 16 bp, P. troglodytes
tattctgattgctgct

SEQ ID NO: 263305 - DNA, 16 bp, P. troglodytes
tattctgattttttaa

SEQ ID NO: 263306 - DNA, 16 bp, P. troglodytes
tattctgcctaccaca

SEQ ID NO: 263307 - DNA, 16 bp, P. troglodytes
tattctggacatttta

SEQ ID NO: 263308 - DNA, 16 bp, P. troglodytes
tattctgtataatact

SEQ ID NO: 263309 - DNA, 16 bp, P. troglodytes
tattctgtatgatgct

SEQ ID NO: 263310 - DNA, 16 bp, P. troglodytes
tattctgtatttgtct

SEQ ID NO: 263311 - DNA, 16 bp, P. troglodytes
tattctgtgtcttttg

SEQ ID NO: 263312 - DNA, 16 bp, P. troglodytes
tattctgtgtgtgtat

SEQ ID NO: 263313 - DNA, 16 bp, P. troglodytes
tattctgttccactga

SEQ ID NO: 263314 - DNA, 16 bp, P. troglodytes
tattctgttttttaaa

SEQ ID NO: 263315 - DNA, 16 bp, P. troglodytes
tattcttaaaaagaaa

SEQ ID NO: 263316 - DNA, 16 bp, P. troglodytes
tattcttaggtttgga

SEQ ID NO: 263317 - DNA, 16 bp, P. troglodytes
tattcttatcctcatt

SEQ ID NO: 263318 - DNA, 16 bp, P. troglodytes
tattcttgaaatattt

SEQ ID NO: 263319 - DNA, 16 bp, P. troglodytes
tattctttcaacaaat

SEQ ID NO: 263320 - DNA, 16 bp, P. troglodytes
tattctttcatttcca

SEQ ID NO: 263321 - DNA, 16 bp, P. troglodytes
tattctttgaatattt

SEQ ID NO: 263322 - DNA, 16 bp, P. troglodytes
tattcttttaaaaatg

SEQ ID NO: 263323 - DNA, 16 bp, P. troglodytes
tattcttttttgtggc

SEQ ID NO: 263324 - DNA, 16 bp, P. troglodytes
tattgaaaaaaatcaa

SEQ ID NO: 263325 - DNA, 16 bp, P. troglodytes
tattgaaaaaaatctg

SEQ ID NO: 263326 - DNA, 16 bp, P. troglodytes
tattgaaagaatgaat

SEQ ID NO: 263327 - DNA, 16 bp, P. troglodytes
tattgaaataaaaaca

SEQ ID NO: 263328 - DNA, 16 bp, P. troglodytes
tattgaaatgctactg

SEQ ID NO: 263329 - DNA, 16 bp, P. troglodytes
tattgaacacttactc

SEQ ID NO: 263330 - DNA, 16 bp, P. troglodytes
tattgaacatttttat

SEQ ID NO: 263331 - DNA, 17 bp, P. troglodytes
tattgaactcctgacct

SEQ ID NO: 263332 - DNA, 16 bp, P. troglodytes
tattgaaggacatctt

SEQ ID NO: 263333 - DNA, 16 bp, P. troglodytes
tattgaagtataacat

SEQ ID NO: 263334 - DNA, 16 bp, P. troglodytes
tattgaatatctcatg

SEQ ID NO: 263335 - DNA, 16 bp, P. troglodytes
tattgaatattttaag

SEQ ID NO: 263336 - DNA, 16 bp, P. troglodytes
tattgaatgaagaaat

SEQ ID NO: 263337 - DNA, 16 bp, P. troglodytes
tattgaatgaataaat

SEQ ID NO: 263338 - DNA, 16 bp, P. troglodytes
tattgaatgaatgaaa

SEQ ID NO: 263339 - DNA, 16 bp, P. troglodytes
tattgaatgctttttt

SEQ ID NO: 263340 - DNA, 16 bp, P. troglodytes
tattgacatttaaaaa

SEQ ID NO: 263341 - DNA, 16 bp, P. troglodytes
tattgacattttgggt

SEQ ID NO: 263342 - DNA, 16 bp, P. troglodytes
tattgacctgtagttt

SEQ ID NO: 263343 - DNA, 16 bp, P. troglodytes
tattgacttatttaat

SEQ ID NO: 263344 - DNA, 22 bp, P. troglodytes
tattgagataatcgtggttttt

SEQ ID NO: 263345 - DNA, 16 bp, P. troglodytes
tattgagatggagtct

SEQ ID NO: 263346 - DNA, 16 bp, P. troglodytes
tattgagcacctactt

SEQ ID NO: 263347 - DNA, 16 bp, P. troglodytes
tattgagcacttaaaa

SEQ ID NO: 263348 - DNA, 16 bp, P. troglodytes
tattgagcatttttta

SEQ ID NO: 263349 - DNA, 16 bp, P. troglodytes
tattgaggtataatta

SEQ ID NO: 263350 - DNA, 16 bp, P. troglodytes
tattgagtgagttctc

SEQ ID NO: 263351 - DNA, 16 bp, P. troglodytes
tattgagtgcctgtta

SEQ ID NO: 263352 - DNA, 16 bp, P. troglodytes
tattgataattacatt

SEQ ID NO: 263353 - DNA, 16 bp, P. troglodytes
tattgatcatcagaga

SEQ ID NO: 263354 - DNA, 16 bp, P. troglodytes
tattgatggggttgtt

SEQ ID NO: 263355 - DNA, 16 bp, P. troglodytes
tattgatgttttaaaa

SEQ ID NO: 263356 - DNA, 16 bp, P. troglodytes
tattgattggcatatg

SEQ ID NO: 263357 - DNA, 16 bp, P. troglodytes
tattgatttcatttat

SEQ ID NO: 263358 - DNA, 16 bp, P. troglodytes
tattgatttttctaat

SEQ ID NO: 263359 - DNA, 16 bp, P. troglodytes
tattgcacaggctgga

SEQ ID NO: 263360 - DNA, 16 bp, P. troglodytes
tattgcagatgtaatt

SEQ ID NO: 263361 - DNA, 16 bp, P. troglodytes
tattgcagcaatattt

SEQ ID NO: 263362 - DNA, 16 bp, P. troglodytes
tattgcagtaaagaaa

SEQ ID NO: 263363 - DNA, 16 bp, P. troglodytes
tattgcagtagcaact

SEQ ID NO: 263364 - DNA, 16 bp, P. troglodytes
tattgcatatttcaaa

SEQ ID NO: 263365 - DNA, 16 bp, P. troglodytes
tattgcattgtaatat

SEQ ID NO: 263366 - DNA, 16 bp, P. troglodytes
tattgccattttacag

SEQ ID NO: 263367 - DNA, 16 bp, P. troglodytes
tattgcccaggctgaa

SEQ ID NO: 263368 - DNA, 16 bp, P. troglodytes
tattgcctcaacttca

SEQ ID NO: 263369 - DNA, 16 bp, P. troglodytes
tattgctattgtaaat

SEQ ID NO: 263370 - DNA, 16 bp, P. troglodytes
tattgctcccatcttt

SEQ ID NO: 263371 - DNA, 16 bp, P. troglodytes
tattgctgagactttc

SEQ ID NO: 263372 - DNA, 16 bp, P. troglodytes
tattgctgagcagtat

SEQ ID NO: 263373 - DNA, 16 bp, P. troglodytes
tattgctgcataacaa

SEQ ID NO: 263374 - DNA, 16 bp, P. troglodytes
tattgctgctgctgct

SEQ ID NO: 263375 - DNA, 16 bp, P. troglodytes
tattgctggtgataat

SEQ ID NO: 263376 - DNA, 16 bp, P. troglodytes
tattgctgtataacaa

SEQ ID NO: 263377 - DNA, 16 bp, P. troglodytes
tattgctgtatagaaa

SEQ ID NO: 263378 - DNA, 16 bp, P. troglodytes
tattgctgtgtaaaaa

SEQ ID NO: 263379 - DNA, 16 bp, P. troglodytes
tattgcttaaaaaaaa

SEQ ID NO: 263380 - DNA, 16 bp, P. troglodytes
tattgcttcaatttca

SEQ ID NO: 263381 - DNA, 16 bp, P. troglodytes
tattgcttccttcagg

SEQ ID NO: 263382 - DNA, 16 bp, P. troglodytes
tattgcttgaacccag

SEQ ID NO: 263383 - DNA, 16 bp, P. troglodytes
tattgctttaaaaaat

SEQ ID NO: 263384 - DNA, 16 bp, P. troglodytes
tattgctttaaagttt

SEQ ID NO: 263385 - DNA, 16 bp, P. troglodytes
tattgctttgttgccc

SEQ ID NO: 263386 - DNA, 16 bp, P. troglodytes
tattgctttttaaagt

SEQ ID NO: 263387 - DNA, 16 bp, P. troglodytes
tattggaaaaggaaaa

SEQ ID NO: 263388 - DNA, 16 bp, P. troglodytes
tattggaacacagtca

SEQ ID NO: 263389 - DNA, 16 bp, P. troglodytes
tattggaagtaatatc

SEQ ID NO: 263390 - DNA, 16 bp, P. troglodytes
tattggacagcacaga

SEQ ID NO: 263391 - DNA, 16 bp, P. troglodytes
tattggacagcactgc

SEQ ID NO: 263392 - DNA, 16 bp, P. troglodytes
tattggatcagggccc

SEQ ID NO: 263393 - DNA, 16 bp, P. troglodytes
tattggattaaggccc

SEQ ID NO: 263394 - DNA, 16 bp, P. troglodytes
tattggctatttgtat

SEQ ID NO: 263395 - DNA, 16 bp, P. troglodytes
tattggctgataattg

SEQ ID NO: 263396 - DNA, 16 bp, P. troglodytes
tattggctgtggattt

SEQ ID NO: 263397 - DNA, 16 bp, P. troglodytes
tattgggtaatcattc

SEQ ID NO: 263398 - DNA, 16 bp, P. troglodytes
tattggtaaaatgcag

SEQ ID NO: 263399 - DNA, 16 bp, P. troglodytes
tattggtctgtagttt

SEQ ID NO: 263400 - DNA, 16 bp, P. troglodytes
tattggtgggagtgta

SEQ ID NO: 263401 - DNA, 16 bp, P. troglodytes
tattggttttcatcca

SEQ ID NO: 263402 - DNA, 16 bp, P. troglodytes
tattgtaaaagggatt

SEQ ID NO: 263403 - DNA, 16 bp, P. troglodytes
tattgtaaagattaaa

SEQ ID NO: 263404 - DNA, 16 bp, P. troglodytes
tattgtaaatggcatt

SEQ ID NO: 263405 - DNA, 16 bp, P. troglodytes
tattgtaagtgggatt

SEQ ID NO: 263406 - DNA, 16 bp, P. troglodytes
tattgtactgtattgt

SEQ ID NO: 263407 - DNA, 16 bp, P. troglodytes
tattgtatacttgaaa

SEQ ID NO: 263408 - DNA, 16 bp, P. troglodytes
tattgtatttacccat

SEQ ID NO: 263409 - DNA, 16 bp, P. troglodytes
tattgtattttacaaa

SEQ ID NO: 263410 - DNA, 16 bp, P. troglodytes
tattgtcattattatt

SEQ ID NO: 263411 - DNA, 16 bp, P. troglodytes
tattgtcattgttgtt

SEQ ID NO: 263412 - DNA, 16 bp, P. troglodytes
tattgtgaatagtgct

SEQ ID NO: 263413 - DNA, 16 bp, P. troglodytes
tattgtgacttacttt

SEQ ID NO: 263414 - DNA, 16 bp, P. troglodytes
tattgtgagtaatgct

SEQ ID NO: 263415 - DNA, 16 bp, P. troglodytes
tattgtgatataataa

SEQ ID NO: 263416 - DNA, 16 bp, P. troglodytes
tattgtgggttcagtt

SEQ ID NO: 263417 - DNA, 16 bp, P. troglodytes
tattgtgtgttctcac

SEQ ID NO: 263418 - DNA, 16 bp, P. troglodytes
tattgttaactataat

SEQ ID NO: 263419 - DNA, 16 bp, P. troglodytes
tattgttaagatggca

SEQ ID NO: 263420 - DNA, 16 bp, P. troglodytes
tattgttaagtgaaaa

SEQ ID NO: 263421 - DNA, 16 bp, P. troglodytes
tattgttactattatt

SEQ ID NO: 263422 - DNA, 16 bp, P. troglodytes
tattgttattaactat

SEQ ID NO: 263423 - DNA, 16 bp, P. troglodytes
tattgttcataatatc

SEQ ID NO: 263424 - DNA, 16 bp, P. troglodytes
tattgttgctgttgtt

SEQ ID NO: 263425 - DNA, 16 bp, P. troglodytes
tattgtttaaaaatga

SEQ ID NO: 263426 - DNA, 16 bp, P. troglodytes
tattgtttaatttcaa

SEQ ID NO: 263427 - DNA, 16 bp, P. troglodytes
tattgtttagctccca

SEQ ID NO: 263428 - DNA, 16 bp, P. troglodytes
tattgtttccatcttt

SEQ ID NO: 263429 - DNA, 16 bp, P. troglodytes
tattgttttatgccac

SEQ ID NO: 263430 - DNA, 16 bp, P. troglodytes
tattgttttcttaaaa

SEQ ID NO: 263431 - DNA, 16 bp, P. troglodytes
tattgtttttaaattc

SEQ ID NO: 263432 - DNA, 16 bp, P. troglodytes
tatttaaaaacaaaga

SEQ ID NO: 263433 - DNA, 16 bp, P. troglodytes
tatttaaaaatacagt

SEQ ID NO: 263434 - DNA, 16 bp, P. troglodytes
tatttaaaacagtttt

SEQ ID NO: 263435 - DNA, 16 bp, P. troglodytes
tatttaaaagacattt

SEQ ID NO: 263436 - DNA, 16 bp, P. troglodytes
tatttaaaagcatttt

SEQ ID NO: 263437 - DNA, 16 bp, P. troglodytes
tatttaaaatagcaaa

SEQ ID NO: 263438 - DNA, 16 bp, P. troglodytes
tatttaaacagaaaaa

SEQ ID NO: 263439 - DNA, 16 bp, P. troglodytes
tatttaaagcaaatat

SEQ ID NO: 263440 - DNA, 16 bp, P. troglodytes
tatttaaagggaaaag

SEQ ID NO: 263441 - DNA, 16 bp, P. troglodytes
tatttaaagtgagaga

SEQ ID NO: 263442 - DNA, 16 bp, P. troglodytes
tatttaaatatctgtt

SEQ ID NO: 263443 - DNA, 16 bp, P. troglodytes
tatttaaatgcatttt

SEQ ID NO: 263444 - DNA, 16 bp, P. troglodytes
tatttaacaaacactt

SEQ ID NO: 263445 - DNA, 16 bp, P. troglodytes
tatttaaccaatgcct

SEQ ID NO: 263446 - DNA, 16 bp, P. troglodytes
tatttaagtctttaat

SEQ ID NO: 263447 - DNA, 16 bp, P. troglodytes
tatttaataaaaatgg

SEQ ID NO: 263448 - DNA, 16 bp, P. troglodytes
tatttaataaatgatg

SEQ ID NO: 263449 - DNA, 16 bp, P. troglodytes
tatttaatagggaatc

SEQ ID NO: 263450 - DNA, 16 bp, P. troglodytes
tatttaatattttcag

SEQ ID NO: 263451 - DNA, 16 bp, P. troglodytes
tatttaatcctcagaa

SEQ ID NO: 263452 - DNA, 16 bp, P. troglodytes
tatttaatcctttcaa

SEQ ID NO: 263453 - DNA, 16 bp, P. troglodytes
tatttaatcttcataa

SEQ ID NO: 263454 - DNA, 16 bp, P. troglodytes
tatttaatgatgaaag

SEQ ID NO: 263455 - DNA, 16 bp, P. troglodytes
tatttaattaggaaaa

SEQ ID NO: 263456 - DNA, 16 bp, P. troglodytes
tatttaatttccaaat

SEQ ID NO: 263457 - DNA, 16 bp, P. troglodytes
tatttacaaaaatgtt

SEQ ID NO: 263458 - DNA, 16 bp, P. troglodytes
tatttacaaaccatat

SEQ ID NO: 263459 - DNA, 16 bp, P. troglodytes
tatttacaaagaaaat

SEQ ID NO: 263460 - DNA, 16 bp, P. troglodytes
tatttacaaatgtttt

SEQ ID NO: 263461 - DNA, 16 bp, P. troglodytes
tatttacaataggaaa

SEQ ID NO: 263462 - DNA, 16 bp, P. troglodytes
tatttacacaatgcct

SEQ ID NO: 263463 - DNA, 16 bp, P. troglodytes
tatttacatggcattt

SEQ ID NO: 263464 - DNA, 16 bp, P. troglodytes
tatttacatgtaaata

SEQ ID NO: 263465 - DNA, 16 bp, P. troglodytes
tatttacgtatttatt

SEQ ID NO: 263466 - DNA, 16 bp, P. troglodytes
tatttactaagcattt

SEQ ID NO: 263467 - DNA, 16 bp, P. troglodytes
tatttactatctgccc

SEQ ID NO: 263468 - DNA, 16 bp, P. troglodytes
tatttactatttggct

SEQ ID NO: 263469 - DNA, 16 bp, P. troglodytes
tatttactttgagatg

SEQ ID NO: 263470 - DNA, 16 bp, P. troglodytes
tatttagaaaaaccaa

SEQ ID NO: 263471 - DNA, 16 bp, P. troglodytes
tatttagaaaatgcca

SEQ ID NO: 263472 - DNA, 16 bp, P. troglodytes
tatttagaaatgtatt

SEQ ID NO: 263473 - DNA, 16 bp, P. troglodytes
tatttagagagagaga

SEQ ID NO: 263474 - DNA, 16 bp, P. troglodytes
tatttagaggtatgtt

SEQ ID NO: 263475 - DNA, 16 bp, P. troglodytes
tatttagatcatttac

SEQ ID NO: 263476 - DNA, 16 bp, P. troglodytes
tatttagatctttaat

SEQ ID NO: 263477 - DNA, 16 bp, P. troglodytes
tatttagattttctct

SEQ ID NO: 263478 - DNA, 16 bp, P. troglodytes
tatttagctcacagtt

SEQ ID NO: 263479 - DNA, 16 bp, P. troglodytes
tatttaggaagaaaaa

SEQ ID NO: 263480 - DNA, 26 bp, P. troglodytes
tatttagtagagacggggtttcaccg

SEQ ID NO: 263481 - DNA, 16 bp, P. troglodytes
tatttataaaaacaag

SEQ ID NO: 263482 - DNA, 16 bp, P. troglodytes
tatttataaaaatagg

SEQ ID NO: 263483 - DNA, 16 bp, P. troglodytes
tatttataaaatgtgt

SEQ ID NO: 263484 - DNA, 16 bp, P. troglodytes
tatttatacccacttt

SEQ ID NO: 263485 - DNA, 16 bp, P. troglodytes
tatttatactgtatat

SEQ ID NO: 263486 - DNA, 16 bp, P. troglodytes
tatttatatacacata

SEQ ID NO: 263487 - DNA, 16 bp, P. troglodytes
tatttatatatttgca

SEQ ID NO: 263488 - DNA, 16 bp, P. troglodytes
tatttatatgatggaa

SEQ ID NO: 263489 - DNA, 16 bp, P. troglodytes
tatttatattcctttg

SEQ ID NO: 263490 - DNA, 16 bp, P. troglodytes
tatttatattgcattt

SEQ ID NO: 263491 - DNA, 16 bp, P. troglodytes
tatttatccaaatgag

SEQ ID NO: 263492 - DNA, 16 bp, P. troglodytes
tatttatcctgcttga

SEQ ID NO: 263493 - DNA, 16 bp, P. troglodytes
tatttatcctttcaaa

SEQ ID NO: 263494 - DNA, 16 bp, P. troglodytes
tatttatctaaaggaa

SEQ ID NO: 263495 - DNA, 16 bp, P. troglodytes
tatttatctttccaaa

SEQ ID NO: 263496 - DNA, 16 bp, P. troglodytes
tatttatgaaaacaaa

SEQ ID NO: 263497 - DNA, 16 bp, P. troglodytes
tatttatgatgatgat

SEQ ID NO: 263498 - DNA, 16 bp, P. troglodytes
tatttatgcatattta

SEQ ID NO: 263499 - DNA, 16 bp, P. troglodytes
tatttatggagtgcct

SEQ ID NO: 263500 - DNA, 16 bp, P. troglodytes
tatttatgtaacattt

SEQ ID NO: 263501 - DNA, 16 bp, P. troglodytes
tatttatgtatcattt

SEQ ID NO: 263502 - DNA, 16 bp, P. troglodytes
tatttatgtcttttgc

SEQ ID NO: 263503 - DNA, 16 bp, P. troglodytes
tatttatgtgataaat

SEQ ID NO: 263504 - DNA, 16 bp, P. troglodytes
tatttattaagaactt

SEQ ID NO: 263505 - DNA, 16 bp, P. troglodytes
tatttattaagcactt

SEQ ID NO: 263506 - DNA, 16 bp, P. troglodytes
tatttattaagctctt

SEQ ID NO: 263507 - DNA, 16 bp, P. troglodytes
tatttattaagttctt

SEQ ID NO: 263508 - DNA, 16 bp, P. troglodytes
tatttattacagaaaa

SEQ ID NO: 263509 - DNA, 16 bp, P. troglodytes
tatttattatagcatt

SEQ ID NO: 263510 - DNA, 16 bp, P. troglodytes
tatttattcacttaaa

SEQ ID NO: 263511 - DNA, 16 bp, P. troglodytes
tatttattcattcagt

SEQ ID NO: 263512 - DNA, 16 bp, P. troglodytes
tatttattcattcatc

SEQ ID NO: 263513 - DNA, 16 bp, P. troglodytes
tatttattcttccaat

SEQ ID NO: 263514 - DNA, 16 bp, P. troglodytes
tatttattgaacatct

SEQ ID NO: 263515 - DNA, 16 bp, P. troglodytes
tatttattgaatacct

SEQ ID NO: 263516 - DNA, 16 bp, P. troglodytes
tatttattgagctcct

SEQ ID NO: 263517 - DNA, 16 bp, P. troglodytes
tatttattgagcttct

SEQ ID NO: 263518 - DNA, 16 bp, P. troglodytes
tatttattgagctttt

SEQ ID NO: 263519 - DNA, 16 bp, P. troglodytes
tatttattgagtgtct

SEQ ID NO: 263520 - DNA, 16 bp, P. troglodytes
tatttattggatacaa

SEQ ID NO: 263521 - DNA, 16 bp, P. troglodytes
tatttattggtcattt

SEQ ID NO: 263522 - DNA, 16 bp, P. troglodytes
tatttattgtacattt

SEQ ID NO: 263523 - DNA, 16 bp, P. troglodytes
tatttattgtattcat

SEQ ID NO: 263524 - DNA, 16 bp, P. troglodytes
tatttattgtctgtct

SEQ ID NO: 263525 - DNA, 16 bp, P. troglodytes
tatttatttagaaatg

SEQ ID NO: 263526 - DNA, 16 bp, P. troglodytes
tatttatttagtgaga

SEQ ID NO: 263527 - DNA, 16 bp, P. troglodytes
tatttatttcagacag

SEQ ID NO: 263528 - DNA, 16 bp, P. troglodytes
tatttatttcatgaat

SEQ ID NO: 263529 - DNA, 16 bp, P. troglodytes
tatttatttctgtata

SEQ ID NO: 263530 - DNA, 16 bp, P. troglodytes
tatttatttgacaaaa

SEQ ID NO: 263531 - DNA, 16 bp, P. troglodytes
tatttatttgcatatg

SEQ ID NO: 263532 - DNA, 16 bp, P. troglodytes
tatttatttgtgagac

SEQ ID NO: 263533 - DNA, 16 bp, P. troglodytes
tatttattttgcataa

SEQ ID NO: 263534 - DNA, 16 bp, P. troglodytes
tatttattttgcctgt

SEQ ID NO: 263535 - DNA, 16 bp, P. troglodytes
tatttattttggtaga

SEQ ID NO: 263536 - DNA, 16 bp, P. troglodytes
tatttcaaaaaattga

SEQ ID NO: 263537 - DNA, 16 bp, P. troglodytes
tatttcaaaacacatt

SEQ ID NO: 263538 - DNA, 16 bp, P. troglodytes
tatttcaaaacatgtt

SEQ ID NO: 263539 - DNA, 16 bp, P. troglodytes
tatttcaaaagaaaaa

SEQ ID NO: 263540 - DNA, 16 bp, P. troglodytes
tatttcaaaaggaaat

SEQ ID NO: 263541 - DNA, 16 bp, P. troglodytes
tatttcaaaataaaag

SEQ ID NO: 263542 - DNA, 16 bp, P. troglodytes
tatttcaaaataaaga

SEQ ID NO: 263543 - DNA, 16 bp, P. troglodytes
tatttcaaaatggcta

SEQ ID NO: 263544 - DNA, 16 bp, P. troglodytes
tatttcaaacttttaa

SEQ ID NO: 263545 - DNA, 16 bp, P. troglodytes
tatttcaaagaaaaat

SEQ ID NO: 263546 - DNA, 16 bp, P. troglodytes
tatttcaaagaaatat

SEQ ID NO: 263547 - DNA, 16 bp, P. troglodytes
tatttcaaagaatttt

SEQ ID NO: 263548 - DNA, 16 bp, P. troglodytes
tatttcaaagtttttt

SEQ ID NO: 263549 - DNA, 16 bp, P. troglodytes
tatttcaaataaatga

SEQ ID NO: 263550 - DNA, 16 bp, P. troglodytes
tatttcaaattgtttt

SEQ ID NO: 263551 - DNA, 16 bp, P. troglodytes
tatttcaaattttgaa

SEQ ID NO: 263552 - DNA, 16 bp, P. troglodytes
tatttcaacatataat

SEQ ID NO: 263553 - DNA, 16 bp, P. troglodytes
tatttcaagatggatt

SEQ ID NO: 263554 - DNA, 16 bp, P. troglodytes
tatttcaagtattttt

SEQ ID NO: 263555 - DNA, 16 bp, P. troglodytes
tatttcaatagatgca

SEQ ID NO: 263556 - DNA, 16 bp, P. troglodytes
tatttcacattgtatg

SEQ ID NO: 263557 - DNA, 16 bp, P. troglodytes
tatttcacgtagcata

SEQ ID NO: 263558 - DNA, 16 bp, P. troglodytes
tatttcactgtggtct

SEQ ID NO: 263559 - DNA, 16 bp, P. troglodytes
tatttcacttaaaata

SEQ ID NO: 263560 - DNA, 16 bp, P. troglodytes
tatttcagaaaagaaa

SEQ ID NO: 263561 - DNA, 16 bp, P. troglodytes
tatttcagaaaatatt

SEQ ID NO: 263562 - DNA, 16 bp, P. troglodytes
tatttcagaaatattt

SEQ ID NO: 263563 - DNA, 16 bp, P. troglodytes
tatttcagaatagcta

SEQ ID NO: 263564 - DNA, 16 bp, P. troglodytes
tatttcagaatatttt

SEQ ID NO: 263565 - DNA, 26 bp, P. troglodytes
tatttcagactatcacatggggagaa

SEQ ID NO: 263566 - DNA, 16 bp, P. troglodytes
tatttcagataaaata

SEQ ID NO: 263567 - DNA, 16 bp, P. troglodytes
tatttcagatttttat

SEQ ID NO: 263568 - DNA, 16 bp, P. troglodytes
tatttcagttcttttg

SEQ ID NO: 263569 - DNA, 16 bp, P. troglodytes
tatttcatataaatgg

SEQ ID NO: 263570 - DNA, 16 bp, P. troglodytes
tatttcatatttgtat

SEQ ID NO: 263571 - DNA, 16 bp, P. troglodytes
tatttcatgtacccca

SEQ ID NO: 263572 - DNA, 16 bp, P. troglodytes
tatttcattagtttta

SEQ ID NO: 263573 - DNA, 16 bp, P. troglodytes
tatttcattgaatttt

SEQ ID NO: 263574 - DNA, 16 bp, P. troglodytes
tatttcatttaatcct

SEQ ID NO: 263575 - DNA, 16 bp, P. troglodytes
tatttcatttccatgt

SEQ ID NO: 263576 - DNA, 16 bp, P. troglodytes
tatttcattttcttgc

SEQ ID NO: 263577 - DNA, 16 bp, P. troglodytes
tatttcattttgaatt

SEQ ID NO: 263578 - DNA, 16 bp, P. troglodytes
tatttcattttggata

SEQ ID NO: 263579 - DNA, 16 bp, P. troglodytes
tatttccaaaaaaggt

SEQ ID NO: 263580 - DNA, 16 bp, P. troglodytes
tatttccaaaatgttt

SEQ ID NO: 263581 - DNA, 16 bp, P. troglodytes
tatttccaaagaaaat

SEQ ID NO: 263582 - DNA, 16 bp, P. troglodytes
tatttccaatatttct

SEQ ID NO: 263583 - DNA, 16 bp, P. troglodytes
tatttccaatattttg

SEQ ID NO: 263584 - DNA, 16 bp, P. troglodytes
tatttccagcactttg

SEQ ID NO: 263585 - DNA, 16 bp, P. troglodytes
tatttccatgtatttt

SEQ ID NO: 263586 - DNA, 16 bp, P. troglodytes
tatttccattaaaata

SEQ ID NO: 263587 - DNA, 16 bp, P. troglodytes
tatttccctgtctcct

SEQ ID NO: 263588 - DNA, 16 bp, P. troglodytes
tatttccctgtttctt

SEQ ID NO: 263589 - DNA, 16 bp, P. troglodytes
tatttcctaaaagaaa

SEQ ID NO: 263590 - DNA, 16 bp, P. troglodytes
tatttcctaaaatatt

SEQ ID NO: 263591 - DNA, 16 bp, P. troglodytes
tatttcctgaatttca

SEQ ID NO: 263592 - DNA, 16 bp, P. troglodytes
tatttcctgtaaattg

SEQ ID NO: 263593 - DNA, 16 bp, P. troglodytes
tatttccttaaaaaat

SEQ ID NO: 263594 - DNA, 16 bp, P. troglodytes
tatttccttcccctgc

SEQ ID NO: 263595 - DNA, 16 bp, P. troglodytes
tatttccttgcctttt

SEQ ID NO: 263596 - DNA, 16 bp, P. troglodytes
tatttcctttaaaaaa

SEQ ID NO: 263597 - DNA, 16 bp, P. troglodytes
tatttcctttaaaatg

SEQ ID NO: 263598 - DNA, 16 bp, P. troglodytes
tatttcctttgaaaat

SEQ ID NO: 263599 - DNA, 16 bp, P. troglodytes
tatttctaaaatgttt

SEQ ID NO: 263600 - DNA, 16 bp, P. troglodytes
tatttctaaagaaaat

SEQ ID NO: 263601 - DNA, 16 bp, P. troglodytes
tatttctaaataaaca

SEQ ID NO: 263602 - DNA, 16 bp, P. troglodytes
tatttctaaatatttg

SEQ ID NO: 263603 - DNA, 16 bp, P. troglodytes
tatttctaggttctct

SEQ ID NO: 263604 - DNA, 16 bp, P. troglodytes
tatttctagtttttca

SEQ ID NO: 263605 - DNA, 16 bp, P. troglodytes
tatttctatatattag

SEQ ID NO: 263606 - DNA, 16 bp, P. troglodytes
tatttctatatgccaa

SEQ ID NO: 263607 - DNA, 16 bp, P. troglodytes
tatttctatcagcatt

SEQ ID NO: 263608 - DNA, 16 bp, P. troglodytes
tatttctatgaaataa

SEQ ID NO: 263609 - DNA, 16 bp, P. troglodytes
tatttctcacacttct

SEQ ID NO: 263610 - DNA, 16 bp, P. troglodytes
tatttctcagcagaaa

SEQ ID NO: 263611 - DNA, 16 bp, P. troglodytes
tatttctcataattct

SEQ ID NO: 263612 - DNA, 16 bp, P. troglodytes
tatttctcatcaggtg

SEQ ID NO: 263613 - DNA, 16 bp, P. troglodytes
tatttctccaaataaa

SEQ ID NO: 263614 - DNA, 16 bp, P. troglodytes
tatttctccttcacct

SEQ ID NO: 263615 - DNA, 16 bp, P. troglodytes
tatttctgaaaaaaaa

SEQ ID NO: 263616 - DNA, 16 bp, P. troglodytes
tatttctgaagaaaat

SEQ ID NO: 263617 - DNA, 16 bp, P. troglodytes
tatttctgccttaatt

SEQ ID NO: 263618 - DNA, 16 bp, P. troglodytes
tatttctggaagagat

SEQ ID NO: 263619 - DNA, 16 bp, P. troglodytes
tatttctggattttta

SEQ ID NO: 263620 - DNA, 16 bp, P. troglodytes
tatttctgggttctct

SEQ ID NO: 263621 - DNA, 16 bp, P. troglodytes
tatttctgggtttcct

SEQ ID NO: 263622 - DNA, 16 bp, P. troglodytes
tatttctggtcacaaa

SEQ ID NO: 263623 - DNA, 16 bp, P. troglodytes
tatttctgtaaaattt

SEQ ID NO: 263624 - DNA, 16 bp, P. troglodytes
tatttctgtaaataat

SEQ ID NO: 263625 - DNA, 16 bp, P. troglodytes
tatttctgtatttaaa

SEQ ID NO: 263626 - DNA, 16 bp, P. troglodytes
tatttctgtcatttta

SEQ ID NO: 263627 - DNA, 16 bp, P. troglodytes
tatttctgtgaaaaaa

SEQ ID NO: 263628 - DNA, 16 bp, P. troglodytes
tatttctgtgaggtca

SEQ ID NO: 263629 - DNA, 16 bp, P. troglodytes
tatttctgtgcctggc

SEQ ID NO: 263630 - DNA, 16 bp, P. troglodytes
tatttctgtggcatca

SEQ ID NO: 263631 - DNA, 16 bp, P. troglodytes
tatttctgttttacag

SEQ ID NO: 263632 - DNA, 16 bp, P. troglodytes
tatttcttatggttct

SEQ ID NO: 263633 - DNA, 16 bp, P. troglodytes
tatttcttatttgaaa

SEQ ID NO: 263634 - DNA, 16 bp, P. troglodytes
tatttcttcaaatctt

SEQ ID NO: 263635 - DNA, 16 bp, P. troglodytes
tatttcttcataaaat

SEQ ID NO: 263636 - DNA, 16 bp, P. troglodytes
tatttcttcatttgct

SEQ ID NO: 263637 - DNA, 16 bp, P. troglodytes
tatttcttcctcttgc

SEQ ID NO: 263638 - DNA, 16 bp, P. troglodytes
tatttcttccttaaaa

SEQ ID NO: 263639 - DNA, 16 bp, P. troglodytes
tatttcttcttgagtg

SEQ ID NO: 263640 - DNA, 16 bp, P. troglodytes
tatttcttcttgagtt

SEQ ID NO: 263641 - DNA, 16 bp, P. troglodytes
tatttcttgccctctg

SEQ ID NO: 263642 - DNA, 16 bp, P. troglodytes
tatttcttgctcatat

SEQ ID NO: 263643 - DNA, 16 bp, P. troglodytes
tatttcttgtcctctg

SEQ ID NO: 263644 - DNA, 16 bp, P. troglodytes
tatttctttaaagttt

SEQ ID NO: 263645 - DNA, 16 bp, P. troglodytes
tatttctttaaataag

SEQ ID NO: 263646 - DNA, 16 bp, P. troglodytes
tatttctttaatgaat

SEQ ID NO: 263647 - DNA, 16 bp, P. troglodytes
tatttctttagaaaaa

SEQ ID NO: 263648 - DNA, 16 bp, P. troglodytes
tatttctttctctaaa

SEQ ID NO: 263649 - DNA, 16 bp, P. troglodytes
tatttctttgaaattt

SEQ ID NO: 263650 - DNA, 16 bp, P. troglodytes
tatttctttgcatgtc

SEQ ID NO: 263651 - DNA, 16 bp, P. troglodytes
tatttcttttaaacaa

SEQ ID NO: 263652 - DNA, 16 bp, P. troglodytes
tatttgaaactaatga

SEQ ID NO: 263653 - DNA, 16 bp, P. troglodytes
tatttgaaagtaattt

SEQ ID NO: 263654 - DNA, 16 bp, P. troglodytes
tatttgaaatcatttt

SEQ ID NO: 263655 - DNA, 16 bp, P. troglodytes
tatttgaaatctttct

SEQ ID NO: 263656 - DNA, 16 bp, P. troglodytes
tatttgaaatgtataa

SEQ ID NO: 263657 - DNA, 16 bp, P. troglodytes
tatttgaaattcttct

SEQ ID NO: 263658 - DNA, 16 bp, P. troglodytes
tatttgaaatttttct

SEQ ID NO: 263659 - DNA, 16 bp, P. troglodytes
tatttgaacatttatt

SEQ ID NO: 263660 - DNA, 16 bp, P. troglodytes
tatttgaagaaaatat

SEQ ID NO: 263661 - DNA, 16 bp, P. troglodytes
tatttgaagaataatt

SEQ ID NO: 263662 - DNA, 16 bp, P. troglodytes
tatttgaagagaaaaa

SEQ ID NO: 263663 - DNA, 16 bp, P. troglodytes
tatttgaagcttttct

SEQ ID NO: 263664 - DNA, 16 bp, P. troglodytes
tatttgaatattctct

SEQ ID NO: 263665 - DNA, 16 bp, P. troglodytes
tatttgaatcttcttt

SEQ ID NO: 263666 - DNA, 16 bp, P. troglodytes
tatttgaattatttct

SEQ ID NO: 263667 - DNA, 16 bp, P. troglodytes
tatttgacaaaatcta

SEQ ID NO: 263668 - DNA, 16 bp, P. troglodytes
tatttgacatatttta

SEQ ID NO: 263669 - DNA, 16 bp, P. troglodytes
tatttgacatttttaa

SEQ ID NO: 263670 - DNA, 16 bp, P. troglodytes
tatttgaccaaaaaaa

SEQ ID NO: 263671 - DNA, 16 bp, P. troglodytes
tatttgagggaaaaaa

SEQ ID NO: 263672 - DNA, 16 bp, P. troglodytes
tatttgaggtcttttg

SEQ ID NO: 263673 - DNA, 16 bp, P. troglodytes
tatttgagttgtttct

SEQ ID NO: 263674 - DNA, 16 bp, P. troglodytes
tatttgagttttaaaa

SEQ ID NO: 263675 - DNA, 16 bp, P. troglodytes
tatttgatacattttt

SEQ ID NO: 263676 - DNA, 16 bp, P. troglodytes
tatttgatagcacaac

SEQ ID NO: 263677 - DNA, 16 bp, P. troglodytes
tatttgatggtacaaa

SEQ ID NO: 263678 - DNA, 16 bp, P. troglodytes
tatttgattgatgtct

SEQ ID NO: 263679 - DNA, 16 bp, P. troglodytes
tatttgattttaaaag

SEQ ID NO: 263680 - DNA, 16 bp, P. troglodytes
tatttgattttccatt

SEQ ID NO: 263681 - DNA, 16 bp, P. troglodytes
tatttgcaaagcacat

SEQ ID NO: 263682 - DNA, 16 bp, P. troglodytes
tatttgcaagcctcat

SEQ ID NO: 263683 - DNA, 16 bp, P. troglodytes
tatttgcataaagaaa

SEQ ID NO: 263684 - DNA, 16 bp, P. troglodytes
tatttgcatagttttg

SEQ ID NO: 263685 - DNA, 16 bp, P. troglodytes
tatttgcatataacct

SEQ ID NO: 263686 - DNA, 16 bp, P. troglodytes
tatttgcatataatgt

SEQ ID NO: 263687 - DNA, 16 bp, P. troglodytes
tatttgcatatacata

SEQ ID NO: 263688 - DNA, 16 bp, P. troglodytes
tatttgcatatgcata

SEQ ID NO: 263689 - DNA, 16 bp, P. troglodytes
tatttgcattaatttt

SEQ ID NO: 263690 - DNA, 16 bp, P. troglodytes
tatttgcattttagaa

SEQ ID NO: 263691 - DNA, 16 bp, P. troglodytes
tatttgcatttttaaa

SEQ ID NO: 263692 - DNA, 16 bp, P. troglodytes
tatttgctaaaataaa

SEQ ID NO: 263693 - DNA, 16 bp, P. troglodytes
tatttgctattgtgaa

SEQ ID NO: 263694 - DNA, 16 bp, P. troglodytes
tatttgctcatttatt

SEQ ID NO: 263695 - DNA, 16 bp, P. troglodytes
tatttgctgaatgaat

SEQ ID NO: 263696 - DNA, 16 bp, P. troglodytes
tatttgcttatttaat

SEQ ID NO: 263697 - DNA, 16 bp, P. troglodytes
tatttgcttcaaaata

SEQ ID NO: 263698 - DNA, 16 bp, P. troglodytes
tatttgctttaaaata

SEQ ID NO: 263699 - DNA, 16 bp, P. troglodytes
tatttgctttaaatat

SEQ ID NO: 263700 - DNA, 16 bp, P. troglodytes
tatttgctttatgtat

SEQ ID NO: 263701 - DNA, 16 bp, P. troglodytes
tatttgctttttaaaa

SEQ ID NO: 263702 - DNA, 16 bp, P. troglodytes
tatttggaaaaataat

SEQ ID NO: 263703 - DNA, 16 bp, P. troglodytes
tatttggaaaaattaa

SEQ ID NO: 263704 - DNA, 16 bp, P. troglodytes
tatttggaaataattt

SEQ ID NO: 263705 - DNA, 16 bp, P. troglodytes
tatttggaaatatata

SEQ ID NO: 263706 - DNA, 16 bp, P. troglodytes
tatttggaatatatat

SEQ ID NO: 263707 - DNA, 16 bp, P. troglodytes
tatttggaattttaaa

SEQ ID NO: 263708 - DNA, 16 bp, P. troglodytes
tatttggagaaagggc

SEQ ID NO: 263709 - DNA, 16 bp, P. troglodytes
tatttggagataagac

SEQ ID NO: 263710 - DNA, 16 bp, P. troglodytes
tatttggagggctttg

SEQ ID NO: 263711 - DNA, 16 bp, P. troglodytes
tatttggattgttttc

SEQ ID NO: 263712 - DNA, 16 bp, P. troglodytes
tatttggcaataaaaa

SEQ ID NO: 263713 - DNA, 16 bp, P. troglodytes
tatttggctataaaaa

SEQ ID NO: 263714 - DNA, 16 bp, P. troglodytes
tatttgggaaatattt

SEQ ID NO: 263715 - DNA, 16 bp, P. troglodytes
tatttgggctcttttt

SEQ ID NO: 263716 - DNA, 16 bp, P. troglodytes
tatttggggaaaatat

SEQ ID NO: 263717 - DNA, 16 bp, P. troglodytes
tatttgggtgatgggt

SEQ ID NO: 263718 - DNA, 16 bp, P. troglodytes
tatttggtataaaaat

SEQ ID NO: 263719 - DNA, 16 bp, P. troglodytes
tatttggtctttgacc

SEQ ID NO: 263720 - DNA, 16 bp, P. troglodytes
tatttggttaaacatt

SEQ ID NO: 263721 - DNA, 16 bp, P. troglodytes
tatttggttcttttaa

SEQ ID NO: 263722 - DNA, 16 bp, P. troglodytes
tatttggtttttcacc

SEQ ID NO: 263723 - DNA, 16 bp, P. troglodytes
tatttgtaaaatagag

SEQ ID NO: 263724 - DNA, 16 bp, P. troglodytes
tatttgtaaaatgaag

SEQ ID NO: 263725 - DNA, 16 bp, P. troglodytes
tatttgtaaacaggat

SEQ ID NO: 263726 - DNA, 16 bp, P. troglodytes
tatttgtaatctttta

SEQ ID NO: 263727 - DNA, 16 bp, P. troglodytes
tatttgtacttttaaa

SEQ ID NO: 263728 - DNA, 16 bp, P. troglodytes
tatttgtagaataaat

SEQ ID NO: 263729 - DNA, 16 bp, P. troglodytes
tatttgtagagatgga

SEQ ID NO: 263730 - DNA, 16 bp, P. troglodytes
tatttgtcctttgtgt

SEQ ID NO: 263731 - DNA, 16 bp, P. troglodytes
tatttgtcttattaat

SEQ ID NO: 263732 - DNA, 16 bp, P. troglodytes
tatttgtctttctctg

SEQ ID NO: 263733 - DNA, 16 bp, P. troglodytes
tatttgtgaaggattt

SEQ ID NO: 263734 - DNA, 16 bp, P. troglodytes
tatttgtggaatgaat

SEQ ID NO: 263735 - DNA, 16 bp, P. troglodytes
tatttgtgtgtataca

SEQ ID NO: 263736 - DNA, 16 bp, P. troglodytes
tatttgtgtgtctaaa

SEQ ID NO: 263737 - DNA, 16 bp, P. troglodytes
tatttgtgtgtgtctg

SEQ ID NO: 263738 - DNA, 16 bp, P. troglodytes
tatttgttaaagaaac

SEQ ID NO: 263739 - DNA, 16 bp, P. troglodytes
tatttgttcaataaat

SEQ ID NO: 263740 - DNA, 16 bp, P. troglodytes
tatttgttcattaatt

SEQ ID NO: 263741 - DNA, 16 bp, P. troglodytes
tatttgttgaaggaat

SEQ ID NO: 263742 - DNA, 16 bp, P. troglodytes
tatttgttgaataaat

SEQ ID NO: 263743 - DNA, 16 bp, P. troglodytes
tatttgttgaatgcat

SEQ ID NO: 263744 - DNA, 16 bp, P. troglodytes
tatttgttgagtgaat

SEQ ID NO: 263745 - DNA, 16 bp, P. troglodytes
tatttgttgcatgaat

SEQ ID NO: 263746 - DNA, 16 bp, P. troglodytes
tatttgtttccaaaat

SEQ ID NO: 263747 - DNA, 16 bp, P. troglodytes
tatttgttttaagaaa

SEQ ID NO: 263748 - DNA, 16 bp, P. troglodytes
tattttaaaaagtttg

SEQ ID NO: 263749 - DNA, 16 bp, P. troglodytes
tattttaaaaatcttg

SEQ ID NO: 263750 - DNA, 16 bp, P. troglodytes
tattttaaaaccagaa

SEQ ID NO: 263751 - DNA, 16 bp, P. troglodytes
tattttaaaactgttt

SEQ ID NO: 263752 - DNA, 16 bp, P. troglodytes
tattttaaaacttcaa

SEQ ID NO: 263753 - DNA, 16 bp, P. troglodytes
tattttaaaagataca

SEQ ID NO: 263754 - DNA, 16 bp, P. troglodytes
tattttaaaaggagaa

SEQ ID NO: 263755 - DNA, 16 bp, P. troglodytes
tattttaaaaggatat

SEQ ID NO: 263756 - DNA, 16 bp, P. troglodytes
tattttaaaagtagaa

SEQ ID NO: 263757 - DNA, 16 bp, P. troglodytes
tattttaaaagttgaa

SEQ ID NO: 263758 - DNA, 16 bp, P. troglodytes
tattttaaaataacag

SEQ ID NO: 263759 - DNA, 16 bp, P. troglodytes
tattttaaaataatgc

SEQ ID NO: 263760 - DNA, 16 bp, P. troglodytes
tattttaaaatatcct

SEQ ID NO: 263761 - DNA, 16 bp, P. troglodytes
tattttaaaatgctga

SEQ ID NO: 263762 - DNA, 16 bp, P. troglodytes
tattttaaaatgcttt

SEQ ID NO: 263763 - DNA, 16 bp, P. troglodytes
tattttaaacccactg

SEQ ID NO: 263764 - DNA, 16 bp, P. troglodytes
tattttaaacttttga

SEQ ID NO: 263765 - DNA, 16 bp, P. troglodytes
tattttaaagaatgtt

SEQ ID NO: 263766 - DNA, 16 bp, P. troglodytes
tattttaaagatgaaa

SEQ ID NO: 263767 - DNA, 16 bp, P. troglodytes
tattttaaagatgtca

SEQ ID NO: 263768 - DNA, 16 bp, P. troglodytes
tattttaaagcaaatt

SEQ ID NO: 263769 - DNA, 16 bp, P. troglodytes
tattttaaagcattta

SEQ ID NO: 263770 - DNA, 16 bp, P. troglodytes
tattttaaaggttaaa

SEQ ID NO: 263771 - DNA, 16 bp, P. troglodytes
tattttaaagtaattc

SEQ ID NO: 263772 - DNA, 16 bp, P. troglodytes
tattttaaagtacatt

SEQ ID NO: 263773 - DNA, 16 bp, P. troglodytes
tattttaaatgcatta

SEQ ID NO: 263774 - DNA, 16 bp, P. troglodytes
tattttaaatggaaaa

SEQ ID NO: 263775 - DNA, 16 bp, P. troglodytes
tattttaaatggaatt

SEQ ID NO: 263776 - DNA, 16 bp, P. troglodytes
tattttaacagaaaaa

SEQ ID NO: 263777 - DNA, 16 bp, P. troglodytes
tattttaacagaaata

SEQ ID NO: 263778 - DNA, 16 bp, P. troglodytes
tattttaagcattttt

SEQ ID NO: 263779 - DNA, 16 bp, P. troglodytes
tattttaaggaaaaat

SEQ ID NO: 263780 - DNA, 16 bp, P. troglodytes
tattttaaggaattga

SEQ ID NO: 263781 - DNA, 16 bp, P. troglodytes
tattttaaggaattgg

SEQ ID NO: 263782 - DNA, 16 bp, P. troglodytes
tattttaatacatttg

SEQ ID NO: 263783 - DNA, 16 bp, P. troglodytes
tattttaatagctatt

SEQ ID NO: 263784 - DNA, 16 bp, P. troglodytes
tattttaatagctttt

SEQ ID NO: 263785 - DNA, 16 bp, P. troglodytes
tattttaatatgcttt

SEQ ID NO: 263786 - DNA, 16 bp, P. troglodytes
tattttacaaatgaaa

SEQ ID NO: 263787 - DNA, 16 bp, P. troglodytes
tattttacaaatgaag

SEQ ID NO: 263788 - DNA, 16 bp, P. troglodytes
tattttacaaatgaga

SEQ ID NO: 263789 - DNA, 16 bp, P. troglodytes
tattttacaaatgagg

SEQ ID NO: 263790 - DNA, 16 bp, P. troglodytes
tattttacagaatttg

SEQ ID NO: 263791 - DNA, 16 bp, P. troglodytes
tattttacagttttat

SEQ ID NO: 263792 - DNA, 16 bp, P. troglodytes
tattttacatatatac

SEQ ID NO: 263793 - DNA, 16 bp, P. troglodytes
tattttacatgaaaat

SEQ ID NO: 263794 - DNA, 16 bp, P. troglodytes
tattttacattcctat

SEQ ID NO: 263795 - DNA, 16 bp, P. troglodytes
tattttaccacagttt

SEQ ID NO: 263796 - DNA, 16 bp, P. troglodytes
tattttaccattaaat

SEQ ID NO: 263797 - DNA, 16 bp, P. troglodytes
tattttagaaaaacat

SEQ ID NO: 263798 - DNA, 16 bp, P. troglodytes
tattttagaaaatgaa

SEQ ID NO: 263799 - DNA, 16 bp, P. troglodytes
tattttagaagaaaat

SEQ ID NO: 263800 - DNA, 16 bp, P. troglodytes
tattttagagacaagg

SEQ ID NO: 263801 - DNA, 16 bp, P. troglodytes
tattttagatactagt

SEQ ID NO: 263802 - DNA, 16 bp, P. troglodytes
tattttaggaaaaata

SEQ ID NO: 263803 - DNA, 16 bp, P. troglodytes
tattttaggaaaattt

SEQ ID NO: 263804 - DNA, 16 bp, P. troglodytes
tattttagggaaaaat

SEQ ID NO: 263805 - DNA, 16 bp, P. troglodytes
tattttaggttcagtg

SEQ ID NO: 263806 - DNA, 16 bp, P. troglodytes
tattttagtcattctg

SEQ ID NO: 263807 - DNA, 16 bp, P. troglodytes
tattttagttttctga

SEQ ID NO: 263808 - DNA, 16 bp, P. troglodytes
tattttataaatggaa

SEQ ID NO: 263809 - DNA, 16 bp, P. troglodytes
tattttataagcattt

SEQ ID NO: 263810 - DNA, 16 bp, P. troglodytes
tattttataatgtaca

SEQ ID NO: 263811 - DNA, 16 bp, P. troglodytes
tattttatacatatgt

SEQ ID NO: 263812 - DNA, 16 bp, P. troglodytes
tattttatataaatgg

SEQ ID NO: 263813 - DNA, 16 bp, P. troglodytes
tattttatatgcatta

SEQ ID NO: 263814 - DNA, 16 bp, P. troglodytes
tattttatcatgatta

SEQ ID NO: 263815 - DNA, 16 bp, P. troglodytes
tattttatcccattct

SEQ ID NO: 263816 - DNA, 16 bp, P. troglodytes
tattttatgaaatgaa

SEQ ID NO: 263817 - DNA, 16 bp, P. troglodytes
tattttatgacatttt

SEQ ID NO: 263818 - DNA, 16 bp, P. troglodytes
tattttatgcattcat

SEQ ID NO: 263819 - DNA, 16 bp, P. troglodytes
tattttatgcatttgt

SEQ ID NO: 263820 - DNA, 16 bp, P. troglodytes
tattttatggaggatt

SEQ ID NO: 263821 - DNA, 16 bp, P. troglodytes
tattttatgtaattct

SEQ ID NO: 263822 - DNA, 16 bp, P. troglodytes
tattttatgtgtggcc

SEQ ID NO: 263823 - DNA, 16 bp, P. troglodytes
tattttatgtttctaa

SEQ ID NO: 263824 - DNA, 16 bp, P. troglodytes
tattttattcatcatg

SEQ ID NO: 263825 - DNA, 16 bp, P. troglodytes
tattttattgacattt

SEQ ID NO: 263826 - DNA, 16 bp, P. troglodytes
tattttattgtactgt

SEQ ID NO: 263827 - DNA, 16 bp, P. troglodytes
tattttatttaacagt

SEQ ID NO: 263828 - DNA, 16 bp, P. troglodytes
tattttattttcaaag

SEQ ID NO: 263829 - DNA, 16 bp, P. troglodytes
tattttcaaaaagaaa

SEQ ID NO: 263830 - DNA, 16 bp, P. troglodytes
tattttcaaagaaaca

SEQ ID NO: 263831 - DNA, 16 bp, P. troglodytes
tattttcaaaggaaaa

SEQ ID NO: 263832 - DNA, 16 bp, P. troglodytes
tattttcaaatgtaaa

SEQ ID NO: 263833 - DNA, 16 bp, P. troglodytes
tattttcaaattgtat

SEQ ID NO: 263834 - DNA, 16 bp, P. troglodytes
tattttcaaggttcat

SEQ ID NO: 263835 - DNA, 16 bp, P. troglodytes
tattttcaagtatttt

SEQ ID NO: 263836 - DNA, 16 bp, P. troglodytes
tattttcaagttattt

SEQ ID NO: 263837 - DNA, 16 bp, P. troglodytes
tattttcagaaaaaca

SEQ ID NO: 263838 - DNA, 16 bp, P. troglodytes
tattttcagacagagt

SEQ ID NO: 263839 - DNA, 16 bp, P. troglodytes
tattttcagagaaaat

SEQ ID NO: 263840 - DNA, 16 bp, P. troglodytes
tattttcagatgagga

SEQ ID NO: 263841 - DNA, 16 bp, P. troglodytes
tattttcagtatatat

SEQ ID NO: 263842 - DNA, 16 bp, P. troglodytes
tattttcagtttatga

SEQ ID NO: 263843 - DNA, 16 bp, P. troglodytes
tattttcataaaacat

SEQ ID NO: 263844 - DNA, 16 bp, P. troglodytes
tattttcataatgttt

SEQ ID NO: 263845 - DNA, 16 bp, P. troglodytes
tattttcatgctgctg

SEQ ID NO: 263846 - DNA, 16 bp, P. troglodytes
tattttcatgtatgtt

SEQ ID NO: 263847 - DNA, 16 bp, P. troglodytes
tattttcattcatctc

SEQ ID NO: 263848 - DNA, 16 bp, P. troglodytes
tattttcatttaaaca

SEQ ID NO: 263849 - DNA, 16 bp, P. troglodytes
tattttcattttgcat

SEQ ID NO: 263850 - DNA, 16 bp, P. troglodytes
tattttccaaaatgtt

SEQ ID NO: 263851 - DNA, 16 bp, P. troglodytes
tattttccaaagatga

SEQ ID NO: 263852 - DNA, 16 bp, P. troglodytes
tattttccaaataatt

SEQ ID NO: 263853 - DNA, 16 bp, P. troglodytes
tattttccagttttct

SEQ ID NO: 263854 - DNA, 16 bp, P. troglodytes
tattttcctgaatatt

SEQ ID NO: 263855 - DNA, 16 bp, P. troglodytes
tattttcctgtcttct

SEQ ID NO: 263856 - DNA, 16 bp, P. troglodytes
tattttcctttcaaaa

SEQ ID NO: 263857 - DNA, 16 bp, P. troglodytes
tattttccttttcaaa

SEQ ID NO: 263858 - DNA, 16 bp, P. troglodytes
tattttctaaaaagaa

SEQ ID NO: 263859 - DNA, 16 bp, P. troglodytes
tattttctaataaatg

SEQ ID NO: 263860 - DNA, 16 bp, P. troglodytes
tattttctatctctgt

SEQ ID NO: 263861 - DNA, 16 bp, P. troglodytes
tattttctcagaaaat

SEQ ID NO: 263862 - DNA, 16 bp, P. troglodytes
tattttctcattaaaa

SEQ ID NO: 263863 - DNA, 16 bp, P. troglodytes
tattttctcccatcct

SEQ ID NO: 263864 - DNA, 16 bp, P. troglodytes
tattttctctctctgt

SEQ ID NO: 263865 - DNA, 16 bp, P. troglodytes
tattttctgtagagat

SEQ ID NO: 263866 - DNA, 16 bp, P. troglodytes
tattttctgtatatta

SEQ ID NO: 263867 - DNA, 16 bp, P. troglodytes
tattttctgtcttcct

SEQ ID NO: 263868 - DNA, 16 bp, P. troglodytes
tattttctgtgtctat

SEQ ID NO: 263869 - DNA, 16 bp, P. troglodytes
tattttcttaaaattg

SEQ ID NO: 263870 - DNA, 16 bp, P. troglodytes
tattttcttaaagttt

SEQ ID NO: 263871 - DNA, 16 bp, P. troglodytes
tattttcttaaatgaa

SEQ ID NO: 263872 - DNA, 16 bp, P. troglodytes
tattttcttagaataa

SEQ ID NO: 263873 - DNA, 16 bp, P. troglodytes
tattttcttatctgta

SEQ ID NO: 263874 - DNA, 16 bp, P. troglodytes
tattttcttccagttt

SEQ ID NO: 263875 - DNA, 16 bp, P. troglodytes
tattttcttgaaattt

SEQ ID NO: 263876 - DNA, 16 bp, P. troglodytes
tattttcttgaacata

SEQ ID NO: 263877 - DNA, 16 bp, P. troglodytes
tattttctttaaaaga

SEQ ID NO: 263878 - DNA, 16 bp, P. troglodytes
tattttctttgaaatt

SEQ ID NO: 263879 - DNA, 16 bp, P. troglodytes
tattttctttttagaa

SEQ ID NO: 263880 - DNA, 16 bp, P. troglodytes
tattttgaaaactata

SEQ ID NO: 263881 - DNA, 16 bp, P. troglodytes
tattttgaaagaaaga

SEQ ID NO: 263882 - DNA, 16 bp, P. troglodytes
tattttgaaagataca

SEQ ID NO: 263883 - DNA, 16 bp, P. troglodytes
tattttgaaagtaaat

SEQ ID NO: 263884 - DNA, 16 bp, P. troglodytes
tattttgaaatattct

SEQ ID NO: 263885 - DNA, 16 bp, P. troglodytes
tattttgaaatctttt

SEQ ID NO: 263886 - DNA, 16 bp, P. troglodytes
tattttgaactatttt

SEQ ID NO: 263887 - DNA, 16 bp, P. troglodytes
tattttgaagaaatat

SEQ ID NO: 263888 - DNA, 16 bp, P. troglodytes
tattttgaaggaaata

SEQ ID NO: 263889 - DNA, 16 bp, P. troglodytes
tattttgaattttcca

SEQ ID NO: 263890 - DNA, 16 bp, P. troglodytes
tattttgagaaaaata

SEQ ID NO: 263891 - DNA, 16 bp, P. troglodytes
tattttgagaaactgc

SEQ ID NO: 263892 - DNA, 16 bp, P. troglodytes
tattttgagaataaaa

SEQ ID NO: 263893 - DNA, 16 bp, P. troglodytes
tattttgagacggagt

SEQ ID NO: 263894 - DNA, 16 bp, P. troglodytes
tattttgagcctttgt

SEQ ID NO: 263895 - DNA, 16 bp, P. troglodytes
tattttgagctgaaga

SEQ ID NO: 263896 - DNA, 16 bp, P. troglodytes
tattttgataaaatgt

SEQ ID NO: 263897 - DNA, 16 bp, P. troglodytes
tattttgatacatgta

SEQ ID NO: 263898 - DNA, 16 bp, P. troglodytes
tattttgatatacata

SEQ ID NO: 263899 - DNA, 16 bp, P. troglodytes
tattttgatgaaaatt

SEQ ID NO: 263900 - DNA, 16 bp, P. troglodytes
tattttgatggagatt

SEQ ID NO: 263901 - DNA, 16 bp, P. troglodytes
tattttgcaaaatttt

SEQ ID NO: 263902 - DNA, 16 bp, P. troglodytes
tattttgcataatttt

SEQ ID NO: 263903 - DNA, 16 bp, P. troglodytes
tattttgcattcattt

SEQ ID NO: 263904 - DNA, 16 bp, P. troglodytes
tattttgcatttaaat

SEQ ID NO: 263905 - DNA, 16 bp, P. troglodytes
tattttgcattttaaa

SEQ ID NO: 263906 - DNA, 16 bp, P. troglodytes
tattttgcccactttt

SEQ ID NO: 263907 - DNA, 16 bp, P. troglodytes
tattttgcccattaat

SEQ ID NO: 263908 - DNA, 16 bp, P. troglodytes
tattttgcctatttct

SEQ ID NO: 263909 - DNA, 16 bp, P. troglodytes
tattttgctaaaaata

SEQ ID NO: 263910 - DNA, 16 bp, P. troglodytes
tattttgctataaaat

SEQ ID NO: 263911 - DNA, 16 bp, P. troglodytes
tattttggaactctgg

SEQ ID NO: 263912 - DNA, 16 bp, P. troglodytes
tattttggacatttca

SEQ ID NO: 263913 - DNA, 16 bp, P. troglodytes
tattttggagaaaaaa

SEQ ID NO: 263914 - DNA, 16 bp, P. troglodytes
tattttggctcactgc

SEQ ID NO: 263915 - DNA, 16 bp, P. troglodytes
tattttggtaaaatat

SEQ ID NO: 263916 - DNA, 16 bp, P. troglodytes
tattttggtaaatata

SEQ ID NO: 263917 - DNA, 16 bp, P. troglodytes
tattttggtagagatt

SEQ ID NO: 263918 - DNA, 16 bp, P. troglodytes
tattttggtataggca

SEQ ID NO: 263919 - DNA, 16 bp, P. troglodytes
tattttgtaaaacaaa

SEQ ID NO: 263920 - DNA, 16 bp, P. troglodytes
tattttgtaaatgaaa

SEQ ID NO: 263921 - DNA, 16 bp, P. troglodytes
tattttgtaatagcag

SEQ ID NO: 263922 - DNA, 16 bp, P. troglodytes
tattttgtatatatct

SEQ ID NO: 263923 - DNA, 16 bp, P. troglodytes
tattttgtcattttca

SEQ ID NO: 263924 - DNA, 16 bp, P. troglodytes
tattttgtggaatatt

SEQ ID NO: 263925 - DNA, 16 bp, P. troglodytes
tattttgtggtaagaa

SEQ ID NO: 263926 - DNA, 16 bp, P. troglodytes
tattttgtgtacacag

SEQ ID NO: 263927 - DNA, 16 bp, P. troglodytes
tattttgttaaagcag

SEQ ID NO: 263928 - DNA, 16 bp, P. troglodytes
tattttgttgaatgaa

SEQ ID NO: 263929 - DNA, 16 bp, P. troglodytes
tattttgttgcctgtg

SEQ ID NO: 263930 - DNA, 16 bp, P. troglodytes
tattttgttttcaaaa

SEQ ID NO: 263931 - DNA, 16 bp, P. troglodytes
tatttttaaaaagcaa

SEQ ID NO: 263932 - DNA, 16 bp, P. troglodytes
tatttttaaaaagtga

SEQ ID NO: 263933 - DNA, 16 bp, P. troglodytes
tatttttaaaagagat

SEQ ID NO: 263934 - DNA, 16 bp, P. troglodytes
tatttttaaaagcata

SEQ ID NO: 263935 - DNA, 16 bp, P. troglodytes
tatttttaaaagcatt

SEQ ID NO: 263936 - DNA, 16 bp, P. troglodytes
tatttttaaaaggaat

SEQ ID NO: 263937 - DNA, 16 bp, P. troglodytes
tatttttaaaagttac

SEQ ID NO: 263938 - DNA, 16 bp, P. troglodytes
tatttttaaaatgtca

SEQ ID NO: 263939 - DNA, 16 bp, P. troglodytes
tatttttaaagaaact

SEQ ID NO: 263940 - DNA, 16 bp, P. troglodytes
tatttttaaagcaaaa

SEQ ID NO: 263941 - DNA, 16 bp, P. troglodytes
tatttttaaagcaatt

SEQ ID NO: 263942 - DNA, 16 bp, P. troglodytes
tatttttaaagcagaa

SEQ ID NO: 263943 - DNA, 16 bp, P. troglodytes
tatttttaaagcagtt

SEQ ID NO: 263944 - DNA, 16 bp, P. troglodytes
tatttttaaagcatgt

SEQ ID NO: 263945 - DNA, 16 bp, P. troglodytes
tatttttaaagcattt

SEQ ID NO: 263946 - DNA, 16 bp, P. troglodytes
tatttttaaaggagaa

SEQ ID NO: 263947 - DNA, 16 bp, P. troglodytes
tatttttaaagtttct

SEQ ID NO: 263948 - DNA, 16 bp, P. troglodytes
tatttttaaataactg

SEQ ID NO: 263949 - DNA, 16 bp, P. troglodytes
tatttttaaatagcta

SEQ ID NO: 263950 - DNA, 16 bp, P. troglodytes
tatttttaaatatcca

SEQ ID NO: 263951 - DNA, 16 bp, P. troglodytes
tatttttaaatcaaag

SEQ ID NO: 263952 - DNA, 16 bp, P. troglodytes
tatttttaaatgaaga

SEQ ID NO: 263953 - DNA, 16 bp, P. troglodytes
tatttttaaattaagg

SEQ ID NO: 263954 - DNA, 16 bp, P. troglodytes
tatttttaagaaaaag

SEQ ID NO: 263955 - DNA, 16 bp, P. troglodytes
tatttttaagaaaaca

SEQ ID NO: 263956 - DNA, 16 bp, P. troglodytes
tatttttaagacaaaa

SEQ ID NO: 263957 - DNA, 16 bp, P. troglodytes
tatttttaagactttt

SEQ ID NO: 263958 - DNA, 16 bp, P. troglodytes
tatttttaatattctg

SEQ ID NO: 263959 - DNA, 16 bp, P. troglodytes
tatttttaatgtcatt

SEQ ID NO: 263960 - DNA, 16 bp, P. troglodytes
tatttttaattttgca

SEQ ID NO: 263961 - DNA, 16 bp, P. troglodytes
tatttttacaaagttt

SEQ ID NO: 263962 - DNA, 16 bp, P. troglodytes
tatttttacatgaaaa

SEQ ID NO: 263963 - DNA, 16 bp, P. troglodytes
tatttttagaaaatgt

SEQ ID NO: 263964 - DNA, 16 bp, P. troglodytes
tatttttagcataaaa

SEQ ID NO: 263965 - DNA, 16 bp, P. troglodytes
tatttttagtacagat

SEQ ID NO: 263966 - DNA, 16 bp, P. troglodytes
tatttttataaagcaa

SEQ ID NO: 263967 - DNA, 16 bp, P. troglodytes
tatttttatacaagta

SEQ ID NO: 263968 - DNA, 16 bp, P. troglodytes
tatttttataccagta

SEQ ID NO: 263969 - DNA, 16 bp, P. troglodytes
tatttttatagagaaa

SEQ ID NO: 263970 - DNA, 16 bp, P. troglodytes
tatttttatagcattt

SEQ ID NO: 263971 - DNA, 16 bp, P. troglodytes
tatttttatattactg

SEQ ID NO: 263972 - DNA, 16 bp, P. troglodytes
tatttttatgtttaca

SEQ ID NO: 263973 - DNA, 16 bp, P. troglodytes
tatttttattggaaaa

SEQ ID NO: 263974 - DNA, 16 bp, P. troglodytes
tatttttcaaaaactt

SEQ ID NO: 263975 - DNA, 16 bp, P. troglodytes
tatttttcaaatgcat

SEQ ID NO: 263976 - DNA, 16 bp, P. troglodytes
tatttttcaaggtttt

SEQ ID NO: 263977 - DNA, 16 bp, P. troglodytes
tatttttcacagaaat

SEQ ID NO: 263978 - DNA, 16 bp, P. troglodytes
tatttttcagatgttt

SEQ ID NO: 263979 - DNA, 16 bp, P. troglodytes
tatttttcagtaattt

SEQ ID NO: 263980 - DNA, 16 bp, P. troglodytes
tatttttccaaaatga

SEQ ID NO: 263981 - DNA, 16 bp, P. troglodytes
tatttttccaatataa

SEQ ID NO: 263982 - DNA, 16 bp, P. troglodytes
tatttttccagaaatt

SEQ ID NO: 263983 - DNA, 16 bp, P. troglodytes
tatttttccagatttt

SEQ ID NO: 263984 - DNA, 16 bp, P. troglodytes
tatttttccaggaatt

SEQ ID NO: 263985 - DNA, 16 bp, P. troglodytes
tatttttcccttttgg

SEQ ID NO: 263986 - DNA, 16 bp, P. troglodytes
tatttttcctaatact

SEQ ID NO: 263987 - DNA, 16 bp, P. troglodytes
tatttttcctcataaa

SEQ ID NO: 263988 - DNA, 16 bp, P. troglodytes
tatttttcctgatact

SEQ ID NO: 263989 - DNA, 16 bp, P. troglodytes
tatttttcgtagagac

SEQ ID NO: 263990 - DNA, 16 bp, P. troglodytes
tatttttctaaaatca

SEQ ID NO: 263991 - DNA, 16 bp, P. troglodytes
tatttttctaagccaa

SEQ ID NO: 263992 - DNA, 16 bp, P. troglodytes
tatttttctgtataaa

SEQ ID NO: 263993 - DNA, 16 bp, P. troglodytes
tatttttctgtgaaat

SEQ ID NO: 263994 - DNA, 16 bp, P. troglodytes
tatttttctgtgcctg

SEQ ID NO: 263995 - DNA, 16 bp, P. troglodytes
tatttttcttcctaaa

SEQ ID NO: 263996 - DNA, 16 bp, P. troglodytes
tatttttcttctgaaa

SEQ ID NO: 263997 - DNA, 16 bp, P. troglodytes
tatttttcttgcctta

SEQ ID NO: 263998 - DNA, 16 bp, P. troglodytes
tatttttgaaaaatct

SEQ ID NO: 263999 - DNA, 16 bp, P. troglodytes
tatttttgaaaaatgt

SEQ ID NO: 264000 - DNA, 16 bp, P. troglodytes
tatttttgaaacattt

SEQ ID NO: 264001 - DNA, 16 bp, P. troglodytes
tatttttgaaagaatt

SEQ ID NO: 264002 - DNA, 16 bp, P. troglodytes
tatttttgatgaaaat

SEQ ID NO: 264003 - DNA, 16 bp, P. troglodytes
tatttttgatgcattt

SEQ ID NO: 264004 - DNA, 16 bp, P. troglodytes
tatttttgcatataaa

SEQ ID NO: 264005 - DNA, 16 bp, P. troglodytes
tatttttgcatatgga

SEQ ID NO: 264006 - DNA, 16 bp, P. troglodytes
tatttttgctggatat

SEQ ID NO: 264007 - DNA, 16 bp, P. troglodytes
tatttttggactgtgg

SEQ ID NO: 264008 - DNA, 16 bp, P. troglodytes
tatttttggcaaaaat

SEQ ID NO: 264009 - DNA, 16 bp, P. troglodytes
tatttttgggagagac

SEQ ID NO: 264010 - DNA, 16 bp, P. troglodytes
tatttttggtaaagac

SEQ ID NO: 264011 - DNA, 16 bp, P. troglodytes
tatttttggtgttgaa

SEQ ID NO: 264012 - DNA, 16 bp, P. troglodytes
tatttttgtaaaagaa

SEQ ID NO: 264013 - DNA, 16 bp, P. troglodytes
tatttttgtaaatgaa

SEQ ID NO: 264014 - DNA, 16 bp, P. troglodytes
tatttttgtacatgtt

SEQ ID NO: 264015 - DNA, 16 bp, P. troglodytes
tatttttgtagaatct

SEQ ID NO: 264016 - DNA, 16 bp, P. troglodytes
tatttttgtagagctg

SEQ ID NO: 264017 - DNA, 16 bp, P. troglodytes
tattttttaaacaact

SEQ ID NO: 264018 - DNA, 16 bp, P. troglodytes
tattttttaaaccaaa

SEQ ID NO: 264019 - DNA, 16 bp, P. troglodytes
tattttttaaagaaag

SEQ ID NO: 264020 - DNA, 16 bp, P. troglodytes
tattttttaaagttca

SEQ ID NO: 264021 - DNA, 16 bp, P. troglodytes
tattttttaaatgctt

SEQ ID NO: 264022 - DNA, 16 bp, P. troglodytes
tattttttaatagaga

SEQ ID NO: 264023 - DNA, 16 bp, P. troglodytes
tattttttaatctgta

SEQ ID NO: 264024 - DNA, 16 bp, P. troglodytes
tattttttagtagaga

SEQ ID NO: 264025 - DNA, 16 bp, P. troglodytes
tattttttatctgaaa

SEQ ID NO: 264026 - DNA, 16 bp, P. troglodytes
tattttttattgctga

SEQ ID NO: 264027 - DNA, 16 bp, P. troglodytes
tattttttcaaaaatg

SEQ ID NO: 264028 - DNA, 16 bp, P. troglodytes
tattttttcagcattt

SEQ ID NO: 264029 - DNA, 16 bp, P. troglodytes
tattttttccagattt

SEQ ID NO: 264030 - DNA, 16 bp, P. troglodytes
tattttttctaaaaca

SEQ ID NO: 264031 - DNA, 16 bp, P. troglodytes
tattttttctgagatg

SEQ ID NO: 264032 - DNA, 16 bp, P. troglodytes
tattttttcttccaga

SEQ ID NO: 264033 - DNA, 16 bp, P. troglodytes
tattttttctttagaa

SEQ ID NO: 264034 - DNA, 16 bp, P. troglodytes
tattttttgacacaga

SEQ ID NO: 264035 - DNA, 16 bp, P. troglodytes
tattttttgagaaagg

SEQ ID NO: 264036 - DNA, 16 bp, P. troglodytes
tattttttgcagagac

SEQ ID NO: 264037 - DNA, 16 bp, P. troglodytes
tattttttggtaaaga

SEQ ID NO: 264038 - DNA, 16 bp, P. troglodytes
tattttttgtacaaat

SEQ ID NO: 264039 - DNA, 16 bp, P. troglodytes
tatttttttaaagaag

SEQ ID NO: 264040 - DNA, 16 bp, P. troglodytes
tatttttttaaatctg

SEQ ID NO: 264041 - DNA, 16 bp, P. troglodytes
tatttttttaactgac

SEQ ID NO: 264042 - DNA, 16 bp, P. troglodytes
tatttttttaactgat

SEQ ID NO: 264043 - DNA, 16 bp, P. troglodytes
tatttttttcaggaaa

SEQ ID NO: 264044 - DNA, 16 bp, P. troglodytes
tatttttttcagtaat

SEQ ID NO: 264045 - DNA, 16 bp, P. troglodytes
tatttttttccagctt

SEQ ID NO: 264046 - DNA, 16 bp, P. troglodytes
tatttttttccagttg

SEQ ID NO: 264047 - DNA, 16 bp, P. troglodytes
tatttttttcctaaga

SEQ ID NO: 264048 - DNA, 16 bp, P. troglodytes
tatttttttctccaaa

SEQ ID NO: 264049 - DNA, 16 bp, P. troglodytes
tatttttttgagacaa

SEQ ID NO: 264050 - DNA, 16 bp, P. troglodytes
tatttttttggagatg

SEQ ID NO: 264051 - DNA, 18 bp, P. troglodytes
tatttttttgtagagaca

SEQ ID NO: 264052 - DNA, 16 bp, P. troglodytes
tcaaaaaaatgtttaa

SEQ ID NO: 264053 - DNA, 16 bp, P. troglodytes
tcaaaaaaccatctcc

SEQ ID NO: 264054 - DNA, 16 bp, P. troglodytes
tcaaaaaataaagtat

SEQ ID NO: 264055 - DNA, 16 bp, P. troglodytes
tcaaaaaatatatatg

SEQ ID NO: 264056 - DNA, 16 bp, P. troglodytes
tcaaaaaccaaaggta

SEQ ID NO: 264057 - DNA, 16 bp, P. troglodytes
tcaaaaagacaaaagg

SEQ ID NO: 264058 - DNA, 16 bp, P. troglodytes
tcaaaaagagagagag

SEQ ID NO: 264059 - DNA, 16 bp, P. troglodytes
tcaaaaagcagtttct

SEQ ID NO: 264060 - DNA, 16 bp, P. troglodytes
tcaaaaagtggacaaa

SEQ ID NO: 264061 - DNA, 16 bp, P. troglodytes
tcaaaaataatagcta

SEQ ID NO: 264062 - DNA, 16 bp, P. troglodytes
tcaaaaatacatttta

SEQ ID NO: 264063 - DNA, 16 bp, P. troglodytes
tcaaaaatatatatgt

SEQ ID NO: 264064 - DNA, 16 bp, P. troglodytes
tcaaaaatgtttattg

SEQ ID NO: 264065 - DNA, 16 bp, P. troglodytes
tcaaaaatgttttcca

SEQ ID NO: 264066 - DNA, 16 bp, P. troglodytes
tcaaaaattggcaaat

SEQ ID NO: 264067 - DNA, 16 bp, P. troglodytes
tcaaaacaattgaact

SEQ ID NO: 264068 - DNA, 16 bp, P. troglodytes
tcaaaacagttatttt

SEQ ID NO: 264069 - DNA, 16 bp, P. troglodytes
tcaaaacatcacatca

SEQ ID NO: 264070 - DNA, 16 bp, P. troglodytes
tcaaaaccaagaaatt

SEQ ID NO: 264071 - DNA, 16 bp, P. troglodytes
tcaaaaccacaagata

SEQ ID NO: 264072 - DNA, 16 bp, P. troglodytes
tcaaaaccacaatatc

SEQ ID NO: 264073 - DNA, 16 bp, P. troglodytes
tcaaaactcattgaac

SEQ ID NO: 264074 - DNA, 16 bp, P. troglodytes
tcaaaacttaccaaat

SEQ ID NO: 264075 - DNA, 16 bp, P. troglodytes
tcaaaacttcaggaaa

SEQ ID NO: 264076 - DNA, 16 bp, P. troglodytes
tcaaaagaaagattca

SEQ ID NO: 264077 - DNA, 16 bp, P. troglodytes
tcaaaagaagacctac

SEQ ID NO: 264078 - DNA, 16 bp, P. troglodytes
tcaaaagaagtcatac

SEQ ID NO: 264079 - DNA, 16 bp, P. troglodytes
tcaaaagacataaaat

SEQ ID NO: 264080 - DNA, 16 bp, P. troglodytes
tcaaaagacttttctg

SEQ ID NO: 264081 - DNA, 16 bp, P. troglodytes
tcaaaagcagccacag

SEQ ID NO: 264082 - DNA, 16 bp, P. troglodytes
tcaaaagccttaaaat

SEQ ID NO: 264083 - DNA, 16 bp, P. troglodytes
tcaaaaggaagcagag

SEQ ID NO: 264084 - DNA, 16 bp, P. troglodytes
tcaaaaggtagaaatg

SEQ ID NO: 264085 - DNA, 16 bp, P. troglodytes
tcaaaagtcaaaatta

SEQ ID NO: 264086 - DNA, 16 bp, P. troglodytes
tcaaaagtcaaagaag

SEQ ID NO: 264087 - DNA, 16 bp, P. troglodytes
tcaaaagtgtcaaagt

SEQ ID NO: 264088 - DNA, 16 bp, P. troglodytes
tcaaaataaactttct

SEQ ID NO: 264089 - DNA, 16 bp, P. troglodytes
tcaaaataaataatga

SEQ ID NO: 264090 - DNA, 16 bp, P. troglodytes
tcaaaataaattaaag

SEQ ID NO: 264091 - DNA, 16 bp, P. troglodytes
tcaaaataactaaaag

SEQ ID NO: 264092 - DNA, 16 bp, P. troglodytes
tcaaaataataagagc

SEQ ID NO: 264093 - DNA, 16 bp, P. troglodytes
tcaaaataataatgat

SEQ ID NO: 264094 - DNA, 16 bp, P. troglodytes
tcaaaataatctcctt

SEQ ID NO: 264095 - DNA, 16 bp, P. troglodytes
tcaaaataattgtttt

SEQ ID NO: 264096 - DNA, 16 bp, P. troglodytes
tcaaaatagtaagagc

SEQ ID NO: 264097 - DNA, 16 bp, P. troglodytes
tcaaaatatataagaa

SEQ ID NO: 264098 - DNA, 16 bp, P. troglodytes
tcaaaatatatcacaa

SEQ ID NO: 264099 - DNA, 16 bp, P. troglodytes
tcaaaatatgaaatat

SEQ ID NO: 264100 - DNA, 16 bp, P. troglodytes
tcaaaatatgccaaag

SEQ ID NO: 264101 - DNA, 16 bp, P. troglodytes
tcaaaatattaaaatg

SEQ ID NO: 264102 - DNA, 16 bp, P. troglodytes
tcaaaatattacatat

SEQ ID NO: 264103 - DNA, 16 bp, P. troglodytes
tcaaaatattttctaa

SEQ ID NO: 264104 - DNA, 16 bp, P. troglodytes
tcaaaatattttctgt

SEQ ID NO: 264105 - DNA, 16 bp, P. troglodytes
tcaaaatatttttgaa

SEQ ID NO: 264106 - DNA, 16 bp, P. troglodytes
tcaaaatcccaatgac

SEQ ID NO: 264107 - DNA, 16 bp, P. troglodytes
tcaaaatgaaagagaa

SEQ ID NO: 264108 - DNA, 16 bp, P. troglodytes
tcaaaatggaaaattt

SEQ ID NO: 264109 - DNA, 16 bp, P. troglodytes
tcaaaatggatcaaaa

SEQ ID NO: 264110 - DNA, 16 bp, P. troglodytes
tcaaaatggattaaac

SEQ ID NO: 264111 - DNA, 16 bp, P. troglodytes
tcaaaatggttaagat

SEQ ID NO: 264112 - DNA, 16 bp, P. troglodytes
tcaaaatgtatttttt

SEQ ID NO: 264113 - DNA, 16 bp, P. troglodytes
tcaaaatgtcaatagt

SEQ ID NO: 264114 - DNA, 16 bp, P. troglodytes
tcaaaatgttgaaaga

SEQ ID NO: 264115 - DNA, 16 bp, P. troglodytes
tcaaaatgttttttaa

SEQ ID NO: 264116 - DNA, 16 bp, P. troglodytes
tcaaaattaatgcaaa

SEQ ID NO: 264117 - DNA, 16 bp, P. troglodytes
tcaaaattcatgttga

SEQ ID NO: 264118 - DNA, 16 bp, P. troglodytes
tcaaaattccaatgat

SEQ ID NO: 264119 - DNA, 16 bp, P. troglodytes
tcaaaattgttacaaa

SEQ ID NO: 264120 - DNA, 16 bp, P. troglodytes
tcaaaatttaaaactt

SEQ ID NO: 264121 - DNA, 16 bp, P. troglodytes
tcaaaatttattttcc

SEQ ID NO: 264122 - DNA, 16 bp, P. troglodytes
tcaaacagaaggagtc

SEQ ID NO: 264123 - DNA, 16 bp, P. troglodytes
tcaaacagagacaatt

SEQ ID NO: 264124 - DNA, 16 bp, P. troglodytes
tcaaacaggctttgtg

SEQ ID NO: 264125 - DNA, 16 bp, P. troglodytes
tcaaacatcttttcat

SEQ ID NO: 264126 - DNA, 16 bp, P. troglodytes
tcaaacatgaaagaga

SEQ ID NO: 264127 - DNA, 16 bp, P. troglodytes
tcaaacattattttgg

SEQ ID NO: 264128 - DNA, 16 bp, P. troglodytes
tcaaaccatagcagaa

SEQ ID NO: 264129 - DNA, 16 bp, P. troglodytes
tcaaacccagatctgt

SEQ ID NO: 264130 - DNA, 16 bp, P. troglodytes
tcaaaccccatctcta

SEQ ID NO: 264131 - DNA, 16 bp, P. troglodytes
tcaaacctgaagccag

SEQ ID NO: 264132 - DNA, 16 bp, P. troglodytes
tcaaacgccatgctgg

SEQ ID NO: 264133 - DNA, 16 bp, P. troglodytes
tcaaactcagcatgtc

SEQ ID NO: 264134 - DNA, 16 bp, P. troglodytes
tcaaactcctgaactt

SEQ ID NO: 264135 - DNA, 16 bp, P. troglodytes
tcaaactcctgacccc

SEQ ID NO: 264136 - DNA, 17 bp, P. troglodytes
tcaaactcctgacctcg

SEQ ID NO: 264137 - DNA, 16 bp, P. troglodytes
tcaaactcctggccct

SEQ ID NO: 264138 - DNA, 16 bp, P. troglodytes
tcaaactctgggcctc

SEQ ID NO: 264139 - DNA, 16 bp, P. troglodytes
tcaaactcttctaaaa

SEQ ID NO: 264140 - DNA, 16 bp, P. troglodytes
tcaaactgaatccagc

SEQ ID NO: 264141 - DNA, 16 bp, P. troglodytes
tcaaactggaacatca

SEQ ID NO: 264142 - DNA, 16 bp, P. troglodytes
tcaaagaaaatgaaat

SEQ ID NO: 264143 - DNA, 16 bp, P. troglodytes
tcaaagaaattcaaga

SEQ ID NO: 264144 - DNA, 16 bp, P. troglodytes
tcaaagaaattcttga

SEQ ID NO: 264145 - DNA, 16 bp, P. troglodytes
tcaaagaagaaataga

SEQ ID NO: 264146 - DNA, 16 bp, P. troglodytes
tcaaagaatataaaat

SEQ ID NO: 264147 - DNA, 16 bp, P. troglodytes
tcaaagaatttttaaa

SEQ ID NO: 264148 - DNA, 16 bp, P. troglodytes
tcaaagacaaaaatca

SEQ ID NO: 264149 - DNA, 16 bp, P. troglodytes
tcaaagaccaaaacta

SEQ ID NO: 264150 - DNA, 17 bp, P. troglodytes
tcaaagacctagaggca

SEQ ID NO: 264151 - DNA, 16 bp, P. troglodytes
tcaaagacttaaagac

SEQ ID NO: 264152 - DNA, 16 bp, P. troglodytes
tcaaagagacacagga

SEQ ID NO: 264153 - DNA, 16 bp, P. troglodytes
tcaaagagagaaggaa

SEQ ID NO: 264154 - DNA, 16 bp, P. troglodytes
tcaaagagagagacag

SEQ ID NO: 264155 - DNA, 16 bp, P. troglodytes
tcaaagagatatctat

SEQ ID NO: 264156 - DNA, 16 bp, P. troglodytes
tcaaagagctaaaaaa

SEQ ID NO: 264157 - DNA, 16 bp, P. troglodytes
tcaaagagcttacagt

SEQ ID NO: 264158 - DNA, 16 bp, P. troglodytes
tcaaagataaagaaag

SEQ ID NO: 264159 - DNA, 21 bp, P. troglodytes
tcaaagatcagatagttgtag

SEQ ID NO: 264160 - DNA, 16 bp, P. troglodytes
tcaaagatcagttgac

SEQ ID NO: 264161 - DNA, 16 bp, P. troglodytes
tcaaagatgcagtgag

SEQ ID NO: 264162 - DNA, 16 bp, P. troglodytes
tcaaagattaaaggaa

SEQ ID NO: 264163 - DNA, 16 bp, P. troglodytes
tcaaagattttaaaat

SEQ ID NO: 264164 - DNA, 16 bp, P. troglodytes
tcaaagatttttttaa

SEQ ID NO: 264165 - DNA, 16 bp, P. troglodytes
tcaaagcaagtcacag

SEQ ID NO: 264166 - DNA, 16 bp, P. troglodytes
tcaaagcagcaaagca

SEQ ID NO: 264167 - DNA, 16 bp, P. troglodytes
tcaaagcccatgttct

SEQ ID NO: 264168 - DNA, 16 bp, P. troglodytes
tcaaaggaaaaaaatc

SEQ ID NO: 264169 - DNA, 16 bp, P. troglodytes
tcaaaggaaagtttca

SEQ ID NO: 264170 - DNA, 16 bp, P. troglodytes
tcaaaggaaatgttta

SEQ ID NO: 264171 - DNA, 16 bp, P. troglodytes
tcaaaggagttctaaa

SEQ ID NO: 264172 - DNA, 16 bp, P. troglodytes
tcaaaggattctcatg

SEQ ID NO: 264173 - DNA, 16 bp, P. troglodytes
tcaaaggcctttttct

SEQ ID NO: 264174 - DNA, 16 bp, P. troglodytes
tcaaagggcaataaaa

SEQ ID NO: 264175 - DNA, 16 bp, P. troglodytes
tcaaagtcattcatga

SEQ ID NO: 264176 - DNA, 25 bp, P. troglodytes
tcaaagtcattctccgtccagcttt

SEQ ID NO: 264177 - DNA, 16 bp, P. troglodytes
tcaaagtgctggaatt

SEQ ID NO: 264178 - DNA, 16 bp, P. troglodytes
tcaaagtgctggatta

SEQ ID NO: 264179 - DNA, 17 bp, P. troglodytes
tcaaagtgctgggatta

SEQ ID NO: 264180 - DNA, 17 bp, P. troglodytes
tcaaagtgctgggattg

SEQ ID NO: 264181 - DNA, 16 bp, P. troglodytes
tcaaagtgtggtcctt

SEQ ID NO: 264182 - DNA, 17 bp, P. troglodytes
tcaaagtgttgggatta

SEQ ID NO: 264183 - DNA, 16 bp, P. troglodytes
tcaaagttttcaactt

SEQ ID NO: 264184 - DNA, 16 bp, P. troglodytes
tcaaagttttgggatt

SEQ ID NO: 264185 - DNA, 16 bp, P. troglodytes
tcaaataaaacccatc

SEQ ID NO: 264186 - DNA, 16 bp, P. troglodytes
tcaaataattctcctg

SEQ ID NO: 264187 - DNA, 16 bp, P. troglodytes
tcaaataattctgttt

SEQ ID NO: 264188 - DNA, 16 bp, P. troglodytes
tcaaatagcctttctt

SEQ ID NO: 264189 - DNA, 16 bp, P. troglodytes
tcaaataggaacagag

SEQ ID NO: 264190 - DNA, 16 bp, P. troglodytes
tcaaatatcacctcct

SEQ ID NO: 264191 - DNA, 16 bp, P. troglodytes
tcaaatatttcttcat

SEQ ID NO: 264192 - DNA, 16 bp, P. troglodytes
tcaaatcaaaatggat

SEQ ID NO: 264193 - DNA, 16 bp, P. troglodytes
tcaaatcagggtattt

SEQ ID NO: 264194 - DNA, 16 bp, P. troglodytes
tcaaatcatcaggcat

SEQ ID NO: 264195 - DNA, 16 bp, P. troglodytes
tcaaatccaaaggaaa

SEQ ID NO: 264196 - DNA, 16 bp, P. troglodytes
tcaaatccaacaatat

SEQ ID NO: 264197 - DNA, 16 bp, P. troglodytes
tcaaatccaggaaata

SEQ ID NO: 264198 - DNA, 16 bp, P. troglodytes
tcaaatcctagaaaat

SEQ ID NO: 264199 - DNA, 16 bp, P. troglodytes
tcaaatcctgccactg

SEQ ID NO: 264200 - DNA, 16 bp, P. troglodytes
tcaaatctaaaaacat

SEQ ID NO: 264201 - DNA, 16 bp, P. troglodytes
tcaaatctcatcttaa

SEQ ID NO: 264202 - DNA, 16 bp, P. troglodytes
tcaaatctcatgagac

SEQ ID NO: 264203 - DNA, 16 bp, P. troglodytes
tcaaatctgtgagatg

SEQ ID NO: 264204 - DNA, 16 bp, P. troglodytes
tcaaatcttttgccca

SEQ ID NO: 264205 - DNA, 16 bp, P. troglodytes
tcaaatgaatagtttg

SEQ ID NO: 264206 - DNA, 16 bp, P. troglodytes
tcaaatgatagttctg

SEQ ID NO: 264207 - DNA, 16 bp, P. troglodytes
tcaaatgattcttctg

SEQ ID NO: 264208 - DNA, 16 bp, P. troglodytes
tcaaatgcatttattt

SEQ ID NO: 264209 - DNA, 16 bp, P. troglodytes
tcaaatgcttttgctg

SEQ ID NO: 264210 - DNA, 16 bp, P. troglodytes
tcaaatgcttttttgg

SEQ ID NO: 264211 - DNA, 16 bp, P. troglodytes
tcaaatggaaaaacaa

SEQ ID NO: 264212 - DNA, 16 bp, P. troglodytes
tcaaatgggaagagag

SEQ ID NO: 264213 - DNA, 16 bp, P. troglodytes
tcaaatgggtagattg

SEQ ID NO: 264214 - DNA, 16 bp, P. troglodytes
tcaaatggtttttctg

SEQ ID NO: 264215 - DNA, 16 bp, P. troglodytes
tcaaatgtattttttt

SEQ ID NO: 264216 - DNA, 16 bp, P. troglodytes
tcaaatgtcatctcct

SEQ ID NO: 264217 - DNA, 16 bp, P. troglodytes
tcaaatgtccatcaat

SEQ ID NO: 264218 - DNA, 20 bp, P. troglodytes
tcaaatgttaatctcctttg

SEQ ID NO: 264219 - DNA, 16 bp, P. troglodytes
tcaaatgttctttttt

SEQ ID NO: 264220 - DNA, 16 bp, P. troglodytes
tcaaatgtttttttct

SEQ ID NO: 264221 - DNA, 16 bp, P. troglodytes
tcaaattaccaatgtc

SEQ ID NO: 264222 - DNA, 16 bp, P. troglodytes
tcaaattaggataatt

SEQ ID NO: 264223 - DNA, 16 bp, P. troglodytes
tcaaattattttgttt

SEQ ID NO: 264224 - DNA, 17 bp, P. troglodytes
tcaaattcctgacctcg

SEQ ID NO: 264225 - DNA, 16 bp, P. troglodytes
tcaaattcctggcctc

SEQ ID NO: 264226 - DNA, 16 bp, P. troglodytes
tcaaattgaggaagtt

SEQ ID NO: 264227 - DNA, 17 bp, P. troglodytes
tcaaattgctgggatta

SEQ ID NO: 264228 - DNA, 16 bp, P. troglodytes
tcaaattggaaaagaa

SEQ ID NO: 264229 - DNA, 16 bp, P. troglodytes
tcaaatttaggaaatt

SEQ ID NO: 264230 - DNA, 16 bp, P. troglodytes
tcaaatttattggcat

SEQ ID NO: 264231 - DNA, 16 bp, P. troglodytes
tcaaatttgatgaaaa

SEQ ID NO: 264232 - DNA, 16 bp, P. troglodytes
tcaaattttgcttttt

SEQ ID NO: 264233 - DNA, 16 bp, P. troglodytes
tcaacaaaactgacaa

SEQ ID NO: 264234 - DNA, 16 bp, P. troglodytes
tcaacaaaatgaaaga

SEQ ID NO: 264235 - DNA, 16 bp, P. troglodytes
tcaacaaagaaacaat

SEQ ID NO: 264236 - DNA, 16 bp, P. troglodytes
tcaacaaatatattta

SEQ ID NO: 264237 - DNA, 16 bp, P. troglodytes
tcaacaaatatttatc

SEQ ID NO: 264238 - DNA, 16 bp, P. troglodytes
tcaacaaatgtttact

SEQ ID NO: 264239 - DNA, 16 bp, P. troglodytes
tcaacaagaagatcta

SEQ ID NO: 264240 - DNA, 17 bp, P. troglodytes
tcaacaagacagaaagt

SEQ ID NO: 264241 - DNA, 16 bp, P. troglodytes
tcaacaagcaaaatgc

SEQ ID NO: 264242 - DNA, 16 bp, P. troglodytes
tcaacaagtgggtgaa

SEQ ID NO: 264243 - DNA, 16 bp, P. troglodytes
tcaacacagctatttt

SEQ ID NO: 264244 - DNA, 16 bp, P. troglodytes
tcaacacatgaggatt

SEQ ID NO: 264245 - DNA, 16 bp, P. troglodytes
tcaacaccagcctggt

SEQ ID NO: 264246 - DNA, 17 bp, P. troglodytes
tcaacactccactgaca

SEQ ID NO: 264247 - DNA, 16 bp, P. troglodytes
tcaacagaatgaaaaa

SEQ ID NO: 264248 - DNA, 16 bp, P. troglodytes
tcaacagaatgaagga

SEQ ID NO: 264249 - DNA, 16 bp, P. troglodytes
tcaacagatatttatt

SEQ ID NO: 264250 - DNA, 16 bp, P. troglodytes
tcaacagatgaataaa

SEQ ID NO: 264251 - DNA, 16 bp, P. troglodytes
tcaacagatgaatttt

SEQ ID NO: 264252 - DNA, 16 bp, P. troglodytes
tcaacagcaccatcaa

SEQ ID NO: 264253 - DNA, 16 bp, P. troglodytes
tcaacagcagaatgaa

SEQ ID NO: 264254 - DNA, 16 bp, P. troglodytes
tcaacagtagaatgaa

SEQ ID NO: 264255 - DNA, 16 bp, P. troglodytes
tcaacagtgccaaggt

SEQ ID NO: 264256 - DNA, 16 bp, P. troglodytes
tcaacatagtactgga

SEQ ID NO: 264257 - DNA, 16 bp, P. troglodytes
tcaacatagtatttga

SEQ ID NO: 264258 - DNA, 16 bp, P. troglodytes
tcaacatagtgagacc

SEQ ID NO: 264259 - DNA, 16 bp, P. troglodytes
tcaacatatgaaaatc

SEQ ID NO: 264260 - DNA, 16 bp, P. troglodytes
tcaacatcaaagacca

SEQ ID NO: 264261 - DNA, 16 bp, P. troglodytes
tcaacatcactgtctt

SEQ ID NO: 264262 - DNA, 16 bp, P. troglodytes
tcaacatcatcatcat

SEQ ID NO: 264263 - DNA, 16 bp, P. troglodytes
tcaacatcctgcacca

SEQ ID NO: 264264 - DNA, 16 bp, P. troglodytes
tcaacatggagaaacc

SEQ ID NO: 264265 - DNA, 16 bp, P. troglodytes
tcaacatggatgaatc

SEQ ID NO: 264266 - DNA, 19 bp, P. troglodytes
tcaacatggtgaaacccca

SEQ ID NO: 264267 - DNA, 18 bp, P. troglodytes
tcaacatggtgaaaccct

SEQ ID NO: 264268 - DNA, 17 bp, P. troglodytes
tcaacatggtgaaatcc

SEQ ID NO: 264269 - DNA, 16 bp, P. troglodytes
tcaacattaacaggag

SEQ ID NO: 264270 - DNA, 16 bp, P. troglodytes
tcaacattgtactgaa

SEQ ID NO: 264271 - DNA, 16 bp, P. troglodytes
tcaacatttggaagat

SEQ ID NO: 264272 - DNA, 16 bp, P. troglodytes
tcaaccaactacagat

SEQ ID NO: 264273 - DNA, 16 bp, P. troglodytes
tcaaccaactgtggat

SEQ ID NO: 264274 - DNA, 16 bp, P. troglodytes
tcaaccaagaattcta

SEQ ID NO: 264275 - DNA, 16 bp, P. troglodytes
tcaaccatggtggaag

SEQ ID NO: 264276 - DNA, 16 bp, P. troglodytes
tcaacccgtcatctgc

SEQ ID NO: 264277 - DNA, 16 bp, P. troglodytes
tcaacctaagtgtctg

SEQ ID NO: 264278 - DNA, 16 bp, P. troglodytes
tcaacctaagtgttca

SEQ ID NO: 264279 - DNA, 16 bp, P. troglodytes
tcaacctccacctcct

SEQ ID NO: 264280 - DNA, 16 bp, P. troglodytes
tcaacctccagggttc

SEQ ID NO: 264281 - DNA, 16 bp, P. troglodytes
tcaacctcctgagtgg

SEQ ID NO: 264282 - DNA, 16 bp, P. troglodytes
tcaacctctgcctcct

SEQ ID NO: 264283 - DNA, 16 bp, P. troglodytes
tcaacctgggaggcag

SEQ ID NO: 264284 - DNA, 16 bp, P. troglodytes
tcaacctgtcatttac

SEQ ID NO: 264285 - DNA, 17 bp, P. troglodytes
tcaacctgtcatttaca

SEQ ID NO: 264286 - DNA, 16 bp, P. troglodytes
tcaacgatagactgga

SEQ ID NO: 264287 - DNA, 16 bp, P. troglodytes
tcaactcaaaatgggt

SEQ ID NO: 264288 - DNA, 16 bp, P. troglodytes
tcaactcaatgaaata

SEQ ID NO: 264289 - DNA, 16 bp, P. troglodytes
tcaactcatttcagca

SEQ ID NO: 264290 - DNA, 16 bp, P. troglodytes
tcaactccaaatacaa

SEQ ID NO: 264291 - DNA, 16 bp, P. troglodytes
tcaactctcccatttg

SEQ ID NO: 264292 - DNA, 16 bp, P. troglodytes
tcaactgaaaatggat

SEQ ID NO: 264293 - DNA, 16 bp, P. troglodytes
tcaactgtttttattt

SEQ ID NO: 264294 - DNA, 16 bp, P. troglodytes
tcaacttattcctggt

SEQ ID NO: 264295 - DNA, 16 bp, P. troglodytes
tcaacttctctgagcc

SEQ ID NO: 264296 - DNA, 16 bp, P. troglodytes
tcaacttgactgggct

SEQ ID NO: 264297 - DNA, 16 bp, P. troglodytes
tcaacttgataaagag

SEQ ID NO: 264298 - DNA, 17 bp, P. troglodytes
tcaacttgtcatttaca

SEQ ID NO: 264299 - DNA, 16 bp, P. troglodytes
tcaactttggcttttg

SEQ ID NO: 264300 - DNA, 16 bp, P. troglodytes
tcaacttttgcttttg

SEQ ID NO: 264301 - DNA, 16 bp, P. troglodytes
tcaagaaaaaatatat

SEQ ID NO: 264302 - DNA, 16 bp, P. troglodytes
tcaagaaaaaggaaga

SEQ ID NO: 264303 - DNA, 16 bp, P. troglodytes
tcaagaaaacagaaat

SEQ ID NO: 264304 - DNA, 16 bp, P. troglodytes
tcaagaaaagcctggg

SEQ ID NO: 264305 - DNA, 16 bp, P. troglodytes
tcaagaaaaggaagaa

SEQ ID NO: 264306 - DNA, 16 bp, P. troglodytes
tcaagaaaatattagc

SEQ ID NO: 264307 - DNA, 16 bp, P. troglodytes
tcaagaaaatcatgaa

SEQ ID NO: 264308 - DNA, 16 bp, P. troglodytes
tcaagaaaatgagaag

SEQ ID NO: 264309 - DNA, 16 bp, P. troglodytes
tcaagaaacaatagat

SEQ ID NO: 264310 - DNA, 16 bp, P. troglodytes
tcaagaaagaattcag

SEQ ID NO: 264311 - DNA, 16 bp, P. troglodytes
tcaagaaagcaatcct

SEQ ID NO: 264312 - DNA, 16 bp, P. troglodytes
tcaagaaagtgaaaaa

SEQ ID NO: 264313 - DNA, 16 bp, P. troglodytes
tcaagaaataaatgtt

SEQ ID NO: 264314 - DNA, 16 bp, P. troglodytes
tcaagaaatacttatt

SEQ ID NO: 264315 - DNA, 16 bp, P. troglodytes
tcaagaaatatgggac

SEQ ID NO: 264316 - DNA, 16 bp, P. troglodytes
tcaagaaatatttatt

SEQ ID NO: 264317 - DNA, 16 bp, P. troglodytes
tcaagaacacacaatg

SEQ ID NO: 264318 - DNA, 16 bp, P. troglodytes
tcaagaagaaatagat

SEQ ID NO: 264319 - DNA, 16 bp, P. troglodytes
tcaagaagaatctgaa

SEQ ID NO: 264320 - DNA, 16 bp, P. troglodytes
tcaagaagctcaacaa

SEQ ID NO: 264321 - DNA, 16 bp, P. troglodytes
tcaagaagctgaggca

SEQ ID NO: 264322 - DNA, 16 bp, P. troglodytes
tcaagaagcttataat

SEQ ID NO: 264323 - DNA, 16 bp, P. troglodytes
tcaagaaggaaataaa

SEQ ID NO: 264324 - DNA, 16 bp, P. troglodytes
tcaagaaggcctgcct

SEQ ID NO: 264325 - DNA, 16 bp, P. troglodytes
tcaagaagttctttga

SEQ ID NO: 264326 - DNA, 16 bp, P. troglodytes
tcaagaagtttaaaat

SEQ ID NO: 264327 - DNA, 16 bp, P. troglodytes
tcaagaatgcagtgag

SEQ ID NO: 264328 - DNA, 16 bp, P. troglodytes
tcaagaattcaagacc

SEQ ID NO: 264329 - DNA, 16 bp, P. troglodytes
tcaagaccaccctgag

SEQ ID NO: 264330 - DNA, 16 bp, P. troglodytes
tcaagaccagactagg

SEQ ID NO: 264331 - DNA, 16 bp, P. troglodytes
tcaagaccagcatggg

SEQ ID NO: 264332 - DNA, 16 bp, P. troglodytes
tcaagaccagcatggt

SEQ ID NO: 264333 - DNA, 16 bp, P. troglodytes
tcaagaccagccaggc

SEQ ID NO: 264334 - DNA, 16 bp, P. troglodytes
tcaagaccagcctcaa

SEQ ID NO: 264335 - DNA, 17 bp, P. troglodytes
tcaagaccagcctgggg

SEQ ID NO: 264336 - DNA, 16 bp, P. troglodytes
tcaagaccagcctgtg

SEQ ID NO: 264337 - DNA, 16 bp, P. troglodytes
tcaagaccatcctgga

SEQ ID NO: 264338 - DNA, 17 bp, P. troglodytes
tcaagaccatcctggat

SEQ ID NO: 264339 - DNA, 16 bp, P. troglodytes
tcaagaccatcctggt

SEQ ID NO: 264340 - DNA, 16 bp, P. troglodytes
tcaagactcattggtg

SEQ ID NO: 264341 - DNA, 16 bp, P. troglodytes
tcaagacttcagtgga

SEQ ID NO: 264342 - DNA, 16 bp, P. troglodytes
tcaagagaaattattt

SEQ ID NO: 264343 - DNA, 16 bp, P. troglodytes
tcaagagaacagcaca

SEQ ID NO: 264344 - DNA, 16 bp, P. troglodytes
tcaagagatgctcctg

SEQ ID NO: 264345 - DNA, 16 bp, P. troglodytes
tcaagaggaagcagaa

SEQ ID NO: 264346 - DNA, 16 bp, P. troglodytes
tcaagaggaatgcttc

SEQ ID NO: 264347 - DNA, 16 bp, P. troglodytes
tcaagagtgaagctgc

SEQ ID NO: 264348 - DNA, 16 bp, P. troglodytes
tcaagagtttgagagc

SEQ ID NO: 264349 - DNA, 16 bp, P. troglodytes
tcaagataaagaacat

SEQ ID NO: 264350 - DNA, 16 bp, P. troglodytes
tcaagatcagcctgaa

SEQ ID NO: 264351 - DNA, 16 bp, P. troglodytes
tcaagatcgcaccact

SEQ ID NO: 264352 - DNA, 16 bp, P. troglodytes
tcaagatgagcctgga

SEQ ID NO: 264353 - DNA, 16 bp, P. troglodytes
tcaagatggctgaata

SEQ ID NO: 264354 - DNA, 16 bp, P. troglodytes
tcaagatgggatttgg

SEQ ID NO: 264355 - DNA, 16 bp, P. troglodytes
tcaagatggtggctcc

SEQ ID NO: 264356 - DNA, 16 bp, P. troglodytes
tcaagatttggaagca

SEQ ID NO: 264357 - DNA, 16 bp, P. troglodytes
tcaagatttttttctt

SEQ ID NO: 264358 - DNA, 16 bp, P. troglodytes
tcaagcaacccttcca

SEQ ID NO: 264359 - DNA, 16 bp, P. troglodytes
tcaagcaactctcctg

SEQ ID NO: 264360 - DNA, 16 bp, P. troglodytes
tcaagcaactctctgc

SEQ ID NO: 264361 - DNA, 16 bp, P. troglodytes
tcaagcaatcctcccg

SEQ ID NO: 264362 - DNA, 16 bp, P. troglodytes
tcaagcaatcctccct

SEQ ID NO: 264363 - DNA, 16 bp, P. troglodytes
tcaagcaatccttcca

SEQ ID NO: 264364 - DNA, 16 bp, P. troglodytes
tcaagcaatgctccca

SEQ ID NO: 264365 - DNA, 16 bp, P. troglodytes
tcaagcaattctccta

SEQ ID NO: 264366 - DNA, 16 bp, P. troglodytes
tcaagcaattctgtct

SEQ ID NO: 264367 - DNA, 16 bp, P. troglodytes
tcaagcaattttcctg

SEQ ID NO: 264368 - DNA, 16 bp, P. troglodytes
tcaagcagaagaattt

SEQ ID NO: 264369 - DNA, 16 bp, P. troglodytes
tcaagcagaagagaga

SEQ ID NO: 264370 - DNA, 16 bp, P. troglodytes
tcaagcagagggaagg

SEQ ID NO: 264371 - DNA, 16 bp, P. troglodytes
tcaagcagtcctcctg

SEQ ID NO: 264372 - DNA, 16 bp, P. troglodytes
tcaagcagttctccca

SEQ ID NO: 264373 - DNA, 19 bp, P. troglodytes
tcaagcagttctgcctcag

SEQ ID NO: 264374 - DNA, 16 bp, P. troglodytes
tcaagcagttttccca

SEQ ID NO: 264375 - DNA, 16 bp, P. troglodytes
tcaagcataaaactgg

SEQ ID NO: 264376 - DNA, 16 bp, P. troglodytes
tcaagccatcctccca

SEQ ID NO: 264377 - DNA, 16 bp, P. troglodytes
tcaagcccaggagttc

SEQ ID NO: 264378 - DNA, 16 bp, P. troglodytes
tcaagcctgggcaatg

SEQ ID NO: 264379 - DNA, 16 bp, P. troglodytes
tcaagcctttctcctg

SEQ ID NO: 264380 - DNA, 16 bp, P. troglodytes
tcaagcgatcatccca

SEQ ID NO: 264381 - DNA, 16 bp, P. troglodytes
tcaagcgatccacccg

SEQ ID NO: 264382 - DNA, 16 bp, P. troglodytes
tcaagcgatcctcctg

SEQ ID NO: 264383 - DNA, 18 bp, P. troglodytes
tcaagcgattctcctgct

SEQ ID NO: 264384 - DNA, 16 bp, P. troglodytes
tcaagctacagatggt

SEQ ID NO: 264385 - DNA, 16 bp, P. troglodytes
tcaagctatccttctg

SEQ ID NO: 264386 - DNA, 16 bp, P. troglodytes
tcaagctattttcctg

SEQ ID NO: 264387 - DNA, 16 bp, P. troglodytes
tcaagcttggtggggg

SEQ ID NO: 264388 - DNA, 16 bp, P. troglodytes
tcaagctttcagatga

SEQ ID NO: 264389 - DNA, 16 bp, P. troglodytes
tcaaggaaataacaga

SEQ ID NO: 264390 - DNA, 16 bp, P. troglodytes
tcaaggaaataagaga

SEQ ID NO: 264391 - DNA, 16 bp, P. troglodytes
tcaaggaaatcatgaa

SEQ ID NO: 264392 - DNA, 16 bp, P. troglodytes
tcaaggaaccagagaa

SEQ ID NO: 264393 - DNA, 16 bp, P. troglodytes
tcaaggaacttaaaat

SEQ ID NO: 264394 - DNA, 16 bp, P. troglodytes
tcaaggaagaaataaa

SEQ ID NO: 264395 - DNA, 16 bp, P. troglodytes
tcaaggacaaaaaacc

SEQ ID NO: 264396 - DNA, 16 bp, P. troglodytes
tcaaggagaacttcaa

SEQ ID NO: 264397 - DNA, 16 bp, P. troglodytes
tcaaggagagaatctt

SEQ ID NO: 264398 - DNA, 16 bp, P. troglodytes
tcaaggagctcacagt

SEQ ID NO: 264399 - DNA, 16 bp, P. troglodytes
tcaaggaggcctgcct

SEQ ID NO: 264400 - DNA, 16 bp, P. troglodytes
tcaaggaggccttcct

SEQ ID NO: 264401 - DNA, 16 bp, P. troglodytes
tcaaggaggctggaga

SEQ ID NO: 264402 - DNA, 16 bp, P. troglodytes
tcaaggatatagaacc

SEQ ID NO: 264403 - DNA, 16 bp, P. troglodytes
tcaaggatattgacct

SEQ ID NO: 264404 - DNA, 16 bp, P. troglodytes
tcaaggcagaagaatt

SEQ ID NO: 264405 - DNA, 16 bp, P. troglodytes
tcaaggcagaaggcaa

SEQ ID NO: 264406 - DNA, 16 bp, P. troglodytes
tcaaggcagacctggg

SEQ ID NO: 264407 - DNA, 16 bp, P. troglodytes
tcaaggcagcagtgag

SEQ ID NO: 264408 - DNA, 16 bp, P. troglodytes
tcaaggccaacctggg

SEQ ID NO: 264409 - DNA, 16 bp, P. troglodytes
tcaaggccagcctggc

SEQ ID NO: 264410 - DNA, 16 bp, P. troglodytes
tcaaggccatcctggc

SEQ ID NO: 264411 - DNA, 16 bp, P. troglodytes
tcaaggccctagggct

SEQ ID NO: 264412 - DNA, 16 bp, P. troglodytes
tcaaggcctgtgatgg

SEQ ID NO: 264413 - DNA, 16 bp, P. troglodytes
tcaaggctacagtggg

SEQ ID NO: 264414 - DNA, 16 bp, P. troglodytes
tcaaggctgcagtaag

SEQ ID NO: 264415 - DNA, 16 bp, P. troglodytes
tcaaggctgtagtgag

SEQ ID NO: 264416 - DNA, 16 bp, P. troglodytes
tcaagggaaaagaaaa

SEQ ID NO: 264417 - DNA, 19 bp, P. troglodytes
tcaagggattctcctgcct

SEQ ID NO: 264418 - DNA, 16 bp, P. troglodytes
tcaagggcaggaccag

SEQ ID NO: 264419 - DNA, 16 bp, P. troglodytes
tcaaggggaagaaagg

SEQ ID NO: 264420 - DNA, 16 bp, P. troglodytes
tcaagggtcaacagta

SEQ ID NO: 264421 - DNA, 16 bp, P. troglodytes
tcaaggtcacacagtg

SEQ ID NO: 264422 - DNA, 16 bp, P. troglodytes
tcaaggtgctgggatt

SEQ ID NO: 264423 - DNA, 16 bp, P. troglodytes
tcaagtaacttgtcca

SEQ ID NO: 264424 - DNA, 16 bp, P. troglodytes
tcaagtaatctgcctg

SEQ ID NO: 264425 - DNA, 16 bp, P. troglodytes
tcaagtacccagagac

SEQ ID NO: 264426 - DNA, 16 bp, P. troglodytes
tcaagtattctgtttt

SEQ ID NO: 264427 - DNA, 16 bp, P. troglodytes
tcaagtcaggagtttg

SEQ ID NO: 264428 - DNA, 16 bp, P. troglodytes
tcaagtccttgatggt

SEQ ID NO: 264429 - DNA, 16 bp, P. troglodytes
tcaagtctgcagtgag

SEQ ID NO: 264430 - DNA, 16 bp, P. troglodytes
tcaagtgaaaggaaga

SEQ ID NO: 264431 - DNA, 16 bp, P. troglodytes
tcaagtgatccacccg

SEQ ID NO: 264432 - DNA, 21 bp, P. troglodytes
tcaagtgatccacctgcctcg

SEQ ID NO: 264433 - DNA, 16 bp, P. troglodytes
tcaagtgatccgccca

SEQ ID NO: 264434 - DNA, 16 bp, P. troglodytes
tcaagtgatcctcaag

SEQ ID NO: 264435 - DNA, 17 bp, P. troglodytes
tcaagtgatcctcccaa

SEQ ID NO: 264436 - DNA, 17 bp, P. troglodytes
tcaagtgatcctcccat

SEQ ID NO: 264437 - DNA, 16 bp, P. troglodytes
tcaagtgatcctccta

SEQ ID NO: 264438 - DNA, 21 bp, P. troglodytes
tcaagtgatctgcccgcctca

SEQ ID NO: 264439 - DNA, 16 bp, P. troglodytes
tcaagtgattatcttg

SEQ ID NO: 264440 - DNA, 16 bp, P. troglodytes
tcaagtgctccacctg

SEQ ID NO: 264441 - DNA, 16 bp, P. troglodytes
tcaagtgggctttatt

SEQ ID NO: 264442 - DNA, 16 bp, P. troglodytes
tcaagtgttctcacca

SEQ ID NO: 264443 - DNA, 16 bp, P. troglodytes
tcaagttaattttttt

SEQ ID NO: 264444 - DNA, 16 bp, P. troglodytes
tcaagttatcctcccg

SEQ ID NO: 264445 - DNA, 16 bp, P. troglodytes
tcaagttgagattttt

SEQ ID NO: 264446 - DNA, 16 bp, P. troglodytes
tcaagttggaaagaac

SEQ ID NO: 264447 - DNA, 16 bp, P. troglodytes
tcaagttttattatga

SEQ ID NO: 264448 - DNA, 16 bp, P. troglodytes
tcaagtttttaaaaat

SEQ ID NO: 264449 - DNA, 16 bp, P. troglodytes
tcaagttttttttaaa

SEQ ID NO: 264450 - DNA, 16 bp, P. troglodytes
tcaataaaactgttat

SEQ ID NO: 264451 - DNA, 16 bp, P. troglodytes
tcaataaaagttgctg

SEQ ID NO: 264452 - DNA, 16 bp, P. troglodytes
tcaataaaattgataa

SEQ ID NO: 264453 - DNA, 16 bp, P. troglodytes
tcaataaacattagct

SEQ ID NO: 264454 - DNA, 16 bp, P. troglodytes
tcaataaacatttatt

SEQ ID NO: 264455 - DNA, 16 bp, P. troglodytes
tcaataaacatttttt

SEQ ID NO: 264456 - DNA, 17 bp, P. troglodytes
tcaataaagcacctctt

SEQ ID NO: 264457 - DNA, 16 bp, P. troglodytes
tcaataaagctgaaaa

SEQ ID NO: 264458 - DNA, 16 bp, P. troglodytes
tcaataaagctgttta

SEQ ID NO: 264459 - DNA, 16 bp, P. troglodytes
tcaataaagtttattt

SEQ ID NO: 264460 - DNA, 16 bp, P. troglodytes
tcaataaatacttgtg

SEQ ID NO: 264461 - DNA, 16 bp, P. troglodytes
tcaataaatatctttt

SEQ ID NO: 264462 - DNA, 16 bp, P. troglodytes
tcaataaatatgtatt

SEQ ID NO: 264463 - DNA, 16 bp, P. troglodytes
tcaataaatattgaat

SEQ ID NO: 264464 - DNA, 16 bp, P. troglodytes
tcaataaatatttcta

SEQ ID NO: 264465 - DNA, 16 bp, P. troglodytes
tcaataaatatttgag

SEQ ID NO: 264466 - DNA, 16 bp, P. troglodytes
tcaataaatatttgta

SEQ ID NO: 264467 - DNA, 16 bp, P. troglodytes
tcaataaatatttgtg

SEQ ID NO: 264468 - DNA, 16 bp, P. troglodytes
tcaataaatattttct

SEQ ID NO: 264469 - DNA, 16 bp, P. troglodytes
tcaataaatgcttact

SEQ ID NO: 264470 - DNA, 16 bp, P. troglodytes
tcaataaatgcttatt

SEQ ID NO: 264471 - DNA, 16 bp, P. troglodytes
tcaataaatgcttgtt

SEQ ID NO: 264472 - DNA, 16 bp, P. troglodytes
tcaataaatgtgaatt

SEQ ID NO: 264473 - DNA, 16 bp, P. troglodytes
tcaataaatgtgtatt

SEQ ID NO: 264474 - DNA, 16 bp, P. troglodytes
tcaataaatgtgtttc

SEQ ID NO: 264475 - DNA, 16 bp, P. troglodytes
tcaataaatgttagct

SEQ ID NO: 264476 - DNA, 16 bp, P. troglodytes
tcaataaatgttattt

SEQ ID NO: 264477 - DNA, 16 bp, P. troglodytes
tcaataaatgtttatt

SEQ ID NO: 264478 - DNA, 16 bp, P. troglodytes
tcaataaatgtttctg

SEQ ID NO: 264479 - DNA, 16 bp, P. troglodytes
tcaataaatgtttctt

SEQ ID NO: 264480 - DNA, 16 bp, P. troglodytes
tcaataaatgtttgct

SEQ ID NO: 264481 - DNA, 16 bp, P. troglodytes
tcaataacagaagaaa

SEQ ID NO: 264482 - DNA, 16 bp, P. troglodytes
tcaatacctaatttgt

SEQ ID NO: 264483 - DNA, 16 bp, P. troglodytes
tcaatactgttttcca

SEQ ID NO: 264484 - DNA, 16 bp, P. troglodytes
tcaatagatatttatt

SEQ ID NO: 264485 - DNA, 16 bp, P. troglodytes
tcaatagcaagaggaa

SEQ ID NO: 264486 - DNA, 16 bp, P. troglodytes
tcaatatatgtaaaat

SEQ ID NO: 264487 - DNA, 16 bp, P. troglodytes
tcaatatatttttgaa

SEQ ID NO: 264488 - DNA, 16 bp, P. troglodytes
tcaatatcaagaagat

SEQ ID NO: 264489 - DNA, 16 bp, P. troglodytes
tcaatattataaagat

SEQ ID NO: 264490 - DNA, 16 bp, P. troglodytes
tcaatattatgaaaat

SEQ ID NO: 264491 - DNA, 16 bp, P. troglodytes
tcaatatttagctccc

SEQ ID NO: 264492 - DNA, 16 bp, P. troglodytes
tcaatcaaaatctcag

SEQ ID NO: 264493 - DNA, 16 bp, P. troglodytes
tcaatcaaacctcttt

SEQ ID NO: 264494 - DNA, 16 bp, P. troglodytes
tcaatcagtcctcctg

SEQ ID NO: 264495 - DNA, 16 bp, P. troglodytes
tcaatccaaaagaaaa

SEQ ID NO: 264496 - DNA, 16 bp, P. troglodytes
tcaatccaaatgtcca

SEQ ID NO: 264497 - DNA, 17 bp, P. troglodytes
tcaatccaatcaagttg

SEQ ID NO: 264498 - DNA, 16 bp, P. troglodytes
tcaatcccttttataa

SEQ ID NO: 264499 - DNA, 16 bp, P. troglodytes
tcaatctctctctctc

SEQ ID NO: 264500 - DNA, 16 bp, P. troglodytes
tcaatctgaaataaaa

SEQ ID NO: 264501 - DNA, 16 bp, P. troglodytes
tcaatcttgagttgat

SEQ ID NO: 264502 - DNA, 16 bp, P. troglodytes
tcaatctttgaggttg

SEQ ID NO: 264503 - DNA, 16 bp, P. troglodytes
tcaatgaaaatttaaa

SEQ ID NO: 264504 - DNA, 16 bp, P. troglodytes
tcaatgaaaccaaaag

SEQ ID NO: 264505 - DNA, 16 bp, P. troglodytes
tcaatgaacttgaaga

SEQ ID NO: 264506 - DNA, 16 bp, P. troglodytes
tcaatgaagaaattaa

SEQ ID NO: 264507 - DNA, 16 bp, P. troglodytes
tcaatgaataaataaa

SEQ ID NO: 264508 - DNA, 16 bp, P. troglodytes
tcaatgaatatttctt

SEQ ID NO: 264509 - DNA, 16 bp, P. troglodytes
tcaatgaatgaataaa

SEQ ID NO: 264510 - DNA, 16 bp, P. troglodytes
tcaatgactggcttca

SEQ ID NO: 264511 - DNA, 18 bp, P. troglodytes
tcaatgcaaggaagctaa

SEQ ID NO: 264512 - DNA, 16 bp, P. troglodytes
tcaatgcaattcctat

SEQ ID NO: 264513 - DNA, 16 bp, P. troglodytes
tcaatgccaaccccat

SEQ ID NO: 264514 - DNA, 16 bp, P. troglodytes
tcaatggacaaatgga

SEQ ID NO: 264515 - DNA, 16 bp, P. troglodytes
tcaatggatttttaaa

SEQ ID NO: 264516 - DNA, 16 bp, P. troglodytes
tcaatgtcttatttat

SEQ ID NO: 264517 - DNA, 16 bp, P. troglodytes
tcaatgtgatggtatt

SEQ ID NO: 264518 - DNA, 16 bp, P. troglodytes
tcaatgtgctgctgga

SEQ ID NO: 264519 - DNA, 16 bp, P. troglodytes
tcaatgttcatcaaag

SEQ ID NO: 264520 - DNA, 16 bp, P. troglodytes
tcaatgttttataatt

SEQ ID NO: 264521 - DNA, 16 bp, P. troglodytes
tcaattaaatcagaat

SEQ ID NO: 264522 - DNA, 16 bp, P. troglodytes
tcaattacttccacct

SEQ ID NO: 264523 - DNA, 16 bp, P. troglodytes
tcaattaggtcaaatt

SEQ ID NO: 264524 - DNA, 16 bp, P. troglodytes
tcaattatgtggtcaa

SEQ ID NO: 264525 - DNA, 16 bp, P. troglodytes
tcaattcatacaaaac

SEQ ID NO: 264526 - DNA, 16 bp, P. troglodytes
tcaattccaagcttca

SEQ ID NO: 264527 - DNA, 16 bp, P. troglodytes
tcaattcctgacctca

SEQ ID NO: 264528 - DNA, 16 bp, P. troglodytes
tcaattctccctaaat

SEQ ID NO: 264529 - DNA, 16 bp, P. troglodytes
tcaattctgttccatt

SEQ ID NO: 264530 - DNA, 16 bp, P. troglodytes
tcaattctgttgatct

SEQ ID NO: 264531 - DNA, 16 bp, P. troglodytes
tcaattcttgtctcct

SEQ ID NO: 264532 - DNA, 16 bp, P. troglodytes
tcaattgatgcagaaa

SEQ ID NO: 264533 - DNA, 16 bp, P. troglodytes
tcaattgattgatttt

SEQ ID NO: 264534 - DNA, 16 bp, P. troglodytes
tcaattgtagttccca

SEQ ID NO: 264535 - DNA, 16 bp, P. troglodytes
tcaattgttttaattt

SEQ ID NO: 264536 - DNA, 16 bp, P. troglodytes
tcaatttaaaaatgag

SEQ ID NO: 264537 - DNA, 16 bp, P. troglodytes
tcaatttaaaatttca

SEQ ID NO: 264538 - DNA, 16 bp, P. troglodytes
tcaatttctacaaaaa

SEQ ID NO: 264539 - DNA, 16 bp, P. troglodytes
tcaattttatgtattt

SEQ ID NO: 264540 - DNA, 16 bp, P. troglodytes
tcaatttttataaatg

SEQ ID NO: 264541 - DNA, 16 bp, P. troglodytes
tcaatttttgaaaatt

SEQ ID NO: 264542 - DNA, 16 bp, P. troglodytes
tcaatttttttgtaaa

SEQ ID NO: 264543 - DNA, 16 bp, P. troglodytes
tcacaaaaacagcatg

SEQ ID NO: 264544 - DNA, 21 bp, P. troglodytes
tcacaaaaacatgtgttgtat

SEQ ID NO: 264545 - DNA, 16 bp, P. troglodytes
tcacaaaaacattttt

SEQ ID NO: 264546 - DNA, 16 bp, P. troglodytes
tcacaaaaagacaaat

SEQ ID NO: 264547 - DNA, 16 bp, P. troglodytes
tcacaaaagcaaagat

SEQ ID NO: 264548 - DNA, 16 bp, P. troglodytes
tcacaaaataatttac

SEQ ID NO: 264549 - DNA, 16 bp, P. troglodytes
tcacaaaattcctgaa

SEQ ID NO: 264550 - DNA, 16 bp, P. troglodytes
tcacaaacataatatt

SEQ ID NO: 264551 - DNA, 16 bp, P. troglodytes
tcacaaacataatgtt

SEQ ID NO: 264552 - DNA, 16 bp, P. troglodytes
tcacaaagatattctc

SEQ ID NO: 264553 - DNA, 16 bp, P. troglodytes
tcacaaagcactttca

SEQ ID NO: 264554 - DNA, 16 bp, P. troglodytes
tcacaaagtacattct

SEQ ID NO: 264555 - DNA, 16 bp, P. troglodytes
tcacaaatatttattg

SEQ ID NO: 264556 - DNA, 16 bp, P. troglodytes
tcacaacagcaaagtc

SEQ ID NO: 264557 - DNA, 16 bp, P. troglodytes
tcacaagaaaaggaaa

SEQ ID NO: 264558 - DNA, 16 bp, P. troglodytes
tcacaagaagagcatg

SEQ ID NO: 264559 - DNA, 16 bp, P. troglodytes
tcacaagctgtgtgac

SEQ ID NO: 264560 - DNA, 16 bp, P. troglodytes
tcacaaggtaatgtca

SEQ ID NO: 264561 - DNA, 16 bp, P. troglodytes
tcacaaggtcatgaga

SEQ ID NO: 264562 - DNA, 16 bp, P. troglodytes
tcacaagttttttttt

SEQ ID NO: 264563 - DNA, 16 bp, P. troglodytes
tcacaatcatcaaaga

SEQ ID NO: 264564 - DNA, 16 bp, P. troglodytes
tcacaatgaaagaaaa

SEQ ID NO: 264565 - DNA, 16 bp, P. troglodytes
tcacaatttgtttatc

SEQ ID NO: 264566 - DNA, 16 bp, P. troglodytes
tcacaattttttaaaa

SEQ ID NO: 264567 - DNA, 20 bp, P. troglodytes
tcacacaaagcctgtttggt

SEQ ID NO: 264568 - DNA, 16 bp, P. troglodytes
tcacacagagctggct

SEQ ID NO: 264569 - DNA, 16 bp, P. troglodytes
tcacacagatagtaag

SEQ ID NO: 264570 - DNA, 16 bp, P. troglodytes
tcacacagccagtgag

SEQ ID NO: 264571 - DNA, 16 bp, P. troglodytes
tcacacagctaacaag

SEQ ID NO: 264572 - DNA, 16 bp, P. troglodytes
tcacacagctaataag

SEQ ID NO: 264573 - DNA, 16 bp, P. troglodytes
tcacacataaaataca

SEQ ID NO: 264574 - DNA, 16 bp, P. troglodytes
tcacacatacactcac

SEQ ID NO: 264575 - DNA, 16 bp, P. troglodytes
tcacacatttttttct

SEQ ID NO: 264576 - DNA, 16 bp, P. troglodytes
tcacaccactgcacac

SEQ ID NO: 264577 - DNA, 16 bp, P. troglodytes
tcacaccactgcattc

SEQ ID NO: 264578 - DNA, 16 bp, P. troglodytes
tcacaccatatgcaaa

SEQ ID NO: 264579 - DNA, 18 bp, P. troglodytes
tcacacccagctaatttt

SEQ ID NO: 264580 - DNA, 16 bp, P. troglodytes
tcacacccttctcctg

SEQ ID NO: 264581 - DNA, 16 bp, P. troglodytes
tcacacctaagaaaat

SEQ ID NO: 264582 - DNA, 16 bp, P. troglodytes
tcacacctgtaacccc

SEQ ID NO: 264583 - DNA, 16 bp, P. troglodytes
tcacacctgtagcccc

SEQ ID NO: 264584 - DNA, 16 bp, P. troglodytes
tcacactacccaactt

SEQ ID NO: 264585 - DNA, 16 bp, P. troglodytes
tcacactcctgagctc

SEQ ID NO: 264586 - DNA, 16 bp, P. troglodytes
tcacactgaatgggca

SEQ ID NO: 264587 - DNA, 16 bp, P. troglodytes
tcacactgaatgggga

SEQ ID NO: 264588 - DNA, 16 bp, P. troglodytes
tcacacttataatccc

SEQ ID NO: 264589 - DNA, 16 bp, P. troglodytes
tcacacttcctgattt

SEQ ID NO: 264590 - DNA, 17 bp, P. troglodytes
tcacacttgtaatccta

SEQ ID NO: 264591 - DNA, 16 bp, P. troglodytes
tcacagaaaaactgga

SEQ ID NO: 264592 - DNA, 16 bp, P. troglodytes
tcacagaaaaggaaaa

SEQ ID NO: 264593 - DNA, 16 bp, P. troglodytes
tcacagaaacacacac

SEQ ID NO: 264594 - DNA, 16 bp, P. troglodytes
tcacagaaacatccag

SEQ ID NO: 264595 - DNA, 16 bp, P. troglodytes
tcacagaaatagaaaa

SEQ ID NO: 264596 - DNA, 17 bp, P. troglodytes
tcacagaactggaaaaa

SEQ ID NO: 264597 - DNA, 16 bp, P. troglodytes
tcacagaactggagaa

SEQ ID NO: 264598 - DNA, 16 bp, P. troglodytes
tcacagaagaagaaat

SEQ ID NO: 264599 - DNA, 16 bp, P. troglodytes
tcacagaagcagaaag

SEQ ID NO: 264600 - DNA, 16 bp, P. troglodytes
tcacagaaggacaaat

SEQ ID NO: 264601 - DNA, 16 bp, P. troglodytes
tcacagaatgaattag

SEQ ID NO: 264602 - DNA, 16 bp, P. troglodytes
tcacagaatttttttt

SEQ ID NO: 264603 - DNA, 16 bp, P. troglodytes
tcacagacttggaaaa

SEQ ID NO: 264604 - DNA, 16 bp, P. troglodytes
tcacagagaataaaat

SEQ ID NO: 264605 - DNA, 16 bp, P. troglodytes
tcacagagcttatatt

SEQ ID NO: 264606 - DNA, 16 bp, P. troglodytes
tcacagaggaggtgac

SEQ ID NO: 264607 - DNA, 16 bp, P. troglodytes
tcacagaggtaaagtg

SEQ ID NO: 264608 - DNA, 16 bp, P. troglodytes
tcacagatagaagatt

SEQ ID NO: 264609 - DNA, 16 bp, P. troglodytes
tcacagatatttattt

SEQ ID NO: 264610 - DNA, 16 bp, P. troglodytes
tcacagatcaccataa

SEQ ID NO: 264611 - DNA, 16 bp, P. troglodytes
tcacagatgaaaaaac

SEQ ID NO: 264612 - DNA, 16 bp, P. troglodytes
tcacagatgaagaaat

SEQ ID NO: 264613 - DNA, 16 bp, P. troglodytes
tcacagatgacatgat

SEQ ID NO: 264614 - DNA, 16 bp, P. troglodytes
tcacagcagattcaga

SEQ ID NO: 264615 - DNA, 16 bp, P. troglodytes
tcacagcagcactgtt

SEQ ID NO: 264616 - DNA, 16 bp, P. troglodytes
tcacagcagccctagg

SEQ ID NO: 264617 - DNA, 16 bp, P. troglodytes
tcacagcatcatttat

SEQ ID NO: 264618 - DNA, 16 bp, P. troglodytes
tcacagccaaattcta

SEQ ID NO: 264619 - DNA, 16 bp, P. troglodytes
tcacagccaacattat

SEQ ID NO: 264620 - DNA, 18 bp, P. troglodytes
tcacagccctcgctcact

SEQ ID NO: 264621 - DNA, 16 bp, P. troglodytes
tcacagcctcaccagc

SEQ ID NO: 264622 - DNA, 16 bp, P. troglodytes
tcacagctcactgcaa

SEQ ID NO: 264623 - DNA, 16 bp, P. troglodytes
tcacagctcttaaaat

SEQ ID NO: 264624 - DNA, 16 bp, P. troglodytes
tcacagctgaattgta

SEQ ID NO: 264625 - DNA, 16 bp, P. troglodytes
tcacagctggcaccag

SEQ ID NO: 264626 - DNA, 16 bp, P. troglodytes
tcacaggcagccaact

SEQ ID NO: 264627 - DNA, 16 bp, P. troglodytes
tcacaggcatgggcca

SEQ ID NO: 264628 - DNA, 16 bp, P. troglodytes
tcacaggtacttggga

SEQ ID NO: 264629 - DNA, 16 bp, P. troglodytes
tcacaggtcactgcag

SEQ ID NO: 264630 - DNA, 16 bp, P. troglodytes
tcacaggtgtgagcca

SEQ ID NO: 264631 - DNA, 16 bp, P. troglodytes
tcacagtggcattatt

SEQ ID NO: 264632 - DNA, 16 bp, P. troglodytes
tcacagtggctcacac

SEQ ID NO: 264633 - DNA, 16 bp, P. troglodytes
tcacagttaagcatgg

SEQ ID NO: 264634 - DNA, 16 bp, P. troglodytes
tcacagttctgcagcc

SEQ ID NO: 264635 - DNA, 16 bp, P. troglodytes
tcacagttctggaagc

SEQ ID NO: 264636 - DNA, 16 bp, P. troglodytes
tcacagttctggaggc

SEQ ID NO: 264637 - DNA, 16 bp, P. troglodytes
tcacagttttggaagc

SEQ ID NO: 264638 - DNA, 16 bp, P. troglodytes
tcacataaatgaaatt

SEQ ID NO: 264639 - DNA, 16 bp, P. troglodytes
tcacataaatgtcttc

SEQ ID NO: 264640 - DNA, 16 bp, P. troglodytes
tcacatactataaaat

SEQ ID NO: 264641 - DNA, 16 bp, P. troglodytes
tcacatattataaaat

SEQ ID NO: 264642 - DNA, 16 bp, P. troglodytes
tcacatattctacaaa

SEQ ID NO: 264643 - DNA, 17 bp, P. troglodytes
tcacatcacaggactct

SEQ ID NO: 264644 - DNA, 16 bp, P. troglodytes
tcacatccagggcaca

SEQ ID NO: 264645 - DNA, 16 bp, P. troglodytes
tcacatcccagctctg

SEQ ID NO: 264646 - DNA, 16 bp, P. troglodytes
tcacatctctttctct

SEQ ID NO: 264647 - DNA, 16 bp, P. troglodytes
tcacatgaaaccaaaa

SEQ ID NO: 264648 - DNA, 16 bp, P. troglodytes
tcacatgatttttttt

SEQ ID NO: 264649 - DNA, 16 bp, P. troglodytes
tcacatggcaagagag

SEQ ID NO: 264650 - DNA, 16 bp, P. troglodytes
tcacatggcattctcc

SEQ ID NO: 264651 - DNA, 16 bp, P. troglodytes
tcacatggcattttaa

SEQ ID NO: 264652 - DNA, 16 bp, P. troglodytes
tcacatggccaggtac

SEQ ID NO: 264653 - DNA, 16 bp, P. troglodytes
tcacattaaatgtaaa

SEQ ID NO: 264654 - DNA, 16 bp, P. troglodytes
tcacattcattaatat

SEQ ID NO: 264655 - DNA, 16 bp, P. troglodytes
tcacattctcaccagc

SEQ ID NO: 264656 - DNA, 16 bp, P. troglodytes
tcacatttaaaacaaa

SEQ ID NO: 264657 - DNA, 16 bp, P. troglodytes
tcacatttcaacatga

SEQ ID NO: 264658 - DNA, 16 bp, P. troglodytes
tcacatttcaacctga

SEQ ID NO: 264659 - DNA, 16 bp, P. troglodytes
tcacatttctctaatg

SEQ ID NO: 264660 - DNA, 16 bp, P. troglodytes
tcacattttaaaaaat

SEQ ID NO: 264661 - DNA, 16 bp, P. troglodytes
tcacattttaaaatgt

SEQ ID NO: 264662 - DNA, 16 bp, P. troglodytes
tcacattttaaattat

SEQ ID NO: 264663 - DNA, 16 bp, P. troglodytes
tcacattttcaggtat

SEQ ID NO: 264664 - DNA, 16 bp, P. troglodytes
tcacattttctttatc

SEQ ID NO: 264665 - DNA, 16 bp, P. troglodytes
tcacattttggtaatt

SEQ ID NO: 264666 - DNA, 16 bp, P. troglodytes
tcaccaacagcaaaga

SEQ ID NO: 264667 - DNA, 16 bp, P. troglodytes
tcaccaacatcaaaga

SEQ ID NO: 264668 - DNA, 17 bp, P. troglodytes
tcaccaaccaactatct

SEQ ID NO: 264669 - DNA, 16 bp, P. troglodytes
tcaccaagacaatggg

SEQ ID NO: 264670 - DNA, 16 bp, P. troglodytes
tcaccaaggagatggt

SEQ ID NO: 264671 - DNA, 16 bp, P. troglodytes
tcaccaaggctgaaat

SEQ ID NO: 264672 - DNA, 16 bp, P. troglodytes
tcaccaaggctggaat

SEQ ID NO: 264673 - DNA, 16 bp, P. troglodytes
tcaccaaggtgatggt

SEQ ID NO: 264674 - DNA, 16 bp, P. troglodytes
tcaccaatttaaatgt

SEQ ID NO: 264675 - DNA, 16 bp, P. troglodytes
tcaccacaaaaaaatg

SEQ ID NO: 264676 - DNA, 16 bp, P. troglodytes
tcaccacaaaagaact

SEQ ID NO: 264677 - DNA, 16 bp, P. troglodytes
tcaccacaaactctgc

SEQ ID NO: 264678 - DNA, 18 bp, P. troglodytes
tcaccacaccatcttcca

SEQ ID NO: 264679 - DNA, 16 bp, P. troglodytes
tcaccacactgccttc

SEQ ID NO: 264680 - DNA, 16 bp, P. troglodytes
tcaccacagtcaagat

SEQ ID NO: 264681 - DNA, 16 bp, P. troglodytes
tcaccaccaccatcat

SEQ ID NO: 264682 - DNA, 16 bp, P. troglodytes
tcaccaccatctatct

SEQ ID NO: 264683 - DNA, 17 bp, P. troglodytes
tcaccacgcccggctaa

SEQ ID NO: 264684 - DNA, 16 bp, P. troglodytes
tcaccactcccagcta

SEQ ID NO: 264685 - DNA, 17 bp, P. troglodytes
tcaccactcctgttcaa

SEQ ID NO: 264686 - DNA, 17 bp, P. troglodytes
tcaccactcgtattcaa

SEQ ID NO: 264687 - DNA, 16 bp, P. troglodytes
tcaccacttctattca

SEQ ID NO: 264688 - DNA, 16 bp, P. troglodytes
tcaccagaagcagatg

SEQ ID NO: 264689 - DNA, 16 bp, P. troglodytes
tcaccagacaatgaat

SEQ ID NO: 264690 - DNA, 16 bp, P. troglodytes
tcaccagacactgaaa

SEQ ID NO: 264691 - DNA, 16 bp, P. troglodytes
tcaccagagaaatgca

SEQ ID NO: 264692 - DNA, 16 bp, P. troglodytes
tcaccagcatttgttt

SEQ ID NO: 264693 - DNA, 16 bp, P. troglodytes
tcaccagctgtgtgat

SEQ ID NO: 264694 - DNA, 16 bp, P. troglodytes
tcaccaggcagggccc

SEQ ID NO: 264695 - DNA, 16 bp, P. troglodytes
tcaccaggcccagcta

SEQ ID NO: 264696 - DNA, 16 bp, P. troglodytes
tcaccagggccctggg

SEQ ID NO: 264697 - DNA, 16 bp, P. troglodytes
tcaccaggtgtgtcct

SEQ ID NO: 264698 - DNA, 16 bp, P. troglodytes
tcaccagtggaggctg

SEQ ID NO: 264699 - DNA, 16 bp, P. troglodytes
tcaccataaaggtctt

SEQ ID NO: 264700 - DNA, 17 bp, P. troglodytes
tcaccataatgtagaat

SEQ ID NO: 264701 - DNA, 16 bp, P. troglodytes
tcaccataatgtggaa

SEQ ID NO: 264702 - DNA, 16 bp, P. troglodytes
tcaccatatataaaaa

SEQ ID NO: 264703 - DNA, 16 bp, P. troglodytes
tcaccatattgcccag

SEQ ID NO: 264704 - DNA, 21 bp, P. troglodytes
tcaccatcatcaaagaccaaa

SEQ ID NO: 264705 - DNA, 16 bp, P. troglodytes
tcaccatccctggcta

SEQ ID NO: 264706 - DNA, 16 bp, P. troglodytes
tcaccatccttcaagt

SEQ ID NO: 264707 - DNA, 16 bp, P. troglodytes
tcaccatgcccagata

SEQ ID NO: 264708 - DNA, 16 bp, P. troglodytes
tcaccatgccctgcta

SEQ ID NO: 264709 - DNA, 16 bp, P. troglodytes
tcaccatgctgcccag

SEQ ID NO: 264710 - DNA, 16 bp, P. troglodytes
tcaccatgctggtcag

SEQ ID NO: 264711 - DNA, 16 bp, P. troglodytes
tcaccatggcacacat

SEQ ID NO: 264712 - DNA, 16 bp, P. troglodytes
tcaccatgtacaaaaa

SEQ ID NO: 264713 - DNA, 16 bp, P. troglodytes
tcaccatgtgaggaca

SEQ ID NO: 264714 - DNA, 16 bp, P. troglodytes
tcaccatgtggcccag

SEQ ID NO: 264715 - DNA, 16 bp, P. troglodytes
tcaccatgttcatcag

SEQ ID NO: 264716 - DNA, 16 bp, P. troglodytes
tcaccatgttgcctag

SEQ ID NO: 264717 - DNA, 16 bp, P. troglodytes
tcaccatgttgggcca

SEQ ID NO: 264718 - DNA, 16 bp, P. troglodytes
tcaccatgttggtctg

SEQ ID NO: 264719 - DNA, 16 bp, P. troglodytes
tcaccattgatcccac

SEQ ID NO: 264720 - DNA, 16 bp, P. troglodytes
tcaccattttggtcag

SEQ ID NO: 264721 - DNA, 16 bp, P. troglodytes
tcacccaaagtgctgg

SEQ ID NO: 264722 - DNA, 16 bp, P. troglodytes
tcacccaagctggact

SEQ ID NO: 264723 - DNA, 16 bp, P. troglodytes
tcacccaagctggggt

SEQ ID NO: 264724 - DNA, 16 bp, P. troglodytes
tcacccacctcagcct

SEQ ID NO: 264725 - DNA, 16 bp, P. troglodytes
tcacccacctgggcct

SEQ ID NO: 264726 - DNA, 16 bp, P. troglodytes
tcacccactttggcct

SEQ ID NO: 264727 - DNA, 16 bp, P. troglodytes
tcacccagagcaactt

SEQ ID NO: 264728 - DNA, 16 bp, P. troglodytes
tcacccaggatagagt

SEQ ID NO: 264729 - DNA, 16 bp, P. troglodytes
tcacccaggatggagt

SEQ ID NO: 264730 - DNA, 16 bp, P. troglodytes
tcacccaggccagact

SEQ ID NO: 264731 - DNA, 16 bp, P. troglodytes
tcacccaggctgcagt

SEQ ID NO: 264732 - DNA, 16 bp, P. troglodytes
tcacccaggctggaga

SEQ ID NO: 264733 - DNA, 16 bp, P. troglodytes
tcacccaggctggagg

SEQ ID NO: 264734 - DNA, 17 bp, P. troglodytes
tcacccaggctggagta

SEQ ID NO: 264735 - DNA, 17 bp, P. troglodytes
tcacccaggctggagtc

SEQ ID NO: 264736 - DNA, 17 bp, P. troglodytes
tcacccaggctggagtt

SEQ ID NO: 264737 - DNA, 18 bp, P. troglodytes
tcacccaggctggagtta

SEQ ID NO: 264738 - DNA, 16 bp, P. troglodytes
tcacccaggctggatt

SEQ ID NO: 264739 - DNA, 16 bp, P. troglodytes
tcacccaggctggtct

SEQ ID NO: 264740 - DNA, 16 bp, P. troglodytes
tcacccagtggatccc

SEQ ID NO: 264741 - DNA, 16 bp, P. troglodytes
tcacccagtttcccct

SEQ ID NO: 264742 - DNA, 16 bp, P. troglodytes
tcacccatcccagcag

SEQ ID NO: 264743 - DNA, 16 bp, P. troglodytes
tcaccccaaaaagttc

SEQ ID NO: 264744 - DNA, 16 bp, P. troglodytes
tcaccccaaaagaaaa

SEQ ID NO: 264745 - DNA, 16 bp, P. troglodytes
tcaccccaaagagaaa

SEQ ID NO: 264746 - DNA, 16 bp, P. troglodytes
tcaccccagccaacac

SEQ ID NO: 264747 - DNA, 16 bp, P. troglodytes
tcaccccagggccagg

SEQ ID NO: 264748 - DNA, 16 bp, P. troglodytes
tcaccccatttcccca

SEQ ID NO: 264749 - DNA, 16 bp, P. troglodytes
tcacccccaaaagaaa

SEQ ID NO: 264750 - DNA, 16 bp, P. troglodytes
tcaccccggctggagt

SEQ ID NO: 264751 - DNA, 16 bp, P. troglodytes
tcacccctggtcacct

SEQ ID NO: 264752 - DNA, 16 bp, P. troglodytes
tcacccgcctcagcct

SEQ ID NO: 264753 - DNA, 16 bp, P. troglodytes
tcaccctcaccaatgt

SEQ ID NO: 264754 - DNA, 16 bp, P. troglodytes
tcaccctcagatggga

SEQ ID NO: 264755 - DNA, 16 bp, P. troglodytes
tcaccctcattttaca

SEQ ID NO: 264756 - DNA, 16 bp, P. troglodytes
tcaccctcccaaagta

SEQ ID NO: 264757 - DNA, 16 bp, P. troglodytes
tcaccctccttgggct

SEQ ID NO: 264758 - DNA, 16 bp, P. troglodytes
tcaccctgccacccag

SEQ ID NO: 264759 - DNA, 16 bp, P. troglodytes
tcaccctgctgcccag

SEQ ID NO: 264760 - DNA, 16 bp, P. troglodytes
tcaccctgtcgcccag

SEQ ID NO: 264761 - DNA, 16 bp, P. troglodytes
tcaccctgttgctcag

SEQ ID NO: 264762 - DNA, 16 bp, P. troglodytes
tcaccgcaacttccgc

SEQ ID NO: 264763 - DNA, 16 bp, P. troglodytes
tcaccgtgtttcccag

SEQ ID NO: 264764 - DNA, 16 bp, P. troglodytes
tcacctacctcagcct

SEQ ID NO: 264765 - DNA, 16 bp, P. troglodytes
tcacctaggtattaag

SEQ ID NO: 264766 - DNA, 16 bp, P. troglodytes
tcacctattttacata

SEQ ID NO: 264767 - DNA, 16 bp, P. troglodytes
tcacctcaattttttt

SEQ ID NO: 264768 - DNA, 19 bp, P. troglodytes
tcacctcagcctcccaaaa

SEQ ID NO: 264769 - DNA, 16 bp, P. troglodytes
tcacctcagcctcctg

SEQ ID NO: 264770 - DNA, 16 bp, P. troglodytes
tcacctcccaccagac

SEQ ID NO: 264771 - DNA, 16 bp, P. troglodytes
tcacctcccaccaggt

SEQ ID NO: 264772 - DNA, 16 bp, P. troglodytes
tcacctcccacctggt

SEQ ID NO: 264773 - DNA, 16 bp, P. troglodytes
tcacctcccacgaggc

SEQ ID NO: 264774 - DNA, 16 bp, P. troglodytes
tcacctccccagagag

SEQ ID NO: 264775 - DNA, 16 bp, P. troglodytes
tcacctcctgccatga

SEQ ID NO: 264776 - DNA, 16 bp, P. troglodytes
tcacctcctgctgtat

SEQ ID NO: 264777 - DNA, 16 bp, P. troglodytes
tcacctctaaaatggg

SEQ ID NO: 264778 - DNA, 16 bp, P. troglodytes
tcacctctcctattca

SEQ ID NO: 264779 - DNA, 16 bp, P. troglodytes
tcacctctctgagcct

SEQ ID NO: 264780 - DNA, 16 bp, P. troglodytes
tcacctctctgtgcct

SEQ ID NO: 264781 - DNA, 16 bp, P. troglodytes
tcacctctttaaagac

SEQ ID NO: 264782 - DNA, 16 bp, P. troglodytes
tcacctgaaccaggga

SEQ ID NO: 264783 - DNA, 16 bp, P. troglodytes
tcacctgaagtcaggt

SEQ ID NO: 264784 - DNA, 16 bp, P. troglodytes
tcacctgaggtcagac

SEQ ID NO: 264785 - DNA, 18 bp, P. troglodytes
tcacctgaggtcagcagt

SEQ ID NO: 264786 - DNA, 16 bp, P. troglodytes
tcacctgaggtcaggc

SEQ ID NO: 264787 - DNA, 16 bp, P. troglodytes
tcacctgccaccatgt

SEQ ID NO: 264788 - DNA, 16 bp, P. troglodytes
tcacctgcctcagcct

SEQ ID NO: 264789 - DNA, 16 bp, P. troglodytes
tcacctgggaagtgca

SEQ ID NO: 264790 - DNA, 16 bp, P. troglodytes
tcacctgggatcttgt

SEQ ID NO: 264791 - DNA, 16 bp, P. troglodytes
tcacctggggagcttt

SEQ ID NO: 264792 - DNA, 16 bp, P. troglodytes
tcacctgtaaaatggg

SEQ ID NO: 264793 - DNA, 19 bp, P. troglodytes
tcacctgtggtcaggagtt

SEQ ID NO: 264794 - DNA, 16 bp, P. troglodytes
tcaccttaaggagatt

SEQ ID NO: 264795 - DNA, 16 bp, P. troglodytes
tcaccttccacaatga

SEQ ID NO: 264796 - DNA, 16 bp, P. troglodytes
tcaccttccccagcta

SEQ ID NO: 264797 - DNA, 16 bp, P. troglodytes
tcaccttccgtcatga

SEQ ID NO: 264798 - DNA, 16 bp, P. troglodytes
tcaccttctgccatga

SEQ ID NO: 264799 - DNA, 16 bp, P. troglodytes
tcaccttgggggtgag

SEQ ID NO: 264800 - DNA, 16 bp, P. troglodytes
tcaccttggtgattag

SEQ ID NO: 264801 - DNA, 16 bp, P. troglodytes
tcaccttgtcagccag

SEQ ID NO: 264802 - DNA, 16 bp, P. troglodytes
tcaccttgtgaagaag

SEQ ID NO: 264803 - DNA, 16 bp, P. troglodytes
tcacctttgctccagt

SEQ ID NO: 264804 - DNA, 17 bp, P. troglodytes
tcacctttgctccagtt

SEQ ID NO: 264805 - DNA, 18 bp, P. troglodytes
tcacgacactgcactcca

SEQ ID NO: 264806 - DNA, 17 bp, P. troglodytes
tcacgacgtcaagagat

SEQ ID NO: 264807 - DNA, 16 bp, P. troglodytes
tcacgccattacactc

SEQ ID NO: 264808 - DNA, 17 bp, P. troglodytes
tcacgcctggctaattt

SEQ ID NO: 264809 - DNA, 16 bp, P. troglodytes
tcacggcaacctccac

SEQ ID NO: 264810 - DNA, 16 bp, P. troglodytes
tcacggcttactgcaa

SEQ ID NO: 264811 - DNA, 18 bp, P. troglodytes
tcacggtgagtgttacag

SEQ ID NO: 264812 - DNA, 16 bp, P. troglodytes
tcacggtggaagggga

SEQ ID NO: 264813 - DNA, 16 bp, P. troglodytes
tcactaaccagatcca

SEQ ID NO: 264814 - DNA, 17 bp, P. troglodytes
tcactaatcatcaaaga

SEQ ID NO: 264815 - DNA, 16 bp, P. troglodytes
tcactaatgtcctttt

SEQ ID NO: 264816 - DNA, 16 bp, P. troglodytes
tcactacaaagagaat

SEQ ID NO: 264817 - DNA, 16 bp, P. troglodytes
tcactatgctgcccag

SEQ ID NO: 264818 - DNA, 16 bp, P. troglodytes
tcactatgtggcccag

SEQ ID NO: 264819 - DNA, 16 bp, P. troglodytes
tcactatgttgcccag

SEQ ID NO: 264820 - DNA, 16 bp, P. troglodytes
tcactatgttgcctag

SEQ ID NO: 264821 - DNA, 16 bp, P. troglodytes
tcactatgttgctcag

SEQ ID NO: 264822 - DNA, 16 bp, P. troglodytes
tcactattaacatttt

SEQ ID NO: 264823 - DNA, 16 bp, P. troglodytes
tcactcacatgtctgg

SEQ ID NO: 264824 - DNA, 16 bp, P. troglodytes
tcactcactcactcac

SEQ ID NO: 264825 - DNA, 16 bp, P. troglodytes
tcactcactgcctccc

SEQ ID NO: 264826 - DNA, 16 bp, P. troglodytes
tcactcaggctggtgt

SEQ ID NO: 264827 - DNA, 16 bp, P. troglodytes
tcactcagggcaatct

SEQ ID NO: 264828 - DNA, 17 bp, P. troglodytes
tcactcagtgctcaatg

SEQ ID NO: 264829 - DNA, 16 bp, P. troglodytes
tcactcatatgtggaa

SEQ ID NO: 264830 - DNA, 16 bp, P. troglodytes
tcactcatttattcaa

SEQ ID NO: 264831 - DNA, 16 bp, P. troglodytes
tcactccaacctctgc

SEQ ID NO: 264832 - DNA, 22 bp, P. troglodytes
tcactccagcctgggcaacaga

SEQ ID NO: 264833 - DNA, 16 bp, P. troglodytes
tcactccatcgcccag

SEQ ID NO: 264834 - DNA, 16 bp, P. troglodytes
tcactcccaaaagaaa

SEQ ID NO: 264835 - DNA, 16 bp, P. troglodytes
tcactcgaggccagga

SEQ ID NO: 264836 - DNA, 16 bp, P. troglodytes
tcactctcaaaaaaaa

SEQ ID NO: 264837 - DNA, 16 bp, P. troglodytes
tcactctcaagttcaa

SEQ ID NO: 264838 - DNA, 16 bp, P. troglodytes
tcactctcactcaggc

SEQ ID NO: 264839 - DNA, 16 bp, P. troglodytes
tcactctctcctgctg

SEQ ID NO: 264840 - DNA, 16 bp, P. troglodytes
tcactctgtcacccaa

SEQ ID NO: 264841 - DNA, 25 bp, P. troglodytes
tcactctgtcgcccaggctggagta

SEQ ID NO: 264842 - DNA, 16 bp, P. troglodytes
tcactctgtcgtccag

SEQ ID NO: 264843 - DNA, 16 bp, P. troglodytes
tcactctgtctctcag

SEQ ID NO: 264844 - DNA, 17 bp, P. troglodytes
tcactctgtggcccagg

SEQ ID NO: 264845 - DNA, 16 bp, P. troglodytes
tcactctgttacctag

SEQ ID NO: 264846 - DNA, 16 bp, P. troglodytes
tcactcttgaattctt

SEQ ID NO: 264847 - DNA, 16 bp, P. troglodytes
tcactcttgtcgccca

SEQ ID NO: 264848 - DNA, 17 bp, P. troglodytes
tcactcttgttgcccaa

SEQ ID NO: 264849 - DNA, 16 bp, P. troglodytes
tcactctttgtgttgt

SEQ ID NO: 264850 - DNA, 16 bp, P. troglodytes
tcactgaaacatctgc

SEQ ID NO: 264851 - DNA, 16 bp, P. troglodytes
tcactgaaggccagga

SEQ ID NO: 264852 - DNA, 16 bp, P. troglodytes
tcactgaatattttaa

SEQ ID NO: 264853 - DNA, 16 bp, P. troglodytes
tcactgaatccaggag

SEQ ID NO: 264854 - DNA, 16 bp, P. troglodytes
tcactgagcacctact

SEQ ID NO: 264855 - DNA, 16 bp, P. troglodytes
tcactgagtcctcaca

SEQ ID NO: 264856 - DNA, 16 bp, P. troglodytes
tcactgatatgtggaa

SEQ ID NO: 264857 - DNA, 16 bp, P. troglodytes
tcactgattcttttct

SEQ ID NO: 264858 - DNA, 16 bp, P. troglodytes
tcactgatttttctct

SEQ ID NO: 264859 - DNA, 21 bp, P. troglodytes
tcactgcaaactccacctccc

SEQ ID NO: 264860 - DNA, 21 bp, P. troglodytes
tcactgcaacctccgcctcca

SEQ ID NO: 264861 - DNA, 18 bp, P. troglodytes
tcactgcaacgtctgcct

SEQ ID NO: 264862 - DNA, 17 bp, P. troglodytes
tcactgcaactctgcct

SEQ ID NO: 264863 - DNA, 21 bp, P. troglodytes
tcactgcaagctccgcctcct

SEQ ID NO: 264864 - DNA, 16 bp, P. troglodytes
tcactgcaagctctgt

SEQ ID NO: 264865 - DNA, 17 bp, P. troglodytes
tcactgcactccagcat

SEQ ID NO: 264866 - DNA, 16 bp, P. troglodytes
tcactgcactccatcc

SEQ ID NO: 264867 - DNA, 16 bp, P. troglodytes
tcactgcagccacaaa

SEQ ID NO: 264868 - DNA, 16 bp, P. troglodytes
tcactgcagcctcaga

SEQ ID NO: 264869 - DNA, 16 bp, P. troglodytes
tcactgcagcctcctt

SEQ ID NO: 264870 - DNA, 16 bp, P. troglodytes
tcactgcagccttgat

SEQ ID NO: 264871 - DNA, 16 bp, P. troglodytes
tcactgcagctttaaa

SEQ ID NO: 264872 - DNA, 19 bp, P. troglodytes
tcactgcagtcttgacctc

SEQ ID NO: 264873 - DNA, 16 bp, P. troglodytes
tcactgcatgctctgc

SEQ ID NO: 264874 - DNA, 16 bp, P. troglodytes
tcactgccaccttcac

SEQ ID NO: 264875 - DNA, 16 bp, P. troglodytes
tcactgccctggaaag

SEQ ID NO: 264876 - DNA, 16 bp, P. troglodytes
tcactgcctggggcca

SEQ ID NO: 264877 - DNA, 16 bp, P. troglodytes
tcactgctacattccc

SEQ ID NO: 264878 - DNA, 17 bp, P. troglodytes
tcactgctcaatgaaat

SEQ ID NO: 264879 - DNA, 16 bp, P. troglodytes
tcactgctgcaacctc

SEQ ID NO: 264880 - DNA, 16 bp, P. troglodytes
tcactgctgccaaaga

SEQ ID NO: 264881 - DNA, 16 bp, P. troglodytes
tcactgctgcctccac

SEQ ID NO: 264882 - DNA, 16 bp, P. troglodytes
tcactggagctcagga

SEQ ID NO: 264883 - DNA, 16 bp, P. troglodytes
tcactggaggccagga

SEQ ID NO: 264884 - DNA, 16 bp, P. troglodytes
tcactggcagctgatt

SEQ ID NO: 264885 - DNA, 16 bp, P. troglodytes
tcactggtgtggtggg

SEQ ID NO: 264886 - DNA, 16 bp, P. troglodytes
tcactgtaaccctgaa

SEQ ID NO: 264887 - DNA, 16 bp, P. troglodytes
tcactgtaacctcagc

SEQ ID NO: 264888 - DNA, 16 bp, P. troglodytes
tcactgtaacctcttc

SEQ ID NO: 264889 - DNA, 16 bp, P. troglodytes
tcactgtagcattatt

SEQ ID NO: 264890 - DNA, 16 bp, P. troglodytes
tcactgtattttcttt

SEQ ID NO: 264891 - DNA, 16 bp, P. troglodytes
tcactgtcacccaagc

SEQ ID NO: 264892 - DNA, 16 bp, P. troglodytes
tcactgtctctgtctc

SEQ ID NO: 264893 - DNA, 16 bp, P. troglodytes
tcactgtcttctacct

SEQ ID NO: 264894 - DNA, 16 bp, P. troglodytes
tcactgtgacctcaaa

SEQ ID NO: 264895 - DNA, 16 bp, P. troglodytes
tcactgtgcctcagtt

SEQ ID NO: 264896 - DNA, 16 bp, P. troglodytes
tcactgtggtcttgat

SEQ ID NO: 264897 - DNA, 16 bp, P. troglodytes
tcactgtggttttggt

SEQ ID NO: 264898 - DNA, 16 bp, P. troglodytes
tcactgtgttgcccaa

SEQ ID NO: 264899 - DNA, 16 bp, P. troglodytes
tcactgtgttgcccag

SEQ ID NO: 264900 - DNA, 16 bp, P. troglodytes
tcactgtgttgctcaa

SEQ ID NO: 264901 - DNA, 18 bp, P. troglodytes
tcactgttcagttcccac

SEQ ID NO: 264902 - DNA, 16 bp, P. troglodytes
tcactgttggcatata

SEQ ID NO: 264903 - DNA, 16 bp, P. troglodytes
tcactgttgtccaggc

SEQ ID NO: 264904 - DNA, 16 bp, P. troglodytes
tcacttaagataatgt

SEQ ID NO: 264905 - DNA, 16 bp, P. troglodytes
tcacttaatcctcaca

SEQ ID NO: 264906 - DNA, 16 bp, P. troglodytes
tcacttaccctctctg

SEQ ID NO: 264907 - DNA, 16 bp, P. troglodytes
tcacttagaataaaat

SEQ ID NO: 264908 - DNA, 16 bp, P. troglodytes
tcacttagaataatat

SEQ ID NO: 264909 - DNA, 16 bp, P. troglodytes
tcacttaggaaaatgg

SEQ ID NO: 264910 - DNA, 16 bp, P. troglodytes
tcacttatcaccaagg

SEQ ID NO: 264911 - DNA, 16 bp, P. troglodytes
tcacttatgaagctca

SEQ ID NO: 264912 - DNA, 16 bp, P. troglodytes
tcacttcaaagctgtc

SEQ ID NO: 264913 - DNA, 16 bp, P. troglodytes
tcacttcacttctctg

SEQ ID NO: 264914 - DNA, 16 bp, P. troglodytes
tcacttcagcctccaa

SEQ ID NO: 264915 - DNA, 16 bp, P. troglodytes
tcacttcatgtctctg

SEQ ID NO: 264916 - DNA, 16 bp, P. troglodytes
tcacttcatttctctg

SEQ ID NO: 264917 - DNA, 16 bp, P. troglodytes
tcacttccaagatggc

SEQ ID NO: 264918 - DNA, 16 bp, P. troglodytes
tcacttccacattttg

SEQ ID NO: 264919 - DNA, 16 bp, P. troglodytes
tcacttccacattttt

SEQ ID NO: 264920 - DNA, 16 bp, P. troglodytes
tcacttccactgcatt

SEQ ID NO: 264921 - DNA, 16 bp, P. troglodytes
tcacttccatattttc

SEQ ID NO: 264922 - DNA, 16 bp, P. troglodytes
tcacttcccttctctg

SEQ ID NO: 264923 - DNA, 16 bp, P. troglodytes
tcacttcctgctgtgt

SEQ ID NO: 264924 - DNA, 16 bp, P. troglodytes
tcacttctcactgtgt

SEQ ID NO: 264925 - DNA, 16 bp, P. troglodytes
tcacttgaaccctgga

SEQ ID NO: 264926 - DNA, 16 bp, P. troglodytes
tcacttgagcccaagt

SEQ ID NO: 264927 - DNA, 16 bp, P. troglodytes
tcacttgaggcaagga

SEQ ID NO: 264928 - DNA, 16 bp, P. troglodytes
tcacttgaggcatttt

SEQ ID NO: 264929 - DNA, 16 bp, P. troglodytes
tcacttgaggctagaa

SEQ ID NO: 264930 - DNA, 16 bp, P. troglodytes
tcacttgcacccagga

SEQ ID NO: 264931 - DNA, 16 bp, P. troglodytes
tcacttgcccaaggtc

SEQ ID NO: 264932 - DNA, 16 bp, P. troglodytes
tcacttggttaagatg

SEQ ID NO: 264933 - DNA, 16 bp, P. troglodytes
tcactttaaaatggtt

SEQ ID NO: 264934 - DNA, 16 bp, P. troglodytes
tcactttaaatcaaaa

SEQ ID NO: 264935 - DNA, 16 bp, P. troglodytes
tcactttaaattaaaa

SEQ ID NO: 264936 - DNA, 16 bp, P. troglodytes
tcactttatttcattc

SEQ ID NO: 264937 - DNA, 16 bp, P. troglodytes
tcactttcaggaacac

SEQ ID NO: 264938 - DNA, 16 bp, P. troglodytes
tcactttgcataatgt

SEQ ID NO: 264939 - DNA, 16 bp, P. troglodytes
tcactttgctgcccag

SEQ ID NO: 264940 - DNA, 16 bp, P. troglodytes
tcactttggaaaacag

SEQ ID NO: 264941 - DNA, 16 bp, P. troglodytes
tcactttgtcacccag

SEQ ID NO: 264942 - DNA, 16 bp, P. troglodytes
tcactttgttgatttt

SEQ ID NO: 264943 - DNA, 16 bp, P. troglodytes
tcacttttaaaattaa

SEQ ID NO: 264944 - DNA, 16 bp, P. troglodytes
tcacttttcttatctg

SEQ ID NO: 264945 - DNA, 16 bp, P. troglodytes
tcacttttgttgtcca

SEQ ID NO: 264946 - DNA, 16 bp, P. troglodytes
tcactttttaaaatat

SEQ ID NO: 264947 - DNA, 16 bp, P. troglodytes
tcagaaaaaaaatgtt

SEQ ID NO: 264948 - DNA, 16 bp, P. troglodytes
tcagaaaaaaagatta

SEQ ID NO: 264949 - DNA, 16 bp, P. troglodytes
tcagaaaaaaatatat

SEQ ID NO: 264950 - DNA, 16 bp, P. troglodytes
tcagaaaaaagaattt

SEQ ID NO: 264951 - DNA, 16 bp, P. troglodytes
tcagaaaaataaagat

SEQ ID NO: 264952 - DNA, 16 bp, P. troglodytes
tcagaaaaattaatat

SEQ ID NO: 264953 - DNA, 16 bp, P. troglodytes
tcagaaaacaaattaa

SEQ ID NO: 264954 - DNA, 16 bp, P. troglodytes
tcagaaaacacacaca

SEQ ID NO: 264955 - DNA, 16 bp, P. troglodytes
tcagaaaacagaatct

SEQ ID NO: 264956 - DNA, 16 bp, P. troglodytes
tcagaaaacaggaaga

SEQ ID NO: 264957 - DNA, 16 bp, P. troglodytes
tcagaaaacatttatt

SEQ ID NO: 264958 - DNA, 16 bp, P. troglodytes
tcagaaaactaagaat

SEQ ID NO: 264959 - DNA, 16 bp, P. troglodytes
tcagaaaacttacaat

SEQ ID NO: 264960 - DNA, 16 bp, P. troglodytes
tcagaaaagagaaaga

SEQ ID NO: 264961 - DNA, 16 bp, P. troglodytes
tcagaaaagcgcagta

SEQ ID NO: 264962 - DNA, 16 bp, P. troglodytes
tcagaaaataaagaag

SEQ ID NO: 264963 - DNA, 16 bp, P. troglodytes
tcagaaaataaatatt

SEQ ID NO: 264964 - DNA, 16 bp, P. troglodytes
tcagaaaatgagttag

SEQ ID NO: 264965 - DNA, 16 bp, P. troglodytes
tcagaaaattaaaaat

SEQ ID NO: 264966 - DNA, 16 bp, P. troglodytes
tcagaaacaatgcaag

SEQ ID NO: 264967 - DNA, 16 bp, P. troglodytes
tcagaaacagaaaata

SEQ ID NO: 264968 - DNA, 16 bp, P. troglodytes
tcagaaacagaaagtc

SEQ ID NO: 264969 - DNA, 16 bp, P. troglodytes
tcagaaactctgggaa

SEQ ID NO: 264970 - DNA, 16 bp, P. troglodytes
tcagaaagaacaagag

SEQ ID NO: 264971 - DNA, 16 bp, P. troglodytes
tcagaaagcaaagatg

SEQ ID NO: 264972 - DNA, 16 bp, P. troglodytes
tcagaaagcaaaggtg

SEQ ID NO: 264973 - DNA, 16 bp, P. troglodytes
tcagaaagctagaaag

SEQ ID NO: 264974 - DNA, 16 bp, P. troglodytes
tcagaaagctgtgaaa

SEQ ID NO: 264975 - DNA, 16 bp, P. troglodytes
tcagaaaggaagaaat

SEQ ID NO: 264976 - DNA, 16 bp, P. troglodytes
tcagaaagtgacattt

SEQ ID NO: 264977 - DNA, 16 bp, P. troglodytes
tcagaaagtgctggga

SEQ ID NO: 264978 - DNA, 16 bp, P. troglodytes
tcagaaataatgtttt

SEQ ID NO: 264979 - DNA, 16 bp, P. troglodytes
tcagaaataattttaa

SEQ ID NO: 264980 - DNA, 16 bp, P. troglodytes
tcagaaatagacccac

SEQ ID NO: 264981 - DNA, 16 bp, P. troglodytes
tcagaaatgaaaaaat

SEQ ID NO: 264982 - DNA, 16 bp, P. troglodytes
tcagaaatgaaaaggg

SEQ ID NO: 264983 - DNA, 16 bp, P. troglodytes
tcagaaatgacaaaag

SEQ ID NO: 264984 - DNA, 16 bp, P. troglodytes
tcagaaattaaaatat

SEQ ID NO: 264985 - DNA, 16 bp, P. troglodytes
tcagaaattatttttt

SEQ ID NO: 264986 - DNA, 16 bp, P. troglodytes
tcagaaatttcttcca

SEQ ID NO: 264987 - DNA, 16 bp, P. troglodytes
tcagaaattttatttt

SEQ ID NO: 264988 - DNA, 16 bp, P. troglodytes
tcagaacaaagaaaat

SEQ ID NO: 264989 - DNA, 16 bp, P. troglodytes
tcagaacacatacatt

SEQ ID NO: 264990 - DNA, 16 bp, P. troglodytes
tcagaacacttacatt

SEQ ID NO: 264991 - DNA, 16 bp, P. troglodytes
tcagaacagaaagaga

SEQ ID NO: 264992 - DNA, 16 bp, P. troglodytes
tcagaacctgcatttt

SEQ ID NO: 264993 - DNA, 16 bp, P. troglodytes
tcagaactatcctaag

SEQ ID NO: 264994 - DNA, 16 bp, P. troglodytes
tcagaactcactcact

SEQ ID NO: 264995 - DNA, 16 bp, P. troglodytes
tcagaacttgaagact

SEQ ID NO: 264996 - DNA, 16 bp, P. troglodytes
tcagaagaaaacagaa

SEQ ID NO: 264997 - DNA, 16 bp, P. troglodytes
tcagaagaaacaaaag

SEQ ID NO: 264998 - DNA, 16 bp, P. troglodytes
tcagaagaaacaagag

SEQ ID NO: 264999 - DNA, 16 bp, P. troglodytes
tcagaagaaaggaaaa

SEQ ID NO: 265000 - DNA, 16 bp, P. troglodytes
tcagaagaagaaagaa

SEQ ID NO: 265001 - DNA, 16 bp, P. troglodytes
tcagaagaatgtatat

SEQ ID NO: 265002 - DNA, 16 bp, P. troglodytes
tcagaagacagaaaaa

SEQ ID NO: 265003 - DNA, 16 bp, P. troglodytes
tcagaagagacaaaag

SEQ ID NO: 265004 - DNA, 16 bp, P. troglodytes
tcagaagcccagctgg

SEQ ID NO: 265005 - DNA, 17 bp, P. troglodytes
tcagaaggaatggtacc

SEQ ID NO: 265006 - DNA, 16 bp, P. troglodytes
tcagaaggagagaaga

SEQ ID NO: 265007 - DNA, 16 bp, P. troglodytes
tcagaaggctgaggag

SEQ ID NO: 265008 - DNA, 16 bp, P. troglodytes
tcagaagggaggaagt

SEQ ID NO: 265009 - DNA, 16 bp, P. troglodytes
tcagaagtttaaaaaa

SEQ ID NO: 265010 - DNA, 16 bp, P. troglodytes
tcagaagttttttttt

SEQ ID NO: 265011 - DNA, 16 bp, P. troglodytes
tcagaataaatctctt

SEQ ID NO: 265012 - DNA, 16 bp, P. troglodytes
tcagaatacacattct

SEQ ID NO: 265013 - DNA, 16 bp, P. troglodytes
tcagaatctccagggg

SEQ ID NO: 265014 - DNA, 16 bp, P. troglodytes
tcagaatctctggggt

SEQ ID NO: 265015 - DNA, 16 bp, P. troglodytes
tcagaatcttgtagct

SEQ ID NO: 265016 - DNA, 16 bp, P. troglodytes
tcagaatgctacaggg

SEQ ID NO: 265017 - DNA, 16 bp, P. troglodytes
tcagaatggcctttac

SEQ ID NO: 265018 - DNA, 16 bp, P. troglodytes
tcagaatggctgaaat

SEQ ID NO: 265019 - DNA, 16 bp, P. troglodytes
tcagaattatttttta

SEQ ID NO: 265020 - DNA, 16 bp, P. troglodytes
tcagaattttaaattt

SEQ ID NO: 265021 - DNA, 16 bp, P. troglodytes
tcagacaaaaataaat

SEQ ID NO: 265022 - DNA, 16 bp, P. troglodytes
tcagacaaattaaatt

SEQ ID NO: 265023 - DNA, 16 bp, P. troglodytes
tcagacaagagaagga

SEQ ID NO: 265024 - DNA, 16 bp, P. troglodytes
tcagacacagaaagat

SEQ ID NO: 265025 - DNA, 16 bp, P. troglodytes
tcagacagattcacag

SEQ ID NO: 265026 - DNA, 16 bp, P. troglodytes
tcagaccacagtggaa

SEQ ID NO: 265027 - DNA, 16 bp, P. troglodytes
tcagaccagttctctg

SEQ ID NO: 265028 - DNA, 16 bp, P. troglodytes
tcagaccatagtggaa

SEQ ID NO: 265029 - DNA, 16 bp, P. troglodytes
tcagaccccaagttct

SEQ ID NO: 265030 - DNA, 16 bp, P. troglodytes
tcagacctgaaaccag

SEQ ID NO: 265031 - DNA, 16 bp, P. troglodytes
tcagacctgaagctag

SEQ ID NO: 265032 - DNA, 17 bp, P. troglodytes
tcagactccaggttctt

SEQ ID NO: 265033 - DNA, 16 bp, P. troglodytes
tcagactcctgacctt

SEQ ID NO: 265034 - DNA, 16 bp, P. troglodytes
tcagactgctgtgctg

SEQ ID NO: 265035 - DNA, 16 bp, P. troglodytes
tcagactggagtgcag

SEQ ID NO: 265036 - DNA, 19 bp, P. troglodytes
tcagactgttactgtgtct

SEQ ID NO: 265037 - DNA, 16 bp, P. troglodytes
tcagagaaaaagagaa

SEQ ID NO: 265038 - DNA, 16 bp, P. troglodytes
tcagagaaaatatttg

SEQ ID NO: 265039 - DNA, 16 bp, P. troglodytes
tcagagaaaggaaaat

SEQ ID NO: 265040 - DNA, 16 bp, P. troglodytes
tcagagaaatgaaaat

SEQ ID NO: 265041 - DNA, 16 bp, P. troglodytes
tcagagaaatgcaatt

SEQ ID NO: 265042 - DNA, 16 bp, P. troglodytes
tcagagaaatttaaat

SEQ ID NO: 265043 - DNA, 16 bp, P. troglodytes
tcagagaagaaaaaag

SEQ ID NO: 265044 - DNA, 16 bp, P. troglodytes
tcagagaaggcttccc

SEQ ID NO: 265045 - DNA, 16 bp, P. troglodytes
tcagagaagtgaaata

SEQ ID NO: 265046 - DNA, 16 bp, P. troglodytes
tcagagaagtgaagtg

SEQ ID NO: 265047 - DNA, 24 bp, P. troglodytes
tcagagaatactataaacacctct

SEQ ID NO: 265048 - DNA, 16 bp, P. troglodytes
tcagagaatgtatgga

SEQ ID NO: 265049 - DNA, 16 bp, P. troglodytes
tcagagaattaaaaaa

SEQ ID NO: 265050 - DNA, 16 bp, P. troglodytes
tcagagacctgcagag

SEQ ID NO: 265051 - DNA, 16 bp, P. troglodytes
tcagagaccttcatgg

SEQ ID NO: 265052 - DNA, 16 bp, P. troglodytes
tcagagagaacagatt

SEQ ID NO: 265053 - DNA, 16 bp, P. troglodytes
tcagagagaagcagct

SEQ ID NO: 265054 - DNA, 16 bp, P. troglodytes
tcagagagagagagag

SEQ ID NO: 265055 - DNA, 16 bp, P. troglodytes
tcagagaggccttccc

SEQ ID NO: 265056 - DNA, 16 bp, P. troglodytes
tcagagagggggatgt

SEQ ID NO: 265057 - DNA, 16 bp, P. troglodytes
tcagagatattgcagg

SEQ ID NO: 265058 - DNA, 16 bp, P. troglodytes
tcagagatgaaaaagg

SEQ ID NO: 265059 - DNA, 16 bp, P. troglodytes
tcagagatgccaggaa

SEQ ID NO: 265060 - DNA, 16 bp, P. troglodytes
tcagagatgctgctaa

SEQ ID NO: 265061 - DNA, 16 bp, P. troglodytes
tcagagatttaaaaaa

SEQ ID NO: 265062 - DNA, 16 bp, P. troglodytes
tcagagatttcttctt

SEQ ID NO: 265063 - DNA, 16 bp, P. troglodytes
tcagagcaaaactaaa

SEQ ID NO: 265064 - DNA, 16 bp, P. troglodytes
tcagagcaacttccag

SEQ ID NO: 265065 - DNA, 16 bp, P. troglodytes
tcagagcagaaataaa

SEQ ID NO: 265066 - DNA, 16 bp, P. troglodytes
tcagagcagaaccaaa

SEQ ID NO: 265067 - DNA, 16 bp, P. troglodytes
tcagagcagaagtaaa

SEQ ID NO: 265068 - DNA, 16 bp, P. troglodytes
tcagagcaggtgctgg

SEQ ID NO: 265069 - DNA, 16 bp, P. troglodytes
tcagagctcttggatg

SEQ ID NO: 265070 - DNA, 16 bp, P. troglodytes
tcagaggaaaaaaaat

SEQ ID NO: 265071 - DNA, 16 bp, P. troglodytes
tcagaggaaagatctg

SEQ ID NO: 265072 - DNA, 16 bp, P. troglodytes
tcagaggaaagcacac

SEQ ID NO: 265073 - DNA, 16 bp, P. troglodytes
tcagaggagaaagaaa

SEQ ID NO: 265074 - DNA, 16 bp, P. troglodytes
tcagaggcataatttg

SEQ ID NO: 265075 - DNA, 16 bp, P. troglodytes
tcagaggcctgacacc

SEQ ID NO: 265076 - DNA, 16 bp, P. troglodytes
tcagaggctgaggctg

SEQ ID NO: 265077 - DNA, 16 bp, P. troglodytes
tcagaggctgggaaag

SEQ ID NO: 265078 - DNA, 16 bp, P. troglodytes
tcagaggtcaggagtt

SEQ ID NO: 265079 - DNA, 16 bp, P. troglodytes
tcagaggtcccagaag

SEQ ID NO: 265080 - DNA, 16 bp, P. troglodytes
tcagaggtcttcatgg

SEQ ID NO: 265081 - DNA, 19 bp, P. troglodytes
tcagagtgaacaggcaacc

SEQ ID NO: 265082 - DNA, 16 bp, P. troglodytes
tcagagtgctgggatt

SEQ ID NO: 265083 - DNA, 16 bp, P. troglodytes
tcagagtggataaaaa

SEQ ID NO: 265084 - DNA, 16 bp, P. troglodytes
tcagagttctgcatgg

SEQ ID NO: 265085 - DNA, 16 bp, P. troglodytes
tcagagtttgaagacc

SEQ ID NO: 265086 - DNA, 16 bp, P. troglodytes
tcagagtttttaaaga

SEQ ID NO: 265087 - DNA, 16 bp, P. troglodytes
tcagataaatgaaaat

SEQ ID NO: 265088 - DNA, 19 bp, P. troglodytes
tcagataaccctgatggct

SEQ ID NO: 265089 - DNA, 16 bp, P. troglodytes
tcagatcaaggagctt

SEQ ID NO: 265090 - DNA, 16 bp, P. troglodytes
tcagatcacagtggaa

SEQ ID NO: 265091 - DNA, 16 bp, P. troglodytes
tcagatcatgtcactc

SEQ ID NO: 265092 - DNA, 16 bp, P. troglodytes
tcagatcccacaggtt

SEQ ID NO: 265093 - DNA, 16 bp, P. troglodytes
tcagatctaacagtgg

SEQ ID NO: 265094 - DNA, 16 bp, P. troglodytes
tcagatgactgcagtt

SEQ ID NO: 265095 - DNA, 16 bp, P. troglodytes
tcagatgagaaatgct

SEQ ID NO: 265096 - DNA, 16 bp, P. troglodytes
tcagatgaggaaaatg

SEQ ID NO: 265097 - DNA, 16 bp, P. troglodytes
tcagatgaggaaatgg

SEQ ID NO: 265098 - DNA, 16 bp, P. troglodytes
tcagatgctttttctg

SEQ ID NO: 265099 - DNA, 17 bp, P. troglodytes
tcagatggagataagga

SEQ ID NO: 265100 - DNA, 16 bp, P. troglodytes
tcagatggatggtttg

SEQ ID NO: 265101 - DNA, 16 bp, P. troglodytes
tcagatggggtttctg

SEQ ID NO: 265102 - DNA, 16 bp, P. troglodytes
tcagatggttgtatgt

SEQ ID NO: 265103 - DNA, 16 bp, P. troglodytes
tcagatgtttgcacag

SEQ ID NO: 265104 - DNA, 16 bp, P. troglodytes
tcagattcatcaaatg

SEQ ID NO: 265105 - DNA, 16 bp, P. troglodytes
tcagattctccaaggt

SEQ ID NO: 265106 - DNA, 16 bp, P. troglodytes
tcagattcttcatctg

SEQ ID NO: 265107 - DNA, 16 bp, P. troglodytes
tcagattggcaaagat

SEQ ID NO: 265108 - DNA, 16 bp, P. troglodytes
tcagatttatttttat

SEQ ID NO: 265109 - DNA, 16 bp, P. troglodytes
tcagatttcagatttt

SEQ ID NO: 265110 - DNA, 16 bp, P. troglodytes
tcagattttgtgagac

SEQ ID NO: 265111 - DNA, 16 bp, P. troglodytes
tcagattttgttttct

SEQ ID NO: 265112 - DNA, 16 bp, P. troglodytes
tcagatttttatttat

SEQ ID NO: 265113 - DNA, 16 bp, P. troglodytes
tcagcaaaatccagaa

SEQ ID NO: 265114 - DNA, 16 bp, P. troglodytes
tcagcaaacactacaa

SEQ ID NO: 265115 - DNA, 16 bp, P. troglodytes
tcagcaaacatttttt

SEQ ID NO: 265116 - DNA, 16 bp, P. troglodytes
tcagcaaactgtggcc

SEQ ID NO: 265117 - DNA, 16 bp, P. troglodytes
tcagcaaagtaaacag

SEQ ID NO: 265118 - DNA, 16 bp, P. troglodytes
tcagcaaatattcact

SEQ ID NO: 265119 - DNA, 16 bp, P. troglodytes
tcagcaaatgtttgtt

SEQ ID NO: 265120 - DNA, 16 bp, P. troglodytes
tcagcaacaaaaagaa

SEQ ID NO: 265121 - DNA, 16 bp, P. troglodytes
tcagcaacaaggctgt

SEQ ID NO: 265122 - DNA, 16 bp, P. troglodytes
tcagcaacatgaaaat

SEQ ID NO: 265123 - DNA, 16 bp, P. troglodytes
tcagcaacatggactt

SEQ ID NO: 265124 - DNA, 16 bp, P. troglodytes
tcagcaagaccaagaa

SEQ ID NO: 265125 - DNA, 16 bp, P. troglodytes
tcagcaagagaaaagc

SEQ ID NO: 265126 - DNA, 16 bp, P. troglodytes
tcagcaatattcactg

SEQ ID NO: 265127 - DNA, 16 bp, P. troglodytes
tcagcaatggcagatg

SEQ ID NO: 265128 - DNA, 16 bp, P. troglodytes
tcagcaatgttttgta

SEQ ID NO: 265129 - DNA, 16 bp, P. troglodytes
tcagcaattgctcagt

SEQ ID NO: 265130 - DNA, 16 bp, P. troglodytes
tcagcaatttgattat

SEQ ID NO: 265131 - DNA, 16 bp, P. troglodytes
tcagcacagaaataaa

SEQ ID NO: 265132 - DNA, 16 bp, P. troglodytes
tcagcacagcagtctg

SEQ ID NO: 265133 - DNA, 16 bp, P. troglodytes
tcagcacagtgcctgg

SEQ ID NO: 265134 - DNA, 16 bp, P. troglodytes
tcagcaccacggacag

SEQ ID NO: 265135 - DNA, 16 bp, P. troglodytes
tcagcaccatggacag

SEQ ID NO: 265136 - DNA, 16 bp, P. troglodytes
tcagcaccgcggacag

SEQ ID NO: 265137 - DNA, 16 bp, P. troglodytes
tcagcacctagcacag

SEQ ID NO: 265138 - DNA, 16 bp, P. troglodytes
tcagcacttcattcct

SEQ ID NO: 265139 - DNA, 16 bp, P. troglodytes
tcagcactttgaagat

SEQ ID NO: 265140 - DNA, 16 bp, P. troglodytes
tcagcactttgggaga

SEQ ID NO: 265141 - DNA, 16 bp, P. troglodytes
tcagcactttgggagg

SEQ ID NO: 265142 - DNA, 24 bp, P. troglodytes
tcagcactttgggaggccgaggcg

SEQ ID NO: 265143 - DNA, 16 bp, P. troglodytes
tcagcagaaactgtac

SEQ ID NO: 265144 - DNA, 16 bp, P. troglodytes
tcagcagaaagaaatg

SEQ ID NO: 265145 - DNA, 16 bp, P. troglodytes
tcagcagagcagccac

SEQ ID NO: 265146 - DNA, 16 bp, P. troglodytes
tcagcagagcagctgc

SEQ ID NO: 265147 - DNA, 16 bp, P. troglodytes
tcagcagatcccaccc

SEQ ID NO: 265148 - DNA, 16 bp, P. troglodytes
tcagcagatgaatgga

SEQ ID NO: 265149 - DNA, 16 bp, P. troglodytes
tcagcagcagcagcaa

SEQ ID NO: 265150 - DNA, 16 bp, P. troglodytes
tcagcagcagtgtctg

SEQ ID NO: 265151 - DNA, 16 bp, P. troglodytes
tcagcagcggaggctg

SEQ ID NO: 265152 - DNA, 16 bp, P. troglodytes
tcagcaggaagcagtt

SEQ ID NO: 265153 - DNA, 20 bp, P. troglodytes
tcagcaggatgtgggtgggg

SEQ ID NO: 265154 - DNA, 16 bp, P. troglodytes
tcagcagggagagcac

SEQ ID NO: 265155 - DNA, 16 bp, P. troglodytes
tcagcagggctgtgct

SEQ ID NO: 265156 - DNA, 16 bp, P. troglodytes
tcagcagtctgcaacc

SEQ ID NO: 265157 - DNA, 16 bp, P. troglodytes
tcagcagtgaagctgt

SEQ ID NO: 265158 - DNA, 16 bp, P. troglodytes
tcagcagtgttttgta

SEQ ID NO: 265159 - DNA, 16 bp, P. troglodytes
tcagcataattatttt

SEQ ID NO: 265160 - DNA, 16 bp, P. troglodytes
tcagcataattcttca

SEQ ID NO: 265161 - DNA, 16 bp, P. troglodytes
tcagcatcacttggga

SEQ ID NO: 265162 - DNA, 16 bp, P. troglodytes
tcagcatcagcatcag

SEQ ID NO: 265163 - DNA, 16 bp, P. troglodytes
tcagcatcatctggga

SEQ ID NO: 265164 - DNA, 16 bp, P. troglodytes
tcagcatctgcttctg

SEQ ID NO: 265165 - DNA, 16 bp, P. troglodytes
tcagcatctgcttgtc

SEQ ID NO: 265166 - DNA, 16 bp, P. troglodytes
tcagcatgaagcagtt

SEQ ID NO: 265167 - DNA, 16 bp, P. troglodytes
tcagcatgtgaatttt

SEQ ID NO: 265168 - DNA, 16 bp, P. troglodytes
tcagcattgtactgga

SEQ ID NO: 265169 - DNA, 17 bp, P. troglodytes
tcagcatttgcttgtct

SEQ ID NO: 265170 - DNA, 16 bp, P. troglodytes
tcagcattttgtagtt

SEQ ID NO: 265171 - DNA, 16 bp, P. troglodytes
tcagccaacaaatatt

SEQ ID NO: 265172 - DNA, 16 bp, P. troglodytes
tcagccaactgagtag

SEQ ID NO: 265173 - DNA, 16 bp, P. troglodytes
tcagccaagatcgtgc

SEQ ID NO: 265174 - DNA, 16 bp, P. troglodytes
tcagccaagcacagtg

SEQ ID NO: 265175 - DNA, 16 bp, P. troglodytes
tcagccaccatgcctg

SEQ ID NO: 265176 - DNA, 16 bp, P. troglodytes
tcagccacccaaagtg

SEQ ID NO: 265177 - DNA, 16 bp, P. troglodytes
tcagccactccagcca

SEQ ID NO: 265178 - DNA, 16 bp, P. troglodytes
tcagccagacacagtg

SEQ ID NO: 265179 - DNA, 16 bp, P. troglodytes
tcagccagagcagggc

SEQ ID NO: 265180 - DNA, 16 bp, P. troglodytes
tcagccaggagtctct

SEQ ID NO: 265181 - DNA, 16 bp, P. troglodytes
tcagccaggcgtggtg

SEQ ID NO: 265182 - DNA, 16 bp, P. troglodytes
tcagccaggtgtctct

SEQ ID NO: 265183 - DNA, 16 bp, P. troglodytes
tcagccatggctaaaa

SEQ ID NO: 265184 - DNA, 16 bp, P. troglodytes
tcagccattattactt

SEQ ID NO: 265185 - DNA, 16 bp, P. troglodytes
tcagccattgtagaag

SEQ ID NO: 265186 - DNA, 16 bp, P. troglodytes
tcagcccacttcagcc

SEQ ID NO: 265187 - DNA, 16 bp, P. troglodytes
tcagcccaggaattca

SEQ ID NO: 265188 - DNA, 16 bp, P. troglodytes
tcagcccaggaggcag

SEQ ID NO: 265189 - DNA, 16 bp, P. troglodytes
tcagcccaggaggttg

SEQ ID NO: 265190 - DNA, 16 bp, P. troglodytes
tcagccccccaaagtg

SEQ ID NO: 265191 - DNA, 16 bp, P. troglodytes
tcagcccccgagggcc

SEQ ID NO: 265192 - DNA, 16 bp, P. troglodytes
tcagccccctgcctgg

SEQ ID NO: 265193 - DNA, 16 bp, P. troglodytes
tcagccccttgagtag

SEQ ID NO: 265194 - DNA, 18 bp, P. troglodytes
tcagccctgtttgtgtta

SEQ ID NO: 265195 - DNA, 18 bp, P. troglodytes
tcagcctaccgagtagct

SEQ ID NO: 265196 - DNA, 16 bp, P. troglodytes
tcagcctcacaaagtg

SEQ ID NO: 265197 - DNA, 16 bp, P. troglodytes
tcagcctcagcactgt

SEQ ID NO: 265198 - DNA, 16 bp, P. troglodytes
tcagcctcagctggga

SEQ ID NO: 265199 - DNA, 16 bp, P. troglodytes
tcagcctcattttacc

SEQ ID NO: 265200 - DNA, 16 bp, P. troglodytes
tcagcctccacctcct

SEQ ID NO: 265201 - DNA, 16 bp, P. troglodytes
tcagcctccagaactc

SEQ ID NO: 265202 - DNA, 16 bp, P. troglodytes
tcagcctccagcctcc

SEQ ID NO: 265203 - DNA, 16 bp, P. troglodytes
tcagcctcccaaaagc

SEQ ID NO: 265204 - DNA, 16 bp, P. troglodytes
tcagcctcccaaagtc

SEQ ID NO: 265205 - DNA, 18 bp, P. troglodytes
tcagcctcccaaagtgcc

SEQ ID NO: 265206 - DNA, 16 bp, P. troglodytes
tcagcctcccaagaag

SEQ ID NO: 265207 - DNA, 16 bp, P. troglodytes
tcagcctcccaagcat

SEQ ID NO: 265208 - DNA, 16 bp, P. troglodytes
tcagcctcccagactc

SEQ ID NO: 265209 - DNA, 16 bp, P. troglodytes
tcagcctcccagagag

SEQ ID NO: 265210 - DNA, 16 bp, P. troglodytes
tcagcctcccagaggg

SEQ ID NO: 265211 - DNA, 18 bp, P. troglodytes
tcagcctcccaggtagct

SEQ ID NO: 265212 - DNA, 16 bp, P. troglodytes
tcagcctcccagtagc

SEQ ID NO: 265213 - DNA, 16 bp, P. troglodytes
tcagcctccccaaaat

SEQ ID NO: 265214 - DNA, 16 bp, P. troglodytes
tcagcctcccgagctg

SEQ ID NO: 265215 - DNA, 18 bp, P. troglodytes
tcagcctcccgagtagcc

SEQ ID NO: 265216 - DNA, 19 bp, P. troglodytes
tcagcctcccgagtagcta

SEQ ID NO: 265217 - DNA, 23 bp, P. troglodytes
tcagcctcccgagtagctggaac

SEQ ID NO: 265218 - DNA, 16 bp, P. troglodytes
tcagcctccctaagtg

SEQ ID NO: 265219 - DNA, 20 bp, P. troglodytes
tcagcctccggagtagctga

SEQ ID NO: 265220 - DNA, 16 bp, P. troglodytes
tcagcctcctaaagag

SEQ ID NO: 265221 - DNA, 16 bp, P. troglodytes
tcagcctcctcatctg

SEQ ID NO: 265222 - DNA, 16 bp, P. troglodytes
tcagcctcctgaactg

SEQ ID NO: 265223 - DNA, 16 bp, P. troglodytes
tcagcctcctgaatac

SEQ ID NO: 265224 - DNA, 16 bp, P. troglodytes
tcagcctcctgagtaa

SEQ ID NO: 265225 - DNA, 16 bp, P. troglodytes
tcagcctcctgagtac

SEQ ID NO: 265226 - DNA, 16 bp, P. troglodytes
tcagcctcctgggcag

SEQ ID NO: 265227 - DNA, 16 bp, P. troglodytes
tcagcctcctgggctg

SEQ ID NO: 265228 - DNA, 16 bp, P. troglodytes
tcagcctcggtgacag

SEQ ID NO: 265229 - DNA, 16 bp, P. troglodytes
tcagcctctagagtag

SEQ ID NO: 265230 - DNA, 16 bp, P. troglodytes
tcagcctcttgggctc

SEQ ID NO: 265231 - DNA, 16 bp, P. troglodytes
tcagcctgaagaagtt

SEQ ID NO: 265232 - DNA, 16 bp, P. troglodytes
tcagcctgagcgacag

SEQ ID NO: 265233 - DNA, 16 bp, P. troglodytes
tcagcctgctgaatag

SEQ ID NO: 265234 - DNA, 16 bp, P. troglodytes
tcagcctgggaggcag

SEQ ID NO: 265235 - DNA, 16 bp, P. troglodytes
tcagcctgggcaacag

SEQ ID NO: 265236 - DNA, 19 bp, P. troglodytes
tcagcctgggcaacatggc

SEQ ID NO: 265237 - DNA, 16 bp, P. troglodytes
tcagcctgggccacag

SEQ ID NO: 265238 - DNA, 16 bp, P. troglodytes
tcagcctggggaacat

SEQ ID NO: 265239 - DNA, 19 bp, P. troglodytes
tcagcctgggtgacagaga

SEQ ID NO: 265240 - DNA, 16 bp, P. troglodytes
tcagcctgggtgacat

SEQ ID NO: 265241 - DNA, 16 bp, P. troglodytes
tcagccttctgaagtg

SEQ ID NO: 265242 - DNA, 16 bp, P. troglodytes
tcagcctttttgctct

SEQ ID NO: 265243 - DNA, 16 bp, P. troglodytes
tcagcgtgacctggat

SEQ ID NO: 265244 - DNA, 16 bp, P. troglodytes
tcagctaaagatgggg

SEQ ID NO: 265245 - DNA, 16 bp, P. troglodytes
tcagctaatttttaat

SEQ ID NO: 265246 - DNA, 16 bp, P. troglodytes
tcagctactgaggagg

SEQ ID NO: 265247 - DNA, 20 bp, P. troglodytes
tcagctacttgggaggctga

SEQ ID NO: 265248 - DNA, 16 bp, P. troglodytes
tcagctattatttttt

SEQ ID NO: 265249 - DNA, 16 bp, P. troglodytes
tcagctatttcttcta

SEQ ID NO: 265250 - DNA, 16 bp, P. troglodytes
tcagctcaaacatcac

SEQ ID NO: 265251 - DNA, 16 bp, P. troglodytes
tcagctcactgcagtc

SEQ ID NO: 265252 - DNA, 16 bp, P. troglodytes
tcagctcactgccagc

SEQ ID NO: 265253 - DNA, 16 bp, P. troglodytes
tcagctcacttgcaac

SEQ ID NO: 265254 - DNA, 16 bp, P. troglodytes
tcagctcagcctcctg

SEQ ID NO: 265255 - DNA, 16 bp, P. troglodytes
tcagctcatggcaacc

SEQ ID NO: 265256 - DNA, 22 bp, P. troglodytes
tcagctcattgcaacctctgcc

SEQ ID NO: 265257 - DNA, 16 bp, P. troglodytes
tcagctccatcagctc

SEQ ID NO: 265258 - DNA, 25 bp, P. troglodytes
tcagctcctatctctgtatggcctg

SEQ ID NO: 265259 - DNA, 17 bp, P. troglodytes
tcagctctgcaccaagt

SEQ ID NO: 265260 - DNA, 16 bp, P. troglodytes
tcagctctggaacaag

SEQ ID NO: 265261 - DNA, 16 bp, P. troglodytes
tcagctgaattttttt

SEQ ID NO: 265262 - DNA, 16 bp, P. troglodytes
tcagctgccaggcagg

SEQ ID NO: 265263 - DNA, 16 bp, P. troglodytes
tcagctgccttcagcc

SEQ ID NO: 265264 - DNA, 16 bp, P. troglodytes
tcagctgctgctgctg

SEQ ID NO: 265265 - DNA, 16 bp, P. troglodytes
tcagctggaaatgcag

SEQ ID NO: 265266 - DNA, 16 bp, P. troglodytes
tcagctggagtgcagt

SEQ ID NO: 265267 - DNA, 16 bp, P. troglodytes
tcagctgggagcatca

SEQ ID NO: 265268 - DNA, 16 bp, P. troglodytes
tcagctgggagtggtg

SEQ ID NO: 265269 - DNA, 16 bp, P. troglodytes
tcagctgggcacagtg

SEQ ID NO: 265270 - DNA, 16 bp, P. troglodytes
tcagctgggcgtggtg

SEQ ID NO: 265271 - DNA, 16 bp, P. troglodytes
tcagctgggtgtggtg

SEQ ID NO: 265272 - DNA, 16 bp, P. troglodytes
tcagctgtgaatctgt

SEQ ID NO: 265273 - DNA, 16 bp, P. troglodytes
tcagcttcaaataaag

SEQ ID NO: 265274 - DNA, 16 bp, P. troglodytes
tcagcttcatccctgg

SEQ ID NO: 265275 - DNA, 16 bp, P. troglodytes
tcagcttccagagcag

SEQ ID NO: 265276 - DNA, 16 bp, P. troglodytes
tcagcttccagagtag

SEQ ID NO: 265277 - DNA, 16 bp, P. troglodytes
tcagcttcccaaagta

SEQ ID NO: 265278 - DNA, 16 bp, P. troglodytes
tcagcttcctcacctg

SEQ ID NO: 265279 - DNA, 16 bp, P. troglodytes
tcagcttctccctctg

SEQ ID NO: 265280 - DNA, 16 bp, P. troglodytes
tcagcttctcgagtag

SEQ ID NO: 265281 - DNA, 16 bp, P. troglodytes
tcagcttctctctctc

SEQ ID NO: 265282 - DNA, 16 bp, P. troglodytes
tcagcttctggtgagg

SEQ ID NO: 265283 - DNA, 16 bp, P. troglodytes
tcagcttgaatgttat

SEQ ID NO: 265284 - DNA, 16 bp, P. troglodytes
tcagctttcccatctg

SEQ ID NO: 265285 - DNA, 16 bp, P. troglodytes
tcagctttcctggttc

SEQ ID NO: 265286 - DNA, 16 bp, P. troglodytes
tcagctttgggactca

SEQ ID NO: 265287 - DNA, 16 bp, P. troglodytes
tcagctttgtcaaaga

SEQ ID NO: 265288 - DNA, 16 bp, P. troglodytes
tcaggaaaaaataatt

SEQ ID NO: 265289 - DNA, 16 bp, P. troglodytes
tcaggaaaaaggcaag

SEQ ID NO: 265290 - DNA, 16 bp, P. troglodytes
tcaggaaaaataacta

SEQ ID NO: 265291 - DNA, 16 bp, P. troglodytes
tcaggaaaaataatta

SEQ ID NO: 265292 - DNA, 16 bp, P. troglodytes
tcaggaaaacaattta

SEQ ID NO: 265293 - DNA, 16 bp, P. troglodytes
tcaggaaacataatca

SEQ ID NO: 265294 - DNA, 16 bp, P. troglodytes
tcaggaaacttacagt

SEQ ID NO: 265295 - DNA, 16 bp, P. troglodytes
tcaggaaagaaagaaa

SEQ ID NO: 265296 - DNA, 16 bp, P. troglodytes
tcaggaaaggctttct

SEQ ID NO: 265297 - DNA, 16 bp, P. troglodytes
tcaggaaatatttgtt

SEQ ID NO: 265298 - DNA, 16 bp, P. troglodytes
tcaggaaatgtgatgc

SEQ ID NO: 265299 - DNA, 16 bp, P. troglodytes
tcaggaacaccagtta

SEQ ID NO: 265300 - DNA, 16 bp, P. troglodytes
tcaggaagaaaaagaa

SEQ ID NO: 265301 - DNA, 16 bp, P. troglodytes
tcaggaagaagttgaa

SEQ ID NO: 265302 - DNA, 16 bp, P. troglodytes
tcaggaagctgaggtg

SEQ ID NO: 265303 - DNA, 16 bp, P. troglodytes
tcaggaagctttcact

SEQ ID NO: 265304 - DNA, 16 bp, P. troglodytes
tcaggaaggagaagga

SEQ ID NO: 265305 - DNA, 16 bp, P. troglodytes
tcaggaagtttgagag

SEQ ID NO: 265306 - DNA, 16 bp, P. troglodytes
tcaggaattcaagaac

SEQ ID NO: 265307 - DNA, 16 bp, P. troglodytes
tcaggacaaaggcatg

SEQ ID NO: 265308 - DNA, 21 bp, P. troglodytes
tcaggacataggtatgggcaa

SEQ ID NO: 265309 - DNA, 16 bp, P. troglodytes
tcaggaccctcagctg

SEQ ID NO: 265310 - DNA, 16 bp, P. troglodytes
tcaggacctcctgagg

SEQ ID NO: 265311 - DNA, 16 bp, P. troglodytes
tcaggacctgaactca

SEQ ID NO: 265312 - DNA, 16 bp, P. troglodytes
tcaggacctgatggct

SEQ ID NO: 265313 - DNA, 16 bp, P. troglodytes
tcaggagaaaaataaa

SEQ ID NO: 265314 - DNA, 16 bp, P. troglodytes
tcaggagaaggaaata

SEQ ID NO: 265315 - DNA, 16 bp, P. troglodytes
tcaggagaatggtgtg

SEQ ID NO: 265316 - DNA, 16 bp, P. troglodytes
tcaggagacagagacc

SEQ ID NO: 265317 - DNA, 16 bp, P. troglodytes
tcaggagacctgggtt

SEQ ID NO: 265318 - DNA, 16 bp, P. troglodytes
tcaggagactgaagtg

SEQ ID NO: 265319 - DNA, 16 bp, P. troglodytes
tcaggagactgaggtg

SEQ ID NO: 265320 - DNA, 16 bp, P. troglodytes
tcaggagagagtggca

SEQ ID NO: 265321 - DNA, 18 bp, P. troglodytes
tcaggagcccagctggct

SEQ ID NO: 265322 - DNA, 16 bp, P. troglodytes
tcaggagcttttgtaa

SEQ ID NO: 265323 - DNA, 16 bp, P. troglodytes
tcaggaggccgaggca

SEQ ID NO: 265324 - DNA, 16 bp, P. troglodytes
tcaggaggcctcagga

SEQ ID NO: 265325 - DNA, 16 bp, P. troglodytes
tcaggaggctaaggta

SEQ ID NO: 265326 - DNA, 16 bp, P. troglodytes
tcaggaggctgagcag

SEQ ID NO: 265327 - DNA, 16 bp, P. troglodytes
tcaggaggctgaggtt

SEQ ID NO: 265328 - DNA, 16 bp, P. troglodytes
tcaggaggctgatgtg

SEQ ID NO: 265329 - DNA, 16 bp, P. troglodytes
tcaggaggctgtgaca

SEQ ID NO: 265330 - DNA, 16 bp, P. troglodytes
tcaggaggtggaggtt

SEQ ID NO: 265331 - DNA, 16 bp, P. troglodytes
tcaggaggttgaggtt

SEQ ID NO: 265332 - DNA, 19 bp, P. troglodytes
tcaggagtgaagctgcaga

SEQ ID NO: 265333 - DNA, 16 bp, P. troglodytes
tcaggagttcaacacc

SEQ ID NO: 265334 - DNA, 16 bp, P. troglodytes
tcaggagttccaggcc

SEQ ID NO: 265335 - DNA, 17 bp, P. troglodytes
tcaggagttcgagacct

SEQ ID NO: 265336 - DNA, 24 bp, P. troglodytes
tcaggagtttgagaccagcctggg

SEQ ID NO: 265337 - DNA, 16 bp, P. troglodytes
tcaggatgagggctgg

SEQ ID NO: 265338 - DNA, 16 bp, P. troglodytes
tcaggatgatactggc

SEQ ID NO: 265339 - DNA, 16 bp, P. troglodytes
tcaggatgatgggaaa

SEQ ID NO: 265340 - DNA, 16 bp, P. troglodytes
tcaggatgctgctggc

SEQ ID NO: 265341 - DNA, 16 bp, P. troglodytes
tcaggattctctagag

SEQ ID NO: 265342 - DNA, 16 bp, P. troglodytes
tcaggatttaaaaact

SEQ ID NO: 265343 - DNA, 16 bp, P. troglodytes
tcaggatttttgctaa

SEQ ID NO: 265344 - DNA, 16 bp, P. troglodytes
tcaggcaagagaaagg

SEQ ID NO: 265345 - DNA, 16 bp, P. troglodytes
tcaggcaagagaagga

SEQ ID NO: 265346 - DNA, 16 bp, P. troglodytes
tcaggcaagataaaga

SEQ ID NO: 265347 - DNA, 16 bp, P. troglodytes
tcaggcaagttactta

SEQ ID NO: 265348 - DNA, 16 bp, P. troglodytes
tcaggcacagaaagaa

SEQ ID NO: 265349 - DNA, 19 bp, P. troglodytes
tcaggcacagtggctcacg

SEQ ID NO: 265350 - DNA, 16 bp, P. troglodytes
tcaggcaggagaaaaa

SEQ ID NO: 265351 - DNA, 16 bp, P. troglodytes
tcaggcaggaggagtt

SEQ ID NO: 265352 - DNA, 16 bp, P. troglodytes
tcaggcatggtggcag

SEQ ID NO: 265353 - DNA, 18 bp, P. troglodytes
tcaggcattagttagatt

SEQ ID NO: 265354 - DNA, 16 bp, P. troglodytes
tcaggccactgcactg

SEQ ID NO: 265355 - DNA, 16 bp, P. troglodytes
tcaggccagagaaaga

SEQ ID NO: 265356 - DNA, 16 bp, P. troglodytes
tcaggccatgatggga

SEQ ID NO: 265357 - DNA, 16 bp, P. troglodytes
tcaggcccacccagat

SEQ ID NO: 265358 - DNA, 16 bp, P. troglodytes
tcaggccccactccag

SEQ ID NO: 265359 - DNA, 16 bp, P. troglodytes
tcaggccccatcccag

SEQ ID NO: 265360 - DNA, 16 bp, P. troglodytes
tcaggcccctctgctg

SEQ ID NO: 265361 - DNA, 22 bp, P. troglodytes
tcaggccgggcacggtggctca

SEQ ID NO: 265362 - DNA, 16 bp, P. troglodytes
tcaggcctctcaaaaa

SEQ ID NO: 265363 - DNA, 16 bp, P. troglodytes
tcaggctagagtgtag

SEQ ID NO: 265364 - DNA, 18 bp, P. troglodytes
tcaggctagtctcgaact

SEQ ID NO: 265365 - DNA, 16 bp, P. troglodytes
tcaggctatcctccca

SEQ ID NO: 265366 - DNA, 16 bp, P. troglodytes
tcaggctccaccccag

SEQ ID NO: 265367 - DNA, 16 bp, P. troglodytes
tcaggctgaagggaaa

SEQ ID NO: 265368 - DNA, 16 bp, P. troglodytes
tcaggctgcacatttt

SEQ ID NO: 265369 - DNA, 16 bp, P. troglodytes
tcaggctgcagtgagc

SEQ ID NO: 265370 - DNA, 16 bp, P. troglodytes
tcaggctgctatgaca

SEQ ID NO: 265371 - DNA, 16 bp, P. troglodytes
tcaggctgctgaacca

SEQ ID NO: 265372 - DNA, 16 bp, P. troglodytes
tcaggctggagcgcag

SEQ ID NO: 265373 - DNA, 18 bp, P. troglodytes
tcaggctggagtgcagtg

SEQ ID NO: 265374 - DNA, 22 bp, P. troglodytes
tcaggctggagtgcagtggcgc

SEQ ID NO: 265375 - DNA, 16 bp, P. troglodytes
tcaggctggtgcccct

SEQ ID NO: 265376 - DNA, 18 bp, P. troglodytes
tcaggctggttttgaact

SEQ ID NO: 265377 - DNA, 16 bp, P. troglodytes
tcaggcttgagggtgg

SEQ ID NO: 265378 - DNA, 16 bp, P. troglodytes
tcaggctttaaactgt

SEQ ID NO: 265379 - DNA, 16 bp, P. troglodytes
tcagggaaacacattt

SEQ ID NO: 265380 - DNA, 16 bp, P. troglodytes
tcagggaaataagaga

SEQ ID NO: 265381 - DNA, 16 bp, P. troglodytes
tcagggaaatacaaat

SEQ ID NO: 265382 - DNA, 16 bp, P. troglodytes
tcagggaaggcctctt

SEQ ID NO: 265383 - DNA, 16 bp, P. troglodytes
tcagggactactggac

SEQ ID NO: 265384 - DNA, 16 bp, P. troglodytes
tcagggagatggattt

SEQ ID NO: 265385 - DNA, 16 bp, P. troglodytes
tcagggagccaatgtg

SEQ ID NO: 265386 - DNA, 16 bp, P. troglodytes
tcagggagctcccagg

SEQ ID NO: 265387 - DNA, 16 bp, P. troglodytes
tcagggagcttacagt

SEQ ID NO: 265388 - DNA, 16 bp, P. troglodytes
tcagggatattggcct

SEQ ID NO: 265389 - DNA, 16 bp, P. troglodytes
tcagggatttcttctt

SEQ ID NO: 265390 - DNA, 16 bp, P. troglodytes
tcagggccagggccag

SEQ ID NO: 265391 - DNA, 16 bp, P. troglodytes
tcagggccccaccctt

SEQ ID NO: 265392 - DNA, 16 bp, P. troglodytes
tcagggccgggtgtgg

SEQ ID NO: 265393 - DNA, 16 bp, P. troglodytes
tcagggcctcctgagg

SEQ ID NO: 265394 - DNA, 16 bp, P. troglodytes
tcagggctgggcacag

SEQ ID NO: 265395 - DNA, 16 bp, P. troglodytes
tcaggggagggggaag

SEQ ID NO: 265396 - DNA, 16 bp, P. troglodytes
tcaggggttgattttt

SEQ ID NO: 265397 - DNA, 16 bp, P. troglodytes
tcagggtcttttgtgg

SEQ ID NO: 265398 - DNA, 16 bp, P. troglodytes
tcagggtgttggcagg

SEQ ID NO: 265399 - DNA, 16 bp, P. troglodytes
tcagggttcccactga

SEQ ID NO: 265400 - DNA, 16 bp, P. troglodytes
tcagggtttcactgtg

SEQ ID NO: 265401 - DNA, 16 bp, P. troglodytes
tcagggttttattttt

SEQ ID NO: 265402 - DNA, 16 bp, P. troglodytes
tcaggtatgtctttat

SEQ ID NO: 265403 - DNA, 16 bp, P. troglodytes
tcaggtcaggagttcg

SEQ ID NO: 265404 - DNA, 16 bp, P. troglodytes
tcaggtccccttccac

SEQ ID NO: 265405 - DNA, 16 bp, P. troglodytes
tcaggtccctcttctg

SEQ ID NO: 265406 - DNA, 16 bp, P. troglodytes
tcaggtctcaaactcc

SEQ ID NO: 265407 - DNA, 16 bp, P. troglodytes
tcaggtgatagatgat

SEQ ID NO: 265408 - DNA, 20 bp, P. troglodytes
tcaggtgatccacccacctt

SEQ ID NO: 265409 - DNA, 17 bp, P. troglodytes
tcaggtgatccacctga

SEQ ID NO: 265410 - DNA, 16 bp, P. troglodytes
tcaggtgatcctccca

SEQ ID NO: 265411 - DNA, 19 bp, P. troglodytes
tcaggtgatctgcctgcct

SEQ ID NO: 265412 - DNA, 16 bp, P. troglodytes
tcaggtgatctggcca

SEQ ID NO: 265413 - DNA, 16 bp, P. troglodytes
tcaggtgattatcctg

SEQ ID NO: 265414 - DNA, 16 bp, P. troglodytes
tcaggtgttcctccca

SEQ ID NO: 265415 - DNA, 16 bp, P. troglodytes
tcaggtgtttgagacc

SEQ ID NO: 265416 - DNA, 16 bp, P. troglodytes
tcaggttcaagcgatt

SEQ ID NO: 265417 - DNA, 16 bp, P. troglodytes
tcaggttcttttttgg

SEQ ID NO: 265418 - DNA, 16 bp, P. troglodytes
tcaggttgcaaatttt

SEQ ID NO: 265419 - DNA, 16 bp, P. troglodytes
tcaggttggagatgaa

SEQ ID NO: 265420 - DNA, 16 bp, P. troglodytes
tcaggtttttgcattt

SEQ ID NO: 265421 - DNA, 16 bp, P. troglodytes
tcagtaaaaccttgca

SEQ ID NO: 265422 - DNA, 16 bp, P. troglodytes
tcagtaaagtccctct

SEQ ID NO: 265423 - DNA, 16 bp, P. troglodytes
tcagtaaatacttgtt

SEQ ID NO: 265424 - DNA, 16 bp, P. troglodytes
tcagtaaatatttcct

SEQ ID NO: 265425 - DNA, 16 bp, P. troglodytes
tcagtaaatatttgct

SEQ ID NO: 265426 - DNA, 16 bp, P. troglodytes
tcagtaaatatttgtt

SEQ ID NO: 265427 - DNA, 16 bp, P. troglodytes
tcagtaaatttagaaa

SEQ ID NO: 265428 - DNA, 16 bp, P. troglodytes
tcagtaatgttaagta

SEQ ID NO: 265429 - DNA, 16 bp, P. troglodytes
tcagtaatttttaaga

SEQ ID NO: 265430 - DNA, 16 bp, P. troglodytes
tcagtaccacaccaca

SEQ ID NO: 265431 - DNA, 16 bp, P. troglodytes
tcagtaccatttattg

SEQ ID NO: 265432 - DNA, 16 bp, P. troglodytes
tcagtagaaactctac

SEQ ID NO: 265433 - DNA, 16 bp, P. troglodytes
tcagtagccacatgtg

SEQ ID NO: 265434 - DNA, 16 bp, P. troglodytes
tcagtagcccaggctg

SEQ ID NO: 265435 - DNA, 16 bp, P. troglodytes
tcagtaggaaaaaaaa

SEQ ID NO: 265436 - DNA, 16 bp, P. troglodytes
tcagtagttctgcttt

SEQ ID NO: 265437 - DNA, 16 bp, P. troglodytes
tcagtagtttgttcct

SEQ ID NO: 265438 - DNA, 16 bp, P. troglodytes
tcagtataaactcatg

SEQ ID NO: 265439 - DNA, 16 bp, P. troglodytes
tcagtatattttcttt

SEQ ID NO: 265440 - DNA, 16 bp, P. troglodytes
tcagtatcattaaaat

SEQ ID NO: 265441 - DNA, 16 bp, P. troglodytes
tcagtatttaaaaaaa

SEQ ID NO: 265442 - DNA, 16 bp, P. troglodytes
tcagtatttcattctt

SEQ ID NO: 265443 - DNA, 16 bp, P. troglodytes
tcagtatttctttata

SEQ ID NO: 265444 - DNA, 16 bp, P. troglodytes
tcagtatttgttgaat

SEQ ID NO: 265445 - DNA, 16 bp, P. troglodytes
tcagtattttaaaatt

SEQ ID NO: 265446 - DNA, 16 bp, P. troglodytes
tcagtcaaaagaaaag

SEQ ID NO: 265447 - DNA, 16 bp, P. troglodytes
tcagtcacatcttcag

SEQ ID NO: 265448 - DNA, 16 bp, P. troglodytes
tcagtcagggtggtgg

SEQ ID NO: 265449 - DNA, 16 bp, P. troglodytes
tcagtcagtcagtcag

SEQ ID NO: 265450 - DNA, 16 bp, P. troglodytes
tcagtccccaagactg

SEQ ID NO: 265451 - DNA, 16 bp, P. troglodytes
tcagtcctccttgtgg

SEQ ID NO: 265452 - DNA, 16 bp, P. troglodytes
tcagtcctctcaaact

SEQ ID NO: 265453 - DNA, 16 bp, P. troglodytes
tcagtctccagagtag

SEQ ID NO: 265454 - DNA, 16 bp, P. troglodytes
tcagtctcctcatttg

SEQ ID NO: 265455 - DNA, 16 bp, P. troglodytes
tcagtctcctcctctg

SEQ ID NO: 265456 - DNA, 18 bp, P. troglodytes
tcagtctcctgagtagct

SEQ ID NO: 265457 - DNA, 16 bp, P. troglodytes
tcagtctctctctctc

SEQ ID NO: 265458 - DNA, 16 bp, P. troglodytes
tcagtctctctctctt

SEQ ID NO: 265459 - DNA, 16 bp, P. troglodytes
tcagtctgatgatagt

SEQ ID NO: 265460 - DNA, 16 bp, P. troglodytes
tcagtctgtacccctt

SEQ ID NO: 265461 - DNA, 16 bp, P. troglodytes
tcagtcttaaaaagga

SEQ ID NO: 265462 - DNA, 16 bp, P. troglodytes
tcagtcttcaaatttt

SEQ ID NO: 265463 - DNA, 16 bp, P. troglodytes
tcagtcttttacattt

SEQ ID NO: 265464 - DNA, 16 bp, P. troglodytes
tcagtctttttaattt

SEQ ID NO: 265465 - DNA, 16 bp, P. troglodytes
tcagtgaaataagcca

SEQ ID NO: 265466 - DNA, 16 bp, P. troglodytes
tcagtgaatgtttgtt

SEQ ID NO: 265467 - DNA, 16 bp, P. troglodytes
tcagtgaccttgggca

SEQ ID NO: 265468 - DNA, 16 bp, P. troglodytes
tcagtgagccatgatt

SEQ ID NO: 265469 - DNA, 16 bp, P. troglodytes
tcagtgagctatgatt

SEQ ID NO: 265470 - DNA, 16 bp, P. troglodytes
tcagtgagtgttacag

SEQ ID NO: 265471 - DNA, 16 bp, P. troglodytes
tcagtgatattggcct

SEQ ID NO: 265472 - DNA, 16 bp, P. troglodytes
tcagtgatgatgatga

SEQ ID NO: 265473 - DNA, 16 bp, P. troglodytes
tcagtgatgttaagca

SEQ ID NO: 265474 - DNA, 16 bp, P. troglodytes
tcagtgcagcctggca

SEQ ID NO: 265475 - DNA, 16 bp, P. troglodytes
tcagtgcccatatcat

SEQ ID NO: 265476 - DNA, 16 bp, P. troglodytes
tcagtgccctaaagag

SEQ ID NO: 265477 - DNA, 16 bp, P. troglodytes
tcagtgctcaatggtg

SEQ ID NO: 265478 - DNA, 16 bp, P. troglodytes
tcagtggaatagaatt

SEQ ID NO: 265479 - DNA, 16 bp, P. troglodytes
tcagtggaatcataca

SEQ ID NO: 265480 - DNA, 16 bp, P. troglodytes
tcagtggagaggagac

SEQ ID NO: 265481 - DNA, 16 bp, P. troglodytes
tcagtggagggtcagt

SEQ ID NO: 265482 - DNA, 16 bp, P. troglodytes
tcagtggctcacacct

SEQ ID NO: 265483 - DNA, 16 bp, P. troglodytes
tcagtgggaaggggag

SEQ ID NO: 265484 - DNA, 16 bp, P. troglodytes
tcagtgggacaagatg

SEQ ID NO: 265485 - DNA, 16 bp, P. troglodytes
tcagtggtaataaata

SEQ ID NO: 265486 - DNA, 16 bp, P. troglodytes
tcagtggtgtctgtga

SEQ ID NO: 265487 - DNA, 16 bp, P. troglodytes
tcagtggttgcctggg

SEQ ID NO: 265488 - DNA, 16 bp, P. troglodytes
tcagtgtaacctctgc

SEQ ID NO: 265489 - DNA, 16 bp, P. troglodytes
tcagtgtacaagtctt

SEQ ID NO: 265490 - DNA, 16 bp, P. troglodytes
tcagtgtccaatatat

SEQ ID NO: 265491 - DNA, 16 bp, P. troglodytes
tcagtgtggcctggat

SEQ ID NO: 265492 - DNA, 16 bp, P. troglodytes
tcagtgtggttttgat

SEQ ID NO: 265493 - DNA, 16 bp, P. troglodytes
tcagtgtgtgtgtatg

SEQ ID NO: 265494 - DNA, 16 bp, P. troglodytes
tcagtgttttgtggtt

SEQ ID NO: 265495 - DNA, 16 bp, P. troglodytes
tcagttaaacttcttt

SEQ ID NO: 265496 - DNA, 16 bp, P. troglodytes
tcagttaatgaaaact

SEQ ID NO: 265497 - DNA, 16 bp, P. troglodytes
tcagttactggggagg

SEQ ID NO: 265498 - DNA, 16 bp, P. troglodytes
tcagttatcagatcaa

SEQ ID NO: 265499 - DNA, 16 bp, P. troglodytes
tcagttatttttaaat

SEQ ID NO: 265500 - DNA, 16 bp, P. troglodytes
tcagttcaaagaattt

SEQ ID NO: 265501 - DNA, 16 bp, P. troglodytes
tcagttcactgcaaac

SEQ ID NO: 265502 - DNA, 16 bp, P. troglodytes
tcagttccagaccacc

SEQ ID NO: 265503 - DNA, 16 bp, P. troglodytes
tcagttcctggtgagg

SEQ ID NO: 265504 - DNA, 16 bp, P. troglodytes
tcagttctcatgctgc

SEQ ID NO: 265505 - DNA, 16 bp, P. troglodytes
tcagttgcactagcca

SEQ ID NO: 265506 - DNA, 16 bp, P. troglodytes
tcagttgcatttttat

SEQ ID NO: 265507 - DNA, 16 bp, P. troglodytes
tcagttggaagtgcag

SEQ ID NO: 265508 - DNA, 16 bp, P. troglodytes
tcagttggctgtaagt

SEQ ID NO: 265509 - DNA, 16 bp, P. troglodytes
tcagtttaatttgcag

SEQ ID NO: 265510 - DNA, 16 bp, P. troglodytes
tcagtttactcatctg

SEQ ID NO: 265511 - DNA, 16 bp, P. troglodytes
tcagtttccacatctg

SEQ ID NO: 265512 - DNA, 16 bp, P. troglodytes
tcagtttccattttct

SEQ ID NO: 265513 - DNA, 16 bp, P. troglodytes
tcagtttccccatttg

SEQ ID NO: 265514 - DNA, 16 bp, P. troglodytes
tcagtttccccctctg

SEQ ID NO: 265515 - DNA, 16 bp, P. troglodytes
tcagtttccctctctg

SEQ ID NO: 265516 - DNA, 16 bp, P. troglodytes
tcagtttccctttctg

SEQ ID NO: 265517 - DNA, 16 bp, P. troglodytes
tcagtttcctcaacta

SEQ ID NO: 265518 - DNA, 16 bp, P. troglodytes
tcagtttcctcctctc

SEQ ID NO: 265519 - DNA, 16 bp, P. troglodytes
tcagtttcctgttctg

SEQ ID NO: 265520 - DNA, 16 bp, P. troglodytes
tcagtttccttctctg

SEQ ID NO: 265521 - DNA, 16 bp, P. troglodytes
tcagtttctctctctg

SEQ ID NO: 265522 - DNA, 16 bp, P. troglodytes
tcagtttctctggaga

SEQ ID NO: 265523 - DNA, 16 bp, P. troglodytes
tcagtttctgttttct

SEQ ID NO: 265524 - DNA, 16 bp, P. troglodytes
tcagtttctttataaa

SEQ ID NO: 265525 - DNA, 16 bp, P. troglodytes
tcagtttctttctctg

SEQ ID NO: 265526 - DNA, 16 bp, P. troglodytes
tcagtttgattctttc

SEQ ID NO: 265527 - DNA, 16 bp, P. troglodytes
tcagtttgccaacatt

SEQ ID NO: 265528 - DNA, 16 bp, P. troglodytes
tcagtttgggaagatg

SEQ ID NO: 265529 - DNA, 16 bp, P. troglodytes
tcagttttaacaaatg

SEQ ID NO: 265530 - DNA, 16 bp, P. troglodytes
tcagttttatttctat

SEQ ID NO: 265531 - DNA, 16 bp, P. troglodytes
tcagttttccaaagtg

SEQ ID NO: 265532 - DNA, 16 bp, P. troglodytes
tcagttttccacatat

SEQ ID NO: 265533 - DNA, 16 bp, P. troglodytes
tcagttttccagaaat

SEQ ID NO: 265534 - DNA, 16 bp, P. troglodytes
tcagttttctcatttg

SEQ ID NO: 265535 - DNA, 16 bp, P. troglodytes
tcagttttctctttta

SEQ ID NO: 265536 - DNA, 16 bp, P. troglodytes
tcagttttctgttgct

SEQ ID NO: 265537 - DNA, 16 bp, P. troglodytes
tcagttttgccatctg

SEQ ID NO: 265538 - DNA, 16 bp, P. troglodytes
tcagttttgtcatctg

SEQ ID NO: 265539 - DNA, 16 bp, P. troglodytes
tcagttttgttgttgt

SEQ ID NO: 265540 - DNA, 16 bp, P. troglodytes
tcagtttttaaaattt

SEQ ID NO: 265541 - DNA, 16 bp, P. troglodytes
tcagtttttccatttg

SEQ ID NO: 265542 - DNA, 16 bp, P. troglodytes
tcagtttttgcctcat

SEQ ID NO: 265543 - DNA, 16 bp, P. troglodytes
tcagttttttaaaaat

SEQ ID NO: 265544 - DNA, 16 bp, P. troglodytes
tcagttttttcacctg

SEQ ID NO: 265545 - DNA, 16 bp, P. troglodytes
tcagtttttttcctct

SEQ ID NO: 265546 - DNA, 16 bp, P. troglodytes
tcataaaaatgaaaca

SEQ ID NO: 265547 - DNA, 16 bp, P. troglodytes
tcataaagacatacct

SEQ ID NO: 265548 - DNA, 16 bp, P. troglodytes
tcataaagcaagctct

SEQ ID NO: 265549 - DNA, 16 bp, P. troglodytes
tcataaatattcatga

SEQ ID NO: 265550 - DNA, 16 bp, P. troglodytes
tcataaattatttccc

SEQ ID NO: 265551 - DNA, 16 bp, P. troglodytes
tcataaattctttccc

SEQ ID NO: 265552 - DNA, 16 bp, P. troglodytes
tcataacatggcagaa

SEQ ID NO: 265553 - DNA, 16 bp, P. troglodytes
tcataacttggctgtt

SEQ ID NO: 265554 - DNA, 16 bp, P. troglodytes
tcataaggaaccaaaa

SEQ ID NO: 265555 - DNA, 16 bp, P. troglodytes
tcataagtcaaaaata

SEQ ID NO: 265556 - DNA, 16 bp, P. troglodytes
tcataagttttaaatt

SEQ ID NO: 265557 - DNA, 16 bp, P. troglodytes
tcataatattttaaga

SEQ ID NO: 265558 - DNA, 16 bp, P. troglodytes
tcataattaagttcaa

SEQ ID NO: 265559 - DNA, 16 bp, P. troglodytes
tcataattgtcaaaaa

SEQ ID NO: 265560 - DNA, 16 bp, P. troglodytes
tcatacaatccagcaa

SEQ ID NO: 265561 - DNA, 16 bp, P. troglodytes
tcatacagatgaacaa

SEQ ID NO: 265562 - DNA, 16 bp, P. troglodytes
tcatacaggagagaaa

SEQ ID NO: 265563 - DNA, 16 bp, P. troglodytes
tcatacattgttgatg

SEQ ID NO: 265564 - DNA, 16 bp, P. troglodytes
tcatactgaagagaaa

SEQ ID NO: 265565 - DNA, 16 bp, P. troglodytes
tcatactgctgataaa

SEQ ID NO: 265566 - DNA, 16 bp, P. troglodytes
tcatactggagagaaa

SEQ ID NO: 265567 - DNA, 16 bp, P. troglodytes
tcatagaaaaggaaat

SEQ ID NO: 265568 - DNA, 16 bp, P. troglodytes
tcatagaaagtaacaa

SEQ ID NO: 265569 - DNA, 16 bp, P. troglodytes
tcatagaagaggaaac

SEQ ID NO: 265570 - DNA, 16 bp, P. troglodytes
tcatagaattaaaaag

SEQ ID NO: 265571 - DNA, 16 bp, P. troglodytes
tcatagatttttaaaa

SEQ ID NO: 265572 - DNA, 16 bp, P. troglodytes
tcatagcaaacagtct

SEQ ID NO: 265573 - DNA, 16 bp, P. troglodytes
tcatagctcaatgtaa

SEQ ID NO: 265574 - DNA, 17 bp, P. troglodytes
tcatagctcactgcagt

SEQ ID NO: 265575 - DNA, 16 bp, P. troglodytes
tcatagctcactgcat

SEQ ID NO: 265576 - DNA, 16 bp, P. troglodytes
tcatagggttgttgag

SEQ ID NO: 265577 - DNA, 16 bp, P. troglodytes
tcatataaacagaatc

SEQ ID NO: 265578 - DNA, 16 bp, P. troglodytes
tcatatactgctggtg

SEQ ID NO: 265579 - DNA, 17 bp, P. troglodytes
tcatataggtggctgcc

SEQ ID NO: 265580 - DNA, 16 bp, P. troglodytes
tcatatatacatatat

SEQ ID NO: 265581 - DNA, 16 bp, P. troglodytes
tcatatatagccttta

SEQ ID NO: 265582 - DNA, 16 bp, P. troglodytes
tcatatatatgtgtat

SEQ ID NO: 265583 - DNA, 16 bp, P. troglodytes
tcatatattctgaata

SEQ ID NO: 265584 - DNA, 16 bp, P. troglodytes
tcatatattttggata

SEQ ID NO: 265585 - DNA, 16 bp, P. troglodytes
tcatatcctttgcaca

SEQ ID NO: 265586 - DNA, 16 bp, P. troglodytes
tcatatctaagaaata

SEQ ID NO: 265587 - DNA, 16 bp, P. troglodytes
tcatatctcagcctcc

SEQ ID NO: 265588 - DNA, 16 bp, P. troglodytes
tcatatgctgctggtg

SEQ ID NO: 265589 - DNA, 16 bp, P. troglodytes
tcatattacctgactt

SEQ ID NO: 265590 - DNA, 16 bp, P. troglodytes
tcatatttggaaaaac

SEQ ID NO: 265591 - DNA, 16 bp, P. troglodytes
tcatcaaaatattttt

SEQ ID NO: 265592 - DNA, 16 bp, P. troglodytes
tcatcaaagtgaacag

SEQ ID NO: 265593 - DNA, 16 bp, P. troglodytes
tcatcaaatatttact

SEQ ID NO: 265594 - DNA, 16 bp, P. troglodytes
tcatcaacatcaaaga

SEQ ID NO: 265595 - DNA, 16 bp, P. troglodytes
tcatcaccccccaaaa

SEQ ID NO: 265596 - DNA, 16 bp, P. troglodytes
tcatcactccagaaag

SEQ ID NO: 265597 - DNA, 16 bp, P. troglodytes
tcatcagaaaaaaatt

SEQ ID NO: 265598 - DNA, 16 bp, P. troglodytes
tcatcagaaaaataca

SEQ ID NO: 265599 - DNA, 16 bp, P. troglodytes
tcatcagaaaccacag

SEQ ID NO: 265600 - DNA, 16 bp, P. troglodytes
tcatcagaattaaaaa

SEQ ID NO: 265601 - DNA, 16 bp, P. troglodytes
tcatcagacactgaat

SEQ ID NO: 265602 - DNA, 16 bp, P. troglodytes
tcatcagattcatcaa

SEQ ID NO: 265603 - DNA, 16 bp, P. troglodytes
tcatcagcatatggaa

SEQ ID NO: 265604 - DNA, 16 bp, P. troglodytes
tcatcaggaatattga

SEQ ID NO: 265605 - DNA, 16 bp, P. troglodytes
tcatcaggctggtctc

SEQ ID NO: 265606 - DNA, 16 bp, P. troglodytes
tcatcagggatgttgg

SEQ ID NO: 265607 - DNA, 19 bp, P. troglodytes
tcatcagtaattctaattt

SEQ ID NO: 265608 - DNA, 16 bp, P. troglodytes
tcatcagtgaacagag

SEQ ID NO: 265609 - DNA, 16 bp, P. troglodytes
tcatcagtgttttgta

SEQ ID NO: 265610 - DNA, 16 bp, P. troglodytes
tcatcataaaggtctt

SEQ ID NO: 265611 - DNA, 16 bp, P. troglodytes
tcatcatcaatggcca

SEQ ID NO: 265612 - DNA, 16 bp, P. troglodytes
tcatcatcaccaccac

SEQ ID NO: 265613 - DNA, 17 bp, P. troglodytes
tcatcatcaccaccatc

SEQ ID NO: 265614 - DNA, 17 bp, P. troglodytes
tcatcatcactggtcat

SEQ ID NO: 265615 - DNA, 16 bp, P. troglodytes
tcatcatcactgtcat

SEQ ID NO: 265616 - DNA, 16 bp, P. troglodytes
tcatcatcatcacctt

SEQ ID NO: 265617 - DNA, 16 bp, P. troglodytes
tcatcatcatcataaa

SEQ ID NO: 265618 - DNA, 16 bp, P. troglodytes
tcatcatcatcatcta

SEQ ID NO: 265619 - DNA, 16 bp, P. troglodytes
tcatcatcatcatctc

SEQ ID NO: 265620 - DNA, 16 bp, P. troglodytes
tcatcatcatcattat

SEQ ID NO: 265621 - DNA, 16 bp, P. troglodytes
tcatcatcatcatttt

SEQ ID NO: 265622 - DNA, 16 bp, P. troglodytes
tcatcatcatcttcat

SEQ ID NO: 265623 - DNA, 16 bp, P. troglodytes
tcatcatcatctttat

SEQ ID NO: 265624 - DNA, 16 bp, P. troglodytes
tcatcatcattggcca

SEQ ID NO: 265625 - DNA, 16 bp, P. troglodytes
tcatcatcattgttgt

SEQ ID NO: 265626 - DNA, 16 bp, P. troglodytes
tcatcatcgtcatcat

SEQ ID NO: 265627 - DNA, 16 bp, P. troglodytes
tcatcatctaggtttt

SEQ ID NO: 265628 - DNA, 16 bp, P. troglodytes
tcatcatcttcatctt

SEQ ID NO: 265629 - DNA, 16 bp, P. troglodytes
tcatcatcttcatgtt

SEQ ID NO: 265630 - DNA, 16 bp, P. troglodytes
tcatcatgaaatattt

SEQ ID NO: 265631 - DNA, 16 bp, P. troglodytes
tcatcatgaaatcttt

SEQ ID NO: 265632 - DNA, 16 bp, P. troglodytes
tcatcatggaaatgca

SEQ ID NO: 265633 - DNA, 16 bp, P. troglodytes
tcatcattagagaaat

SEQ ID NO: 265634 - DNA, 16 bp, P. troglodytes
tcatcattatcaccat

SEQ ID NO: 265635 - DNA, 16 bp, P. troglodytes
tcatcattcttcagtt

SEQ ID NO: 265636 - DNA, 16 bp, P. troglodytes
tcatccacctcagcct

SEQ ID NO: 265637 - DNA, 16 bp, P. troglodytes
tcatccacgctggagt

SEQ ID NO: 265638 - DNA, 16 bp, P. troglodytes
tcatccacgtccctgc

SEQ ID NO: 265639 - DNA, 16 bp, P. troglodytes
tcatccagactttgtt

SEQ ID NO: 265640 - DNA, 16 bp, P. troglodytes
tcatccaggctaaagt

SEQ ID NO: 265641 - DNA, 16 bp, P. troglodytes
tcatccaggctggggt

SEQ ID NO: 265642 - DNA, 16 bp, P. troglodytes
tcatccataagaagca

SEQ ID NO: 265643 - DNA, 16 bp, P. troglodytes
tcatccatccatctgt

SEQ ID NO: 265644 - DNA, 16 bp, P. troglodytes
tcatccatgttgttac

SEQ ID NO: 265645 - DNA, 16 bp, P. troglodytes
tcatccattgtggaag

SEQ ID NO: 265646 - DNA, 16 bp, P. troglodytes
tcatcccaaaaccatc

SEQ ID NO: 265647 - DNA, 16 bp, P. troglodytes
tcatcccagggccagg

SEQ ID NO: 265648 - DNA, 16 bp, P. troglodytes
tcatccccattctaca

SEQ ID NO: 265649 - DNA, 16 bp, P. troglodytes
tcatccccattttatg

SEQ ID NO: 265650 - DNA, 16 bp, P. troglodytes
tcatccctgggatgga

SEQ ID NO: 265651 - DNA, 16 bp, P. troglodytes
tcatcctactataaag

SEQ ID NO: 265652 - DNA, 16 bp, P. troglodytes
tcatcctcatcctcat

SEQ ID NO: 265653 - DNA, 16 bp, P. troglodytes
tcatcctcattgtctt

SEQ ID NO: 265654 - DNA, 18 bp, P. troglodytes
tcatcctcctgcctcggc

SEQ ID NO: 265655 - DNA, 16 bp, P. troglodytes
tcatcctcttttatgg

SEQ ID NO: 265656 - DNA, 16 bp, P. troglodytes
tcatcctgaaaccaaa

SEQ ID NO: 265657 - DNA, 16 bp, P. troglodytes
tcatcctgaaaccatc

SEQ ID NO: 265658 - DNA, 16 bp, P. troglodytes
tcatcctgggcaacat

SEQ ID NO: 265659 - DNA, 19 bp, P. troglodytes
tcatcctgtgacttagaat

SEQ ID NO: 265660 - DNA, 16 bp, P. troglodytes
tcatccttgactcctt

SEQ ID NO: 265661 - DNA, 16 bp, P. troglodytes
tcatctaaaaaatggg

SEQ ID NO: 265662 - DNA, 16 bp, P. troglodytes
tcatctaatttttgta

SEQ ID NO: 265663 - DNA, 16 bp, P. troglodytes
tcatctacactgaaaa

SEQ ID NO: 265664 - DNA, 16 bp, P. troglodytes
tcatctacattgtagc

SEQ ID NO: 265665 - DNA, 16 bp, P. troglodytes
tcatctagattttaag

SEQ ID NO: 265666 - DNA, 16 bp, P. troglodytes
tcatctatatcctttg

SEQ ID NO: 265667 - DNA, 16 bp, P. troglodytes
tcatctatgtgtctgt

SEQ ID NO: 265668 - DNA, 16 bp, P. troglodytes
tcatctcaaaaaaaca

SEQ ID NO: 265669 - DNA, 16 bp, P. troglodytes
tcatctcagcctcctg

SEQ ID NO: 265670 - DNA, 16 bp, P. troglodytes
tcatctcagccttcca

SEQ ID NO: 265671 - DNA, 20 bp, P. troglodytes
tcatctcattgggactggtt

SEQ ID NO: 265672 - DNA, 16 bp, P. troglodytes
tcatctccatctgaga

SEQ ID NO: 265673 - DNA, 16 bp, P. troglodytes
tcatctcccaaataaa

SEQ ID NO: 265674 - DNA, 16 bp, P. troglodytes
tcatctcccaccaggc

SEQ ID NO: 265675 - DNA, 16 bp, P. troglodytes
tcatctctaaaaaata

SEQ ID NO: 265676 - DNA, 16 bp, P. troglodytes
tcatctctaaaatggg

SEQ ID NO: 265677 - DNA, 17 bp, P. troglodytes
tcatctctacaaaaaat

SEQ ID NO: 265678 - DNA, 16 bp, P. troglodytes
tcatctctctcctgga

SEQ ID NO: 265679 - DNA, 16 bp, P. troglodytes
tcatctcttgcctgaa

SEQ ID NO: 265680 - DNA, 16 bp, P. troglodytes
tcatctgaaggctgga

SEQ ID NO: 265681 - DNA, 16 bp, P. troglodytes
tcatctgatcttgtgg

SEQ ID NO: 265682 - DNA, 16 bp, P. troglodytes
tcatctgatttttaaa

SEQ ID NO: 265683 - DNA, 16 bp, P. troglodytes
tcatctgcaaaatgag

SEQ ID NO: 265684 - DNA, 16 bp, P. troglodytes
tcatctgcaaaatgga

SEQ ID NO: 265685 - DNA, 16 bp, P. troglodytes
tcatctgcaaacagac

SEQ ID NO: 265686 - DNA, 16 bp, P. troglodytes
tcatctgcactgccaa

SEQ ID NO: 265687 - DNA, 16 bp, P. troglodytes
tcatctgggaaatggg

SEQ ID NO: 265688 - DNA, 16 bp, P. troglodytes
tcatctgggctgcctg

SEQ ID NO: 265689 - DNA, 16 bp, P. troglodytes
tcatctgtaaaactgg

SEQ ID NO: 265690 - DNA, 16 bp, P. troglodytes
tcatctgtaaaatagt

SEQ ID NO: 265691 - DNA, 16 bp, P. troglodytes
tcatctgtacaatgaa

SEQ ID NO: 265692 - DNA, 16 bp, P. troglodytes
tcatctgtcaaatgag

SEQ ID NO: 265693 - DNA, 16 bp, P. troglodytes
tcatctgtcaaatgga

SEQ ID NO: 265694 - DNA, 16 bp, P. troglodytes
tcatctgtgaaagggg

SEQ ID NO: 265695 - DNA, 16 bp, P. troglodytes
tcatctgtgaaatggg

SEQ ID NO: 265696 - DNA, 16 bp, P. troglodytes
tcatctgtttatggac

SEQ ID NO: 265697 - DNA, 16 bp, P. troglodytes
tcatcttacaaaactg

SEQ ID NO: 265698 - DNA, 16 bp, P. troglodytes
tcatcttcatatttga

SEQ ID NO: 265699 - DNA, 16 bp, P. troglodytes
tcatcttccctgttgg

SEQ ID NO: 265700 - DNA, 16 bp, P. troglodytes
tcatcttctgccatga

SEQ ID NO: 265701 - DNA, 17 bp, P. troglodytes
tcatcttgaattgtaat

SEQ ID NO: 265702 - DNA, 16 bp, P. troglodytes
tcatcttgaattttag

SEQ ID NO: 265703 - DNA, 16 bp, P. troglodytes
tcatctttaaaataaa

SEQ ID NO: 265704 - DNA, 16 bp, P. troglodytes
tcatctttacaaaaat

SEQ ID NO: 265705 - DNA, 16 bp, P. troglodytes
tcatctttggagaaat

SEQ ID NO: 265706 - DNA, 16 bp, P. troglodytes
tcatctttgtggtttt

SEQ ID NO: 265707 - DNA, 16 bp, P. troglodytes
tcatcttttaaaaata

SEQ ID NO: 265708 - DNA, 16 bp, P. troglodytes
tcatcttttcaaagaa

SEQ ID NO: 265709 - DNA, 16 bp, P. troglodytes
tcatcttttgagaaat

SEQ ID NO: 265710 - DNA, 16 bp, P. troglodytes
tcatgaaaaaaatgaa

SEQ ID NO: 265711 - DNA, 16 bp, P. troglodytes
tcatgaaaaatgaaaa

SEQ ID NO: 265712 - DNA, 16 bp, P. troglodytes
tcatgaaaataaaaat

SEQ ID NO: 265713 - DNA, 16 bp, P. troglodytes
tcatgaaaggaagagt

SEQ ID NO: 265714 - DNA, 16 bp, P. troglodytes
tcatgaaatctttgtc

SEQ ID NO: 265715 - DNA, 16 bp, P. troglodytes
tcatgaacatgaaata

SEQ ID NO: 265716 - DNA, 16 bp, P. troglodytes
tcatgaacatggtata

SEQ ID NO: 265717 - DNA, 16 bp, P. troglodytes
tcatgaacatttcagc

SEQ ID NO: 265718 - DNA, 16 bp, P. troglodytes
tcatgaaccagcctct

SEQ ID NO: 265719 - DNA, 16 bp, P. troglodytes
tcatgaagaaatgttg

SEQ ID NO: 265720 - DNA, 16 bp, P. troglodytes
tcatgaagacagcacc

SEQ ID NO: 265721 - DNA, 16 bp, P. troglodytes
tcatgaagcttatatt

SEQ ID NO: 265722 - DNA, 16 bp, P. troglodytes
tcatgaaggtagagag

SEQ ID NO: 265723 - DNA, 16 bp, P. troglodytes
tcatgaagtatttgtc

SEQ ID NO: 265724 - DNA, 16 bp, P. troglodytes
tcatgaatggattaat

SEQ ID NO: 265725 - DNA, 16 bp, P. troglodytes
tcatgacaaagactcc

SEQ ID NO: 265726 - DNA, 16 bp, P. troglodytes
tcatgacctaatcact

SEQ ID NO: 265727 - DNA, 16 bp, P. troglodytes
tcatgactcaatcacc

SEQ ID NO: 265728 - DNA, 16 bp, P. troglodytes
tcatgactttcacaga

SEQ ID NO: 265729 - DNA, 16 bp, P. troglodytes
tcatgagaacagaaag

SEQ ID NO: 265730 - DNA, 17 bp, P. troglodytes
tcatgagacttattcat

SEQ ID NO: 265731 - DNA, 16 bp, P. troglodytes
tcatgagagcagagcc

SEQ ID NO: 265732 - DNA, 16 bp, P. troglodytes
tcatgagcatggaatg

SEQ ID NO: 265733 - DNA, 16 bp, P. troglodytes
tcatgagcatgtcaca

SEQ ID NO: 265734 - DNA, 16 bp, P. troglodytes
tcatgagctaatcacc

SEQ ID NO: 265735 - DNA, 16 bp, P. troglodytes
tcatgagctcaggaga

SEQ ID NO: 265736 - DNA, 16 bp, P. troglodytes
tcatgaggatggggcc

SEQ ID NO: 265737 - DNA, 16 bp, P. troglodytes
tcatgaggcctcccca

SEQ ID NO: 265738 - DNA, 16 bp, P. troglodytes
tcatgagggctctgcc

SEQ ID NO: 265739 - DNA, 16 bp, P. troglodytes
tcatgataaaagccct

SEQ ID NO: 265740 - DNA, 16 bp, P. troglodytes
tcatgatagtgaattc

SEQ ID NO: 265741 - DNA, 16 bp, P. troglodytes
tcatgatcaaacttga

SEQ ID NO: 265742 - DNA, 16 bp, P. troglodytes
tcatgatccaaacacc

SEQ ID NO: 265743 - DNA, 16 bp, P. troglodytes
tcatgatccaccagcc

SEQ ID NO: 265744 - DNA, 16 bp, P. troglodytes
tcatgatggaagggga

SEQ ID NO: 265745 - DNA, 16 bp, P. troglodytes
tcatgatgttctctct

SEQ ID NO: 265746 - DNA, 16 bp, P. troglodytes
tcatgattagattgag

SEQ ID NO: 265747 - DNA, 16 bp, P. troglodytes
tcatgattattatttt

SEQ ID NO: 265748 - DNA, 16 bp, P. troglodytes
tcatgcaagatctggt

SEQ ID NO: 265749 - DNA, 16 bp, P. troglodytes
tcatgcagaaccatct

SEQ ID NO: 265750 - DNA, 16 bp, P. troglodytes
tcatgccactgcactt

SEQ ID NO: 265751 - DNA, 16 bp, P. troglodytes
tcatgccactgcagcc

SEQ ID NO: 265752 - DNA, 16 bp, P. troglodytes
tcatgccactgcagtc

SEQ ID NO: 265753 - DNA, 16 bp, P. troglodytes
tcatgccatttagaat

SEQ ID NO: 265754 - DNA, 17 bp, P. troglodytes
tcatgcccggctaattt

SEQ ID NO: 265755 - DNA, 16 bp, P. troglodytes
tcatgcctgtgttccc

SEQ ID NO: 265756 - DNA, 16 bp, P. troglodytes
tcatgctacagagaaa

SEQ ID NO: 265757 - DNA, 16 bp, P. troglodytes
tcatgctacctgacct

SEQ ID NO: 265758 - DNA, 16 bp, P. troglodytes
tcatgctgaaatttaa

SEQ ID NO: 265759 - DNA, 16 bp, P. troglodytes
tcatgctgcttgctgt

SEQ ID NO: 265760 - DNA, 16 bp, P. troglodytes
tcatgctgtgtcatcc

SEQ ID NO: 265761 - DNA, 16 bp, P. troglodytes
tcatgctttcccaaca

SEQ ID NO: 265762 - DNA, 16 bp, P. troglodytes
tcatgctttttaaaaa

SEQ ID NO: 265763 - DNA, 16 bp, P. troglodytes
tcatggaaaaaataaa

SEQ ID NO: 265764 - DNA, 16 bp, P. troglodytes
tcatggaagatggggt

SEQ ID NO: 265765 - DNA, 16 bp, P. troglodytes
tcatggagaggaagaa

SEQ ID NO: 265766 - DNA, 16 bp, P. troglodytes
tcatggagctgaaaaa

SEQ ID NO: 265767 - DNA, 16 bp, P. troglodytes
tcatggagcttacatt

SEQ ID NO: 265768 - DNA, 16 bp, P. troglodytes
tcatggaggcagtttc

SEQ ID NO: 265769 - DNA, 16 bp, P. troglodytes
tcatggaggtggtttc

SEQ ID NO: 265770 - DNA, 19 bp, P. troglodytes
tcatggataggaagaatca

SEQ ID NO: 265771 - DNA, 16 bp, P. troglodytes
tcatggataggaataa

SEQ ID NO: 265772 - DNA, 16 bp, P. troglodytes
tcatggatcatgcctt

SEQ ID NO: 265773 - DNA, 16 bp, P. troglodytes
tcatggatgacttgga

SEQ ID NO: 265774 - DNA, 16 bp, P. troglodytes
tcatggattggaagaa

SEQ ID NO: 265775 - DNA, 16 bp, P. troglodytes
tcatggattttttgaa

SEQ ID NO: 265776 - DNA, 16 bp, P. troglodytes
tcatggcaaaactgct

SEQ ID NO: 265777 - DNA, 16 bp, P. troglodytes
tcatggcaccccaaaa

SEQ ID NO: 265778 - DNA, 16 bp, P. troglodytes
tcatggcagaaggcaa

SEQ ID NO: 265779 - DNA, 16 bp, P. troglodytes
tcatggcagaaggtga

SEQ ID NO: 265780 - DNA, 16 bp, P. troglodytes
tcatggcagaagtgga

SEQ ID NO: 265781 - DNA, 16 bp, P. troglodytes
tcatggcagagggcaa

SEQ ID NO: 265782 - DNA, 16 bp, P. troglodytes
tcatggcaggaggcaa

SEQ ID NO: 265783 - DNA, 16 bp, P. troglodytes
tcatggcccccttcct

SEQ ID NO: 265784 - DNA, 24 bp, P. troglodytes
tcatggcccgttctcaatgagctg

SEQ ID NO: 265785 - DNA, 16 bp, P. troglodytes
tcatggcgaaaggcaa

SEQ ID NO: 265786 - DNA, 16 bp, P. troglodytes
tcatggctggagcagc

SEQ ID NO: 265787 - DNA, 16 bp, P. troglodytes
tcatgggaaggacctg

SEQ ID NO: 265788 - DNA, 16 bp, P. troglodytes
tcatgggctcaagcga

SEQ ID NO: 265789 - DNA, 16 bp, P. troglodytes
tcatgggggcagagcc

SEQ ID NO: 265790 - DNA, 16 bp, P. troglodytes
tcatgggggcagattt

SEQ ID NO: 265791 - DNA, 16 bp, P. troglodytes
tcatgggggtgggtcc

SEQ ID NO: 265792 - DNA, 16 bp, P. troglodytes
tcatggggtggggaga

SEQ ID NO: 265793 - DNA, 16 bp, P. troglodytes
tcatggggtgggggag

SEQ ID NO: 265794 - DNA, 16 bp, P. troglodytes
tcatggtcactgtttg

SEQ ID NO: 265795 - DNA, 16 bp, P. troglodytes
tcatggtgaattatct

SEQ ID NO: 265796 - DNA, 16 bp, P. troglodytes
tcatggtggaaagcaa

SEQ ID NO: 265797 - DNA, 16 bp, P. troglodytes
tcatggtggcatgtgc

SEQ ID NO: 265798 - DNA, 17 bp, P. troglodytes
tcatggtggcgggcacc

SEQ ID NO: 265799 - DNA, 16 bp, P. troglodytes
tcatggtggtgggcac

SEQ ID NO: 265800 - DNA, 16 bp, P. troglodytes
tcatgtaaataaaaat

SEQ ID NO: 265801 - DNA, 16 bp, P. troglodytes
tcatgtaaatgaaatc

SEQ ID NO: 265802 - DNA, 16 bp, P. troglodytes
tcatgtaagtggaata

SEQ ID NO: 265803 - DNA, 16 bp, P. troglodytes
tcatgtaatttattaa

SEQ ID NO: 265804 - DNA, 16 bp, P. troglodytes
tcatgtaatttattga

SEQ ID NO: 265805 - DNA, 16 bp, P. troglodytes
tcatgtaatttttgtt

SEQ ID NO: 265806 - DNA, 16 bp, P. troglodytes
tcatgtacatgttttt

SEQ ID NO: 265807 - DNA, 16 bp, P. troglodytes
tcatgtaccccataaa

SEQ ID NO: 265808 - DNA, 16 bp, P. troglodytes
tcatgtacctcataaa

SEQ ID NO: 265809 - DNA, 16 bp, P. troglodytes
tcatgtagtttttgtc

SEQ ID NO: 265810 - DNA, 16 bp, P. troglodytes
tcatgtataaaatgaa

SEQ ID NO: 265811 - DNA, 16 bp, P. troglodytes
tcatgtatttctttat

SEQ ID NO: 265812 - DNA, 16 bp, P. troglodytes
tcatgtatttgtttat

SEQ ID NO: 265813 - DNA, 16 bp, P. troglodytes
tcatgtattttaattt

SEQ ID NO: 265814 - DNA, 16 bp, P. troglodytes
tcatgtcatctacaaa

SEQ ID NO: 265815 - DNA, 16 bp, P. troglodytes
tcatgtccctgcactc

SEQ ID NO: 265816 - DNA, 16 bp, P. troglodytes
tcatgtccttcaccca

SEQ ID NO: 265817 - DNA, 16 bp, P. troglodytes
tcatgtcctttgcagg

SEQ ID NO: 265818 - DNA, 16 bp, P. troglodytes
tcatgtctccctaaaa

SEQ ID NO: 265819 - DNA, 16 bp, P. troglodytes
tcatgtgaggccagga

SEQ ID NO: 265820 - DNA, 16 bp, P. troglodytes
tcatgtgctgatgaaa

SEQ ID NO: 265821 - DNA, 16 bp, P. troglodytes
tcatgtgcttattgtc

SEQ ID NO: 265822 - DNA, 16 bp, P. troglodytes
tcatgtggtggattct

SEQ ID NO: 265823 - DNA, 16 bp, P. troglodytes
tcatgtgttgaagtcc

SEQ ID NO: 265824 - DNA, 16 bp, P. troglodytes
tcatgttaaaaagtct

SEQ ID NO: 265825 - DNA, 16 bp, P. troglodytes
tcatgttattttttaa

SEQ ID NO: 265826 - DNA, 16 bp, P. troglodytes
tcatgttccagatctt

SEQ ID NO: 265827 - DNA, 16 bp, P. troglodytes
tcatgttctttgccca

SEQ ID NO: 265828 - DNA, 16 bp, P. troglodytes
tcatgttgatagcatg

SEQ ID NO: 265829 - DNA, 16 bp, P. troglodytes
tcatgttgcccaggct

SEQ ID NO: 265830 - DNA, 16 bp, P. troglodytes
tcatgttgctcaggct

SEQ ID NO: 265831 - DNA, 16 bp, P. troglodytes
tcatgttggataagct

SEQ ID NO: 265832 - DNA, 16 bp, P. troglodytes
tcatgttggcactcaa

SEQ ID NO: 265833 - DNA, 18 bp, P. troglodytes
tcatgttggcctggctgg

SEQ ID NO: 265834 - DNA, 16 bp, P. troglodytes
tcatgttgtacatctt

SEQ ID NO: 265835 - DNA, 16 bp, P. troglodytes
tcatgtttaaaaaaaa

SEQ ID NO: 265836 - DNA, 16 bp, P. troglodytes
tcatgtttagcttaat

SEQ ID NO: 265837 - DNA, 16 bp, P. troglodytes
tcatgttttaaaatat

SEQ ID NO: 265838 - DNA, 16 bp, P. troglodytes
tcatgtttttctttaa

SEQ ID NO: 265839 - DNA, 16 bp, P. troglodytes
tcatgtttttggtgtt

SEQ ID NO: 265840 - DNA, 16 bp, P. troglodytes
tcatgttttttgccca

SEQ ID NO: 265841 - DNA, 16 bp, P. troglodytes
tcattaaaaagataaa

SEQ ID NO: 265842 - DNA, 16 bp, P. troglodytes
tcattaaaacattttt

SEQ ID NO: 265843 - DNA, 16 bp, P. troglodytes
tcattaaaaggaaaat

SEQ ID NO: 265844 - DNA, 16 bp, P. troglodytes
tcattaaaatgatttt

SEQ ID NO: 265845 - DNA, 16 bp, P. troglodytes
tcattaaaatgtccat

SEQ ID NO: 265846 - DNA, 16 bp, P. troglodytes
tcattaaacaataact

SEQ ID NO: 265847 - DNA, 27 bp, P. troglodytes
tcattaaactaaagagcttctgcacag

SEQ ID NO: 265848 - DNA, 16 bp, P. troglodytes
tcattaaagaaaataa

SEQ ID NO: 265849 - DNA, 16 bp, P. troglodytes
tcattaaatggaagtg

SEQ ID NO: 265850 - DNA, 16 bp, P. troglodytes
tcattaagaaaaaata

SEQ ID NO: 265851 - DNA, 16 bp, P. troglodytes
tcattaatttattcaa

SEQ ID NO: 265852 - DNA, 16 bp, P. troglodytes
tcattacaaaatattt

SEQ ID NO: 265853 - DNA, 16 bp, P. troglodytes
tcattagattctcaaa

SEQ ID NO: 265854 - DNA, 16 bp, P. troglodytes
tcattagcaaaatgca

SEQ ID NO: 265855 - DNA, 16 bp, P. troglodytes
tcattaggaaaatgca

SEQ ID NO: 265856 - DNA, 16 bp, P. troglodytes
tcattaggttaagtga

SEQ ID NO: 265857 - DNA, 16 bp, P. troglodytes
tcattagtttcaaaga

SEQ ID NO: 265858 - DNA, 16 bp, P. troglodytes
tcattagttttaaaaa

SEQ ID NO: 265859 - DNA, 16 bp, P. troglodytes
tcattataattttgat

SEQ ID NO: 265860 - DNA, 16 bp, P. troglodytes
tcattatataatgata

SEQ ID NO: 265861 - DNA, 16 bp, P. troglodytes
tcattatatgtatata

SEQ ID NO: 265862 - DNA, 16 bp, P. troglodytes
tcattatcaccatcat

SEQ ID NO: 265863 - DNA, 16 bp, P. troglodytes
tcattatcatcaccat

SEQ ID NO: 265864 - DNA, 16 bp, P. troglodytes
tcattatttatgtatt

SEQ ID NO: 265865 - DNA, 16 bp, P. troglodytes
tcattattttcaaaga

SEQ ID NO: 265866 - DNA, 16 bp, P. troglodytes
tcattattttcaaatg

SEQ ID NO: 265867 - DNA, 16 bp, P. troglodytes
tcattattttgaatta

SEQ ID NO: 265868 - DNA, 16 bp, P. troglodytes
tcattcaaaaacattt

SEQ ID NO: 265869 - DNA, 16 bp, P. troglodytes
tcattcaaaagtcagg

SEQ ID NO: 265870 - DNA, 16 bp, P. troglodytes
tcattcaaaatattta

SEQ ID NO: 265871 - DNA, 16 bp, P. troglodytes
tcattcaacaactatt

SEQ ID NO: 265872 - DNA, 16 bp, P. troglodytes
tcattcaacaagtact

SEQ ID NO: 265873 - DNA, 16 bp, P. troglodytes
tcattcaagcaaagct

SEQ ID NO: 265874 - DNA, 16 bp, P. troglodytes
tcattcaataaacact

SEQ ID NO: 265875 - DNA, 16 bp, P. troglodytes
tcattcaattattcat

SEQ ID NO: 265876 - DNA, 16 bp, P. troglodytes
tcattcaattcaaaat

SEQ ID NO: 265877 - DNA, 16 bp, P. troglodytes
tcattcactcaacaga

SEQ ID NO: 265878 - DNA, 16 bp, P. troglodytes
tcattcactgatggac

SEQ ID NO: 265879 - DNA, 16 bp, P. troglodytes
tcattcagcagcaggt

SEQ ID NO: 265880 - DNA, 16 bp, P. troglodytes
tcattcaggagcatgt

SEQ ID NO: 265881 - DNA, 16 bp, P. troglodytes
tcattcaggttgttgg

SEQ ID NO: 265882 - DNA, 16 bp, P. troglodytes
tcattcagtttgaaga

SEQ ID NO: 265883 - DNA, 16 bp, P. troglodytes
tcattcataaataaat

SEQ ID NO: 265884 - DNA, 16 bp, P. troglodytes
tcattcatgagggtgg

SEQ ID NO: 265885 - DNA, 16 bp, P. troglodytes
tcattcattcaaaaat

SEQ ID NO: 265886 - DNA, 16 bp, P. troglodytes
tcattcattcactcag

SEQ ID NO: 265887 - DNA, 16 bp, P. troglodytes
tcattcattcagcaaa

SEQ ID NO: 265888 - DNA, 16 bp, P. troglodytes
tcattcattcagtcaa

SEQ ID NO: 265889 - DNA, 16 bp, P. troglodytes
tcattcattcattcct

SEQ ID NO: 265890 - DNA, 16 bp, P. troglodytes
tcattcattccttcct

SEQ ID NO: 265891 - DNA, 16 bp, P. troglodytes
tcattcattgatggac

SEQ ID NO: 265892 - DNA, 16 bp, P. troglodytes
tcattcatttataaat

SEQ ID NO: 265893 - DNA, 16 bp, P. troglodytes
tcattcatttgctcaa

SEQ ID NO: 265894 - DNA, 16 bp, P. troglodytes
tcattcatttgttcag

SEQ ID NO: 265895 - DNA, 16 bp, P. troglodytes
tcattccatatgaatt

SEQ ID NO: 265896 - DNA, 16 bp, P. troglodytes
tcattccatcccaata

SEQ ID NO: 265897 - DNA, 16 bp, P. troglodytes
tcattcctgaagccag

SEQ ID NO: 265898 - DNA, 16 bp, P. troglodytes
tcattcctgaaggatc

SEQ ID NO: 265899 - DNA, 16 bp, P. troglodytes
tcattcctgggataaa

SEQ ID NO: 265900 - DNA, 16 bp, P. troglodytes
tcattcctgttgccca

SEQ ID NO: 265901 - DNA, 16 bp, P. troglodytes
tcattcctttttatgg

SEQ ID NO: 265902 - DNA, 16 bp, P. troglodytes
tcattctactttctat

SEQ ID NO: 265903 - DNA, 16 bp, P. troglodytes
tcattctactttctgt

SEQ ID NO: 265904 - DNA, 16 bp, P. troglodytes
tcattctattatgaag

SEQ ID NO: 265905 - DNA, 16 bp, P. troglodytes
tcattctcagcagact

SEQ ID NO: 265906 - DNA, 16 bp, P. troglodytes
tcattctcattctcat

SEQ ID NO: 265907 - DNA, 16 bp, P. troglodytes
tcattctcattttata

SEQ ID NO: 265908 - DNA, 16 bp, P. troglodytes
tcattctccaagccca

SEQ ID NO: 265909 - DNA, 16 bp, P. troglodytes
tcattctccttcctca

SEQ ID NO: 265910 - DNA, 16 bp, P. troglodytes
tcattctctgtccagc

SEQ ID NO: 265911 - DNA, 16 bp, P. troglodytes
tcattctcttgcctca

SEQ ID NO: 265912 - DNA, 16 bp, P. troglodytes
tcattctctttttaaa

SEQ ID NO: 265913 - DNA, 16 bp, P. troglodytes
tcattctgtcacccag

SEQ ID NO: 265914 - DNA, 16 bp, P. troglodytes
tcattctgtttctttc

SEQ ID NO: 265915 - DNA, 16 bp, P. troglodytes
tcattctttaaaaaaa

SEQ ID NO: 265916 - DNA, 16 bp, P. troglodytes
tcattcttttaacaaa

SEQ ID NO: 265917 - DNA, 16 bp, P. troglodytes
tcattctttttaatgg

SEQ ID NO: 265918 - DNA, 16 bp, P. troglodytes
tcattcttttttatgg

SEQ ID NO: 265919 - DNA, 16 bp, P. troglodytes
tcattgaatccaggag

SEQ ID NO: 265920 - DNA, 16 bp, P. troglodytes
tcattgaatcctcaca

SEQ ID NO: 265921 - DNA, 16 bp, P. troglodytes
tcattgaattctcaca

SEQ ID NO: 265922 - DNA, 16 bp, P. troglodytes
tcattgaccaaaacat

SEQ ID NO: 265923 - DNA, 16 bp, P. troglodytes
tcattgaggccaggag

SEQ ID NO: 265924 - DNA, 16 bp, P. troglodytes
tcattgatggtcattt

SEQ ID NO: 265925 - DNA, 16 bp, P. troglodytes
tcattgcaagtgtata

SEQ ID NO: 265926 - DNA, 16 bp, P. troglodytes
tcattgcagcattact

SEQ ID NO: 265927 - DNA, 16 bp, P. troglodytes
tcattgcagcctcaat

SEQ ID NO: 265928 - DNA, 16 bp, P. troglodytes
tcattgcagccttgac

SEQ ID NO: 265929 - DNA, 16 bp, P. troglodytes
tcattgctagcacagc

SEQ ID NO: 265930 - DNA, 16 bp, P. troglodytes
tcattgctcaattaaa

SEQ ID NO: 265931 - DNA, 16 bp, P. troglodytes
tcattggagtgaacag

SEQ ID NO: 265932 - DNA, 16 bp, P. troglodytes
tcattggatgaaatgt

SEQ ID NO: 265933 - DNA, 16 bp, P. troglodytes
tcattggattgaagga

SEQ ID NO: 265934 - DNA, 16 bp, P. troglodytes
tcattggtctttatat

SEQ ID NO: 265935 - DNA, 16 bp, P. troglodytes
tcattggtgatgttga

SEQ ID NO: 265936 - DNA, 16 bp, P. troglodytes
tcattgtaaattattt

SEQ ID NO: 265937 - DNA, 16 bp, P. troglodytes
tcattgtcatcatcat

SEQ ID NO: 265938 - DNA, 16 bp, P. troglodytes
tcattgtgaggattaa

SEQ ID NO: 265939 - DNA, 16 bp, P. troglodytes
tcattgtgcagcacct

SEQ ID NO: 265940 - DNA, 16 bp, P. troglodytes
tcattgtgtaaacatc

SEQ ID NO: 265941 - DNA, 16 bp, P. troglodytes
tcattgtgtctctgcc

SEQ ID NO: 265942 - DNA, 16 bp, P. troglodytes
tcattgttaatgtata

SEQ ID NO: 265943 - DNA, 17 bp, P. troglodytes
tcattgttggacatctg

SEQ ID NO: 265944 - DNA, 16 bp, P. troglodytes
tcattgtttaaatttt

SEQ ID NO: 265945 - DNA, 16 bp, P. troglodytes
tcatttaaaaaaatct

SEQ ID NO: 265946 - DNA, 16 bp, P. troglodytes
tcatttaaaaaatgtt

SEQ ID NO: 265947 - DNA, 16 bp, P. troglodytes
tcatttaaaaatgtgt

SEQ ID NO: 265948 - DNA, 16 bp, P. troglodytes
tcatttaaaaatgttt

SEQ ID NO: 265949 - DNA, 16 bp, P. troglodytes
tcatttaaaacatttt

SEQ ID NO: 265950 - DNA, 16 bp, P. troglodytes
tcatttaaaatggaaa

SEQ ID NO: 265951 - DNA, 16 bp, P. troglodytes
tcatttaaaatgtaaa

SEQ ID NO: 265952 - DNA, 16 bp, P. troglodytes
tcatttaaaatttttg

SEQ ID NO: 265953 - DNA, 16 bp, P. troglodytes
tcatttaaattgtttt

SEQ ID NO: 265954 - DNA, 16 bp, P. troglodytes
tcatttaaccctcaaa

SEQ ID NO: 265955 - DNA, 16 bp, P. troglodytes
tcatttaaccctcatg

SEQ ID NO: 265956 - DNA, 16 bp, P. troglodytes
tcatttaatcctcaaa

SEQ ID NO: 265957 - DNA, 16 bp, P. troglodytes
tcatttaatccttaca

SEQ ID NO: 265958 - DNA, 16 bp, P. troglodytes
tcatttaatctttaaa

SEQ ID NO: 265959 - DNA, 16 bp, P. troglodytes
tcatttaattttctca

SEQ ID NO: 265960 - DNA, 16 bp, P. troglodytes
tcatttaccttaggta

SEQ ID NO: 265961 - DNA, 16 bp, P. troglodytes
tcatttagcattaagt

SEQ ID NO: 265962 - DNA, 16 bp, P. troglodytes
tcatttataaagaaca

SEQ ID NO: 265963 - DNA, 16 bp, P. troglodytes
tcatttatatgtgaaa

SEQ ID NO: 265964 - DNA, 16 bp, P. troglodytes
tcatttatctatgaaa

SEQ ID NO: 265965 - DNA, 16 bp, P. troglodytes
tcatttatctgttcat

SEQ ID NO: 265966 - DNA, 16 bp, P. troglodytes
tcatttattcaacaca

SEQ ID NO: 265967 - DNA, 16 bp, P. troglodytes
tcatttattcagcaaa

SEQ ID NO: 265968 - DNA, 16 bp, P. troglodytes
tcatttattcagcaag

SEQ ID NO: 265969 - DNA, 16 bp, P. troglodytes
tcatttattgaaaaat

SEQ ID NO: 265970 - DNA, 16 bp, P. troglodytes
tcatttatttacatct

SEQ ID NO: 265971 - DNA, 16 bp, P. troglodytes
tcatttatttgaaaaa

SEQ ID NO: 265972 - DNA, 16 bp, P. troglodytes
tcatttatttgaaaat

SEQ ID NO: 265973 - DNA, 16 bp, P. troglodytes
tcatttattttcacaa

SEQ ID NO: 265974 - DNA, 16 bp, P. troglodytes
tcatttattttggata

SEQ ID NO: 265975 - DNA, 16 bp, P. troglodytes
tcatttatttttatga

SEQ ID NO: 265976 - DNA, 16 bp, P. troglodytes
tcatttcaaaatgttt

SEQ ID NO: 265977 - DNA, 16 bp, P. troglodytes
tcatttcaaaattatt

SEQ ID NO: 265978 - DNA, 16 bp, P. troglodytes
tcatttcaaagaactt

SEQ ID NO: 265979 - DNA, 16 bp, P. troglodytes
tcatttcaaagaattt

SEQ ID NO: 265980 - DNA, 16 bp, P. troglodytes
tcatttcaatttcatt

SEQ ID NO: 265981 - DNA, 16 bp, P. troglodytes
tcatttcaccctcaca

SEQ ID NO: 265982 - DNA, 16 bp, P. troglodytes
tcatttcacctgtaaa

SEQ ID NO: 265983 - DNA, 16 bp, P. troglodytes
tcatttcagccatttt

SEQ ID NO: 265984 - DNA, 16 bp, P. troglodytes
tcatttcatcctcaca

SEQ ID NO: 265985 - DNA, 16 bp, P. troglodytes
tcatttcatctcattt

SEQ ID NO: 265986 - DNA, 16 bp, P. troglodytes
tcatttcatcttcaca

SEQ ID NO: 265987 - DNA, 16 bp, P. troglodytes
tcatttcattaaaaat

SEQ ID NO: 265988 - DNA, 16 bp, P. troglodytes
tcatttcattctcaca

SEQ ID NO: 265989 - DNA, 16 bp, P. troglodytes
tcatttcattgatctt

SEQ ID NO: 265990 - DNA, 16 bp, P. troglodytes
tcatttccacattttc

SEQ ID NO: 265991 - DNA, 16 bp, P. troglodytes
tcatttccagaagttg

SEQ ID NO: 265992 - DNA, 16 bp, P. troglodytes
tcatttccatttcaca

SEQ ID NO: 265993 - DNA, 16 bp, P. troglodytes
tcatttccttcaagaa

SEQ ID NO: 265994 - DNA, 16 bp, P. troglodytes
tcatttctattaaaaa

SEQ ID NO: 265995 - DNA, 16 bp, P. troglodytes
tcatttctgaaatttt

SEQ ID NO: 265996 - DNA, 16 bp, P. troglodytes
tcatttctgatattga

SEQ ID NO: 265997 - DNA, 16 bp, P. troglodytes
tcatttctgattttag

SEQ ID NO: 265998 - DNA, 16 bp, P. troglodytes
tcatttcttaaaaaaa

SEQ ID NO: 265999 - DNA, 16 bp, P. troglodytes
tcatttctttaaaaat

SEQ ID NO: 266000 - DNA, 16 bp, P. troglodytes
tcatttgaaaattatt

SEQ ID NO: 266001 - DNA, 16 bp, P. troglodytes
tcatttgaattgtttt

SEQ ID NO: 266002 - DNA, 16 bp, P. troglodytes
tcatttgatcctcaca

SEQ ID NO: 266003 - DNA, 16 bp, P. troglodytes
tcatttgcagcaaaat

SEQ ID NO: 266004 - DNA, 16 bp, P. troglodytes
tcatttgcttttcctt

SEQ ID NO: 266005 - DNA, 16 bp, P. troglodytes
tcatttggaaaaataa

SEQ ID NO: 266006 - DNA, 16 bp, P. troglodytes
tcatttggaaaatgaa

SEQ ID NO: 266007 - DNA, 16 bp, P. troglodytes
tcatttggtttttgtc

SEQ ID NO: 266008 - DNA, 16 bp, P. troglodytes
tcatttgtaaaacaag

SEQ ID NO: 266009 - DNA, 16 bp, P. troglodytes
tcatttgtaaaacaga

SEQ ID NO: 266010 - DNA, 16 bp, P. troglodytes
tcatttgtaaagtgga

SEQ ID NO: 266011 - DNA, 16 bp, P. troglodytes
tcatttgtatttcctt

SEQ ID NO: 266012 - DNA, 16 bp, P. troglodytes
tcatttgtgacaacat

SEQ ID NO: 266013 - DNA, 16 bp, P. troglodytes
tcatttgtggaaaaga

SEQ ID NO: 266014 - DNA, 16 bp, P. troglodytes
tcatttgtgttttaaa

SEQ ID NO: 266015 - DNA, 16 bp, P. troglodytes
tcatttgttaatattt

SEQ ID NO: 266016 - DNA, 16 bp, P. troglodytes
tcatttgtttacattt

SEQ ID NO: 266017 - DNA, 16 bp, P. troglodytes
tcatttgtttcaagaa

SEQ ID NO: 266018 - DNA, 16 bp, P. troglodytes
tcatttgtttcaagag

SEQ ID NO: 266019 - DNA, 16 bp, P. troglodytes
tcatttgtttcaggaa

SEQ ID NO: 266020 - DNA, 16 bp, P. troglodytes
tcatttgtttgaagaa

SEQ ID NO: 266021 - DNA, 16 bp, P. troglodytes
tcatttgtttttaaaa

SEQ ID NO: 266022 - DNA, 16 bp, P. troglodytes
tcattttacaaagcca

SEQ ID NO: 266023 - DNA, 16 bp, P. troglodytes
tcattttagaaaagaa

SEQ ID NO: 266024 - DNA, 16 bp, P. troglodytes
tcattttagaaatgag

SEQ ID NO: 266025 - DNA, 16 bp, P. troglodytes
tcattttataaacaaa

SEQ ID NO: 266026 - DNA, 16 bp, P. troglodytes
tcattttattaaaaag

SEQ ID NO: 266027 - DNA, 16 bp, P. troglodytes
tcattttcaaaagaaa

SEQ ID NO: 266028 - DNA, 16 bp, P. troglodytes
tcattttcaaaggaaa

SEQ ID NO: 266029 - DNA, 16 bp, P. troglodytes
tcattttcaaataaaa

SEQ ID NO: 266030 - DNA, 16 bp, P. troglodytes
tcattttcaaatgttt

SEQ ID NO: 266031 - DNA, 16 bp, P. troglodytes
tcattttcaacaaaga

SEQ ID NO: 266032 - DNA, 16 bp, P. troglodytes
tcattttcaacaacat

SEQ ID NO: 266033 - DNA, 16 bp, P. troglodytes
tcattttcagcaaact

SEQ ID NO: 266034 - DNA, 16 bp, P. troglodytes
tcattttcattgctgt

SEQ ID NO: 266035 - DNA, 16 bp, P. troglodytes
tcattttcattgttgt

SEQ ID NO: 266036 - DNA, 16 bp, P. troglodytes
tcattttcctgtcttc

SEQ ID NO: 266037 - DNA, 16 bp, P. troglodytes
tcattttccttctaac

SEQ ID NO: 266038 - DNA, 16 bp, P. troglodytes
tcattttcttaacaat

SEQ ID NO: 266039 - DNA, 16 bp, P. troglodytes
tcattttctttatcca

SEQ ID NO: 266040 - DNA, 16 bp, P. troglodytes
tcattttctttgtaaa

SEQ ID NO: 266041 - DNA, 16 bp, P. troglodytes
tcattttcttttgcca

SEQ ID NO: 266042 - DNA, 16 bp, P. troglodytes
tcattttgaactgtag

SEQ ID NO: 266043 - DNA, 16 bp, P. troglodytes
tcattttgaagatgag

SEQ ID NO: 266044 - DNA, 16 bp, P. troglodytes
tcattttgcatatttt

SEQ ID NO: 266045 - DNA, 16 bp, P. troglodytes
tcattttggaaaatta

SEQ ID NO: 266046 - DNA, 16 bp, P. troglodytes
tcattttgtgtgtgtg

SEQ ID NO: 266047 - DNA, 16 bp, P. troglodytes
tcattttgttgattgt

SEQ ID NO: 266048 - DNA, 16 bp, P. troglodytes
tcattttgtttttaaa

SEQ ID NO: 266049 - DNA, 16 bp, P. troglodytes
tcatttttaaaaagaa

SEQ ID NO: 266050 - DNA, 16 bp, P. troglodytes
tcatttttaaaagtaa

SEQ ID NO: 266051 - DNA, 16 bp, P. troglodytes
tcatttttaaatgtac

SEQ ID NO: 266052 - DNA, 16 bp, P. troglodytes
tcatttttaagaaaaa

SEQ ID NO: 266053 - DNA, 16 bp, P. troglodytes
tcatttttagcttttg

SEQ ID NO: 266054 - DNA, 16 bp, P. troglodytes
tcatttttattgctat

SEQ ID NO: 266055 - DNA, 16 bp, P. troglodytes
tcatttttcaaataaa

SEQ ID NO: 266056 - DNA, 16 bp, P. troglodytes
tcatttttctcttgcc

SEQ ID NO: 266057 - DNA, 16 bp, P. troglodytes
tcatttttctgaattt

SEQ ID NO: 266058 - DNA, 16 bp, P. troglodytes
tcatttttcttgagta

SEQ ID NO: 266059 - DNA, 16 bp, P. troglodytes
tcatttttgaaaaatt

SEQ ID NO: 266060 - DNA, 16 bp, P. troglodytes
tcatttttgacccagt

SEQ ID NO: 266061 - DNA, 16 bp, P. troglodytes
tcatttttgataattt

SEQ ID NO: 266062 - DNA, 16 bp, P. troglodytes
tcatttttgatggctg

SEQ ID NO: 266063 - DNA, 16 bp, P. troglodytes
tcatttttgtggtgag

SEQ ID NO: 266064 - DNA, 16 bp, P. troglodytes
tcattttttaaaaaca

SEQ ID NO: 266065 - DNA, 16 bp, P. troglodytes
tcattttttaaaatca

SEQ ID NO: 266066 - DNA, 16 bp, P. troglodytes
tcattttttaatgaaa

SEQ ID NO: 266067 - DNA, 16 bp, P. troglodytes
tcattttttattatga

SEQ ID NO: 266068 - DNA, 16 bp, P. troglodytes
tcatttttttaatggc

SEQ ID NO: 266069 - DNA, 16 bp, P. troglodytes
tcatttttttccccaa

SEQ ID NO: 266070 - DNA, 16 bp, P. troglodytes
tccaaaaaaattgaag

SEQ ID NO: 266071 - DNA, 16 bp, P. troglodytes
tccaaaaaactgaaga

SEQ ID NO: 266072 - DNA, 16 bp, P. troglodytes
tccaaaaaatcaagga

SEQ ID NO: 266073 - DNA, 16 bp, P. troglodytes
tccaaaaaggaaaaag

SEQ ID NO: 266074 - DNA, 16 bp, P. troglodytes
tccaaaacagaaagca

SEQ ID NO: 266075 - DNA, 16 bp, P. troglodytes
tccaaaacatttctgg

SEQ ID NO: 266076 - DNA, 16 bp, P. troglodytes
tccaaaaccagcctgg

SEQ ID NO: 266077 - DNA, 16 bp, P. troglodytes
tccaaaacctgaacat

SEQ ID NO: 266078 - DNA, 16 bp, P. troglodytes
tccaaaactcatgctg

SEQ ID NO: 266079 - DNA, 16 bp, P. troglodytes
tccaaaagaactttct

SEQ ID NO: 266080 - DNA, 16 bp, P. troglodytes
tccaaaagacagagaa

SEQ ID NO: 266081 - DNA, 16 bp, P. troglodytes
tccaaaagcctgagaa

SEQ ID NO: 266082 - DNA, 16 bp, P. troglodytes
tccaaaataaacctgt

SEQ ID NO: 266083 - DNA, 16 bp, P. troglodytes
tccaaaatatatatat

SEQ ID NO: 266084 - DNA, 16 bp, P. troglodytes
tccaaaatcatctcct

SEQ ID NO: 266085 - DNA, 16 bp, P. troglodytes
tccaaaatctgaaaaa

SEQ ID NO: 266086 - DNA, 16 bp, P. troglodytes
tccaaaatctgcagag

SEQ ID NO: 266087 - DNA, 16 bp, P. troglodytes
tccaaaatggtctcct

SEQ ID NO: 266088 - DNA, 16 bp, P. troglodytes
tccaaacaactgaaaa

SEQ ID NO: 266089 - DNA, 16 bp, P. troglodytes
tccaaacagaaaataa

SEQ ID NO: 266090 - DNA, 16 bp, P. troglodytes
tccaaaccaagaaaaa

SEQ ID NO: 266091 - DNA, 16 bp, P. troglodytes
tccaaaccagcctggc

SEQ ID NO: 266092 - DNA, 16 bp, P. troglodytes
tccaaaccttcccaca

SEQ ID NO: 266093 - DNA, 16 bp, P. troglodytes
tccaaactcatagaat

SEQ ID NO: 266094 - DNA, 16 bp, P. troglodytes
tccaaactcctggcct

SEQ ID NO: 266095 - DNA, 16 bp, P. troglodytes
tccaaactctgcctgt

SEQ ID NO: 266096 - DNA, 16 bp, P. troglodytes
tccaaagagcttttgt

SEQ ID NO: 266097 - DNA, 16 bp, P. troglodytes
tccaaagcatttatta

SEQ ID NO: 266098 - DNA, 16 bp, P. troglodytes
tccaaagcctcatctg

SEQ ID NO: 266099 - DNA, 16 bp, P. troglodytes
tccaaaggaaaataat

SEQ ID NO: 266100 - DNA, 16 bp, P. troglodytes
tccaaaggctggagaa

SEQ ID NO: 266101 - DNA, 16 bp, P. troglodytes
tccaaagtcacttcca

SEQ ID NO: 266102 - DNA, 16 bp, P. troglodytes
tccaaagtccatgctt

SEQ ID NO: 266103 - DNA, 16 bp, P. troglodytes
tccaaagtctcatcca

SEQ ID NO: 266104 - DNA, 18 bp, P. troglodytes
tccaaagtgctaggatta

SEQ ID NO: 266105 - DNA, 18 bp, P. troglodytes
tccaaagtgctgggatta

SEQ ID NO: 266106 - DNA, 18 bp, P. troglodytes
tccaaagtgttaggatta

SEQ ID NO: 266107 - DNA, 18 bp, P. troglodytes
tccaaagtgttgggatta

SEQ ID NO: 266108 - DNA, 17 bp, P. troglodytes
tccaaagttctgggatt

SEQ ID NO: 266109 - DNA, 16 bp, P. troglodytes
tccaaagttgtttcca

SEQ ID NO: 266110 - DNA, 16 bp, P. troglodytes
tccaaataatgaaata

SEQ ID NO: 266111 - DNA, 16 bp, P. troglodytes
tccaaataccaccaca

SEQ ID NO: 266112 - DNA, 16 bp, P. troglodytes
tccaaataggaaagaa

SEQ ID NO: 266113 - DNA, 16 bp, P. troglodytes
tccaaatatagtcaca

SEQ ID NO: 266114 - DNA, 16 bp, P. troglodytes
tccaaatatccacctg

SEQ ID NO: 266115 - DNA, 16 bp, P. troglodytes
tccaaatgctcatcaa

SEQ ID NO: 266116 - DNA, 16 bp, P. troglodytes
tccaaattcatatgtt

SEQ ID NO: 266117 - DNA, 16 bp, P. troglodytes
tccaaattcattttat

SEQ ID NO: 266118 - DNA, 16 bp, P. troglodytes
tccaaattgagatgtg

SEQ ID NO: 266119 - DNA, 16 bp, P. troglodytes
tccaaatttccttttc

SEQ ID NO: 266120 - DNA, 16 bp, P. troglodytes
tccaaatttgaaagga

SEQ ID NO: 266121 - DNA, 16 bp, P. troglodytes
tccaaatttgatgaaa

SEQ ID NO: 266122 - DNA, 16 bp, P. troglodytes
tccaaattttctttaa

SEQ ID NO: 266123 - DNA, 16 bp, P. troglodytes
tccaaattttgtttat

SEQ ID NO: 266124 - DNA, 16 bp, P. troglodytes
tccaacactggtgatt

SEQ ID NO: 266125 - DNA, 16 bp, P. troglodytes
tccaacactttgagag

SEQ ID NO: 266126 - DNA, 17 bp, P. troglodytes
tccaacagaactgcagc

SEQ ID NO: 266127 - DNA, 21 bp, P. troglodytes
tccaacagacctgcagctgag

SEQ ID NO: 266128 - DNA, 23 bp, P. troglodytes
tccaacagacctgcagctgaggg

SEQ ID NO: 266129 - DNA, 16 bp, P. troglodytes
tccaacaggaagatat

SEQ ID NO: 266130 - DNA, 16 bp, P. troglodytes
tccaacagggcagtca

SEQ ID NO: 266131 - DNA, 16 bp, P. troglodytes
tccaacatggtaaaac

SEQ ID NO: 266132 - DNA, 16 bp, P. troglodytes
tccaacatggtgaaat

SEQ ID NO: 266133 - DNA, 16 bp, P. troglodytes
tccaacccctgggcca

SEQ ID NO: 266134 - DNA, 16 bp, P. troglodytes
tccaaccctttatttt

SEQ ID NO: 266135 - DNA, 16 bp, P. troglodytes
tccaacctcaggtgat

SEQ ID NO: 266136 - DNA, 16 bp, P. troglodytes
tccaacctctgcccat

SEQ ID NO: 266137 - DNA, 16 bp, P. troglodytes
tccaacctctgcctcc

SEQ ID NO: 266138 - DNA, 16 bp, P. troglodytes
tccaacctgactctgg

SEQ ID NO: 266139 - DNA, 16 bp, P. troglodytes
tccaacctgggcaaca

SEQ ID NO: 266140 - DNA, 16 bp, P. troglodytes
tccaacctggggaaca

SEQ ID NO: 266141 - DNA, 16 bp, P. troglodytes
tccaactatgtgacat

SEQ ID NO: 266142 - DNA, 16 bp, P. troglodytes
tccaacttgcaaggga

SEQ ID NO: 266143 - DNA, 16 bp, P. troglodytes
tccaactttattcttt

SEQ ID NO: 266144 - DNA, 16 bp, P. troglodytes
tccaagaaatatagga

SEQ ID NO: 266145 - DNA, 16 bp, P. troglodytes
tccaagaagcagatgc

SEQ ID NO: 266146 - DNA, 22 bp, P. troglodytes
tccaagactaaaccaggaagaa

SEQ ID NO: 266147 - DNA, 16 bp, P. troglodytes
tccaagactgggcaat

SEQ ID NO: 266148 - DNA, 16 bp, P. troglodytes
tccaagatcaaggcac

SEQ ID NO: 266149 - DNA, 16 bp, P. troglodytes
tccaagatgaaggtgc

SEQ ID NO: 266150 - DNA, 16 bp, P. troglodytes
tccaagatggcagatt

SEQ ID NO: 266151 - DNA, 16 bp, P. troglodytes
tccaagattaaaaaaa

SEQ ID NO: 266152 - DNA, 16 bp, P. troglodytes
tccaagcagagggaat

SEQ ID NO: 266153 - DNA, 16 bp, P. troglodytes
tccaagcattttggga

SEQ ID NO: 266154 - DNA, 16 bp, P. troglodytes
tccaagctgaagacag

SEQ ID NO: 266155 - DNA, 16 bp, P. troglodytes
tccaagctgggcaaca

SEQ ID NO: 266156 - DNA, 16 bp, P. troglodytes
tccaagcttctaatca

SEQ ID NO: 266157 - DNA, 16 bp, P. troglodytes
tccaaggagccctggt

SEQ ID NO: 266158 - DNA, 16 bp, P. troglodytes
tccaagggaaaaaaaa

SEQ ID NO: 266159 - DNA, 16 bp, P. troglodytes
tccaagggctcttcag

SEQ ID NO: 266160 - DNA, 16 bp, P. troglodytes
tccaagggctctttag

SEQ ID NO: 266161 - DNA, 16 bp, P. troglodytes
tccaaggtcaaggtgc

SEQ ID NO: 266162 - DNA, 16 bp, P. troglodytes
tccaaggtcacacagc

SEQ ID NO: 266163 - DNA, 16 bp, P. troglodytes
tccaagtagctgaaac

SEQ ID NO: 266164 - DNA, 18 bp, P. troglodytes
tccaagtagctgggatta

SEQ ID NO: 266165 - DNA, 16 bp, P. troglodytes
tccaagtattttattt

SEQ ID NO: 266166 - DNA, 16 bp, P. troglodytes
tccaagtcactgcaaa

SEQ ID NO: 266167 - DNA, 16 bp, P. troglodytes
tccaagtccccacccc

SEQ ID NO: 266168 - DNA, 16 bp, P. troglodytes
tccaagtctgtggctt

SEQ ID NO: 266169 - DNA, 16 bp, P. troglodytes
tccaagtgattctgat

SEQ ID NO: 266170 - DNA, 16 bp, P. troglodytes
tccaagttcaagtgat

SEQ ID NO: 266171 - DNA, 16 bp, P. troglodytes
tccaagttctttggct

SEQ ID NO: 266172 - DNA, 16 bp, P. troglodytes
tccaagttgctgcaaa

SEQ ID NO: 266173 - DNA, 16 bp, P. troglodytes
tccaagttggagtgca

SEQ ID NO: 266174 - DNA, 16 bp, P. troglodytes
tccaataaatatttat

SEQ ID NO: 266175 - DNA, 16 bp, P. troglodytes
tccaatagaaataaaa

SEQ ID NO: 266176 - DNA, 16 bp, P. troglodytes
tccaatatggtaacca

SEQ ID NO: 266177 - DNA, 16 bp, P. troglodytes
tccaatcaaaagatat

SEQ ID NO: 266178 - DNA, 16 bp, P. troglodytes
tccaatcaagagaaaa

SEQ ID NO: 266179 - DNA, 16 bp, P. troglodytes
tccaatcatggtggaa

SEQ ID NO: 266180 - DNA, 16 bp, P. troglodytes
tccaattcaagatgag

SEQ ID NO: 266181 - DNA, 36 bp, P. troglodytes
tccaattctgtgaagaaagtcattggtagcttgatg

SEQ ID NO: 266182 - DNA, 16 bp, P. troglodytes
tccaattctgtggaga

SEQ ID NO: 266183 - DNA, 16 bp, P. troglodytes
tccaattctgtgggtt

SEQ ID NO: 266184 - DNA, 16 bp, P. troglodytes
tccaattttaaaaatg

SEQ ID NO: 266185 - DNA, 16 bp, P. troglodytes
tccaatttttccacat

SEQ ID NO: 266186 - DNA, 16 bp, P. troglodytes
tccacaaaaaaattta

SEQ ID NO: 266187 - DNA, 16 bp, P. troglodytes
tccacaaaataacttt

SEQ ID NO: 266188 - DNA, 16 bp, P. troglodytes
tccacaaatttgataa

SEQ ID NO: 266189 - DNA, 16 bp, P. troglodytes
tccacaagaagctggt

SEQ ID NO: 266190 - DNA, 16 bp, P. troglodytes
tccacaagggcagaga

SEQ ID NO: 266191 - DNA, 16 bp, P. troglodytes
tccacacatctacaac

SEQ ID NO: 266192 - DNA, 16 bp, P. troglodytes
tccacacccagctaat

SEQ ID NO: 266193 - DNA, 19 bp, P. troglodytes
tccacacccggctaatttt

SEQ ID NO: 266194 - DNA, 16 bp, P. troglodytes
tccacactgtcttcca

SEQ ID NO: 266195 - DNA, 16 bp, P. troglodytes
tccacagatctccagg

SEQ ID NO: 266196 - DNA, 16 bp, P. troglodytes
tccacagatgctcaag

SEQ ID NO: 266197 - DNA, 16 bp, P. troglodytes
tccacagcagctgcac

SEQ ID NO: 266198 - DNA, 16 bp, P. troglodytes
tccacagcagctgcag

SEQ ID NO: 266199 - DNA, 16 bp, P. troglodytes
tccacagcagctgcat

SEQ ID NO: 266200 - DNA, 16 bp, P. troglodytes
tccacagcctcatcag

SEQ ID NO: 266201 - DNA, 16 bp, P. troglodytes
tccacagtgtatatat

SEQ ID NO: 266202 - DNA, 16 bp, P. troglodytes
tccacagttttgcctt

SEQ ID NO: 266203 - DNA, 16 bp, P. troglodytes
tccacatacctcttcc

SEQ ID NO: 266204 - DNA, 16 bp, P. troglodytes
tccacatcctctacag

SEQ ID NO: 266205 - DNA, 16 bp, P. troglodytes
tccacatctgtaaagt

SEQ ID NO: 266206 - DNA, 16 bp, P. troglodytes
tccacatggtgttaag

SEQ ID NO: 266207 - DNA, 16 bp, P. troglodytes
tccacattctctccaa

SEQ ID NO: 266208 - DNA, 16 bp, P. troglodytes
tccacatttttgccaa

SEQ ID NO: 266209 - DNA, 16 bp, P. troglodytes
tccaccaaaaaactat

SEQ ID NO: 266210 - DNA, 16 bp, P. troglodytes
tccaccaccaagcctg

SEQ ID NO: 266211 - DNA, 16 bp, P. troglodytes
tccaccacctccaaaa

SEQ ID NO: 266212 - DNA, 16 bp, P. troglodytes
tccaccagcaaaaaga

SEQ ID NO: 266213 - DNA, 16 bp, P. troglodytes
tccaccatgattggaa

SEQ ID NO: 266214 - DNA, 16 bp, P. troglodytes
tccaccatgattttga

SEQ ID NO: 266215 - DNA, 17 bp, P. troglodytes
tccaccatgcctggcta

SEQ ID NO: 266216 - DNA, 16 bp, P. troglodytes
tccaccattataatat

SEQ ID NO: 266217 - DNA, 16 bp, P. troglodytes
tccacccacctcaact

SEQ ID NO: 266218 - DNA, 16 bp, P. troglodytes
tccacccacctcaggc

SEQ ID NO: 266219 - DNA, 17 bp, P. troglodytes
tccacccacctctgcct

SEQ ID NO: 266220 - DNA, 16 bp, P. troglodytes
tccaccccagaccctg

SEQ ID NO: 266221 - DNA, 16 bp, P. troglodytes
tccaccccagtgtgca

SEQ ID NO: 266222 - DNA, 16 bp, P. troglodytes
tccaccccatttgctc

SEQ ID NO: 266223 - DNA, 16 bp, P. troglodytes
tccaccccctcggcct

SEQ ID NO: 266224 - DNA, 17 bp, P. troglodytes
tccacccctctcggcct

SEQ ID NO: 266225 - DNA, 16 bp, P. troglodytes
tccacccctgtgatcc

SEQ ID NO: 266226 - DNA, 18 bp, P. troglodytes
tccacccgcctgggcctc

SEQ ID NO: 266227 - DNA, 18 bp, P. troglodytes
tccacccgccttgacctc

SEQ ID NO: 266228 - DNA, 16 bp, P. troglodytes
tccaccctcagcctcc

SEQ ID NO: 266229 - DNA, 16 bp, P. troglodytes
tccaccctgggcaaaa

SEQ ID NO: 266230 - DNA, 16 bp, P. troglodytes
tccaccctgggcaaca

SEQ ID NO: 266231 - DNA, 16 bp, P. troglodytes
tccaccgccttggcct

SEQ ID NO: 266232 - DNA, 16 bp, P. troglodytes
tccacctagattttag

SEQ ID NO: 266233 - DNA, 16 bp, P. troglodytes
tccacctcagccacct

SEQ ID NO: 266234 - DNA, 16 bp, P. troglodytes
tccacctcagcctccc

SEQ ID NO: 266235 - DNA, 16 bp, P. troglodytes
tccacctcagcctcct

SEQ ID NO: 266236 - DNA, 16 bp, P. troglodytes
tccacctccaaggttc

SEQ ID NO: 266237 - DNA, 16 bp, P. troglodytes
tccacctccagggctc

SEQ ID NO: 266238 - DNA, 16 bp, P. troglodytes
tccacctcccagagtg

SEQ ID NO: 266239 - DNA, 17 bp, P. troglodytes
tccacctcccaggctca

SEQ ID NO: 266240 - DNA, 16 bp, P. troglodytes
tccacctcccaggttt

SEQ ID NO: 266241 - DNA, 17 bp, P. troglodytes
tccacctcccggattca

SEQ ID NO: 266242 - DNA, 17 bp, P. troglodytes
tccacctcctgggttca

SEQ ID NO: 266243 - DNA, 16 bp, P. troglodytes
tccacctcctggtctc

SEQ ID NO: 266244 - DNA, 16 bp, P. troglodytes
tccacctcggcctctc

SEQ ID NO: 266245 - DNA, 16 bp, P. troglodytes
tccacctctggcccct

SEQ ID NO: 266246 - DNA, 21 bp, P. troglodytes
tccacctctgggggcagggca

SEQ ID NO: 266247 - DNA, 16 bp, P. troglodytes
tccacctcttgcatca

SEQ ID NO: 266248 - DNA, 16 bp, P. troglodytes
tccacctcttgtcaga

SEQ ID NO: 266249 - DNA, 16 bp, P. troglodytes
tccacctctttacctt

SEQ ID NO: 266250 - DNA, 16 bp, P. troglodytes
tccacctgcagccccc

SEQ ID NO: 266251 - DNA, 16 bp, P. troglodytes
tccacctgccaaagtg

SEQ ID NO: 266252 - DNA, 16 bp, P. troglodytes
tccacctgccccagcc

SEQ ID NO: 266253 - DNA, 16 bp, P. troglodytes
tccacctgcctcacct

SEQ ID NO: 266254 - DNA, 16 bp, P. troglodytes
tccacctgcctcaggc

SEQ ID NO: 266255 - DNA, 16 bp, P. troglodytes
tccacctgcctctgct

SEQ ID NO: 266256 - DNA, 16 bp, P. troglodytes
tccacctgccttcgcc

SEQ ID NO: 266257 - DNA, 16 bp, P. troglodytes
tccacctgccttggcc

SEQ ID NO: 266258 - DNA, 16 bp, P. troglodytes
tccacctgctgtggcc

SEQ ID NO: 266259 - DNA, 16 bp, P. troglodytes
tccaccttacagtcct

SEQ ID NO: 266260 - DNA, 19 bp, P. troglodytes
tccaccttggcctcccaaa

SEQ ID NO: 266261 - DNA, 16 bp, P. troglodytes
tccacgcccagctaat

SEQ ID NO: 266262 - DNA, 19 bp, P. troglodytes
tccacgcccggctaatttt

SEQ ID NO: 266263 - DNA, 16 bp, P. troglodytes
tccacgtgtgtgtgtg

SEQ ID NO: 266264 - DNA, 16 bp, P. troglodytes
tccactaaaaatattt

SEQ ID NO: 266265 - DNA, 16 bp, P. troglodytes
tccactagaatataag

SEQ ID NO: 266266 - DNA, 18 bp, P. troglodytes
tccactagaggcaaggtg

SEQ ID NO: 266267 - DNA, 16 bp, P. troglodytes
tccactcagaaacccc

SEQ ID NO: 266268 - DNA, 27 bp, P. troglodytes
tccactcagggttgaatggattaaggg

SEQ ID NO: 266269 - DNA, 16 bp, P. troglodytes
tccactccagacactg

SEQ ID NO: 266270 - DNA, 16 bp, P. troglodytes
tccactcccctcggcc

SEQ ID NO: 266271 - DNA, 16 bp, P. troglodytes
tccactctctgtgtcc

SEQ ID NO: 266272 - DNA, 16 bp, P. troglodytes
tccactgaagtcttga

SEQ ID NO: 266273 - DNA, 16 bp, P. troglodytes
tccactgagagctgga

SEQ ID NO: 266274 - DNA, 16 bp, P. troglodytes
tccactgcaacctcca

SEQ ID NO: 266275 - DNA, 16 bp, P. troglodytes
tccactgcaacctctg

SEQ ID NO: 266276 - DNA, 16 bp, P. troglodytes
tccactgtcttctggc

SEQ ID NO: 266277 - DNA, 16 bp, P. troglodytes
tccacttcactccagc

SEQ ID NO: 266278 - DNA, 16 bp, P. troglodytes
tccacttcagcctggg

SEQ ID NO: 266279 - DNA, 17 bp, P. troglodytes
tccacttcctgggttca

SEQ ID NO: 266280 - DNA, 16 bp, P. troglodytes
tccacttctgggggca

SEQ ID NO: 266281 - DNA, 16 bp, P. troglodytes
tccacttgaagattct

SEQ ID NO: 266282 - DNA, 18 bp, P. troglodytes
tccacttgcctcggcctc

SEQ ID NO: 266283 - DNA, 16 bp, P. troglodytes
tccacttgccttggct

SEQ ID NO: 266284 - DNA, 16 bp, P. troglodytes
tccacttggtctctcc

SEQ ID NO: 266285 - DNA, 16 bp, P. troglodytes
tccactttacagatga

SEQ ID NO: 266286 - DNA, 16 bp, P. troglodytes
tccactttcaattttc

SEQ ID NO: 266287 - DNA, 16 bp, P. troglodytes
tccagaaaaatatttt

SEQ ID NO: 266288 - DNA, 16 bp, P. troglodytes
tccagaaaactgaaga

SEQ ID NO: 266289 - DNA, 16 bp, P. troglodytes
tccagaaaagaagtct

SEQ ID NO: 266290 - DNA, 16 bp, P. troglodytes
tccagaaaagacaaat

SEQ ID NO: 266291 - DNA, 16 bp, P. troglodytes
tccagaaataccctca

SEQ ID NO: 266292 - DNA, 16 bp, P. troglodytes
tccagaaatagatcca

SEQ ID NO: 266293 - DNA, 16 bp, P. troglodytes
tccagaaatttgtcca

SEQ ID NO: 266294 - DNA, 16 bp, P. troglodytes
tccagaacagctggga

SEQ ID NO: 266295 - DNA, 16 bp, P. troglodytes
tccagaacagggaaat

SEQ ID NO: 266296 - DNA, 16 bp, P. troglodytes
tccagaacagtgagaa

SEQ ID NO: 266297 - DNA, 16 bp, P. troglodytes
tccagaacatttcatc

SEQ ID NO: 266298 - DNA, 16 bp, P. troglodytes
tccagaactatgagca

SEQ ID NO: 266299 - DNA, 16 bp, P. troglodytes
tccagaactgggagag

SEQ ID NO: 266300 - DNA, 16 bp, P. troglodytes
tccagaagaaatgcag

SEQ ID NO: 266301 - DNA, 16 bp, P. troglodytes
tccagaagatctggct

SEQ ID NO: 266302 - DNA, 16 bp, P. troglodytes
tccagaagctggaaaa

SEQ ID NO: 266303 - DNA, 16 bp, P. troglodytes
tccagaaggaacacag

SEQ ID NO: 266304 - DNA, 16 bp, P. troglodytes
tccagaaggagaagag

SEQ ID NO: 266305 - DNA, 16 bp, P. troglodytes
tccagaaggttttcaa

SEQ ID NO: 266306 - DNA, 16 bp, P. troglodytes
tccagaatagacaaat

SEQ ID NO: 266307 - DNA, 16 bp, P. troglodytes
tccagaataggcaaat

SEQ ID NO: 266308 - DNA, 16 bp, P. troglodytes
tccagaatccataagg

SEQ ID NO: 266309 - DNA, 16 bp, P. troglodytes
tccagaatggtattgc

SEQ ID NO: 266310 - DNA, 16 bp, P. troglodytes
tccagaatggtgagaa

SEQ ID NO: 266311 - DNA, 16 bp, P. troglodytes
tccagaatggtgtttc

SEQ ID NO: 266312 - DNA, 16 bp, P. troglodytes
tccagaattatgagaa

SEQ ID NO: 266313 - DNA, 16 bp, P. troglodytes
tccagaattttcattt

SEQ ID NO: 266314 - DNA, 16 bp, P. troglodytes
tccagacagagtctca

SEQ ID NO: 266315 - DNA, 16 bp, P. troglodytes
tccagaccatcacaat

SEQ ID NO: 266316 - DNA, 16 bp, P. troglodytes
tccagacctcaggtga

SEQ ID NO: 266317 - DNA, 16 bp, P. troglodytes
tccagactccaagaga

SEQ ID NO: 266318 - DNA, 16 bp, P. troglodytes
tccagactcccagaag

SEQ ID NO: 266319 - DNA, 16 bp, P. troglodytes
tccagactgtgggaaa

SEQ ID NO: 266320 - DNA, 16 bp, P. troglodytes
tccagagaaaggaaca

SEQ ID NO: 266321 - DNA, 16 bp, P. troglodytes
tccagagaagctggga

SEQ ID NO: 266322 - DNA, 16 bp, P. troglodytes
tccagagaatccctga

SEQ ID NO: 266323 - DNA, 16 bp, P. troglodytes
tccagagagctgcctt

SEQ ID NO: 266324 - DNA, 16 bp, P. troglodytes
tccagagcccatgctc

SEQ ID NO: 266325 - DNA, 16 bp, P. troglodytes
tccagagcctgggcga

SEQ ID NO: 266326 - DNA, 16 bp, P. troglodytes
tccagaggctgaggaa

SEQ ID NO: 266327 - DNA, 18 bp, P. troglodytes
tccagagtgctgggatta

SEQ ID NO: 266328 - DNA, 16 bp, P. troglodytes
tccagagtgggtgaca

SEQ ID NO: 266329 - DNA, 16 bp, P. troglodytes
tccagatcagcctggg

SEQ ID NO: 266330 - DNA, 16 bp, P. troglodytes
tccagatcctgtttgc

SEQ ID NO: 266331 - DNA, 16 bp, P. troglodytes
tccagatggctgggga

SEQ ID NO: 266332 - DNA, 16 bp, P. troglodytes
tccagatttctggctt

SEQ ID NO: 266333 - DNA, 16 bp, P. troglodytes
tccagcaatccaccca

SEQ ID NO: 266334 - DNA, 16 bp, P. troglodytes
tccagcacagcaaagg

SEQ ID NO: 266335 - DNA, 16 bp, P. troglodytes
tccagcactggagatt

SEQ ID NO: 266336 - DNA, 16 bp, P. troglodytes
tccagcactttgagaa

SEQ ID NO: 266337 - DNA, 16 bp, P. troglodytes
tccagcactttgcaag

SEQ ID NO: 266338 - DNA, 16 bp, P. troglodytes
tccagcactttgggag

SEQ ID NO: 266339 - DNA, 16 bp, P. troglodytes
tccagcagatctgcag

SEQ ID NO: 266340 - DNA, 16 bp, P. troglodytes
tccagcagcatattaa

SEQ ID NO: 266341 - DNA, 16 bp, P. troglodytes
tccagcaggaagtagc

SEQ ID NO: 266342 - DNA, 16 bp, P. troglodytes
tccagcaggacagtca

SEQ ID NO: 266343 - DNA, 16 bp, P. troglodytes
tccagcagggcagtca

SEQ ID NO: 266344 - DNA, 16 bp, P. troglodytes
tccagcatgggcaaca

SEQ ID NO: 266345 - DNA, 16 bp, P. troglodytes
tccagcatgggcgaca

SEQ ID NO: 266346 - DNA, 16 bp, P. troglodytes
tccagccacactggtc

SEQ ID NO: 266347 - DNA, 16 bp, P. troglodytes
tccagccacccagcca

SEQ ID NO: 266348 - DNA, 16 bp, P. troglodytes
tccagccacccctgcc

SEQ ID NO: 266349 - DNA, 16 bp, P. troglodytes
tccagccaccttggcc

SEQ ID NO: 266350 - DNA, 16 bp, P. troglodytes
tccagccagcctgggc

SEQ ID NO: 266351 - DNA, 16 bp, P. troglodytes
tccagccagggtgaca

SEQ ID NO: 266352 - DNA, 16 bp, P. troglodytes
tccagccaggtgcagt

SEQ ID NO: 266353 - DNA, 16 bp, P. troglodytes
tccagccagtccctct

SEQ ID NO: 266354 - DNA, 16 bp, P. troglodytes
tccagccatgcagaac

SEQ ID NO: 266355 - DNA, 16 bp, P. troglodytes
tccagccatgctggcc

SEQ ID NO: 266356 - DNA, 16 bp, P. troglodytes
tccagcccactgcctg

SEQ ID NO: 266357 - DNA, 16 bp, P. troglodytes
tccagcccagcctggg

SEQ ID NO: 266358 - DNA, 16 bp, P. troglodytes
tccagccccagccctg

SEQ ID NO: 266359 - DNA, 16 bp, P. troglodytes
tccagccccagctgag

SEQ ID NO: 266360 - DNA, 16 bp, P. troglodytes
tccagcccgagcaaca

SEQ ID NO: 266361 - DNA, 16 bp, P. troglodytes
tccagcccgggggaca

SEQ ID NO: 266362 - DNA, 16 bp, P. troglodytes
tccagccctgggtgac

SEQ ID NO: 266363 - DNA, 16 bp, P. troglodytes
tccagcctaagcaaca

SEQ ID NO: 266364 - DNA, 16 bp, P. troglodytes
tccagcctacgcaaca

SEQ ID NO: 266365 - DNA, 16 bp, P. troglodytes
tccagcctcagcctgg

SEQ ID NO: 266366 - DNA, 16 bp, P. troglodytes
tccagcctccagcctg

SEQ ID NO: 266367 - DNA, 16 bp, P. troglodytes
tccagcctcggcaaca

SEQ ID NO: 266368 - DNA, 16 bp, P. troglodytes
tccagcctctggaact

SEQ ID NO: 266369 - DNA, 16 bp, P. troglodytes
tccagcctgagaaaca

SEQ ID NO: 266370 - DNA, 16 bp, P. troglodytes
tccagcctgagagaca

SEQ ID NO: 266371 - DNA, 16 bp, P. troglodytes
tccagcctgagcgata

SEQ ID NO: 266372 - DNA, 16 bp, P. troglodytes
tccagcctgagctaca

SEQ ID NO: 266373 - DNA, 16 bp, P. troglodytes
tccagcctgagtgaca

SEQ ID NO: 266374 - DNA, 16 bp, P. troglodytes
tccagcctgcagcctg

SEQ ID NO: 266375 - DNA, 16 bp, P. troglodytes
tccagcctgcccttcc

SEQ ID NO: 266376 - DNA, 16 bp, P. troglodytes
tccagcctgcctgggc

SEQ ID NO: 266377 - DNA, 16 bp, P. troglodytes
tccagcctgcgtgaca

SEQ ID NO: 266378 - DNA, 16 bp, P. troglodytes
tccagcctggactgca

SEQ ID NO: 266379 - DNA, 16 bp, P. troglodytes
tccagcctggatgcca

SEQ ID NO: 266380 - DNA, 16 bp, P. troglodytes
tccagcctggatggca

SEQ ID NO: 266381 - DNA, 16 bp, P. troglodytes
tccagcctgggaaaca

SEQ ID NO: 266382 - DNA, 16 bp, P. troglodytes
tccagcctgggacaca

SEQ ID NO: 266383 - DNA, 16 bp, P. troglodytes
tccagcctgggcaaca

SEQ ID NO: 266384 - DNA, 16 bp, P. troglodytes
tccagcctgggcaacc

SEQ ID NO: 266385 - DNA, 16 bp, P. troglodytes
tccagcctgggcagca

SEQ ID NO: 266386 - DNA, 17 bp, P. troglodytes
tccagcctgggcgacaa

SEQ ID NO: 266387 - DNA, 16 bp, P. troglodytes
tccagcctgggcgtca

SEQ ID NO: 266388 - DNA, 16 bp, P. troglodytes
tccagcctgggctctg

SEQ ID NO: 266389 - DNA, 16 bp, P. troglodytes
tccagcctggggaaga

SEQ ID NO: 266390 - DNA, 17 bp, P. troglodytes
tccagcctggggacaga

SEQ ID NO: 266391 - DNA, 16 bp, P. troglodytes
tccagcctgggtcaga

SEQ ID NO: 266392 - DNA, 22 bp, P. troglodytes
tccagcctgggtgacagaggga

SEQ ID NO: 266393 - DNA, 16 bp, P. troglodytes
tccagcctgggtgacc

SEQ ID NO: 266394 - DNA, 16 bp, P. troglodytes
tccagcctgggtgtcg

SEQ ID NO: 266395 - DNA, 16 bp, P. troglodytes
tccagcctgggttata

SEQ ID NO: 266396 - DNA, 16 bp, P. troglodytes
tccagcctggttgaca

SEQ ID NO: 266397 - DNA, 16 bp, P. troglodytes
tccagcctgtgtgaca

SEQ ID NO: 266398 - DNA, 16 bp, P. troglodytes
tccagcctgttgacag

SEQ ID NO: 266399 - DNA, 16 bp, P. troglodytes
tccagccttgacctcc

SEQ ID NO: 266400 - DNA, 16 bp, P. troglodytes
tccagccttgtgacag

SEQ ID NO: 266401 - DNA, 16 bp, P. troglodytes
tccagctactaaggag

SEQ ID NO: 266402 - DNA, 22 bp, P. troglodytes
tccagctactcgggaggctgaa

SEQ ID NO: 266403 - DNA, 16 bp, P. troglodytes
tccagctactcgggtg

SEQ ID NO: 266404 - DNA, 16 bp, P. troglodytes
tccagctacttgagag

SEQ ID NO: 266405 - DNA, 16 bp, P. troglodytes
tccagctccatcaatg

SEQ ID NO: 266406 - DNA, 16 bp, P. troglodytes
tccagctccccatcct

SEQ ID NO: 266407 - DNA, 17 bp, P. troglodytes
tccagctgcacatcaaa

SEQ ID NO: 266408 - DNA, 16 bp, P. troglodytes
tccagctgctgcttct

SEQ ID NO: 266409 - DNA, 16 bp, P. troglodytes
tccagctgctggggag

SEQ ID NO: 266410 - DNA, 16 bp, P. troglodytes
tccagctgggtgtggt

SEQ ID NO: 266411 - DNA, 16 bp, P. troglodytes
tccagcttcagcctct

SEQ ID NO: 266412 - DNA, 16 bp, P. troglodytes
tccagcttcagcttct

SEQ ID NO: 266413 - DNA, 16 bp, P. troglodytes
tccagcttcatccaca

SEQ ID NO: 266414 - DNA, 16 bp, P. troglodytes
tccagcttccagagct

SEQ ID NO: 266415 - DNA, 16 bp, P. troglodytes
tccagcttcggtgaca

SEQ ID NO: 266416 - DNA, 16 bp, P. troglodytes
tccagcttctcaggag

SEQ ID NO: 266417 - DNA, 16 bp, P. troglodytes
tccagcttctccacat

SEQ ID NO: 266418 - DNA, 16 bp, P. troglodytes
tccagcttgggcaaca

SEQ ID NO: 266419 - DNA, 16 bp, P. troglodytes
tccagcttggtggggg

SEQ ID NO: 266420 - DNA, 16 bp, P. troglodytes
tccagctttaagcctt

SEQ ID NO: 266421 - DNA, 16 bp, P. troglodytes
tccagctttgtgtcat

SEQ ID NO: 266422 - DNA, 16 bp, P. troglodytes
tccagctttgttcttc

SEQ ID NO: 266423 - DNA, 16 bp, P. troglodytes
tccaggaaccacactt

SEQ ID NO: 266424 - DNA, 16 bp, P. troglodytes
tccaggaactgaactc

SEQ ID NO: 266425 - DNA, 17 bp, P. troglodytes
tccaggaagaatcaggt

SEQ ID NO: 266426 - DNA, 16 bp, P. troglodytes
tccaggaagccctcca

SEQ ID NO: 266427 - DNA, 16 bp, P. troglodytes
tccaggaaggcttcct

SEQ ID NO: 266428 - DNA, 16 bp, P. troglodytes
tccaggaagtcttcct

SEQ ID NO: 266429 - DNA, 16 bp, P. troglodytes
tccaggacaatgttga

SEQ ID NO: 266430 - DNA, 16 bp, P. troglodytes
tccaggactatgagaa

SEQ ID NO: 266431 - DNA, 16 bp, P. troglodytes
tccaggagaactcccc

SEQ ID NO: 266432 - DNA, 16 bp, P. troglodytes
tccaggagaacttctc

SEQ ID NO: 266433 - DNA, 16 bp, P. troglodytes
tccaggagaagttccc

SEQ ID NO: 266434 - DNA, 16 bp, P. troglodytes
tccaggagatggaggc

SEQ ID NO: 266435 - DNA, 16 bp, P. troglodytes
tccaggagcagtggct

SEQ ID NO: 266436 - DNA, 16 bp, P. troglodytes
tccaggagctttttgg

SEQ ID NO: 266437 - DNA, 16 bp, P. troglodytes
tccaggaggaagagga

SEQ ID NO: 266438 - DNA, 16 bp, P. troglodytes
tccaggaggcagatgt

SEQ ID NO: 266439 - DNA, 16 bp, P. troglodytes
tccaggaggccaaggc

SEQ ID NO: 266440 - DNA, 16 bp, P. troglodytes
tccaggaggcggagct

SEQ ID NO: 266441 - DNA, 16 bp, P. troglodytes
tccaggaggtcaaggc

SEQ ID NO: 266442 - DNA, 16 bp, P. troglodytes
tccaggagtggtggct

SEQ ID NO: 266443 - DNA, 16 bp, P. troglodytes
tccaggagtttgagaa

SEQ ID NO: 266444 - DNA, 16 bp, P. troglodytes
tccaggataatttccc

SEQ ID NO: 266445 - DNA, 16 bp, P. troglodytes
tccaggatctggtttt

SEQ ID NO: 266446 - DNA, 16 bp, P. troglodytes
tccaggcacagtggct

SEQ ID NO: 266447 - DNA, 16 bp, P. troglodytes
tccaggcagaaatctg

SEQ ID NO: 266448 - DNA, 16 bp, P. troglodytes
tccaggcagaggaaac

SEQ ID NO: 266449 - DNA, 16 bp, P. troglodytes
tccaggcattcagagc

SEQ ID NO: 266450 - DNA, 16 bp, P. troglodytes
tccaggccagagtgca

SEQ ID NO: 266451 - DNA, 16 bp, P. troglodytes
tccaggcccagatggt

SEQ ID NO: 266452 - DNA, 16 bp, P. troglodytes
tccaggcccccagccc

SEQ ID NO: 266453 - DNA, 16 bp, P. troglodytes
tccaggcctgggcctc

SEQ ID NO: 266454 - DNA, 16 bp, P. troglodytes
tccaggcctgggtgac

SEQ ID NO: 266455 - DNA, 16 bp, P. troglodytes
tccaggctcagcctcc

SEQ ID NO: 266456 - DNA, 16 bp, P. troglodytes
tccaggctgcagtgag

SEQ ID NO: 266457 - DNA, 16 bp, P. troglodytes
tccaggctggaatgca

SEQ ID NO: 266458 - DNA, 16 bp, P. troglodytes
tccaggctggaggaca

SEQ ID NO: 266459 - DNA, 16 bp, P. troglodytes
tccaggctggagtaca

SEQ ID NO: 266460 - DNA, 16 bp, P. troglodytes
tccaggctggagtgca

SEQ ID NO: 266461 - DNA, 16 bp, P. troglodytes
tccaggctggatggag

SEQ ID NO: 266462 - DNA, 16 bp, P. troglodytes
tccaggctggattgca

SEQ ID NO: 266463 - DNA, 16 bp, P. troglodytes
tccaggctgggagaca

SEQ ID NO: 266464 - DNA, 16 bp, P. troglodytes
tccaggctgggtgaga

SEQ ID NO: 266465 - DNA, 16 bp, P. troglodytes
tccaggctggtctgaa

SEQ ID NO: 266466 - DNA, 16 bp, P. troglodytes
tccaggcttccttctg

SEQ ID NO: 266467 - DNA, 16 bp, P. troglodytes
tccaggcttgagggtg

SEQ ID NO: 266468 - DNA, 16 bp, P. troglodytes
tccagggactgttgtg

SEQ ID NO: 266469 - DNA, 16 bp, P. troglodytes
tccagggaggggagag

SEQ ID NO: 266470 - DNA, 16 bp, P. troglodytes
tccaggggaacttccc

SEQ ID NO: 266471 - DNA, 16 bp, P. troglodytes
tccaggtagacagtgt

SEQ ID NO: 266472 - DNA, 16 bp, P. troglodytes
tccaggtggctcagaa

SEQ ID NO: 266473 - DNA, 17 bp, P. troglodytes
tccaggttcaagcaatt

SEQ ID NO: 266474 - DNA, 16 bp, P. troglodytes
tccaggttcatccatg

SEQ ID NO: 266475 - DNA, 16 bp, P. troglodytes
tccagtaagaacaaaa

SEQ ID NO: 266476 - DNA, 17 bp, P. troglodytes
tccagtactttgggagg

SEQ ID NO: 266477 - DNA, 16 bp, P. troglodytes
tccagtagtcattcag

SEQ ID NO: 266478 - DNA, 16 bp, P. troglodytes
tccagtcaatagaaaa

SEQ ID NO: 266479 - DNA, 16 bp, P. troglodytes
tccagtcacctcccat

SEQ ID NO: 266480 - DNA, 16 bp, P. troglodytes
tccagtccaccattga

SEQ ID NO: 266481 - DNA, 16 bp, P. troglodytes
tccagtccaggcaaca

SEQ ID NO: 266482 - DNA, 16 bp, P. troglodytes
tccagtcctggctctg

SEQ ID NO: 266483 - DNA, 17 bp, P. troglodytes
tccagtctatcattcat

SEQ ID NO: 266484 - DNA, 16 bp, P. troglodytes
tccagtctgggtgaca

SEQ ID NO: 266485 - DNA, 16 bp, P. troglodytes
tccagtctgggtgaga

SEQ ID NO: 266486 - DNA, 16 bp, P. troglodytes
tccagtcttttggctt

SEQ ID NO: 266487 - DNA, 16 bp, P. troglodytes
tccagtgaccagcccc

SEQ ID NO: 266488 - DNA, 16 bp, P. troglodytes
tccagtgatgtgacct

SEQ ID NO: 266489 - DNA, 16 bp, P. troglodytes
tccagtgccatccatg

SEQ ID NO: 266490 - DNA, 16 bp, P. troglodytes
tccagtgctctttcca

SEQ ID NO: 266491 - DNA, 16 bp, P. troglodytes
tccagtgttttgggag

SEQ ID NO: 266492 - DNA, 16 bp, P. troglodytes
tccagttcacagaaaa

SEQ ID NO: 266493 - DNA, 16 bp, P. troglodytes
tccagttctggaggct

SEQ ID NO: 266494 - DNA, 16 bp, P. troglodytes
tccagttgctccagca

SEQ ID NO: 266495 - DNA, 16 bp, P. troglodytes
tccagtttcattattc

SEQ ID NO: 266496 - DNA, 16 bp, P. troglodytes
tccagtttccaatacc

SEQ ID NO: 266497 - DNA, 16 bp, P. troglodytes
tccagtttctccagca

SEQ ID NO: 266498 - DNA, 16 bp, P. troglodytes
tccagttttatttttc

SEQ ID NO: 266499 - DNA, 16 bp, P. troglodytes
tccagttttgtgccct

SEQ ID NO: 266500 - DNA, 16 bp, P. troglodytes
tccagttttgttattt

SEQ ID NO: 266501 - DNA, 16 bp, P. troglodytes
tccagttttttaaaaa

SEQ ID NO: 266502 - DNA, 16 bp, P. troglodytes
tccagtttttttttaa

SEQ ID NO: 266503 - DNA, 16 bp, P. troglodytes
tccataaacatgggat

SEQ ID NO: 266504 - DNA, 16 bp, P. troglodytes
tccataaataaagttt

SEQ ID NO: 266505 - DNA, 16 bp, P. troglodytes
tccatacagcagccag

SEQ ID NO: 266506 - DNA, 16 bp, P. troglodytes
tccatactggagagaa

SEQ ID NO: 266507 - DNA, 16 bp, P. troglodytes
tccatatacacacaca

SEQ ID NO: 266508 - DNA, 16 bp, P. troglodytes
tccatatattttaaaa

SEQ ID NO: 266509 - DNA, 16 bp, P. troglodytes
tccatatgaatttaaa

SEQ ID NO: 266510 - DNA, 16 bp, P. troglodytes
tccatatgaattttag

SEQ ID NO: 266511 - DNA, 16 bp, P. troglodytes
tccatcaacagataaa

SEQ ID NO: 266512 - DNA, 16 bp, P. troglodytes
tccatcaagggatgaa

SEQ ID NO: 266513 - DNA, 16 bp, P. troglodytes
tccatcaagtggaaga

SEQ ID NO: 266514 - DNA, 16 bp, P. troglodytes
tccatcacagctcact

SEQ ID NO: 266515 - DNA, 16 bp, P. troglodytes
tccatcagcctcagcc

SEQ ID NO: 266516 - DNA, 16 bp, P. troglodytes
tccatcatcaccatca

SEQ ID NO: 266517 - DNA, 16 bp, P. troglodytes
tccatcatcccagaaa

SEQ ID NO: 266518 - DNA, 16 bp, P. troglodytes
tccatccacagatgaa

SEQ ID NO: 266519 - DNA, 16 bp, P. troglodytes
tccatccacctgtcca

SEQ ID NO: 266520 - DNA, 16 bp, P. troglodytes
tccatccacttatcca

SEQ ID NO: 266521 - DNA, 16 bp, P. troglodytes
tccatccatccatcca

SEQ ID NO: 266522 - DNA, 16 bp, P. troglodytes
tccatccatccattca

SEQ ID NO: 266523 - DNA, 16 bp, P. troglodytes
tccatccatccttcca

SEQ ID NO: 266524 - DNA, 16 bp, P. troglodytes
tccatccatcctttca

SEQ ID NO: 266525 - DNA, 16 bp, P. troglodytes
tccatccatctaccca

SEQ ID NO: 266526 - DNA, 16 bp, P. troglodytes
tccatcctccatccat

SEQ ID NO: 266527 - DNA, 16 bp, P. troglodytes
tccatcctgggctaca

SEQ ID NO: 266528 - DNA, 16 bp, P. troglodytes
tccatccttccatcca

SEQ ID NO: 266529 - DNA, 16 bp, P. troglodytes
tccatcgatggacact

SEQ ID NO: 266530 - DNA, 16 bp, P. troglodytes
tccatctacccaccca

SEQ ID NO: 266531 - DNA, 18 bp, P. troglodytes
tccatctactgagatagg

SEQ ID NO: 266532 - DNA, 16 bp, P. troglodytes
tccatctcaaaaagca

SEQ ID NO: 266533 - DNA, 16 bp, P. troglodytes
tccatctcaaagaaac

SEQ ID NO: 266534 - DNA, 16 bp, P. troglodytes
tccatctcagaaaaac

SEQ ID NO: 266535 - DNA, 16 bp, P. troglodytes
tccatctccaagaaaa

SEQ ID NO: 266536 - DNA, 16 bp, P. troglodytes
tccatctccagaactt

SEQ ID NO: 266537 - DNA, 16 bp, P. troglodytes
tccatctcccggattc

SEQ ID NO: 266538 - DNA, 16 bp, P. troglodytes
tccatctccctacaaa

SEQ ID NO: 266539 - DNA, 16 bp, P. troglodytes
tccatctccctgggac

SEQ ID NO: 266540 - DNA, 16 bp, P. troglodytes
tccatctcctggcttc

SEQ ID NO: 266541 - DNA, 16 bp, P. troglodytes
tccatctctgcctccc

SEQ ID NO: 266542 - DNA, 16 bp, P. troglodytes
tccatctcttgacctc

SEQ ID NO: 266543 - DNA, 16 bp, P. troglodytes
tccatcttaaaacaaa

SEQ ID NO: 266544 - DNA, 16 bp, P. troglodytes
tccatcttcaaggcca

SEQ ID NO: 266545 - DNA, 16 bp, P. troglodytes
tccatcttcatccatg

SEQ ID NO: 266546 - DNA, 16 bp, P. troglodytes
tccatcttctcctgcc

SEQ ID NO: 266547 - DNA, 16 bp, P. troglodytes
tccatcttctcttgcc

SEQ ID NO: 266548 - DNA, 16 bp, P. troglodytes
tccatcttgcttctga

SEQ ID NO: 266549 - DNA, 16 bp, P. troglodytes
tccatcttgttttatg

SEQ ID NO: 266550 - DNA, 16 bp, P. troglodytes
tccatctttgtggttt

SEQ ID NO: 266551 - DNA, 16 bp, P. troglodytes
tccatcttttggctat

SEQ ID NO: 266552 - DNA, 16 bp, P. troglodytes
tccatgaaacaggaag

SEQ ID NO: 266553 - DNA, 16 bp, P. troglodytes
tccatgaaggcagaaa

SEQ ID NO: 266554 - DNA, 16 bp, P. troglodytes
tccatgaaggctctgc

SEQ ID NO: 266555 - DNA, 16 bp, P. troglodytes
tccatgacccatggct

SEQ ID NO: 266556 - DNA, 16 bp, P. troglodytes
tccatgagaacagaga

SEQ ID NO: 266557 - DNA, 16 bp, P. troglodytes
tccatgagagcaggga

SEQ ID NO: 266558 - DNA, 16 bp, P. troglodytes
tccatgagcatggatt

SEQ ID NO: 266559 - DNA, 16 bp, P. troglodytes
tccatgagcatggcat

SEQ ID NO: 266560 - DNA, 16 bp, P. troglodytes
tccatgaggtcaggga

SEQ ID NO: 266561 - DNA, 16 bp, P. troglodytes
tccatgatgccccctg

SEQ ID NO: 266562 - DNA, 17 bp, P. troglodytes
tccatgcctggctaatt

SEQ ID NO: 266563 - DNA, 16 bp, P. troglodytes
tccatggaaatatcca

SEQ ID NO: 266564 - DNA, 16 bp, P. troglodytes
tccatggactgcagaa

SEQ ID NO: 266565 - DNA, 16 bp, P. troglodytes
tccatggagacagaaa

SEQ ID NO: 266566 - DNA, 16 bp, P. troglodytes
tccatggagcatgcag

SEQ ID NO: 266567 - DNA, 16 bp, P. troglodytes
tccatggagctggtgg

SEQ ID NO: 266568 - DNA, 16 bp, P. troglodytes
tccatggcaatgaccc

SEQ ID NO: 266569 - DNA, 16 bp, P. troglodytes
tccatgtacctgcaaa

SEQ ID NO: 266570 - DNA, 16 bp, P. troglodytes
tccatgtccccaccca

SEQ ID NO: 266571 - DNA, 16 bp, P. troglodytes
tccatgtgcagatgag

SEQ ID NO: 266572 - DNA, 16 bp, P. troglodytes
tccatgtgtactcatt

SEQ ID NO: 266573 - DNA, 16 bp, P. troglodytes
tccatgttgctgcaaa

SEQ ID NO: 266574 - DNA, 16 bp, P. troglodytes
tccatgttgctgccaa

SEQ ID NO: 266575 - DNA, 17 bp, P. troglodytes
tccatgtttagtgcttt

SEQ ID NO: 266576 - DNA, 16 bp, P. troglodytes
tccattaaacctcttt

SEQ ID NO: 266577 - DNA, 16 bp, P. troglodytes
tccattcagttttgtt

SEQ ID NO: 266578 - DNA, 16 bp, P. troglodytes
tccattcatgttaaaa

SEQ ID NO: 266579 - DNA, 16 bp, P. troglodytes
tccattcattcattga

SEQ ID NO: 266580 - DNA, 16 bp, P. troglodytes
tccattcattctttca

SEQ ID NO: 266581 - DNA, 16 bp, P. troglodytes
tccattccaagatggc

SEQ ID NO: 266582 - DNA, 16 bp, P. troglodytes
tccattccattccctt

SEQ ID NO: 266583 - DNA, 16 bp, P. troglodytes
tccattcccaccagca

SEQ ID NO: 266584 - DNA, 16 bp, P. troglodytes
tccattcctgagttac

SEQ ID NO: 266585 - DNA, 16 bp, P. troglodytes
tccattgagacagaaa

SEQ ID NO: 266586 - DNA, 16 bp, P. troglodytes
tccattgatctgtgtg

SEQ ID NO: 266587 - DNA, 16 bp, P. troglodytes
tccattggctggaaca

SEQ ID NO: 266588 - DNA, 16 bp, P. troglodytes
tccattggcttgaaat

SEQ ID NO: 266589 - DNA, 16 bp, P. troglodytes
tccattgtatgtgtat

SEQ ID NO: 266590 - DNA, 16 bp, P. troglodytes
tccattgtatttatat

SEQ ID NO: 266591 - DNA, 16 bp, P. troglodytes
tccattgtgtggatag

SEQ ID NO: 266592 - DNA, 16 bp, P. troglodytes
tccattgtttaagcca

SEQ ID NO: 266593 - DNA, 16 bp, P. troglodytes
tccattgtttataagc

SEQ ID NO: 266594 - DNA, 16 bp, P. troglodytes
tccattgttttgcctt

SEQ ID NO: 266595 - DNA, 16 bp, P. troglodytes
tccatttaaaaaattt

SEQ ID NO: 266596 - DNA, 16 bp, P. troglodytes
tccatttatgtgaaat

SEQ ID NO: 266597 - DNA, 16 bp, P. troglodytes
tccatttattgaatag

SEQ ID NO: 266598 - DNA, 16 bp, P. troglodytes
tccatttcaaaaaaaa

SEQ ID NO: 266599 - DNA, 16 bp, P. troglodytes
tccatttcacagatga

SEQ ID NO: 266600 - DNA, 16 bp, P. troglodytes
tccatttccatccatg

SEQ ID NO: 266601 - DNA, 16 bp, P. troglodytes
tccatttcttcatctc

SEQ ID NO: 266602 - DNA, 16 bp, P. troglodytes
tccatttctttcatca

SEQ ID NO: 266603 - DNA, 16 bp, P. troglodytes
tccatttctttgtatc

SEQ ID NO: 266604 - DNA, 16 bp, P. troglodytes
tccatttgacagatga

SEQ ID NO: 266605 - DNA, 16 bp, P. troglodytes
tccatttgcatgaaat

SEQ ID NO: 266606 - DNA, 16 bp, P. troglodytes
tccatttgtaaaatga

SEQ ID NO: 266607 - DNA, 16 bp, P. troglodytes
tccatttgtctgtgtg

SEQ ID NO: 266608 - DNA, 16 bp, P. troglodytes
tccatttgtctgttga

SEQ ID NO: 266609 - DNA, 16 bp, P. troglodytes
tccatttgttcatgtc

SEQ ID NO: 266610 - DNA, 16 bp, P. troglodytes
tccatttgtttgtata

SEQ ID NO: 266611 - DNA, 16 bp, P. troglodytes
tccatttgtttgtatt

SEQ ID NO: 266612 - DNA, 16 bp, P. troglodytes
tccatttgtttgtgtg

SEQ ID NO: 266613 - DNA, 16 bp, P. troglodytes
tccattttagagatga

SEQ ID NO: 266614 - DNA, 16 bp, P. troglodytes
tccattttcacacttc

SEQ ID NO: 266615 - DNA, 16 bp, P. troglodytes
tccattttcatgctgt

SEQ ID NO: 266616 - DNA, 16 bp, P. troglodytes
tccattttcttatctg

SEQ ID NO: 266617 - DNA, 16 bp, P. troglodytes
tccattttcttcctca

SEQ ID NO: 266618 - DNA, 16 bp, P. troglodytes
tccatttttagttttc

SEQ ID NO: 266619 - DNA, 16 bp, P. troglodytes
tccatttttttcccca

SEQ ID NO: 266620 - DNA, 16 bp, P. troglodytes
tcccaaaacaaagaaa

SEQ ID NO: 266621 - DNA, 19 bp, P. troglodytes
tcccaaaatactgggatta

SEQ ID NO: 266622 - DNA, 16 bp, P. troglodytes
tcccaaaatattggga

SEQ ID NO: 266623 - DNA, 16 bp, P. troglodytes
tcccaaaatgctagaa

SEQ ID NO: 266624 - DNA, 17 bp, P. troglodytes
tcccaaaatgctgggag

SEQ ID NO: 266625 - DNA, 19 bp, P. troglodytes
tcccaaaatgctgggatta

SEQ ID NO: 266626 - DNA, 17 bp, P. troglodytes
tcccaaacctcaattct

SEQ ID NO: 266627 - DNA, 16 bp, P. troglodytes
tcccaaactcctggcc

SEQ ID NO: 266628 - DNA, 16 bp, P. troglodytes
tcccaaactgaaattc

SEQ ID NO: 266629 - DNA, 19 bp, P. troglodytes
tcccaaactgctgggatta

SEQ ID NO: 266630 - DNA, 19 bp, P. troglodytes
tcccaaagcgctgggatta

SEQ ID NO: 266631 - DNA, 16 bp, P. troglodytes
tcccaaaggcctggga

SEQ ID NO: 266632 - DNA, 19 bp, P. troglodytes
tcccaaagggctgggatta

SEQ ID NO: 266633 - DNA, 16 bp, P. troglodytes
tcccaaagggctgggg

SEQ ID NO: 266634 - DNA, 19 bp, P. troglodytes
tcccaaagtactgggatta

SEQ ID NO: 266635 - DNA, 19 bp, P. troglodytes
tcccaaagtcctgggatta

SEQ ID NO: 266636 - DNA, 19 bp, P. troglodytes
tcccaaagtgatgggatta

SEQ ID NO: 266637 - DNA, 16 bp, P. troglodytes
tcccaaagtgctagat

SEQ ID NO: 266638 - DNA, 19 bp, P. troglodytes
tcccaaagtgctaggatta

SEQ ID NO: 266639 - DNA, 19 bp, P. troglodytes
tcccaaagtgctgagatta

SEQ ID NO: 266640 - DNA, 16 bp, P. troglodytes
tcccaaagtgctgagg

SEQ ID NO: 266641 - DNA, 19 bp, P. troglodytes
tcccaaagtgctggaatta

SEQ ID NO: 266642 - DNA, 17 bp, P. troglodytes
tcccaaagtgctgggaa

SEQ ID NO: 266643 - DNA, 17 bp, P. troglodytes
tcccaaagtgctgggac

SEQ ID NO: 266644 - DNA, 18 bp, P. troglodytes
tcccaaagtgctgggatc

SEQ ID NO: 266645 - DNA, 18 bp, P. troglodytes
tcccaaagtgctgggatg

SEQ ID NO: 266646 - DNA, 19 bp, P. troglodytes
tcccaaagtgctgggatta

SEQ ID NO: 266647 - DNA, 19 bp, P. troglodytes
tcccaaagtgctgggattc

SEQ ID NO: 266648 - DNA, 19 bp, P. troglodytes
tcccaaagtgctgggattg

SEQ ID NO: 266649 - DNA, 19 bp, P. troglodytes
tcccaaagtgctgggattt

SEQ ID NO: 266650 - DNA, 16 bp, P. troglodytes
tcccaaagtgctgggc

SEQ ID NO: 266651 - DNA, 16 bp, P. troglodytes
tcccaaagtgctgggg

SEQ ID NO: 266652 - DNA, 18 bp, P. troglodytes
tcccaaagtgctgggtta

SEQ ID NO: 266653 - DNA, 19 bp, P. troglodytes
tcccaaagtggtgggatta

SEQ ID NO: 266654 - DNA, 16 bp, P. troglodytes
tcccaaagtgttagta

SEQ ID NO: 266655 - DNA, 17 bp, P. troglodytes
tcccaaagtgttgagat

SEQ ID NO: 266656 - DNA, 18 bp, P. troglodytes
tcccaaagtgttggaatt

SEQ ID NO: 266657 - DNA, 19 bp, P. troglodytes
tcccaaagtgttggaatta

SEQ ID NO: 266658 - DNA, 19 bp, P. troglodytes
tcccaaagtgttgggatta

SEQ ID NO: 266659 - DNA, 19 bp, P. troglodytes
tcccaaagtgttgggattg

SEQ ID NO: 266660 - DNA, 19 bp, P. troglodytes
tcccaaagttctgggatta

SEQ ID NO: 266661 - DNA, 16 bp, P. troglodytes
tcccaaatccaaaatg

SEQ ID NO: 266662 - DNA, 16 bp, P. troglodytes
tcccaaatcttatgtc

SEQ ID NO: 266663 - DNA, 19 bp, P. troglodytes
tcccaaattgctgggatta

SEQ ID NO: 266664 - DNA, 16 bp, P. troglodytes
tcccaaatttgaaaat

SEQ ID NO: 266665 - DNA, 16 bp, P. troglodytes
tcccaaatttggcaaa

SEQ ID NO: 266666 - DNA, 16 bp, P. troglodytes
tcccaacactgtttat

SEQ ID NO: 266667 - DNA, 16 bp, P. troglodytes
tcccaacagcagttgg

SEQ ID NO: 266668 - DNA, 16 bp, P. troglodytes
tcccaacaggccctgg

SEQ ID NO: 266669 - DNA, 19 bp, P. troglodytes
tcccaacgtgctgggatta

SEQ ID NO: 266670 - DNA, 16 bp, P. troglodytes
tcccaactactaggga

SEQ ID NO: 266671 - DNA, 16 bp, P. troglodytes
tcccaactatttggga

SEQ ID NO: 266672 - DNA, 23 bp, P. troglodytes
tcccaagactaaaccaggaagaa

SEQ ID NO: 266673 - DNA, 16 bp, P. troglodytes
tcccaagagattatgt

SEQ ID NO: 266674 - DNA, 16 bp, P. troglodytes
tcccaagagtttatgt

SEQ ID NO: 266675 - DNA, 19 bp, P. troglodytes
tcccaagcagctgggatta

SEQ ID NO: 266676 - DNA, 16 bp, P. troglodytes
tcccaagccatgctga

SEQ ID NO: 266677 - DNA, 16 bp, P. troglodytes
tcccaaggatgaagcc

SEQ ID NO: 266678 - DNA, 16 bp, P. troglodytes
tcccaaggctgtgcag

SEQ ID NO: 266679 - DNA, 16 bp, P. troglodytes
tcccaaggtgctgaga

SEQ ID NO: 266680 - DNA, 19 bp, P. troglodytes
tcccaaggtgctgggatta

SEQ ID NO: 266681 - DNA, 16 bp, P. troglodytes
tcccaaggttctggga

SEQ ID NO: 266682 - DNA, 18 bp, P. troglodytes
tcccaagtaactgggact

SEQ ID NO: 266683 - DNA, 16 bp, P. troglodytes
tcccaagtagctgcaa

SEQ ID NO: 266684 - DNA, 16 bp, P. troglodytes
tcccaagtagttggga

SEQ ID NO: 266685 - DNA, 16 bp, P. troglodytes
tcccaagtgatgctga

SEQ ID NO: 266686 - DNA, 19 bp, P. troglodytes
tcccaagtgctgggattac

SEQ ID NO: 266687 - DNA, 16 bp, P. troglodytes
tcccaagtgttgtggg

SEQ ID NO: 266688 - DNA, 19 bp, P. troglodytes
tcccaatgtgctgggatta

SEQ ID NO: 266689 - DNA, 16 bp, P. troglodytes
tcccaatgttggaggt

SEQ ID NO: 266690 - DNA, 19 bp, P. troglodytes
tcccaattcttagtccttt

SEQ ID NO: 266691 - DNA, 16 bp, P. troglodytes
tcccacaacacgtggg

SEQ ID NO: 266692 - DNA, 16 bp, P. troglodytes
tcccacagctctggag

SEQ ID NO: 266693 - DNA, 16 bp, P. troglodytes
tcccacaggctgaggg

SEQ ID NO: 266694 - DNA, 16 bp, P. troglodytes
tcccacagggtgctcc

SEQ ID NO: 266695 - DNA, 18 bp, P. troglodytes
tcccacagtgctgggatt

SEQ ID NO: 266696 - DNA, 16 bp, P. troglodytes
tcccacatccaggaag

SEQ ID NO: 266697 - DNA, 16 bp, P. troglodytes
tcccacatccagggca

SEQ ID NO: 266698 - DNA, 16 bp, P. troglodytes
tcccacatcctgggca

SEQ ID NO: 266699 - DNA, 16 bp, P. troglodytes
tcccacattccttaca

SEQ ID NO: 266700 - DNA, 16 bp, P. troglodytes
tcccaccaacagtata

SEQ ID NO: 266701 - DNA, 16 bp, P. troglodytes
tcccaccaacagtgta

SEQ ID NO: 266702 - DNA, 16 bp, P. troglodytes
tcccaccacagcctcc

SEQ ID NO: 266703 - DNA, 16 bp, P. troglodytes
tcccaccaccctgacc

SEQ ID NO: 266704 - DNA, 16 bp, P. troglodytes
tcccaccacgcccagc

SEQ ID NO: 266705 - DNA, 16 bp, P. troglodytes
tcccaccagcagtgta

SEQ ID NO: 266706 - DNA, 16 bp, P. troglodytes
tcccaccagcctgact

SEQ ID NO: 266707 - DNA, 16 bp, P. troglodytes
tcccaccaggcccaac

SEQ ID NO: 266708 - DNA, 16 bp, P. troglodytes
tcccaccaggcccctc

SEQ ID NO: 266709 - DNA, 16 bp, P. troglodytes
tcccaccaggccctgc

SEQ ID NO: 266710 - DNA, 16 bp, P. troglodytes
tcccaccatgtaagac

SEQ ID NO: 266711 - DNA, 16 bp, P. troglodytes
tcccacccaggctgga

SEQ ID NO: 266712 - DNA, 16 bp, P. troglodytes
tcccacccccatggag

SEQ ID NO: 266713 - DNA, 16 bp, P. troglodytes
tcccaccctcatgacc

SEQ ID NO: 266714 - DNA, 16 bp, P. troglodytes
tcccaccctggcttcc

SEQ ID NO: 266715 - DNA, 16 bp, P. troglodytes
tcccaccctgtcaccc

SEQ ID NO: 266716 - DNA, 16 bp, P. troglodytes
tcccaccctgtgtcca

SEQ ID NO: 266717 - DNA, 16 bp, P. troglodytes
tcccacctaagcctct

SEQ ID NO: 266718 - DNA, 16 bp, P. troglodytes
tcccacctcaaactcc

SEQ ID NO: 266719 - DNA, 16 bp, P. troglodytes
tcccacctcagactcc

SEQ ID NO: 266720 - DNA, 16 bp, P. troglodytes
tcccacctcagcatcc

SEQ ID NO: 266721 - DNA, 16 bp, P. troglodytes
tcccacctcagccctc

SEQ ID NO: 266722 - DNA, 16 bp, P. troglodytes
tcccacctcagcctca

SEQ ID NO: 266723 - DNA, 16 bp, P. troglodytes
tcccacctcagctcct

SEQ ID NO: 266724 - DNA, 16 bp, P. troglodytes
tcccacctcaggctcc

SEQ ID NO: 266725 - DNA, 16 bp, P. troglodytes
tcccacctccagcctc

SEQ ID NO: 266726 - DNA, 16 bp, P. troglodytes
tcccacctgtcccctc

SEQ ID NO: 266727 - DNA, 16 bp, P. troglodytes
tcccaccttaggctcc

SEQ ID NO: 266728 - DNA, 16 bp, P. troglodytes
tcccaccttggcctcc

SEQ ID NO: 266729 - DNA, 16 bp, P. troglodytes
tcccactactgggtaa

SEQ ID NO: 266730 - DNA, 16 bp, P. troglodytes
tcccactattattttg

SEQ ID NO: 266731 - DNA, 16 bp, P. troglodytes
tcccactctgtcacct

SEQ ID NO: 266732 - DNA, 16 bp, P. troglodytes
tcccactgggtccctc

SEQ ID NO: 266733 - DNA, 16 bp, P. troglodytes
tcccacttaaaagtga

SEQ ID NO: 266734 - DNA, 16 bp, P. troglodytes
tcccacttataagtga

SEQ ID NO: 266735 - DNA, 16 bp, P. troglodytes
tcccacttatgtgtga

SEQ ID NO: 266736 - DNA, 16 bp, P. troglodytes
tcccacttcacagatg

SEQ ID NO: 266737 - DNA, 16 bp, P. troglodytes
tcccacttcggcctcc

SEQ ID NO: 266738 - DNA, 16 bp, P. troglodytes
tcccagaaataaatcc

SEQ ID NO: 266739 - DNA, 16 bp, P. troglodytes
tcccagaacaaagctc

SEQ ID NO: 266740 - DNA, 16 bp, P. troglodytes
tcccagaacactggga

SEQ ID NO: 266741 - DNA, 16 bp, P. troglodytes
tcccagaaccatttat

SEQ ID NO: 266742 - DNA, 16 bp, P. troglodytes
tcccagaacctcaaaa

SEQ ID NO: 266743 - DNA, 16 bp, P. troglodytes
tcccagaagcccccag

SEQ ID NO: 266744 - DNA, 16 bp, P. troglodytes
tcccagaaggttaggc

SEQ ID NO: 266745 - DNA, 16 bp, P. troglodytes
tcccagaatttctgat

SEQ ID NO: 266746 - DNA, 16 bp, P. troglodytes
tcccagacactggcgt

SEQ ID NO: 266747 - DNA, 16 bp, P. troglodytes
tcccagacctgctgaa

SEQ ID NO: 266748 - DNA, 16 bp, P. troglodytes
tcccagacgatgggca

SEQ ID NO: 266749 - DNA, 16 bp, P. troglodytes
tcccagacttcttgga

SEQ ID NO: 266750 - DNA, 16 bp, P. troglodytes
tcccagagatgaagct

SEQ ID NO: 266751 - DNA, 16 bp, P. troglodytes
tcccagagatgctggt

SEQ ID NO: 266752 - DNA, 16 bp, P. troglodytes
tcccagagattctgat

SEQ ID NO: 266753 - DNA, 17 bp, P. troglodytes
tcccagagattctggta

SEQ ID NO: 266754 - DNA, 16 bp, P. troglodytes
tcccagaggcagaggt

SEQ ID NO: 266755 - DNA, 16 bp, P. troglodytes
tcccagagtgctggca

SEQ ID NO: 266756 - DNA, 19 bp, P. troglodytes
tcccagagtgctgggatta

SEQ ID NO: 266757 - DNA, 16 bp, P. troglodytes
tcccagagttctggga

SEQ ID NO: 266758 - DNA, 16 bp, P. troglodytes
tcccagatgctcagga

SEQ ID NO: 266759 - DNA, 17 bp, P. troglodytes
tcccagatggggcggcc

SEQ ID NO: 266760 - DNA, 16 bp, P. troglodytes
tcccagattcaaatga

SEQ ID NO: 266761 - DNA, 17 bp, P. troglodytes
tcccagattcaagtgat

SEQ ID NO: 266762 - DNA, 16 bp, P. troglodytes
tcccagcaaagaaaag

SEQ ID NO: 266763 - DNA, 16 bp, P. troglodytes
tcccagcaaattggga

SEQ ID NO: 266764 - DNA, 16 bp, P. troglodytes
tcccagcacagtggga

SEQ ID NO: 266765 - DNA, 16 bp, P. troglodytes
tcccagcacagtgttc

SEQ ID NO: 266766 - DNA, 16 bp, P. troglodytes
tcccagcacctagcac

SEQ ID NO: 266767 - DNA, 16 bp, P. troglodytes
tcccagcactcgggag

SEQ ID NO: 266768 - DNA, 16 bp, P. troglodytes
tcccagcactttagaa

SEQ ID NO: 266769 - DNA, 16 bp, P. troglodytes
tcccagcactttgata

SEQ ID NO: 266770 - DNA, 16 bp, P. troglodytes
tcccagcactttgtgg

SEQ ID NO: 266771 - DNA, 16 bp, P. troglodytes
tcccagcagccccagc

SEQ ID NO: 266772 - DNA, 16 bp, P. troglodytes
tcccagcagcctgggg

SEQ ID NO: 266773 - DNA, 16 bp, P. troglodytes
tcccagcaggcagctg

SEQ ID NO: 266774 - DNA, 16 bp, P. troglodytes
tcccagcagtccccca

SEQ ID NO: 266775 - DNA, 16 bp, P. troglodytes
tcccagccactcagga

SEQ ID NO: 266776 - DNA, 16 bp, P. troglodytes
tcccagccactccagc

SEQ ID NO: 266777 - DNA, 16 bp, P. troglodytes
tcccagccactctagc

SEQ ID NO: 266778 - DNA, 16 bp, P. troglodytes
tcccagccccttggga

SEQ ID NO: 266779 - DNA, 16 bp, P. troglodytes
tcccagccctgcctcc

SEQ ID NO: 266780 - DNA, 16 bp, P. troglodytes
tcccagccctgctgcc

SEQ ID NO: 266781 - DNA, 16 bp, P. troglodytes
tcccagccctgggcaa

SEQ ID NO: 266782 - DNA, 16 bp, P. troglodytes
tcccagcccttcagga

SEQ ID NO: 266783 - DNA, 16 bp, P. troglodytes
tcccagccgggcgcgg

SEQ ID NO: 266784 - DNA, 16 bp, P. troglodytes
tcccagcctcaagtga

SEQ ID NO: 266785 - DNA, 16 bp, P. troglodytes
tcccagcctccagaac

SEQ ID NO: 266786 - DNA, 16 bp, P. troglodytes
tcccagcctcccagcc

SEQ ID NO: 266787 - DNA, 16 bp, P. troglodytes
tcccagctaattggga

SEQ ID NO: 266788 - DNA, 16 bp, P. troglodytes
tcccagctacccaaga

SEQ ID NO: 266789 - DNA, 17 bp, P. troglodytes
tcccagctactcgggaa

SEQ ID NO: 266790 - DNA, 16 bp, P. troglodytes
tcccagctacttcggg

SEQ ID NO: 266791 - DNA, 16 bp, P. troglodytes
tcccagctacttgtaa

SEQ ID NO: 266792 - DNA, 16 bp, P. troglodytes
tcccagctatgtggga

SEQ ID NO: 266793 - DNA, 16 bp, P. troglodytes
tcccagctattaggga

SEQ ID NO: 266794 - DNA, 16 bp, P. troglodytes
tcccagctcagcttcc

SEQ ID NO: 266795 - DNA, 16 bp, P. troglodytes
tcccagctccacctct

SEQ ID NO: 266796 - DNA, 16 bp, P. troglodytes
tcccagctccagagct

SEQ ID NO: 266797 - DNA, 16 bp, P. troglodytes
tcccagctccctggga

SEQ ID NO: 266798 - DNA, 16 bp, P. troglodytes
tcccagctccttgaga

SEQ ID NO: 266799 - DNA, 16 bp, P. troglodytes
tcccagctctcccact

SEQ ID NO: 266800 - DNA, 16 bp, P. troglodytes
tcccagctctgcccct

SEQ ID NO: 266801 - DNA, 16 bp, P. troglodytes
tcccagctctgccctg

SEQ ID NO: 266802 - DNA, 16 bp, P. troglodytes
tcccagctctgcctcc

SEQ ID NO: 266803 - DNA, 16 bp, P. troglodytes
tcccagctctgcctct

SEQ ID NO: 266804 - DNA, 16 bp, P. troglodytes
tcccagctctgctatt

SEQ ID NO: 266805 - DNA, 16 bp, P. troglodytes
tcccagctctgtcact

SEQ ID NO: 266806 - DNA, 16 bp, P. troglodytes
tcccagctcttcggga

SEQ ID NO: 266807 - DNA, 16 bp, P. troglodytes
tcccagctctttggaa

SEQ ID NO: 266808 - DNA, 16 bp, P. troglodytes
tcccagctgatcccag

SEQ ID NO: 266809 - DNA, 16 bp, P. troglodytes
tcccagctgccccagc

SEQ ID NO: 266810 - DNA, 16 bp, P. troglodytes
tcccagctgcctgcct

SEQ ID NO: 266811 - DNA, 16 bp, P. troglodytes
tcccagctgccttcat

SEQ ID NO: 266812 - DNA, 16 bp, P. troglodytes
tcccagctgctccagc

SEQ ID NO: 266813 - DNA, 16 bp, P. troglodytes
tcccagctgtgaaaga

SEQ ID NO: 266814 - DNA, 16 bp, P. troglodytes
tcccagctgtgtgact

SEQ ID NO: 266815 - DNA, 16 bp, P. troglodytes
tcccagcttggcctcc

SEQ ID NO: 266816 - DNA, 16 bp, P. troglodytes
tcccaggaaaaaaaaa

SEQ ID NO: 266817 - DNA, 16 bp, P. troglodytes
tcccaggaccagcagc

SEQ ID NO: 266818 - DNA, 16 bp, P. troglodytes
tcccaggactttggga

SEQ ID NO: 266819 - DNA, 16 bp, P. troglodytes
tcccaggactttgtga

SEQ ID NO: 266820 - DNA, 16 bp, P. troglodytes
tcccaggagacatttg

SEQ ID NO: 266821 - DNA, 16 bp, P. troglodytes
tcccaggaggctgagg

SEQ ID NO: 266822 - DNA, 16 bp, P. troglodytes
tcccaggattccttgg

SEQ ID NO: 266823 - DNA, 16 bp, P. troglodytes
tcccaggcacagctgc

SEQ ID NO: 266824 - DNA, 16 bp, P. troglodytes
tcccaggcccccaaga

SEQ ID NO: 266825 - DNA, 16 bp, P. troglodytes
tcccaggctgaagcca

SEQ ID NO: 266826 - DNA, 16 bp, P. troglodytes
tcccaggctggtcctg

SEQ ID NO: 266827 - DNA, 16 bp, P. troglodytes
tcccagggatgaaacc

SEQ ID NO: 266828 - DNA, 16 bp, P. troglodytes
tcccagggatgagcag

SEQ ID NO: 266829 - DNA, 16 bp, P. troglodytes
tcccagggatgcagcc

SEQ ID NO: 266830 - DNA, 16 bp, P. troglodytes
tcccagggccccagcc

SEQ ID NO: 266831 - DNA, 16 bp, P. troglodytes
tcccagggttcacgcc

SEQ ID NO: 266832 - DNA, 16 bp, P. troglodytes
tcccaggtacccagga

SEQ ID NO: 266833 - DNA, 16 bp, P. troglodytes
tcccaggtagctggga

SEQ ID NO: 266834 - DNA, 16 bp, P. troglodytes
tcccaggtcagcctcc

SEQ ID NO: 266835 - DNA, 16 bp, P. troglodytes
tcccaggttcaaggat

SEQ ID NO: 266836 - DNA, 16 bp, P. troglodytes
tcccagtgagatcaac

SEQ ID NO: 266837 - DNA, 16 bp, P. troglodytes
tcccagtgcccagcac

SEQ ID NO: 266838 - DNA, 16 bp, P. troglodytes
tcccagtgctctggga

SEQ ID NO: 266839 - DNA, 18 bp, P. troglodytes
tcccagttcaagtgattc

SEQ ID NO: 266840 - DNA, 16 bp, P. troglodytes
tcccagttttgccact

SEQ ID NO: 266841 - DNA, 19 bp, P. troglodytes
tcccatagtgctgggatta

SEQ ID NO: 266842 - DNA, 16 bp, P. troglodytes
tcccatatattttaaa

SEQ ID NO: 266843 - DNA, 16 bp, P. troglodytes
tcccatcaaagaaaag

SEQ ID NO: 266844 - DNA, 20 bp, P. troglodytes
tcccatcaatacctaattta

SEQ ID NO: 266845 - DNA, 16 bp, P. troglodytes
tcccatcacagcctcc

SEQ ID NO: 266846 - DNA, 16 bp, P. troglodytes
tcccatcatggcctga

SEQ ID NO: 266847 - DNA, 16 bp, P. troglodytes
tcccatccaggacacc

SEQ ID NO: 266848 - DNA, 16 bp, P. troglodytes
tcccatcccacatgct

SEQ ID NO: 266849 - DNA, 16 bp, P. troglodytes
tcccatctactcagga

SEQ ID NO: 266850 - DNA, 17 bp, P. troglodytes
tcccatctctaccaaaa

SEQ ID NO: 266851 - DNA, 16 bp, P. troglodytes
tcccatctctgccact

SEQ ID NO: 266852 - DNA, 16 bp, P. troglodytes
tcccatctctgtctct

SEQ ID NO: 266853 - DNA, 16 bp, P. troglodytes
tcccatctgccatgat

SEQ ID NO: 266854 - DNA, 16 bp, P. troglodytes
tcccatcttggcctct

SEQ ID NO: 266855 - DNA, 16 bp, P. troglodytes
tcccatgcaacccaaa

SEQ ID NO: 266856 - DNA, 16 bp, P. troglodytes
tcccatgctgatcagt

SEQ ID NO: 266857 - DNA, 16 bp, P. troglodytes
tcccatgctgctctca

SEQ ID NO: 266858 - DNA, 16 bp, P. troglodytes
tcccatgctgttcttg

SEQ ID NO: 266859 - DNA, 16 bp, P. troglodytes
tcccatgtagctagga

SEQ ID NO: 266860 - DNA, 16 bp, P. troglodytes
tcccatgttgaaatgt

SEQ ID NO: 266861 - DNA, 16 bp, P. troglodytes
tcccatgtttgttaca

SEQ ID NO: 266862 - DNA, 16 bp, P. troglodytes
tcccattaaaaagtgg

SEQ ID NO: 266863 - DNA, 16 bp, P. troglodytes
tcccattaaaatacca

SEQ ID NO: 266864 - DNA, 16 bp, P. troglodytes
tcccattcacaattgc

SEQ ID NO: 266865 - DNA, 16 bp, P. troglodytes
tcccattcacaattgt

SEQ ID NO: 266866 - DNA, 16 bp, P. troglodytes
tcccattctattcagt

SEQ ID NO: 266867 - DNA, 16 bp, P. troglodytes
tcccattgtatttaaa

SEQ ID NO: 266868 - DNA, 16 bp, P. troglodytes
tcccatttacaaatga

SEQ ID NO: 266869 - DNA, 16 bp, P. troglodytes
tcccatttatagatga

SEQ ID NO: 266870 - DNA, 16 bp, P. troglodytes
tcccatttctctacat

SEQ ID NO: 266871 - DNA, 16 bp, P. troglodytes
tcccatttggaatggg

SEQ ID NO: 266872 - DNA, 16 bp, P. troglodytes
tcccattttacagata

SEQ ID NO: 266873 - DNA, 16 bp, P. troglodytes
tcccattttacagatg

SEQ ID NO: 266874 - DNA, 19 bp, P. troglodytes
tcccattttacagatgagg

SEQ ID NO: 266875 - DNA, 16 bp, P. troglodytes
tcccattttatggatg

SEQ ID NO: 266876 - DNA, 16 bp, P. troglodytes
tcccattttgtttcta

SEQ ID NO: 266877 - DNA, 16 bp, P. troglodytes
tcccattttgtttctt

SEQ ID NO: 266878 - DNA, 16 bp, P. troglodytes
tcccatttttactaaa

SEQ ID NO: 266879 - DNA, 16 bp, P. troglodytes
tccccaaaaactattg

SEQ ID NO: 266880 - DNA, 16 bp, P. troglodytes
tccccaaaacacataa

SEQ ID NO: 266881 - DNA, 16 bp, P. troglodytes
tccccaaatacagtca

SEQ ID NO: 266882 - DNA, 16 bp, P. troglodytes
tccccaaatttgatga

SEQ ID NO: 266883 - DNA, 17 bp, P. troglodytes
tccccaaccaaatctca

SEQ ID NO: 266884 - DNA, 16 bp, P. troglodytes
tccccaagaccaccct

SEQ ID NO: 266885 - DNA, 16 bp, P. troglodytes
tccccaagcccaccag

SEQ ID NO: 266886 - DNA, 16 bp, P. troglodytes
tccccaagcctcagtt

SEQ ID NO: 266887 - DNA, 16 bp, P. troglodytes
tccccacccaaatctg

SEQ ID NO: 266888 - DNA, 16 bp, P. troglodytes
tccccacccaaatctt

SEQ ID NO: 266889 - DNA, 16 bp, P. troglodytes
tccccacccttgagaa

SEQ ID NO: 266890 - DNA, 16 bp, P. troglodytes
tccccacctgtcaagg

SEQ ID NO: 266891 - DNA, 16 bp, P. troglodytes
tccccactcagtctat

SEQ ID NO: 266892 - DNA, 16 bp, P. troglodytes
tccccactccctgcca

SEQ ID NO: 266893 - DNA, 16 bp, P. troglodytes
tccccactgggacctc

SEQ ID NO: 266894 - DNA, 16 bp, P. troglodytes
tccccagaaaataggt

SEQ ID NO: 266895 - DNA, 16 bp, P. troglodytes
tccccagaaaatgttt

SEQ ID NO: 266896 - DNA, 16 bp, P. troglodytes
tccccagagcccagca

SEQ ID NO: 266897 - DNA, 16 bp, P. troglodytes
tccccagcaaaacttc

SEQ ID NO: 266898 - DNA, 16 bp, P. troglodytes
tccccagcaaatgcaa

SEQ ID NO: 266899 - DNA, 16 bp, P. troglodytes
tccccagcaccagccc

SEQ ID NO: 266900 - DNA, 16 bp, P. troglodytes
tccccagcaccagcct

SEQ ID NO: 266901 - DNA, 16 bp, P. troglodytes
tccccagccacctctg

SEQ ID NO: 266902 - DNA, 16 bp, P. troglodytes
tccccagccccaggcc

SEQ ID NO: 266903 - DNA, 16 bp, P. troglodytes
tccccagcccctgaca

SEQ ID NO: 266904 - DNA, 16 bp, P. troglodytes
tccccagcccctgcca

SEQ ID NO: 266905 - DNA, 16 bp, P. troglodytes
tccccagccctggaaa

SEQ ID NO: 266906 - DNA, 16 bp, P. troglodytes
tccccagccctgtgga

SEQ ID NO: 266907 - DNA, 16 bp, P. troglodytes
tccccagcccttggca

SEQ ID NO: 266908 - DNA, 16 bp, P. troglodytes
tccccagcctcctgag

SEQ ID NO: 266909 - DNA, 16 bp, P. troglodytes
tccccaggagctggga

SEQ ID NO: 266910 - DNA, 16 bp, P. troglodytes
tccccaggatggagtg

SEQ ID NO: 266911 - DNA, 16 bp, P. troglodytes
tccccaggcaagaagg

SEQ ID NO: 266912 - DNA, 16 bp, P. troglodytes
tccccaggccagcagc

SEQ ID NO: 266913 - DNA, 16 bp, P. troglodytes
tccccaggctgaagtg

SEQ ID NO: 266914 - DNA, 16 bp, P. troglodytes
tccccaggctgatctc

SEQ ID NO: 266915 - DNA, 16 bp, P. troglodytes
tccccagtccccagcc

SEQ ID NO: 266916 - DNA, 16 bp, P. troglodytes
tccccagtgagggtgt

SEQ ID NO: 266917 - DNA, 16 bp, P. troglodytes
tccccagtgccagctg

SEQ ID NO: 266918 - DNA, 16 bp, P. troglodytes
tccccagtgcctagaa

SEQ ID NO: 266919 - DNA, 16 bp, P. troglodytes
tccccagtgttggaga

SEQ ID NO: 266920 - DNA, 16 bp, P. troglodytes
tccccatcccccacag

SEQ ID NO: 266921 - DNA, 16 bp, P. troglodytes
tccccatgctgttctt

SEQ ID NO: 266922 - DNA, 16 bp, P. troglodytes
tccccatggggcaggg

SEQ ID NO: 266923 - DNA, 16 bp, P. troglodytes
tccccatgtgtcctgg

SEQ ID NO: 266924 - DNA, 16 bp, P. troglodytes
tccccattgcttttct

SEQ ID NO: 266925 - DNA, 16 bp, P. troglodytes
tccccattggttgttt

SEQ ID NO: 266926 - DNA, 16 bp, P. troglodytes
tccccattttacagat

SEQ ID NO: 266927 - DNA, 16 bp, P. troglodytes
tccccattttacattt

SEQ ID NO: 266928 - DNA, 16 bp, P. troglodytes
tccccattttaccaat

SEQ ID NO: 266929 - DNA, 16 bp, P. troglodytes
tcccccaaaaaagaaa

SEQ ID NO: 266930 - DNA, 16 bp, P. troglodytes
tcccccaaaattcaca

SEQ ID NO: 266931 - DNA, 16 bp, P. troglodytes
tcccccaacactgggg

SEQ ID NO: 266932 - DNA, 16 bp, P. troglodytes
tcccccagcccctgca

SEQ ID NO: 266933 - DNA, 16 bp, P. troglodytes
tcccccagcccctggc

SEQ ID NO: 266934 - DNA, 16 bp, P. troglodytes
tcccccagcctcagcc

SEQ ID NO: 266935 - DNA, 17 bp, P. troglodytes
tcccccagcctggctgc

SEQ ID NO: 266936 - DNA, 16 bp, P. troglodytes
tcccccaggccccagg

SEQ ID NO: 266937 - DNA, 16 bp, P. troglodytes
tcccccaggctggagg

SEQ ID NO: 266938 - DNA, 16 bp, P. troglodytes
tcccccagtccctggc

SEQ ID NO: 266939 - DNA, 16 bp, P. troglodytes
tcccccagtttattac

SEQ ID NO: 266940 - DNA, 16 bp, P. troglodytes
tcccccatctgctgag

SEQ ID NO: 266941 - DNA, 16 bp, P. troglodytes
tcccccattattattg

SEQ ID NO: 266942 - DNA, 16 bp, P. troglodytes
tccccccaaggcaaaa

SEQ ID NO: 266943 - DNA, 16 bp, P. troglodytes
tccccctgcagagagc

SEQ ID NO: 266944 - DNA, 16 bp, P. troglodytes
tccccctgccaggctg

SEQ ID NO: 266945 - DNA, 16 bp, P. troglodytes
tccccctgctgtgtgc

SEQ ID NO: 266946 - DNA, 16 bp, P. troglodytes
tcccccttcactcagc

SEQ ID NO: 266947 - DNA, 16 bp, P. troglodytes
tcccccttttcctgtg

SEQ ID NO: 266948 - DNA, 16 bp, P. troglodytes
tccccgcctcagcctc

SEQ ID NO: 266949 - DNA, 16 bp, P. troglodytes
tccccggctaattttt

SEQ ID NO: 266950 - DNA, 16 bp, P. troglodytes
tccccggctccttcag

SEQ ID NO: 266951 - DNA, 16 bp, P. troglodytes
tcccctacctgctcct

SEQ ID NO: 266952 - DNA, 16 bp, P. troglodytes
tcccctaccttctgcc

SEQ ID NO: 266953 - DNA, 16 bp, P. troglodytes
tcccctcactgcaagc

SEQ ID NO: 266954 - DNA, 16 bp, P. troglodytes
tcccctcagcccctgg

SEQ ID NO: 266955 - DNA, 16 bp, P. troglodytes
tcccctccctgtgacc

SEQ ID NO: 266956 - DNA, 16 bp, P. troglodytes
tcccctctctgggcct

SEQ ID NO: 266957 - DNA, 16 bp, P. troglodytes
tcccctctggaggaca

SEQ ID NO: 266958 - DNA, 16 bp, P. troglodytes
tcccctgaagcattta

SEQ ID NO: 266959 - DNA, 16 bp, P. troglodytes
tcccctgacaggcccc

SEQ ID NO: 266960 - DNA, 16 bp, P. troglodytes
tcccctgacctcgtga

SEQ ID NO: 266961 - DNA, 16 bp, P. troglodytes
tcccctgagctccagg

SEQ ID NO: 266962 - DNA, 16 bp, P. troglodytes
tcccctgaggttggga

SEQ ID NO: 266963 - DNA, 16 bp, P. troglodytes
tcccctgccctgtgtg

SEQ ID NO: 266964 - DNA, 16 bp, P. troglodytes
tcccctgctgcagctg

SEQ ID NO: 266965 - DNA, 16 bp, P. troglodytes
tcccctgggaacttgt

SEQ ID NO: 266966 - DNA, 16 bp, P. troglodytes
tcccctgggcccagct

SEQ ID NO: 266967 - DNA, 16 bp, P. troglodytes
tcccctgggctcaagt

SEQ ID NO: 266968 - DNA, 16 bp, P. troglodytes
tcccctgtctcagcct

SEQ ID NO: 266969 - DNA, 16 bp, P. troglodytes
tccccttaactgctct

SEQ ID NO: 266970 - DNA, 16 bp, P. troglodytes
tcccctttccactagg

SEQ ID NO: 266971 - DNA, 16 bp, P. troglodytes
tcccctttcccctagg

SEQ ID NO: 266972 - DNA, 17 bp, P. troglodytes
tcccctttctaaaccaa

SEQ ID NO: 266973 - DNA, 16 bp, P. troglodytes
tccccttttttaaaaa

SEQ ID NO: 266974 - DNA, 18 bp, P. troglodytes
tcccgaagtgctaggatt

SEQ ID NO: 266975 - DNA, 19 bp, P. troglodytes
tcccgaagtgctgagatta

SEQ ID NO: 266976 - DNA, 19 bp, P. troglodytes
tcccgaagtgctgggatta

SEQ ID NO: 266977 - DNA, 16 bp, P. troglodytes
tcccgagccctgcccg

SEQ ID NO: 266978 - DNA, 18 bp, P. troglodytes
tcccgagtagctgggaca

SEQ ID NO: 266979 - DNA, 16 bp, P. troglodytes
tcccgagtagctgggg

SEQ ID NO: 266980 - DNA, 16 bp, P. troglodytes
tcccgcctcagccacc

SEQ ID NO: 266981 - DNA, 16 bp, P. troglodytes
tcccgcctcagcctcc

SEQ ID NO: 266982 - DNA, 16 bp, P. troglodytes
tcccgcctcatcctcc

SEQ ID NO: 266983 - DNA, 16 bp, P. troglodytes
tcccgcctgggcaaca

SEQ ID NO: 266984 - DNA, 16 bp, P. troglodytes
tcccgcctgggcctcc

SEQ ID NO: 266985 - DNA, 16 bp, P. troglodytes
tcccgccttagcttcc

SEQ ID NO: 266986 - DNA, 16 bp, P. troglodytes
tcccgccttggcctcc

SEQ ID NO: 266987 - DNA, 18 bp, P. troglodytes
tcccggagggggcggctg

SEQ ID NO: 266988 - DNA, 16 bp, P. troglodytes
tcccggccagccgccc

SEQ ID NO: 266989 - DNA, 16 bp, P. troglodytes
tcccggctactcagaa

SEQ ID NO: 266990 - DNA, 16 bp, P. troglodytes
tcccggctcagcctcc

SEQ ID NO: 266991 - DNA, 18 bp, P. troglodytes
tcccgggttcaaacaatt

SEQ ID NO: 266992 - DNA, 16 bp, P. troglodytes
tcccgtctcagcctcc

SEQ ID NO: 266993 - DNA, 16 bp, P. troglodytes
tcccgtctctacaaaa

SEQ ID NO: 266994 - DNA, 16 bp, P. troglodytes
tccctaaatgctggga

SEQ ID NO: 266995 - DNA, 16 bp, P. troglodytes
tccctaatcagaaaat

SEQ ID NO: 266996 - DNA, 16 bp, P. troglodytes
tccctactaaaaatac

SEQ ID NO: 266997 - DNA, 16 bp, P. troglodytes
tccctagcacctagca

SEQ ID NO: 266998 - DNA, 16 bp, P. troglodytes
tccctaggggaagggg

SEQ ID NO: 266999 - DNA, 16 bp, P. troglodytes
tccctagtaaaaatac

SEQ ID NO: 267000 - DNA, 16 bp, P. troglodytes
tccctatctgacagct

SEQ ID NO: 267001 - DNA, 16 bp, P. troglodytes
tccctatgatttcatc

SEQ ID NO: 267002 - DNA, 16 bp, P. troglodytes
tccctatttaaaaaaa

SEQ ID NO: 267003 - DNA, 16 bp, P. troglodytes
tccctcaactgtaaaa

SEQ ID NO: 267004 - DNA, 16 bp, P. troglodytes
tccctcaaggagctca

SEQ ID NO: 267005 - DNA, 16 bp, P. troglodytes
tccctcacctgtaaaa

SEQ ID NO: 267006 - DNA, 16 bp, P. troglodytes
tccctcagcccctggc

SEQ ID NO: 267007 - DNA, 16 bp, P. troglodytes
tccctcagcctctgga

SEQ ID NO: 267008 - DNA, 16 bp, P. troglodytes
tccctccaccttggcc

SEQ ID NO: 267009 - DNA, 16 bp, P. troglodytes
tccctcctcagccacc

SEQ ID NO: 267010 - DNA, 16 bp, P. troglodytes
tccctcctccaggaag

SEQ ID NO: 267011 - DNA, 16 bp, P. troglodytes
tccctcctcccagcct

SEQ ID NO: 267012 - DNA, 16 bp, P. troglodytes
tccctcctcctgggag

SEQ ID NO: 267013 - DNA, 16 bp, P. troglodytes
tccctcctctagccaa

SEQ ID NO: 267014 - DNA, 16 bp, P. troglodytes
tccctcctgccaccct

SEQ ID NO: 267015 - DNA, 16 bp, P. troglodytes
tccctcctgctctggc

SEQ ID NO: 267016 - DNA, 16 bp, P. troglodytes
tccctcctggctgcct

SEQ ID NO: 267017 - DNA, 16 bp, P. troglodytes
tccctccttagcctcc

SEQ ID NO: 267018 - DNA, 16 bp, P. troglodytes
tccctccttttcaatt

SEQ ID NO: 267019 - DNA, 16 bp, P. troglodytes
tccctctcctgccacc

SEQ ID NO: 267020 - DNA, 16 bp, P. troglodytes
tccctctctgggcctc

SEQ ID NO: 267021 - DNA, 16 bp, P. troglodytes
tccctctctgtcaccc

SEQ ID NO: 267022 - DNA, 16 bp, P. troglodytes
tccctctgatgcccag

SEQ ID NO: 267023 - DNA, 16 bp, P. troglodytes
tccctctgcccagtcc

SEQ ID NO: 267024 - DNA, 16 bp, P. troglodytes
tccctctgcctggaat

SEQ ID NO: 267025 - DNA, 16 bp, P. troglodytes
tccctctgctgtgtgc

SEQ ID NO: 267026 - DNA, 16 bp, P. troglodytes
tccctctgggtccctc

SEQ ID NO: 267027 - DNA, 16 bp, P. troglodytes
tccctctgtccccagg

SEQ ID NO: 267028 - DNA, 16 bp, P. troglodytes
tccctctgtccctctg

SEQ ID NO: 267029 - DNA, 16 bp, P. troglodytes
tccctctgtgtgtctg

SEQ ID NO: 267030 - DNA, 16 bp, P. troglodytes
tccctcttggccaagg

SEQ ID NO: 267031 - DNA, 16 bp, P. troglodytes
tccctgaaagagatgg

SEQ ID NO: 267032 - DNA, 16 bp, P. troglodytes
tccctgaagcctcccc

SEQ ID NO: 267033 - DNA, 16 bp, P. troglodytes
tccctgaatgacctca

SEQ ID NO: 267034 - DNA, 16 bp, P. troglodytes
tccctgacctctgacc

SEQ ID NO: 267035 - DNA, 16 bp, P. troglodytes
tccctgagacagagca

SEQ ID NO: 267036 - DNA, 16 bp, P. troglodytes
tccctgagactcagtt

SEQ ID NO: 267037 - DNA, 16 bp, P. troglodytes
tccctgagcccaggag

SEQ ID NO: 267038 - DNA, 16 bp, P. troglodytes
tccctgagcctgtttc

SEQ ID NO: 267039 - DNA, 16 bp, P. troglodytes
tccctgaggccctcac

SEQ ID NO: 267040 - DNA, 16 bp, P. troglodytes
tccctgaggcctcccc

SEQ ID NO: 267041 - DNA, 16 bp, P. troglodytes
tccctgaggcctctcc

SEQ ID NO: 267042 - DNA, 16 bp, P. troglodytes
tccctgaggccttccc

SEQ ID NO: 267043 - DNA, 16 bp, P. troglodytes
tccctgaggctctgtt

SEQ ID NO: 267044 - DNA, 16 bp, P. troglodytes
tccctgaggcttcccc

SEQ ID NO: 267045 - DNA, 16 bp, P. troglodytes
tccctgatgaacatgg

SEQ ID NO: 267046 - DNA, 16 bp, P. troglodytes
tccctgatgccaaaaa

SEQ ID NO: 267047 - DNA, 16 bp, P. troglodytes
tccctgcaaaggaaat

SEQ ID NO: 267048 - DNA, 16 bp, P. troglodytes
tccctgcactttggaa

SEQ ID NO: 267049 - DNA, 16 bp, P. troglodytes
tccctgcaggaactcc

SEQ ID NO: 267050 - DNA, 16 bp, P. troglodytes
tccctgcagtttggga

SEQ ID NO: 267051 - DNA, 16 bp, P. troglodytes
tccctgccagctcaag

SEQ ID NO: 267052 - DNA, 16 bp, P. troglodytes
tccctgcccccacaca

SEQ ID NO: 267053 - DNA, 16 bp, P. troglodytes
tccctgccctcagggg

SEQ ID NO: 267054 - DNA, 16 bp, P. troglodytes
tccctgccctcatgga

SEQ ID NO: 267055 - DNA, 16 bp, P. troglodytes
tccctgccctgccctg

SEQ ID NO: 267056 - DNA, 16 bp, P. troglodytes
tccctgcccttaagga

SEQ ID NO: 267057 - DNA, 16 bp, P. troglodytes
tccctgcccttgagaa

SEQ ID NO: 267058 - DNA, 16 bp, P. troglodytes
tccctgcctctgccag

SEQ ID NO: 267059 - DNA, 16 bp, P. troglodytes
tccctgctccatctca

SEQ ID NO: 267060 - DNA, 16 bp, P. troglodytes
tccctgctccctgggg

SEQ ID NO: 267061 - DNA, 16 bp, P. troglodytes
tccctgctgctgctgc

SEQ ID NO: 267062 - DNA, 16 bp, P. troglodytes
tccctgcttccattct

SEQ ID NO: 267063 - DNA, 16 bp, P. troglodytes
tccctgctttgagttg

SEQ ID NO: 267064 - DNA, 16 bp, P. troglodytes
tccctggaatctgtga

SEQ ID NO: 267065 - DNA, 16 bp, P. troglodytes
tccctggagcctggga

SEQ ID NO: 267066 - DNA, 16 bp, P. troglodytes
tccctggattaccagg

SEQ ID NO: 267067 - DNA, 16 bp, P. troglodytes
tccctggcagccacca

SEQ ID NO: 267068 - DNA, 16 bp, P. troglodytes
tccctggcccctccca

SEQ ID NO: 267069 - DNA, 16 bp, P. troglodytes
tccctggcctcagcct

SEQ ID NO: 267070 - DNA, 16 bp, P. troglodytes
tccctggcctccaccc

SEQ ID NO: 267071 - DNA, 16 bp, P. troglodytes
tccctggcctccacct

SEQ ID NO: 267072 - DNA, 16 bp, P. troglodytes
tccctggcttatttca

SEQ ID NO: 267073 - DNA, 16 bp, P. troglodytes
tccctgggattcaagg

SEQ ID NO: 267074 - DNA, 21 bp, P. troglodytes
tccctgggcaatggaatgtct

SEQ ID NO: 267075 - DNA, 16 bp, P. troglodytes
tccctgggcctcagtt

SEQ ID NO: 267076 - DNA, 16 bp, P. troglodytes
tccctgggctcaagca

SEQ ID NO: 267077 - DNA, 16 bp, P. troglodytes
tccctggtgacctgtg

SEQ ID NO: 267078 - DNA, 16 bp, P. troglodytes
tccctgtctctggtgc

SEQ ID NO: 267079 - DNA, 16 bp, P. troglodytes
tccctgtctctttcag

SEQ ID NO: 267080 - DNA, 16 bp, P. troglodytes
tccctgtctgtaaaat

SEQ ID NO: 267081 - DNA, 16 bp, P. troglodytes
tccctgtcttgttcca

SEQ ID NO: 267082 - DNA, 16 bp, P. troglodytes
tccctgtgtccatgta

SEQ ID NO: 267083 - DNA, 16 bp, P. troglodytes
tccctgttccctgaga

SEQ ID NO: 267084 - DNA, 16 bp, P. troglodytes
tccctgtttctcaccc

SEQ ID NO: 267085 - DNA, 16 bp, P. troglodytes
tccctgttttcctgct

SEQ ID NO: 267086 - DNA, 16 bp, P. troglodytes
tcccttaaggacttct

SEQ ID NO: 267087 - DNA, 16 bp, P. troglodytes
tcccttatgaatatag

SEQ ID NO: 267088 - DNA, 16 bp, P. troglodytes
tcccttcacagattcc

SEQ ID NO: 267089 - DNA, 16 bp, P. troglodytes
tcccttcacagatttt

SEQ ID NO: 267090 - DNA, 16 bp, P. troglodytes
tcccttccctagccaa

SEQ ID NO: 267091 - DNA, 16 bp, P. troglodytes
tcccttctccccagcc

SEQ ID NO: 267092 - DNA, 16 bp, P. troglodytes
tcccttctctttgcca

SEQ ID NO: 267093 - DNA, 16 bp, P. troglodytes
tcccttgaaccctgga

SEQ ID NO: 267094 - DNA, 16 bp, P. troglodytes
tcccttgactccatgt

SEQ ID NO: 267095 - DNA, 16 bp, P. troglodytes
tcccttgagccaggga

SEQ ID NO: 267096 - DNA, 16 bp, P. troglodytes
tcccttgcctattttt

SEQ ID NO: 267097 - DNA, 16 bp, P. troglodytes
tcccttgcctcttcca

SEQ ID NO: 267098 - DNA, 16 bp, P. troglodytes
tcccttgtctcagatg

SEQ ID NO: 267099 - DNA, 16 bp, P. troglodytes
tccctttcacctatga

SEQ ID NO: 267100 - DNA, 16 bp, P. troglodytes
tccctttccaagtcaa

SEQ ID NO: 267101 - DNA, 16 bp, P. troglodytes
tccctttccccagccc

SEQ ID NO: 267102 - DNA, 16 bp, P. troglodytes
tccctttccgagtcaa

SEQ ID NO: 267103 - DNA, 16 bp, P. troglodytes
tccctttcctagtcaa

SEQ ID NO: 267104 - DNA, 16 bp, P. troglodytes
tccctttcctctgcag

SEQ ID NO: 267105 - DNA, 16 bp, P. troglodytes
tccctttgtgtgtgtg

SEQ ID NO: 267106 - DNA, 16 bp, P. troglodytes
tccctttgttttcagt

SEQ ID NO: 267107 - DNA, 16 bp, P. troglodytes
tcccttttaacaaaaa

SEQ ID NO: 267108 - DNA, 16 bp, P. troglodytes
tcccttttataaaatg

SEQ ID NO: 267109 - DNA, 16 bp, P. troglodytes
tcccttttgcttttca

SEQ ID NO: 267110 - DNA, 16 bp, P. troglodytes
tccctttttctccaca

SEQ ID NO: 267111 - DNA, 16 bp, P. troglodytes
tccctttttttgtcta

SEQ ID NO: 267112 - DNA, 17 bp, P. troglodytes
tccgaacatcagaagga

SEQ ID NO: 267113 - DNA, 16 bp, P. troglodytes
tccgacaatgatagac

SEQ ID NO: 267114 - DNA, 16 bp, P. troglodytes
tccgactcctgggctc

SEQ ID NO: 267115 - DNA, 16 bp, P. troglodytes
tccgaggcgggcggat

SEQ ID NO: 267116 - DNA, 16 bp, P. troglodytes
tccgaggctgcagtga

SEQ ID NO: 267117 - DNA, 17 bp, P. troglodytes
tccgaggtgggcggatc

SEQ ID NO: 267118 - DNA, 19 bp, P. troglodytes
tccgcagttcccaggaatt

SEQ ID NO: 267119 - DNA, 16 bp, P. troglodytes
tccgccaccacgccca

SEQ ID NO: 267120 - DNA, 21 bp, P. troglodytes
tccgcccaccttggcctccca

SEQ ID NO: 267121 - DNA, 16 bp, P. troglodytes
tccgcccagctcggcc

SEQ ID NO: 267122 - DNA, 17 bp, P. troglodytes
tccgcctccagggttca

SEQ ID NO: 267123 - DNA, 17 bp, P. troglodytes
tccgcctcccaggctca

SEQ ID NO: 267124 - DNA, 17 bp, P. troglodytes
tccgcctcctggattca

SEQ ID NO: 267125 - DNA, 19 bp, P. troglodytes
tccgcctcctggattcaag

SEQ ID NO: 267126 - DNA, 17 bp, P. troglodytes
tccgcctcctgggttcg

SEQ ID NO: 267127 - DNA, 16 bp, P. troglodytes
tccgcctcctgtgttc

SEQ ID NO: 267128 - DNA, 16 bp, P. troglodytes
tccgcctgcctcgacc

SEQ ID NO: 267129 - DNA, 16 bp, P. troglodytes
tccgcctgcctcggcc

SEQ ID NO: 267130 - DNA, 16 bp, P. troglodytes
tccgccttcctcggcc

SEQ ID NO: 267131 - DNA, 17 bp, P. troglodytes
tccgccttctgggttca

SEQ ID NO: 267132 - DNA, 16 bp, P. troglodytes
tccgctccctgtgtcc

SEQ ID NO: 267133 - DNA, 18 bp, P. troglodytes
tccggagtagctgggatt

SEQ ID NO: 267134 - DNA, 16 bp, P. troglodytes
tccggccgcctcagcc

SEQ ID NO: 267135 - DNA, 20 bp, P. troglodytes
tccggctaatttttgtattt

SEQ ID NO: 267136 - DNA, 16 bp, P. troglodytes
tccgggaggccgaggc

SEQ ID NO: 267137 - DNA, 16 bp, P. troglodytes
tccgggaggcggagct

SEQ ID NO: 267138 - DNA, 16 bp, P. troglodytes
tccgggaggctgaggc

SEQ ID NO: 267139 - DNA, 16 bp, P. troglodytes
tccgggaggtgagggg

SEQ ID NO: 267140 - DNA, 16 bp, P. troglodytes
tccgggccccaggccc

SEQ ID NO: 267141 - DNA, 19 bp, P. troglodytes
tccgggttcaagcgattct

SEQ ID NO: 267142 - DNA, 16 bp, P. troglodytes
tccgtctgcctcagcc

SEQ ID NO: 267143 - DNA, 16 bp, P. troglodytes
tccgtgaggccaagaa

SEQ ID NO: 267144 - DNA, 16 bp, P. troglodytes
tccgtgcctcagtttc

SEQ ID NO: 267145 - DNA, 16 bp, P. troglodytes
tccgtggaaaaattgt

SEQ ID NO: 267146 - DNA, 16 bp, P. troglodytes
tcctaaaagaaaacat

SEQ ID NO: 267147 - DNA, 16 bp, P. troglodytes
tcctaaaatgtgtatg

SEQ ID NO: 267148 - DNA, 16 bp, P. troglodytes
tcctaaaccaaaagaa

SEQ ID NO: 267149 - DNA, 16 bp, P. troglodytes
tcctaaagtcctggga

SEQ ID NO: 267150 - DNA, 18 bp, P. troglodytes
tcctaaagtgctggaatt

SEQ ID NO: 267151 - DNA, 16 bp, P. troglodytes
tcctaacaacaacaac

SEQ ID NO: 267152 - DNA, 16 bp, P. troglodytes
tcctaacatggtgaaa

SEQ ID NO: 267153 - DNA, 16 bp, P. troglodytes
tcctaagagccagggg

SEQ ID NO: 267154 - DNA, 16 bp, P. troglodytes
tcctaagcacaaagaa

SEQ ID NO: 267155 - DNA, 16 bp, P. troglodytes
tcctaagtagctggga

SEQ ID NO: 267156 - DNA, 18 bp, P. troglodytes
tcctaataagcctgggag

SEQ ID NO: 267157 - DNA, 16 bp, P. troglodytes
tcctaatctccttttc

SEQ ID NO: 267158 - DNA, 16 bp, P. troglodytes
tcctaatgctctccct

SEQ ID NO: 267159 - DNA, 16 bp, P. troglodytes
tcctaccccagggcct

SEQ ID NO: 267160 - DNA, 16 bp, P. troglodytes
tcctacctcaacctct

SEQ ID NO: 267161 - DNA, 17 bp, P. troglodytes
tcctacctcagcctcct

SEQ ID NO: 267162 - DNA, 16 bp, P. troglodytes
tcctacctcagcctct

SEQ ID NO: 267163 - DNA, 16 bp, P. troglodytes
tcctacctcggcttcc

SEQ ID NO: 267164 - DNA, 16 bp, P. troglodytes
tcctactctgtcaccc

SEQ ID NO: 267165 - DNA, 16 bp, P. troglodytes
tcctactgctgggtat

SEQ ID NO: 267166 - DNA, 16 bp, P. troglodytes
tcctactgggtccctc

SEQ ID NO: 267167 - DNA, 16 bp, P. troglodytes
tcctacttcagcctcc

SEQ ID NO: 267168 - DNA, 16 bp, P. troglodytes
tcctagaagaaaaaaa

SEQ ID NO: 267169 - DNA, 17 bp, P. troglodytes
tcctagactcaagtgat

SEQ ID NO: 267170 - DNA, 16 bp, P. troglodytes
tcctagcacagtgcct

SEQ ID NO: 267171 - DNA, 16 bp, P. troglodytes
tcctagccagagaaat

SEQ ID NO: 267172 - DNA, 16 bp, P. troglodytes
tcctagctactttgga

SEQ ID NO: 267173 - DNA, 16 bp, P. troglodytes
tcctagctctaccact

SEQ ID NO: 267174 - DNA, 16 bp, P. troglodytes
tcctagctgctgggga

SEQ ID NO: 267175 - DNA, 16 bp, P. troglodytes
tcctaggcagacaggg

SEQ ID NO: 267176 - DNA, 16 bp, P. troglodytes
tcctaggctcaagcca

SEQ ID NO: 267177 - DNA, 16 bp, P. troglodytes
tcctaggtattatatt

SEQ ID NO: 267178 - DNA, 16 bp, P. troglodytes
tcctaggtcctcccaa

SEQ ID NO: 267179 - DNA, 17 bp, P. troglodytes
tcctaggttcaagcgat

SEQ ID NO: 267180 - DNA, 16 bp, P. troglodytes
tcctagtgggtgtgaa

SEQ ID NO: 267181 - DNA, 16 bp, P. troglodytes
tcctagttcactgcag

SEQ ID NO: 267182 - DNA, 16 bp, P. troglodytes
tcctataattcccatg

SEQ ID NO: 267183 - DNA, 16 bp, P. troglodytes
tcctatcagatcaggg

SEQ ID NO: 267184 - DNA, 16 bp, P. troglodytes
tcctatgaaaatctaa

SEQ ID NO: 267185 - DNA, 16 bp, P. troglodytes
tcctatggagttgttt

SEQ ID NO: 267186 - DNA, 16 bp, P. troglodytes
tcctatgtattttatt

SEQ ID NO: 267187 - DNA, 16 bp, P. troglodytes
tcctatgttgaaatct

SEQ ID NO: 267188 - DNA, 16 bp, P. troglodytes
tcctatgttgggtgca

SEQ ID NO: 267189 - DNA, 16 bp, P. troglodytes
tcctattataaagata

SEQ ID NO: 267190 - DNA, 16 bp, P. troglodytes
tcctattcacaattgc

SEQ ID NO: 267191 - DNA, 16 bp, P. troglodytes
tcctattcatccttca

SEQ ID NO: 267192 - DNA, 16 bp, P. troglodytes
tcctatttaataaatg

SEQ ID NO: 267193 - DNA, 16 bp, P. troglodytes
tcctatttcagcctcc

SEQ ID NO: 267194 - DNA, 16 bp, P. troglodytes
tcctatttgtctattt

SEQ ID NO: 267195 - DNA, 16 bp, P. troglodytes
tcctattttgattaat

SEQ ID NO: 267196 - DNA, 16 bp, P. troglodytes
tcctcaaaaatctaaa

SEQ ID NO: 267197 - DNA, 16 bp, P. troglodytes
tcctcaaaacaatcct

SEQ ID NO: 267198 - DNA, 16 bp, P. troglodytes
tcctcaaaagcaaatg

SEQ ID NO: 267199 - DNA, 16 bp, P. troglodytes
tcctcaaatatttatt

SEQ ID NO: 267200 - DNA, 16 bp, P. troglodytes
tcctcaaatttatatg

SEQ ID NO: 267201 - DNA, 16 bp, P. troglodytes
tcctcaacttacaatg

SEQ ID NO: 267202 - DNA, 16 bp, P. troglodytes
tcctcaagaaattaaa

SEQ ID NO: 267203 - DNA, 16 bp, P. troglodytes
tcctcaagacaatggg

SEQ ID NO: 267204 - DNA, 16 bp, P. troglodytes
tcctcaaggatttaga

SEQ ID NO: 267205 - DNA, 16 bp, P. troglodytes
tcctcacaacaaccct

SEQ ID NO: 267206 - DNA, 16 bp, P. troglodytes
tcctcacaacagtcct

SEQ ID NO: 267207 - DNA, 16 bp, P. troglodytes
tcctcacaacatggtg

SEQ ID NO: 267208 - DNA, 16 bp, P. troglodytes
tcctcacaataaccct

SEQ ID NO: 267209 - DNA, 16 bp, P. troglodytes
tcctcacaataacctt

SEQ ID NO: 267210 - DNA, 16 bp, P. troglodytes
tcctcacaattcaaaa

SEQ ID NO: 267211 - DNA, 16 bp, P. troglodytes
tcctcacagcaaccct

SEQ ID NO: 267212 - DNA, 16 bp, P. troglodytes
tcctcacagcagccct

SEQ ID NO: 267213 - DNA, 16 bp, P. troglodytes
tcctcacatggtggaa

SEQ ID NO: 267214 - DNA, 16 bp, P. troglodytes
tcctcacatttgaaaa

SEQ ID NO: 267215 - DNA, 16 bp, P. troglodytes
tcctcaccaacactta

SEQ ID NO: 267216 - DNA, 16 bp, P. troglodytes
tcctcaccagaaccca

SEQ ID NO: 267217 - DNA, 17 bp, P. troglodytes
tcctcacccaaatctca

SEQ ID NO: 267218 - DNA, 16 bp, P. troglodytes
tcctcaccctcctgag

SEQ ID NO: 267219 - DNA, 16 bp, P. troglodytes
tcctcacctcagatga

SEQ ID NO: 267220 - DNA, 16 bp, P. troglodytes
tcctcacctccatctg

SEQ ID NO: 267221 - DNA, 18 bp, P. troglodytes
tcctcactgctacactcc

SEQ ID NO: 267222 - DNA, 16 bp, P. troglodytes
tcctcactgggtgggg

SEQ ID NO: 267223 - DNA, 16 bp, P. troglodytes
tcctcacttataaaat

SEQ ID NO: 267224 - DNA, 16 bp, P. troglodytes
tcctcacttcaggtga

SEQ ID NO: 267225 - DNA, 16 bp, P. troglodytes
tcctcacttggggctg

SEQ ID NO: 267226 - DNA, 16 bp, P. troglodytes
tcctcagaaagctaaa

SEQ ID NO: 267227 - DNA, 16 bp, P. troglodytes
tcctcagaagcatgtg

SEQ ID NO: 267228 - DNA, 16 bp, P. troglodytes
tcctcagacaaaggtg

SEQ ID NO: 267229 - DNA, 22 bp, P. troglodytes
tcctcagaccgaccagcccaag

SEQ ID NO: 267230 - DNA, 16 bp, P. troglodytes
tcctcagccacctgag

SEQ ID NO: 267231 - DNA, 21 bp, P. troglodytes
tcctcagcctcccgagtagct

SEQ ID NO: 267232 - DNA, 16 bp, P. troglodytes
tcctcagccttctgag

SEQ ID NO: 267233 - DNA, 16 bp, P. troglodytes
tcctcagcctttcttt

SEQ ID NO: 267234 - DNA, 16 bp, P. troglodytes
tcctcaggacccaccc

SEQ ID NO: 267235 - DNA, 16 bp, P. troglodytes
tcctcagggacctaga

SEQ ID NO: 267236 - DNA, 16 bp, P. troglodytes
tcctcagggagcccca

SEQ ID NO: 267237 - DNA, 16 bp, P. troglodytes
tcctcagggatccaga

SEQ ID NO: 267238 - DNA, 16 bp, P. troglodytes
tcctcagtcttttctt

SEQ ID NO: 267239 - DNA, 16 bp, P. troglodytes
tcctcagtgttggagg

SEQ ID NO: 267240 - DNA, 16 bp, P. troglodytes
tcctcatacataaaat

SEQ ID NO: 267241 - DNA, 16 bp, P. troglodytes
tcctcatcagcaatgg

SEQ ID NO: 267242 - DNA, 16 bp, P. troglodytes
tcctcatcctcatcct

SEQ ID NO: 267243 - DNA, 16 bp, P. troglodytes
tcctcatctagaaaat

SEQ ID NO: 267244 - DNA, 16 bp, P. troglodytes
tcctcatctataaaat

SEQ ID NO: 267245 - DNA, 16 bp, P. troglodytes
tcctcatctataaatg

SEQ ID NO: 267246 - DNA, 16 bp, P. troglodytes
tcctcatctctaaaac

SEQ ID NO: 267247 - DNA, 16 bp, P. troglodytes
tcctcatctgtaaaac

SEQ ID NO: 267248 - DNA, 16 bp, P. troglodytes
tcctcatctgtaaaga

SEQ ID NO: 267249 - DNA, 16 bp, P. troglodytes
tcctcatcttcatgga

SEQ ID NO: 267250 - DNA, 16 bp, P. troglodytes
tcctcatcttcctgtc

SEQ ID NO: 267251 - DNA, 16 bp, P. troglodytes
tcctcatgataatgag

SEQ ID NO: 267252 - DNA, 16 bp, P. troglodytes
tcctcattcaccttcc

SEQ ID NO: 267253 - DNA, 16 bp, P. troglodytes
tcctcatttctgtctg

SEQ ID NO: 267254 - DNA, 16 bp, P. troglodytes
tcctcatttcttgttt

SEQ ID NO: 267255 - DNA, 16 bp, P. troglodytes
tcctcatttgccttcc

SEQ ID NO: 267256 - DNA, 16 bp, P. troglodytes
tcctcattttaaagat

SEQ ID NO: 267257 - DNA, 16 bp, P. troglodytes
tcctccacctctgcct

SEQ ID NO: 267258 - DNA, 16 bp, P. troglodytes
tcctccactgaaatct

SEQ ID NO: 267259 - DNA, 16 bp, P. troglodytes
tcctccagccccagcc

SEQ ID NO: 267260 - DNA, 16 bp, P. troglodytes
tcctccagcccccaga

SEQ ID NO: 267261 - DNA, 16 bp, P. troglodytes
tcctccagcctcaacc

SEQ ID NO: 267262 - DNA, 16 bp, P. troglodytes
tcctccagctcctcct

SEQ ID NO: 267263 - DNA, 16 bp, P. troglodytes
tcctccagcttcagcc

SEQ ID NO: 267264 - DNA, 16 bp, P. troglodytes
tcctccagcttctggt

SEQ ID NO: 267265 - DNA, 16 bp, P. troglodytes
tcctccaggaagtctt

SEQ ID NO: 267266 - DNA, 16 bp, P. troglodytes
tcctccaggcagcctt

SEQ ID NO: 267267 - DNA, 16 bp, P. troglodytes
tcctccaggtacagtc

SEQ ID NO: 267268 - DNA, 16 bp, P. troglodytes
tcctccatcctcagcc

SEQ ID NO: 267269 - DNA, 16 bp, P. troglodytes
tcctccatcttcaaag

SEQ ID NO: 267270 - DNA, 16 bp, P. troglodytes
tcctccatttttaaaa

SEQ ID NO: 267271 - DNA, 16 bp, P. troglodytes
tcctcccaccccagct

SEQ ID NO: 267272 - DNA, 16 bp, P. troglodytes
tcctcccaccctggcc

SEQ ID NO: 267273 - DNA, 16 bp, P. troglodytes
tcctcccacctaagcc

SEQ ID NO: 267274 - DNA, 16 bp, P. troglodytes
tcctcccacctcagct

SEQ ID NO: 267275 - DNA, 16 bp, P. troglodytes
tcctcccacctccctg

SEQ ID NO: 267276 - DNA, 16 bp, P. troglodytes
tcctcccacctgtctc

SEQ ID NO: 267277 - DNA, 16 bp, P. troglodytes
tcctcccagcagccct

SEQ ID NO: 267278 - DNA, 16 bp, P. troglodytes
tcctcccagctcagcc

SEQ ID NO: 267279 - DNA, 16 bp, P. troglodytes
tcctcccagctgcttt

SEQ ID NO: 267280 - DNA, 16 bp, P. troglodytes
tcctcccaggccctgg

SEQ ID NO: 267281 - DNA, 16 bp, P. troglodytes
tcctcccaggctcaag

SEQ ID NO: 267282 - DNA, 16 bp, P. troglodytes
tcctcccatcctggcc

SEQ ID NO: 267283 - DNA, 16 bp, P. troglodytes
tcctcccatctcagct

SEQ ID NO: 267284 - DNA, 16 bp, P. troglodytes
tcctcccatctctgcc

SEQ ID NO: 267285 - DNA, 16 bp, P. troglodytes
tcctccccagccccag

SEQ ID NO: 267286 - DNA, 16 bp, P. troglodytes
tcctccccctcagcct

SEQ ID NO: 267287 - DNA, 16 bp, P. troglodytes
tcctcccctctgaggt

SEQ ID NO: 267288 - DNA, 17 bp, P. troglodytes
tcctcccgccttggcct

SEQ ID NO: 267289 - DNA, 16 bp, P. troglodytes
tcctcccgggttcaag

SEQ ID NO: 267290 - DNA, 34 bp, P. troglodytes
tcctccctaactcattttatgaggccagcatcat

SEQ ID NO: 267291 - DNA, 16 bp, P. troglodytes
tcctccctcactcatt

SEQ ID NO: 267292 - DNA, 16 bp, P. troglodytes
tcctccctcagactca

SEQ ID NO: 267293 - DNA, 16 bp, P. troglodytes
tcctccctccctgcag

SEQ ID NO: 267294 - DNA, 16 bp, P. troglodytes
tcctccctcctgagcc

SEQ ID NO: 267295 - DNA, 16 bp, P. troglodytes
tcctccctccttagcc

SEQ ID NO: 267296 - DNA, 16 bp, P. troglodytes
tcctccgacctcagcc

SEQ ID NO: 267297 - DNA, 16 bp, P. troglodytes
tcctccgcctcagcct

SEQ ID NO: 267298 - DNA, 16 bp, P. troglodytes
tcctccgcctcctggg

SEQ ID NO: 267299 - DNA, 16 bp, P. troglodytes
tcctcctaaacctcca

SEQ ID NO: 267300 - DNA, 16 bp, P. troglodytes
tcctcctactccagcc

SEQ ID NO: 267301 - DNA, 16 bp, P. troglodytes
tcctcctacttcagct

SEQ ID NO: 267302 - DNA, 16 bp, P. troglodytes
tcctcctcagcctact

SEQ ID NO: 267303 - DNA, 16 bp, P. troglodytes
tcctcctcagcctcca

SEQ ID NO: 267304 - DNA, 16 bp, P. troglodytes
tcctcctcagcctccc

SEQ ID NO: 267305 - DNA, 16 bp, P. troglodytes
tcctcctccaacaagg

SEQ ID NO: 267306 - DNA, 16 bp, P. troglodytes
tcctcctccagaggaa

SEQ ID NO: 267307 - DNA, 16 bp, P. troglodytes
tcctcctccaggaagc

SEQ ID NO: 267308 - DNA, 16 bp, P. troglodytes
tcctcctccctcagac

SEQ ID NO: 267309 - DNA, 16 bp, P. troglodytes
tcctcctccctcagcc

SEQ ID NO: 267310 - DNA, 16 bp, P. troglodytes
tcctcctccctggttc

SEQ ID NO: 267311 - DNA, 16 bp, P. troglodytes
tcctcctcctcctcag

SEQ ID NO: 267312 - DNA, 16 bp, P. troglodytes
tcctcctcctgctgct

SEQ ID NO: 267313 - DNA, 16 bp, P. troglodytes
tcctcctccttcagcc

SEQ ID NO: 267314 - DNA, 16 bp, P. troglodytes
tcctcctgaaggaagg

SEQ ID NO: 267315 - DNA, 16 bp, P. troglodytes
tcctcctgccctcagc

SEQ ID NO: 267316 - DNA, 16 bp, P. troglodytes
tcctcctgcctcagca

SEQ ID NO: 267317 - DNA, 16 bp, P. troglodytes
tcctcctgcctcggcc

SEQ ID NO: 267318 - DNA, 16 bp, P. troglodytes
tcctcctgcctggcct

SEQ ID NO: 267319 - DNA, 16 bp, P. troglodytes
tcctcctgccttgcct

SEQ ID NO: 267320 - DNA, 16 bp, P. troglodytes
tcctcctgctccagct

SEQ ID NO: 267321 - DNA, 16 bp, P. troglodytes
tcctcctgctcccacc

SEQ ID NO: 267322 - DNA, 16 bp, P. troglodytes
tcctcctgctcctgct

SEQ ID NO: 267323 - DNA, 18 bp, P. troglodytes
tcctcctgctctttgctc

SEQ ID NO: 267324 - DNA, 16 bp, P. troglodytes
tcctcctgctgcagcc

SEQ ID NO: 267325 - DNA, 16 bp, P. troglodytes
tcctcctgcttcaacc

SEQ ID NO: 267326 - DNA, 16 bp, P. troglodytes
tcctcctgcttgggcc

SEQ ID NO: 267327 - DNA, 16 bp, P. troglodytes
tcctcctgctttggcc

SEQ ID NO: 267328 - DNA, 16 bp, P. troglodytes
tcctcctgtctaactg

SEQ ID NO: 267329 - DNA, 16 bp, P. troglodytes
tcctcctgtgtagctg

SEQ ID NO: 267330 - DNA, 17 bp, P. troglodytes
tcctccttatacctctg

SEQ ID NO: 267331 - DNA, 16 bp, P. troglodytes
tcctccttcagcctcc

SEQ ID NO: 267332 - DNA, 16 bp, P. troglodytes
tcctccttcctcagct

SEQ ID NO: 267333 - DNA, 16 bp, P. troglodytes
tcctccttctcctcag

SEQ ID NO: 267334 - DNA, 16 bp, P. troglodytes
tcctccttcttcagcc

SEQ ID NO: 267335 - DNA, 16 bp, P. troglodytes
tcctccttgatttttt

SEQ ID NO: 267336 - DNA, 16 bp, P. troglodytes
tcctccttgtcttcca

SEQ ID NO: 267337 - DNA, 16 bp, P. troglodytes
tcctcctttctcagcc

SEQ ID NO: 267338 - DNA, 16 bp, P. troglodytes
tcctcgagaggagcaa

SEQ ID NO: 267339 - DNA, 16 bp, P. troglodytes
tcctcgtctgtaaaat

SEQ ID NO: 267340 - DNA, 16 bp, P. troglodytes
tcctctagaatttgga

SEQ ID NO: 267341 - DNA, 16 bp, P. troglodytes
tcctctcaccacagcc

SEQ ID NO: 267342 - DNA, 16 bp, P. troglodytes
tcctctcacctcagct

SEQ ID NO: 267343 - DNA, 16 bp, P. troglodytes
tcctctcactgcaagc

SEQ ID NO: 267344 - DNA, 16 bp, P. troglodytes
tcctctcagctcagcc

SEQ ID NO: 267345 - DNA, 16 bp, P. troglodytes
tcctctcatctcagcc

SEQ ID NO: 267346 - DNA, 16 bp, P. troglodytes
tcctctccacaggcag

SEQ ID NO: 267347 - DNA, 16 bp, P. troglodytes
tcctctccagcacctg

SEQ ID NO: 267348 - DNA, 16 bp, P. troglodytes
tcctctccagcccctg

SEQ ID NO: 267349 - DNA, 16 bp, P. troglodytes
tcctctccagtacctg

SEQ ID NO: 267350 - DNA, 16 bp, P. troglodytes
tcctctcccagtggag

SEQ ID NO: 267351 - DNA, 16 bp, P. troglodytes
tcctctccctgctctg

SEQ ID NO: 267352 - DNA, 16 bp, P. troglodytes
tcctctcctgcctggg

SEQ ID NO: 267353 - DNA, 16 bp, P. troglodytes
tcctctctccctctgg

SEQ ID NO: 267354 - DNA, 16 bp, P. troglodytes
tcctctctcttcagcc

SEQ ID NO: 267355 - DNA, 16 bp, P. troglodytes
tcctctctggacaggg

SEQ ID NO: 267356 - DNA, 16 bp, P. troglodytes
tcctctctggctgccc

SEQ ID NO: 267357 - DNA, 16 bp, P. troglodytes
tcctctctgggcagga

SEQ ID NO: 267358 - DNA, 16 bp, P. troglodytes
tcctctctgttgaccc

SEQ ID NO: 267359 - DNA, 16 bp, P. troglodytes
tcctctcttccagcta

SEQ ID NO: 267360 - DNA, 16 bp, P. troglodytes
tcctctgactgtattt

SEQ ID NO: 267361 - DNA, 16 bp, P. troglodytes
tcctctgcctcctgag

SEQ ID NO: 267362 - DNA, 16 bp, P. troglodytes
tcctctgcctctgcct

SEQ ID NO: 267363 - DNA, 16 bp, P. troglodytes
tcctctgccttggcct

SEQ ID NO: 267364 - DNA, 16 bp, P. troglodytes
tcctctggcctcggcc

SEQ ID NO: 267365 - DNA, 16 bp, P. troglodytes
tcctctgggaagtctt

SEQ ID NO: 267366 - DNA, 16 bp, P. troglodytes
tcctctgtaaaacagg

SEQ ID NO: 267367 - DNA, 16 bp, P. troglodytes
tcctctgtaaaatgag

SEQ ID NO: 267368 - DNA, 16 bp, P. troglodytes
tcctctgtaaagtggg

SEQ ID NO: 267369 - DNA, 16 bp, P. troglodytes
tcctctgtgctctgct

SEQ ID NO: 267370 - DNA, 16 bp, P. troglodytes
tcctctgtgtgtgtgt

SEQ ID NO: 267371 - DNA, 16 bp, P. troglodytes
tcctctgttttctgaa

SEQ ID NO: 267372 - DNA, 16 bp, P. troglodytes
tcctcttataaggaca

SEQ ID NO: 267373 - DNA, 17 bp, P. troglodytes
tcctcttcaacacagta

SEQ ID NO: 267374 - DNA, 16 bp, P. troglodytes
tcctcttcagcacctg

SEQ ID NO: 267375 - DNA, 16 bp, P. troglodytes
tcctcttcagcctccc

SEQ ID NO: 267376 - DNA, 16 bp, P. troglodytes
tcctcttcagtaaaat

SEQ ID NO: 267377 - DNA, 16 bp, P. troglodytes
tcctcttcatcttcca

SEQ ID NO: 267378 - DNA, 16 bp, P. troglodytes
tcctcttcccaggttc

SEQ ID NO: 267379 - DNA, 16 bp, P. troglodytes
tcctcttcctcagcct

SEQ ID NO: 267380 - DNA, 16 bp, P. troglodytes
tcctcttcctccccag

SEQ ID NO: 267381 - DNA, 16 bp, P. troglodytes
tcctcttcctcctcag

SEQ ID NO: 267382 - DNA, 16 bp, P. troglodytes
tcctcttcctcctgga

SEQ ID NO: 267383 - DNA, 16 bp, P. troglodytes
tcctcttctacaaaat

SEQ ID NO: 267384 - DNA, 16 bp, P. troglodytes
tcctcttctgaaaaat

SEQ ID NO: 267385 - DNA, 16 bp, P. troglodytes
tcctcttctgtaaagt

SEQ ID NO: 267386 - DNA, 16 bp, P. troglodytes
tcctcttgctcctgct

SEQ ID NO: 267387 - DNA, 16 bp, P. troglodytes
tcctcttgcttcagcc

SEQ ID NO: 267388 - DNA, 16 bp, P. troglodytes
tcctcttggctatgac

SEQ ID NO: 267389 - DNA, 16 bp, P. troglodytes
tcctcttgggttcaag

SEQ ID NO: 267390 - DNA, 16 bp, P. troglodytes
tcctcttttatttcgt

SEQ ID NO: 267391 - DNA, 16 bp, P. troglodytes
tcctgaaaaagaagaa

SEQ ID NO: 267392 - DNA, 16 bp, P. troglodytes
tcctgaaagcagcaag

SEQ ID NO: 267393 - DNA, 16 bp, P. troglodytes
tcctgaaaggtattgc

SEQ ID NO: 267394 - DNA, 16 bp, P. troglodytes
tcctgaacaaaaagaa

SEQ ID NO: 267395 - DNA, 16 bp, P. troglodytes
tcctgaacagctggga

SEQ ID NO: 267396 - DNA, 17 bp, P. troglodytes
tcctgaactcaggtgat

SEQ ID NO: 267397 - DNA, 16 bp, P. troglodytes
tcctgaactcgtgatc

SEQ ID NO: 267398 - DNA, 16 bp, P. troglodytes
tcctgaagaaacagag

SEQ ID NO: 267399 - DNA, 16 bp, P. troglodytes
tcctgaagaccttcct

SEQ ID NO: 267400 - DNA, 16 bp, P. troglodytes
tcctgaagcagctgga

SEQ ID NO: 267401 - DNA, 16 bp, P. troglodytes
tcctgaaggaagccct

SEQ ID NO: 267402 - DNA, 16 bp, P. troglodytes
tcctgaagtgggtccc

SEQ ID NO: 267403 - DNA, 16 bp, P. troglodytes
tcctgaataactactg

SEQ ID NO: 267404 - DNA, 16 bp, P. troglodytes
tcctgaatacagcaca

SEQ ID NO: 267405 - DNA, 16 bp, P. troglodytes
tcctgaatagctggaa

SEQ ID NO: 267406 - DNA, 16 bp, P. troglodytes
tcctgaatggctggga

SEQ ID NO: 267407 - DNA, 16 bp, P. troglodytes
tcctgaatttaaatgt

SEQ ID NO: 267408 - DNA, 16 bp, P. troglodytes
tcctgaattttctttt

SEQ ID NO: 267409 - DNA, 16 bp, P. troglodytes
tcctgaatttttaatg

SEQ ID NO: 267410 - DNA, 16 bp, P. troglodytes
tcctgacacacagaaa

SEQ ID NO: 267411 - DNA, 18 bp, P. troglodytes
tcctgacattttaatgat

SEQ ID NO: 267412 - DNA, 16 bp, P. troglodytes
tcctgacccacagaaa

SEQ ID NO: 267413 - DNA, 16 bp, P. troglodytes
tcctgaccctcagaaa

SEQ ID NO: 267414 - DNA, 16 bp, P. troglodytes
tcctgaccctctccct

SEQ ID NO: 267415 - DNA, 16 bp, P. troglodytes
tcctgacctcaagtca

SEQ ID NO: 267416 - DNA, 16 bp, P. troglodytes
tcctgacctcagatgg

SEQ ID NO: 267417 - DNA, 18 bp, P. troglodytes
tcctgacctcaggttatc

SEQ ID NO: 267418 - DNA, 16 bp, P. troglodytes
tcctgacctcgtgacc

SEQ ID NO: 267419 - DNA, 17 bp, P. troglodytes
tcctgaccttaagtgat

SEQ ID NO: 267420 - DNA, 16 bp, P. troglodytes
tcctgactagctggga

SEQ ID NO: 267421 - DNA, 16 bp, P. troglodytes
tcctgactcccaggcc

SEQ ID NO: 267422 - DNA, 16 bp, P. troglodytes
tcctgacttcaggcga

SEQ ID NO: 267423 - DNA, 16 bp, P. troglodytes
tcctgagaccttgctg

SEQ ID NO: 267424 - DNA, 16 bp, P. troglodytes
tcctgagatttatttt

SEQ ID NO: 267425 - DNA, 16 bp, P. troglodytes
tcctgagcccagcaag

SEQ ID NO: 267426 - DNA, 17 bp, P. troglodytes
tcctgagctcaggcgat

SEQ ID NO: 267427 - DNA, 16 bp, P. troglodytes
tcctgagctccagcga

SEQ ID NO: 267428 - DNA, 16 bp, P. troglodytes
tcctgaggaagaaaag

SEQ ID NO: 267429 - DNA, 16 bp, P. troglodytes
tcctgaggcctcccag

SEQ ID NO: 267430 - DNA, 16 bp, P. troglodytes
tcctgaggcctcccta

SEQ ID NO: 267431 - DNA, 16 bp, P. troglodytes
tcctgaggcctcctga

SEQ ID NO: 267432 - DNA, 16 bp, P. troglodytes
tcctgaggctgtgcag

SEQ ID NO: 267433 - DNA, 16 bp, P. troglodytes
tcctgagggctccacc

SEQ ID NO: 267434 - DNA, 16 bp, P. troglodytes
tcctgaggtcacacag

SEQ ID NO: 267435 - DNA, 17 bp, P. troglodytes
tcctgagtaactggaac

SEQ ID NO: 267436 - DNA, 16 bp, P. troglodytes
tcctgagtacctggaa

SEQ ID NO: 267437 - DNA, 16 bp, P. troglodytes
tcctgagtacctggga

SEQ ID NO: 267438 - DNA, 16 bp, P. troglodytes
tcctgagtagctagga

SEQ ID NO: 267439 - DNA, 16 bp, P. troglodytes
tcctgagtagctggca

SEQ ID NO: 267440 - DNA, 16 bp, P. troglodytes
tcctgagtagctgggc

SEQ ID NO: 267441 - DNA, 16 bp, P. troglodytes
tcctgagtagctggtg

SEQ ID NO: 267442 - DNA, 16 bp, P. troglodytes
tcctgagttcaggtga

SEQ ID NO: 267443 - DNA, 16 bp, P. troglodytes
tcctgagttctgattt

SEQ ID NO: 267444 - DNA, 16 bp, P. troglodytes
tcctgagttcttgtcc

SEQ ID NO: 267445 - DNA, 16 bp, P. troglodytes
tcctgataccaaaagc

SEQ ID NO: 267446 - DNA, 16 bp, P. troglodytes
tcctgataccatcacc

SEQ ID NO: 267447 - DNA, 16 bp, P. troglodytes
tcctgatccacctgcc

SEQ ID NO: 267448 - DNA, 16 bp, P. troglodytes
tcctgatcctctcctt

SEQ ID NO: 267449 - DNA, 17 bp, P. troglodytes
tcctgatctcaggcaat

SEQ ID NO: 267450 - DNA, 16 bp, P. troglodytes
tcctgatgtcatgatc

SEQ ID NO: 267451 - DNA, 16 bp, P. troglodytes
tcctgattctcctgcc

SEQ ID NO: 267452 - DNA, 16 bp, P. troglodytes
tcctgatttaaaaaaa

SEQ ID NO: 267453 - DNA, 16 bp, P. troglodytes
tcctgatttctcagaa

SEQ ID NO: 267454 - DNA, 16 bp, P. troglodytes
tcctgattttcctcct

SEQ ID NO: 267455 - DNA, 16 bp, P. troglodytes
tcctgcaagctccact

SEQ ID NO: 267456 - DNA, 16 bp, P. troglodytes
tcctgcaagctccatt

SEQ ID NO: 267457 - DNA, 16 bp, P. troglodytes
tcctgcacctggaggt

SEQ ID NO: 267458 - DNA, 16 bp, P. troglodytes
tcctgcagagagagag

SEQ ID NO: 267459 - DNA, 16 bp, P. troglodytes
tcctgcagagccacag

SEQ ID NO: 267460 - DNA, 16 bp, P. troglodytes
tcctgcagctgcaggc

SEQ ID NO: 267461 - DNA, 16 bp, P. troglodytes
tcctgcaggagcagtc

SEQ ID NO: 267462 - DNA, 16 bp, P. troglodytes
tcctgcatcaacctcc

SEQ ID NO: 267463 - DNA, 16 bp, P. troglodytes
tcctgcatttttattt

SEQ ID NO: 267464 - DNA, 16 bp, P. troglodytes
tcctgccaacaccttg

SEQ ID NO: 267465 - DNA, 16 bp, P. troglodytes
tcctgccacagcctcc

SEQ ID NO: 267466 - DNA, 16 bp, P. troglodytes
tcctgccacagcttcc

SEQ ID NO: 267467 - DNA, 16 bp, P. troglodytes
tcctgccaccctgcct

SEQ ID NO: 267468 - DNA, 16 bp, P. troglodytes
tcctgccactgccctc

SEQ ID NO: 267469 - DNA, 16 bp, P. troglodytes
tcctgccactgctctc

SEQ ID NO: 267470 - DNA, 16 bp, P. troglodytes
tcctgccagcaaagat

SEQ ID NO: 267471 - DNA, 16 bp, P. troglodytes
tcctgccaggaggtgg

SEQ ID NO: 267472 - DNA, 16 bp, P. troglodytes
tcctgccatggcctcc

SEQ ID NO: 267473 - DNA, 16 bp, P. troglodytes
tcctgcccagcccacc

SEQ ID NO: 267474 - DNA, 16 bp, P. troglodytes
tcctgcccagcctcct

SEQ ID NO: 267475 - DNA, 16 bp, P. troglodytes
tcctgccccagcctcc

SEQ ID NO: 267476 - DNA, 16 bp, P. troglodytes
tcctgccccagcctct

SEQ ID NO: 267477 - DNA, 16 bp, P. troglodytes
tcctgccccaggctcc

SEQ ID NO: 267478 - DNA, 16 bp, P. troglodytes
tcctgcccccactgtc

SEQ ID NO: 267479 - DNA, 16 bp, P. troglodytes
tcctgcccctgccctg

SEQ ID NO: 267480 - DNA, 16 bp, P. troglodytes
tcctgccctcagcctc

SEQ ID NO: 267481 - DNA, 16 bp, P. troglodytes
tcctgccctcgaacat

SEQ ID NO: 267482 - DNA, 16 bp, P. troglodytes
tcctgccctgccaact

SEQ ID NO: 267483 - DNA, 16 bp, P. troglodytes
tcctgccgcagcctcc

SEQ ID NO: 267484 - DNA, 16 bp, P. troglodytes
tcctgccgcctcagcc

SEQ ID NO: 267485 - DNA, 16 bp, P. troglodytes
tcctgcctcaacctgc

SEQ ID NO: 267486 - DNA, 16 bp, P. troglodytes
tcctgcctcaagtgat

SEQ ID NO: 267487 - DNA, 17 bp, P. troglodytes
tcctgcctcaccctcct

SEQ ID NO: 267488 - DNA, 16 bp, P. troglodytes
tcctgcctcaccttcc

SEQ ID NO: 267489 - DNA, 16 bp, P. troglodytes
tcctgcctcagactct

SEQ ID NO: 267490 - DNA, 16 bp, P. troglodytes
tcctgcctcagagcct

SEQ ID NO: 267491 - DNA, 16 bp, P. troglodytes
tcctgcctcagcccct

SEQ ID NO: 267492 - DNA, 16 bp, P. troglodytes
tcctgcctcagcccgc

SEQ ID NO: 267493 - DNA, 25 bp, P. troglodytes
tcctgcctcagcctcccaaagtgct

SEQ ID NO: 267494 - DNA, 22 bp, P. troglodytes
tcctgcctcagcctcccaaata

SEQ ID NO: 267495 - DNA, 16 bp, P. troglodytes
tcctgcctcagctgcc

SEQ ID NO: 267496 - DNA, 16 bp, P. troglodytes
tcctgcctcaggcttc

SEQ ID NO: 267497 - DNA, 16 bp, P. troglodytes
tcctgcctcagggctt

SEQ ID NO: 267498 - DNA, 16 bp, P. troglodytes
tcctgcctccacctct

SEQ ID NO: 267499 - DNA, 16 bp, P. troglodytes
tcctgcctcccaaagt

SEQ ID NO: 267500 - DNA, 16 bp, P. troglodytes
tcctgcctcctcccag

SEQ ID NO: 267501 - DNA, 16 bp, P. troglodytes
tcctgcctcctgcctt

SEQ ID NO: 267502 - DNA, 16 bp, P. troglodytes
tcctgcctcggcctcc

SEQ ID NO: 267503 - DNA, 16 bp, P. troglodytes
tcctgcctctcccagc

SEQ ID NO: 267504 - DNA, 16 bp, P. troglodytes
tcctgcctctgccttt

SEQ ID NO: 267505 - DNA, 16 bp, P. troglodytes
tcctgcctctgcttcc

SEQ ID NO: 267506 - DNA, 16 bp, P. troglodytes
tcctgcctctgggcct

SEQ ID NO: 267507 - DNA, 16 bp, P. troglodytes
tcctgcctctgtgcct

SEQ ID NO: 267508 - DNA, 16 bp, P. troglodytes
tcctgcctgctcccag

SEQ ID NO: 267509 - DNA, 16 bp, P. troglodytes
tcctgcctgctcctgg

SEQ ID NO: 267510 - DNA, 16 bp, P. troglodytes
tcctgcctgggcctcc

SEQ ID NO: 267511 - DNA, 16 bp, P. troglodytes
tcctgcctggggctcc

SEQ ID NO: 267512 - DNA, 16 bp, P. troglodytes
tcctgcctgggggaca

SEQ ID NO: 267513 - DNA, 16 bp, P. troglodytes
tcctgcctgtctcctg

SEQ ID NO: 267514 - DNA, 16 bp, P. troglodytes
tcctgccttcctgcct

SEQ ID NO: 267515 - DNA, 16 bp, P. troglodytes
tcctgccttggccacc

SEQ ID NO: 267516 - DNA, 16 bp, P. troglodytes
tcctgccttggcctcc

SEQ ID NO: 267517 - DNA, 16 bp, P. troglodytes
tcctgccttggtctcc

SEQ ID NO: 267518 - DNA, 16 bp, P. troglodytes
tcctgcgcccactgtc

SEQ ID NO: 267519 - DNA, 16 bp, P. troglodytes
tcctgcgtcagcctcc

SEQ ID NO: 267520 - DNA, 16 bp, P. troglodytes
tcctgctaatttttgt

SEQ ID NO: 267521 - DNA, 16 bp, P. troglodytes
tcctgctccagccctg

SEQ ID NO: 267522 - DNA, 16 bp, P. troglodytes
tcctgctccctcccca

SEQ ID NO: 267523 - DNA, 16 bp, P. troglodytes
tcctgctgcctggcct

SEQ ID NO: 267524 - DNA, 16 bp, P. troglodytes
tcctgctgctcactgc

SEQ ID NO: 267525 - DNA, 16 bp, P. troglodytes
tcctgctgctgctcac

SEQ ID NO: 267526 - DNA, 16 bp, P. troglodytes
tcctgctgctgcttct

SEQ ID NO: 267527 - DNA, 16 bp, P. troglodytes
tcctgctgcttcagcc

SEQ ID NO: 267528 - DNA, 16 bp, P. troglodytes
tcctgctgcttcctct

SEQ ID NO: 267529 - DNA, 16 bp, P. troglodytes
tcctgctggattttgg

SEQ ID NO: 267530 - DNA, 16 bp, P. troglodytes
tcctgctgtgcagccc

SEQ ID NO: 267531 - DNA, 16 bp, P. troglodytes
tcctgctgtgctctca

SEQ ID NO: 267532 - DNA, 16 bp, P. troglodytes
tcctgctgtgtgacct

SEQ ID NO: 267533 - DNA, 16 bp, P. troglodytes
tcctgctgtgtgcagc

SEQ ID NO: 267534 - DNA, 16 bp, P. troglodytes
tcctgctgtgtgccag

SEQ ID NO: 267535 - DNA, 16 bp, P. troglodytes
tcctgcttaaaaccct

SEQ ID NO: 267536 - DNA, 16 bp, P. troglodytes
tcctgcttcagcttcc

SEQ ID NO: 267537 - DNA, 16 bp, P. troglodytes
tcctgcttcaggctcc

SEQ ID NO: 267538 - DNA, 16 bp, P. troglodytes
tcctgcttccttcact

SEQ ID NO: 267539 - DNA, 16 bp, P. troglodytes
tcctgcttctgccatg

SEQ ID NO: 267540 - DNA, 16 bp, P. troglodytes
tcctgcttggtgttct

SEQ ID NO: 267541 - DNA, 16 bp, P. troglodytes
tcctgcttgtccctgg

SEQ ID NO: 267542 - DNA, 16 bp, P. troglodytes
tcctgctttcatttct

SEQ ID NO: 267543 - DNA, 16 bp, P. troglodytes
tcctggaaaaaaaaaa

SEQ ID NO: 267544 - DNA, 16 bp, P. troglodytes
tcctggaaccaatccc

SEQ ID NO: 267545 - DNA, 16 bp, P. troglodytes
tcctggaactaatccc

SEQ ID NO: 267546 - DNA, 16 bp, P. troglodytes
tcctggaactgaaaaa

SEQ ID NO: 267547 - DNA, 16 bp, P. troglodytes
tcctggacttcttttt

SEQ ID NO: 267548 - DNA, 16 bp, P. troglodytes
tcctggagaaacagat

SEQ ID NO: 267549 - DNA, 16 bp, P. troglodytes
tcctggagagtttccc

SEQ ID NO: 267550 - DNA, 16 bp, P. troglodytes
tcctggagcatttccc

SEQ ID NO: 267551 - DNA, 16 bp, P. troglodytes
tcctggagcctctgga

SEQ ID NO: 267552 - DNA, 16 bp, P. troglodytes
tcctggagctgtgagc

SEQ ID NO: 267553 - DNA, 16 bp, P. troglodytes
tcctggaggaagtggc

SEQ ID NO: 267554 - DNA, 16 bp, P. troglodytes
tcctggaggaggaggc

SEQ ID NO: 267555 - DNA, 16 bp, P. troglodytes
tcctggaggaggtgat

SEQ ID NO: 267556 - DNA, 16 bp, P. troglodytes
tcctggaggctgagaa

SEQ ID NO: 267557 - DNA, 16 bp, P. troglodytes
tcctggagggtggcat

SEQ ID NO: 267558 - DNA, 16 bp, P. troglodytes
tcctggagtcccagct

SEQ ID NO: 267559 - DNA, 16 bp, P. troglodytes
tcctggatctgccact

SEQ ID NO: 267560 - DNA, 16 bp, P. troglodytes
tcctggatgacatttc

SEQ ID NO: 267561 - DNA, 16 bp, P. troglodytes
tcctggatggggtggc

SEQ ID NO: 267562 - DNA, 16 bp, P. troglodytes
tcctggattccagtga

SEQ ID NO: 267563 - DNA, 16 bp, P. troglodytes
tcctggcaccttggga

SEQ ID NO: 267564 - DNA, 16 bp, P. troglodytes
tcctggcactctggga

SEQ ID NO: 267565 - DNA, 16 bp, P. troglodytes
tcctggcactgtggga

SEQ ID NO: 267566 - DNA, 16 bp, P. troglodytes
tcctggcaggaggcca

SEQ ID NO: 267567 - DNA, 16 bp, P. troglodytes
tcctggccaacgtggc

SEQ ID NO: 267568 - DNA, 19 bp, P. troglodytes
tcctggccaacgtggtgaa

SEQ ID NO: 267569 - DNA, 16 bp, P. troglodytes
tcctggccacaagcaa

SEQ ID NO: 267570 - DNA, 16 bp, P. troglodytes
tcctggccaggcgcag

SEQ ID NO: 267571 - DNA, 16 bp, P. troglodytes
tcctggcccagcctcc

SEQ ID NO: 267572 - DNA, 16 bp, P. troglodytes
tcctggccctgccact

SEQ ID NO: 267573 - DNA, 16 bp, P. troglodytes
tcctggcctcaaaaga

SEQ ID NO: 267574 - DNA, 16 bp, P. troglodytes
tcctggcctcaaagaa

SEQ ID NO: 267575 - DNA, 16 bp, P. troglodytes
tcctggcctcaagcaa

SEQ ID NO: 267576 - DNA, 16 bp, P. troglodytes
tcctggcctcccaaag

SEQ ID NO: 267577 - DNA, 16 bp, P. troglodytes
tcctggctaaaacagt

SEQ ID NO: 267578 - DNA, 16 bp, P. troglodytes
tcctggctatttggga

SEQ ID NO: 267579 - DNA, 16 bp, P. troglodytes
tcctggctcagcctcc

SEQ ID NO: 267580 - DNA, 16 bp, P. troglodytes
tcctggctccaccact

SEQ ID NO: 267581 - DNA, 16 bp, P. troglodytes
tcctggctcctcagct

SEQ ID NO: 267582 - DNA, 16 bp, P. troglodytes
tcctggctctgccact

SEQ ID NO: 267583 - DNA, 16 bp, P. troglodytes
tcctggctctgccctg

SEQ ID NO: 267584 - DNA, 16 bp, P. troglodytes
tcctggctctgcctct

SEQ ID NO: 267585 - DNA, 16 bp, P. troglodytes
tcctggctctgctact

SEQ ID NO: 267586 - DNA, 16 bp, P. troglodytes
tcctggctctgctgct

SEQ ID NO: 267587 - DNA, 16 bp, P. troglodytes
tcctggctgagcctcc

SEQ ID NO: 267588 - DNA, 16 bp, P. troglodytes
tcctggctgctcagga

SEQ ID NO: 267589 - DNA, 16 bp, P. troglodytes
tcctggctggaggcca

SEQ ID NO: 267590 - DNA, 16 bp, P. troglodytes
tcctggctgtgccact

SEQ ID NO: 267591 - DNA, 16 bp, P. troglodytes
tcctggctgtgtgacc

SEQ ID NO: 267592 - DNA, 16 bp, P. troglodytes
tcctggcttatttcac

SEQ ID NO: 267593 - DNA, 16 bp, P. troglodytes
tcctgggaaaactgga

SEQ ID NO: 267594 - DNA, 16 bp, P. troglodytes
tcctgggactttgctg

SEQ ID NO: 267595 - DNA, 16 bp, P. troglodytes
tcctgggaggctgagg

SEQ ID NO: 267596 - DNA, 16 bp, P. troglodytes
tcctgggataaatctc

SEQ ID NO: 267597 - DNA, 16 bp, P. troglodytes
tcctgggatccagtga

SEQ ID NO: 267598 - DNA, 16 bp, P. troglodytes
tcctgggcacaagcca

SEQ ID NO: 267599 - DNA, 16 bp, P. troglodytes
tcctgggcacagctgc

SEQ ID NO: 267600 - DNA, 16 bp, P. troglodytes
tcctgggcatttatcc

SEQ ID NO: 267601 - DNA, 16 bp, P. troglodytes
tcctgggcccaagtgg

SEQ ID NO: 267602 - DNA, 16 bp, P. troglodytes
tcctgggcccccaaga

SEQ ID NO: 267603 - DNA, 16 bp, P. troglodytes
tcctgggcctcaagtg

SEQ ID NO: 267604 - DNA, 16 bp, P. troglodytes
tcctgggctcaggaga

SEQ ID NO: 267605 - DNA, 16 bp, P. troglodytes
tcctgggctcaggtaa

SEQ ID NO: 267606 - DNA, 16 bp, P. troglodytes
tcctgggctccaggga

SEQ ID NO: 267607 - DNA, 16 bp, P. troglodytes
tcctgggctcctcctg

SEQ ID NO: 267608 - DNA, 16 bp, P. troglodytes
tcctgggctgcaggca

SEQ ID NO: 267609 - DNA, 16 bp, P. troglodytes
tcctgggctgggctgg

SEQ ID NO: 267610 - DNA, 16 bp, P. troglodytes
tcctgggcttgggtga

SEQ ID NO: 267611 - DNA, 16 bp, P. troglodytes
tcctggggcctctctc

SEQ ID NO: 267612 - DNA, 16 bp, P. troglodytes
tcctggggttccatga

SEQ ID NO: 267613 - DNA, 16 bp, P. troglodytes
tcctgggtcctgcagg

SEQ ID NO: 267614 - DNA, 16 bp, P. troglodytes
tcctgggtctccagtt

SEQ ID NO: 267615 - DNA, 16 bp, P. troglodytes
tcctgggtggagtggg

SEQ ID NO: 267616 - DNA, 17 bp, P. troglodytes
tcctgggttaaagtgat

SEQ ID NO: 267617 - DNA, 16 bp, P. troglodytes
tcctgggttcaagaca

SEQ ID NO: 267618 - DNA, 17 bp, P. troglodytes
tcctgggttcaagtgat

SEQ ID NO: 267619 - DNA, 17 bp, P. troglodytes
tcctgggttcacatgat

SEQ ID NO: 267620 - DNA, 16 bp, P. troglodytes
tcctgggttccaatga

SEQ ID NO: 267621 - DNA, 17 bp, P. troglodytes
tcctgggttccagtgat

SEQ ID NO: 267622 - DNA, 16 bp, P. troglodytes
tcctgggtttgagtga

SEQ ID NO: 267623 - DNA, 16 bp, P. troglodytes
tcctggtgctatcccc

SEQ ID NO: 267624 - DNA, 16 bp, P. troglodytes
tcctggtgctctccct

SEQ ID NO: 267625 - DNA, 16 bp, P. troglodytes
tcctggtgtgtgtgtg

SEQ ID NO: 267626 - DNA, 20 bp, P. troglodytes
tcctggttaacacggtgaaa

SEQ ID NO: 267627 - DNA, 16 bp, P. troglodytes
tcctggttcaagcagt

SEQ ID NO: 267628 - DNA, 16 bp, P. troglodytes
tcctggttcatagaca

SEQ ID NO: 267629 - DNA, 16 bp, P. troglodytes
tcctggttctaccact

SEQ ID NO: 267630 - DNA, 16 bp, P. troglodytes
tcctggttgtgatatt

SEQ ID NO: 267631 - DNA, 17 bp, P. troglodytes
tcctggtttcaagcgat

SEQ ID NO: 267632 - DNA, 16 bp, P. troglodytes
tcctggtttcaaggga

SEQ ID NO: 267633 - DNA, 16 bp, P. troglodytes
tcctggtttcattgat

SEQ ID NO: 267634 - DNA, 16 bp, P. troglodytes
tcctgtaatcctagca

SEQ ID NO: 267635 - DNA, 16 bp, P. troglodytes
tcctgtaattatgatg

SEQ ID NO: 267636 - DNA, 16 bp, P. troglodytes
tcctgtcactcaggta

SEQ ID NO: 267637 - DNA, 16 bp, P. troglodytes
tcctgtcagatcagct

SEQ ID NO: 267638 - DNA, 16 bp, P. troglodytes
tcctgtcagcctccca

SEQ ID NO: 267639 - DNA, 16 bp, P. troglodytes
tcctgtccagcctgcc

SEQ ID NO: 267640 - DNA, 16 bp, P. troglodytes
tcctgtcctcttctga

SEQ ID NO: 267641 - DNA, 16 bp, P. troglodytes
tcctgtctaactgaaa

SEQ ID NO: 267642 - DNA, 16 bp, P. troglodytes
tcctgtctcagtctcc

SEQ ID NO: 267643 - DNA, 16 bp, P. troglodytes
tcctgtctcctttgcc

SEQ ID NO: 267644 - DNA, 16 bp, P. troglodytes
tcctgtctctacaaaa

SEQ ID NO: 267645 - DNA, 16 bp, P. troglodytes
tcctgtctctctgtct

SEQ ID NO: 267646 - DNA, 16 bp, P. troglodytes
tcctgtgaatctataa

SEQ ID NO: 267647 - DNA, 16 bp, P. troglodytes
tcctgtgattatgatg

SEQ ID NO: 267648 - DNA, 16 bp, P. troglodytes
tcctgtgcactgcagg

SEQ ID NO: 267649 - DNA, 16 bp, P. troglodytes
tcctgtgctggatgct

SEQ ID NO: 267650 - DNA, 16 bp, P. troglodytes
tcctgtggcccccacc

SEQ ID NO: 267651 - DNA, 16 bp, P. troglodytes
tcctgtgtcccagcca

SEQ ID NO: 267652 - DNA, 17 bp, P. troglodytes
tcctgtgttagtttgct

SEQ ID NO: 267653 - DNA, 16 bp, P. troglodytes
tcctgtgtttgctgag

SEQ ID NO: 267654 - DNA, 16 bp, P. troglodytes
tcctgttaatattgat

SEQ ID NO: 267655 - DNA, 16 bp, P. troglodytes
tcctgttcctcctcac

SEQ ID NO: 267656 - DNA, 16 bp, P. troglodytes
tcctgttgcccaggct

SEQ ID NO: 267657 - DNA, 16 bp, P. troglodytes
tcctgtttgcttttgg

SEQ ID NO: 267658 - DNA, 16 bp, P. troglodytes
tcctgttttatggctg

SEQ ID NO: 267659 - DNA, 16 bp, P. troglodytes
tcctgttttcctaatt

SEQ ID NO: 267660 - DNA, 16 bp, P. troglodytes
tcctgttttctctgtg

SEQ ID NO: 267661 - DNA, 16 bp, P. troglodytes
tccttaaaaagaaaaa

SEQ ID NO: 267662 - DNA, 16 bp, P. troglodytes
tccttaaaggaaaaaa

SEQ ID NO: 267663 - DNA, 16 bp, P. troglodytes
tccttaaatatgtttt

SEQ ID NO: 267664 - DNA, 16 bp, P. troglodytes
tccttaaattgggctt

SEQ ID NO: 267665 - DNA, 16 bp, P. troglodytes
tccttaaattttgtgc

SEQ ID NO: 267666 - DNA, 16 bp, P. troglodytes
tccttacatccctggg

SEQ ID NO: 267667 - DNA, 16 bp, P. troglodytes
tccttaccctgcccct

SEQ ID NO: 267668 - DNA, 16 bp, P. troglodytes
tccttagaaatttctt

SEQ ID NO: 267669 - DNA, 16 bp, P. troglodytes
tccttagaagaagaga

SEQ ID NO: 267670 - DNA, 16 bp, P. troglodytes
tccttagagacagaaa

SEQ ID NO: 267671 - DNA, 16 bp, P. troglodytes
tccttataaaagagac

SEQ ID NO: 267672 - DNA, 17 bp, P. troglodytes
tccttatctccatctga

SEQ ID NO: 267673 - DNA, 17 bp, P. troglodytes
tccttatcttggctatt

SEQ ID NO: 267674 - DNA, 17 bp, P. troglodytes
tccttatgagaatctaa

SEQ ID NO: 267675 - DNA, 16 bp, P. troglodytes
tccttattaactttct

SEQ ID NO: 267676 - DNA, 16 bp, P. troglodytes
tccttattcattcctg

SEQ ID NO: 267677 - DNA, 16 bp, P. troglodytes
tccttcaatggctccc

SEQ ID NO: 267678 - DNA, 16 bp, P. troglodytes
tccttcacaaataaaa

SEQ ID NO: 267679 - DNA, 17 bp, P. troglodytes
tccttcacatcacttgt

SEQ ID NO: 267680 - DNA, 17 bp, P. troglodytes
tccttcacatctcttgt

SEQ ID NO: 267681 - DNA, 16 bp, P. troglodytes
tccttcacattccttg

SEQ ID NO: 267682 - DNA, 16 bp, P. troglodytes
tccttcacttcccttg

SEQ ID NO: 267683 - DNA, 16 bp, P. troglodytes
tccttcagaaatgaaa

SEQ ID NO: 267684 - DNA, 16 bp, P. troglodytes
tccttcagaagctctt

SEQ ID NO: 267685 - DNA, 16 bp, P. troglodytes
tccttcaggagctctt

SEQ ID NO: 267686 - DNA, 16 bp, P. troglodytes
tccttcaggctggagt

SEQ ID NO: 267687 - DNA, 16 bp, P. troglodytes
tccttcagtggatgaa

SEQ ID NO: 267688 - DNA, 20 bp, P. troglodytes
tccttcagttctgctctgat

SEQ ID NO: 267689 - DNA, 16 bp, P. troglodytes
tccttcagttctgctt

SEQ ID NO: 267690 - DNA, 16 bp, P. troglodytes
tccttcatatcccttg

SEQ ID NO: 267691 - DNA, 16 bp, P. troglodytes
tccttcatcagtgttt

SEQ ID NO: 267692 - DNA, 16 bp, P. troglodytes
tccttcatcttcctgt

SEQ ID NO: 267693 - DNA, 16 bp, P. troglodytes
tccttcattcattcac

SEQ ID NO: 267694 - DNA, 16 bp, P. troglodytes
tccttcattctgctga

SEQ ID NO: 267695 - DNA, 16 bp, P. troglodytes
tccttcattctgttga

SEQ ID NO: 267696 - DNA, 16 bp, P. troglodytes
tccttcattttgttaa

SEQ ID NO: 267697 - DNA, 16 bp, P. troglodytes
tccttccaaaactatt

SEQ ID NO: 267698 - DNA, 16 bp, P. troglodytes
tccttccaaagtgctg

SEQ ID NO: 267699 - DNA, 16 bp, P. troglodytes
tccttccacctctgcc

SEQ ID NO: 267700 - DNA, 16 bp, P. troglodytes
tccttccaccttggcc

SEQ ID NO: 267701 - DNA, 16 bp, P. troglodytes
tccttccagaggctct

SEQ ID NO: 267702 - DNA, 16 bp, P. troglodytes
tccttccagtcttttt

SEQ ID NO: 267703 - DNA, 16 bp, P. troglodytes
tccttcccagcctcta

SEQ ID NO: 267704 - DNA, 16 bp, P. troglodytes
tccttcccagcttctc

SEQ ID NO: 267705 - DNA, 16 bp, P. troglodytes
tccttcccttttaagg

SEQ ID NO: 267706 - DNA, 16 bp, P. troglodytes
tccttcctatccatga

SEQ ID NO: 267707 - DNA, 16 bp, P. troglodytes
tccttcctcaagcagg

SEQ ID NO: 267708 - DNA, 16 bp, P. troglodytes
tccttcctcagactcc

SEQ ID NO: 267709 - DNA, 16 bp, P. troglodytes
tccttcctcaggaaac

SEQ ID NO: 267710 - DNA, 16 bp, P. troglodytes
tccttcctccagcccc

SEQ ID NO: 267711 - DNA, 16 bp, P. troglodytes
tccttcctgattctgt

SEQ ID NO: 267712 - DNA, 16 bp, P. troglodytes
tccttcctgggcatgg

SEQ ID NO: 267713 - DNA, 16 bp, P. troglodytes
tccttccttcaggagc

SEQ ID NO: 267714 - DNA, 16 bp, P. troglodytes
tccttccttcattcat

SEQ ID NO: 267715 - DNA, 17 bp, P. troglodytes
tccttctacaacttggt

SEQ ID NO: 267716 - DNA, 16 bp, P. troglodytes
tccttctactaacttt

SEQ ID NO: 267717 - DNA, 16 bp, P. troglodytes
tccttctacttgcttt

SEQ ID NO: 267718 - DNA, 16 bp, P. troglodytes
tccttctagaacacag

SEQ ID NO: 267719 - DNA, 16 bp, P. troglodytes
tccttctcatccttca

SEQ ID NO: 267720 - DNA, 16 bp, P. troglodytes
tccttctccagccatg

SEQ ID NO: 267721 - DNA, 16 bp, P. troglodytes
tccttctctgtctctg

SEQ ID NO: 267722 - DNA, 16 bp, P. troglodytes
tccttctgcctctgtc

SEQ ID NO: 267723 - DNA, 16 bp, P. troglodytes
tccttctgccttggct

SEQ ID NO: 267724 - DNA, 16 bp, P. troglodytes
tccttctgctattgat

SEQ ID NO: 267725 - DNA, 16 bp, P. troglodytes
tccttctgtttcttca

SEQ ID NO: 267726 - DNA, 16 bp, P. troglodytes
tccttcttcacatggt

SEQ ID NO: 267727 - DNA, 16 bp, P. troglodytes
tccttcttcagcctcc

SEQ ID NO: 267728 - DNA, 16 bp, P. troglodytes
tccttgaaaagagcaa

SEQ ID NO: 267729 - DNA, 16 bp, P. troglodytes
tccttgactttcatga

SEQ ID NO: 267730 - DNA, 16 bp, P. troglodytes
tccttgagaggctgag

SEQ ID NO: 267731 - DNA, 16 bp, P. troglodytes
tccttgagggcaagga

SEQ ID NO: 267732 - DNA, 16 bp, P. troglodytes
tccttgagttctgtga

SEQ ID NO: 267733 - DNA, 16 bp, P. troglodytes
tccttgatcttggact

SEQ ID NO: 267734 - DNA, 16 bp, P. troglodytes
tccttgcaaattgatg

SEQ ID NO: 267735 - DNA, 16 bp, P. troglodytes
tccttgcatattctgg

SEQ ID NO: 267736 - DNA, 16 bp, P. troglodytes
tccttgcatccttggg

SEQ ID NO: 267737 - DNA, 16 bp, P. troglodytes
tccttgcctcagtttc

SEQ ID NO: 267738 - DNA, 16 bp, P. troglodytes
tccttgcctcttcctg

SEQ ID NO: 267739 - DNA, 16 bp, P. troglodytes
tccttgcctgctgcca

SEQ ID NO: 267740 - DNA, 16 bp, P. troglodytes
tccttgctgttcctca

SEQ ID NO: 267741 - DNA, 16 bp, P. troglodytes
tccttgcttctcagct

SEQ ID NO: 267742 - DNA, 16 bp, P. troglodytes
tccttggcattctttg

SEQ ID NO: 267743 - DNA, 16 bp, P. troglodytes
tccttggcctcccaaa

SEQ ID NO: 267744 - DNA, 16 bp, P. troglodytes
tccttgtcagcacttg

SEQ ID NO: 267745 - DNA, 16 bp, P. troglodytes
tccttgtcttgctcca

SEQ ID NO: 267746 - DNA, 16 bp, P. troglodytes
tccttgtgcactgttg

SEQ ID NO: 267747 - DNA, 16 bp, P. troglodytes
tccttgtgcctcagct

SEQ ID NO: 267748 - DNA, 16 bp, P. troglodytes
tccttgtggagcaggg

SEQ ID NO: 267749 - DNA, 16 bp, P. troglodytes
tccttgttaattttgt

SEQ ID NO: 267750 - DNA, 16 bp, P. troglodytes
tcctttaaaaaaattt

SEQ ID NO: 267751 - DNA, 16 bp, P. troglodytes
tcctttaaaaatttta

SEQ ID NO: 267752 - DNA, 16 bp, P. troglodytes
tcctttaaaatattta

SEQ ID NO: 267753 - DNA, 16 bp, P. troglodytes
tcctttaaggaatcaa

SEQ ID NO: 267754 - DNA, 16 bp, P. troglodytes
tcctttaatcctcaca

SEQ ID NO: 267755 - DNA, 16 bp, P. troglodytes
tcctttacttcccttg
